United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 94

SEQ ID NO: 3344627 - RNA, 21 nt, Mycobacterium tuberculosis H37Rv
gcgccgucagcccaggugggc

SEQ ID NO: 3344628 - RNA, 15 nt, Mycobacterium tuberculosis H37Rv
gcgccgucaucgcag

SEQ ID NO: 3344629 - RNA, 20 nt, Mycobacterium tuberculosis H37Rv
gcgccgucccgaaacgccgg

SEQ ID NO: 3344630 - RNA, 22 nt, Mycobacterium tuberculosis H37Rv
gcgccguccuagcgugccgccc

SEQ ID NO: 3344631 - RNA, 16 nt, Mycobacterium tuberculosis H37Rv
gcgccgucgcagccag

SEQ ID NO: 3344632 - RNA, 19 nt, Mycobacterium tuberculosis H37Rv
gcgccgucggagccggcca

SEQ ID NO: 3344633 - RNA, 15 nt, Mycobacterium tuberculosis H37Rv
gcgccgucgggccug

SEQ ID NO: 3344634 - RNA, 16 nt, Mycobacterium tuberculosis H37Rv
gcgccgucgggccugc

SEQ ID NO: 3344635 - RNA, 19 nt, Mycobacterium tuberculosis H37Rv
gcgccgucgggccugccgg

SEQ ID NO: 3344636 - RNA, 16 nt, Mycobacterium tuberculosis H37Rv
gcgccgucggugggug

SEQ ID NO: 3344637 - RNA, 17 nt, Mycobacterium tuberculosis H37Rv
gcgccgucgucgaccac

SEQ ID NO: 3344638 - RNA, 16 nt, Mycobacterium tuberculosis H37Rv
gcgccgucgucgagca

SEQ ID NO: 3344639 - RNA, 20 nt, Mycobacterium tuberculosis H37Rv
gcgccgucucgaagcucagc

SEQ ID NO: 3344640 - RNA, 22 nt, Mycobacterium tuberculosis H37Rv
gcgccgugaucagcucgcgcac

SEQ ID NO: 3344641 - RNA, 17 nt, Mycobacterium tuberculosis H37Rv
gcgccguggcaucgccu

SEQ ID NO: 3344642 - RNA, 15 nt, Mycobacterium tuberculosis H37Rv
gcgccguggcgcggu

SEQ ID NO: 3344643 - RNA, 19 nt, Mycobacterium tuberculosis H37Rv
gcgccguuagcgucgccuu

SEQ ID NO: 3344644 - RNA, 21 nt, Mycobacterium tuberculosis H37Rv
gcgccguucacccuggugguc

SEQ ID NO: 3344645 - RNA, 15 nt, Mycobacterium tuberculosis H37Rv
gcgccguucgcuccc

SEQ ID NO: 3344646 - RNA, 14 nt, Mycobacterium tuberculosis H37Rv
gcgccguugccgcc

SEQ ID NO: 3344647 - RNA, 21 nt, Mycobacterium tuberculosis H37Rv
gcgccguugccgcccacgcug

SEQ ID NO: 3344648 - RNA, 20 nt, Mycobacterium tuberculosis H37Rv
gcgccguugccgccgucgcc

SEQ ID NO: 3344649 - RNA, 20 nt, Mycobacterium tuberculosis H37Rv
gcgccguugucggcggugaa

SEQ ID NO: 3344650 - RNA, 19 nt, Mycobacterium tuberculosis H37Rv
gcgccuaaccccggcucga

SEQ ID NO: 3344651 - RNA, 22 nt, Mycobacterium tuberculosis H37Rv
gcgccuaaccccggcucgacgc

SEQ ID NO: 3344652 - RNA, 14 nt, Mycobacterium tuberculosis H37Rv
gcgccuaccagcac

SEQ ID NO: 3344653 - RNA, 16 nt, Mycobacterium tuberculosis H37Rv
gcgccuaccagcaccg

SEQ ID NO: 3344654 - RNA, 17 nt, Mycobacterium tuberculosis H37Rv
gcgccucaagcucgccg

SEQ ID NO: 3344655 - RNA, 17 nt, Mycobacterium tuberculosis H37Rv
gcgccucauccuccagu

SEQ ID NO: 3344656 - RNA, 14 nt, Mycobacterium tuberculosis H37Rv
gcgccuccgggacg

SEQ ID NO: 3344657 - RNA, 15 nt, Mycobacterium tuberculosis H37Rv
gcgccuccgggacgg

SEQ ID NO: 3344658 - RNA, 22 nt, Mycobacterium tuberculosis H37Rv
gcgccucgaccugacuggucag

SEQ ID NO: 3344659 - RNA, 15 nt, Mycobacterium tuberculosis H37Rv
gcgccucgcccagca

SEQ ID NO: 3344660 - RNA, 22 nt, Mycobacterium tuberculosis H37Rv
gcgccucggaccagacccacga

SEQ ID NO: 3344661 - RNA, 17 nt, Mycobacterium tuberculosis H37Rv
gcgccucggcggccagc

SEQ ID NO: 3344662 - RNA, 19 nt, Mycobacterium tuberculosis H37Rv
gcgccucggugacgucgcc

SEQ ID NO: 3344663 - RNA, 13 nt, Mycobacterium tuberculosis H37Rv
gcgccucggugag

SEQ ID NO: 3344664 - RNA, 20 nt, Mycobacterium tuberculosis H37Rv
gcgccucggugagcugcacg

SEQ ID NO: 3344665 - RNA, 12 nt, Mycobacterium tuberculosis H37Rv
gcgccucggugg

SEQ ID NO: 3344666 - RNA, 15 nt, Mycobacterium tuberculosis H37Rv
gcgccucgugcgugg

SEQ ID NO: 3344667 - RNA, 22 nt, Mycobacterium tuberculosis H37Rv
gcgccugaacauguccgcacgc

SEQ ID NO: 3344668 - RNA, 16 nt, Mycobacterium tuberculosis H37Rv
gcgccugaauaggucg

SEQ ID NO: 3344669 - RNA, 14 nt, Mycobacterium tuberculosis H37Rv
gcgccugacucauc

SEQ ID NO: 3344670 - RNA, 11 nt, Mycobacterium tuberculosis H37Rv
gcgccugagcg

SEQ ID NO: 3344671 - RNA, 15 nt, Mycobacterium tuberculosis H37Rv
gcgccugagcggccu

SEQ ID NO: 3344672 - RNA, 16 nt, Mycobacterium tuberculosis H37Rv
gcgccugagcggccuc

SEQ ID NO: 3344673 - RNA, 15 nt, Mycobacterium tuberculosis H37Rv
gcgccugaggugcug

SEQ ID NO: 3344674 - RNA, 19 nt, Mycobacterium tuberculosis H37Rv
gcgccugauaggccugagc

SEQ ID NO: 3344675 - RNA, 18 nt, Mycobacterium tuberculosis H37Rv
gcgccugaugcggccggc

SEQ ID NO: 3344676 - RNA, 13 nt, Mycobacterium tuberculosis H37Rv
gcgccugcccggg

SEQ ID NO: 3344677 - RNA, 14 nt, Mycobacterium tuberculosis H37Rv
gcgccugcggcagc

SEQ ID NO: 3344678 - RNA, 15 nt, Mycobacterium tuberculosis H37Rv
gcgccugcggcagca

SEQ ID NO: 3344679 - RNA, 14 nt, Mycobacterium tuberculosis H37Rv
gcgccugcugcggc

SEQ ID NO: 3344680 - RNA, 16 nt, Mycobacterium tuberculosis H37Rv
gcgccugcugcggcca

SEQ ID NO: 3344681 - RNA, 16 nt, Mycobacterium tuberculosis H37Rv
gcgccuggcggcgccg

SEQ ID NO: 3344682 - RNA, 21 nt, Mycobacterium tuberculosis H37Rv
gcgccugguccucacgggucg

SEQ ID NO: 3344683 - RNA, 20 nt, Mycobacterium tuberculosis H37Rv
gcgccugugccaccgcugga

SEQ ID NO: 3344684 - RNA, 19 nt, Mycobacterium tuberculosis H37Rv
gcgccuuaggcguccgagc

SEQ ID NO: 3344685 - RNA, 23 nt, Mycobacterium tuberculosis H37Rv
gcgccuucacgcuggccuccagc

SEQ ID NO: 3344686 - RNA, 15 nt, Mycobacterium tuberculosis H37Rv
gcgccuuccacggag

SEQ ID NO: 3344687 - RNA, 22 nt, Mycobacterium tuberculosis H37Rv
gcgccuuccaggcgggcggcac

SEQ ID NO: 3344688 - RNA, 16 nt, Mycobacterium tuberculosis H37Rv
gcgccuucgccagcgg

SEQ ID NO: 3344689 - RNA, 16 nt, Mycobacterium tuberculosis H37Rv
gcgccuugaagcggug

SEQ ID NO: 3344690 - RNA, 16 nt, Mycobacterium tuberculosis H37Rv
gcgccuugaccacagc

SEQ ID NO: 3344691 - RNA, 14 nt, Mycobacterium tuberculosis H37Rv
gcgccuugcgggcc

SEQ ID NO: 3344692 - RNA, 16 nt, Mycobacterium tuberculosis H37Rv
gcgccuuggccagcgc

SEQ ID NO: 3344693 - RNA, 18 nt, Mycobacterium tuberculosis H37Rv
gcgccuuggccagcgcgu

SEQ ID NO: 3344694 - RNA, 13 nt, Mycobacterium tuberculosis H37Rv
gcgccuuggucgc

SEQ ID NO: 3344695 - RNA, 15 nt, Mycobacterium tuberculosis H37Rv
gcgccuuggucgccg

SEQ ID NO: 3344696 - RNA, 18 nt, Mycobacterium tuberculosis H37Rv
gcgccuuggucgccgccu

SEQ ID NO: 3344697 - RNA, 22 nt, Mycobacterium tuberculosis H37Rv
gcgccuuggucgccgccuucuu

SEQ ID NO: 3344698 - RNA, 18 nt, Mycobacterium tuberculosis H37Rv
gcgccuuggucgccgcuu

SEQ ID NO: 3344699 - RNA, 15 nt, Mycobacterium tuberculosis H37Rv
gcgccuuucggucac

SEQ ID NO: 3344700 - RNA, 14 nt, Mycobacterium tuberculosis H37Rv
gcgccuuugagccc

SEQ ID NO: 3344701 - RNA, 15 nt, Mycobacterium tuberculosis H37Rv
gcgccuuugcccgau

SEQ ID NO: 3344702 - RNA, 20 nt, Mycobacterium tuberculosis H37Rv
gcgcgaaaccaguccaucga

SEQ ID NO: 3344703 - RNA, 15 nt, Mycobacterium tuberculosis H37Rv
gcgcgaaaccgcaug

SEQ ID NO: 3344704 - RNA, 14 nt, Mycobacterium tuberculosis H37Rv
gcgcgaaacgccgc

SEQ ID NO: 3344705 - RNA, 18 nt, Mycobacterium tuberculosis H37Rv
gcgcgaaacgccgcaaug

SEQ ID NO: 3344706 - RNA, 14 nt, Mycobacterium tuberculosis H37Rv
gcgcgaaagcgccg

SEQ ID NO: 3344707 - RNA, 15 nt, Mycobacterium tuberculosis H37Rv
gcgcgaaagcgccga

SEQ ID NO: 3344708 - RNA, 13 nt, Mycobacterium tuberculosis H37Rv
gcgcgaacacccg

SEQ ID NO: 3344709 - RNA, 22 nt, Mycobacterium tuberculosis H37Rv
gcgcgaaccggcccgguccagc

SEQ ID NO: 3344710 - RNA, 23 nt, Mycobacterium tuberculosis H37Rv
gcgcgaaccggcccgguccagcc

SEQ ID NO: 3344711 - RNA, 20 nt, Mycobacterium tuberculosis H37Rv
gcgcgcgaccauacccgcgc

SEQ ID NO: 3344712 - RNA, 20 nt, Mycobacterium tuberculosis H37Rv
gcgcgcgaccucgcuggccg

SEQ ID NO: 3344713 - RNA, 12 nt, Mycobacterium tuberculosis H37Rv
gcgcgcgacugu

SEQ ID NO: 3344714 - RNA, 13 nt, Mycobacterium tuberculosis H37Rv
gcgcgcgauggcg

SEQ ID NO: 3344715 - RNA, 20 nt, Mycobacterium tuberculosis H37Rv
gcgcgcgccgcugggugacc

SEQ ID NO: 3344716 - RNA, 13 nt, Mycobacterium tuberculosis H37Rv
gcgcgcgcgccgg

SEQ ID NO: 3344717 - RNA, 14 nt, Mycobacterium tuberculosis H37Rv
gcgcgcgcgccggc

SEQ ID NO: 3344718 - RNA, 15 nt, Mycobacterium tuberculosis H37Rv
gcgcgcgcucgggcc

SEQ ID NO: 3344719 - RNA, 12 nt, Mycobacterium tuberculosis H37Rv
gcgcgcggcgac

SEQ ID NO: 3344720 - RNA, 15 nt, Mycobacterium tuberculosis H37Rv
gcgcgcggcucgggu

SEQ ID NO: 3344721 - RNA, 23 nt, Mycobacterium tuberculosis H37Rv
gcgcgcggucgagguggcgggcg

SEQ ID NO: 3344722 - RNA, 16 nt, Mycobacterium tuberculosis H37Rv
gcgcgcguagcggggg

SEQ ID NO: 3344723 - RNA, 18 nt, Mycobacterium tuberculosis H37Rv
gcgcgcguagcgggggag

SEQ ID NO: 3344724 - RNA, 19 nt, Mycobacterium tuberculosis H37Rv
gcgcgcgugaagaacacgu

SEQ ID NO: 3344725 - RNA, 21 nt, Mycobacterium tuberculosis H37Rv
gcgcgcucaucgaccgcggcc

SEQ ID NO: 3344726 - RNA, 19 nt, Mycobacterium tuberculosis H37Rv
gcgcgcucgaggguggcgc

SEQ ID NO: 3344727 - RNA, 13 nt, Mycobacterium tuberculosis H37Rv
gcgcgcucgcggc

SEQ ID NO: 3344728 - RNA, 16 nt, Mycobacterium tuberculosis H37Rv
gcgcgcucgcucaccg

SEQ ID NO: 3344729 - RNA, 21 nt, Mycobacterium tuberculosis H37Rv
gcgcgcucggagagguagggc

SEQ ID NO: 3344730 - RNA, 13 nt, Mycobacterium tuberculosis H37Rv
gcgcgcugagccg

SEQ ID NO: 3344731 - RNA, 14 nt, Mycobacterium tuberculosis H37Rv
gcgcgcugcgcgac

SEQ ID NO: 3344732 - RNA, 15 nt, Mycobacterium tuberculosis H37Rv
gcgcgcuggcgggcg

SEQ ID NO: 3344733 - RNA, 17 nt, Mycobacterium tuberculosis H37Rv
gcgcgcuggcgggcggc

SEQ ID NO: 3344734 - RNA, 19 nt, Mycobacterium tuberculosis H37Rv
gcgcgcugggaagcucggu

SEQ ID NO: 3344735 - RNA, 21 nt, Mycobacterium tuberculosis H37Rv
gcgcgcugggaagcucggucc

SEQ ID NO: 3344736 - RNA, 21 nt, Mycobacterium tuberculosis H37Rv
gcgcgcugggaggcggcgcca

SEQ ID NO: 3344737 - RNA, 21 nt, Mycobacterium tuberculosis H37Rv
gcgcgcugggcccgagcgcgc

SEQ ID NO: 3344738 - RNA, 12 nt, Mycobacterium tuberculosis H37Rv
gcgcgcugggcg

SEQ ID NO: 3344739 - RNA, 14 nt, Mycobacterium tuberculosis H37Rv
gcgcgcugggcgcg

SEQ ID NO: 3344740 - RNA, 17 nt, Mycobacterium tuberculosis H37Rv
gcgcgcugggcgcgcuc

SEQ ID NO: 3344741 - RNA, 21 nt, Mycobacterium tuberculosis H37Rv
gcgcgcuguuguacggcccaa

SEQ ID NO: 3344742 - RNA, 20 nt, Mycobacterium tuberculosis H37Rv
gcgcgcuuuccucaccagcc

SEQ ID NO: 3344743 - RNA, 15 nt, Mycobacterium tuberculosis H37Rv
gcgcggacccagcac

SEQ ID NO: 3344744 - RNA, 15 nt, Mycobacterium tuberculosis H37Rv
gcgcggacccgccgu

SEQ ID NO: 3344745 - RNA, 19 nt, Mycobacterium tuberculosis H37Rv
gcgcggagagccugcucgc

SEQ ID NO: 3344746 - RNA, 18 nt, Mycobacterium tuberculosis H37Rv
gcgcggaucggcggccgc

SEQ ID NO: 3344747 - RNA, 13 nt, Mycobacterium tuberculosis H37Rv
gcgcggaucgucg

SEQ ID NO: 3344748 - RNA, 17 nt, Mycobacterium tuberculosis H37Rv
gcgcggaucgucgaggc

SEQ ID NO: 3344749 - RNA, 20 nt, Mycobacterium tuberculosis H37Rv
gcgcggaucgucgaggcacg

SEQ ID NO: 3344750 - RNA, 22 nt, Mycobacterium tuberculosis H37Rv
gcgcggauucgguuagcgcggc

SEQ ID NO: 3344751 - RNA, 21 nt, Mycobacterium tuberculosis H37Rv
gcgcggcaaaguuggccgccc

SEQ ID NO: 3344752 - RNA, 16 nt, Mycobacterium tuberculosis H37Rv
gcgcggcaaccgucga

SEQ ID NO: 3344753 - RNA, 13 nt, Mycobacterium tuberculosis H37Rv
gcgcggcacccgg

SEQ ID NO: 3344754 - RNA, 12 nt, Mycobacterium tuberculosis H37Rv
gcgcggcauccc

SEQ ID NO: 3344755 - RNA, 18 nt, Mycobacterium tuberculosis H37Rv
gcgcggcauucucgagca

SEQ ID NO: 3344756 - RNA, 15 nt, Mycobacterium tuberculosis H37Rv
gcgcggccaauugcg

SEQ ID NO: 3344757 - RNA, 16 nt, Mycobacterium tuberculosis H37Rv
gcgcggccacccgcga

SEQ ID NO: 3344758 - RNA, 17 nt, Mycobacterium tuberculosis H37Rv
gcgcggccacccgcgac

SEQ ID NO: 3344759 - RNA, 14 nt, Mycobacterium tuberculosis H37Rv
gcgcggccacuugg

SEQ ID NO: 3344760 - RNA, 14 nt, Mycobacterium tuberculosis H37Rv
gcgcggccagcagc

SEQ ID NO: 3344761 - RNA, 17 nt, Mycobacterium tuberculosis H37Rv
gcgcggcccagguccgc

SEQ ID NO: 3344762 - RNA, 12 nt, Mycobacterium tuberculosis H37Rv
gcgcggccccga

SEQ ID NO: 3344763 - RNA, 13 nt, Mycobacterium tuberculosis H37Rv
gcgcggcccgcau

SEQ ID NO: 3344764 - RNA, 12 nt, Mycobacterium tuberculosis H37Rv
gcgcggcccgcc

SEQ ID NO: 3344765 - RNA, 13 nt, Mycobacterium tuberculosis H37Rv
gcgcggcccgccg

SEQ ID NO: 3344766 - RNA, 14 nt, Mycobacterium tuberculosis H37Rv
gcgcggccgcagcc

SEQ ID NO: 3344767 - RNA, 14 nt, Mycobacterium tuberculosis H37Rv
gcgcggccgcgcug

SEQ ID NO: 3344768 - RNA, 13 nt, Mycobacterium tuberculosis H37Rv
gcgcggccggccg

SEQ ID NO: 3344769 - RNA, 15 nt, Mycobacterium tuberculosis H37Rv
gcgcggccggccgcu

SEQ ID NO: 3344770 - RNA, 20 nt, Mycobacterium tuberculosis H37Rv
gcgcggccguagugcacguc

SEQ ID NO: 3344771 - RNA, 22 nt, Mycobacterium tuberculosis H37Rv
gcgcggccguagugcacgucgg

SEQ ID NO: 3344772 - RNA, 18 nt, Mycobacterium tuberculosis H37Rv
gcgcggccgugaacggcg

SEQ ID NO: 3344773 - RNA, 12 nt, Mycobacterium tuberculosis H37Rv
gcgcggccuugg

SEQ ID NO: 3344774 - RNA, 20 nt, Mycobacterium tuberculosis H37Rv
gcgcggcgaagccgggugcu

SEQ ID NO: 3344775 - RNA, 21 nt, Mycobacterium tuberculosis H37Rv
gcgcggcgaccauaagcucgu

SEQ ID NO: 3344776 - RNA, 19 nt, Mycobacterium tuberculosis H37Rv
gcgcggcgacgacggccug

SEQ ID NO: 3344777 - RNA, 13 nt, Mycobacterium tuberculosis H37Rv
gcgcggcgagcac

SEQ ID NO: 3344778 - RNA, 11 nt, Mycobacterium tuberculosis H37Rv
gcgcggcgauc

SEQ ID NO: 3344779 - RNA, 23 nt, Mycobacterium tuberculosis H37Rv
gcgcggcgaucgcuccgcggcgc

SEQ ID NO: 3344780 - RNA, 13 nt, Mycobacterium tuberculosis H37Rv
gcgcggcgcacaa

SEQ ID NO: 3344781 - RNA, 17 nt, Mycobacterium tuberculosis H37Rv
gcgcggcgcgggucacg

SEQ ID NO: 3344782 - RNA, 17 nt, Mycobacterium tuberculosis H37Rv
gcgcggcggagugcaug

SEQ ID NO: 3344783 - RNA, 15 nt, Mycobacterium tuberculosis H37Rv
gcgcggcggcggagg

SEQ ID NO: 3344784 - RNA, 17 nt, Mycobacterium tuberculosis H37Rv
gcgcggcggcguccacc

SEQ ID NO: 3344785 - RNA, 13 nt, Mycobacterium tuberculosis H37Rv
gcgcggcucacgg

SEQ ID NO: 3344786 - RNA, 17 nt, Mycobacterium tuberculosis H37Rv
gcgcggcugccgcggug

SEQ ID NO: 3344787 - RNA, 15 nt, Mycobacterium tuberculosis H37Rv
gcgcggcuggggccc

SEQ ID NO: 3344788 - RNA, 22 nt, Mycobacterium tuberculosis H37Rv
gcgcggcuggggccccgcgccg

SEQ ID NO: 3344789 - RNA, 16 nt, Mycobacterium tuberculosis H37Rv
gcgcggcugugcccga

SEQ ID NO: 3344790 - RNA, 22 nt, Mycobacterium tuberculosis H37Rv
gcgcggcugugcccgaucagcc

SEQ ID NO: 3344791 - RNA, 12 nt, Mycobacterium tuberculosis H37Rv
gcgcggcuucgu

SEQ ID NO: 3344792 - RNA, 21 nt, Mycobacterium tuberculosis H37Rv
gcgcggcuuguaccgcaauca

SEQ ID NO: 3344793 - RNA, 22 nt, Mycobacterium tuberculosis H37Rv
gcgcgggauguaccccggcccg

SEQ ID NO: 3344794 - RNA, 21 nt, Mycobacterium tuberculosis H37Rv
gcgcgggcacgcccucgucga

SEQ ID NO: 3344795 - RNA, 12 nt, Mycobacterium tuberculosis H37Rv
gcgcgggccacc

SEQ ID NO: 3344796 - RNA, 13 nt, Mycobacterium tuberculosis H37Rv
gcgcgggccggcg

SEQ ID NO: 3344797 - RNA, 15 nt, Mycobacterium tuberculosis H37Rv
gcgcgggccggcgac

SEQ ID NO: 3344798 - RNA, 16 nt, Mycobacterium tuberculosis H37Rv
gcgcgggcgccgggaa

SEQ ID NO: 3344799 - RNA, 17 nt, Mycobacterium tuberculosis H37Rv
gcgcgggcggaucgccg

SEQ ID NO: 3344800 - RNA, 23 nt, Mycobacterium tuberculosis H37Rv
gcgcgggcucgguggcggacggc

SEQ ID NO: 3344801 - RNA, 11 nt, Mycobacterium tuberculosis H37Rv
gcgcggggccg

SEQ ID NO: 3344802 - RNA, 15 nt, Mycobacterium tuberculosis H37Rv
gcgcggggccgccgc

SEQ ID NO: 3344803 - RNA, 20 nt, Mycobacterium tuberculosis H37Rv
gcgcggggccgccgcggccg

SEQ ID NO: 3344804 - RNA, 13 nt, Mycobacterium tuberculosis H37Rv
gcgcggggcggcc

SEQ ID NO: 3344805 - RNA, 15 nt, Mycobacterium tuberculosis H37Rv
gcgcggggcggccug

SEQ ID NO: 3344806 - RNA, 17 nt, Mycobacterium tuberculosis H37Rv
gcgcggggcggccugcc

SEQ ID NO: 3344807 - RNA, 13 nt, Mycobacterium tuberculosis H37Rv
gcgcggggcggcu

SEQ ID NO: 3344808 - RNA, 24 nt, Mycobacterium tuberculosis H37Rv
gcgcuccagauggggcucgagugu

SEQ ID NO: 3344809 - RNA, 15 nt, Mycobacterium tuberculosis H37Rv
gcgcuccagccgcgc

SEQ ID NO: 3344810 - RNA, 17 nt, Mycobacterium tuberculosis H37Rv
gcgcuccagccgcgcgu

SEQ ID NO: 3344811 - RNA, 22 nt, Mycobacterium tuberculosis H37Rv
gcgcuccagcugagcggccggc

SEQ ID NO: 3344812 - RNA, 18 nt, Mycobacterium tuberculosis H37Rv
gcgcucccacgcuucggc

SEQ ID NO: 3344813 - RNA, 21 nt, Mycobacterium tuberculosis H37Rv
gcgcucccacgcuucggccug

SEQ ID NO: 3344814 - RNA, 14 nt, Mycobacterium tuberculosis H37Rv
gcgcucccgccggc

SEQ ID NO: 3344815 - RNA, 19 nt, Mycobacterium tuberculosis H37Rv
gcgcucccguacgccggcg

SEQ ID NO: 3344816 - RNA, 19 nt, Mycobacterium tuberculosis H37Rv
gcgcucgaaagagccgcuu

SEQ ID NO: 3344817 - RNA, 23 nt, Mycobacterium tuberculosis H37Rv
gcgcucgaacuccccggucgccg

SEQ ID NO: 3344818 - RNA, 22 nt, Mycobacterium tuberculosis H37Rv
gcgcucgaacucggcggccagc

SEQ ID NO: 3344819 - RNA, 22 nt, Mycobacterium tuberculosis H37Rv
gcgcucgaaggccgcacucaca

SEQ ID NO: 3344820 - RNA, 13 nt, Mycobacterium tuberculosis H37Rv
gcgcucgauggcg

SEQ ID NO: 3344821 - RNA, 21 nt, Mycobacterium tuberculosis H37Rv
gcgcucgauggcggccaccag

SEQ ID NO: 3344822 - RNA, 18 nt, Mycobacterium tuberculosis H37Rv
gcgcucgcacccgcucgg

SEQ ID NO: 3344823 - RNA, 19 nt, Mycobacterium tuberculosis H37Rv
gcgcucgcacccgcucggc

SEQ ID NO: 3344824 - RNA, 21 nt, Mycobacterium tuberculosis H37Rv
gcgcucgccgauaucugccac

SEQ ID NO: 3344825 - RNA, 15 nt, Mycobacterium tuberculosis H37Rv
gcgcucgcgcaccgu

SEQ ID NO: 3344826 - RNA, 13 nt, Mycobacterium tuberculosis H37Rv
gcgcucgcgcgcu

SEQ ID NO: 3344827 - RNA, 22 nt, Mycobacterium tuberculosis H37Rv
gcgcucgcgcgguagucgucgc

SEQ ID NO: 3344828 - RNA, 22 nt, Mycobacterium tuberculosis H37Rv
gcgcucgcggcuucaguccggc

SEQ ID NO: 3344829 - RNA, 17 nt, Mycobacterium tuberculosis H37Rv
gcgcucgcucaccggcg

SEQ ID NO: 3344830 - RNA, 23 nt, Mycobacterium tuberculosis H37Rv
gcgcucgcucacgccguccggug

SEQ ID NO: 3344831 - RNA, 15 nt, Mycobacterium tuberculosis H37Rv
gcgcucggcagccgg

SEQ ID NO: 3344832 - RNA, 15 nt, Mycobacterium tuberculosis H37Rv
gcgcucggccagcau

SEQ ID NO: 3344833 - RNA, 20 nt, Mycobacterium tuberculosis H37Rv
gcgcucggccauagcgccgc

SEQ ID NO: 3344834 - RNA, 14 nt, Mycobacterium tuberculosis H37Rv
gcgcucggccgggg

SEQ ID NO: 3344835 - RNA, 23 nt, Mycobacterium tuberculosis H37Rv
gcgcucggcgagcaacacgagcg

SEQ ID NO: 3344836 - RNA, 17 nt, Mycobacterium tuberculosis H37Rv
gcgcucggcgaucugcg

SEQ ID NO: 3344837 - RNA, 16 nt, Mycobacterium tuberculosis H37Rv
gcgcucgggcccagcg

SEQ ID NO: 3344838 - RNA, 20 nt, Mycobacterium tuberculosis H37Rv
gcgcucggucuccaccaccg

SEQ ID NO: 3344839 - RNA, 22 nt, Mycobacterium tuberculosis H37Rv
gcgcucggugccgcccaggagc

SEQ ID NO: 3344840 - RNA, 22 nt, Mycobacterium tuberculosis H37Rv
gcgcucguggucgacgugaucg

SEQ ID NO: 3344841 - RNA, 18 nt, Mycobacterium tuberculosis H37Rv
gcgcucucauagcgacgg

SEQ ID NO: 3344842 - RNA, 19 nt, Mycobacterium tuberculosis H37Rv
gcgcucucauagcgacggc

SEQ ID NO: 3344843 - RNA, 13 nt, Mycobacterium tuberculosis H37Rv
gcgcucucgguca

SEQ ID NO: 3344844 - RNA, 18 nt, Mycobacterium tuberculosis H37Rv
gcgcugaacuagggucgg

SEQ ID NO: 3344845 - RNA, 17 nt, Mycobacterium tuberculosis H37Rv
gcgcugaagcccauggc

SEQ ID NO: 3344846 - RNA, 16 nt, Mycobacterium tuberculosis H37Rv
gcgcugaagccgacga

SEQ ID NO: 3344847 - RNA, 18 nt, Mycobacterium tuberculosis H37Rv
gcgcugaaggccgguagc

SEQ ID NO: 3344848 - RNA, 17 nt, Mycobacterium tuberculosis H37Rv
gcgcugaagguggcgaa

SEQ ID NO: 3344849 - RNA, 21 nt, Mycobacterium tuberculosis H37Rv
gcgcugaaucaccccggcggc

SEQ ID NO: 3344850 - RNA, 21 nt, Mycobacterium tuberculosis H37Rv
gcgcugagcacgcggaucgcg

SEQ ID NO: 3344851 - RNA, 14 nt, Mycobacterium tuberculosis H37Rv
gcgcugagcgacug

SEQ ID NO: 3344852 - RNA, 19 nt, Mycobacterium tuberculosis H37Rv
gcgcugagcgacugcagcg

SEQ ID NO: 3344853 - RNA, 22 nt, Mycobacterium tuberculosis H37Rv
gcgcugagcgacugcagcggcg

SEQ ID NO: 3344854 - RNA, 17 nt, Mycobacterium tuberculosis H37Rv
gcgcugaucgcgcgcac

SEQ ID NO: 3344855 - RNA, 14 nt, Mycobacterium tuberculosis H37Rv
gcgcugaucggcag

SEQ ID NO: 3344856 - RNA, 17 nt, Mycobacterium tuberculosis H37Rv
gcgcugaucggcagggu

SEQ ID NO: 3344857 - RNA, 15 nt, Mycobacterium tuberculosis H37Rv
gcgcugcaccggguc

SEQ ID NO: 3344858 - RNA, 11 nt, Mycobacterium tuberculosis H37Rv
gcgcugcagca

SEQ ID NO: 3344859 - RNA, 17 nt, Mycobacterium tuberculosis H37Rv
gcgcugcagcauggcuc

SEQ ID NO: 3344860 - RNA, 17 nt, Mycobacterium tuberculosis H37Rv
gcgcugcagcucacgac

SEQ ID NO: 3344861 - RNA, 21 nt, Mycobacterium tuberculosis H37Rv
gcgcugccaaacuaacggcag

SEQ ID NO: 3344862 - RNA, 23 nt, Mycobacterium tuberculosis H37Rv
gcgcugccaaacuaacggcagcc

SEQ ID NO: 3344863 - RNA, 14 nt, Mycobacterium tuberculosis H37Rv
gcgcugccaccgcg

SEQ ID NO: 3344864 - RNA, 21 nt, Mycobacterium tuberculosis H37Rv
gcgcugccaguucuuggcgac

SEQ ID NO: 3344865 - RNA, 22 nt, Mycobacterium tuberculosis H37Rv
gcgcugcccgccgccccguuca

SEQ ID NO: 3344866 - RNA, 21 nt, Mycobacterium tuberculosis H37Rv
gcgcugcccgggcugccgccc

SEQ ID NO: 3344867 - RNA, 13 nt, Mycobacterium tuberculosis H37Rv
gcgcugccggccg

SEQ ID NO: 3344868 - RNA, 15 nt, Mycobacterium tuberculosis H37Rv
gcgcugccggccgcg

SEQ ID NO: 3344869 - RNA, 15 nt, Mycobacterium tuberculosis H37Rv
gcgcugcgcaccgcc

SEQ ID NO: 3344870 - RNA, 21 nt, Mycobacterium tuberculosis H37Rv
gcgcugcgcaccgccgcgcga

SEQ ID NO: 3344871 - RNA, 11 nt, Mycobacterium tuberculosis H37Rv
gcgcugcgcag

SEQ ID NO: 3344872 - RNA, 14 nt, Mycobacterium tuberculosis H37Rv
gcgcugcgcgacga

SEQ ID NO: 3344873 - RNA, 21 nt, Mycobacterium tuberculosis H37Rv
gcgcugcggaucguggcgccc

SEQ ID NO: 3344874 - RNA, 14 nt, Mycobacterium tuberculosis H37Rv
gcgcugcggccagc

SEQ ID NO: 3344875 - RNA, 16 nt, Mycobacterium tuberculosis H37Rv
gcgcugcggcccacac

SEQ ID NO: 3344876 - RNA, 19 nt, Mycobacterium tuberculosis H37Rv
gcgcugcggcccacaccag

SEQ ID NO: 3344877 - RNA, 17 nt, Mycobacterium tuberculosis H37Rv
gcgcugcucacgcagca

SEQ ID NO: 3344878 - RNA, 18 nt, Mycobacterium tuberculosis H37Rv
gcgcugcucugagcuugg

SEQ ID NO: 3344879 - RNA, 22 nt, Mycobacterium tuberculosis H37Rv
gcgcugcucugagcuuggucgc

SEQ ID NO: 3344880 - RNA, 15 nt, Mycobacterium tuberculosis H37Rv
gcgcugcuggcagac

SEQ ID NO: 3344881 - RNA, 18 nt, Mycobacterium tuberculosis H37Rv
gcgcugcuggcagaccaa

SEQ ID NO: 3344882 - RNA, 18 nt, Mycobacterium tuberculosis H37Rv
gcgcugcuugaggucccg

SEQ ID NO: 3344883 - RNA, 18 nt, Mycobacterium tuberculosis H37Rv
gcgcuggaaugcggucga

SEQ ID NO: 3344884 - RNA, 13 nt, Mycobacterium tuberculosis H37Rv
gcgcuggaccuga

SEQ ID NO: 3344885 - RNA, 17 nt, Mycobacterium tuberculosis H37Rv
gcgcuggaggccaccac

SEQ ID NO: 3344886 - RNA, 18 nt, Mycobacterium tuberculosis H37Rv
gcgcuggaggccaccacc

SEQ ID NO: 3344887 - RNA, 22 nt, Mycobacterium tuberculosis H37Rv
gcgcuggaucgagcuaguucgg

SEQ ID NO: 3344888 - RNA, 17 nt, Mycobacterium tuberculosis H37Rv
gcgcuggaugugggcgc

SEQ ID NO: 3344889 - RNA, 16 nt, Mycobacterium tuberculosis H37Rv
gcgcuggccagcaggg

SEQ ID NO: 3344890 - RNA, 19 nt, Mycobacterium tuberculosis H37Rv
gcgcuggccaugguggcgc

SEQ ID NO: 3344891 - RNA, 14 nt, Mycobacterium tuberculosis H37Rv
gcgcuggcggcgca

SEQ ID NO: 3344892 - RNA, 16 nt, Mycobacterium tuberculosis H37Rv
gcgcuggcggcgcagc

SEQ ID NO: 3344893 - RNA, 15 nt, Mycobacterium tuberculosis H37Rv
gcgcuggcgggcagc

SEQ ID NO: 3344894 - RNA, 16 nt, Mycobacterium tuberculosis H37Rv
gcgcugggacggucgc

SEQ ID NO: 3344895 - RNA, 21 nt, Mycobacterium tuberculosis H37Rv
gcgcugggacggucgcucggc

SEQ ID NO: 3344896 - RNA, 21 nt, Mycobacterium tuberculosis H37Rv
gcgcugggaggcggcgccagu

SEQ ID NO: 3344897 - RNA, 24 nt, Mycobacterium tuberculosis H37Rv
gcgcugggaggcggcgccagugcg

SEQ ID NO: 3344898 - RNA, 21 nt, Mycobacterium tuberculosis H37Rv
gcgcugggauguucgaucagc

SEQ ID NO: 3344899 - RNA, 21 nt, Mycobacterium tuberculosis H37Rv
gcgcugggcccaggagaucca

SEQ ID NO: 3344900 - RNA, 16 nt, Mycobacterium tuberculosis H37Rv
gcgcugggcgcgcuca

SEQ ID NO: 3344901 - RNA, 17 nt, Mycobacterium tuberculosis H37Rv
gcgcugggcgcgcucau

SEQ ID NO: 3344902 - RNA, 20 nt, Mycobacterium tuberculosis H37Rv
gcgcugggcgcgcucaucga

SEQ ID NO: 3344903 - RNA, 12 nt, Mycobacterium tuberculosis H37Rv
gcggagccggcg

SEQ ID NO: 3344904 - RNA, 15 nt, Mycobacterium tuberculosis H37Rv
gcggagccgucgcau

SEQ ID NO: 3344905 - RNA, 18 nt, Mycobacterium tuberculosis H37Rv
gcggagcucacgccgggu

SEQ ID NO: 3344906 - RNA, 14 nt, Mycobacterium tuberculosis H37Rv
gcggaggcggccag

SEQ ID NO: 3344907 - RNA, 17 nt, Mycobacterium tuberculosis H37Rv
gcggaggcugggcugag

SEQ ID NO: 3344908 - RNA, 16 nt, Mycobacterium tuberculosis H37Rv
gcggaguaggccgcgc

SEQ ID NO: 3344909 - RNA, 18 nt, Mycobacterium tuberculosis H37Rv
gcggaguaggccgcgccc

SEQ ID NO: 3344910 - RNA, 21 nt, Mycobacterium tuberculosis H37Rv
gcggaguucgcugacggccau

SEQ ID NO: 3344911 - RNA, 16 nt, Mycobacterium tuberculosis H37Rv
gcggaguuuuucgggg

SEQ ID NO: 3344912 - RNA, 16 nt, Mycobacterium tuberculosis H37Rv
gcggauaaccggcaug

SEQ ID NO: 3344913 - RNA, 19 nt, Mycobacterium tuberculosis H37Rv
gcggauacaugguccggcc

SEQ ID NO: 3344914 - RNA, 20 nt, Mycobacterium tuberculosis H37Rv
gcggauagcggcaaagccgg

SEQ ID NO: 3344915 - RNA, 22 nt, Mycobacterium tuberculosis H37Rv
gcggaucaacaggccggcucgc

SEQ ID NO: 3344916 - RNA, 17 nt, Mycobacterium tuberculosis H37Rv
gcggaucagcccgcgca

SEQ ID NO: 3344917 - RNA, 16 nt, Mycobacterium tuberculosis H37Rv
gcggaucaggucuggc

SEQ ID NO: 3344918 - RNA, 19 nt, Mycobacterium tuberculosis H37Rv
gcggaucaggucuggcgcg

SEQ ID NO: 3344919 - RNA, 23 nt, Mycobacterium tuberculosis H37Rv
gcggauccaccacgcuggccucg

SEQ ID NO: 3344920 - RNA, 21 nt, Mycobacterium tuberculosis H37Rv
gcggauccagaaacugcucgg

SEQ ID NO: 3344921 - RNA, 16 nt, Mycobacterium tuberculosis H37Rv
gcggaucccgaggcgc

SEQ ID NO: 3344922 - RNA, 17 nt, Mycobacterium tuberculosis H37Rv
gcggaucccgaggcgcc

SEQ ID NO: 3344923 - RNA, 14 nt, Mycobacterium tuberculosis H37Rv
gcggaucccgccgg

SEQ ID NO: 3344924 - RNA, 16 nt, Mycobacterium tuberculosis H37Rv
gcggaucccgccggug

SEQ ID NO: 3344925 - RNA, 18 nt, Mycobacterium tuberculosis H37Rv
gcggaucgaccgccagcg

SEQ ID NO: 3344926 - RNA, 12 nt, Mycobacterium tuberculosis H37Rv
gcggaucgccgg

SEQ ID NO: 3344927 - RNA, 16 nt, Mycobacterium tuberculosis H37Rv
gcggaucgcgagcgcc

SEQ ID NO: 3344928 - RNA, 15 nt, Mycobacterium tuberculosis H37Rv
gcggaucgcgcugau

SEQ ID NO: 3344929 - RNA, 22 nt, Mycobacterium tuberculosis H37Rv
gcggaucgcgcugaucagccca

SEQ ID NO: 3344930 - RNA, 15 nt, Mycobacterium tuberculosis H37Rv
gcggaucgcgcugcg

SEQ ID NO: 3344931 - RNA, 21 nt, Mycobacterium tuberculosis H37Rv
gcggaucggcggaccgcagcg

SEQ ID NO: 3344932 - RNA, 23 nt, Mycobacterium tuberculosis H37Rv
gcggaucggcggccgcgaccagc

SEQ ID NO: 3344933 - RNA, 16 nt, Mycobacterium tuberculosis H37Rv
gcggaucgucguuguc

SEQ ID NO: 3344934 - RNA, 21 nt, Mycobacterium tuberculosis H37Rv
gcggaucgucguugucagcga

SEQ ID NO: 3344935 - RNA, 14 nt, Mycobacterium tuberculosis H37Rv
gcggaucguggcgc

SEQ ID NO: 3344936 - RNA, 15 nt, Mycobacterium tuberculosis H37Rv
gcggaucguggcgcc

SEQ ID NO: 3344937 - RNA, 21 nt, Mycobacterium tuberculosis H37Rv
gcggaucucaccacccgucgg

SEQ ID NO: 3344938 - RNA, 18 nt, Mycobacterium tuberculosis H37Rv
gcggaucugaucggcgcg

SEQ ID NO: 3344939 - RNA, 13 nt, Mycobacterium tuberculosis H37Rv
gcggaucugcugc

SEQ ID NO: 3344940 - RNA, 20 nt, Mycobacterium tuberculosis H37Rv
gcggaucugcugcgagaucu

SEQ ID NO: 3344941 - RNA, 21 nt, Mycobacterium tuberculosis H37Rv
gcggaucugcugcgagaucuu

SEQ ID NO: 3344942 - RNA, 12 nt, Mycobacterium tuberculosis H37Rv
gcggaucuggcc

SEQ ID NO: 3344943 - RNA, 20 nt, Mycobacterium tuberculosis H37Rv
gcggaucuggcuccggccag

SEQ ID NO: 3344944 - RNA, 22 nt, Mycobacterium tuberculosis H37Rv
gcggaucuggcuccggccaggg

SEQ ID NO: 3344945 - RNA, 12 nt, Mycobacterium tuberculosis H37Rv
gcggaucugggc

SEQ ID NO: 3344946 - RNA, 12 nt, Mycobacterium tuberculosis H37Rv
gcggaucugguc

SEQ ID NO: 3344947 - RNA, 16 nt, Mycobacterium tuberculosis H37Rv
gcggaucugguccagu

SEQ ID NO: 3344948 - RNA, 20 nt, Mycobacterium tuberculosis H37Rv
gcggaucugguccaguggga

SEQ ID NO: 3344949 - RNA, 13 nt, Mycobacterium tuberculosis H37Rv
gcggaucuguucc

SEQ ID NO: 3344950 - RNA, 21 nt, Mycobacterium tuberculosis H37Rv
gcggaucuguuccucggugac

SEQ ID NO: 3344951 - RNA, 20 nt, Mycobacterium tuberculosis H37Rv
gcggaugaacugggcaacau

SEQ ID NO: 3344952 - RNA, 18 nt, Mycobacterium tuberculosis H37Rv
gcggaugcguuggcccca

SEQ ID NO: 3344953 - RNA, 23 nt, Mycobacterium tuberculosis H37Rv
gcggaugcguuggccccaggauc

SEQ ID NO: 3344954 - RNA, 14 nt, Mycobacterium tuberculosis H37Rv
gcggauggccgccu

SEQ ID NO: 3344955 - RNA, 14 nt, Mycobacterium tuberculosis H37Rv
gcggauggcgucga

SEQ ID NO: 3344956 - RNA, 15 nt, Mycobacterium tuberculosis H37Rv
gcggaugucgucgac

SEQ ID NO: 3344957 - RNA, 21 nt, Mycobacterium tuberculosis H37Rv
gcggauuccggcaucgguucg

SEQ ID NO: 3344958 - RNA, 23 nt, Mycobacterium tuberculosis H37Rv
gcggauucgcgcuguccacgaug

SEQ ID NO: 3344959 - RNA, 11 nt, Mycobacterium tuberculosis H37Rv
gcggauucggc

SEQ ID NO: 3344960 - RNA, 20 nt, Mycobacterium tuberculosis H37Rv
gcggauucggcgucgaagca

SEQ ID NO: 3344961 - RNA, 19 nt, Mycobacterium tuberculosis H37Rv
gcggcaaacacugcggccu

SEQ ID NO: 3344962 - RNA, 16 nt, Mycobacterium tuberculosis H37Rv
gcggcaaagccgggug

SEQ ID NO: 3344963 - RNA, 17 nt, Mycobacterium tuberculosis H37Rv
gcggcaacaccaccucg

SEQ ID NO: 3344964 - RNA, 22 nt, Mycobacterium tuberculosis H37Rv
gcggcaacaccaccucgacgag

SEQ ID NO: 3344965 - RNA, 15 nt, Mycobacterium tuberculosis H37Rv
gcggcaaccccgagc

SEQ ID NO: 3344966 - RNA, 14 nt, Mycobacterium tuberculosis H37Rv
gcggcaacgagguc

SEQ ID NO: 3344967 - RNA, 20 nt, Mycobacterium tuberculosis H37Rv
gcggcaacgaucgacaccag

SEQ ID NO: 3344968 - RNA, 19 nt, Mycobacterium tuberculosis H37Rv
gcggcaacgcggucugcuc

SEQ ID NO: 3344969 - RNA, 20 nt, Mycobacterium tuberculosis H37Rv
gcggcaacgcggucugcucc

SEQ ID NO: 3344970 - RNA, 19 nt, Mycobacterium tuberculosis H37Rv
gcggcaagcucguccggug

SEQ ID NO: 3344971 - RNA, 14 nt, Mycobacterium tuberculosis H37Rv
gcggcaagggcuuc

SEQ ID NO: 3344972 - RNA, 17 nt, Mycobacterium tuberculosis H37Rv
gcggcaagggcuucgga

SEQ ID NO: 3344973 - RNA, 14 nt, Mycobacterium tuberculosis H37Rv
gcggcaauggccag

SEQ ID NO: 3344974 - RNA, 13 nt, Mycobacterium tuberculosis H37Rv
gcggcaccacccg

SEQ ID NO: 3344975 - RNA, 15 nt, Mycobacterium tuberculosis H37Rv
gcggcaccacgucga

SEQ ID NO: 3344976 - RNA, 17 nt, Mycobacterium tuberculosis H37Rv
gcggcaccacgucgacc

SEQ ID NO: 3344977 - RNA, 11 nt, Mycobacterium tuberculosis H37Rv
gcggcaccaga

SEQ ID NO: 3344978 - RNA, 19 nt, Mycobacterium tuberculosis H37Rv
gcggcaccagcaccgucgg

SEQ ID NO: 3344979 - RNA, 17 nt, Mycobacterium tuberculosis H37Rv
gcggcacccaggugucg

SEQ ID NO: 3344980 - RNA, 22 nt, Mycobacterium tuberculosis H37Rv
gcggcacccagucggcgccgcc

SEQ ID NO: 3344981 - RNA, 17 nt, Mycobacterium tuberculosis H37Rv
gcggcaccgauggcgca

SEQ ID NO: 3344982 - RNA, 13 nt, Mycobacterium tuberculosis H37Rv
gcggcaccgccgc

SEQ ID NO: 3344983 - RNA, 17 nt, Mycobacterium tuberculosis H37Rv
gcggcaccgccgcccaa

SEQ ID NO: 3344984 - RNA, 20 nt, Mycobacterium tuberculosis H37Rv
gcggcaccgcuucaggcgcc

SEQ ID NO: 3344985 - RNA, 21 nt, Mycobacterium tuberculosis H37Rv
gcggcaccucauugccguucu

SEQ ID NO: 3344986 - RNA, 10 nt, Mycobacterium tuberculosis H37Rv
gcggcaccuu

SEQ ID NO: 3344987 - RNA, 19 nt, Mycobacterium tuberculosis H37Rv
gcggcaccuuguagcgggc

SEQ ID NO: 3344988 - RNA, 16 nt, Mycobacterium tuberculosis H37Rv
gcggcacgaucggcag

SEQ ID NO: 3344989 - RNA, 17 nt, Mycobacterium tuberculosis H37Rv
gcggcacgcacgcgguu

SEQ ID NO: 3344990 - RNA, 15 nt, Mycobacterium tuberculosis H37Rv
gcggcacgccggccg

SEQ ID NO: 3344991 - RNA, 15 nt, Mycobacterium tuberculosis H37Rv
gcggcacgcucgcgc

SEQ ID NO: 3344992 - RNA, 23 nt, Mycobacterium tuberculosis H37Rv
gcggcacggaugcgauggccgac

SEQ ID NO: 3344993 - RNA, 14 nt, Mycobacterium tuberculosis H37Rv
gcggcacggugugc

SEQ ID NO: 3344994 - RNA, 12 nt, Mycobacterium tuberculosis H37Rv
gcggcacgucgg

SEQ ID NO: 3344995 - RNA, 23 nt, Mycobacterium tuberculosis H37Rv
gcggcacugaucugcguugcggc

SEQ ID NO: 3344996 - RNA, 19 nt, Mycobacterium tuberculosis H37Rv
gcggcagauacucggcgac

SEQ ID NO: 3344997 - RNA, 16 nt, Mycobacterium tuberculosis H37Rv
gcggcagccaagcgag

SEQ ID NO: 3344998 - RNA, 18 nt, Mycobacterium tuberculosis H37Rv
gcggcagcgaucggggcg

SEQ ID NO: 3344999 - RNA, 19 nt, Mycobacterium tuberculosis H37Rv
gcggcccgcagcccgccgg

SEQ ID NO: 3345000 - RNA, 14 nt, Mycobacterium tuberculosis H37Rv
gcggcccgcagcgu

SEQ ID NO: 3345001 - RNA, 22 nt, Mycobacterium tuberculosis H37Rv
gcggcccgcaucguugccgacc

SEQ ID NO: 3345002 - RNA, 23 nt, Mycobacterium tuberculosis H37Rv
gcggcccgccgaguucugcugga

SEQ ID NO: 3345003 - RNA, 13 nt, Mycobacterium tuberculosis H37Rv
gcggcccgcucca

SEQ ID NO: 3345004 - RNA, 13 nt, Mycobacterium tuberculosis H37Rv
gcggcccgcucgg

SEQ ID NO: 3345005 - RNA, 17 nt, Mycobacterium tuberculosis H37Rv
gcggcccgcugcgcggc

SEQ ID NO: 3345006 - RNA, 18 nt, Mycobacterium tuberculosis H37Rv
gcggcccgcugcgcggcc

SEQ ID NO: 3345007 - RNA, 13 nt, Mycobacterium tuberculosis H37Rv
gcggcccgcugug

SEQ ID NO: 3345008 - RNA, 18 nt, Mycobacterium tuberculosis H37Rv
gcggcccgggaacccgcu

SEQ ID NO: 3345009 - RNA, 21 nt, Mycobacterium tuberculosis H37Rv
gcggcccggguuggccgaaca

SEQ ID NO: 3345010 - RNA, 22 nt, Mycobacterium tuberculosis H37Rv
gcggcccggucuacgccaccga

SEQ ID NO: 3345011 - RNA, 17 nt, Mycobacterium tuberculosis H37Rv
gcggcccgucaccgcgg

SEQ ID NO: 3345012 - RNA, 19 nt, Mycobacterium tuberculosis H37Rv
gcggcccuaaacaccgcga

SEQ ID NO: 3345013 - RNA, 15 nt, Mycobacterium tuberculosis H37Rv
gcggcccucgagcag

SEQ ID NO: 3345014 - RNA, 21 nt, Mycobacterium tuberculosis H37Rv
gcggcccugcuugcaggcgau

SEQ ID NO: 3345015 - RNA, 17 nt, Mycobacterium tuberculosis H37Rv
gcggccgaacucgaggu

SEQ ID NO: 3345016 - RNA, 22 nt, Mycobacterium tuberculosis H37Rv
gcggccgaauuccucaaggucg

SEQ ID NO: 3345017 - RNA, 18 nt, Mycobacterium tuberculosis H37Rv
gcggccgagggauugccg

SEQ ID NO: 3345018 - RNA, 20 nt, Mycobacterium tuberculosis H37Rv
gcggccgaggucacccggua

SEQ ID NO: 3345019 - RNA, 18 nt, Mycobacterium tuberculosis H37Rv
gcggccgcagccagcaag

SEQ ID NO: 3345020 - RNA, 19 nt, Mycobacterium tuberculosis H37Rv
gcggccgcagccagcaagu

SEQ ID NO: 3345021 - RNA, 14 nt, Mycobacterium tuberculosis H37Rv
gcggccgcagcggc

SEQ ID NO: 3345022 - RNA, 19 nt, Mycobacterium tuberculosis H37Rv
gcggccgcagcggccagcc

SEQ ID NO: 3345023 - RNA, 22 nt, Mycobacterium tuberculosis H37Rv
gcggccgcagcggccagcccag

SEQ ID NO: 3345024 - RNA, 12 nt, Mycobacterium tuberculosis H37Rv
gcggccgccauc

SEQ ID NO: 3345025 - RNA, 15 nt, Mycobacterium tuberculosis H37Rv
gcggccgccaucagc

SEQ ID NO: 3345026 - RNA, 19 nt, Mycobacterium tuberculosis H37Rv
gcggccgccaucagccgcu

SEQ ID NO: 3345027 - RNA, 13 nt, Mycobacterium tuberculosis H37Rv
gcggccgccccag

SEQ ID NO: 3345028 - RNA, 12 nt, Mycobacterium tuberculosis H37Rv
gcggccgcccgu

SEQ ID NO: 3345029 - RNA, 15 nt, Mycobacterium tuberculosis H37Rv
gcggccgccgcggcu

SEQ ID NO: 3345030 - RNA, 20 nt, Mycobacterium tuberculosis H37Rv
gcggccgccguccccgccgu

SEQ ID NO: 3345031 - RNA, 22 nt, Mycobacterium tuberculosis H37Rv
gcggccgccguccccgccgucg

SEQ ID NO: 3345032 - RNA, 14 nt, Mycobacterium tuberculosis H37Rv
gcggccgccuaccc

SEQ ID NO: 3345033 - RNA, 19 nt, Mycobacterium tuberculosis H37Rv
gcggccgccuacccguucu

SEQ ID NO: 3345034 - RNA, 23 nt, Mycobacterium tuberculosis H37Rv
gcggccgccuacccguucuucgc

SEQ ID NO: 3345035 - RNA, 23 nt, Mycobacterium tuberculosis H37Rv
gcggccgcgaccagcgccgcacc

SEQ ID NO: 3345036 - RNA, 22 nt, Mycobacterium tuberculosis H37Rv
gcggccgcgcgcaucgcgccuu

SEQ ID NO: 3345037 - RNA, 14 nt, Mycobacterium tuberculosis H37Rv
gcggccgcgcgcuc

SEQ ID NO: 3345038 - RNA, 16 nt, Mycobacterium tuberculosis H37Rv
gcggccgcgcgcucga

SEQ ID NO: 3345039 - RNA, 15 nt, Mycobacterium tuberculosis H37Rv
gcggccgcgcugcag

SEQ ID NO: 3345040 - RNA, 15 nt, Mycobacterium tuberculosis H37Rv
gcggccgcggaugcu

SEQ ID NO: 3345041 - RNA, 14 nt, Mycobacterium tuberculosis H37Rv
gcggccgcggcgau

SEQ ID NO: 3345042 - RNA, 19 nt, Mycobacterium tuberculosis H37Rv
gcggccgcggcgcggcggg

SEQ ID NO: 3345043 - RNA, 12 nt, Mycobacterium tuberculosis H37Rv
gcggccgcggug

SEQ ID NO: 3345044 - RNA, 18 nt, Mycobacterium tuberculosis H37Rv
gcggccgcggugacggcg

SEQ ID NO: 3345045 - RNA, 23 nt, Mycobacterium tuberculosis H37Rv
gcggccgcucacauacagcaggc

SEQ ID NO: 3345046 - RNA, 14 nt, Mycobacterium tuberculosis H37Rv
gcggccgcuccacc

SEQ ID NO: 3345047 - RNA, 17 nt, Mycobacterium tuberculosis H37Rv
gcggccgcuccaccucg

SEQ ID NO: 3345048 - RNA, 12 nt, Mycobacterium tuberculosis H37Rv
gcggccgcuggg

SEQ ID NO: 3345049 - RNA, 18 nt, Mycobacterium tuberculosis H37Rv
gcggccggcacgaccgcu

SEQ ID NO: 3345050 - RNA, 22 nt, Mycobacterium tuberculosis H37Rv
gcggccggcgcucgcggcggcg

SEQ ID NO: 3345051 - RNA, 23 nt, Mycobacterium tuberculosis H37Rv
gcggccggcgcucgcggcggcgc

SEQ ID NO: 3345052 - RNA, 24 nt, Mycobacterium tuberculosis H37Rv
gcggccggcgcucgcggcggcgcu

SEQ ID NO: 3345053 - RNA, 14 nt, Mycobacterium tuberculosis H37Rv
gcggccggcggccg

SEQ ID NO: 3345054 - RNA, 15 nt, Mycobacterium tuberculosis H37Rv
gcggccggcggccgc

SEQ ID NO: 3345055 - RNA, 15 nt, Mycobacterium tuberculosis H37Rv
gcggccggcgucggc

SEQ ID NO: 3345056 - RNA, 19 nt, Mycobacterium tuberculosis H37Rv
gcggccgggcgggcggccg

SEQ ID NO: 3345057 - RNA, 17 nt, Mycobacterium tuberculosis H37Rv
gcggccgggcguccucg

SEQ ID NO: 3345058 - RNA, 18 nt, Mycobacterium tuberculosis H37Rv
gcggccgggcuccccaag

SEQ ID NO: 3345059 - RNA, 20 nt, Mycobacterium tuberculosis H37Rv
gcggccgggucucuugcggg

SEQ ID NO: 3345060 - RNA, 17 nt, Mycobacterium tuberculosis H37Rv
gcggccggguucgcguc

SEQ ID NO: 3345061 - RNA, 16 nt, Mycobacterium tuberculosis H37Rv
gcggccguagugcacg

SEQ ID NO: 3345062 - RNA, 16 nt, Mycobacterium tuberculosis H37Rv
gcggccgucgcgggac

SEQ ID NO: 3345063 - RNA, 16 nt, Mycobacterium tuberculosis H37Rv
gcggccgugucgggcg

SEQ ID NO: 3345064 - RNA, 18 nt, Mycobacterium tuberculosis H37Rv
gcggccgugucgggcgcg

SEQ ID NO: 3345065 - RNA, 22 nt, Mycobacterium tuberculosis H37Rv
gcggccuaacgaguaggcggcu

SEQ ID NO: 3345066 - RNA, 19 nt, Mycobacterium tuberculosis H37Rv
gcggccuagcgccacuuga

SEQ ID NO: 3345067 - RNA, 14 nt, Mycobacterium tuberculosis H37Rv
gcggccuaggacgc

SEQ ID NO: 3345068 - RNA, 21 nt, Mycobacterium tuberculosis H37Rv
gcggccuaggacgccgcccuc

SEQ ID NO: 3345069 - RNA, 13 nt, Mycobacterium tuberculosis H37Rv
gcggccucccgca

SEQ ID NO: 3345070 - RNA, 21 nt, Mycobacterium tuberculosis H37Rv
gcggccucccgcaaugcgagc

SEQ ID NO: 3345071 - RNA, 15 nt, Mycobacterium tuberculosis H37Rv
gcggccucgcugcuc

SEQ ID NO: 3345072 - RNA, 18 nt, Mycobacterium tuberculosis H37Rv
gcggccucgcugcucagc

SEQ ID NO: 3345073 - RNA, 17 nt, Mycobacterium tuberculosis H37Rv
gcggccucggucuggug

SEQ ID NO: 3345074 - RNA, 18 nt, Mycobacterium tuberculosis H37Rv
gcggccugagcgucgucg

SEQ ID NO: 3345075 - RNA, 16 nt, Mycobacterium tuberculosis H37Rv
gcggccugcccgccgu

SEQ ID NO: 3345076 - RNA, 20 nt, Mycobacterium tuberculosis H37Rv
gcggccugcccgccguuacg

SEQ ID NO: 3345077 - RNA, 15 nt, Mycobacterium tuberculosis H37Rv
gcggccugcucgacc

SEQ ID NO: 3345078 - RNA, 18 nt, Mycobacterium tuberculosis H37Rv
gcggccugcucgggggcc

SEQ ID NO: 3345079 - RNA, 21 nt, Mycobacterium tuberculosis H37Rv
gcggccugggccagccgcuca

SEQ ID NO: 3345080 - RNA, 15 nt, Mycobacterium tuberculosis H37Rv
gcggccuucggccgg

SEQ ID NO: 3345081 - RNA, 18 nt, Mycobacterium tuberculosis H37Rv
gcggccuucggccggcgu

SEQ ID NO: 3345082 - RNA, 23 nt, Mycobacterium tuberculosis H37Rv
gcggccuugcgcacaggcgcgau

SEQ ID NO: 3345083 - RNA, 21 nt, Mycobacterium tuberculosis H37Rv
gcggccuugcgggcucucggc

SEQ ID NO: 3345084 - RNA, 17 nt, Mycobacterium tuberculosis H37Rv
gcggccuugcucagcac

SEQ ID NO: 3345085 - RNA, 18 nt, Mycobacterium tuberculosis H37Rv
gcggccuugcucagcacg

SEQ ID NO: 3345086 - RNA, 18 nt, Mycobacterium tuberculosis H37Rv
gcggccuuggcgacgucg

SEQ ID NO: 3345087 - RNA, 19 nt, Mycobacterium tuberculosis H37Rv
gcggccuuggcgacgucgc

SEQ ID NO: 3345088 - RNA, 21 nt, Mycobacterium tuberculosis H37Rv
gcggccuuggcgacgucgcgg

SEQ ID NO: 3345089 - RNA, 20 nt, Mycobacterium tuberculosis H37Rv
gcggccuuggcggccgcgac

SEQ ID NO: 3345090 - RNA, 17 nt, Mycobacterium tuberculosis H37Rv
gcggccuuugucgccuu

SEQ ID NO: 3345091 - RNA, 15 nt, Mycobacterium tuberculosis H37Rv
gcggcgaacagcccc

SEQ ID NO: 3345092 - RNA, 18 nt, Mycobacterium tuberculosis H37Rv
gcggcgaacagccccagg

SEQ ID NO: 3345093 - RNA, 16 nt, Mycobacterium tuberculosis H37Rv
gcggcgaacaucaccg

SEQ ID NO: 3345094 - RNA, 16 nt, Mycobacterium tuberculosis H37Rv
gcggcgaagaagccgg

SEQ ID NO: 3345095 - RNA, 13 nt, Mycobacterium tuberculosis H37Rv
gcggcggcggccc

SEQ ID NO: 3345096 - RNA, 14 nt, Mycobacterium tuberculosis H37Rv
gcggcggcggcccg

SEQ ID NO: 3345097 - RNA, 15 nt, Mycobacterium tuberculosis H37Rv
gcggcggcgucgacg

SEQ ID NO: 3345098 - RNA, 16 nt, Mycobacterium tuberculosis H37Rv
gcggcgggcaccguga

SEQ ID NO: 3345099 - RNA, 21 nt, Mycobacterium tuberculosis H37Rv
gcggcgggcaccgugauggcg

SEQ ID NO: 3345100 - RNA, 14 nt, Mycobacterium tuberculosis H37Rv
gcggcgggcagcgg

SEQ ID NO: 3345101 - RNA, 14 nt, Mycobacterium tuberculosis H37Rv
gcggcgggcgauga

SEQ ID NO: 3345102 - RNA, 18 nt, Mycobacterium tuberculosis H37Rv
gcggcgggggcggcggcu

SEQ ID NO: 3345103 - RNA, 19 nt, Mycobacterium tuberculosis H37Rv
gcggcgggggcggcggcug

SEQ ID NO: 3345104 - RNA, 14 nt, Mycobacterium tuberculosis H37Rv
gcggcggguccucg

SEQ ID NO: 3345105 - RNA, 16 nt, Mycobacterium tuberculosis H37Rv
gcggcgguaccggaau

SEQ ID NO: 3345106 - RNA, 21 nt, Mycobacterium tuberculosis H37Rv
gcggcgguaccggaaucggcg

SEQ ID NO: 3345107 - RNA, 17 nt, Mycobacterium tuberculosis H37Rv
gcggcgguaugccacag

SEQ ID NO: 3345108 - RNA, 22 nt, Mycobacterium tuberculosis H37Rv
gcggcgguaugccacaggcugc

SEQ ID NO: 3345109 - RNA, 13 nt, Mycobacterium tuberculosis H37Rv
gcggcggucacca

SEQ ID NO: 3345110 - RNA, 16 nt, Mycobacterium tuberculosis H37Rv
gcggcggucaccaccg

SEQ ID NO: 3345111 - RNA, 19 nt, Mycobacterium tuberculosis H37Rv
gcggcggucaccaccgacc

SEQ ID NO: 3345112 - RNA, 17 nt, Mycobacterium tuberculosis H37Rv
gcggcggucgagcgaac

SEQ ID NO: 3345113 - RNA, 15 nt, Mycobacterium tuberculosis H37Rv
gcggcggucgagcuc

SEQ ID NO: 3345114 - RNA, 14 nt, Mycobacterium tuberculosis H37Rv
gcggcggucucguc

SEQ ID NO: 3345115 - RNA, 22 nt, Mycobacterium tuberculosis H37Rv
gcggcggucugagacucgucga

SEQ ID NO: 3345116 - RNA, 18 nt, Mycobacterium tuberculosis H37Rv
gcggcggucugggugagc

SEQ ID NO: 3345117 - RNA, 17 nt, Mycobacterium tuberculosis H37Rv
gcggcggugcagcaggg

SEQ ID NO: 3345118 - RNA, 21 nt, Mycobacterium tuberculosis H37Rv
gcggcggugccacgaucggcg

SEQ ID NO: 3345119 - RNA, 14 nt, Mycobacterium tuberculosis H37Rv
gcggcggugcgccc

SEQ ID NO: 3345120 - RNA, 16 nt, Mycobacterium tuberculosis H37Rv
gcggcggugcgucagc

SEQ ID NO: 3345121 - RNA, 17 nt, Mycobacterium tuberculosis H37Rv
gcggcggugcgucagcu

SEQ ID NO: 3345122 - RNA, 15 nt, Mycobacterium tuberculosis H37Rv
gcggcgguggccagc

SEQ ID NO: 3345123 - RNA, 21 nt, Mycobacterium tuberculosis H37Rv
gcggcggugucacgacccaag

SEQ ID NO: 3345124 - RNA, 16 nt, Mycobacterium tuberculosis H37Rv
gcggcguaacugugga

SEQ ID NO: 3345125 - RNA, 16 nt, Mycobacterium tuberculosis H37Rv
gcggcguaggcgguca

SEQ ID NO: 3345126 - RNA, 18 nt, Mycobacterium tuberculosis H37Rv
gcggcguauugcggccug

SEQ ID NO: 3345127 - RNA, 18 nt, Mycobacterium tuberculosis H37Rv
gcggcgucaaaugugcga

SEQ ID NO: 3345128 - RNA, 12 nt, Mycobacterium tuberculosis H37Rv
gcggcguccaga

SEQ ID NO: 3345129 - RNA, 14 nt, Mycobacterium tuberculosis H37Rv
gcggcguccagcag

SEQ ID NO: 3345130 - RNA, 15 nt, Mycobacterium tuberculosis H37Rv
gcggcguccagcagc

SEQ ID NO: 3345131 - RNA, 14 nt, Mycobacterium tuberculosis H37Rv
gcggcgucgacggc

SEQ ID NO: 3345132 - RNA, 19 nt, Mycobacterium tuberculosis H37Rv
gcggcgucgaugucauccg

SEQ ID NO: 3345133 - RNA, 13 nt, Mycobacterium tuberculosis H37Rv
gcggcgucgccgu

SEQ ID NO: 3345134 - RNA, 17 nt, Mycobacterium tuberculosis H37Rv
gcggcgucggucgggug

SEQ ID NO: 3345135 - RNA, 18 nt, Mycobacterium tuberculosis H37Rv
gcggcgucggugagcgcg

SEQ ID NO: 3345136 - RNA, 20 nt, Mycobacterium tuberculosis H37Rv
gcggcgucggugagcgcguc

SEQ ID NO: 3345137 - RNA, 14 nt, Mycobacterium tuberculosis H37Rv
gcggcgucgucgau

SEQ ID NO: 3345138 - RNA, 13 nt, Mycobacterium tuberculosis H37Rv
gcggcgucguucg

SEQ ID NO: 3345139 - RNA, 17 nt, Mycobacterium tuberculosis H37Rv
gcggcgucguucgagac

SEQ ID NO: 3345140 - RNA, 15 nt, Mycobacterium tuberculosis H37Rv
gcggcgugccgggug

SEQ ID NO: 3345141 - RNA, 22 nt, Mycobacterium tuberculosis H37Rv
gcggcgugguauccgccguucu

SEQ ID NO: 3345142 - RNA, 14 nt, Mycobacterium tuberculosis H37Rv
gcggcguggucucg

SEQ ID NO: 3345143 - RNA, 17 nt, Mycobacterium tuberculosis H37Rv
gcggcguuaccaccguc

SEQ ID NO: 3345144 - RNA, 22 nt, Mycobacterium tuberculosis H37Rv
gcggcguuccccgagaacggcg

SEQ ID NO: 3345145 - RNA, 20 nt, Mycobacterium tuberculosis H37Rv
gcggcguuccgggccgauca

SEQ ID NO: 3345146 - RNA, 14 nt, Mycobacterium tuberculosis H37Rv
gcggcguucgaugc

SEQ ID NO: 3345147 - RNA, 19 nt, Mycobacterium tuberculosis H37Rv
gcggcguucgaugccacau

SEQ ID NO: 3345148 - RNA, 19 nt, Mycobacterium tuberculosis H37Rv
gcggcguuggugcagucgg

SEQ ID NO: 3345149 - RNA, 21 nt, Mycobacterium tuberculosis H37Rv
gcggcguuggugcagucggug

SEQ ID NO: 3345150 - RNA, 17 nt, Mycobacterium tuberculosis H37Rv
gcggcguuguggcgugu

SEQ ID NO: 3345151 - RNA, 21 nt, Mycobacterium tuberculosis H37Rv
gcggcguuguggcguguggcu

SEQ ID NO: 3345152 - RNA, 23 nt, Mycobacterium tuberculosis H37Rv
gcggcguuguugcggaucgagca

SEQ ID NO: 3345153 - RNA, 20 nt, Mycobacterium tuberculosis H37Rv
gcggcguuucccggguccug

SEQ ID NO: 3345154 - RNA, 16 nt, Mycobacterium tuberculosis H37Rv
gcggcuacaucggcgg

SEQ ID NO: 3345155 - RNA, 16 nt, Mycobacterium tuberculosis H37Rv
gcggcuacccauggcc

SEQ ID NO: 3345156 - RNA, 21 nt, Mycobacterium tuberculosis H37Rv
gcggcuacccauggcccguug

SEQ ID NO: 3345157 - RNA, 16 nt, Mycobacterium tuberculosis H37Rv
gcggcuaggcaccagc

SEQ ID NO: 3345158 - RNA, 20 nt, Mycobacterium tuberculosis H37Rv
gcggcuaggcaccagcggau

SEQ ID NO: 3345159 - RNA, 16 nt, Mycobacterium tuberculosis H37Rv
gcggcuaggccagcac

SEQ ID NO: 3345160 - RNA, 17 nt, Mycobacterium tuberculosis H37Rv
gcggcuaggccagcacg

SEQ ID NO: 3345161 - RNA, 21 nt, Mycobacterium tuberculosis H37Rv
gcggcucaaccucuggcggcg

SEQ ID NO: 3345162 - RNA, 17 nt, Mycobacterium tuberculosis H37Rv
gcggcucaaucuccucc

SEQ ID NO: 3345163 - RNA, 18 nt, Mycobacterium tuberculosis H37Rv
gcggcucaaucuccuccg

SEQ ID NO: 3345164 - RNA, 19 nt, Mycobacterium tuberculosis H37Rv
gcggcucagaacccuccgu

SEQ ID NO: 3345165 - RNA, 13 nt, Mycobacterium tuberculosis H37Rv
gcggcuccaccgg

SEQ ID NO: 3345166 - RNA, 18 nt, Mycobacterium tuberculosis H37Rv
gcggcuccaccgggcccg

SEQ ID NO: 3345167 - RNA, 20 nt, Mycobacterium tuberculosis H37Rv
gcggcuccaccgggcccgcc

SEQ ID NO: 3345168 - RNA, 15 nt, Mycobacterium tuberculosis H37Rv
gcggcuccgcccggc

SEQ ID NO: 3345169 - RNA, 18 nt, Mycobacterium tuberculosis H37Rv
gcggcuccguuguccagc

SEQ ID NO: 3345170 - RNA, 17 nt, Mycobacterium tuberculosis H37Rv
gcggcucgggugcgccc

SEQ ID NO: 3345171 - RNA, 20 nt, Mycobacterium tuberculosis H37Rv
gcggcucgggugcgcccggc

SEQ ID NO: 3345172 - RNA, 18 nt, Mycobacterium tuberculosis H37Rv
gcggcucguuggcaaaga

SEQ ID NO: 3345173 - RNA, 21 nt, Mycobacterium tuberculosis H37Rv
gcggcucuagaucgccgagcg

SEQ ID NO: 3345174 - RNA, 20 nt, Mycobacterium tuberculosis H37Rv
gcggcucuauccggcgcagg

SEQ ID NO: 3345175 - RNA, 15 nt, Mycobacterium tuberculosis H37Rv
gcggcugcagccgac

SEQ ID NO: 3345176 - RNA, 12 nt, Mycobacterium tuberculosis H37Rv
gcggcugccagc

SEQ ID NO: 3345177 - RNA, 13 nt, Mycobacterium tuberculosis H37Rv
gcggcugcccacc

SEQ ID NO: 3345178 - RNA, 17 nt, Mycobacterium tuberculosis H37Rv
gcggcugcccgagaucg

SEQ ID NO: 3345179 - RNA, 23 nt, Mycobacterium tuberculosis H37Rv
gcggcugcccgagaucgcgugcg

SEQ ID NO: 3345180 - RNA, 22 nt, Mycobacterium tuberculosis H37Rv
gcggcugccgcggugccaaccg

SEQ ID NO: 3345181 - RNA, 16 nt, Mycobacterium tuberculosis H37Rv
gcggcugcugcgcggu

SEQ ID NO: 3345182 - RNA, 13 nt, Mycobacterium tuberculosis H37Rv
gcggcugcuuggu

SEQ ID NO: 3345183 - RNA, 16 nt, Mycobacterium tuberculosis H37Rv
gcggcugcuuggucgc

SEQ ID NO: 3345184 - RNA, 22 nt, Mycobacterium tuberculosis H37Rv
gcggcugcuuggucgcccagcc

SEQ ID NO: 3345185 - RNA, 15 nt, Mycobacterium tuberculosis H37Rv
gcggcuggcccgcau

SEQ ID NO: 3345186 - RNA, 20 nt, Mycobacterium tuberculosis H37Rv
gcggcuggcccgcaugccgg

SEQ ID NO: 3345187 - RNA, 21 nt, Mycobacterium tuberculosis H37Rv
gcggcuggcccgcaugccggc

SEQ ID NO: 3345188 - RNA, 23 nt, Mycobacterium tuberculosis H37Rv
gcggcuggcccgcaugccggcgc

SEQ ID NO: 3345189 - RNA, 15 nt, Mycobacterium tuberculosis H37Rv
gcggcuggucucugg

SEQ ID NO: 3345190 - RNA, 17 nt, Mycobacterium tuberculosis H37Rv
gcggcugguguccagcc

SEQ ID NO: 3345191 - RNA, 16 nt, Mycobacterium tuberculosis H37Rv
gcgggccgcgucgaac

SEQ ID NO: 3345192 - RNA, 21 nt, Mycobacterium tuberculosis H37Rv
gcgggccgcgucgaacugggc

SEQ ID NO: 3345193 - RNA, 14 nt, Mycobacterium tuberculosis H37Rv
gcgggccgcucggu

SEQ ID NO: 3345194 - RNA, 15 nt, Mycobacterium tuberculosis H37Rv
gcgggccgcucggua

SEQ ID NO: 3345195 - RNA, 21 nt, Mycobacterium tuberculosis H37Rv
gcgggccgcucgguaggacag

SEQ ID NO: 3345196 - RNA, 20 nt, Mycobacterium tuberculosis H37Rv
gcgggccggaugacgcccag

SEQ ID NO: 3345197 - RNA, 14 nt, Mycobacterium tuberculosis H37Rv
gcgggccggcaucg

SEQ ID NO: 3345198 - RNA, 13 nt, Mycobacterium tuberculosis H37Rv
gcgggccggcgac

SEQ ID NO: 3345199 - RNA, 17 nt, Mycobacterium tuberculosis H37Rv
gcgggccuccugcuggc

SEQ ID NO: 3345200 - RNA, 18 nt, Mycobacterium tuberculosis H37Rv
gcgggccugcacgccggc

SEQ ID NO: 3345201 - RNA, 19 nt, Mycobacterium tuberculosis H37Rv
gcgggccugcacgccggcg

SEQ ID NO: 3345202 - RNA, 21 nt, Mycobacterium tuberculosis H37Rv
gcgggccugcacgccggcgcu

SEQ ID NO: 3345203 - RNA, 16 nt, Mycobacterium tuberculosis H37Rv
gcgggccugcgcgauc

SEQ ID NO: 3345204 - RNA, 13 nt, Mycobacterium tuberculosis H37Rv
gcgggcgacccgu

SEQ ID NO: 3345205 - RNA, 14 nt, Mycobacterium tuberculosis H37Rv
gcgggcgaucggca

SEQ ID NO: 3345206 - RNA, 15 nt, Mycobacterium tuberculosis H37Rv
gcgggcgaucggcau

SEQ ID NO: 3345207 - RNA, 21 nt, Mycobacterium tuberculosis H37Rv
gcgggcgaucucggcgagcac

SEQ ID NO: 3345208 - RNA, 19 nt, Mycobacterium tuberculosis H37Rv
gcgggcgaugagcgcgauc

SEQ ID NO: 3345209 - RNA, 22 nt, Mycobacterium tuberculosis H37Rv
gcgggcgaugagcgcgaucucc

SEQ ID NO: 3345210 - RNA, 16 nt, Mycobacterium tuberculosis H37Rv
gcgggcgaugcgggcc

SEQ ID NO: 3345211 - RNA, 13 nt, Mycobacterium tuberculosis H37Rv
gcgggcgauggcg

SEQ ID NO: 3345212 - RNA, 21 nt, Mycobacterium tuberculosis H37Rv
gcgggcgauuucggcgccggc

SEQ ID NO: 3345213 - RNA, 22 nt, Mycobacterium tuberculosis H37Rv
gcgggcgauuucggcgccggcg

SEQ ID NO: 3345214 - RNA, 14 nt, Mycobacterium tuberculosis H37Rv
gcgggcgcaccagg

SEQ ID NO: 3345215 - RNA, 18 nt, Mycobacterium tuberculosis H37Rv
gcgggcgccucggugacg

SEQ ID NO: 3345216 - RNA, 18 nt, Mycobacterium tuberculosis H37Rv
gcgggcgccuuccaggcg

SEQ ID NO: 3345217 - RNA, 19 nt, Mycobacterium tuberculosis H37Rv
gcgggcgccuuccaggcgg

SEQ ID NO: 3345218 - RNA, 16 nt, Mycobacterium tuberculosis H37Rv
gcgggcgccuuggucg

SEQ ID NO: 3345219 - RNA, 21 nt, Mycobacterium tuberculosis H37Rv
gcgggcgccuuggucgccgcc

SEQ ID NO: 3345220 - RNA, 15 nt, Mycobacterium tuberculosis H37Rv
gcgggcgcggguggc

SEQ ID NO: 3345221 - RNA, 24 nt, Mycobacterium tuberculosis H37Rv
gcgggcgcggguggcgccaguucg

SEQ ID NO: 3345222 - RNA, 22 nt, Mycobacterium tuberculosis H37Rv
gcgggcgcuugccggggugugc

SEQ ID NO: 3345223 - RNA, 15 nt, Mycobacterium tuberculosis H37Rv
gcgggcggaucgccg

SEQ ID NO: 3345224 - RNA, 13 nt, Mycobacterium tuberculosis H37Rv
gcgggcggcaccg

SEQ ID NO: 3345225 - RNA, 17 nt, Mycobacterium tuberculosis H37Rv
gcgggcggcaucgccga

SEQ ID NO: 3345226 - RNA, 16 nt, Mycobacterium tuberculosis H37Rv
gcgggcgggcguccac

SEQ ID NO: 3345227 - RNA, 16 nt, Mycobacterium tuberculosis H37Rv
gcgggcgggucugggu

SEQ ID NO: 3345228 - RNA, 21 nt, Mycobacterium tuberculosis H37Rv
gcgggcgggucugggugguga

SEQ ID NO: 3345229 - RNA, 13 nt, Mycobacterium tuberculosis H37Rv
gcgggcggugggc

SEQ ID NO: 3345230 - RNA, 13 nt, Mycobacterium tuberculosis H37Rv
gcgggcgucgcgg

SEQ ID NO: 3345231 - RNA, 16 nt, Mycobacterium tuberculosis H37Rv
gcgggcgugccgacca

SEQ ID NO: 3345232 - RNA, 18 nt, Mycobacterium tuberculosis H37Rv
gcgggcgugccgaccagc

SEQ ID NO: 3345233 - RNA, 16 nt, Mycobacterium tuberculosis H37Rv
gcgggcgugcuacacc

SEQ ID NO: 3345234 - RNA, 13 nt, Mycobacterium tuberculosis H37Rv
gcgggcgugugca

SEQ ID NO: 3345235 - RNA, 16 nt, Mycobacterium tuberculosis H37Rv
gcgggcgugugcaguc

SEQ ID NO: 3345236 - RNA, 17 nt, Mycobacterium tuberculosis H37Rv
gcgggcguugaccugca

SEQ ID NO: 3345237 - RNA, 20 nt, Mycobacterium tuberculosis H37Rv
gcgggcguuggccagcaggu

SEQ ID NO: 3345238 - RNA, 23 nt, Mycobacterium tuberculosis H37Rv
gcgggcucaacaccagccggucg

SEQ ID NO: 3345239 - RNA, 21 nt, Mycobacterium tuberculosis H37Rv
gcgggcucgcuucaggcaccg

SEQ ID NO: 3345240 - RNA, 23 nt, Mycobacterium tuberculosis H37Rv
gcgggcucgcuucaggcaccgga

SEQ ID NO: 3345241 - RNA, 13 nt, Mycobacterium tuberculosis H37Rv
gcgggcucggucc

SEQ ID NO: 3345242 - RNA, 13 nt, Mycobacterium tuberculosis H37Rv
gcgggcucggugg

SEQ ID NO: 3345243 - RNA, 12 nt, Mycobacterium tuberculosis H37Rv
gcgggcuugagc

SEQ ID NO: 3345244 - RNA, 15 nt, Mycobacterium tuberculosis H37Rv
gcgggcuugccguug

SEQ ID NO: 3345245 - RNA, 21 nt, Mycobacterium tuberculosis H37Rv
gcgggcuuggggucccgccgg

SEQ ID NO: 3345246 - RNA, 17 nt, Mycobacterium tuberculosis H37Rv
gcgggcuuugagcgccc

SEQ ID NO: 3345247 - RNA, 24 nt, Mycobacterium tuberculosis H37Rv
gcggggaaguuggcugagcagcgc

SEQ ID NO: 3345248 - RNA, 16 nt, Mycobacterium tuberculosis H37Rv
gcggggaucagcgagu

SEQ ID NO: 3345249 - RNA, 19 nt, Mycobacterium tuberculosis H37Rv
gcggggaugucgaccgcga

SEQ ID NO: 3345250 - RNA, 19 nt, Mycobacterium tuberculosis H37Rv
gcggggcagaagucguugc

SEQ ID NO: 3345251 - RNA, 15 nt, Mycobacterium tuberculosis H37Rv
gcggggccgccgcgg

SEQ ID NO: 3345252 - RNA, 21 nt, Mycobacterium tuberculosis H37Rv
gcggggccgccgcggccggcg

SEQ ID NO: 3345253 - RNA, 13 nt, Mycobacterium tuberculosis H37Rv
gcggggccggccg

SEQ ID NO: 3345254 - RNA, 22 nt, Mycobacterium tuberculosis H37Rv
gcggggcgaaguggaucuggcg

SEQ ID NO: 3345255 - RNA, 15 nt, Mycobacterium tuberculosis H37Rv
gcggggcgaucccca

SEQ ID NO: 3345256 - RNA, 16 nt, Mycobacterium tuberculosis H37Rv
gcggggcgauccccag

SEQ ID NO: 3345257 - RNA, 14 nt, Mycobacterium tuberculosis H37Rv
gcggggcgcaccgc

SEQ ID NO: 3345258 - RNA, 12 nt, Mycobacterium tuberculosis H37Rv
gcggggcggccu

SEQ ID NO: 3345259 - RNA, 23 nt, Mycobacterium tuberculosis H37Rv
gcggggcuaguugagcgcugcgc

SEQ ID NO: 3345260 - RNA, 22 nt, Mycobacterium tuberculosis H37Rv
gcggggcugggcgccaugcgcc

SEQ ID NO: 3345261 - RNA, 15 nt, Mycobacterium tuberculosis H37Rv
gcgggggaccccgcc

SEQ ID NO: 3345262 - RNA, 16 nt, Mycobacterium tuberculosis H37Rv
gcgggggaccgcccga

SEQ ID NO: 3345263 - RNA, 18 nt, Mycobacterium tuberculosis H37Rv
gcgggggagcgaacggcg

SEQ ID NO: 3345264 - RNA, 22 nt, Mycobacterium tuberculosis H37Rv
gcgggggagcgaacggcgcagu

SEQ ID NO: 3345265 - RNA, 17 nt, Mycobacterium tuberculosis H37Rv
gcgggggcgucgccgcc

SEQ ID NO: 3345266 - RNA, 21 nt, Mycobacterium tuberculosis H37Rv
gcgggggcuuaugcgucugcu

SEQ ID NO: 3345267 - RNA, 17 nt, Mycobacterium tuberculosis H37Rv
gcggggguacgucaccg

SEQ ID NO: 3345268 - RNA, 22 nt, Mycobacterium tuberculosis H37Rv
gcggggguggaaucagggucug

SEQ ID NO: 3345269 - RNA, 21 nt, Mycobacterium tuberculosis H37Rv
gcgggguaggcccagcaaccg

SEQ ID NO: 3345270 - RNA, 12 nt, Mycobacterium tuberculosis H37Rv
gcgggguccagc

SEQ ID NO: 3345271 - RNA, 15 nt, Mycobacterium tuberculosis H37Rv
gcggggugcgcccac

SEQ ID NO: 3345272 - RNA, 14 nt, Mycobacterium tuberculosis H37Rv
gcggggugcucagc

SEQ ID NO: 3345273 - RNA, 20 nt, Mycobacterium tuberculosis H37Rv
gcgggguggcggcgcugcgc

SEQ ID NO: 3345274 - RNA, 18 nt, Mycobacterium tuberculosis H37Rv
gcggggugugcgguugcu

SEQ ID NO: 3345275 - RNA, 17 nt, Mycobacterium tuberculosis H37Rv
gcgggguugaucaccga

SEQ ID NO: 3345276 - RNA, 24 nt, Mycobacterium tuberculosis H37Rv
gcgggguuggccguggucgaggug

SEQ ID NO: 3345277 - RNA, 19 nt, Mycobacterium tuberculosis H37Rv
gcggguacuuacgggucgc

SEQ ID NO: 3345278 - RNA, 15 nt, Mycobacterium tuberculosis H37Rv
gcggguagccgucga

SEQ ID NO: 3345279 - RNA, 22 nt, Mycobacterium tuberculosis H37Rv
gcgggucacaaaaccugggaug

SEQ ID NO: 3345280 - RNA, 15 nt, Mycobacterium tuberculosis H37Rv
gcgggucagcgccga

SEQ ID NO: 3345281 - RNA, 20 nt, Mycobacterium tuberculosis H37Rv
gcgggucagcucgaccugag

SEQ ID NO: 3345282 - RNA, 14 nt, Mycobacterium tuberculosis H37Rv
gcggguccgucagc

SEQ ID NO: 3345283 - RNA, 14 nt, Mycobacterium tuberculosis H37Rv
gcgggucgccgggc

SEQ ID NO: 3345284 - RNA, 18 nt, Mycobacterium tuberculosis H37Rv
gcgggucgcggcuauggc

SEQ ID NO: 3345285 - RNA, 16 nt, Mycobacterium tuberculosis H37Rv
gcgggucgcguuucgc

SEQ ID NO: 3345286 - RNA, 13 nt, Mycobacterium tuberculosis H37Rv
gcgggucggcgac

SEQ ID NO: 3345287 - RNA, 21 nt, Mycobacterium tuberculosis H37Rv
gcggucccacucgucgucggu

SEQ ID NO: 3345288 - RNA, 16 nt, Mycobacterium tuberculosis H37Rv
gcggucccgcggaccg

SEQ ID NO: 3345289 - RNA, 15 nt, Mycobacterium tuberculosis H37Rv
gcggucccuccgacu

SEQ ID NO: 3345290 - RNA, 23 nt, Mycobacterium tuberculosis H37Rv
gcggucccugaagccagcgcaag

SEQ ID NO: 3345291 - RNA, 20 nt, Mycobacterium tuberculosis H37Rv
gcggucccugaucaaggacc

SEQ ID NO: 3345292 - RNA, 17 nt, Mycobacterium tuberculosis H37Rv
gcgguccgagcggcauc

SEQ ID NO: 3345293 - RNA, 14 nt, Mycobacterium tuberculosis H37Rv
gcgguccggcuucg

SEQ ID NO: 3345294 - RNA, 22 nt, Mycobacterium tuberculosis H37Rv
gcgguccugguguagccgagca

SEQ ID NO: 3345295 - RNA, 13 nt, Mycobacterium tuberculosis H37Rv
gcggucgacgugu

SEQ ID NO: 3345296 - RNA, 14 nt, Mycobacterium tuberculosis H37Rv
gcggucgacguguu

SEQ ID NO: 3345297 - RNA, 14 nt, Mycobacterium tuberculosis H37Rv
gcggucgagauguc

SEQ ID NO: 3345298 - RNA, 12 nt, Mycobacterium tuberculosis H37Rv
gcggucgagcag

SEQ ID NO: 3345299 - RNA, 16 nt, Mycobacterium tuberculosis H37Rv
gcggucgagccaccca

SEQ ID NO: 3345300 - RNA, 20 nt, Mycobacterium tuberculosis H37Rv
gcggucgaucaacaccaacg

SEQ ID NO: 3345301 - RNA, 17 nt, Mycobacterium tuberculosis H37Rv
gcggucgcagcagacca

SEQ ID NO: 3345302 - RNA, 15 nt, Mycobacterium tuberculosis H37Rv
gcggucgcccaggcc

SEQ ID NO: 3345303 - RNA, 18 nt, Mycobacterium tuberculosis H37Rv
gcggucgcccgcuaccaa

SEQ ID NO: 3345304 - RNA, 18 nt, Mycobacterium tuberculosis H37Rv
gcggucgcgcccucagcc

SEQ ID NO: 3345305 - RNA, 13 nt, Mycobacterium tuberculosis H37Rv
gcggucgcugaug

SEQ ID NO: 3345306 - RNA, 19 nt, Mycobacterium tuberculosis H37Rv
gcggucggagucgagcaca

SEQ ID NO: 3345307 - RNA, 19 nt, Mycobacterium tuberculosis H37Rv
gcggucggccacauccagc

SEQ ID NO: 3345308 - RNA, 20 nt, Mycobacterium tuberculosis H37Rv
gcggucggccacauccagcg

SEQ ID NO: 3345309 - RNA, 18 nt, Mycobacterium tuberculosis H37Rv
gcggucguugauuucggc

SEQ ID NO: 3345310 - RNA, 22 nt, Mycobacterium tuberculosis H37Rv
gcggucuccccagagcuggucc

SEQ ID NO: 3345311 - RNA, 14 nt, Mycobacterium tuberculosis H37Rv
gcggucucggugcc

SEQ ID NO: 3345312 - RNA, 19 nt, Mycobacterium tuberculosis H37Rv
gcggucugaccgcgucggc

SEQ ID NO: 3345313 - RNA, 21 nt, Mycobacterium tuberculosis H37Rv
gcggucugagacucgucgaug

SEQ ID NO: 3345314 - RNA, 18 nt, Mycobacterium tuberculosis H37Rv
gcggucugcgcgucgcgu

SEQ ID NO: 3345315 - RNA, 17 nt, Mycobacterium tuberculosis H37Rv
gcggucugcuccaggcg

SEQ ID NO: 3345316 - RNA, 23 nt, Mycobacterium tuberculosis H37Rv
gcggucugguugucgaucucggc

SEQ ID NO: 3345317 - RNA, 20 nt, Mycobacterium tuberculosis H37Rv
gcggucuuugagccgguagc

SEQ ID NO: 3345318 - RNA, 19 nt, Mycobacterium tuberculosis H37Rv
gcggugaaaucgcacagcg

SEQ ID NO: 3345319 - RNA, 21 nt, Mycobacterium tuberculosis H37Rv
gcggugaacuucuccaccagc

SEQ ID NO: 3345320 - RNA, 19 nt, Mycobacterium tuberculosis H37Rv
gcggugaauccgugcaggg

SEQ ID NO: 3345321 - RNA, 14 nt, Mycobacterium tuberculosis H37Rv
gcggugaccggguu

SEQ ID NO: 3345322 - RNA, 18 nt, Mycobacterium tuberculosis H37Rv
gcggugacgccagccugg

SEQ ID NO: 3345323 - RNA, 20 nt, Mycobacterium tuberculosis H37Rv
gcggugacgggaucgucggc

SEQ ID NO: 3345324 - RNA, 21 nt, Mycobacterium tuberculosis H37Rv
gcggugacggugccgguuuuc

SEQ ID NO: 3345325 - RNA, 17 nt, Mycobacterium tuberculosis H37Rv
gcggugacguggugggc

SEQ ID NO: 3345326 - RNA, 20 nt, Mycobacterium tuberculosis H37Rv
gcggugagccgccaggaccg

SEQ ID NO: 3345327 - RNA, 15 nt, Mycobacterium tuberculosis H37Rv
gcggugaggucggug

SEQ ID NO: 3345328 - RNA, 16 nt, Mycobacterium tuberculosis H37Rv
gcggugaguccgcuga

SEQ ID NO: 3345329 - RNA, 18 nt, Mycobacterium tuberculosis H37Rv
gcggugauauccgugaau

SEQ ID NO: 3345330 - RNA, 23 nt, Mycobacterium tuberculosis H37Rv
gcggugaucgauccggcuccacc

SEQ ID NO: 3345331 - RNA, 16 nt, Mycobacterium tuberculosis H37Rv
gcggugcacacugacc

SEQ ID NO: 3345332 - RNA, 22 nt, Mycobacterium tuberculosis H37Rv
gcggugcaggauucggcggucg

SEQ ID NO: 3345333 - RNA, 22 nt, Mycobacterium tuberculosis H37Rv
gcggugccaccagugagcccgc

SEQ ID NO: 3345334 - RNA, 15 nt, Mycobacterium tuberculosis H37Rv
gcggugcccagcagc

SEQ ID NO: 3345335 - RNA, 17 nt, Mycobacterium tuberculosis H37Rv
gcggugcccgcaccaga

SEQ ID NO: 3345336 - RNA, 15 nt, Mycobacterium tuberculosis H37Rv
gcggugcccgcgaac

SEQ ID NO: 3345337 - RNA, 18 nt, Mycobacterium tuberculosis H37Rv
gcggugccgacggugggc

SEQ ID NO: 3345338 - RNA, 18 nt, Mycobacterium tuberculosis H37Rv
gcggugccggcggaucug

SEQ ID NO: 3345339 - RNA, 18 nt, Mycobacterium tuberculosis H37Rv
gcggugccgugguggacg

SEQ ID NO: 3345340 - RNA, 19 nt, Mycobacterium tuberculosis H37Rv
gcggugcgcaccaccgagc

SEQ ID NO: 3345341 - RNA, 21 nt, Mycobacterium tuberculosis H37Rv
gcggugcgcaccaccgagccg

SEQ ID NO: 3345342 - RNA, 22 nt, Mycobacterium tuberculosis H37Rv
gcggugcgcagcuuggccagcc

SEQ ID NO: 3345343 - RNA, 20 nt, Mycobacterium tuberculosis H37Rv
gcggugcgcucacuggcgau

SEQ ID NO: 3345344 - RNA, 23 nt, Mycobacterium tuberculosis H37Rv
gcggugcggcacgccggccgcgc

SEQ ID NO: 3345345 - RNA, 19 nt, Mycobacterium tuberculosis H37Rv
gcggugcgggcuucaacac

SEQ ID NO: 3345346 - RNA, 21 nt, Mycobacterium tuberculosis H37Rv
gcggugcucuucggcaccacc

SEQ ID NO: 3345347 - RNA, 16 nt, Mycobacterium tuberculosis H37Rv
gcggugcugcuucaac

SEQ ID NO: 3345348 - RNA, 19 nt, Mycobacterium tuberculosis H37Rv
gcggugcugguggcggcac

SEQ ID NO: 3345349 - RNA, 20 nt, Mycobacterium tuberculosis H37Rv
gcgguggaaaaagcccgaca

SEQ ID NO: 3345350 - RNA, 16 nt, Mycobacterium tuberculosis H37Rv
gcgguggaccgcucga

SEQ ID NO: 3345351 - RNA, 12 nt, Mycobacterium tuberculosis H37Rv
gcgguggccacc

SEQ ID NO: 3345352 - RNA, 21 nt, Mycobacterium tuberculosis H37Rv
gcgguggccacccggccgcgc

SEQ ID NO: 3345353 - RNA, 20 nt, Mycobacterium tuberculosis H37Rv
gcgguggccagaucgaacgc

SEQ ID NO: 3345354 - RNA, 22 nt, Mycobacterium tuberculosis H37Rv
gcgguggccagaucgaacgcag

SEQ ID NO: 3345355 - RNA, 14 nt, Mycobacterium tuberculosis H37Rv
gcgguggcccgccg

SEQ ID NO: 3345356 - RNA, 16 nt, Mycobacterium tuberculosis H37Rv
gcgguggcccgccggc

SEQ ID NO: 3345357 - RNA, 19 nt, Mycobacterium tuberculosis H37Rv
gcgguggcccgccggcaac

SEQ ID NO: 3345358 - RNA, 16 nt, Mycobacterium tuberculosis H37Rv
gcgguggccgucgggu

SEQ ID NO: 3345359 - RNA, 22 nt, Mycobacterium tuberculosis H37Rv
gcgguggccucccacggcgcgu

SEQ ID NO: 3345360 - RNA, 12 nt, Mycobacterium tuberculosis H37Rv
gcgguggcggcg

SEQ ID NO: 3345361 - RNA, 13 nt, Mycobacterium tuberculosis H37Rv
gcgguggcggcgg

SEQ ID NO: 3345362 - RNA, 12 nt, Mycobacterium tuberculosis H37Rv
gcggugggcaca

SEQ ID NO: 3345363 - RNA, 14 nt, Mycobacterium tuberculosis H37Rv
gcggugggcacagc

SEQ ID NO: 3345364 - RNA, 14 nt, Mycobacterium tuberculosis H37Rv
gcggugggcagcag

SEQ ID NO: 3345365 - RNA, 15 nt, Mycobacterium tuberculosis H37Rv
gcggugggcagcagc

SEQ ID NO: 3345366 - RNA, 22 nt, Mycobacterium tuberculosis H37Rv
gcggugggccagguuuugccgc

SEQ ID NO: 3345367 - RNA, 14 nt, Mycobacterium tuberculosis H37Rv
gcggugggcuucca

SEQ ID NO: 3345368 - RNA, 17 nt, Mycobacterium tuberculosis H37Rv
gcgguggggcgcgccgg

SEQ ID NO: 3345369 - RNA, 18 nt, Mycobacterium tuberculosis H37Rv
gcgguggggcgcgccggc

SEQ ID NO: 3345370 - RNA, 14 nt, Mycobacterium tuberculosis H37Rv
gcggugggucgucg

SEQ ID NO: 3345371 - RNA, 16 nt, Mycobacterium tuberculosis H37Rv
gcgguggucgcgaccg

SEQ ID NO: 3345372 - RNA, 18 nt, Mycobacterium tuberculosis H37Rv
gcgguguagaagcgggcg

SEQ ID NO: 3345373 - RNA, 16 nt, Mycobacterium tuberculosis H37Rv
gcgguguauccgacgu

SEQ ID NO: 3345374 - RNA, 17 nt, Mycobacterium tuberculosis H37Rv
gcggugucgucgagguc

SEQ ID NO: 3345375 - RNA, 18 nt, Mycobacterium tuberculosis H37Rv
gcggugucgucgagguca

SEQ ID NO: 3345376 - RNA, 18 nt, Mycobacterium tuberculosis H37Rv
gcggugugcacgucacgc

SEQ ID NO: 3345377 - RNA, 21 nt, Mycobacterium tuberculosis H37Rv
gcggugugcacgucacgcgga

SEQ ID NO: 3345378 - RNA, 21 nt, Mycobacterium tuberculosis H37Rv
gcggugugcucacgcaucgcg

SEQ ID NO: 3345379 - RNA, 13 nt, Mycobacterium tuberculosis H37Rv
gcgguguggucgc

SEQ ID NO: 3345380 - RNA, 14 nt, Mycobacterium tuberculosis H37Rv
gcgguguuggacgc

SEQ ID NO: 3345381 - RNA, 21 nt, Mycobacterium tuberculosis H37Rv
gcgguguuggacgcgggccga

SEQ ID NO: 3345382 - RNA, 21 nt, Mycobacterium tuberculosis H37Rv
gcgguguuggcgccagccccg

SEQ ID NO: 3345383 - RNA, 14 nt, Mycobacterium tuberculosis H37Rv
gcgucccagccgau

SEQ ID NO: 3345384 - RNA, 14 nt, Mycobacterium tuberculosis H37Rv
gcguccccagcgcc

SEQ ID NO: 3345385 - RNA, 15 nt, Mycobacterium tuberculosis H37Rv
gcguccccagcgcca

SEQ ID NO: 3345386 - RNA, 15 nt, Mycobacterium tuberculosis H37Rv
gcguccccaugcagc

SEQ ID NO: 3345387 - RNA, 17 nt, Mycobacterium tuberculosis H37Rv
gcgucccgccgcaccgc

SEQ ID NO: 3345388 - RNA, 16 nt, Mycobacterium tuberculosis H37Rv
gcgucccggcggucag

SEQ ID NO: 3345389 - RNA, 20 nt, Mycobacterium tuberculosis H37Rv
gcgucccggcggucagcggc

SEQ ID NO: 3345390 - RNA, 16 nt, Mycobacterium tuberculosis H37Rv
gcguccgaaccaccug

SEQ ID NO: 3345391 - RNA, 16 nt, Mycobacterium tuberculosis H37Rv
gcguccgcccagccgc

SEQ ID NO: 3345392 - RNA, 17 nt, Mycobacterium tuberculosis H37Rv
gcguccgcccagccgca

SEQ ID NO: 3345393 - RNA, 13 nt, Mycobacterium tuberculosis H37Rv
gcguccggaacca

SEQ ID NO: 3345394 - RNA, 15 nt, Mycobacterium tuberculosis H37Rv
gcguccgggcagccg

SEQ ID NO: 3345395 - RNA, 16 nt, Mycobacterium tuberculosis H37Rv
gcguccgggcagccgc

SEQ ID NO: 3345396 - RNA, 14 nt, Mycobacterium tuberculosis H37Rv
gcguccggugcacc

SEQ ID NO: 3345397 - RNA, 15 nt, Mycobacterium tuberculosis H37Rv
gcguccggugcuggu

SEQ ID NO: 3345398 - RNA, 19 nt, Mycobacterium tuberculosis H37Rv
gcguccguagcgauucugg

SEQ ID NO: 3345399 - RNA, 15 nt, Mycobacterium tuberculosis H37Rv
gcguccgucggcgaa

SEQ ID NO: 3345400 - RNA, 15 nt, Mycobacterium tuberculosis H37Rv
gcguccgucgucggc

SEQ ID NO: 3345401 - RNA, 12 nt, Mycobacterium tuberculosis H37Rv
gcguccuccucg

SEQ ID NO: 3345402 - RNA, 16 nt, Mycobacterium tuberculosis H37Rv
gcguccuccucggugu

SEQ ID NO: 3345403 - RNA, 16 nt, Mycobacterium tuberculosis H37Rv
gcguccuugcgcagca

SEQ ID NO: 3345404 - RNA, 16 nt, Mycobacterium tuberculosis H37Rv
gcgucgaacacgucgg

SEQ ID NO: 3345405 - RNA, 20 nt, Mycobacterium tuberculosis H37Rv
gcgucgaacacgucgggaug

SEQ ID NO: 3345406 - RNA, 16 nt, Mycobacterium tuberculosis H37Rv
gcgucgaaccagucga

SEQ ID NO: 3345407 - RNA, 19 nt, Mycobacterium tuberculosis H37Rv
gcgucgaacugggcgcccg

SEQ ID NO: 3345408 - RNA, 14 nt, Mycobacterium tuberculosis H37Rv
gcgucgaagccggg

SEQ ID NO: 3345409 - RNA, 15 nt, Mycobacterium tuberculosis H37Rv
gcgucgaagccgggg

SEQ ID NO: 3345410 - RNA, 16 nt, Mycobacterium tuberculosis H37Rv
gcgucgacaacacgcc

SEQ ID NO: 3345411 - RNA, 21 nt, Mycobacterium tuberculosis H37Rv
gcgucgacaacacgccgucga

SEQ ID NO: 3345412 - RNA, 14 nt, Mycobacterium tuberculosis H37Rv
gcgucgacacaccc

SEQ ID NO: 3345413 - RNA, 17 nt, Mycobacterium tuberculosis H37Rv
gcgucgacaucggugac

SEQ ID NO: 3345414 - RNA, 21 nt, Mycobacterium tuberculosis H37Rv
gcgucgaccaagguguccagc

SEQ ID NO: 3345415 - RNA, 15 nt, Mycobacterium tuberculosis H37Rv
gcgucgaccacaggc

SEQ ID NO: 3345416 - RNA, 16 nt, Mycobacterium tuberculosis H37Rv
gcgucgacccagaaca

SEQ ID NO: 3345417 - RNA, 13 nt, Mycobacterium tuberculosis H37Rv
gcgucgacccgaa

SEQ ID NO: 3345418 - RNA, 20 nt, Mycobacterium tuberculosis H37Rv
gcgucgacccugcccagcac

SEQ ID NO: 3345419 - RNA, 21 nt, Mycobacterium tuberculosis H37Rv
gcgucgacccugcccagcacc

SEQ ID NO: 3345420 - RNA, 15 nt, Mycobacterium tuberculosis H37Rv
gcgucgaccggacaa

SEQ ID NO: 3345421 - RNA, 15 nt, Mycobacterium tuberculosis H37Rv
gcgucgacgagcggc

SEQ ID NO: 3345422 - RNA, 14 nt, Mycobacterium tuberculosis H37Rv
gcgucgacgucggc

SEQ ID NO: 3345423 - RNA, 21 nt, Mycobacterium tuberculosis H37Rv
gcgucgacuggccguuucggc

SEQ ID NO: 3345424 - RNA, 23 nt, Mycobacterium tuberculosis H37Rv
gcgucgagcaccuuggggugggc

SEQ ID NO: 3345425 - RNA, 22 nt, Mycobacterium tuberculosis H37Rv
gcgucgagccggauucggcugc

SEQ ID NO: 3345426 - RNA, 14 nt, Mycobacterium tuberculosis H37Rv
gcgucgagcgaccc

SEQ ID NO: 3345427 - RNA, 20 nt, Mycobacterium tuberculosis H37Rv
gcgucgagcgacccccagcg

SEQ ID NO: 3345428 - RNA, 21 nt, Mycobacterium tuberculosis H37Rv
gcgucgagcgacccccagcgc

SEQ ID NO: 3345429 - RNA, 16 nt, Mycobacterium tuberculosis H37Rv
gcgucgagcucguccu

SEQ ID NO: 3345430 - RNA, 16 nt, Mycobacterium tuberculosis H37Rv
gcgucgagggagcgcc

SEQ ID NO: 3345431 - RNA, 15 nt, Mycobacterium tuberculosis H37Rv
gcgucgagguggcgc

SEQ ID NO: 3345432 - RNA, 23 nt, Mycobacterium tuberculosis H37Rv
gcgucgaguuuugcggccagggc

SEQ ID NO: 3345433 - RNA, 24 nt, Mycobacterium tuberculosis H37Rv
gcgucgaguuuugcggccagggcg

SEQ ID NO: 3345434 - RNA, 20 nt, Mycobacterium tuberculosis H37Rv
gcgucgaucacgucgucagc

SEQ ID NO: 3345435 - RNA, 16 nt, Mycobacterium tuberculosis H37Rv
gcgucgaucguuccgc

SEQ ID NO: 3345436 - RNA, 16 nt, Mycobacterium tuberculosis H37Rv
gcgucgaugucgccgc

SEQ ID NO: 3345437 - RNA, 18 nt, Mycobacterium tuberculosis H37Rv
gcgucgaugucgccgccc

SEQ ID NO: 3345438 - RNA, 20 nt, Mycobacterium tuberculosis H37Rv
gcgucgcaacccggccugga

SEQ ID NO: 3345439 - RNA, 17 nt, Mycobacterium tuberculosis H37Rv
gcgucgcaacgcgauca

SEQ ID NO: 3345440 - RNA, 21 nt, Mycobacterium tuberculosis H37Rv
gcgucgcaaggcccgcaccgc

SEQ ID NO: 3345441 - RNA, 16 nt, Mycobacterium tuberculosis H37Rv
gcgucgccgccgggca

SEQ ID NO: 3345442 - RNA, 14 nt, Mycobacterium tuberculosis H37Rv
gcgucgccggccuu

SEQ ID NO: 3345443 - RNA, 20 nt, Mycobacterium tuberculosis H37Rv
gcgucgccggccuugagcac

SEQ ID NO: 3345444 - RNA, 13 nt, Mycobacterium tuberculosis H37Rv
gcgucgccgucga

SEQ ID NO: 3345445 - RNA, 23 nt, Mycobacterium tuberculosis H37Rv
gcgucgcuggugggaucgcagcg

SEQ ID NO: 3345446 - RNA, 19 nt, Mycobacterium tuberculosis H37Rv
gcgucggaauacaacagcu

SEQ ID NO: 3345447 - RNA, 13 nt, Mycobacterium tuberculosis H37Rv
gcgucggccaccg

SEQ ID NO: 3345448 - RNA, 18 nt, Mycobacterium tuberculosis H37Rv
gcgucggcccgcggucgc

SEQ ID NO: 3345449 - RNA, 17 nt, Mycobacterium tuberculosis H37Rv
gcgucggccgcgcugcu

SEQ ID NO: 3345450 - RNA, 13 nt, Mycobacterium tuberculosis H37Rv
gcgucggccggca

SEQ ID NO: 3345451 - RNA, 21 nt, Mycobacterium tuberculosis H37Rv
gcgucggcgaacagacgcaaa

SEQ ID NO: 3345452 - RNA, 12 nt, Mycobacterium tuberculosis H37Rv
gcgucggcgaau

SEQ ID NO: 3345453 - RNA, 13 nt, Mycobacterium tuberculosis H37Rv
gcgucggcgauga

SEQ ID NO: 3345454 - RNA, 17 nt, Mycobacterium tuberculosis H37Rv
gcgucggcgcccagcuc

SEQ ID NO: 3345455 - RNA, 17 nt, Mycobacterium tuberculosis H37Rv
gcgucggcggccaguac

SEQ ID NO: 3345456 - RNA, 15 nt, Mycobacterium tuberculosis H37Rv
gcgucggcugccgcg

SEQ ID NO: 3345457 - RNA, 14 nt, Mycobacterium tuberculosis H37Rv
gcgucgggccgcaa

SEQ ID NO: 3345458 - RNA, 20 nt, Mycobacterium tuberculosis H37Rv
gcgucggucagcugugcgac

SEQ ID NO: 3345459 - RNA, 19 nt, Mycobacterium tuberculosis H37Rv
gcgucggucggguggaucu

SEQ ID NO: 3345460 - RNA, 17 nt, Mycobacterium tuberculosis H37Rv
gcgucggugccaccacg

SEQ ID NO: 3345461 - RNA, 16 nt, Mycobacterium tuberculosis H37Rv
gcgucggugccgcuga

SEQ ID NO: 3345462 - RNA, 15 nt, Mycobacterium tuberculosis H37Rv
gcgucguagaacgug

SEQ ID NO: 3345463 - RNA, 16 nt, Mycobacterium tuberculosis H37Rv
gcgucguagcgcucgu

SEQ ID NO: 3345464 - RNA, 18 nt, Mycobacterium tuberculosis H37Rv
gcgucguauucgaugccg

SEQ ID NO: 3345465 - RNA, 18 nt, Mycobacterium tuberculosis H37Rv
gcgucgucgagucgacaa

SEQ ID NO: 3345466 - RNA, 13 nt, Mycobacterium tuberculosis H37Rv
gcgucgucgaguu

SEQ ID NO: 3345467 - RNA, 19 nt, Mycobacterium tuberculosis H37Rv
gcgucgucgaguuggccau

SEQ ID NO: 3345468 - RNA, 22 nt, Mycobacterium tuberculosis H37Rv
gcgucgucgaugaugccggaca

SEQ ID NO: 3345469 - RNA, 15 nt, Mycobacterium tuberculosis H37Rv
gcgucgucgccggcg

SEQ ID NO: 3345470 - RNA, 19 nt, Mycobacterium tuberculosis H37Rv
gcgucgucugcagaccugu

SEQ ID NO: 3345471 - RNA, 16 nt, Mycobacterium tuberculosis H37Rv
gcgucgugccacuucc

SEQ ID NO: 3345472 - RNA, 21 nt, Mycobacterium tuberculosis H37Rv
gcgucgugccacuuccacggc

SEQ ID NO: 3345473 - RNA, 20 nt, Mycobacterium tuberculosis H37Rv
gcgucgugcgauucacacuc

SEQ ID NO: 3345474 - RNA, 15 nt, Mycobacterium tuberculosis H37Rv
gcgucguggucggcg

SEQ ID NO: 3345475 - RNA, 16 nt, Mycobacterium tuberculosis H37Rv
gcgucguggucggcga

SEQ ID NO: 3345476 - RNA, 13 nt, Mycobacterium tuberculosis H37Rv
gcgucgugguggc

SEQ ID NO: 3345477 - RNA, 16 nt, Mycobacterium tuberculosis H37Rv
gcgucguucgcgggug

SEQ ID NO: 3345478 - RNA, 19 nt, Mycobacterium tuberculosis H37Rv
gcgucguucggagcccuga

SEQ ID NO: 3345479 - RNA, 14 nt, Mycobacterium tuberculosis H37Rv
gcgucguugaggaa

SEQ ID NO: 3345480 - RNA, 15 nt, Mycobacterium tuberculosis H37Rv
gcgugggcauucccg

SEQ ID NO: 3345481 - RNA, 15 nt, Mycobacterium tuberculosis H37Rv
gcgugggcgcggcgc

SEQ ID NO: 3345482 - RNA, 18 nt, Mycobacterium tuberculosis H37Rv
gcgugggcgugagcgcgc

SEQ ID NO: 3345483 - RNA, 20 nt, Mycobacterium tuberculosis H37Rv
gcgugggcgugagcgcgcgc

SEQ ID NO: 3345484 - RNA, 21 nt, Mycobacterium tuberculosis H37Rv
gcgugguacuuucacgcucgu

SEQ ID NO: 3345485 - RNA, 16 nt, Mycobacterium tuberculosis H37Rv
gcgugguauccgccgu

SEQ ID NO: 3345486 - RNA, 18 nt, Mycobacterium tuberculosis H37Rv
gcgugguauccgccguuc

SEQ ID NO: 3345487 - RNA, 23 nt, Mycobacterium tuberculosis H37Rv
gcguggucaccccuucgccagcg

SEQ ID NO: 3345488 - RNA, 22 nt, Mycobacterium tuberculosis H37Rv
gcguggucggcaaagcgcucgu

SEQ ID NO: 3345489 - RNA, 19 nt, Mycobacterium tuberculosis H37Rv
gcguggugaagucggugcc

SEQ ID NO: 3345490 - RNA, 15 nt, Mycobacterium tuberculosis H37Rv
gcguguaccagccca

SEQ ID NO: 3345491 - RNA, 17 nt, Mycobacterium tuberculosis H37Rv
gcguguaccagcccagc

SEQ ID NO: 3345492 - RNA, 15 nt, Mycobacterium tuberculosis H37Rv
gcguguacggcggcu

SEQ ID NO: 3345493 - RNA, 17 nt, Mycobacterium tuberculosis H37Rv
gcguguagguccacaac

SEQ ID NO: 3345494 - RNA, 21 nt, Mycobacterium tuberculosis H37Rv
gcguguaguggcccgcgggca

SEQ ID NO: 3345495 - RNA, 17 nt, Mycobacterium tuberculosis H37Rv
gcguguccgccgaacug

SEQ ID NO: 3345496 - RNA, 17 nt, Mycobacterium tuberculosis H37Rv
gcguguccuuugccacc

SEQ ID NO: 3345497 - RNA, 13 nt, Mycobacterium tuberculosis H37Rv
gcgugucgccgau

SEQ ID NO: 3345498 - RNA, 12 nt, Mycobacterium tuberculosis H37Rv
gcgugucgccgc

SEQ ID NO: 3345499 - RNA, 21 nt, Mycobacterium tuberculosis H37Rv
gcgugucgggggauuucgcgu

SEQ ID NO: 3345500 - RNA, 22 nt, Mycobacterium tuberculosis H37Rv
gcgugucguugccagggcgggc

SEQ ID NO: 3345501 - RNA, 16 nt, Mycobacterium tuberculosis H37Rv
gcgugucugcccgagg

SEQ ID NO: 3345502 - RNA, 15 nt, Mycobacterium tuberculosis H37Rv
gcgugugcgcgugcu

SEQ ID NO: 3345503 - RNA, 12 nt, Mycobacterium tuberculosis H37Rv
gcgugugcucgu

SEQ ID NO: 3345504 - RNA, 16 nt, Mycobacterium tuberculosis H37Rv
gcguguugcguucggu

SEQ ID NO: 3345505 - RNA, 20 nt, Mycobacterium tuberculosis H37Rv
gcguuaaugcuucgcgucga

SEQ ID NO: 3345506 - RNA, 19 nt, Mycobacterium tuberculosis H37Rv
gcguuacccaucgccacac

SEQ ID NO: 3345507 - RNA, 14 nt, Mycobacterium tuberculosis H37Rv
gcguuacgcucggc

SEQ ID NO: 3345508 - RNA, 17 nt, Mycobacterium tuberculosis H37Rv
gcguuagggccgccauc

SEQ ID NO: 3345509 - RNA, 23 nt, Mycobacterium tuberculosis H37Rv
gcguucaacaccgccgaccuagu

SEQ ID NO: 3345510 - RNA, 19 nt, Mycobacterium tuberculosis H37Rv
gcguucaaggucuccagac

SEQ ID NO: 3345511 - RNA, 15 nt, Mycobacterium tuberculosis H37Rv
gcguucaccacgauc

SEQ ID NO: 3345512 - RNA, 19 nt, Mycobacterium tuberculosis H37Rv
gcguucaggaugccaggac

SEQ ID NO: 3345513 - RNA, 22 nt, Mycobacterium tuberculosis H37Rv
gcguucagguguugacgccaac

SEQ ID NO: 3345514 - RNA, 12 nt, Mycobacterium tuberculosis H37Rv
gcguucaucauc

SEQ ID NO: 3345515 - RNA, 16 nt, Mycobacterium tuberculosis H37Rv
gcguuccacacagauc

SEQ ID NO: 3345516 - RNA, 17 nt, Mycobacterium tuberculosis H37Rv
gcguuccagcacaccca

SEQ ID NO: 3345517 - RNA, 14 nt, Mycobacterium tuberculosis H37Rv
gcguucccccacuc

SEQ ID NO: 3345518 - RNA, 20 nt, Mycobacterium tuberculosis H37Rv
gcguuccgaucggcaaucga

SEQ ID NO: 3345519 - RNA, 24 nt, Mycobacterium tuberculosis H37Rv
gcguuccgaucggcaaucgacuca

SEQ ID NO: 3345520 - RNA, 16 nt, Mycobacterium tuberculosis H37Rv
gcguuccgcgacagcg

SEQ ID NO: 3345521 - RNA, 14 nt, Mycobacterium tuberculosis H37Rv
gcguucgaugccac

SEQ ID NO: 3345522 - RNA, 17 nt, Mycobacterium tuberculosis H37Rv
gcguucgccgcccggcg

SEQ ID NO: 3345523 - RNA, 23 nt, Mycobacterium tuberculosis H37Rv
gcguucgccggaauacaccagcg

SEQ ID NO: 3345524 - RNA, 16 nt, Mycobacterium tuberculosis H37Rv
gcguucggcaccuggu

SEQ ID NO: 3345525 - RNA, 22 nt, Mycobacterium tuberculosis H37Rv
gcguucggccgacucggucuca

SEQ ID NO: 3345526 - RNA, 15 nt, Mycobacterium tuberculosis H37Rv
gcguucggccgggcc

SEQ ID NO: 3345527 - RNA, 17 nt, Mycobacterium tuberculosis H37Rv
gcguucggcgagcagcg

SEQ ID NO: 3345528 - RNA, 23 nt, Mycobacterium tuberculosis H37Rv
gcguucggcgcugaucgcgcgca

SEQ ID NO: 3345529 - RNA, 20 nt, Mycobacterium tuberculosis H37Rv
gcguucgggcccguagccga

SEQ ID NO: 3345530 - RNA, 20 nt, Mycobacterium tuberculosis H37Rv
gcguucgucguaguccaggc

SEQ ID NO: 3345531 - RNA, 23 nt, Mycobacterium tuberculosis H37Rv
gcguugacgaucuccgccaaccg

SEQ ID NO: 3345532 - RNA, 14 nt, Mycobacterium tuberculosis H37Rv
gcguugacggcggg

SEQ ID NO: 3345533 - RNA, 15 nt, Mycobacterium tuberculosis H37Rv
gcguugacucugcgu

SEQ ID NO: 3345534 - RNA, 20 nt, Mycobacterium tuberculosis H37Rv
gcguugacucugcguccacc

SEQ ID NO: 3345535 - RNA, 17 nt, Mycobacterium tuberculosis H37Rv
gcguugauacgcgucga

SEQ ID NO: 3345536 - RNA, 22 nt, Mycobacterium tuberculosis H37Rv
gcguugaucgacaucaccaccg

SEQ ID NO: 3345537 - RNA, 17 nt, Mycobacterium tuberculosis H37Rv
gcguugaucgccgggcc

SEQ ID NO: 3345538 - RNA, 14 nt, Mycobacterium tuberculosis H37Rv
gcguugcacagcag

SEQ ID NO: 3345539 - RNA, 15 nt, Mycobacterium tuberculosis H37Rv
gcguugcacagcagc

SEQ ID NO: 3345540 - RNA, 21 nt, Mycobacterium tuberculosis H37Rv
gcguugcacagcagcgguuga

SEQ ID NO: 3345541 - RNA, 17 nt, Mycobacterium tuberculosis H37Rv
gcguugcaccauucgca

SEQ ID NO: 3345542 - RNA, 22 nt, Mycobacterium tuberculosis H37Rv
gcguugcaccauucgcaccggc

SEQ ID NO: 3345543 - RNA, 19 nt, Mycobacterium tuberculosis H37Rv
gcguugcagaccaccagug

SEQ ID NO: 3345544 - RNA, 16 nt, Mycobacterium tuberculosis H37Rv
gcguugccgaaacccg

SEQ ID NO: 3345545 - RNA, 15 nt, Mycobacterium tuberculosis H37Rv
gcguugccgccguug

SEQ ID NO: 3345546 - RNA, 13 nt, Mycobacterium tuberculosis H37Rv
gcguugccggucg

SEQ ID NO: 3345547 - RNA, 22 nt, Mycobacterium tuberculosis H37Rv
gcguugcggaaucagcacccca

SEQ ID NO: 3345548 - RNA, 19 nt, Mycobacterium tuberculosis H37Rv
gcguuggaaaagucgggca

SEQ ID NO: 3345549 - RNA, 18 nt, Mycobacterium tuberculosis H37Rv
gcguuggaucccagcccg

SEQ ID NO: 3345550 - RNA, 22 nt, Mycobacterium tuberculosis H37Rv
gcguuggaugaagucgucggca

SEQ ID NO: 3345551 - RNA, 16 nt, Mycobacterium tuberculosis H37Rv
gcguuggccauggcca

SEQ ID NO: 3345552 - RNA, 16 nt, Mycobacterium tuberculosis H37Rv
gcguuggccccaggau

SEQ ID NO: 3345553 - RNA, 18 nt, Mycobacterium tuberculosis H37Rv
gcguuggccccaggaucg

SEQ ID NO: 3345554 - RNA, 13 nt, Mycobacterium tuberculosis H37Rv
gcguuggcccgcc

SEQ ID NO: 3345555 - RNA, 20 nt, Mycobacterium tuberculosis H37Rv
gcguuggcgaucucgacggc

SEQ ID NO: 3345556 - RNA, 14 nt, Mycobacterium tuberculosis H37Rv
gcguuggggcucgu

SEQ ID NO: 3345557 - RNA, 16 nt, Mycobacterium tuberculosis H37Rv
gcguugguagccaggg

SEQ ID NO: 3345558 - RNA, 14 nt, Mycobacterium tuberculosis H37Rv
gcguugguggucgg

SEQ ID NO: 3345559 - RNA, 20 nt, Mycobacterium tuberculosis H37Rv
gcguugguggucggcccucc

SEQ ID NO: 3345560 - RNA, 18 nt, Mycobacterium tuberculosis H37Rv
gcguuguagcgguccagc

SEQ ID NO: 3345561 - RNA, 19 nt, Mycobacterium tuberculosis H37Rv
gcguuguuaucgaagcccg

SEQ ID NO: 3345562 - RNA, 20 nt, Mycobacterium tuberculosis H37Rv
gcguuguugcggaucgagca

SEQ ID NO: 3345563 - RNA, 21 nt, Mycobacterium tuberculosis H37Rv
gcguuuaucagcaagagccgc

SEQ ID NO: 3345564 - RNA, 17 nt, Mycobacterium tuberculosis H37Rv
gcguuucgucgaccgcg

SEQ ID NO: 3345565 - RNA, 14 nt, Mycobacterium tuberculosis H37Rv
gcguuugccggccg

SEQ ID NO: 3345566 - RNA, 21 nt, Mycobacterium tuberculosis H37Rv
gcguuuucaauuucacugcga

SEQ ID NO: 3345567 - RNA, 13 nt, Mycobacterium tuberculosis H37Rv
gcuaaacccccac

SEQ ID NO: 3345568 - RNA, 19 nt, Mycobacterium tuberculosis H37Rv
gcuaaagcccccgacacgc

SEQ ID NO: 3345569 - RNA, 15 nt, Mycobacterium tuberculosis H37Rv
gcuaacaccgcaggc

SEQ ID NO: 3345570 - RNA, 12 nt, Mycobacterium tuberculosis H37Rv
gcuaaccaugcu

SEQ ID NO: 3345571 - RNA, 17 nt, Mycobacterium tuberculosis H37Rv
gcuaaccgacgcugaag

SEQ ID NO: 3345572 - RNA, 21 nt, Mycobacterium tuberculosis H37Rv
gcuaacgcaccugcgcgcggc

SEQ ID NO: 3345573 - RNA, 20 nt, Mycobacterium tuberculosis H37Rv
gcuaacuccccagacaucca

SEQ ID NO: 3345574 - RNA, 18 nt, Mycobacterium tuberculosis H37Rv
gcuaaggugggcacagcg

SEQ ID NO: 3345575 - RNA, 16 nt, Mycobacterium tuberculosis H37Rv
gcuaauaccugcggau

SEQ ID NO: 3345576 - RNA, 16 nt, Mycobacterium tuberculosis H37Rv
gcuccgauuccgaacu

SEQ ID NO: 3345577 - RNA, 23 nt, Mycobacterium tuberculosis H37Rv
gcuccgauuccgaacuggucgac

SEQ ID NO: 3345578 - RNA, 23 nt, Mycobacterium tuberculosis H37Rv
gcuccgauucuucgaugaugccg

SEQ ID NO: 3345579 - RNA, 13 nt, Mycobacterium tuberculosis H37Rv
gcuccgccagcgc

SEQ ID NO: 3345580 - RNA, 14 nt, Mycobacterium tuberculosis H37Rv
gcuccgccagcgcc

SEQ ID NO: 3345581 - RNA, 13 nt, Mycobacterium tuberculosis H37Rv
gcuccgccgccga

SEQ ID NO: 3345582 - RNA, 18 nt, Mycobacterium tuberculosis H37Rv
gcuccgccgccgacggau

SEQ ID NO: 3345583 - RNA, 22 nt, Mycobacterium tuberculosis H37Rv
gcuccgccggguuggcgccggc

SEQ ID NO: 3345584 - RNA, 19 nt, Mycobacterium tuberculosis H37Rv
gcuccgccugccgcugguc

SEQ ID NO: 3345585 - RNA, 16 nt, Mycobacterium tuberculosis H37Rv
gcuccgcgccgcucau

SEQ ID NO: 3345586 - RNA, 15 nt, Mycobacterium tuberculosis H37Rv
gcuccgcggcgcagc

SEQ ID NO: 3345587 - RNA, 20 nt, Mycobacterium tuberculosis H37Rv
gcuccgcggcgcagcacggc

SEQ ID NO: 3345588 - RNA, 13 nt, Mycobacterium tuberculosis H37Rv
gcuccgcugucac

SEQ ID NO: 3345589 - RNA, 21 nt, Mycobacterium tuberculosis H37Rv
gcuccggacaccccgcacgga

SEQ ID NO: 3345590 - RNA, 22 nt, Mycobacterium tuberculosis H37Rv
gcuccggcccugccgccggccc

SEQ ID NO: 3345591 - RNA, 17 nt, Mycobacterium tuberculosis H37Rv
gcuccggccgcacgccu

SEQ ID NO: 3345592 - RNA, 17 nt, Mycobacterium tuberculosis H37Rv
gcuccggcggcagcggc

SEQ ID NO: 3345593 - RNA, 14 nt, Mycobacterium tuberculosis H37Rv
gcuccggcucgaca

SEQ ID NO: 3345594 - RNA, 20 nt, Mycobacterium tuberculosis H37Rv
gcuccgggaauggcgaccac

SEQ ID NO: 3345595 - RNA, 15 nt, Mycobacterium tuberculosis H37Rv
gcuccgggacgguga

SEQ ID NO: 3345596 - RNA, 21 nt, Mycobacterium tuberculosis H37Rv
gcuccgggaugaagcucgacc

SEQ ID NO: 3345597 - RNA, 15 nt, Mycobacterium tuberculosis H37Rv
gcuccgggucgacga

SEQ ID NO: 3345598 - RNA, 16 nt, Mycobacterium tuberculosis H37Rv
gcuccgggucgacgac

SEQ ID NO: 3345599 - RNA, 20 nt, Mycobacterium tuberculosis H37Rv
gcuccgggugcagaucgccc

SEQ ID NO: 3345600 - RNA, 13 nt, Mycobacterium tuberculosis H37Rv
gcuccggucgggu

SEQ ID NO: 3345601 - RNA, 14 nt, Mycobacterium tuberculosis H37Rv
gcuccgucgcggcc

SEQ ID NO: 3345602 - RNA, 20 nt, Mycobacterium tuberculosis H37Rv
gcuccgugguugccgaagcc

SEQ ID NO: 3345603 - RNA, 21 nt, Mycobacterium tuberculosis H37Rv
gcuccgugguugccgaagccg

SEQ ID NO: 3345604 - RNA, 17 nt, Mycobacterium tuberculosis H37Rv
gcuccguuguccagcgc

SEQ ID NO: 3345605 - RNA, 17 nt, Mycobacterium tuberculosis H37Rv
gcuccucacggauccgc

SEQ ID NO: 3345606 - RNA, 13 nt, Mycobacterium tuberculosis H37Rv
gcuccucagccac

SEQ ID NO: 3345607 - RNA, 19 nt, Mycobacterium tuberculosis H37Rv
gcuccucauagagcggcac

SEQ ID NO: 3345608 - RNA, 20 nt, Mycobacterium tuberculosis H37Rv
gcuccucauagagcggcacc

SEQ ID NO: 3345609 - RNA, 20 nt, Mycobacterium tuberculosis H37Rv
gcuccuccccggcccgcuca

SEQ ID NO: 3345610 - RNA, 15 nt, Mycobacterium tuberculosis H37Rv
gcuccucgcgguagu

SEQ ID NO: 3345611 - RNA, 15 nt, Mycobacterium tuberculosis H37Rv
gcuccucggccagcg

SEQ ID NO: 3345612 - RNA, 16 nt, Mycobacterium tuberculosis H37Rv
gcuccucggccagcgu

SEQ ID NO: 3345613 - RNA, 18 nt, Mycobacterium tuberculosis H37Rv
gcuccucgugcacgcaca

SEQ ID NO: 3345614 - RNA, 19 nt, Mycobacterium tuberculosis H37Rv
gcuccugagguuuggggcc

SEQ ID NO: 3345615 - RNA, 17 nt, Mycobacterium tuberculosis H37Rv
gcuccuguaacugcucc

SEQ ID NO: 3345616 - RNA, 20 nt, Mycobacterium tuberculosis H37Rv
gcuccuucagggcgucgaac

SEQ ID NO: 3345617 - RNA, 15 nt, Mycobacterium tuberculosis H37Rv
gcuccuugaggucac

SEQ ID NO: 3345618 - RNA, 18 nt, Mycobacterium tuberculosis H37Rv
gcuccuugaggucaccca

SEQ ID NO: 3345619 - RNA, 24 nt, Mycobacterium tuberculosis H37Rv
gcuccuuggcuaacaccgcaggca

SEQ ID NO: 3345620 - RNA, 17 nt, Mycobacterium tuberculosis H37Rv
gcucgaaacgcccuugu

SEQ ID NO: 3345621 - RNA, 23 nt, Mycobacterium tuberculosis H37Rv
gcucgaaacggauuggucgaccg

SEQ ID NO: 3345622 - RNA, 15 nt, Mycobacterium tuberculosis H37Rv
gcucgaaauccuggu

SEQ ID NO: 3345623 - RNA, 18 nt, Mycobacterium tuberculosis H37Rv
gcucgaaaucgcacagcg

SEQ ID NO: 3345624 - RNA, 14 nt, Mycobacterium tuberculosis H37Rv
gcucgaacagcucg

SEQ ID NO: 3345625 - RNA, 19 nt, Mycobacterium tuberculosis H37Rv
gcucgaacuccccggucgc

SEQ ID NO: 3345626 - RNA, 19 nt, Mycobacterium tuberculosis H37Rv
gcucgaacucggcggccag

SEQ ID NO: 3345627 - RNA, 12 nt, Mycobacterium tuberculosis H37Rv
gcucgaaggacc

SEQ ID NO: 3345628 - RNA, 21 nt, Mycobacterium tuberculosis H37Rv
gcucgaaggaccggcaccugg

SEQ ID NO: 3345629 - RNA, 11 nt, Mycobacterium tuberculosis H37Rv
gcucgacaacc

SEQ ID NO: 3345630 - RNA, 18 nt, Mycobacterium tuberculosis H37Rv
gcucgacaaccacggcag

SEQ ID NO: 3345631 - RNA, 12 nt, Mycobacterium tuberculosis H37Rv
gcucgacaacug

SEQ ID NO: 3345632 - RNA, 13 nt, Mycobacterium tuberculosis H37Rv
gcucgacaacugc

SEQ ID NO: 3345633 - RNA, 17 nt, Mycobacterium tuberculosis H37Rv
gcucgaccagacgcugc

SEQ ID NO: 3345634 - RNA, 13 nt, Mycobacterium tuberculosis H37Rv
gcucgaccaggaa

SEQ ID NO: 3345635 - RNA, 16 nt, Mycobacterium tuberculosis H37Rv
gcucgaccgcccggcu

SEQ ID NO: 3345636 - RNA, 20 nt, Mycobacterium tuberculosis H37Rv
gcucgaccugaggcaccucg

SEQ ID NO: 3345637 - RNA, 21 nt, Mycobacterium tuberculosis H37Rv
gcucgacgaaugugagcgcgc

SEQ ID NO: 3345638 - RNA, 15 nt, Mycobacterium tuberculosis H37Rv
gcucgacgacgggcg

SEQ ID NO: 3345639 - RNA, 15 nt, Mycobacterium tuberculosis H37Rv
gcucgacgaggccac

SEQ ID NO: 3345640 - RNA, 15 nt, Mycobacterium tuberculosis H37Rv
gcucgagcaccucgg

SEQ ID NO: 3345641 - RNA, 21 nt, Mycobacterium tuberculosis H37Rv
gcucgagcuacgacgaguggu

SEQ ID NO: 3345642 - RNA, 15 nt, Mycobacterium tuberculosis H37Rv
gcucgagguggucuc

SEQ ID NO: 3345643 - RNA, 21 nt, Mycobacterium tuberculosis H37Rv
gcucgaguguggccgaaagcc

SEQ ID NO: 3345644 - RNA, 15 nt, Mycobacterium tuberculosis H37Rv
gcucgauaucguugg

SEQ ID NO: 3345645 - RNA, 19 nt, Mycobacterium tuberculosis H37Rv
gcucgauaucguuggcgac

SEQ ID NO: 3345646 - RNA, 16 nt, Mycobacterium tuberculosis H37Rv
gcucgaucacuagcgc

SEQ ID NO: 3345647 - RNA, 20 nt, Mycobacterium tuberculosis H37Rv
gcucgaucggcagccagggc

SEQ ID NO: 3345648 - RNA, 20 nt, Mycobacterium tuberculosis H37Rv
gcucgaucugcccggugauc

SEQ ID NO: 3345649 - RNA, 20 nt, Mycobacterium tuberculosis H37Rv
gcucgaucugucgcgccggu

SEQ ID NO: 3345650 - RNA, 16 nt, Mycobacterium tuberculosis H37Rv
gcucgaugcgaucgac

SEQ ID NO: 3345651 - RNA, 17 nt, Mycobacterium tuberculosis H37Rv
gcucgaugcgaucgacg

SEQ ID NO: 3345652 - RNA, 17 nt, Mycobacterium tuberculosis H37Rv
gcucgaugucagcggcc

SEQ ID NO: 3345653 - RNA, 23 nt, Mycobacterium tuberculosis H37Rv
gcucgaugucagcggccgcgacg

SEQ ID NO: 3345654 - RNA, 14 nt, Mycobacterium tuberculosis H37Rv
gcucgaugucccga

SEQ ID NO: 3345655 - RNA, 22 nt, Mycobacterium tuberculosis H37Rv
gcucgauguccucgauccgggc

SEQ ID NO: 3345656 - RNA, 16 nt, Mycobacterium tuberculosis H37Rv
gcucgcaaacaagauc

SEQ ID NO: 3345657 - RNA, 16 nt, Mycobacterium tuberculosis H37Rv
gcucgcaaucguuggc

SEQ ID NO: 3345658 - RNA, 12 nt, Mycobacterium tuberculosis H37Rv
gcucgcacagcc

SEQ ID NO: 3345659 - RNA, 21 nt, Mycobacterium tuberculosis H37Rv
gcucgcacucguugccgacca

SEQ ID NO: 3345660 - RNA, 17 nt, Mycobacterium tuberculosis H37Rv
gcucgcagccacgcaaa

SEQ ID NO: 3345661 - RNA, 14 nt, Mycobacterium tuberculosis H37Rv
gcucgcagcgggcg

SEQ ID NO: 3345662 - RNA, 12 nt, Mycobacterium tuberculosis H37Rv
gcucgccagcac

SEQ ID NO: 3345663 - RNA, 14 nt, Mycobacterium tuberculosis H37Rv
gcucgccagccggc

SEQ ID NO: 3345664 - RNA, 14 nt, Mycobacterium tuberculosis H37Rv
gcucgccagcgggg

SEQ ID NO: 3345665 - RNA, 13 nt, Mycobacterium tuberculosis H37Rv
gcucgccaggcaa

SEQ ID NO: 3345666 - RNA, 23 nt, Mycobacterium tuberculosis H37Rv
gcucgccaggcaagccagcacug

SEQ ID NO: 3345667 - RNA, 15 nt, Mycobacterium tuberculosis H37Rv
gcucgccagggucgc

SEQ ID NO: 3345668 - RNA, 14 nt, Mycobacterium tuberculosis H37Rv
gcucgcccagugaa

SEQ ID NO: 3345669 - RNA, 15 nt, Mycobacterium tuberculosis H37Rv
gcucgccccauguca

SEQ ID NO: 3345670 - RNA, 22 nt, Mycobacterium tuberculosis H37Rv
gcucgcccuaaccuaggcgcuc

SEQ ID NO: 3345671 - RNA, 14 nt, Mycobacterium tuberculosis H37Rv
gcucgccgaccagc

SEQ ID NO: 3345672 - RNA, 17 nt, Mycobacterium tuberculosis H37Rv
gcucggucuccaccacc

SEQ ID NO: 3345673 - RNA, 22 nt, Mycobacterium tuberculosis H37Rv
gcucggugacaagcggcccgcu

SEQ ID NO: 3345674 - RNA, 15 nt, Mycobacterium tuberculosis H37Rv
gcucggugacguaga

SEQ ID NO: 3345675 - RNA, 18 nt, Mycobacterium tuberculosis H37Rv
gcucggugaugcccagcg

SEQ ID NO: 3345676 - RNA, 20 nt, Mycobacterium tuberculosis H37Rv
gcucggugaugcccagcgcc

SEQ ID NO: 3345677 - RNA, 16 nt, Mycobacterium tuberculosis H37Rv
gcucggugcacggcgc

SEQ ID NO: 3345678 - RNA, 17 nt, Mycobacterium tuberculosis H37Rv
gcucggugcacggcgcu

SEQ ID NO: 3345679 - RNA, 11 nt, Mycobacterium tuberculosis H37Rv
gcucggugcgc

SEQ ID NO: 3345680 - RNA, 19 nt, Mycobacterium tuberculosis H37Rv
gcucggugcugcgccgaua

SEQ ID NO: 3345681 - RNA, 19 nt, Mycobacterium tuberculosis H37Rv
gcucgguggcaucggcggc

SEQ ID NO: 3345682 - RNA, 18 nt, Mycobacterium tuberculosis H37Rv
gcucgguggcggacggcg

SEQ ID NO: 3345683 - RNA, 20 nt, Mycobacterium tuberculosis H37Rv
gcucgguuugcguccuggug

SEQ ID NO: 3345684 - RNA, 17 nt, Mycobacterium tuberculosis H37Rv
gcucguagacuugcugc

SEQ ID NO: 3345685 - RNA, 14 nt, Mycobacterium tuberculosis H37Rv
gcucguagagguca

SEQ ID NO: 3345686 - RNA, 17 nt, Mycobacterium tuberculosis H37Rv
gcucguagcggcggcgc

SEQ ID NO: 3345687 - RNA, 14 nt, Mycobacterium tuberculosis H37Rv
gcucguagcuggug

SEQ ID NO: 3345688 - RNA, 21 nt, Mycobacterium tuberculosis H37Rv
gcucgucacgugucccgcaug

SEQ ID NO: 3345689 - RNA, 23 nt, Mycobacterium tuberculosis H37Rv
gcucgucacgugucccgcaugca

SEQ ID NO: 3345690 - RNA, 20 nt, Mycobacterium tuberculosis H37Rv
gcucguccaagccggccacg

SEQ ID NO: 3345691 - RNA, 23 nt, Mycobacterium tuberculosis H37Rv
gcucguccagcgagcgcagcacg

SEQ ID NO: 3345692 - RNA, 14 nt, Mycobacterium tuberculosis H37Rv
gcucguccucgucu

SEQ ID NO: 3345693 - RNA, 22 nt, Mycobacterium tuberculosis H37Rv
gcucguccucgucuucgucggu

SEQ ID NO: 3345694 - RNA, 18 nt, Mycobacterium tuberculosis H37Rv
gcucgucgaacauggcac

SEQ ID NO: 3345695 - RNA, 14 nt, Mycobacterium tuberculosis H37Rv
gcucgucgagcaug

SEQ ID NO: 3345696 - RNA, 13 nt, Mycobacterium tuberculosis H37Rv
gcucgucgagccg

SEQ ID NO: 3345697 - RNA, 21 nt, Mycobacterium tuberculosis H37Rv
gcucgucgagcgcgucgguca

SEQ ID NO: 3345698 - RNA, 22 nt, Mycobacterium tuberculosis H37Rv
gcucgucgagcgcgucggucac

SEQ ID NO: 3345699 - RNA, 13 nt, Mycobacterium tuberculosis H37Rv
gcucgucgagcug

SEQ ID NO: 3345700 - RNA, 16 nt, Mycobacterium tuberculosis H37Rv
gcucgucgaucuccuc

SEQ ID NO: 3345701 - RNA, 17 nt, Mycobacterium tuberculosis H37Rv
gcucgucgccugcgacu

SEQ ID NO: 3345702 - RNA, 22 nt, Mycobacterium tuberculosis H37Rv
gcucgucgcggcccgcgaauac

SEQ ID NO: 3345703 - RNA, 23 nt, Mycobacterium tuberculosis H37Rv
gcucgucgcugaacagacggcuc

SEQ ID NO: 3345704 - RNA, 14 nt, Mycobacterium tuberculosis H37Rv
gcucgucggcgaug

SEQ ID NO: 3345705 - RNA, 21 nt, Mycobacterium tuberculosis H37Rv
gcucgucggcgauggccagca

SEQ ID NO: 3345706 - RNA, 23 nt, Mycobacterium tuberculosis H37Rv
gcucgucggcgauggccagcacg

SEQ ID NO: 3345707 - RNA, 14 nt, Mycobacterium tuberculosis H37Rv
gcucgucggucacc

SEQ ID NO: 3345708 - RNA, 20 nt, Mycobacterium tuberculosis H37Rv
gcucgucggucaccgaaugc

SEQ ID NO: 3345709 - RNA, 17 nt, Mycobacterium tuberculosis H37Rv
gcucgucgucgauccag

SEQ ID NO: 3345710 - RNA, 18 nt, Mycobacterium tuberculosis H37Rv
gcucgucgucgauccagc

SEQ ID NO: 3345711 - RNA, 20 nt, Mycobacterium tuberculosis H37Rv
gcucgucgucgauccagccc

SEQ ID NO: 3345712 - RNA, 15 nt, Mycobacterium tuberculosis H37Rv
gcucgucgucggcgu

SEQ ID NO: 3345713 - RNA, 15 nt, Mycobacterium tuberculosis H37Rv
gcucgucgugaguca

SEQ ID NO: 3345714 - RNA, 15 nt, Mycobacterium tuberculosis H37Rv
gcucgucuugggccg

SEQ ID NO: 3345715 - RNA, 20 nt, Mycobacterium tuberculosis H37Rv
gcucgugagccccagcgacg

SEQ ID NO: 3345716 - RNA, 19 nt, Mycobacterium tuberculosis H37Rv
gcucgugaucuucggcgau

SEQ ID NO: 3345717 - RNA, 20 nt, Mycobacterium tuberculosis H37Rv
gcucgugaucuucggcgauc

SEQ ID NO: 3345718 - RNA, 19 nt, Mycobacterium tuberculosis H37Rv
gcucgugcacgcugagccg

SEQ ID NO: 3345719 - RNA, 18 nt, Mycobacterium tuberculosis H37Rv
gcucguggguaccgagca

SEQ ID NO: 3345720 - RNA, 17 nt, Mycobacterium tuberculosis H37Rv
gcucguuacgccgagca

SEQ ID NO: 3345721 - RNA, 19 nt, Mycobacterium tuberculosis H37Rv
gcucguuagcggcgggcac

SEQ ID NO: 3345722 - RNA, 12 nt, Mycobacterium tuberculosis H37Rv
gcucguucaccg

SEQ ID NO: 3345723 - RNA, 21 nt, Mycobacterium tuberculosis H37Rv
gcucguucaccgcagcgggug

SEQ ID NO: 3345724 - RNA, 12 nt, Mycobacterium tuberculosis H37Rv
gcucguugcguu

SEQ ID NO: 3345725 - RNA, 18 nt, Mycobacterium tuberculosis H37Rv
gcucguuugcgagcaggg

SEQ ID NO: 3345726 - RNA, 16 nt, Mycobacterium tuberculosis H37Rv
gcucucacgagcggcg

SEQ ID NO: 3345727 - RNA, 13 nt, Mycobacterium tuberculosis H37Rv
gcucucagcgaca

SEQ ID NO: 3345728 - RNA, 17 nt, Mycobacterium tuberculosis H37Rv
gcucucauagcgacggc

SEQ ID NO: 3345729 - RNA, 14 nt, Mycobacterium tuberculosis H37Rv
gcucucgaguccag

SEQ ID NO: 3345730 - RNA, 17 nt, Mycobacterium tuberculosis H37Rv
gcucucgaguccaggca

SEQ ID NO: 3345731 - RNA, 18 nt, Mycobacterium tuberculosis H37Rv
gcucucgaguccaggcag

SEQ ID NO: 3345732 - RNA, 20 nt, Mycobacterium tuberculosis H37Rv
gcucucgaguccaggcagcu

SEQ ID NO: 3345733 - RNA, 22 nt, Mycobacterium tuberculosis H37Rv
gcucucgcucgugcacgcugag

SEQ ID NO: 3345734 - RNA, 16 nt, Mycobacterium tuberculosis H37Rv
gcucucggcacccggc

SEQ ID NO: 3345735 - RNA, 13 nt, Mycobacterium tuberculosis H37Rv
gcucucggcgaau

SEQ ID NO: 3345736 - RNA, 16 nt, Mycobacterium tuberculosis H37Rv
gcucucggucaguucc

SEQ ID NO: 3345737 - RNA, 21 nt, Mycobacterium tuberculosis H37Rv
gcucucggucaguuccucuac

SEQ ID NO: 3345738 - RNA, 18 nt, Mycobacterium tuberculosis H37Rv
gcucucggucugcaugcg

SEQ ID NO: 3345739 - RNA, 18 nt, Mycobacterium tuberculosis H37Rv
gcucucggugguccagcg

SEQ ID NO: 3345740 - RNA, 18 nt, Mycobacterium tuberculosis H37Rv
gcucucguggauggccgc

SEQ ID NO: 3345741 - RNA, 22 nt, Mycobacterium tuberculosis H37Rv
gcucucguggauggccgccagg

SEQ ID NO: 3345742 - RNA, 17 nt, Mycobacterium tuberculosis H37Rv
gcucucuucgcgcgcug

SEQ ID NO: 3345743 - RNA, 19 nt, Mycobacterium tuberculosis H37Rv
gcucucuucgcgcgcuggg

SEQ ID NO: 3345744 - RNA, 20 nt, Mycobacterium tuberculosis H37Rv
gcucugagcuuggucgccgg

SEQ ID NO: 3345745 - RNA, 16 nt, Mycobacterium tuberculosis H37Rv
gcucugaggucaccgg

SEQ ID NO: 3345746 - RNA, 18 nt, Mycobacterium tuberculosis H37Rv
gcucugaggucaccggcg

SEQ ID NO: 3345747 - RNA, 22 nt, Mycobacterium tuberculosis H37Rv
gcucugaugguguacacgucgc

SEQ ID NO: 3345748 - RNA, 18 nt, Mycobacterium tuberculosis H37Rv
gcucugcgccacagcagc

SEQ ID NO: 3345749 - RNA, 15 nt, Mycobacterium tuberculosis H37Rv
gcucugcugccagcc

SEQ ID NO: 3345750 - RNA, 23 nt, Mycobacterium tuberculosis H37Rv
gcucugguuuuacacaccagcgg

SEQ ID NO: 3345751 - RNA, 22 nt, Mycobacterium tuberculosis H37Rv
gcucuguagcgucgcacccagg

SEQ ID NO: 3345752 - RNA, 17 nt, Mycobacterium tuberculosis H37Rv
gcucugugucgccgauc

SEQ ID NO: 3345753 - RNA, 20 nt, Mycobacterium tuberculosis H37Rv
gcucuucgcagcgguggucg

SEQ ID NO: 3345754 - RNA, 14 nt, Mycobacterium tuberculosis H37Rv
gcucuugcgggcag

SEQ ID NO: 3345755 - RNA, 22 nt, Mycobacterium tuberculosis H37Rv
gcucuugcgggcagccgcccgc

SEQ ID NO: 3345756 - RNA, 14 nt, Mycobacterium tuberculosis H37Rv
gcucuuugagugcc

SEQ ID NO: 3345757 - RNA, 17 nt, Mycobacterium tuberculosis H37Rv
gcugaaaauaggccggg

SEQ ID NO: 3345758 - RNA, 20 nt, Mycobacterium tuberculosis H37Rv
gcugaaauaagggccggcgg

SEQ ID NO: 3345759 - RNA, 15 nt, Mycobacterium tuberculosis H37Rv
gcugaacacgaaucc

SEQ ID NO: 3345760 - RNA, 23 nt, Mycobacterium tuberculosis H37Rv
gcugaacagacggcucagcgugc

SEQ ID NO: 3345761 - RNA, 19 nt, Mycobacterium tuberculosis H37Rv
gcugaacauuccggcaccu

SEQ ID NO: 3345762 - RNA, 15 nt, Mycobacterium tuberculosis H37Rv
gcugaacggcagccg

SEQ ID NO: 3345763 - RNA, 21 nt, Mycobacterium tuberculosis H37Rv
gcugaagacgaauaacgccgc

SEQ ID NO: 3345764 - RNA, 23 nt, Mycobacterium tuberculosis H37Rv
gcugaagccaggauugccgccgu

SEQ ID NO: 3345765 - RNA, 19 nt, Mycobacterium tuberculosis H37Rv
gcugaagccgacgauccac

SEQ ID NO: 3345766 - RNA, 19 nt, Mycobacterium tuberculosis H37Rv
gcugaagccgcuggaaguc

SEQ ID NO: 3345767 - RNA, 18 nt, Mycobacterium tuberculosis H37Rv
gcugaagcuguaggcgac

SEQ ID NO: 3345768 - RNA, 14 nt, Mycobacterium tuberculosis H37Rv
gcugaaggacggca

SEQ ID NO: 3345769 - RNA, 21 nt, Mycobacterium tuberculosis H37Rv
gcugaaguggcacaagcuggg

SEQ ID NO: 3345770 - RNA, 21 nt, Mycobacterium tuberculosis H37Rv
gcugaaucaucaucgggaucg

SEQ ID NO: 3345771 - RNA, 13 nt, Mycobacterium tuberculosis H37Rv
gcugaaucguucu

SEQ ID NO: 3345772 - RNA, 22 nt, Mycobacterium tuberculosis H37Rv
gcugaaugcuugcgcagcaccg

SEQ ID NO: 3345773 - RNA, 16 nt, Mycobacterium tuberculosis H37Rv
gcugaauucggcgagc

SEQ ID NO: 3345774 - RNA, 18 nt, Mycobacterium tuberculosis H37Rv
gcugaauuggcgccgaug

SEQ ID NO: 3345775 - RNA, 23 nt, Mycobacterium tuberculosis H37Rv
gcugacaccgauccggccgccga

SEQ ID NO: 3345776 - RNA, 19 nt, Mycobacterium tuberculosis H37Rv
gcugacacgacaugaccga

SEQ ID NO: 3345777 - RNA, 22 nt, Mycobacterium tuberculosis H37Rv
gcugaccaugaccgggcuggcc

SEQ ID NO: 3345778 - RNA, 18 nt, Mycobacterium tuberculosis H37Rv
gcugacccauggucacca

SEQ ID NO: 3345779 - RNA, 17 nt, Mycobacterium tuberculosis H37Rv
gcugaccccgccggcug

SEQ ID NO: 3345780 - RNA, 21 nt, Mycobacterium tuberculosis H37Rv
gcugaccccgccggcugcgga

SEQ ID NO: 3345781 - RNA, 14 nt, Mycobacterium tuberculosis H37Rv
gcugaccccggcag

SEQ ID NO: 3345782 - RNA, 17 nt, Mycobacterium tuberculosis H37Rv
gcugacccgccgacgac

SEQ ID NO: 3345783 - RNA, 17 nt, Mycobacterium tuberculosis H37Rv
gcugaccgacccggacc

SEQ ID NO: 3345784 - RNA, 17 nt, Mycobacterium tuberculosis H37Rv
gcugaccgcguagacca

SEQ ID NO: 3345785 - RNA, 16 nt, Mycobacterium tuberculosis H37Rv
gcugaccguggcgccg

SEQ ID NO: 3345786 - RNA, 20 nt, Mycobacterium tuberculosis H37Rv
gcugaccguggcgccggucg

SEQ ID NO: 3345787 - RNA, 22 nt, Mycobacterium tuberculosis H37Rv
gcugaccguuucgaucucgagc

SEQ ID NO: 3345788 - RNA, 14 nt, Mycobacterium tuberculosis H37Rv
gcugaccucccacc

SEQ ID NO: 3345789 - RNA, 20 nt, Mycobacterium tuberculosis H37Rv
gcugaccugcaugggcagcu

SEQ ID NO: 3345790 - RNA, 16 nt, Mycobacterium tuberculosis H37Rv
gcugaccuucaggccc

SEQ ID NO: 3345791 - RNA, 16 nt, Mycobacterium tuberculosis H37Rv
gcugaccuucucacgc

SEQ ID NO: 3345792 - RNA, 19 nt, Mycobacterium tuberculosis H37Rv
gcugaccuuguugaccacc

SEQ ID NO: 3345793 - RNA, 16 nt, Mycobacterium tuberculosis H37Rv
gcugacgauggccagg

SEQ ID NO: 3345794 - RNA, 17 nt, Mycobacterium tuberculosis H37Rv
gcugacgggccgcugug

SEQ ID NO: 3345795 - RNA, 19 nt, Mycobacterium tuberculosis H37Rv
gcugacgguuugcggagca

SEQ ID NO: 3345796 - RNA, 18 nt, Mycobacterium tuberculosis H37Rv
gcugacgugucggcugcu

SEQ ID NO: 3345797 - RNA, 18 nt, Mycobacterium tuberculosis H37Rv
gcugacuagggucaccga

SEQ ID NO: 3345798 - RNA, 19 nt, Mycobacterium tuberculosis H37Rv
gcugagaugggccacccgc

SEQ ID NO: 3345799 - RNA, 22 nt, Mycobacterium tuberculosis H37Rv
gcugagcacucaugaugccgga

SEQ ID NO: 3345800 - RNA, 11 nt, Mycobacterium tuberculosis H37Rv
gcugagcagcg

SEQ ID NO: 3345801 - RNA, 17 nt, Mycobacterium tuberculosis H37Rv
gcugagcagcgccgcgu

SEQ ID NO: 3345802 - RNA, 20 nt, Mycobacterium tuberculosis H37Rv
gcugagcagcgcggccagag

SEQ ID NO: 3345803 - RNA, 14 nt, Mycobacterium tuberculosis H37Rv
gcugagccccccga

SEQ ID NO: 3345804 - RNA, 16 nt, Mycobacterium tuberculosis H37Rv
gcugagcccgccgcga

SEQ ID NO: 3345805 - RNA, 20 nt, Mycobacterium tuberculosis H37Rv
gcugagcccguuuccucagc

SEQ ID NO: 3345806 - RNA, 16 nt, Mycobacterium tuberculosis H37Rv
gcugagccgcucaucg

SEQ ID NO: 3345807 - RNA, 16 nt, Mycobacterium tuberculosis H37Rv
gcugagccggucgcgc

SEQ ID NO: 3345808 - RNA, 17 nt, Mycobacterium tuberculosis H37Rv
gcugagccgucggcgcc

SEQ ID NO: 3345809 - RNA, 13 nt, Mycobacterium tuberculosis H37Rv
gcugagcggacuc

SEQ ID NO: 3345810 - RNA, 17 nt, Mycobacterium tuberculosis H37Rv
gcugagcggccggcaug

SEQ ID NO: 3345811 - RNA, 13 nt, Mycobacterium tuberculosis H37Rv
gcugagcgggcaa

SEQ ID NO: 3345812 - RNA, 18 nt, Mycobacterium tuberculosis H37Rv
gcugagcguaggccagcg

SEQ ID NO: 3345813 - RNA, 11 nt, Mycobacterium tuberculosis H37Rv
gcugagcucga

SEQ ID NO: 3345814 - RNA, 18 nt, Mycobacterium tuberculosis H37Rv
gcugagcugcucgccggc

SEQ ID NO: 3345815 - RNA, 19 nt, Mycobacterium tuberculosis H37Rv
gcugagcugcucgccggcc

SEQ ID NO: 3345816 - RNA, 22 nt, Mycobacterium tuberculosis H37Rv
gcugagcugcucgccggccaac

SEQ ID NO: 3345817 - RNA, 15 nt, Mycobacterium tuberculosis H37Rv
gcugaggaacgccgg

SEQ ID NO: 3345818 - RNA, 17 nt, Mycobacterium tuberculosis H37Rv
gcugaggaagcggcggc

SEQ ID NO: 3345819 - RNA, 18 nt, Mycobacterium tuberculosis H37Rv
gcugaggaagcggcggca

SEQ ID NO: 3345820 - RNA, 20 nt, Mycobacterium tuberculosis H37Rv
gcugaggaagcggcggcaac

SEQ ID NO: 3345821 - RNA, 19 nt, Mycobacterium tuberculosis H37Rv
gcugaguccccaggugggc

SEQ ID NO: 3345822 - RNA, 20 nt, Mycobacterium tuberculosis H37Rv
gcugaguccccaggugggca

SEQ ID NO: 3345823 - RNA, 22 nt, Mycobacterium tuberculosis H37Rv
gcugaguccccaggugggcagc

SEQ ID NO: 3345824 - RNA, 23 nt, Mycobacterium tuberculosis H37Rv
gcugaguccccaggugggcagca

SEQ ID NO: 3345825 - RNA, 24 nt, Mycobacterium tuberculosis H37Rv
gcugagucgguucagccacgcagc

SEQ ID NO: 3345826 - RNA, 20 nt, Mycobacterium tuberculosis H37Rv
gcugauagcggucggucacc

SEQ ID NO: 3345827 - RNA, 16 nt, Mycobacterium tuberculosis H37Rv
gcugaucaggucuucg

SEQ ID NO: 3345828 - RNA, 22 nt, Mycobacterium tuberculosis H37Rv
gcugaucaggucuucgauggcc

SEQ ID NO: 3345829 - RNA, 12 nt, Mycobacterium tuberculosis H37Rv
gcugauccaagu

SEQ ID NO: 3345830 - RNA, 22 nt, Mycobacterium tuberculosis H37Rv
gcugauccacgauaucgaugcg

SEQ ID NO: 3345831 - RNA, 16 nt, Mycobacterium tuberculosis H37Rv
gcugaucccggccagg

SEQ ID NO: 3345832 - RNA, 17 nt, Mycobacterium tuberculosis H37Rv
gcugaucccggccaggc

SEQ ID NO: 3345833 - RNA, 16 nt, Mycobacterium tuberculosis H37Rv
gcugauccgggcgccg

SEQ ID NO: 3345834 - RNA, 20 nt, Mycobacterium tuberculosis H37Rv
gcugauccggucggccagca

SEQ ID NO: 3345835 - RNA, 15 nt, Mycobacterium tuberculosis H37Rv
gcugaucgccgacaa

SEQ ID NO: 3345836 - RNA, 23 nt, Mycobacterium tuberculosis H37Rv
gcugaucgccgacaauggcagcg

SEQ ID NO: 3345837 - RNA, 15 nt, Mycobacterium tuberculosis H37Rv
gcugaucgcgcgcac

SEQ ID NO: 3345838 - RNA, 15 nt, Mycobacterium tuberculosis H37Rv
gcugaucuugccgcc

SEQ ID NO: 3345839 - RNA, 22 nt, Mycobacterium tuberculosis H37Rv
gcugaucuuggcaagccaagcg

SEQ ID NO: 3345840 - RNA, 19 nt, Mycobacterium tuberculosis H37Rv
gcugaugaaacgccgucgc

SEQ ID NO: 3345841 - RNA, 21 nt, Mycobacterium tuberculosis H37Rv
gcugaugccgucuuugucacg

SEQ ID NO: 3345842 - RNA, 18 nt, Mycobacterium tuberculosis H37Rv
gcugauguacccggcgac

SEQ ID NO: 3345843 - RNA, 14 nt, Mycobacterium tuberculosis H37Rv
gcugaugucgccgg

SEQ ID NO: 3345844 - RNA, 14 nt, Mycobacterium tuberculosis H37Rv
gcugauugcgaccg

SEQ ID NO: 3345845 - RNA, 23 nt, Mycobacterium tuberculosis H37Rv
gcugauugcgaccgcgccaacag

SEQ ID NO: 3345846 - RNA, 22 nt, Mycobacterium tuberculosis H37Rv
gcugauuggcccaccgccguug

SEQ ID NO: 3345847 - RNA, 20 nt, Mycobacterium tuberculosis H37Rv
gcugcaaaucgucgaugguc

SEQ ID NO: 3345848 - RNA, 22 nt, Mycobacterium tuberculosis H37Rv
gcugcaaccgacuucgauggug

SEQ ID NO: 3345849 - RNA, 23 nt, Mycobacterium tuberculosis H37Rv
gcugcaacgauugaacucuggug

SEQ ID NO: 3345850 - RNA, 23 nt, Mycobacterium tuberculosis H37Rv
gcugcaauagccuuacgcgggug

SEQ ID NO: 3345851 - RNA, 15 nt, Mycobacterium tuberculosis H37Rv
gcugcaaugacugga

SEQ ID NO: 3345852 - RNA, 17 nt, Mycobacterium tuberculosis H37Rv
gcugcaaugacuggacc

SEQ ID NO: 3345853 - RNA, 14 nt, Mycobacterium tuberculosis H37Rv
gcugcaccagcugc

SEQ ID NO: 3345854 - RNA, 22 nt, Mycobacterium tuberculosis H37Rv
gcugcacccggagaaucggucc

SEQ ID NO: 3345855 - RNA, 21 nt, Mycobacterium tuberculosis H37Rv
gcugcaccggcuugggccagg

SEQ ID NO: 3345856 - RNA, 18 nt, Mycobacterium tuberculosis H37Rv
gcugcaccgucagcccga

SEQ ID NO: 3345857 - RNA, 15 nt, Mycobacterium tuberculosis H37Rv
gcugcaccguuuccg

SEQ ID NO: 3345858 - RNA, 22 nt, Mycobacterium tuberculosis H37Rv
gcugcaccuccgacggccgcgg

SEQ ID NO: 3345859 - RNA, 13 nt, Mycobacterium tuberculosis H37Rv
gcugcacgcucgu

SEQ ID NO: 3345860 - RNA, 13 nt, Mycobacterium tuberculosis H37Rv
gcugcacguggcc

SEQ ID NO: 3345861 - RNA, 15 nt, Mycobacterium tuberculosis H37Rv
gcugcagaaaggcca

SEQ ID NO: 3345862 - RNA, 19 nt, Mycobacterium tuberculosis H37Rv
gcugcggguagccgucgau

SEQ ID NO: 3345863 - RNA, 23 nt, Mycobacterium tuberculosis H37Rv
gcugcggguagccgucgaucccg

SEQ ID NO: 3345864 - RNA, 16 nt, Mycobacterium tuberculosis H37Rv
gcugcgggucagcgcc

SEQ ID NO: 3345865 - RNA, 17 nt, Mycobacterium tuberculosis H37Rv
gcugcgggucucgccga

SEQ ID NO: 3345866 - RNA, 20 nt, Mycobacterium tuberculosis H37Rv
gcugcggucgaacaucaucg

SEQ ID NO: 3345867 - RNA, 12 nt, Mycobacterium tuberculosis H37Rv
gcugcggugccg

SEQ ID NO: 3345868 - RNA, 16 nt, Mycobacterium tuberculosis H37Rv
gcugcggugccggccc

SEQ ID NO: 3345869 - RNA, 17 nt, Mycobacterium tuberculosis H37Rv
gcugcggugccggcccu

SEQ ID NO: 3345870 - RNA, 19 nt, Mycobacterium tuberculosis H37Rv
gcugcggugccggcccugc

SEQ ID NO: 3345871 - RNA, 14 nt, Mycobacterium tuberculosis H37Rv
gcugcguccggaac

SEQ ID NO: 3345872 - RNA, 20 nt, Mycobacterium tuberculosis H37Rv
gcugcgucgucugcagaccu

SEQ ID NO: 3345873 - RNA, 19 nt, Mycobacterium tuberculosis H37Rv
gcugcguggcgaaccaggg

SEQ ID NO: 3345874 - RNA, 23 nt, Mycobacterium tuberculosis H37Rv
gcugcguggcgaaccaggggucg

SEQ ID NO: 3345875 - RNA, 14 nt, Mycobacterium tuberculosis H37Rv
gcugcguucgccgg

SEQ ID NO: 3345876 - RNA, 16 nt, Mycobacterium tuberculosis H37Rv
gcugcguucgccggaa

SEQ ID NO: 3345877 - RNA, 17 nt, Mycobacterium tuberculosis H37Rv
gcugcuagcccggcggc

SEQ ID NO: 3345878 - RNA, 14 nt, Mycobacterium tuberculosis H37Rv
gcugcuaugggucg

SEQ ID NO: 3345879 - RNA, 18 nt, Mycobacterium tuberculosis H37Rv
gcugcucaucgcgcccgc

SEQ ID NO: 3345880 - RNA, 22 nt, Mycobacterium tuberculosis H37Rv
gcugcucaucgcgcccgccauc

SEQ ID NO: 3345881 - RNA, 12 nt, Mycobacterium tuberculosis H37Rv
gcugcuccugga

SEQ ID NO: 3345882 - RNA, 14 nt, Mycobacterium tuberculosis H37Rv
gcugcuccuggaag

SEQ ID NO: 3345883 - RNA, 14 nt, Mycobacterium tuberculosis H37Rv
gcugcucgccggcc

SEQ ID NO: 3345884 - RNA, 23 nt, Mycobacterium tuberculosis H37Rv
gcugcucggucaggcggcuggcc

SEQ ID NO: 3345885 - RNA, 14 nt, Mycobacterium tuberculosis H37Rv
gcugcucgucgucg

SEQ ID NO: 3345886 - RNA, 19 nt, Mycobacterium tuberculosis H37Rv
gcugcucgucgugagacug

SEQ ID NO: 3345887 - RNA, 17 nt, Mycobacterium tuberculosis H37Rv
gcugcucgugagcccca

SEQ ID NO: 3345888 - RNA, 22 nt, Mycobacterium tuberculosis H37Rv
gcugcucgugagccccagcgac

SEQ ID NO: 3345889 - RNA, 17 nt, Mycobacterium tuberculosis H37Rv
gcugcucugagcuuggu

SEQ ID NO: 3345890 - RNA, 19 nt, Mycobacterium tuberculosis H37Rv
gcugcucugagcuuggucg

SEQ ID NO: 3345891 - RNA, 22 nt, Mycobacterium tuberculosis H37Rv
gcugcucugagcuuggucgccg

SEQ ID NO: 3345892 - RNA, 20 nt, Mycobacterium tuberculosis H37Rv
gcugcugaugcgguagucgc

SEQ ID NO: 3345893 - RNA, 14 nt, Mycobacterium tuberculosis H37Rv
gcugcugcagcgau

SEQ ID NO: 3345894 - RNA, 14 nt, Mycobacterium tuberculosis H37Rv
gcugcugccgcacc

SEQ ID NO: 3345895 - RNA, 19 nt, Mycobacterium tuberculosis H37Rv
gcugcugccgcaccggugc

SEQ ID NO: 3345896 - RNA, 18 nt, Mycobacterium tuberculosis H37Rv
gcugcugccguggcggca

SEQ ID NO: 3345897 - RNA, 15 nt, Mycobacterium tuberculosis H37Rv
gcugcugcgcggugc

SEQ ID NO: 3345898 - RNA, 17 nt, Mycobacterium tuberculosis H37Rv
gcugcugcgcggugccg

SEQ ID NO: 3345899 - RNA, 17 nt, Mycobacterium tuberculosis H37Rv
gcugcuggcaugcaggu

SEQ ID NO: 3345900 - RNA, 16 nt, Mycobacterium tuberculosis H37Rv
gcugcuggcgcgccug

SEQ ID NO: 3345901 - RNA, 17 nt, Mycobacterium tuberculosis H37Rv
gcugcuggucuugccgu

SEQ ID NO: 3345902 - RNA, 20 nt, Mycobacterium tuberculosis H37Rv
gcugcugucgauuucgccgu

SEQ ID NO: 3345903 - RNA, 21 nt, Mycobacterium tuberculosis H37Rv
gcugcuucuucggacagcagc

SEQ ID NO: 3345904 - RNA, 22 nt, Mycobacterium tuberculosis H37Rv
gcugcuuggucgcccagccacu

SEQ ID NO: 3345905 - RNA, 19 nt, Mycobacterium tuberculosis H37Rv
gcuggaacuuggcgucgac

SEQ ID NO: 3345906 - RNA, 16 nt, Mycobacterium tuberculosis H37Rv
gcuggaagucggucug

SEQ ID NO: 3345907 - RNA, 22 nt, Mycobacterium tuberculosis H37Rv
gcuggaaucgaaaaggugcacc

SEQ ID NO: 3345908 - RNA, 14 nt, Mycobacterium tuberculosis H37Rv
gcuggacccgcaug

SEQ ID NO: 3345909 - RNA, 13 nt, Mycobacterium tuberculosis H37Rv
gcuggacggcggg

SEQ ID NO: 3345910 - RNA, 14 nt, Mycobacterium tuberculosis H37Rv
gcuggacggcgggc

SEQ ID NO: 3345911 - RNA, 22 nt, Mycobacterium tuberculosis H37Rv
gcuggacggcgggccgcgcggc

SEQ ID NO: 3345912 - RNA, 21 nt, Mycobacterium tuberculosis H37Rv
gcuggacuaucgccgcgcguc

SEQ ID NO: 3345913 - RNA, 15 nt, Mycobacterium tuberculosis H37Rv
gcuggacuccgguca

SEQ ID NO: 3345914 - RNA, 18 nt, Mycobacterium tuberculosis H37Rv
gcuggacuccggucagcg

SEQ ID NO: 3345915 - RNA, 16 nt, Mycobacterium tuberculosis H37Rv
gcuggagcagcuaccg

SEQ ID NO: 3345916 - RNA, 20 nt, Mycobacterium tuberculosis H37Rv
gcuggaggugaacucguuca

SEQ ID NO: 3345917 - RNA, 16 nt, Mycobacterium tuberculosis H37Rv
gcuggaguaggugugc

SEQ ID NO: 3345918 - RNA, 19 nt, Mycobacterium tuberculosis H37Rv
gcuggaguaggugugcggg

SEQ ID NO: 3345919 - RNA, 21 nt, Mycobacterium tuberculosis H37Rv
gcuggaucgagcuaguucggc

SEQ ID NO: 3345920 - RNA, 23 nt, Mycobacterium tuberculosis H37Rv
gcuggaucgagcuaguucggcgu

SEQ ID NO: 3345921 - RNA, 17 nt, Mycobacterium tuberculosis H37Rv
gcuggaucucguuggug

SEQ ID NO: 3345922 - RNA, 18 nt, Mycobacterium tuberculosis H37Rv
gcuggauguaguuggcga

SEQ ID NO: 3345923 - RNA, 22 nt, Mycobacterium tuberculosis H37Rv
gcuggauguaguuggcgaccug

SEQ ID NO: 3345924 - RNA, 19 nt, Mycobacterium tuberculosis H37Rv
gcuggcaacgccgcgccgu

SEQ ID NO: 3345925 - RNA, 21 nt, Mycobacterium tuberculosis H37Rv
gcuggcaacgccgcgccguuc

SEQ ID NO: 3345926 - RNA, 13 nt, Mycobacterium tuberculosis H37Rv
gcuggcacacucc

SEQ ID NO: 3345927 - RNA, 12 nt, Mycobacterium tuberculosis H37Rv
gcuggcagacuc

SEQ ID NO: 3345928 - RNA, 20 nt, Mycobacterium tuberculosis H37Rv
gcuggcagcgacuuaggcag

SEQ ID NO: 3345929 - RNA, 15 nt, Mycobacterium tuberculosis H37Rv
gcuggcaggauaccg

SEQ ID NO: 3345930 - RNA, 13 nt, Mycobacterium tuberculosis H37Rv
gcuggcaggccgg

SEQ ID NO: 3345931 - RNA, 14 nt, Mycobacterium tuberculosis H37Rv
gcuggcaggccggg

SEQ ID NO: 3345932 - RNA, 12 nt, Mycobacterium tuberculosis H37Rv
gcuggccaccgc

SEQ ID NO: 3345933 - RNA, 19 nt, Mycobacterium tuberculosis H37Rv
gcuggccaccgcaucgccg

SEQ ID NO: 3345934 - RNA, 21 nt, Mycobacterium tuberculosis H37Rv
gcuggccaccgcaucgccgaa

SEQ ID NO: 3345935 - RNA, 22 nt, Mycobacterium tuberculosis H37Rv
gcuggccaccuuagcgcuugcc

SEQ ID NO: 3345936 - RNA, 14 nt, Mycobacterium tuberculosis H37Rv
gcuggccacgaucc

SEQ ID NO: 3345937 - RNA, 16 nt, Mycobacterium tuberculosis H37Rv
gcuggccacgauccgc

SEQ ID NO: 3345938 - RNA, 21 nt, Mycobacterium tuberculosis H37Rv
gcuggccacucacauuggcca

SEQ ID NO: 3345939 - RNA, 23 nt, Mycobacterium tuberculosis H37Rv
gcuggccagcacaccgucgacga

SEQ ID NO: 3345940 - RNA, 18 nt, Mycobacterium tuberculosis H37Rv
gcuggccagcugcggcuc

SEQ ID NO: 3345941 - RNA, 14 nt, Mycobacterium tuberculosis H37Rv
gcuggcccaacauc

SEQ ID NO: 3345942 - RNA, 18 nt, Mycobacterium tuberculosis H37Rv
gcuggcccagcgaccagu

SEQ ID NO: 3345943 - RNA, 18 nt, Mycobacterium tuberculosis H37Rv
gcuggcccgcacgaaccg

SEQ ID NO: 3345944 - RNA, 18 nt, Mycobacterium tuberculosis H37Rv
gcuggcccgcaugccggc

SEQ ID NO: 3345945 - RNA, 23 nt, Mycobacterium tuberculosis H37Rv
gcuggccgcggcuggugucgggc

SEQ ID NO: 3345946 - RNA, 22 nt, Mycobacterium tuberculosis H37Rv
gcuggccggguuccagcggcac

SEQ ID NO: 3345947 - RNA, 23 nt, Mycobacterium tuberculosis H37Rv
gcuggccguaacgcggaucgggc

SEQ ID NO: 3345948 - RNA, 20 nt, Mycobacterium tuberculosis H37Rv
gcuggccguauaggcccggg

SEQ ID NO: 3345949 - RNA, 14 nt, Mycobacterium tuberculosis H37Rv
gcuggccgucgaag

SEQ ID NO: 3345950 - RNA, 14 nt, Mycobacterium tuberculosis H37Rv
gcuggccuccagcu

SEQ ID NO: 3345951 - RNA, 16 nt, Mycobacterium tuberculosis H37Rv
gcuggccuccagcuug

SEQ ID NO: 3345952 - RNA, 20 nt, Mycobacterium tuberculosis H37Rv
gcuggccuccagcuuggcga

SEQ ID NO: 3345953 - RNA, 18 nt, Mycobacterium tuberculosis H37Rv
gcuggcgaacucgagguc

SEQ ID NO: 3345954 - RNA, 21 nt, Mycobacterium tuberculosis H37Rv
gcuggcgaaggacaacagccg

SEQ ID NO: 3345955 - RNA, 17 nt, Mycobacterium tuberculosis H37Rv
gcuggcgaccuggucgc

SEQ ID NO: 3345956 - RNA, 22 nt, Mycobacterium tuberculosis H37Rv
gcuggcgaccuggucgcuggug

SEQ ID NO: 3345957 - RNA, 16 nt, Mycobacterium tuberculosis H37Rv
gcuggcgauacagcga

SEQ ID NO: 3345958 - RNA, 14 nt, Mycobacterium tuberculosis H37Rv
gcugguugugcugg

SEQ ID NO: 3345959 - RNA, 18 nt, Mycobacterium tuberculosis H37Rv
gcuguaacacccggccgc

SEQ ID NO: 3345960 - RNA, 21 nt, Mycobacterium tuberculosis H37Rv
gcuguaacacccggccgccga

SEQ ID NO: 3345961 - RNA, 23 nt, Mycobacterium tuberculosis H37Rv
gcuguaacacccggccgccgaaa

SEQ ID NO: 3345962 - RNA, 22 nt, Mycobacterium tuberculosis H37Rv
gcuguaagcaugccguugcgau

SEQ ID NO: 3345963 - RNA, 20 nt, Mycobacterium tuberculosis H37Rv
gcuguacaacgccgucgucg

SEQ ID NO: 3345964 - RNA, 22 nt, Mycobacterium tuberculosis H37Rv
gcuguacccgaccagcaccaga

SEQ ID NO: 3345965 - RNA, 21 nt, Mycobacterium tuberculosis H37Rv
gcuguacucgcggcgcggccg

SEQ ID NO: 3345966 - RNA, 19 nt, Mycobacterium tuberculosis H37Rv
gcuguacugccccagcaca

SEQ ID NO: 3345967 - RNA, 17 nt, Mycobacterium tuberculosis H37Rv
gcuguacugcggugcca

SEQ ID NO: 3345968 - RNA, 16 nt, Mycobacterium tuberculosis H37Rv
gcuguagucgcgccuc

SEQ ID NO: 3345969 - RNA, 23 nt, Mycobacterium tuberculosis H37Rv
gcuguauuucaauucucgagcaa

SEQ ID NO: 3345970 - RNA, 20 nt, Mycobacterium tuberculosis H37Rv
gcugucaauccgcccuaaug

SEQ ID NO: 3345971 - RNA, 16 nt, Mycobacterium tuberculosis H37Rv
gcugucacaagccugc

SEQ ID NO: 3345972 - RNA, 18 nt, Mycobacterium tuberculosis H37Rv
gcugucacaagccugccg

SEQ ID NO: 3345973 - RNA, 19 nt, Mycobacterium tuberculosis H37Rv
gcugucaguucccgcuuga

SEQ ID NO: 3345974 - RNA, 11 nt, Mycobacterium tuberculosis H37Rv
gcuguccaccg

SEQ ID NO: 3345975 - RNA, 14 nt, Mycobacterium tuberculosis H37Rv
gcugucccagcccg

SEQ ID NO: 3345976 - RNA, 21 nt, Mycobacterium tuberculosis H37Rv
gcugucccgcgggccagcacc

SEQ ID NO: 3345977 - RNA, 17 nt, Mycobacterium tuberculosis H37Rv
gcuguccgaaccgacgu

SEQ ID NO: 3345978 - RNA, 14 nt, Mycobacterium tuberculosis H37Rv
gcuguccgacuugu

SEQ ID NO: 3345979 - RNA, 15 nt, Mycobacterium tuberculosis H37Rv
gcuguccgcgggccg

SEQ ID NO: 3345980 - RNA, 17 nt, Mycobacterium tuberculosis H37Rv
gcuguccgcgggccgcg

SEQ ID NO: 3345981 - RNA, 13 nt, Mycobacterium tuberculosis H37Rv
gcuguccgggcug

SEQ ID NO: 3345982 - RNA, 19 nt, Mycobacterium tuberculosis H37Rv
gcugucgaaguuggucacg

SEQ ID NO: 3345983 - RNA, 18 nt, Mycobacterium tuberculosis H37Rv
gcugucgaccgcgaucac

SEQ ID NO: 3345984 - RNA, 15 nt, Mycobacterium tuberculosis H37Rv
gcugucgacgucggc

SEQ ID NO: 3345985 - RNA, 20 nt, Mycobacterium tuberculosis H37Rv
gcugucgacgucggcaaucu

SEQ ID NO: 3345986 - RNA, 17 nt, Mycobacterium tuberculosis H37Rv
gcugucggcaugccggu

SEQ ID NO: 3345987 - RNA, 14 nt, Mycobacterium tuberculosis H37Rv
gcugucggugccgu

SEQ ID NO: 3345988 - RNA, 23 nt, Mycobacterium tuberculosis H37Rv
gcugucgugauacagcucggugc

SEQ ID NO: 3345989 - RNA, 21 nt, Mycobacterium tuberculosis H37Rv
gcugugagcuuggucgccaug

SEQ ID NO: 3345990 - RNA, 13 nt, Mycobacterium tuberculosis H37Rv
gcugugccccagg

SEQ ID NO: 3345991 - RNA, 17 nt, Mycobacterium tuberculosis H37Rv
gcugugccccagggcag

SEQ ID NO: 3345992 - RNA, 19 nt, Mycobacterium tuberculosis H37Rv
gcugugccccagggcagug

SEQ ID NO: 3345993 - RNA, 23 nt, Mycobacterium tuberculosis H37Rv
gcugugcccgaucagccguggca

SEQ ID NO: 3345994 - RNA, 15 nt, Mycobacterium tuberculosis H37Rv
gcugugccuucgccu

SEQ ID NO: 3345995 - RNA, 13 nt, Mycobacterium tuberculosis H37Rv
gcugugcgcuggu

SEQ ID NO: 3345996 - RNA, 14 nt, Mycobacterium tuberculosis H37Rv
gcugugcgcugguc

SEQ ID NO: 3345997 - RNA, 15 nt, Mycobacterium tuberculosis H37Rv
gcugugcgcuggucg

SEQ ID NO: 3345998 - RNA, 14 nt, Mycobacterium tuberculosis H37Rv
gcugugcgguaucg

SEQ ID NO: 3345999 - RNA, 19 nt, Mycobacterium tuberculosis H37Rv
gcugugcggucgucaccgu

SEQ ID NO: 3346000 - RNA, 18 nt, Mycobacterium tuberculosis H37Rv
gcugugcucacgagcaaa

SEQ ID NO: 3346001 - RNA, 18 nt, Mycobacterium tuberculosis H37Rv
gcuguggcccgcggugac

SEQ ID NO: 3346002 - RNA, 13 nt, Mycobacterium tuberculosis H37Rv
gcuguggccgcgu

SEQ ID NO: 3346003 - RNA, 18 nt, Mycobacterium tuberculosis H37Rv
gcugugguaggccggugc

SEQ ID NO: 3346004 - RNA, 22 nt, Mycobacterium tuberculosis H37Rv
gcugugguaggccggugcguca

SEQ ID NO: 3346005 - RNA, 14 nt, Mycobacterium tuberculosis H37Rv
gcuguggucggugc

SEQ ID NO: 3346006 - RNA, 15 nt, Mycobacterium tuberculosis H37Rv
gcuguggucggugcc

SEQ ID NO: 3346007 - RNA, 21 nt, Mycobacterium tuberculosis H37Rv
gcuguggucggugccagcacc

SEQ ID NO: 3346008 - RNA, 13 nt, Mycobacterium tuberculosis H37Rv
gcuguggugguga

SEQ ID NO: 3346009 - RNA, 19 nt, Mycobacterium tuberculosis H37Rv
gcuguugacgccacgacgc

SEQ ID NO: 3346010 - RNA, 15 nt, Mycobacterium tuberculosis H37Rv
gcuguugcggggugc

SEQ ID NO: 3346011 - RNA, 18 nt, Mycobacterium tuberculosis H37Rv
gcuguugcggggugcuca

SEQ ID NO: 3346012 - RNA, 23 nt, Mycobacterium tuberculosis H37Rv
gcuguuggcguggaucuuggcca

SEQ ID NO: 3346013 - RNA, 19 nt, Mycobacterium tuberculosis H37Rv
gcuguuguacugcggauga

SEQ ID NO: 3346014 - RNA, 22 nt, Mycobacterium tuberculosis H37Rv
gcuuaacgacgggaaccagcgg

SEQ ID NO: 3346015 - RNA, 15 nt, Mycobacterium tuberculosis H37Rv
gcuuacaugcccugc

SEQ ID NO: 3346016 - RNA, 17 nt, Mycobacterium tuberculosis H37Rv
gcuuacaugcccugcgc

SEQ ID NO: 3346017 - RNA, 14 nt, Mycobacterium tuberculosis H37Rv
gcuuaccggcgggc

SEQ ID NO: 3346018 - RNA, 14 nt, Mycobacterium tuberculosis H37Rv
gcuuacuugaucuc

SEQ ID NO: 3346019 - RNA, 20 nt, Mycobacterium tuberculosis H37Rv
gcuuacuugaucucggcgag

SEQ ID NO: 3346020 - RNA, 15 nt, Mycobacterium tuberculosis H37Rv
gcuuagcggcuuggc

SEQ ID NO: 3346021 - RNA, 20 nt, Mycobacterium tuberculosis H37Rv
gcuuagcugccgucggugcc

SEQ ID NO: 3346022 - RNA, 23 nt, Mycobacterium tuberculosis H37Rv
gcuuagcugccgucggugccggg

SEQ ID NO: 3346023 - RNA, 21 nt, Mycobacterium tuberculosis H37Rv
gcuuaucgaacgucucggcca

SEQ ID NO: 3346024 - RNA, 15 nt, Mycobacterium tuberculosis H37Rv
gcuuaugcacgacgg

SEQ ID NO: 3346025 - RNA, 18 nt, Mycobacterium tuberculosis H37Rv
gcuucaggaucggcgauu

SEQ ID NO: 3346026 - RNA, 18 nt, Mycobacterium tuberculosis H37Rv
gcuucaucccggagccgc

SEQ ID NO: 3346027 - RNA, 12 nt, Mycobacterium tuberculosis H37Rv
gcuuccagcauc

SEQ ID NO: 3346028 - RNA, 15 nt, Mycobacterium tuberculosis H37Rv
gcuuccagcaucagu

SEQ ID NO: 3346029 - RNA, 16 nt, Mycobacterium tuberculosis H37Rv
gcuuccagccacagcc

SEQ ID NO: 3346030 - RNA, 20 nt, Mycobacterium tuberculosis H37Rv
gcuuccagccacagcccggc

SEQ ID NO: 3346031 - RNA, 21 nt, Mycobacterium tuberculosis H37Rv
gcuuccagccggagucaccga

SEQ ID NO: 3346032 - RNA, 15 nt, Mycobacterium tuberculosis H37Rv
gcuuccagggcgacg

SEQ ID NO: 3346033 - RNA, 14 nt, Mycobacterium tuberculosis H37Rv
gcuuccagggcggc

SEQ ID NO: 3346034 - RNA, 14 nt, Mycobacterium tuberculosis H37Rv
gcuuccccaccaca

SEQ ID NO: 3346035 - RNA, 23 nt, Mycobacterium tuberculosis H37Rv
gcuucccuccagauaccaccgcc

SEQ ID NO: 3346036 - RNA, 17 nt, Mycobacterium tuberculosis H37Rv
gcuuccgaccgcuccga

SEQ ID NO: 3346037 - RNA, 23 nt, Mycobacterium tuberculosis H37Rv
gcuuccgcgacgcucgcugcagc

SEQ ID NO: 3346038 - RNA, 22 nt, Mycobacterium tuberculosis H37Rv
gcuuccgcgcgcagaugagcgc

SEQ ID NO: 3346039 - RNA, 23 nt, Mycobacterium tuberculosis H37Rv
gcuuccucgagcgaaccgaagcc

SEQ ID NO: 3346040 - RNA, 18 nt, Mycobacterium tuberculosis H37Rv
gcuuccucgcgagcuccc

SEQ ID NO: 3346041 - RNA, 20 nt, Mycobacterium tuberculosis H37Rv
gcuuccuggguuggcaucca

SEQ ID NO: 3346042 - RNA, 15 nt, Mycobacterium tuberculosis H37Rv
gcuucgaccguggug

SEQ ID NO: 3346043 - RNA, 15 nt, Mycobacterium tuberculosis H37Rv
gcuucgacggcggcc

SEQ ID NO: 3346044 - RNA, 18 nt, Mycobacterium tuberculosis H37Rv
gcuucgacgucggcgacc

SEQ ID NO: 3346045 - RNA, 18 nt, Mycobacterium tuberculosis H37Rv
gcuucgagguggcugcgc

SEQ ID NO: 3346046 - RNA, 19 nt, Mycobacterium tuberculosis H37Rv
gcuucgcaagucauccagg

SEQ ID NO: 3346047 - RNA, 17 nt, Mycobacterium tuberculosis H37Rv
gcuucgccacaccauga

SEQ ID NO: 3346048 - RNA, 19 nt, Mycobacterium tuberculosis H37Rv
gcuucgccacaccaugauu

SEQ ID NO: 3346049 - RNA, 15 nt, Mycobacterium tuberculosis H37Rv
gcuucgcccggcugc

SEQ ID NO: 3346050 - RNA, 20 nt, Mycobacterium tuberculosis H37Rv
gcuucgccgaguugaccgcc

SEQ ID NO: 3346051 - RNA, 14 nt, Mycobacterium tuberculosis H37Rv
gcuucgccgcgcag

SEQ ID NO: 3346052 - RNA, 21 nt, Mycobacterium tuberculosis H37Rv
gcuucgccgcgcagccuucuc

SEQ ID NO: 3346053 - RNA, 20 nt, Mycobacterium tuberculosis H37Rv
gcuucgcgguuggcggcgau

SEQ ID NO: 3346054 - RNA, 16 nt, Mycobacterium tuberculosis H37Rv
gcuuugccgucgagca

SEQ ID NO: 3346055 - RNA, 13 nt, Mycobacterium tuberculosis H37Rv
gcuuugcucgcca

SEQ ID NO: 3346056 - RNA, 16 nt, Mycobacterium tuberculosis H37Rv
gcuuuggguccgggcg

SEQ ID NO: 3346057 - RNA, 16 nt, Mycobacterium tuberculosis H37Rv
gcuuuuacgucugcuc

SEQ ID NO: 3346058 - RNA, 17 nt, Mycobacterium tuberculosis H37Rv
gcuuuuacgucugcucg

SEQ ID NO: 3346059 - RNA, 23 nt, Mycobacterium tuberculosis H37Rv
gcuuuuccggcguucccccacuc

SEQ ID NO: 3346060 - RNA, 17 nt, Mycobacterium tuberculosis H37Rv
ggaaaaagucaccuugc

SEQ ID NO: 3346061 - RNA, 17 nt, Mycobacterium tuberculosis H37Rv
ggaaaaccgcaccgucc

SEQ ID NO: 3346062 - RNA, 13 nt, Mycobacterium tuberculosis H37Rv
ggaaaagcccgga

SEQ ID NO: 3346063 - RNA, 14 nt, Mycobacterium tuberculosis H37Rv
ggaaacaagcaagc

SEQ ID NO: 3346064 - RNA, 15 nt, Mycobacterium tuberculosis H37Rv
ggaaacaccggcuug

SEQ ID NO: 3346065 - RNA, 21 nt, Mycobacterium tuberculosis H37Rv
ggaaacaucguucugacggcu

SEQ ID NO: 3346066 - RNA, 17 nt, Mycobacterium tuberculosis H37Rv
ggaaaccacagcgccau

SEQ ID NO: 3346067 - RNA, 19 nt, Mycobacterium tuberculosis H37Rv
ggaaacccggccagcugcg

SEQ ID NO: 3346068 - RNA, 17 nt, Mycobacterium tuberculosis H37Rv
ggaaaccgcugggggcg

SEQ ID NO: 3346069 - RNA, 15 nt, Mycobacterium tuberculosis H37Rv
ggaaaccggccagcc

SEQ ID NO: 3346070 - RNA, 22 nt, Mycobacterium tuberculosis H37Rv
ggaaaccucuucgggugcagcc

SEQ ID NO: 3346071 - RNA, 16 nt, Mycobacterium tuberculosis H37Rv
ggaaacggagccgagc

SEQ ID NO: 3346072 - RNA, 21 nt, Mycobacterium tuberculosis H37Rv
ggaaacggagccgagccgaua

SEQ ID NO: 3346073 - RNA, 16 nt, Mycobacterium tuberculosis H37Rv
ggaaagaucucgguca

SEQ ID NO: 3346074 - RNA, 22 nt, Mycobacterium tuberculosis H37Rv
ggaaagccuaguacgccgagca

SEQ ID NO: 3346075 - RNA, 16 nt, Mycobacterium tuberculosis H37Rv
ggaaaggccgcgguga

SEQ ID NO: 3346076 - RNA, 16 nt, Mycobacterium tuberculosis H37Rv
ggaaaucggacgacuc

SEQ ID NO: 3346077 - RNA, 14 nt, Mycobacterium tuberculosis H37Rv
ggaaaugaaguggc

SEQ ID NO: 3346078 - RNA, 13 nt, Mycobacterium tuberculosis H37Rv
ggaaaugucgcac

SEQ ID NO: 3346079 - RNA, 14 nt, Mycobacterium tuberculosis H37Rv
ggaaauuccaagcg

SEQ ID NO: 3346080 - RNA, 20 nt, Mycobacterium tuberculosis H37Rv
ggaacaacgcgcaaccagcc

SEQ ID NO: 3346081 - RNA, 19 nt, Mycobacterium tuberculosis H37Rv
ggaacaaguagccgucguc

SEQ ID NO: 3346082 - RNA, 22 nt, Mycobacterium tuberculosis H37Rv
ggaacacccauaccuucggcga

SEQ ID NO: 3346083 - RNA, 20 nt, Mycobacterium tuberculosis H37Rv
ggaacaccgaggcgaccgga

SEQ ID NO: 3346084 - RNA, 19 nt, Mycobacterium tuberculosis H37Rv
ggaacaccgcccggcccgg

SEQ ID NO: 3346085 - RNA, 13 nt, Mycobacterium tuberculosis H37Rv
ggaacacgaugcg

SEQ ID NO: 3346086 - RNA, 15 nt, Mycobacterium tuberculosis H37Rv
ggaacagccuauucc

SEQ ID NO: 3346087 - RNA, 12 nt, Mycobacterium tuberculosis H37Rv
ggaacaggccgu

SEQ ID NO: 3346088 - RNA, 19 nt, Mycobacterium tuberculosis H37Rv
ggaacaucgucaucgacga

SEQ ID NO: 3346089 - RNA, 21 nt, Mycobacterium tuberculosis H37Rv
ggaaccaaccucggaucgcca

SEQ ID NO: 3346090 - RNA, 19 nt, Mycobacterium tuberculosis H37Rv
ggaaccacccaccggccac

SEQ ID NO: 3346091 - RNA, 18 nt, Mycobacterium tuberculosis H37Rv
ggaaccacucgcucagga

SEQ ID NO: 3346092 - RNA, 17 nt, Mycobacterium tuberculosis H37Rv
ggaaccagcggucggcg

SEQ ID NO: 3346093 - RNA, 15 nt, Mycobacterium tuberculosis H37Rv
ggaaccauugcccga

SEQ ID NO: 3346094 - RNA, 21 nt, Mycobacterium tuberculosis H37Rv
ggaacccacaguggcucgcgg

SEQ ID NO: 3346095 - RNA, 14 nt, Mycobacterium tuberculosis H37Rv
ggaacccccagcug

SEQ ID NO: 3346096 - RNA, 18 nt, Mycobacterium tuberculosis H37Rv
ggaacccccagcugcagg

SEQ ID NO: 3346097 - RNA, 23 nt, Mycobacterium tuberculosis H37Rv
ggaacccgaaucccacagcagga

SEQ ID NO: 3346098 - RNA, 19 nt, Mycobacterium tuberculosis H37Rv
ggaacccgagcuugggccg

SEQ ID NO: 3346099 - RNA, 20 nt, Mycobacterium tuberculosis H37Rv
ggaaccgaucggucgaucga

SEQ ID NO: 3346100 - RNA, 16 nt, Mycobacterium tuberculosis H37Rv
ggaaccggcgugcagc

SEQ ID NO: 3346101 - RNA, 17 nt, Mycobacterium tuberculosis H37Rv
ggaaccggucagccgga

SEQ ID NO: 3346102 - RNA, 20 nt, Mycobacterium tuberculosis H37Rv
ggaaccguccaagccggcug

SEQ ID NO: 3346103 - RNA, 12 nt, Mycobacterium tuberculosis H37Rv
ggaacgagccac

SEQ ID NO: 3346104 - RNA, 15 nt, Mycobacterium tuberculosis H37Rv
ggaacgaucgaugac

SEQ ID NO: 3346105 - RNA, 21 nt, Mycobacterium tuberculosis H37Rv
ggaacgaugccgccggcgggc

SEQ ID NO: 3346106 - RNA, 24 nt, Mycobacterium tuberculosis H37Rv
ggaacgauggacgcccaguugccg

SEQ ID NO: 3346107 - RNA, 16 nt, Mycobacterium tuberculosis H37Rv
ggaacgccggcaccga

SEQ ID NO: 3346108 - RNA, 13 nt, Mycobacterium tuberculosis H37Rv
ggaacgccggcau

SEQ ID NO: 3346109 - RNA, 15 nt, Mycobacterium tuberculosis H37Rv
ggaacgcgcccacgg

SEQ ID NO: 3346110 - RNA, 15 nt, Mycobacterium tuberculosis H37Rv
ggaacgcuaggcgau

SEQ ID NO: 3346111 - RNA, 20 nt, Mycobacterium tuberculosis H37Rv
ggaacgcuaggcgauccaga

SEQ ID NO: 3346112 - RNA, 14 nt, Mycobacterium tuberculosis H37Rv
ggaacgcucgucga

SEQ ID NO: 3346113 - RNA, 13 nt, Mycobacterium tuberculosis H37Rv
ggaacggcgucgu

SEQ ID NO: 3346114 - RNA, 20 nt, Mycobacterium tuberculosis H37Rv
ggaacggugcacagcaguga

SEQ ID NO: 3346115 - RNA, 14 nt, Mycobacterium tuberculosis H37Rv
ggaacguccagccg

SEQ ID NO: 3346116 - RNA, 18 nt, Mycobacterium tuberculosis H37Rv
ggaacguccagccguggc

SEQ ID NO: 3346117 - RNA, 16 nt, Mycobacterium tuberculosis H37Rv
ggaacguccgcgccga

SEQ ID NO: 3346118 - RNA, 21 nt, Mycobacterium tuberculosis H37Rv
ggaacgugacccccagcaggg

SEQ ID NO: 3346119 - RNA, 21 nt, Mycobacterium tuberculosis H37Rv
ggaacguuccugcacagacag

SEQ ID NO: 3346120 - RNA, 21 nt, Mycobacterium tuberculosis H37Rv
ggaacuccggguggcggcggc

SEQ ID NO: 3346121 - RNA, 22 nt, Mycobacterium tuberculosis H37Rv
ggaacucggcccacacggucgu

SEQ ID NO: 3346122 - RNA, 19 nt, Mycobacterium tuberculosis H37Rv
ggaacucgucgcugcccau

SEQ ID NO: 3346123 - RNA, 17 nt, Mycobacterium tuberculosis H37Rv
ggaacugcaugguggcg

SEQ ID NO: 3346124 - RNA, 16 nt, Mycobacterium tuberculosis H37Rv
ggaacuggaccacagc

SEQ ID NO: 3346125 - RNA, 18 nt, Mycobacterium tuberculosis H37Rv
ggaagaaaccgcagucgc

SEQ ID NO: 3346126 - RNA, 23 nt, Mycobacterium tuberculosis H37Rv
ggaagaacaucaccucgaugccg

SEQ ID NO: 3346127 - RNA, 21 nt, Mycobacterium tuberculosis H37Rv
ggaagaacucguugagcagcu

SEQ ID NO: 3346128 - RNA, 17 nt, Mycobacterium tuberculosis H37Rv
ggaagaagagguuggcg

SEQ ID NO: 3346129 - RNA, 16 nt, Mycobacterium tuberculosis H37Rv
ggaagacgccggcgau

SEQ ID NO: 3346130 - RNA, 19 nt, Mycobacterium tuberculosis H37Rv
ggaagacuuagcgggugcc

SEQ ID NO: 3346131 - RNA, 18 nt, Mycobacterium tuberculosis H37Rv
ggaagaucucggccagga

SEQ ID NO: 3346132 - RNA, 17 nt, Mycobacterium tuberculosis H37Rv
ggaagcccacgaucgcg

SEQ ID NO: 3346133 - RNA, 19 nt, Mycobacterium tuberculosis H37Rv
ggaagcccggcagaugcag

SEQ ID NO: 3346134 - RNA, 15 nt, Mycobacterium tuberculosis H37Rv
ggaagcccgucgcgg

SEQ ID NO: 3346135 - RNA, 11 nt, Mycobacterium tuberculosis H37Rv
ggaagccgacc

SEQ ID NO: 3346136 - RNA, 21 nt, Mycobacterium tuberculosis H37Rv
ggaagccgaccuucucggcgu

SEQ ID NO: 3346137 - RNA, 20 nt, Mycobacterium tuberculosis H37Rv
ggaagccugcgggccggcau

SEQ ID NO: 3346138 - RNA, 21 nt, Mycobacterium tuberculosis H37Rv
ggaagcgcaaugcgcgacggu

SEQ ID NO: 3346139 - RNA, 23 nt, Mycobacterium tuberculosis H37Rv
ggaagcgcaaugcgcgacgguca

SEQ ID NO: 3346140 - RNA, 23 nt, Mycobacterium tuberculosis H37Rv
ggaagcgccaacccggcgggccc

SEQ ID NO: 3346141 - RNA, 14 nt, Mycobacterium tuberculosis H37Rv
ggaagcgguggccu

SEQ ID NO: 3346142 - RNA, 17 nt, Mycobacterium tuberculosis H37Rv
ggaagcgguugacccac

SEQ ID NO: 3346143 - RNA, 12 nt, Mycobacterium tuberculosis H37Rv
ggaaggagaucc

SEQ ID NO: 3346144 - RNA, 18 nt, Mycobacterium tuberculosis H37Rv
ggaagggcuaucguggcg

SEQ ID NO: 3346145 - RNA, 20 nt, Mycobacterium tuberculosis H37Rv
ggaaggggcucagcgguggc

SEQ ID NO: 3346146 - RNA, 19 nt, Mycobacterium tuberculosis H37Rv
ggaaggucgacaugggucg

SEQ ID NO: 3346147 - RNA, 22 nt, Mycobacterium tuberculosis H37Rv
ggaaggucgacaugggucggcu

SEQ ID NO: 3346148 - RNA, 22 nt, Mycobacterium tuberculosis H37Rv
ggaaggugugcgucuccagcug

SEQ ID NO: 3346149 - RNA, 17 nt, Mycobacterium tuberculosis H37Rv
ggaaguacacggcggcc

SEQ ID NO: 3346150 - RNA, 17 nt, Mycobacterium tuberculosis H37Rv
ggaccagcguggggccg

SEQ ID NO: 3346151 - RNA, 12 nt, Mycobacterium tuberculosis H37Rv
ggaccagcuccu

SEQ ID NO: 3346152 - RNA, 21 nt, Mycobacterium tuberculosis H37Rv
ggaccaggccgcgcgcaccgg

SEQ ID NO: 3346153 - RNA, 13 nt, Mycobacterium tuberculosis H37Rv
ggaccaucgccag

SEQ ID NO: 3346154 - RNA, 16 nt, Mycobacterium tuberculosis H37Rv
ggaccaucgccaggcc

SEQ ID NO: 3346155 - RNA, 13 nt, Mycobacterium tuberculosis H37Rv
ggacccaccguca

SEQ ID NO: 3346156 - RNA, 14 nt, Mycobacterium tuberculosis H37Rv
ggacccagccagcu

SEQ ID NO: 3346157 - RNA, 16 nt, Mycobacterium tuberculosis H37Rv
ggacccagccagcugg

SEQ ID NO: 3346158 - RNA, 17 nt, Mycobacterium tuberculosis H37Rv
ggacccagccagcugga

SEQ ID NO: 3346159 - RNA, 24 nt, Mycobacterium tuberculosis H37Rv
ggacccagccagcuggacuccggu

SEQ ID NO: 3346160 - RNA, 13 nt, Mycobacterium tuberculosis H37Rv
ggacccagcggcg

SEQ ID NO: 3346161 - RNA, 18 nt, Mycobacterium tuberculosis H37Rv
ggacccaugagcccguga

SEQ ID NO: 3346162 - RNA, 13 nt, Mycobacterium tuberculosis H37Rv
ggaccccgccagc

SEQ ID NO: 3346163 - RNA, 15 nt, Mycobacterium tuberculosis H37Rv
ggaccccucgaccga

SEQ ID NO: 3346164 - RNA, 15 nt, Mycobacterium tuberculosis H37Rv
ggacccgaccgucgu

SEQ ID NO: 3346165 - RNA, 12 nt, Mycobacterium tuberculosis H37Rv
ggacccgcagcu

SEQ ID NO: 3346166 - RNA, 15 nt, Mycobacterium tuberculosis H37Rv
ggacccgcagcugcg

SEQ ID NO: 3346167 - RNA, 19 nt, Mycobacterium tuberculosis H37Rv
ggacccgcagcugcggauc

SEQ ID NO: 3346168 - RNA, 14 nt, Mycobacterium tuberculosis H37Rv
ggacccgcccaggc

SEQ ID NO: 3346169 - RNA, 16 nt, Mycobacterium tuberculosis H37Rv
ggacccgcuacgacgg

SEQ ID NO: 3346170 - RNA, 18 nt, Mycobacterium tuberculosis H37Rv
ggacccgcugaucucggu

SEQ ID NO: 3346171 - RNA, 19 nt, Mycobacterium tuberculosis H37Rv
ggacccggcgcgauggcga

SEQ ID NO: 3346172 - RNA, 20 nt, Mycobacterium tuberculosis H37Rv
ggacccggugacccgcuggg

SEQ ID NO: 3346173 - RNA, 19 nt, Mycobacterium tuberculosis H37Rv
ggacccgugagcucgucga

SEQ ID NO: 3346174 - RNA, 20 nt, Mycobacterium tuberculosis H37Rv
ggacccgugagcucgucgag

SEQ ID NO: 3346175 - RNA, 19 nt, Mycobacterium tuberculosis H37Rv
ggacccugcgccgccacag

SEQ ID NO: 3346176 - RNA, 16 nt, Mycobacterium tuberculosis H37Rv
ggaccgaacgacucga

SEQ ID NO: 3346177 - RNA, 21 nt, Mycobacterium tuberculosis H37Rv
ggaccgaugguugagcaucga

SEQ ID NO: 3346178 - RNA, 14 nt, Mycobacterium tuberculosis H37Rv
ggaccgccagggcu

SEQ ID NO: 3346179 - RNA, 19 nt, Mycobacterium tuberculosis H37Rv
ggaccgccccggccaggac

SEQ ID NO: 3346180 - RNA, 21 nt, Mycobacterium tuberculosis H37Rv
ggaccgcccgagucucgucgg

SEQ ID NO: 3346181 - RNA, 17 nt, Mycobacterium tuberculosis H37Rv
ggaccgccgaucggcca

SEQ ID NO: 3346182 - RNA, 18 nt, Mycobacterium tuberculosis H37Rv
ggaccgcgaacccguggg

SEQ ID NO: 3346183 - RNA, 14 nt, Mycobacterium tuberculosis H37Rv
ggaccgcgccgauc

SEQ ID NO: 3346184 - RNA, 14 nt, Mycobacterium tuberculosis H37Rv
ggaccgcggccacc

SEQ ID NO: 3346185 - RNA, 21 nt, Mycobacterium tuberculosis H37Rv
ggaccgcggucauggcgacgg

SEQ ID NO: 3346186 - RNA, 21 nt, Mycobacterium tuberculosis H37Rv
ggaccgcggugacccggaagc

SEQ ID NO: 3346187 - RNA, 14 nt, Mycobacterium tuberculosis H37Rv
ggaccgcucgucgc

SEQ ID NO: 3346188 - RNA, 13 nt, Mycobacterium tuberculosis H37Rv
ggaccgcucugcg

SEQ ID NO: 3346189 - RNA, 16 nt, Mycobacterium tuberculosis H37Rv
ggaccggcgucggcug

SEQ ID NO: 3346190 - RNA, 14 nt, Mycobacterium tuberculosis H37Rv
ggaccggcugcagg

SEQ ID NO: 3346191 - RNA, 14 nt, Mycobacterium tuberculosis H37Rv
ggaccggugccagc

SEQ ID NO: 3346192 - RNA, 21 nt, Mycobacterium tuberculosis H37Rv
ggaccggugugcacgcgggcg

SEQ ID NO: 3346193 - RNA, 16 nt, Mycobacterium tuberculosis H37Rv
ggaccguccgacggcg

SEQ ID NO: 3346194 - RNA, 12 nt, Mycobacterium tuberculosis H37Rv
ggaccgucgugg

SEQ ID NO: 3346195 - RNA, 20 nt, Mycobacterium tuberculosis H37Rv
ggaccgucuuuggugccgag

SEQ ID NO: 3346196 - RNA, 20 nt, Mycobacterium tuberculosis H37Rv
ggaccgugacguaucgccgc

SEQ ID NO: 3346197 - RNA, 20 nt, Mycobacterium tuberculosis H37Rv
ggaccguuaccggacccgcu

SEQ ID NO: 3346198 - RNA, 21 nt, Mycobacterium tuberculosis H37Rv
ggaccuauuggucgcucgcgg

SEQ ID NO: 3346199 - RNA, 22 nt, Mycobacterium tuberculosis H37Rv
ggaccuccgacgugcccccgua

SEQ ID NO: 3346200 - RNA, 20 nt, Mycobacterium tuberculosis H37Rv
ggaccucgaagcccagcacc

SEQ ID NO: 3346201 - RNA, 13 nt, Mycobacterium tuberculosis H37Rv
ggaccucggcgau

SEQ ID NO: 3346202 - RNA, 19 nt, Mycobacterium tuberculosis H37Rv
ggaccugcgagaucggaug

SEQ ID NO: 3346203 - RNA, 15 nt, Mycobacterium tuberculosis H37Rv
ggacgaaaucggcgg

SEQ ID NO: 3346204 - RNA, 19 nt, Mycobacterium tuberculosis H37Rv
ggacgaccgcgcggcacuu

SEQ ID NO: 3346205 - RNA, 11 nt, Mycobacterium tuberculosis H37Rv
ggacgacgauc

SEQ ID NO: 3346206 - RNA, 15 nt, Mycobacterium tuberculosis H37Rv
ggacgacggcaagaa

SEQ ID NO: 3346207 - RNA, 19 nt, Mycobacterium tuberculosis H37Rv
ggacgagguucugccgcga

SEQ ID NO: 3346208 - RNA, 16 nt, Mycobacterium tuberculosis H37Rv
ggacgauacgcgcacc

SEQ ID NO: 3346209 - RNA, 23 nt, Mycobacterium tuberculosis H37Rv
ggacgaucagggugucgaagagc

SEQ ID NO: 3346210 - RNA, 11 nt, Mycobacterium tuberculosis H37Rv
ggacgaugcgg

SEQ ID NO: 3346211 - RNA, 20 nt, Mycobacterium tuberculosis H37Rv
ggacgauggcgucggccagg

SEQ ID NO: 3346212 - RNA, 23 nt, Mycobacterium tuberculosis H37Rv
ggacgauggcgucggccaggauc

SEQ ID NO: 3346213 - RNA, 19 nt, Mycobacterium tuberculosis H37Rv
ggacgcagagucaacgaac

SEQ ID NO: 3346214 - RNA, 13 nt, Mycobacterium tuberculosis H37Rv
ggacgccagcaau

SEQ ID NO: 3346215 - RNA, 19 nt, Mycobacterium tuberculosis H37Rv
ggacgccagcucaaccaca

SEQ ID NO: 3346216 - RNA, 21 nt, Mycobacterium tuberculosis H37Rv
ggacgccagcucaaccacaug

SEQ ID NO: 3346217 - RNA, 22 nt, Mycobacterium tuberculosis H37Rv
ggacgcccacaugcucagggca

SEQ ID NO: 3346218 - RNA, 20 nt, Mycobacterium tuberculosis H37Rv
ggacgcccgaguugaagaau

SEQ ID NO: 3346219 - RNA, 21 nt, Mycobacterium tuberculosis H37Rv
ggacgcccgcccgcacgacga

SEQ ID NO: 3346220 - RNA, 15 nt, Mycobacterium tuberculosis H37Rv
ggacgcccucggggu

SEQ ID NO: 3346221 - RNA, 16 nt, Mycobacterium tuberculosis H37Rv
ggacgccgccggagau

SEQ ID NO: 3346222 - RNA, 16 nt, Mycobacterium tuberculosis H37Rv
ggacgccgcgccggcg

SEQ ID NO: 3346223 - RNA, 16 nt, Mycobacterium tuberculosis H37Rv
ggacgcgaacagcucg

SEQ ID NO: 3346224 - RNA, 12 nt, Mycobacterium tuberculosis H37Rv
ggacgcgagugc

SEQ ID NO: 3346225 - RNA, 16 nt, Mycobacterium tuberculosis H37Rv
ggacgcgagugcguga

SEQ ID NO: 3346226 - RNA, 14 nt, Mycobacterium tuberculosis H37Rv
ggacgcgaucggcg

SEQ ID NO: 3346227 - RNA, 20 nt, Mycobacterium tuberculosis H37Rv
ggacgcgaugaccgcaccga

SEQ ID NO: 3346228 - RNA, 17 nt, Mycobacterium tuberculosis H37Rv
ggacgcgaugaucauga

SEQ ID NO: 3346229 - RNA, 23 nt, Mycobacterium tuberculosis H37Rv
ggacgcgaugaucaugaacgcca

SEQ ID NO: 3346230 - RNA, 21 nt, Mycobacterium tuberculosis H37Rv
ggacgcgcagcaucggcgaca

SEQ ID NO: 3346231 - RNA, 14 nt, Mycobacterium tuberculosis H37Rv
ggacgcgccggcgu

SEQ ID NO: 3346232 - RNA, 22 nt, Mycobacterium tuberculosis H37Rv
ggacgcugauugcgaccgcgcc

SEQ ID NO: 3346233 - RNA, 18 nt, Mycobacterium tuberculosis H37Rv
ggacggcaggcuggcgag

SEQ ID NO: 3346234 - RNA, 22 nt, Mycobacterium tuberculosis H37Rv
ggacggcauagcagccagcguc

SEQ ID NO: 3346235 - RNA, 16 nt, Mycobacterium tuberculosis H37Rv
ggacggccaacagggc

SEQ ID NO: 3346236 - RNA, 16 nt, Mycobacterium tuberculosis H37Rv
ggacggccaucgccag

SEQ ID NO: 3346237 - RNA, 17 nt, Mycobacterium tuberculosis H37Rv
ggacggccgccgccgca

SEQ ID NO: 3346238 - RNA, 12 nt, Mycobacterium tuberculosis H37Rv
ggacggccucca

SEQ ID NO: 3346239 - RNA, 20 nt, Mycobacterium tuberculosis H37Rv
ggacggccuccaucgcgaca

SEQ ID NO: 3346240 - RNA, 20 nt, Mycobacterium tuberculosis H37Rv
ggacggcgcgagccgcacga

SEQ ID NO: 3346241 - RNA, 15 nt, Mycobacterium tuberculosis H37Rv
ggacggcggccagga

SEQ ID NO: 3346242 - RNA, 21 nt, Mycobacterium tuberculosis H37Rv
ggacggcguuuccuucgacga

SEQ ID NO: 3346243 - RNA, 21 nt, Mycobacterium tuberculosis H37Rv
ggacggcuaccaccgcaccug

SEQ ID NO: 3346244 - RNA, 18 nt, Mycobacterium tuberculosis H37Rv
ggacgggaucgcccaggc

SEQ ID NO: 3346245 - RNA, 21 nt, Mycobacterium tuberculosis H37Rv
ggacgggaugcuuggucucga

SEQ ID NO: 3346246 - RNA, 22 nt, Mycobacterium tuberculosis H37Rv
ggagcggaguguagacaggacc

SEQ ID NO: 3346247 - RNA, 20 nt, Mycobacterium tuberculosis H37Rv
ggagcggauagcggcaaagc

SEQ ID NO: 3346248 - RNA, 16 nt, Mycobacterium tuberculosis H37Rv
ggagcggcgcgggggu

SEQ ID NO: 3346249 - RNA, 14 nt, Mycobacterium tuberculosis H37Rv
ggagcggcugcacg

SEQ ID NO: 3346250 - RNA, 17 nt, Mycobacterium tuberculosis H37Rv
ggagcggcugcacgccu

SEQ ID NO: 3346251 - RNA, 19 nt, Mycobacterium tuberculosis H37Rv
ggagcggcuugcgguggcg

SEQ ID NO: 3346252 - RNA, 20 nt, Mycobacterium tuberculosis H37Rv
ggagcggguccccaccgguu

SEQ ID NO: 3346253 - RNA, 16 nt, Mycobacterium tuberculosis H37Rv
ggagcggguggccggg

SEQ ID NO: 3346254 - RNA, 23 nt, Mycobacterium tuberculosis H37Rv
ggagcgguaggcguugaucgccg

SEQ ID NO: 3346255 - RNA, 16 nt, Mycobacterium tuberculosis H37Rv
ggagcggugccgacgg

SEQ ID NO: 3346256 - RNA, 21 nt, Mycobacterium tuberculosis H37Rv
ggagcgguguggucgcaggau

SEQ ID NO: 3346257 - RNA, 16 nt, Mycobacterium tuberculosis H37Rv
ggagcuauucgguguc

SEQ ID NO: 3346258 - RNA, 20 nt, Mycobacterium tuberculosis H37Rv
ggagcucacgccgggugugg

SEQ ID NO: 3346259 - RNA, 15 nt, Mycobacterium tuberculosis H37Rv
ggagcucaucgacga

SEQ ID NO: 3346260 - RNA, 18 nt, Mycobacterium tuberculosis H37Rv
ggagcucaucuucgguca

SEQ ID NO: 3346261 - RNA, 17 nt, Mycobacterium tuberculosis H37Rv
ggagcucuugcgggcag

SEQ ID NO: 3346262 - RNA, 19 nt, Mycobacterium tuberculosis H37Rv
ggagcucuugcgggcagcc

SEQ ID NO: 3346263 - RNA, 21 nt, Mycobacterium tuberculosis H37Rv
ggagcucuugcgggcagccgc

SEQ ID NO: 3346264 - RNA, 14 nt, Mycobacterium tuberculosis H37Rv
ggagcugcggcggc

SEQ ID NO: 3346265 - RNA, 14 nt, Mycobacterium tuberculosis H37Rv
ggagcuguggcggg

SEQ ID NO: 3346266 - RNA, 21 nt, Mycobacterium tuberculosis H37Rv
ggagcuuuuugcgucuguucg

SEQ ID NO: 3346267 - RNA, 18 nt, Mycobacterium tuberculosis H37Rv
ggaggaaggucgaaucgc

SEQ ID NO: 3346268 - RNA, 17 nt, Mycobacterium tuberculosis H37Rv
ggaggacaccagcugga

SEQ ID NO: 3346269 - RNA, 12 nt, Mycobacterium tuberculosis H37Rv
ggaggcaagcaa

SEQ ID NO: 3346270 - RNA, 13 nt, Mycobacterium tuberculosis H37Rv
ggaggccaucauc

SEQ ID NO: 3346271 - RNA, 15 nt, Mycobacterium tuberculosis H37Rv
ggaggccaucauccc

SEQ ID NO: 3346272 - RNA, 18 nt, Mycobacterium tuberculosis H37Rv
ggaggcggaccaggccgc

SEQ ID NO: 3346273 - RNA, 15 nt, Mycobacterium tuberculosis H37Rv
ggaggcggcgccagu

SEQ ID NO: 3346274 - RNA, 17 nt, Mycobacterium tuberculosis H37Rv
ggaggcguugcacugcu

SEQ ID NO: 3346275 - RNA, 12 nt, Mycobacterium tuberculosis H37Rv
ggaggcugggcu

SEQ ID NO: 3346276 - RNA, 18 nt, Mycobacterium tuberculosis H37Rv
ggagggcccggccggacg

SEQ ID NO: 3346277 - RNA, 12 nt, Mycobacterium tuberculosis H37Rv
ggagggcgagca

SEQ ID NO: 3346278 - RNA, 21 nt, Mycobacterium tuberculosis H37Rv
ggagggcgagcaacucgucca

SEQ ID NO: 3346279 - RNA, 17 nt, Mycobacterium tuberculosis H37Rv
ggaggggacccagcggc

SEQ ID NO: 3346280 - RNA, 21 nt, Mycobacterium tuberculosis H37Rv
ggagggguucacccagcggcg

SEQ ID NO: 3346281 - RNA, 17 nt, Mycobacterium tuberculosis H37Rv
ggaggucgggcggcgac

SEQ ID NO: 3346282 - RNA, 16 nt, Mycobacterium tuberculosis H37Rv
ggagguguggucgagc

SEQ ID NO: 3346283 - RNA, 17 nt, Mycobacterium tuberculosis H37Rv
ggagguguggucgagcg

SEQ ID NO: 3346284 - RNA, 16 nt, Mycobacterium tuberculosis H37Rv
ggaguaguggugggcg

SEQ ID NO: 3346285 - RNA, 21 nt, Mycobacterium tuberculosis H37Rv
ggagucaacuucgacaacgca

SEQ ID NO: 3346286 - RNA, 17 nt, Mycobacterium tuberculosis H37Rv
ggagucgguaucggcag

SEQ ID NO: 3346287 - RNA, 15 nt, Mycobacterium tuberculosis H37Rv
ggagucgucggcaac

SEQ ID NO: 3346288 - RNA, 20 nt, Mycobacterium tuberculosis H37Rv
ggagucgucggcaacgcugg

SEQ ID NO: 3346289 - RNA, 23 nt, Mycobacterium tuberculosis H37Rv
ggagucgucggcaugggccggcg

SEQ ID NO: 3346290 - RNA, 15 nt, Mycobacterium tuberculosis H37Rv
ggagugaggcugugc

SEQ ID NO: 3346291 - RNA, 21 nt, Mycobacterium tuberculosis H37Rv
ggagugaggcugugccccagg

SEQ ID NO: 3346292 - RNA, 14 nt, Mycobacterium tuberculosis H37Rv
ggaguggccgggcg

SEQ ID NO: 3346293 - RNA, 22 nt, Mycobacterium tuberculosis H37Rv
ggaguggcuguacccgaccagc

SEQ ID NO: 3346294 - RNA, 19 nt, Mycobacterium tuberculosis H37Rv
ggagugucgaugcgcgccg

SEQ ID NO: 3346295 - RNA, 15 nt, Mycobacterium tuberculosis H37Rv
ggaguucgcgcagca

SEQ ID NO: 3346296 - RNA, 16 nt, Mycobacterium tuberculosis H37Rv
ggaguugucgacggcc

SEQ ID NO: 3346297 - RNA, 13 nt, Mycobacterium tuberculosis H37Rv
ggaguuuccccua

SEQ ID NO: 3346298 - RNA, 20 nt, Mycobacterium tuberculosis H37Rv
ggaguuugauuccaggucau

SEQ ID NO: 3346299 - RNA, 23 nt, Mycobacterium tuberculosis H37Rv
ggauaacccagcggcgccacgug

SEQ ID NO: 3346300 - RNA, 23 nt, Mycobacterium tuberculosis H37Rv
ggauacaacacagaacucaccga

SEQ ID NO: 3346301 - RNA, 18 nt, Mycobacterium tuberculosis H37Rv
ggauaccggucagcaccu

SEQ ID NO: 3346302 - RNA, 20 nt, Mycobacterium tuberculosis H37Rv
ggauagcgucgucccagcgc

SEQ ID NO: 3346303 - RNA, 21 nt, Mycobacterium tuberculosis H37Rv
ggauaggacgaacaacgcgac

SEQ ID NO: 3346304 - RNA, 23 nt, Mycobacterium tuberculosis H37Rv
ggauagguggucuuggcgguggc

SEQ ID NO: 3346305 - RNA, 13 nt, Mycobacterium tuberculosis H37Rv
ggauaucacgacg

SEQ ID NO: 3346306 - RNA, 13 nt, Mycobacterium tuberculosis H37Rv
ggauaucgucgac

SEQ ID NO: 3346307 - RNA, 20 nt, Mycobacterium tuberculosis H37Rv
ggaucaaggccgguccgauu

SEQ ID NO: 3346308 - RNA, 18 nt, Mycobacterium tuberculosis H37Rv
ggaucacacccacgucga

SEQ ID NO: 3346309 - RNA, 18 nt, Mycobacterium tuberculosis H37Rv
ggaucacaccccaggcac

SEQ ID NO: 3346310 - RNA, 19 nt, Mycobacterium tuberculosis H37Rv
ggaucacaccccaggcacc

SEQ ID NO: 3346311 - RNA, 18 nt, Mycobacterium tuberculosis H37Rv
ggaucacccacucgacgu

SEQ ID NO: 3346312 - RNA, 14 nt, Mycobacterium tuberculosis H37Rv
ggaucacccgccgc

SEQ ID NO: 3346313 - RNA, 20 nt, Mycobacterium tuberculosis H37Rv
ggaucacucccccacacacc

SEQ ID NO: 3346314 - RNA, 14 nt, Mycobacterium tuberculosis H37Rv
ggaucagaacgcgg

SEQ ID NO: 3346315 - RNA, 16 nt, Mycobacterium tuberculosis H37Rv
ggaucagaacgcggcc

SEQ ID NO: 3346316 - RNA, 12 nt, Mycobacterium tuberculosis H37Rv
ggaucagcgacu

SEQ ID NO: 3346317 - RNA, 14 nt, Mycobacterium tuberculosis H37Rv
ggaucagcgcacug

SEQ ID NO: 3346318 - RNA, 13 nt, Mycobacterium tuberculosis H37Rv
ggaucagcgucgg

SEQ ID NO: 3346319 - RNA, 15 nt, Mycobacterium tuberculosis H37Rv
ggaucagcgugucgc

SEQ ID NO: 3346320 - RNA, 17 nt, Mycobacterium tuberculosis H37Rv
ggaucagcgugucgccg

SEQ ID NO: 3346321 - RNA, 20 nt, Mycobacterium tuberculosis H37Rv
ggaucaggcccgggcggaug

SEQ ID NO: 3346322 - RNA, 21 nt, Mycobacterium tuberculosis H37Rv
ggaucauccuucgccggcgcc

SEQ ID NO: 3346323 - RNA, 13 nt, Mycobacterium tuberculosis H37Rv
ggaucaucgccgc

SEQ ID NO: 3346324 - RNA, 19 nt, Mycobacterium tuberculosis H37Rv
ggauccaccacgcuggccu

SEQ ID NO: 3346325 - RNA, 16 nt, Mycobacterium tuberculosis H37Rv
ggauccacccagugcc

SEQ ID NO: 3346326 - RNA, 15 nt, Mycobacterium tuberculosis H37Rv
ggauccagcaggccg

SEQ ID NO: 3346327 - RNA, 16 nt, Mycobacterium tuberculosis H37Rv
ggauccaggcccagcc

SEQ ID NO: 3346328 - RNA, 15 nt, Mycobacterium tuberculosis H37Rv
ggauccaugcgggug

SEQ ID NO: 3346329 - RNA, 21 nt, Mycobacterium tuberculosis H37Rv
ggaucccacgaguuggccaag

SEQ ID NO: 3346330 - RNA, 23 nt, Mycobacterium tuberculosis H37Rv
ggaucccagugccagugccagcg

SEQ ID NO: 3346331 - RNA, 19 nt, Mycobacterium tuberculosis H37Rv
ggaucccccgcgcgaaccg

SEQ ID NO: 3346332 - RNA, 15 nt, Mycobacterium tuberculosis H37Rv
ggaucccgcugcacg

SEQ ID NO: 3346333 - RNA, 19 nt, Mycobacterium tuberculosis H37Rv
ggauccgaagagccagcaa

SEQ ID NO: 3346334 - RNA, 17 nt, Mycobacterium tuberculosis H37Rv
ggauccgaccccgcgcc

SEQ ID NO: 3346335 - RNA, 20 nt, Mycobacterium tuberculosis H37Rv
ggauccgaccccgcgccgac

SEQ ID NO: 3346336 - RNA, 22 nt, Mycobacterium tuberculosis H37Rv
ggauccgcaccacgcccgacga

SEQ ID NO: 3346337 - RNA, 15 nt, Mycobacterium tuberculosis H37Rv
ggauccggaagcccu

SEQ ID NO: 3346338 - RNA, 22 nt, Mycobacterium tuberculosis H37Rv
ggauccggacggugucagccgu

SEQ ID NO: 3346339 - RNA, 13 nt, Mycobacterium tuberculosis H37Rv
ggauccggcggca

SEQ ID NO: 3346340 - RNA, 19 nt, Mycobacterium tuberculosis H37Rv
ggauccgggcgugguggau

SEQ ID NO: 3346341 - RNA, 18 nt, Mycobacterium tuberculosis H37Rv
ggauccgguggugggccg

SEQ ID NO: 3346342 - RNA, 15 nt, Mycobacterium tuberculosis H37Rv
ggcaaacgugaucag

SEQ ID NO: 3346343 - RNA, 15 nt, Mycobacterium tuberculosis H37Rv
ggcaaacuccugcag

SEQ ID NO: 3346344 - RNA, 22 nt, Mycobacterium tuberculosis H37Rv
ggcaaagcgagcaccgcgguag

SEQ ID NO: 3346345 - RNA, 19 nt, Mycobacterium tuberculosis H37Rv
ggcaaaguuggccgcccga

SEQ ID NO: 3346346 - RNA, 13 nt, Mycobacterium tuberculosis H37Rv
ggcaaaucaagca

SEQ ID NO: 3346347 - RNA, 18 nt, Mycobacterium tuberculosis H37Rv
ggcaaaucaagcacagcc

SEQ ID NO: 3346348 - RNA, 18 nt, Mycobacterium tuberculosis H37Rv
ggcaaaucggugcgaucc

SEQ ID NO: 3346349 - RNA, 20 nt, Mycobacterium tuberculosis H37Rv
ggcaaaucggugcgauccug

SEQ ID NO: 3346350 - RNA, 14 nt, Mycobacterium tuberculosis H37Rv
ggcaacacagcuga

SEQ ID NO: 3346351 - RNA, 21 nt, Mycobacterium tuberculosis H37Rv
ggcaacacgauaucgggcuca

SEQ ID NO: 3346352 - RNA, 13 nt, Mycobacterium tuberculosis H37Rv
ggcaacagcgcca

SEQ ID NO: 3346353 - RNA, 21 nt, Mycobacterium tuberculosis H37Rv
ggcaacagcggggugugcggu

SEQ ID NO: 3346354 - RNA, 17 nt, Mycobacterium tuberculosis H37Rv
ggcaacaucgagcgcca

SEQ ID NO: 3346355 - RNA, 22 nt, Mycobacterium tuberculosis H37Rv
ggcaacaucgagcgccagccgg

SEQ ID NO: 3346356 - RNA, 16 nt, Mycobacterium tuberculosis H37Rv
ggcaaccacaucaccg

SEQ ID NO: 3346357 - RNA, 14 nt, Mycobacterium tuberculosis H37Rv
ggcaaccaccggcc

SEQ ID NO: 3346358 - RNA, 16 nt, Mycobacterium tuberculosis H37Rv
ggcaaccaccggccgc

SEQ ID NO: 3346359 - RNA, 14 nt, Mycobacterium tuberculosis H37Rv
ggcaaccagcgagc

SEQ ID NO: 3346360 - RNA, 23 nt, Mycobacterium tuberculosis H37Rv
ggcaaccaggaugguugcgacgg

SEQ ID NO: 3346361 - RNA, 18 nt, Mycobacterium tuberculosis H37Rv
ggcaaccauuagcgccaa

SEQ ID NO: 3346362 - RNA, 22 nt, Mycobacterium tuberculosis H37Rv
ggcaacccagugucagcaagau

SEQ ID NO: 3346363 - RNA, 22 nt, Mycobacterium tuberculosis H37Rv
ggcaaccccgagcggagccgcc

SEQ ID NO: 3346364 - RNA, 20 nt, Mycobacterium tuberculosis H37Rv
ggcaaccgaaccgguccacu

SEQ ID NO: 3346365 - RNA, 17 nt, Mycobacterium tuberculosis H37Rv
ggcaaccgaauugaacu

SEQ ID NO: 3346366 - RNA, 17 nt, Mycobacterium tuberculosis H37Rv
ggcaaccgacacuggga

SEQ ID NO: 3346367 - RNA, 14 nt, Mycobacterium tuberculosis H37Rv
ggcaaccgaugacg

SEQ ID NO: 3346368 - RNA, 22 nt, Mycobacterium tuberculosis H37Rv
ggcaaccgcgcgcgacacgaga

SEQ ID NO: 3346369 - RNA, 12 nt, Mycobacterium tuberculosis H37Rv
ggcaaccggaga

SEQ ID NO: 3346370 - RNA, 23 nt, Mycobacterium tuberculosis H37Rv
ggcaaccuggacugggucgccuc

SEQ ID NO: 3346371 - RNA, 18 nt, Mycobacterium tuberculosis H37Rv
ggcaaccuguuccagcgu

SEQ ID NO: 3346372 - RNA, 12 nt, Mycobacterium tuberculosis H37Rv
ggcaacgacacg

SEQ ID NO: 3346373 - RNA, 16 nt, Mycobacterium tuberculosis H37Rv
ggcaacgacccgccgc

SEQ ID NO: 3346374 - RNA, 18 nt, Mycobacterium tuberculosis H37Rv
ggcaacgacucucaucga

SEQ ID NO: 3346375 - RNA, 17 nt, Mycobacterium tuberculosis H37Rv
ggcaacgaggucugcgg

SEQ ID NO: 3346376 - RNA, 12 nt, Mycobacterium tuberculosis H37Rv
ggcaacgaucag

SEQ ID NO: 3346377 - RNA, 21 nt, Mycobacterium tuberculosis H37Rv
ggcaacgcagcacguucaggu

SEQ ID NO: 3346378 - RNA, 19 nt, Mycobacterium tuberculosis H37Rv
ggcaacgcgaaccggccau

SEQ ID NO: 3346379 - RNA, 14 nt, Mycobacterium tuberculosis H37Rv
ggcaacgcggccuu

SEQ ID NO: 3346380 - RNA, 14 nt, Mycobacterium tuberculosis H37Rv
ggcaacgcggucug

SEQ ID NO: 3346381 - RNA, 14 nt, Mycobacterium tuberculosis H37Rv
ggcaacgcuggcaa

SEQ ID NO: 3346382 - RNA, 18 nt, Mycobacterium tuberculosis H37Rv
ggcaacgguacgcgcuga

SEQ ID NO: 3346383 - RNA, 23 nt, Mycobacterium tuberculosis H37Rv
ggcaacuccggucaacacccgcc

SEQ ID NO: 3346384 - RNA, 20 nt, Mycobacterium tuberculosis H37Rv
ggcaagaaaguuccacgaca

SEQ ID NO: 3346385 - RNA, 18 nt, Mycobacterium tuberculosis H37Rv
ggcaagaccgaacagcgg

SEQ ID NO: 3346386 - RNA, 19 nt, Mycobacterium tuberculosis H37Rv
ggcaagaccgaacagcggc

SEQ ID NO: 3346387 - RNA, 23 nt, Mycobacterium tuberculosis H37Rv
ggcaagaguugccggaucgacgu

SEQ ID NO: 3346388 - RNA, 18 nt, Mycobacterium tuberculosis H37Rv
ggcaagcaaccggugcgc

SEQ ID NO: 3346389 - RNA, 19 nt, Mycobacterium tuberculosis H37Rv
ggcaagcacaccgccagcg

SEQ ID NO: 3346390 - RNA, 22 nt, Mycobacterium tuberculosis H37Rv
ggcaagcacaccgccagcggca

SEQ ID NO: 3346391 - RNA, 14 nt, Mycobacterium tuberculosis H37Rv
ggcaagcacggcgu

SEQ ID NO: 3346392 - RNA, 22 nt, Mycobacterium tuberculosis H37Rv
ggcaagcacggcgucgaugucg

SEQ ID NO: 3346393 - RNA, 19 nt, Mycobacterium tuberculosis H37Rv
ggcaagccacgccggucgc

SEQ ID NO: 3346394 - RNA, 14 nt, Mycobacterium tuberculosis H37Rv
ggcaagccguucug

SEQ ID NO: 3346395 - RNA, 14 nt, Mycobacterium tuberculosis H37Rv
ggcaagcgcacgcu

SEQ ID NO: 3346396 - RNA, 12 nt, Mycobacterium tuberculosis H37Rv
ggcaagcgcaga

SEQ ID NO: 3346397 - RNA, 22 nt, Mycobacterium tuberculosis H37Rv
ggcaagcgcaucgcacagcgcc

SEQ ID NO: 3346398 - RNA, 23 nt, Mycobacterium tuberculosis H37Rv
ggcaagcgugacccgccggcgac

SEQ ID NO: 3346399 - RNA, 18 nt, Mycobacterium tuberculosis H37Rv
ggcaagcugaccgccagc

SEQ ID NO: 3346400 - RNA, 19 nt, Mycobacterium tuberculosis H37Rv
ggcaagcugaccgccagcg

SEQ ID NO: 3346401 - RNA, 18 nt, Mycobacterium tuberculosis H37Rv
ggcaagcugucgucgccc

SEQ ID NO: 3346402 - RNA, 15 nt, Mycobacterium tuberculosis H37Rv
ggcaaggacguggcg

SEQ ID NO: 3346403 - RNA, 21 nt, Mycobacterium tuberculosis H37Rv
ggcaaggccaccgucgcggcg

SEQ ID NO: 3346404 - RNA, 21 nt, Mycobacterium tuberculosis H37Rv
ggcaaggccuugcguguacca

SEQ ID NO: 3346405 - RNA, 21 nt, Mycobacterium tuberculosis H37Rv
ggcaaggcggcggccagccgu

SEQ ID NO: 3346406 - RNA, 15 nt, Mycobacterium tuberculosis H37Rv
ggcaaggucgcggcc

SEQ ID NO: 3346407 - RNA, 20 nt, Mycobacterium tuberculosis H37Rv
ggcaagucaacaccgcggcc

SEQ ID NO: 3346408 - RNA, 20 nt, Mycobacterium tuberculosis H37Rv
ggcaaguccggucgcggaga

SEQ ID NO: 3346409 - RNA, 18 nt, Mycobacterium tuberculosis H37Rv
ggcaagucgacgccgcag

SEQ ID NO: 3346410 - RNA, 23 nt, Mycobacterium tuberculosis H37Rv
ggcaauaccgaaccgguguagca

SEQ ID NO: 3346411 - RNA, 20 nt, Mycobacterium tuberculosis H37Rv
ggcaauaccgccagcgccac

SEQ ID NO: 3346412 - RNA, 19 nt, Mycobacterium tuberculosis H37Rv
ggcaauacguagucgccga

SEQ ID NO: 3346413 - RNA, 14 nt, Mycobacterium tuberculosis H37Rv
ggcaauauccggga

SEQ ID NO: 3346414 - RNA, 18 nt, Mycobacterium tuberculosis H37Rv
ggcaaucaacgcaaugcc

SEQ ID NO: 3346415 - RNA, 23 nt, Mycobacterium tuberculosis H37Rv
ggcaaucacaucaaagucggcgu

SEQ ID NO: 3346416 - RNA, 21 nt, Mycobacterium tuberculosis H37Rv
ggcaaucaucucccgaccgcc

SEQ ID NO: 3346417 - RNA, 17 nt, Mycobacterium tuberculosis H37Rv
ggcaaucccgcggucga

SEQ ID NO: 3346418 - RNA, 22 nt, Mycobacterium tuberculosis H37Rv
ggcaaucgaggaaggugugcgu

SEQ ID NO: 3346419 - RNA, 19 nt, Mycobacterium tuberculosis H37Rv
ggcaaucgcgggcgauggc

SEQ ID NO: 3346420 - RNA, 19 nt, Mycobacterium tuberculosis H37Rv
ggcaaucgcucugugucgc

SEQ ID NO: 3346421 - RNA, 14 nt, Mycobacterium tuberculosis H37Rv
ggcaaucggcggca

SEQ ID NO: 3346422 - RNA, 21 nt, Mycobacterium tuberculosis H37Rv
ggcaaucucccgaaucgugcg

SEQ ID NO: 3346423 - RNA, 22 nt, Mycobacterium tuberculosis H37Rv
ggcaaugaccccggcguugccg

SEQ ID NO: 3346424 - RNA, 22 nt, Mycobacterium tuberculosis H37Rv
ggcaaugaucaucccggcgcgu

SEQ ID NO: 3346425 - RNA, 15 nt, Mycobacterium tuberculosis H37Rv
ggcaaugcggggcaa

SEQ ID NO: 3346426 - RNA, 20 nt, Mycobacterium tuberculosis H37Rv
ggcaaugcuccuaucugccg

SEQ ID NO: 3346427 - RNA, 13 nt, Mycobacterium tuberculosis H37Rv
ggcaauggccagc

SEQ ID NO: 3346428 - RNA, 14 nt, Mycobacterium tuberculosis H37Rv
ggcaauuccgccga

SEQ ID NO: 3346429 - RNA, 16 nt, Mycobacterium tuberculosis H37Rv
ggcaauugcgguucga

SEQ ID NO: 3346430 - RNA, 15 nt, Mycobacterium tuberculosis H37Rv
ggcacaacaucgccg

SEQ ID NO: 3346431 - RNA, 17 nt, Mycobacterium tuberculosis H37Rv
ggcacaacaucgccgca

SEQ ID NO: 3346432 - RNA, 19 nt, Mycobacterium tuberculosis H37Rv
ggcacaaccaacgacaggu

SEQ ID NO: 3346433 - RNA, 17 nt, Mycobacterium tuberculosis H37Rv
ggcacaaucaccgccgc

SEQ ID NO: 3346434 - RNA, 13 nt, Mycobacterium tuberculosis H37Rv
ggcacaaucggcg

SEQ ID NO: 3346435 - RNA, 12 nt, Mycobacterium tuberculosis H37Rv
ggcacacagguc

SEQ ID NO: 3346436 - RNA, 18 nt, Mycobacterium tuberculosis H37Rv
ggcacacccaucaccgcc

SEQ ID NO: 3346437 - RNA, 19 nt, Mycobacterium tuberculosis H37Rv
ggcacacccgcaccggauc

SEQ ID NO: 3346438 - RNA, 16 nt, Mycobacterium tuberculosis H37Rv
ggcacgccgccgacgu

SEQ ID NO: 3346439 - RNA, 19 nt, Mycobacterium tuberculosis H37Rv
ggcacgccggccgcgcuga

SEQ ID NO: 3346440 - RNA, 14 nt, Mycobacterium tuberculosis H37Rv
ggcacgccggcggc

SEQ ID NO: 3346441 - RNA, 16 nt, Mycobacterium tuberculosis H37Rv
ggcacgccggcggcgg

SEQ ID NO: 3346442 - RNA, 19 nt, Mycobacterium tuberculosis H37Rv
ggcacgccgggcaucggcg

SEQ ID NO: 3346443 - RNA, 15 nt, Mycobacterium tuberculosis H37Rv
ggcacgcgaggcgcu

SEQ ID NO: 3346444 - RNA, 18 nt, Mycobacterium tuberculosis H37Rv
ggcacgcggcgaugaugg

SEQ ID NO: 3346445 - RNA, 22 nt, Mycobacterium tuberculosis H37Rv
ggcacgcuccagcucggccagu

SEQ ID NO: 3346446 - RNA, 19 nt, Mycobacterium tuberculosis H37Rv
ggcacgcugagcguccgac

SEQ ID NO: 3346447 - RNA, 22 nt, Mycobacterium tuberculosis H37Rv
ggcacggaaguacuccacccag

SEQ ID NO: 3346448 - RNA, 20 nt, Mycobacterium tuberculosis H37Rv
ggcacggaguuuagcaacua

SEQ ID NO: 3346449 - RNA, 18 nt, Mycobacterium tuberculosis H37Rv
ggcacggaugcgauggcc

SEQ ID NO: 3346450 - RNA, 19 nt, Mycobacterium tuberculosis H37Rv
ggcacggccccugccacga

SEQ ID NO: 3346451 - RNA, 14 nt, Mycobacterium tuberculosis H37Rv
ggcacggccgucga

SEQ ID NO: 3346452 - RNA, 17 nt, Mycobacterium tuberculosis H37Rv
ggcacggccgucgacga

SEQ ID NO: 3346453 - RNA, 14 nt, Mycobacterium tuberculosis H37Rv
ggcacgggcgucgu

SEQ ID NO: 3346454 - RNA, 15 nt, Mycobacterium tuberculosis H37Rv
ggcacgggucgucau

SEQ ID NO: 3346455 - RNA, 22 nt, Mycobacterium tuberculosis H37Rv
ggcacgggucgucaugccaguc

SEQ ID NO: 3346456 - RNA, 18 nt, Mycobacterium tuberculosis H37Rv
ggcacgggugacgauguc

SEQ ID NO: 3346457 - RNA, 19 nt, Mycobacterium tuberculosis H37Rv
ggcacggugaacggcaagg

SEQ ID NO: 3346458 - RNA, 13 nt, Mycobacterium tuberculosis H37Rv
ggcacggugucgc

SEQ ID NO: 3346459 - RNA, 22 nt, Mycobacterium tuberculosis H37Rv
ggcacguccgaucggcgcgccg

SEQ ID NO: 3346460 - RNA, 21 nt, Mycobacterium tuberculosis H37Rv
ggcacgucgaaaucggugcac

SEQ ID NO: 3346461 - RNA, 14 nt, Mycobacterium tuberculosis H37Rv
ggcacgucggcgcc

SEQ ID NO: 3346462 - RNA, 16 nt, Mycobacterium tuberculosis H37Rv
ggcacgucggcgccga

SEQ ID NO: 3346463 - RNA, 22 nt, Mycobacterium tuberculosis H37Rv
ggcacgugaaagccgaccagcg

SEQ ID NO: 3346464 - RNA, 18 nt, Mycobacterium tuberculosis H37Rv
ggcacguggcgaccggcg

SEQ ID NO: 3346465 - RNA, 21 nt, Mycobacterium tuberculosis H37Rv
ggcacguggcgaccggcgacc

SEQ ID NO: 3346466 - RNA, 16 nt, Mycobacterium tuberculosis H37Rv
ggcacguucagccagg

SEQ ID NO: 3346467 - RNA, 17 nt, Mycobacterium tuberculosis H37Rv
ggcacguucagccaggc

SEQ ID NO: 3346468 - RNA, 19 nt, Mycobacterium tuberculosis H37Rv
ggcacguugugaucgucag

SEQ ID NO: 3346469 - RNA, 20 nt, Mycobacterium tuberculosis H37Rv
ggcacuaacggcgugucggg

SEQ ID NO: 3346470 - RNA, 20 nt, Mycobacterium tuberculosis H37Rv
ggcacuacgcagccguagcu

SEQ ID NO: 3346471 - RNA, 18 nt, Mycobacterium tuberculosis H37Rv
ggcacuagacugcugguc

SEQ ID NO: 3346472 - RNA, 16 nt, Mycobacterium tuberculosis H37Rv
ggcacuccaccgggau

SEQ ID NO: 3346473 - RNA, 20 nt, Mycobacterium tuberculosis H37Rv
ggcacuccagcggcgggggc

SEQ ID NO: 3346474 - RNA, 12 nt, Mycobacterium tuberculosis H37Rv
ggcacucccgga

SEQ ID NO: 3346475 - RNA, 16 nt, Mycobacterium tuberculosis H37Rv
ggcacucccuggggua

SEQ ID NO: 3346476 - RNA, 12 nt, Mycobacterium tuberculosis H37Rv
ggcacugaucgg

SEQ ID NO: 3346477 - RNA, 17 nt, Mycobacterium tuberculosis H37Rv
ggcacugcccagcagac

SEQ ID NO: 3346478 - RNA, 15 nt, Mycobacterium tuberculosis H37Rv
ggcacugcgaucgcg

SEQ ID NO: 3346479 - RNA, 15 nt, Mycobacterium tuberculosis H37Rv
ggcacugcggccagu

SEQ ID NO: 3346480 - RNA, 16 nt, Mycobacterium tuberculosis H37Rv
ggcacuggauccggga

SEQ ID NO: 3346481 - RNA, 22 nt, Mycobacterium tuberculosis H37Rv
ggcacugugaggucauuggcga

SEQ ID NO: 3346482 - RNA, 16 nt, Mycobacterium tuberculosis H37Rv
ggcacuuccagcccgg

SEQ ID NO: 3346483 - RNA, 20 nt, Mycobacterium tuberculosis H37Rv
ggcacuuccagcccggcaau

SEQ ID NO: 3346484 - RNA, 19 nt, Mycobacterium tuberculosis H37Rv
ggcacuugcccgucggcgc

SEQ ID NO: 3346485 - RNA, 20 nt, Mycobacterium tuberculosis H37Rv
ggcacuuuguagcccgcgau

SEQ ID NO: 3346486 - RNA, 21 nt, Mycobacterium tuberculosis H37Rv
ggcagaacuggacaagcuccu

SEQ ID NO: 3346487 - RNA, 18 nt, Mycobacterium tuberculosis H37Rv
ggcagacacgcugcaggc

SEQ ID NO: 3346488 - RNA, 22 nt, Mycobacterium tuberculosis H37Rv
ggcagacacgcugcaggcggcc

SEQ ID NO: 3346489 - RNA, 22 nt, Mycobacterium tuberculosis H37Rv
ggcagaccaagcccgucgucgu

SEQ ID NO: 3346490 - RNA, 20 nt, Mycobacterium tuberculosis H37Rv
ggcagaccgaucggcaggcc

SEQ ID NO: 3346491 - RNA, 14 nt, Mycobacterium tuberculosis H37Rv
ggcagaccggcauc

SEQ ID NO: 3346492 - RNA, 12 nt, Mycobacterium tuberculosis H37Rv
ggcagagccgcc

SEQ ID NO: 3346493 - RNA, 22 nt, Mycobacterium tuberculosis H37Rv
ggcagauacucggcgacugcgu

SEQ ID NO: 3346494 - RNA, 14 nt, Mycobacterium tuberculosis H37Rv
ggcagaucgauacc

SEQ ID NO: 3346495 - RNA, 23 nt, Mycobacterium tuberculosis H37Rv
ggcagaugagucaaaauccgcgu

SEQ ID NO: 3346496 - RNA, 18 nt, Mycobacterium tuberculosis H37Rv
ggcagauucuucacccaa

SEQ ID NO: 3346497 - RNA, 12 nt, Mycobacterium tuberculosis H37Rv
ggcagcaaaaac

SEQ ID NO: 3346498 - RNA, 19 nt, Mycobacterium tuberculosis H37Rv
ggcagcaaaaaccagcguc

SEQ ID NO: 3346499 - RNA, 19 nt, Mycobacterium tuberculosis H37Rv
ggcagcaaaaacgcugccg

SEQ ID NO: 3346500 - RNA, 16 nt, Mycobacterium tuberculosis H37Rv
ggcagcaacaggccca

SEQ ID NO: 3346501 - RNA, 23 nt, Mycobacterium tuberculosis H37Rv
ggcagcaacaggcccacggcgac

SEQ ID NO: 3346502 - RNA, 15 nt, Mycobacterium tuberculosis H37Rv
ggcagcacaggcugg

SEQ ID NO: 3346503 - RNA, 21 nt, Mycobacterium tuberculosis H37Rv
ggcagcacccacaucagccgc

SEQ ID NO: 3346504 - RNA, 16 nt, Mycobacterium tuberculosis H37Rv
ggcagcacccgcgcca

SEQ ID NO: 3346505 - RNA, 21 nt, Mycobacterium tuberculosis H37Rv
ggcagcaccggugaccucggu

SEQ ID NO: 3346506 - RNA, 13 nt, Mycobacterium tuberculosis H37Rv
ggcagcacgaccu

SEQ ID NO: 3346507 - RNA, 17 nt, Mycobacterium tuberculosis H37Rv
ggcagcacggucugggu

SEQ ID NO: 3346508 - RNA, 15 nt, Mycobacterium tuberculosis H37Rv
ggcagcacgucacgc

SEQ ID NO: 3346509 - RNA, 15 nt, Mycobacterium tuberculosis H37Rv
ggcagcacuuggacc

SEQ ID NO: 3346510 - RNA, 16 nt, Mycobacterium tuberculosis H37Rv
ggcagcagccggcggg

SEQ ID NO: 3346511 - RNA, 14 nt, Mycobacterium tuberculosis H37Rv
ggcagcagcgggcg

SEQ ID NO: 3346512 - RNA, 16 nt, Mycobacterium tuberculosis H37Rv
ggcagcagcgggcgcg

SEQ ID NO: 3346513 - RNA, 12 nt, Mycobacterium tuberculosis H37Rv
ggcagcagcggu

SEQ ID NO: 3346514 - RNA, 19 nt, Mycobacterium tuberculosis H37Rv
ggcagcagcggugcagccc

SEQ ID NO: 3346515 - RNA, 21 nt, Mycobacterium tuberculosis H37Rv
ggcagcagcggugcagcccgc

SEQ ID NO: 3346516 - RNA, 23 nt, Mycobacterium tuberculosis H37Rv
ggcagcagcggugcagcccgccg

SEQ ID NO: 3346517 - RNA, 13 nt, Mycobacterium tuberculosis H37Rv
ggcagcauauccg

SEQ ID NO: 3346518 - RNA, 21 nt, Mycobacterium tuberculosis H37Rv
ggcagcauauccgccggcgac

SEQ ID NO: 3346519 - RNA, 16 nt, Mycobacterium tuberculosis H37Rv
ggcagcaucggucaca

SEQ ID NO: 3346520 - RNA, 19 nt, Mycobacterium tuberculosis H37Rv
ggcagcaucuccgucggcc

SEQ ID NO: 3346521 - RNA, 13 nt, Mycobacterium tuberculosis H37Rv
ggcagcauggcca

SEQ ID NO: 3346522 - RNA, 14 nt, Mycobacterium tuberculosis H37Rv
ggcagccaccagcg

SEQ ID NO: 3346523 - RNA, 22 nt, Mycobacterium tuberculosis H37Rv
ggcagccaccgucaugccgacg

SEQ ID NO: 3346524 - RNA, 13 nt, Mycobacterium tuberculosis H37Rv
ggcagccagaucu

SEQ ID NO: 3346525 - RNA, 13 nt, Mycobacterium tuberculosis H37Rv
ggcagccagcggc

SEQ ID NO: 3346526 - RNA, 14 nt, Mycobacterium tuberculosis H37Rv
ggcagccccuccgc

SEQ ID NO: 3346527 - RNA, 16 nt, Mycobacterium tuberculosis H37Rv
ggcagcccgcuggccu

SEQ ID NO: 3346528 - RNA, 18 nt, Mycobacterium tuberculosis H37Rv
ggcagcccggcggccgcu

SEQ ID NO: 3346529 - RNA, 19 nt, Mycobacterium tuberculosis H37Rv
ggcagcccguggucgauca

SEQ ID NO: 3346530 - RNA, 19 nt, Mycobacterium tuberculosis H37Rv
ggcagccgaagcgcccguu

SEQ ID NO: 3346531 - RNA, 13 nt, Mycobacterium tuberculosis H37Rv
ggcagccgcccgc

SEQ ID NO: 3346532 - RNA, 16 nt, Mycobacterium tuberculosis H37Rv
ggcagccgcccgccag

SEQ ID NO: 3346533 - RNA, 18 nt, Mycobacterium tuberculosis H37Rv
ggcagccgcgccgcggcc

SEQ ID NO: 3346534 - RNA, 13 nt, Mycobacterium tuberculosis H37Rv
ggcauacauccag

SEQ ID NO: 3346535 - RNA, 16 nt, Mycobacterium tuberculosis H37Rv
ggcauagcagccagcg

SEQ ID NO: 3346536 - RNA, 17 nt, Mycobacterium tuberculosis H37Rv
ggcauagcagccagcgu

SEQ ID NO: 3346537 - RNA, 22 nt, Mycobacterium tuberculosis H37Rv
ggcauaucgauucgggcgucgg

SEQ ID NO: 3346538 - RNA, 19 nt, Mycobacterium tuberculosis H37Rv
ggcaucaacgcgggcgcuu

SEQ ID NO: 3346539 - RNA, 14 nt, Mycobacterium tuberculosis H37Rv
ggcaucaccgacgc

SEQ ID NO: 3346540 - RNA, 22 nt, Mycobacterium tuberculosis H37Rv
ggcaucaccgacgcgucggcga

SEQ ID NO: 3346541 - RNA, 14 nt, Mycobacterium tuberculosis H37Rv
ggcaucaccggaac

SEQ ID NO: 3346542 - RNA, 13 nt, Mycobacterium tuberculosis H37Rv
ggcaucaccuggc

SEQ ID NO: 3346543 - RNA, 19 nt, Mycobacterium tuberculosis H37Rv
ggcaucaccuggcgugucg

SEQ ID NO: 3346544 - RNA, 23 nt, Mycobacterium tuberculosis H37Rv
ggcaucaccuggcgugucgccgc

SEQ ID NO: 3346545 - RNA, 14 nt, Mycobacterium tuberculosis H37Rv
ggcaucagcagagc

SEQ ID NO: 3346546 - RNA, 18 nt, Mycobacterium tuberculosis H37Rv
ggcaucagcagagccccg

SEQ ID NO: 3346547 - RNA, 17 nt, Mycobacterium tuberculosis H37Rv
ggcauccaaaaucgccu

SEQ ID NO: 3346548 - RNA, 20 nt, Mycobacterium tuberculosis H37Rv
ggcauccaaaaucgccugau

SEQ ID NO: 3346549 - RNA, 19 nt, Mycobacterium tuberculosis H37Rv
ggcauccacaccgaccgcg

SEQ ID NO: 3346550 - RNA, 15 nt, Mycobacterium tuberculosis H37Rv
ggcauccagcuucgc

SEQ ID NO: 3346551 - RNA, 17 nt, Mycobacterium tuberculosis H37Rv
ggcauccaggcugucgc

SEQ ID NO: 3346552 - RNA, 22 nt, Mycobacterium tuberculosis H37Rv
ggcauccccaguugugcggcca

SEQ ID NO: 3346553 - RNA, 20 nt, Mycobacterium tuberculosis H37Rv
ggcauccucugaaccugcug

SEQ ID NO: 3346554 - RNA, 13 nt, Mycobacterium tuberculosis H37Rv
ggcauccugcacg

SEQ ID NO: 3346555 - RNA, 14 nt, Mycobacterium tuberculosis H37Rv
ggcauccuucacca

SEQ ID NO: 3346556 - RNA, 20 nt, Mycobacterium tuberculosis H37Rv
ggcaucgaauuccagccagc

SEQ ID NO: 3346557 - RNA, 13 nt, Mycobacterium tuberculosis H37Rv
ggcaucgacgcgg

SEQ ID NO: 3346558 - RNA, 16 nt, Mycobacterium tuberculosis H37Rv
ggcaucgacugccagc

SEQ ID NO: 3346559 - RNA, 18 nt, Mycobacterium tuberculosis H37Rv
ggcaucgagacgagccac

SEQ ID NO: 3346560 - RNA, 15 nt, Mycobacterium tuberculosis H37Rv
ggcaucgaggccagc

SEQ ID NO: 3346561 - RNA, 14 nt, Mycobacterium tuberculosis H37Rv
ggcaucgccgagcu

SEQ ID NO: 3346562 - RNA, 23 nt, Mycobacterium tuberculosis H37Rv
ggcaucgcgaauauagcggcguu

SEQ ID NO: 3346563 - RNA, 17 nt, Mycobacterium tuberculosis H37Rv
ggcaucgcgagccagcu

SEQ ID NO: 3346564 - RNA, 17 nt, Mycobacterium tuberculosis H37Rv
ggcaucgcgcgcggcuc

SEQ ID NO: 3346565 - RNA, 22 nt, Mycobacterium tuberculosis H37Rv
ggcaucggagauacgggccacc

SEQ ID NO: 3346566 - RNA, 23 nt, Mycobacterium tuberculosis H37Rv
ggcaucggaggaaccccgcgcgg

SEQ ID NO: 3346567 - RNA, 17 nt, Mycobacterium tuberculosis H37Rv
ggcaucggccaccuguu

SEQ ID NO: 3346568 - RNA, 14 nt, Mycobacterium tuberculosis H37Rv
ggcaucggccagcc

SEQ ID NO: 3346569 - RNA, 14 nt, Mycobacterium tuberculosis H37Rv
ggcaucggccaucu

SEQ ID NO: 3346570 - RNA, 17 nt, Mycobacterium tuberculosis H37Rv
ggcaucggcggagucga

SEQ ID NO: 3346571 - RNA, 18 nt, Mycobacterium tuberculosis H37Rv
ggcaucggcggccugcuc

SEQ ID NO: 3346572 - RNA, 20 nt, Mycobacterium tuberculosis H37Rv
ggcaucggcggcgucuucgu

SEQ ID NO: 3346573 - RNA, 22 nt, Mycobacterium tuberculosis H37Rv
ggcaucggucagcgcggcaagc

SEQ ID NO: 3346574 - RNA, 13 nt, Mycobacterium tuberculosis H37Rv
ggcaucggugcgg

SEQ ID NO: 3346575 - RNA, 18 nt, Mycobacterium tuberculosis H37Rv
ggcaucggugcgguucgc

SEQ ID NO: 3346576 - RNA, 14 nt, Mycobacterium tuberculosis H37Rv
ggcaucgucgacgc

SEQ ID NO: 3346577 - RNA, 21 nt, Mycobacterium tuberculosis H37Rv
ggcaucgucgccauaccugcc

SEQ ID NO: 3346578 - RNA, 14 nt, Mycobacterium tuberculosis H37Rv
ggcaucgucgccga

SEQ ID NO: 3346579 - RNA, 15 nt, Mycobacterium tuberculosis H37Rv
ggcaucgucgccgag

SEQ ID NO: 3346580 - RNA, 23 nt, Mycobacterium tuberculosis H37Rv
ggcaucuccaccgucgccgccgg

SEQ ID NO: 3346581 - RNA, 21 nt, Mycobacterium tuberculosis H37Rv
ggcaucucggcuacgccucgg

SEQ ID NO: 3346582 - RNA, 18 nt, Mycobacterium tuberculosis H37Rv
ggcaugacgaaugcgggu

SEQ ID NO: 3346583 - RNA, 16 nt, Mycobacterium tuberculosis H37Rv
ggcaugacgaauuggu

SEQ ID NO: 3346584 - RNA, 23 nt, Mycobacterium tuberculosis H37Rv
ggcaugauccccguugacccaga

SEQ ID NO: 3346585 - RNA, 22 nt, Mycobacterium tuberculosis H37Rv
ggcaugauuuuucgcagugacg

SEQ ID NO: 3346586 - RNA, 21 nt, Mycobacterium tuberculosis H37Rv
ggcaugcaaugcuggcggcgc

SEQ ID NO: 3346587 - RNA, 17 nt, Mycobacterium tuberculosis H37Rv
ggcaugcagccccacuu

SEQ ID NO: 3346588 - RNA, 12 nt, Mycobacterium tuberculosis H37Rv
ggcaugccacac

SEQ ID NO: 3346589 - RNA, 19 nt, Mycobacterium tuberculosis H37Rv
ggcaugccagccacgaacu

SEQ ID NO: 3346590 - RNA, 14 nt, Mycobacterium tuberculosis H37Rv
ggcaugccgcccgc

SEQ ID NO: 3346591 - RNA, 23 nt, Mycobacterium tuberculosis H37Rv
ggcaugcggaucggaucaucggg

SEQ ID NO: 3346592 - RNA, 17 nt, Mycobacterium tuberculosis H37Rv
ggcaugcggaucggcgg

SEQ ID NO: 3346593 - RNA, 15 nt, Mycobacterium tuberculosis H37Rv
ggcaugcgugccggc

SEQ ID NO: 3346594 - RNA, 22 nt, Mycobacterium tuberculosis H37Rv
ggcaugcucgacaaccgcccgc

SEQ ID NO: 3346595 - RNA, 19 nt, Mycobacterium tuberculosis H37Rv
ggcauggauacgcagcacc

SEQ ID NO: 3346596 - RNA, 16 nt, Mycobacterium tuberculosis H37Rv
ggcauggccuggguug

SEQ ID NO: 3346597 - RNA, 14 nt, Mycobacterium tuberculosis H37Rv
ggcauggcgccguu

SEQ ID NO: 3346598 - RNA, 15 nt, Mycobacterium tuberculosis H37Rv
ggcauggcgccguug

SEQ ID NO: 3346599 - RNA, 17 nt, Mycobacterium tuberculosis H37Rv
ggcaugggcccugcaca

SEQ ID NO: 3346600 - RNA, 15 nt, Mycobacterium tuberculosis H37Rv
ggcaugggccggcgc

SEQ ID NO: 3346601 - RNA, 16 nt, Mycobacterium tuberculosis H37Rv
ggcauguaccgaccgc

SEQ ID NO: 3346602 - RNA, 17 nt, Mycobacterium tuberculosis H37Rv
ggcauguaccgaccgcg

SEQ ID NO: 3346603 - RNA, 23 nt, Mycobacterium tuberculosis H37Rv
ggcaugugacaucgggccgccga

SEQ ID NO: 3346604 - RNA, 15 nt, Mycobacterium tuberculosis H37Rv
ggcauuaggccgggg

SEQ ID NO: 3346605 - RNA, 16 nt, Mycobacterium tuberculosis H37Rv
ggcauucccgcucgca

SEQ ID NO: 3346606 - RNA, 22 nt, Mycobacterium tuberculosis H37Rv
ggcauuccggugugcuugcucg

SEQ ID NO: 3346607 - RNA, 13 nt, Mycobacterium tuberculosis H37Rv
ggcauugcggccc

SEQ ID NO: 3346608 - RNA, 18 nt, Mycobacterium tuberculosis H37Rv
ggcauugcuccgguuggc

SEQ ID NO: 3346609 - RNA, 17 nt, Mycobacterium tuberculosis H37Rv
ggcauugguaccggcuu

SEQ ID NO: 3346610 - RNA, 17 nt, Mycobacterium tuberculosis H37Rv
ggcauuucagcgcgccg

SEQ ID NO: 3346611 - RNA, 13 nt, Mycobacterium tuberculosis H37Rv
ggccaaaauggcg

SEQ ID NO: 3346612 - RNA, 21 nt, Mycobacterium tuberculosis H37Rv
ggccaaagacccggcacccag

SEQ ID NO: 3346613 - RNA, 22 nt, Mycobacterium tuberculosis H37Rv
ggccaaagccgucagcucacca

SEQ ID NO: 3346614 - RNA, 14 nt, Mycobacterium tuberculosis H37Rv
ggccaaagcgcggg

SEQ ID NO: 3346615 - RNA, 18 nt, Mycobacterium tuberculosis H37Rv
ggccaaauaacgcgggau

SEQ ID NO: 3346616 - RNA, 21 nt, Mycobacterium tuberculosis H37Rv
ggccaacaccacuagcggcuc

SEQ ID NO: 3346617 - RNA, 13 nt, Mycobacterium tuberculosis H37Rv
ggccaacaccuca

SEQ ID NO: 3346618 - RNA, 15 nt, Mycobacterium tuberculosis H37Rv
ggccaacagguccac

SEQ ID NO: 3346619 - RNA, 17 nt, Mycobacterium tuberculosis H37Rv
ggccaacagguccaccg

SEQ ID NO: 3346620 - RNA, 18 nt, Mycobacterium tuberculosis H37Rv
ggccaacagucgcagcac

SEQ ID NO: 3346621 - RNA, 14 nt, Mycobacterium tuberculosis H37Rv
ggccaacauccggu

SEQ ID NO: 3346622 - RNA, 23 nt, Mycobacterium tuberculosis H37Rv
ggccaacauccgguggugcucgu

SEQ ID NO: 3346623 - RNA, 14 nt, Mycobacterium tuberculosis H37Rv
ggccaaccccaugg

SEQ ID NO: 3346624 - RNA, 20 nt, Mycobacterium tuberculosis H37Rv
ggccaaccccauggccagcg

SEQ ID NO: 3346625 - RNA, 22 nt, Mycobacterium tuberculosis H37Rv
ggccaaccccauggccagcgcu

SEQ ID NO: 3346626 - RNA, 15 nt, Mycobacterium tuberculosis H37Rv
ggccaacccgggccg

SEQ ID NO: 3346627 - RNA, 18 nt, Mycobacterium tuberculosis H37Rv
ggccaaccgggugugcgu

SEQ ID NO: 3346628 - RNA, 16 nt, Mycobacterium tuberculosis H37Rv
ggccaacgaacgugcc

SEQ ID NO: 3346629 - RNA, 14 nt, Mycobacterium tuberculosis H37Rv
ggccaacgacggcc

SEQ ID NO: 3346630 - RNA, 17 nt, Mycobacterium tuberculosis H37Rv
ggccacggucagccagg

SEQ ID NO: 3346631 - RNA, 16 nt, Mycobacterium tuberculosis H37Rv
ggccacgguccggccc

SEQ ID NO: 3346632 - RNA, 22 nt, Mycobacterium tuberculosis H37Rv
ggccacgguccggcccaccagc

SEQ ID NO: 3346633 - RNA, 22 nt, Mycobacterium tuberculosis H37Rv
ggccacguagcagcagacgacg

SEQ ID NO: 3346634 - RNA, 18 nt, Mycobacterium tuberculosis H37Rv
ggccacguccucagccgu

SEQ ID NO: 3346635 - RNA, 14 nt, Mycobacterium tuberculosis H37Rv
ggccacucccagcc

SEQ ID NO: 3346636 - RNA, 16 nt, Mycobacterium tuberculosis H37Rv
ggccacuccgguggcc

SEQ ID NO: 3346637 - RNA, 18 nt, Mycobacterium tuberculosis H37Rv
ggccacugauucgcaggc

SEQ ID NO: 3346638 - RNA, 22 nt, Mycobacterium tuberculosis H37Rv
ggccacugcguuccaucgccga

SEQ ID NO: 3346639 - RNA, 23 nt, Mycobacterium tuberculosis H37Rv
ggccacugcguuccaucgccgac

SEQ ID NO: 3346640 - RNA, 19 nt, Mycobacterium tuberculosis H37Rv
ggccacuugaugcucgaug

SEQ ID NO: 3346641 - RNA, 16 nt, Mycobacterium tuberculosis H37Rv
ggccacuugcucggcg

SEQ ID NO: 3346642 - RNA, 17 nt, Mycobacterium tuberculosis H37Rv
ggccacuugcucggcga

SEQ ID NO: 3346643 - RNA, 22 nt, Mycobacterium tuberculosis H37Rv
ggccagaacggaauucagcgac

SEQ ID NO: 3346644 - RNA, 15 nt, Mycobacterium tuberculosis H37Rv
ggccagacccaccac

SEQ ID NO: 3346645 - RNA, 12 nt, Mycobacterium tuberculosis H37Rv
ggccagaccgaa

SEQ ID NO: 3346646 - RNA, 15 nt, Mycobacterium tuberculosis H37Rv
ggccagaccgcgcgc

SEQ ID NO: 3346647 - RNA, 20 nt, Mycobacterium tuberculosis H37Rv
ggccagacggugcagcuccc

SEQ ID NO: 3346648 - RNA, 13 nt, Mycobacterium tuberculosis H37Rv
ggccagagccgcg

SEQ ID NO: 3346649 - RNA, 16 nt, Mycobacterium tuberculosis H37Rv
ggccagagccgcgcgc

SEQ ID NO: 3346650 - RNA, 18 nt, Mycobacterium tuberculosis H37Rv
ggccagagccgcgcgccg

SEQ ID NO: 3346651 - RNA, 16 nt, Mycobacterium tuberculosis H37Rv
ggccagagucgcccgc

SEQ ID NO: 3346652 - RNA, 20 nt, Mycobacterium tuberculosis H37Rv
ggccagagucgcccgcacac

SEQ ID NO: 3346653 - RNA, 14 nt, Mycobacterium tuberculosis H37Rv
ggccagaucacgca

SEQ ID NO: 3346654 - RNA, 16 nt, Mycobacterium tuberculosis H37Rv
ggccagaucgaagcgc

SEQ ID NO: 3346655 - RNA, 23 nt, Mycobacterium tuberculosis H37Rv
ggccagaucgaagcgcagcaccu

SEQ ID NO: 3346656 - RNA, 22 nt, Mycobacterium tuberculosis H37Rv
ggccagcaacugccgcacccgg

SEQ ID NO: 3346657 - RNA, 17 nt, Mycobacterium tuberculosis H37Rv
ggccagcaaguacgcgu

SEQ ID NO: 3346658 - RNA, 14 nt, Mycobacterium tuberculosis H37Rv
ggccagcaagugcg

SEQ ID NO: 3346659 - RNA, 19 nt, Mycobacterium tuberculosis H37Rv
ggccagcaccacggccagc

SEQ ID NO: 3346660 - RNA, 22 nt, Mycobacterium tuberculosis H37Rv
ggccagcacccgcuccagcucg

SEQ ID NO: 3346661 - RNA, 16 nt, Mycobacterium tuberculosis H37Rv
ggccagcaccucgacc

SEQ ID NO: 3346662 - RNA, 13 nt, Mycobacterium tuberculosis H37Rv
ggccagcacgccg

SEQ ID NO: 3346663 - RNA, 18 nt, Mycobacterium tuberculosis H37Rv
ggccagcacgccgccggc

SEQ ID NO: 3346664 - RNA, 24 nt, Mycobacterium tuberculosis H37Rv
ggccagcacgccgccggccgccag

SEQ ID NO: 3346665 - RNA, 14 nt, Mycobacterium tuberculosis H37Rv
ggccagcacggcga

SEQ ID NO: 3346666 - RNA, 21 nt, Mycobacterium tuberculosis H37Rv
ggccagcagaaacaucgacag

SEQ ID NO: 3346667 - RNA, 16 nt, Mycobacterium tuberculosis H37Rv
ggccagcagagcggca

SEQ ID NO: 3346668 - RNA, 12 nt, Mycobacterium tuberculosis H37Rv
ggccagcagcaa

SEQ ID NO: 3346669 - RNA, 15 nt, Mycobacterium tuberculosis H37Rv
ggccagcagcaacga

SEQ ID NO: 3346670 - RNA, 14 nt, Mycobacterium tuberculosis H37Rv
ggccagcagcagau

SEQ ID NO: 3346671 - RNA, 15 nt, Mycobacterium tuberculosis H37Rv
ggccagcagccgcga

SEQ ID NO: 3346672 - RNA, 13 nt, Mycobacterium tuberculosis H37Rv
ggccagcagcgac

SEQ ID NO: 3346673 - RNA, 22 nt, Mycobacterium tuberculosis H37Rv
ggccagcagcgacuccagcgcc

SEQ ID NO: 3346674 - RNA, 23 nt, Mycobacterium tuberculosis H37Rv
ggccagcagcgacuccagcgccc

SEQ ID NO: 3346675 - RNA, 14 nt, Mycobacterium tuberculosis H37Rv
ggccagcagcgcgg

SEQ ID NO: 3346676 - RNA, 23 nt, Mycobacterium tuberculosis H37Rv
ggccagcaggaugaugaccgcca

SEQ ID NO: 3346677 - RNA, 14 nt, Mycobacterium tuberculosis H37Rv
ggccagcaggcggc

SEQ ID NO: 3346678 - RNA, 20 nt, Mycobacterium tuberculosis H37Rv
ggccagcagggccaccacca

SEQ ID NO: 3346679 - RNA, 12 nt, Mycobacterium tuberculosis H37Rv
ggccagcaggua

SEQ ID NO: 3346680 - RNA, 20 nt, Mycobacterium tuberculosis H37Rv
ggccagcaucagcgccagcg

SEQ ID NO: 3346681 - RNA, 23 nt, Mycobacterium tuberculosis H37Rv
ggccagcaucagcgccagcgagc

SEQ ID NO: 3346682 - RNA, 21 nt, Mycobacterium tuberculosis H37Rv
ggccagcaucagcucgaugcc

SEQ ID NO: 3346683 - RNA, 16 nt, Mycobacterium tuberculosis H37Rv
ggccagcaucgggugg

SEQ ID NO: 3346684 - RNA, 18 nt, Mycobacterium tuberculosis H37Rv
ggccagccacuccucggu

SEQ ID NO: 3346685 - RNA, 12 nt, Mycobacterium tuberculosis H37Rv
ggccagccaugg

SEQ ID NO: 3346686 - RNA, 18 nt, Mycobacterium tuberculosis H37Rv
ggccagcccacucgucga

SEQ ID NO: 3346687 - RNA, 12 nt, Mycobacterium tuberculosis H37Rv
ggccagcccagc

SEQ ID NO: 3346688 - RNA, 17 nt, Mycobacterium tuberculosis H37Rv
ggccagccgacgcggcg

SEQ ID NO: 3346689 - RNA, 16 nt, Mycobacterium tuberculosis H37Rv
ggccagccuaccggcu

SEQ ID NO: 3346690 - RNA, 17 nt, Mycobacterium tuberculosis H37Rv
ggccagcgagaucagca

SEQ ID NO: 3346691 - RNA, 22 nt, Mycobacterium tuberculosis H37Rv
ggccagcgaugugaaccgggca

SEQ ID NO: 3346692 - RNA, 17 nt, Mycobacterium tuberculosis H37Rv
ggccagcgauguggcgu

SEQ ID NO: 3346693 - RNA, 14 nt, Mycobacterium tuberculosis H37Rv
ggccagcgcaccgc

SEQ ID NO: 3346694 - RNA, 23 nt, Mycobacterium tuberculosis H37Rv
ggccagcgcaucuuugaacgcca

SEQ ID NO: 3346695 - RNA, 14 nt, Mycobacterium tuberculosis H37Rv
ggccagcgcaugga

SEQ ID NO: 3346696 - RNA, 18 nt, Mycobacterium tuberculosis H37Rv
ggccagcgccucggcauc

SEQ ID NO: 3346697 - RNA, 18 nt, Mycobacterium tuberculosis H37Rv
ggccagcgcgccacgagc

SEQ ID NO: 3346698 - RNA, 15 nt, Mycobacterium tuberculosis H37Rv
ggccagcgcgcgcgg

SEQ ID NO: 3346699 - RNA, 13 nt, Mycobacterium tuberculosis H37Rv
ggccagcgcggcg

SEQ ID NO: 3346700 - RNA, 19 nt, Mycobacterium tuberculosis H37Rv
ggccagcgcggcgcgcggg

SEQ ID NO: 3346701 - RNA, 15 nt, Mycobacterium tuberculosis H37Rv
ggccagcgcucaccg

SEQ ID NO: 3346702 - RNA, 16 nt, Mycobacterium tuberculosis H37Rv
ggccagcgcucaccgg

SEQ ID NO: 3346703 - RNA, 14 nt, Mycobacterium tuberculosis H37Rv
ggccagcgcugcug

SEQ ID NO: 3346704 - RNA, 11 nt, Mycobacterium tuberculosis H37Rv
ggccagcggca

SEQ ID NO: 3346705 - RNA, 13 nt, Mycobacterium tuberculosis H37Rv
ggccagcggcagc

SEQ ID NO: 3346706 - RNA, 14 nt, Mycobacterium tuberculosis H37Rv
ggccagcggcagcc

SEQ ID NO: 3346707 - RNA, 14 nt, Mycobacterium tuberculosis H37Rv
ggccagcggcagga

SEQ ID NO: 3346708 - RNA, 11 nt, Mycobacterium tuberculosis H37Rv
ggccagcggcc

SEQ ID NO: 3346709 - RNA, 20 nt, Mycobacterium tuberculosis H37Rv
ggccagcgggugaaucgaca

SEQ ID NO: 3346710 - RNA, 22 nt, Mycobacterium tuberculosis H37Rv
ggccagcgggugaaucgacacc

SEQ ID NO: 3346711 - RNA, 18 nt, Mycobacterium tuberculosis H37Rv
ggccagcgguaaugccag

SEQ ID NO: 3346712 - RNA, 22 nt, Mycobacterium tuberculosis H37Rv
ggccagcgguaaugccagcggc

SEQ ID NO: 3346713 - RNA, 23 nt, Mycobacterium tuberculosis H37Rv
ggccagcgguaaugccagcggca

SEQ ID NO: 3346714 - RNA, 19 nt, Mycobacterium tuberculosis H37Rv
ggccagcgucaacagcgug

SEQ ID NO: 3346715 - RNA, 22 nt, Mycobacterium tuberculosis H37Rv
ggccagcgugucccaacgccac

SEQ ID NO: 3346716 - RNA, 15 nt, Mycobacterium tuberculosis H37Rv
ggccagcuccagcgc

SEQ ID NO: 3346717 - RNA, 22 nt, Mycobacterium tuberculosis H37Rv
ggccagcucccgggcggcggcc

SEQ ID NO: 3346718 - RNA, 23 nt, Mycobacterium tuberculosis H37Rv
ggccagcucccgggcggcggccu

SEQ ID NO: 3346719 - RNA, 20 nt, Mycobacterium tuberculosis H37Rv
ggccagcuccucagccaccg

SEQ ID NO: 3346720 - RNA, 12 nt, Mycobacterium tuberculosis H37Rv
ggccagcucgcg

SEQ ID NO: 3346721 - RNA, 21 nt, Mycobacterium tuberculosis H37Rv
ggccagcucgcgggccgcguc

SEQ ID NO: 3346722 - RNA, 14 nt, Mycobacterium tuberculosis H37Rv
ggccagcucggcca

SEQ ID NO: 3346723 - RNA, 17 nt, Mycobacterium tuberculosis H37Rv
ggccagcucggccagcu

SEQ ID NO: 3346724 - RNA, 17 nt, Mycobacterium tuberculosis H37Rv
ggccagcucggccuggu

SEQ ID NO: 3346725 - RNA, 15 nt, Mycobacterium tuberculosis H37Rv
ggccagcugcggcuc

SEQ ID NO: 3346726 - RNA, 14 nt, Mycobacterium tuberculosis H37Rv
ggcccagccgagcg

SEQ ID NO: 3346727 - RNA, 20 nt, Mycobacterium tuberculosis H37Rv
ggcccagccgagcggcggca

SEQ ID NO: 3346728 - RNA, 22 nt, Mycobacterium tuberculosis H37Rv
ggcccagccggaccgcgacggc

SEQ ID NO: 3346729 - RNA, 15 nt, Mycobacterium tuberculosis H37Rv
ggcccagcgaccagu

SEQ ID NO: 3346730 - RNA, 18 nt, Mycobacterium tuberculosis H37Rv
ggcccagcgcgccagcuu

SEQ ID NO: 3346731 - RNA, 14 nt, Mycobacterium tuberculosis H37Rv
ggcccagcggccgc

SEQ ID NO: 3346732 - RNA, 15 nt, Mycobacterium tuberculosis H37Rv
ggcccagcggccgcg

SEQ ID NO: 3346733 - RNA, 19 nt, Mycobacterium tuberculosis H37Rv
ggcccagcgguaguccggc

SEQ ID NO: 3346734 - RNA, 23 nt, Mycobacterium tuberculosis H37Rv
ggcccagcgugucuugucgcgca

SEQ ID NO: 3346735 - RNA, 22 nt, Mycobacterium tuberculosis H37Rv
ggcccagguccgcgugcugccg

SEQ ID NO: 3346736 - RNA, 12 nt, Mycobacterium tuberculosis H37Rv
ggcccaguccgc

SEQ ID NO: 3346737 - RNA, 22 nt, Mycobacterium tuberculosis H37Rv
ggcccagugggacaggucggca

SEQ ID NO: 3346738 - RNA, 18 nt, Mycobacterium tuberculosis H37Rv
ggcccaguuccgcugcgg

SEQ ID NO: 3346739 - RNA, 17 nt, Mycobacterium tuberculosis H37Rv
ggcccauaacagcuggc

SEQ ID NO: 3346740 - RNA, 18 nt, Mycobacterium tuberculosis H37Rv
ggcccauacgugccgccg

SEQ ID NO: 3346741 - RNA, 22 nt, Mycobacterium tuberculosis H37Rv
ggcccaucuucggacgccagcu

SEQ ID NO: 3346742 - RNA, 17 nt, Mycobacterium tuberculosis H37Rv
ggcccauggcgccuguc

SEQ ID NO: 3346743 - RNA, 22 nt, Mycobacterium tuberculosis H37Rv
ggcccauucaucuugcggcagc

SEQ ID NO: 3346744 - RNA, 16 nt, Mycobacterium tuberculosis H37Rv
ggcccauugucgauca

SEQ ID NO: 3346745 - RNA, 20 nt, Mycobacterium tuberculosis H37Rv
ggccccaagcgugcugccgc

SEQ ID NO: 3346746 - RNA, 15 nt, Mycobacterium tuberculosis H37Rv
ggccccaccggugcc

SEQ ID NO: 3346747 - RNA, 13 nt, Mycobacterium tuberculosis H37Rv
ggccccacggcgg

SEQ ID NO: 3346748 - RNA, 20 nt, Mycobacterium tuberculosis H37Rv
ggccccacuggugcagcgcc

SEQ ID NO: 3346749 - RNA, 17 nt, Mycobacterium tuberculosis H37Rv
ggcccccaagaccaagu

SEQ ID NO: 3346750 - RNA, 19 nt, Mycobacterium tuberculosis H37Rv
ggcccccacacaggcagau

SEQ ID NO: 3346751 - RNA, 18 nt, Mycobacterium tuberculosis H37Rv
ggcccccaguucggcguc

SEQ ID NO: 3346752 - RNA, 13 nt, Mycobacterium tuberculosis H37Rv
ggccccccgcgcc

SEQ ID NO: 3346753 - RNA, 17 nt, Mycobacterium tuberculosis H37Rv
ggccccccgcgccugcc

SEQ ID NO: 3346754 - RNA, 19 nt, Mycobacterium tuberculosis H37Rv
ggccccccgcgccugccuc

SEQ ID NO: 3346755 - RNA, 17 nt, Mycobacterium tuberculosis H37Rv
ggccccccggggccgca

SEQ ID NO: 3346756 - RNA, 13 nt, Mycobacterium tuberculosis H37Rv
ggcccccggcagc

SEQ ID NO: 3346757 - RNA, 14 nt, Mycobacterium tuberculosis H37Rv
ggcccccgguaccg

SEQ ID NO: 3346758 - RNA, 18 nt, Mycobacterium tuberculosis H37Rv
ggccccgaaacgauggcc

SEQ ID NO: 3346759 - RNA, 23 nt, Mycobacterium tuberculosis H37Rv
ggccccgacauacgucggggccg

SEQ ID NO: 3346760 - RNA, 14 nt, Mycobacterium tuberculosis H37Rv
ggccccgaucccga

SEQ ID NO: 3346761 - RNA, 17 nt, Mycobacterium tuberculosis H37Rv
ggccccgcaagcggaug

SEQ ID NO: 3346762 - RNA, 15 nt, Mycobacterium tuberculosis H37Rv
ggccccgccagcgcc

SEQ ID NO: 3346763 - RNA, 15 nt, Mycobacterium tuberculosis H37Rv
ggccccgccagcggc

SEQ ID NO: 3346764 - RNA, 19 nt, Mycobacterium tuberculosis H37Rv
ggccccgccagcggcagcg

SEQ ID NO: 3346765 - RNA, 19 nt, Mycobacterium tuberculosis H37Rv
ggccccgccgaugccgccg

SEQ ID NO: 3346766 - RNA, 20 nt, Mycobacterium tuberculosis H37Rv
ggccccgccgaugccgccgg

SEQ ID NO: 3346767 - RNA, 15 nt, Mycobacterium tuberculosis H37Rv
ggccccgccggcccc

SEQ ID NO: 3346768 - RNA, 21 nt, Mycobacterium tuberculosis H37Rv
ggccccgccggccccgccguc

SEQ ID NO: 3346769 - RNA, 16 nt, Mycobacterium tuberculosis H37Rv
ggccccgccgguggcc

SEQ ID NO: 3346770 - RNA, 18 nt, Mycobacterium tuberculosis H37Rv
ggccccgccgucaccgcc

SEQ ID NO: 3346771 - RNA, 19 nt, Mycobacterium tuberculosis H37Rv
ggccccgccguugccgccg

SEQ ID NO: 3346772 - RNA, 14 nt, Mycobacterium tuberculosis H37Rv
ggccccgcgccggc

SEQ ID NO: 3346773 - RNA, 15 nt, Mycobacterium tuberculosis H37Rv
ggccccgcgccggcc

SEQ ID NO: 3346774 - RNA, 14 nt, Mycobacterium tuberculosis H37Rv
ggccccgcggcgcc

SEQ ID NO: 3346775 - RNA, 15 nt, Mycobacterium tuberculosis H37Rv
ggccccgcggcgccg

SEQ ID NO: 3346776 - RNA, 15 nt, Mycobacterium tuberculosis H37Rv
ggccccggccgcguc

SEQ ID NO: 3346777 - RNA, 18 nt, Mycobacterium tuberculosis H37Rv
ggccccgggaacgccuca

SEQ ID NO: 3346778 - RNA, 13 nt, Mycobacterium tuberculosis H37Rv
ggccccgggaagu

SEQ ID NO: 3346779 - RNA, 15 nt, Mycobacterium tuberculosis H37Rv
ggccccgggcgguga

SEQ ID NO: 3346780 - RNA, 17 nt, Mycobacterium tuberculosis H37Rv
ggccccggggugccccc

SEQ ID NO: 3346781 - RNA, 20 nt, Mycobacterium tuberculosis H37Rv
ggccccggugccgaccgguu

SEQ ID NO: 3346782 - RNA, 20 nt, Mycobacterium tuberculosis H37Rv
ggccccgguggugcugccga

SEQ ID NO: 3346783 - RNA, 20 nt, Mycobacterium tuberculosis H37Rv
ggccccucccuggcucguga

SEQ ID NO: 3346784 - RNA, 16 nt, Mycobacterium tuberculosis H37Rv
ggcccgacccggccga

SEQ ID NO: 3346785 - RNA, 21 nt, Mycobacterium tuberculosis H37Rv
ggcccgacccggccgauggug

SEQ ID NO: 3346786 - RNA, 19 nt, Mycobacterium tuberculosis H37Rv
ggcccgaccgggaaccacg

SEQ ID NO: 3346787 - RNA, 12 nt, Mycobacterium tuberculosis H37Rv
ggcccgaccugu

SEQ ID NO: 3346788 - RNA, 14 nt, Mycobacterium tuberculosis H37Rv
ggcccgacggcgcc

SEQ ID NO: 3346789 - RNA, 20 nt, Mycobacterium tuberculosis H37Rv
ggcccgacggcgcccagcgc

SEQ ID NO: 3346790 - RNA, 20 nt, Mycobacterium tuberculosis H37Rv
ggcccgagccgcuaggacgg

SEQ ID NO: 3346791 - RNA, 15 nt, Mycobacterium tuberculosis H37Rv
ggcccgagcgcgcgc

SEQ ID NO: 3346792 - RNA, 17 nt, Mycobacterium tuberculosis H37Rv
ggcccgagcgcgcgcug

SEQ ID NO: 3346793 - RNA, 19 nt, Mycobacterium tuberculosis H37Rv
ggcccgaggugccggggcc

SEQ ID NO: 3346794 - RNA, 17 nt, Mycobacterium tuberculosis H37Rv
ggcccgauaaaugccgc

SEQ ID NO: 3346795 - RNA, 20 nt, Mycobacterium tuberculosis H37Rv
ggcccgauagaucgcgugga

SEQ ID NO: 3346796 - RNA, 12 nt, Mycobacterium tuberculosis H37Rv
ggcccgaucccg

SEQ ID NO: 3346797 - RNA, 14 nt, Mycobacterium tuberculosis H37Rv
ggcccgcaacgcgu

SEQ ID NO: 3346798 - RNA, 13 nt, Mycobacterium tuberculosis H37Rv
ggcccgcacgauc

SEQ ID NO: 3346799 - RNA, 16 nt, Mycobacterium tuberculosis H37Rv
ggcccgcacggccgca

SEQ ID NO: 3346800 - RNA, 20 nt, Mycobacterium tuberculosis H37Rv
ggcccgcacggccgcagccg

SEQ ID NO: 3346801 - RNA, 13 nt, Mycobacterium tuberculosis H37Rv
ggcccgcagcagc

SEQ ID NO: 3346802 - RNA, 23 nt, Mycobacterium tuberculosis H37Rv
ggcccgcagcccgccgggcucca

SEQ ID NO: 3346803 - RNA, 14 nt, Mycobacterium tuberculosis H37Rv
ggcccgcagcgugu

SEQ ID NO: 3346804 - RNA, 14 nt, Mycobacterium tuberculosis H37Rv
ggcccgcaggucgg

SEQ ID NO: 3346805 - RNA, 18 nt, Mycobacterium tuberculosis H37Rv
ggcccgcauccgcaccga

SEQ ID NO: 3346806 - RNA, 13 nt, Mycobacterium tuberculosis H37Rv
ggcccgcaucguu

SEQ ID NO: 3346807 - RNA, 22 nt, Mycobacterium tuberculosis H37Rv
ggcccgccaaaaacgccccggc

SEQ ID NO: 3346808 - RNA, 16 nt, Mycobacterium tuberculosis H37Rv
ggcccgccagcccagc

SEQ ID NO: 3346809 - RNA, 19 nt, Mycobacterium tuberculosis H37Rv
ggcccgccagcccagcacg

SEQ ID NO: 3346810 - RNA, 20 nt, Mycobacterium tuberculosis H37Rv
ggcccgccaucauggcggcc

SEQ ID NO: 3346811 - RNA, 19 nt, Mycobacterium tuberculosis H37Rv
ggcccgcccguagacccac

SEQ ID NO: 3346812 - RNA, 21 nt, Mycobacterium tuberculosis H37Rv
ggcccgcccguagacccacag

SEQ ID NO: 3346813 - RNA, 19 nt, Mycobacterium tuberculosis H37Rv
ggcccgccgaguucugcug

SEQ ID NO: 3346814 - RNA, 15 nt, Mycobacterium tuberculosis H37Rv
ggcccgccggccccg

SEQ ID NO: 3346815 - RNA, 14 nt, Mycobacterium tuberculosis H37Rv
ggcccgccgucacc

SEQ ID NO: 3346816 - RNA, 15 nt, Mycobacterium tuberculosis H37Rv
ggcccgccgucaccg

SEQ ID NO: 3346817 - RNA, 20 nt, Mycobacterium tuberculosis H37Rv
ggcccgcgagauagcaccag

SEQ ID NO: 3346818 - RNA, 23 nt, Mycobacterium tuberculosis H37Rv
ggcccgcgcguacccgaucagcg

SEQ ID NO: 3346819 - RNA, 16 nt, Mycobacterium tuberculosis H37Rv
ggcccgcgggcaagcc

SEQ ID NO: 3346820 - RNA, 15 nt, Mycobacterium tuberculosis H37Rv
ggcccgcggucgcga

SEQ ID NO: 3346821 - RNA, 13 nt, Mycobacterium tuberculosis H37Rv
ggcccgcucaccu

SEQ ID NO: 3346822 - RNA, 16 nt, Mycobacterium tuberculosis H37Rv
ggccgacgucgaccac

SEQ ID NO: 3346823 - RNA, 17 nt, Mycobacterium tuberculosis H37Rv
ggccgacgugacaacug

SEQ ID NO: 3346824 - RNA, 14 nt, Mycobacterium tuberculosis H37Rv
ggccgacucgaggu

SEQ ID NO: 3346825 - RNA, 20 nt, Mycobacterium tuberculosis H37Rv
ggccgagaucacgccgggcg

SEQ ID NO: 3346826 - RNA, 18 nt, Mycobacterium tuberculosis H37Rv
ggccgagcagggccggca

SEQ ID NO: 3346827 - RNA, 22 nt, Mycobacterium tuberculosis H37Rv
ggccgagcgcaccacggcgguc

SEQ ID NO: 3346828 - RNA, 15 nt, Mycobacterium tuberculosis H37Rv
ggccgagcgcaccgc

SEQ ID NO: 3346829 - RNA, 14 nt, Mycobacterium tuberculosis H37Rv
ggccgagcgcgccg

SEQ ID NO: 3346830 - RNA, 22 nt, Mycobacterium tuberculosis H37Rv
ggccgagcucguugcuggcggc

SEQ ID NO: 3346831 - RNA, 17 nt, Mycobacterium tuberculosis H37Rv
ggccgagucgauugcca

SEQ ID NO: 3346832 - RNA, 19 nt, Mycobacterium tuberculosis H37Rv
ggccgagugcccagcgaug

SEQ ID NO: 3346833 - RNA, 16 nt, Mycobacterium tuberculosis H37Rv
ggccgaguucgucagc

SEQ ID NO: 3346834 - RNA, 21 nt, Mycobacterium tuberculosis H37Rv
ggccgaguuguaggccgccug

SEQ ID NO: 3346835 - RNA, 19 nt, Mycobacterium tuberculosis H37Rv
ggccgauacgaagccgccg

SEQ ID NO: 3346836 - RNA, 16 nt, Mycobacterium tuberculosis H37Rv
ggccgaucaccccggu

SEQ ID NO: 3346837 - RNA, 19 nt, Mycobacterium tuberculosis H37Rv
ggccgaucaccccggugga

SEQ ID NO: 3346838 - RNA, 13 nt, Mycobacterium tuberculosis H37Rv
ggccgaucagcgc

SEQ ID NO: 3346839 - RNA, 14 nt, Mycobacterium tuberculosis H37Rv
ggccgaucagcgcg

SEQ ID NO: 3346840 - RNA, 15 nt, Mycobacterium tuberculosis H37Rv
ggccgaucagcgcgg

SEQ ID NO: 3346841 - RNA, 13 nt, Mycobacterium tuberculosis H37Rv
ggccgaucagcgu

SEQ ID NO: 3346842 - RNA, 19 nt, Mycobacterium tuberculosis H37Rv
ggccgaugacgaugccgcc

SEQ ID NO: 3346843 - RNA, 16 nt, Mycobacterium tuberculosis H37Rv
ggccgaugccgaccuu

SEQ ID NO: 3346844 - RNA, 12 nt, Mycobacterium tuberculosis H37Rv
ggccgcaaccau

SEQ ID NO: 3346845 - RNA, 20 nt, Mycobacterium tuberculosis H37Rv
ggccgcaacugcagguucuu

SEQ ID NO: 3346846 - RNA, 20 nt, Mycobacterium tuberculosis H37Rv
ggccgcaagccgcgagucgc

SEQ ID NO: 3346847 - RNA, 13 nt, Mycobacterium tuberculosis H37Rv
ggccgcaccagca

SEQ ID NO: 3346848 - RNA, 21 nt, Mycobacterium tuberculosis H37Rv
ggccgcaccgauuuccucugg

SEQ ID NO: 3346849 - RNA, 16 nt, Mycobacterium tuberculosis H37Rv
ggccgcacgccgacca

SEQ ID NO: 3346850 - RNA, 18 nt, Mycobacterium tuberculosis H37Rv
ggccgcacgccgaccagc

SEQ ID NO: 3346851 - RNA, 18 nt, Mycobacterium tuberculosis H37Rv
ggccgcacgccggccagc

SEQ ID NO: 3346852 - RNA, 16 nt, Mycobacterium tuberculosis H37Rv
ggccgcacgccuacga

SEQ ID NO: 3346853 - RNA, 20 nt, Mycobacterium tuberculosis H37Rv
ggccgcacgggcgaccugcg

SEQ ID NO: 3346854 - RNA, 19 nt, Mycobacterium tuberculosis H37Rv
ggccgcacggucagcgcgc

SEQ ID NO: 3346855 - RNA, 15 nt, Mycobacterium tuberculosis H37Rv
ggccgcacgucgacc

SEQ ID NO: 3346856 - RNA, 19 nt, Mycobacterium tuberculosis H37Rv
ggccgcacgucgaccucgg

SEQ ID NO: 3346857 - RNA, 16 nt, Mycobacterium tuberculosis H37Rv
ggccgcacugcugguc

SEQ ID NO: 3346858 - RNA, 15 nt, Mycobacterium tuberculosis H37Rv
ggccgcacugggugc

SEQ ID NO: 3346859 - RNA, 22 nt, Mycobacterium tuberculosis H37Rv
ggccgcacugggugcgucgacc

SEQ ID NO: 3346860 - RNA, 15 nt, Mycobacterium tuberculosis H37Rv
ggccgcagcggccag

SEQ ID NO: 3346861 - RNA, 21 nt, Mycobacterium tuberculosis H37Rv
ggccgcagcggccagcccagc

SEQ ID NO: 3346862 - RNA, 13 nt, Mycobacterium tuberculosis H37Rv
ggccgcagggccu

SEQ ID NO: 3346863 - RNA, 23 nt, Mycobacterium tuberculosis H37Rv
ggccgcagugcgacucugcgucu

SEQ ID NO: 3346864 - RNA, 19 nt, Mycobacterium tuberculosis H37Rv
ggccgcauauugcggcgcc

SEQ ID NO: 3346865 - RNA, 14 nt, Mycobacterium tuberculosis H37Rv
ggccgcaucgguca

SEQ ID NO: 3346866 - RNA, 16 nt, Mycobacterium tuberculosis H37Rv
ggccgcaugccacggc

SEQ ID NO: 3346867 - RNA, 19 nt, Mycobacterium tuberculosis H37Rv
ggccgccaacuucaccacc

SEQ ID NO: 3346868 - RNA, 13 nt, Mycobacterium tuberculosis H37Rv
ggccgccaccagc

SEQ ID NO: 3346869 - RNA, 14 nt, Mycobacterium tuberculosis H37Rv
ggccgccaccagcg

SEQ ID NO: 3346870 - RNA, 17 nt, Mycobacterium tuberculosis H37Rv
ggccgccaccagcgcga

SEQ ID NO: 3346871 - RNA, 14 nt, Mycobacterium tuberculosis H37Rv
ggccgccacccgca

SEQ ID NO: 3346872 - RNA, 14 nt, Mycobacterium tuberculosis H37Rv
ggccgccaccgcga

SEQ ID NO: 3346873 - RNA, 12 nt, Mycobacterium tuberculosis H37Rv
ggccgccaccgu

SEQ ID NO: 3346874 - RNA, 16 nt, Mycobacterium tuberculosis H37Rv
ggccgccaccgucacc

SEQ ID NO: 3346875 - RNA, 17 nt, Mycobacterium tuberculosis H37Rv
ggccgccaccgucaccg

SEQ ID NO: 3346876 - RNA, 20 nt, Mycobacterium tuberculosis H37Rv
ggccgccagccccacccgca

SEQ ID NO: 3346877 - RNA, 14 nt, Mycobacterium tuberculosis H37Rv
ggccgccagccggu

SEQ ID NO: 3346878 - RNA, 21 nt, Mycobacterium tuberculosis H37Rv
ggccgccagccgguccagcag

SEQ ID NO: 3346879 - RNA, 13 nt, Mycobacterium tuberculosis H37Rv
ggccgccagcugc

SEQ ID NO: 3346880 - RNA, 15 nt, Mycobacterium tuberculosis H37Rv
ggccgccagcugcgc

SEQ ID NO: 3346881 - RNA, 21 nt, Mycobacterium tuberculosis H37Rv
ggccgccagcugcgcagcgca

SEQ ID NO: 3346882 - RNA, 15 nt, Mycobacterium tuberculosis H37Rv
ggccgccaggcggcc

SEQ ID NO: 3346883 - RNA, 18 nt, Mycobacterium tuberculosis H37Rv
ggccgccaggcggccggg

SEQ ID NO: 3346884 - RNA, 15 nt, Mycobacterium tuberculosis H37Rv
ggccgccaguccgau

SEQ ID NO: 3346885 - RNA, 22 nt, Mycobacterium tuberculosis H37Rv
ggccgccaguccgaucgccgag

SEQ ID NO: 3346886 - RNA, 14 nt, Mycobacterium tuberculosis H37Rv
ggccgccaguucgg

SEQ ID NO: 3346887 - RNA, 13 nt, Mycobacterium tuberculosis H37Rv
ggccgccaucccc

SEQ ID NO: 3346888 - RNA, 21 nt, Mycobacterium tuberculosis H37Rv
ggccgccauccccuggccagc

SEQ ID NO: 3346889 - RNA, 21 nt, Mycobacterium tuberculosis H37Rv
ggccgccaugaaaucacccau

SEQ ID NO: 3346890 - RNA, 15 nt, Mycobacterium tuberculosis H37Rv
ggccgccccaggcug

SEQ ID NO: 3346891 - RNA, 16 nt, Mycobacterium tuberculosis H37Rv
ggccgccccaggcugg

SEQ ID NO: 3346892 - RNA, 16 nt, Mycobacterium tuberculosis H37Rv
ggccgccccggccgcu

SEQ ID NO: 3346893 - RNA, 20 nt, Mycobacterium tuberculosis H37Rv
ggccgccccggccgcuggcg

SEQ ID NO: 3346894 - RNA, 17 nt, Mycobacterium tuberculosis H37Rv
ggccgcccgcucgaugu

SEQ ID NO: 3346895 - RNA, 19 nt, Mycobacterium tuberculosis H37Rv
ggccgcccgcucgaugucg

SEQ ID NO: 3346896 - RNA, 15 nt, Mycobacterium tuberculosis H37Rv
ggccgcccgcugcgg

SEQ ID NO: 3346897 - RNA, 17 nt, Mycobacterium tuberculosis H37Rv
ggccgcccgcugcggcg

SEQ ID NO: 3346898 - RNA, 14 nt, Mycobacterium tuberculosis H37Rv
ggccgcccggcgag

SEQ ID NO: 3346899 - RNA, 15 nt, Mycobacterium tuberculosis H37Rv
ggccgcccggcgagc

SEQ ID NO: 3346900 - RNA, 18 nt, Mycobacterium tuberculosis H37Rv
ggccgcccggcgagcagg

SEQ ID NO: 3346901 - RNA, 20 nt, Mycobacterium tuberculosis H37Rv
ggccgcccuggccgcccaga

SEQ ID NO: 3346902 - RNA, 21 nt, Mycobacterium tuberculosis H37Rv
ggccgccgaauccgacgucga

SEQ ID NO: 3346903 - RNA, 14 nt, Mycobacterium tuberculosis H37Rv
ggccgccgacaacc

SEQ ID NO: 3346904 - RNA, 12 nt, Mycobacterium tuberculosis H37Rv
ggccgccgaccg

SEQ ID NO: 3346905 - RNA, 19 nt, Mycobacterium tuberculosis H37Rv
ggccgccgaccggagccgc

SEQ ID NO: 3346906 - RNA, 15 nt, Mycobacterium tuberculosis H37Rv
ggccgccgagacgac

SEQ ID NO: 3346907 - RNA, 16 nt, Mycobacterium tuberculosis H37Rv
ggccgccgagcucggu

SEQ ID NO: 3346908 - RNA, 23 nt, Mycobacterium tuberculosis H37Rv
ggccgccgaggacacauugacca

SEQ ID NO: 3346909 - RNA, 14 nt, Mycobacterium tuberculosis H37Rv
ggccgccgaugcca

SEQ ID NO: 3346910 - RNA, 12 nt, Mycobacterium tuberculosis H37Rv
ggccgccgcaag

SEQ ID NO: 3346911 - RNA, 12 nt, Mycobacterium tuberculosis H37Rv
ggccgccgcagc

SEQ ID NO: 3346912 - RNA, 14 nt, Mycobacterium tuberculosis H37Rv
ggccgccgcagcuc

SEQ ID NO: 3346913 - RNA, 23 nt, Mycobacterium tuberculosis H37Rv
ggccgccgcagcuccccgaccga

SEQ ID NO: 3346914 - RNA, 18 nt, Mycobacterium tuberculosis H37Rv
ggccgccgccccggcgcu

SEQ ID NO: 3346915 - RNA, 20 nt, Mycobacterium tuberculosis H37Rv
ggccgccgccgucggcgagc

SEQ ID NO: 3346916 - RNA, 16 nt, Mycobacterium tuberculosis H37Rv
ggccgccgcgaggaug

SEQ ID NO: 3346917 - RNA, 16 nt, Mycobacterium tuberculosis H37Rv
ggccgccgcgauggcc

SEQ ID NO: 3346918 - RNA, 13 nt, Mycobacterium tuberculosis H37Rv
ggccgccgcgcac

SEQ ID NO: 3346919 - RNA, 22 nt, Mycobacterium tuberculosis H37Rv
ggccggaucccagugccagugc

SEQ ID NO: 3346920 - RNA, 17 nt, Mycobacterium tuberculosis H37Rv
ggccggauccucgauau

SEQ ID NO: 3346921 - RNA, 22 nt, Mycobacterium tuberculosis H37Rv
ggccggaugacgcccagggcgu

SEQ ID NO: 3346922 - RNA, 22 nt, Mycobacterium tuberculosis H37Rv
ggccggaugucgacgagcaccg

SEQ ID NO: 3346923 - RNA, 13 nt, Mycobacterium tuberculosis H37Rv
ggccggcaagcag

SEQ ID NO: 3346924 - RNA, 22 nt, Mycobacterium tuberculosis H37Rv
ggccggcaaugccgcggccagu

SEQ ID NO: 3346925 - RNA, 18 nt, Mycobacterium tuberculosis H37Rv
ggccggcacccaccagug

SEQ ID NO: 3346926 - RNA, 14 nt, Mycobacterium tuberculosis H37Rv
ggccggcaccccac

SEQ ID NO: 3346927 - RNA, 18 nt, Mycobacterium tuberculosis H37Rv
ggccggcaccgcagcgga

SEQ ID NO: 3346928 - RNA, 20 nt, Mycobacterium tuberculosis H37Rv
ggccggcauggcggcauagc

SEQ ID NO: 3346929 - RNA, 15 nt, Mycobacterium tuberculosis H37Rv
ggccggccaccaccg

SEQ ID NO: 3346930 - RNA, 13 nt, Mycobacterium tuberculosis H37Rv
ggccggcccgggu

SEQ ID NO: 3346931 - RNA, 11 nt, Mycobacterium tuberculosis H37Rv
ggccggccgcg

SEQ ID NO: 3346932 - RNA, 13 nt, Mycobacterium tuberculosis H37Rv
ggccggccgcuca

SEQ ID NO: 3346933 - RNA, 18 nt, Mycobacterium tuberculosis H37Rv
ggccggccgcucaccccg

SEQ ID NO: 3346934 - RNA, 12 nt, Mycobacterium tuberculosis H37Rv
ggccggccggca

SEQ ID NO: 3346935 - RNA, 15 nt, Mycobacterium tuberculosis H37Rv
ggccggccgguggcc

SEQ ID NO: 3346936 - RNA, 15 nt, Mycobacterium tuberculosis H37Rv
ggccggcgacgcguc

SEQ ID NO: 3346937 - RNA, 18 nt, Mycobacterium tuberculosis H37Rv
ggccggcgagcucgacga

SEQ ID NO: 3346938 - RNA, 15 nt, Mycobacterium tuberculosis H37Rv
ggccggcgcaguggu

SEQ ID NO: 3346939 - RNA, 14 nt, Mycobacterium tuberculosis H37Rv
ggccggcgccgcac

SEQ ID NO: 3346940 - RNA, 15 nt, Mycobacterium tuberculosis H37Rv
ggccggcgccgcacc

SEQ ID NO: 3346941 - RNA, 17 nt, Mycobacterium tuberculosis H37Rv
ggccggcgccggcgcgu

SEQ ID NO: 3346942 - RNA, 13 nt, Mycobacterium tuberculosis H37Rv
ggccggcgcucgc

SEQ ID NO: 3346943 - RNA, 13 nt, Mycobacterium tuberculosis H37Rv
ggccggcgcugcc

SEQ ID NO: 3346944 - RNA, 14 nt, Mycobacterium tuberculosis H37Rv
ggccggcggcucgg

SEQ ID NO: 3346945 - RNA, 16 nt, Mycobacterium tuberculosis H37Rv
ggccggcggcucgggu

SEQ ID NO: 3346946 - RNA, 22 nt, Mycobacterium tuberculosis H37Rv
ggccggcggcucgggugcgccc

SEQ ID NO: 3346947 - RNA, 18 nt, Mycobacterium tuberculosis H37Rv
ggccggcgggccugcccg

SEQ ID NO: 3346948 - RNA, 20 nt, Mycobacterium tuberculosis H37Rv
ggccggcgguaagcccagac

SEQ ID NO: 3346949 - RNA, 17 nt, Mycobacterium tuberculosis H37Rv
ggccggcggucagcagc

SEQ ID NO: 3346950 - RNA, 13 nt, Mycobacterium tuberculosis H37Rv
ggccggcggucgc

SEQ ID NO: 3346951 - RNA, 16 nt, Mycobacterium tuberculosis H37Rv
ggccggcgucagcccc

SEQ ID NO: 3346952 - RNA, 14 nt, Mycobacterium tuberculosis H37Rv
ggccggcgucggcg

SEQ ID NO: 3346953 - RNA, 11 nt, Mycobacterium tuberculosis H37Rv
ggccggcguug

SEQ ID NO: 3346954 - RNA, 23 nt, Mycobacterium tuberculosis H37Rv
ggccggcuagggcagcagcccgg

SEQ ID NO: 3346955 - RNA, 11 nt, Mycobacterium tuberculosis H37Rv
ggccgggaacc

SEQ ID NO: 3346956 - RNA, 11 nt, Mycobacterium tuberculosis H37Rv
ggccgggaucu

SEQ ID NO: 3346957 - RNA, 13 nt, Mycobacterium tuberculosis H37Rv
ggccgggcagugc

SEQ ID NO: 3346958 - RNA, 19 nt, Mycobacterium tuberculosis H37Rv
ggccgggcagugcgcggcg

SEQ ID NO: 3346959 - RNA, 13 nt, Mycobacterium tuberculosis H37Rv
ggccgggccgagu

SEQ ID NO: 3346960 - RNA, 19 nt, Mycobacterium tuberculosis H37Rv
ggccgggccgagugcccag

SEQ ID NO: 3346961 - RNA, 17 nt, Mycobacterium tuberculosis H37Rv
ggccgggcgaucgccug

SEQ ID NO: 3346962 - RNA, 16 nt, Mycobacterium tuberculosis H37Rv
ggccgggcgggcggcc

SEQ ID NO: 3346963 - RNA, 19 nt, Mycobacterium tuberculosis H37Rv
ggccgggcgggcggccgau

SEQ ID NO: 3346964 - RNA, 20 nt, Mycobacterium tuberculosis H37Rv
ggccgggcgggcggccgauc

SEQ ID NO: 3346965 - RNA, 14 nt, Mycobacterium tuberculosis H37Rv
ggccgggcucccca

SEQ ID NO: 3346966 - RNA, 20 nt, Mycobacterium tuberculosis H37Rv
ggccgggcucuaucagacga

SEQ ID NO: 3346967 - RNA, 15 nt, Mycobacterium tuberculosis H37Rv
ggccgggcuggcgac

SEQ ID NO: 3346968 - RNA, 18 nt, Mycobacterium tuberculosis H37Rv
ggccggggccacccgcag

SEQ ID NO: 3346969 - RNA, 23 nt, Mycobacterium tuberculosis H37Rv
ggccgggucgaacuugaucaccg

SEQ ID NO: 3346970 - RNA, 18 nt, Mycobacterium tuberculosis H37Rv
ggccgggucgucuuccag

SEQ ID NO: 3346971 - RNA, 16 nt, Mycobacterium tuberculosis H37Rv
ggccggguggcccggc

SEQ ID NO: 3346972 - RNA, 18 nt, Mycobacterium tuberculosis H37Rv
ggccggguucgcgucuga

SEQ ID NO: 3346973 - RNA, 23 nt, Mycobacterium tuberculosis H37Rv
ggccgguagaucuucggccgcac

SEQ ID NO: 3346974 - RNA, 18 nt, Mycobacterium tuberculosis H37Rv
ggccgguauuucggcgac

SEQ ID NO: 3346975 - RNA, 14 nt, Mycobacterium tuberculosis H37Rv
ggccgguccgggaa

SEQ ID NO: 3346976 - RNA, 15 nt, Mycobacterium tuberculosis H37Rv
ggccgguccggggca

SEQ ID NO: 3346977 - RNA, 21 nt, Mycobacterium tuberculosis H37Rv
ggccgguccggggcaacgauc

SEQ ID NO: 3346978 - RNA, 13 nt, Mycobacterium tuberculosis H37Rv
ggccggucgaggc

SEQ ID NO: 3346979 - RNA, 19 nt, Mycobacterium tuberculosis H37Rv
ggccggucgaggcccucgc

SEQ ID NO: 3346980 - RNA, 13 nt, Mycobacterium tuberculosis H37Rv
ggccggucgggca

SEQ ID NO: 3346981 - RNA, 15 nt, Mycobacterium tuberculosis H37Rv
ggccggucggugagc

SEQ ID NO: 3346982 - RNA, 16 nt, Mycobacterium tuberculosis H37Rv
ggccggugcagcacgu

SEQ ID NO: 3346983 - RNA, 14 nt, Mycobacterium tuberculosis H37Rv
ggccggugccaguc

SEQ ID NO: 3346984 - RNA, 15 nt, Mycobacterium tuberculosis H37Rv
ggccggugcccgggc

SEQ ID NO: 3346985 - RNA, 16 nt, Mycobacterium tuberculosis H37Rv
ggccggugcgcaugga

SEQ ID NO: 3346986 - RNA, 13 nt, Mycobacterium tuberculosis H37Rv
ggccggugcgccc

SEQ ID NO: 3346987 - RNA, 20 nt, Mycobacterium tuberculosis H37Rv
ggccggugcgucacagccgg

SEQ ID NO: 3346988 - RNA, 21 nt, Mycobacterium tuberculosis H37Rv
ggccgguggguagccagcgcg

SEQ ID NO: 3346989 - RNA, 20 nt, Mycobacterium tuberculosis H37Rv
ggccgguuccucagcggccc

SEQ ID NO: 3346990 - RNA, 14 nt, Mycobacterium tuberculosis H37Rv
ggccgguucgcccg

SEQ ID NO: 3346991 - RNA, 12 nt, Mycobacterium tuberculosis H37Rv
ggccgguuggcc

SEQ ID NO: 3346992 - RNA, 15 nt, Mycobacterium tuberculosis H37Rv
ggccguaacgcggau

SEQ ID NO: 3346993 - RNA, 14 nt, Mycobacterium tuberculosis H37Rv
ggccguaacggcga

SEQ ID NO: 3346994 - RNA, 18 nt, Mycobacterium tuberculosis H37Rv
ggccguacaacagcgcgc

SEQ ID NO: 3346995 - RNA, 13 nt, Mycobacterium tuberculosis H37Rv
ggccguacucgau

SEQ ID NO: 3346996 - RNA, 15 nt, Mycobacterium tuberculosis H37Rv
ggccguagcccacga

SEQ ID NO: 3346997 - RNA, 16 nt, Mycobacterium tuberculosis H37Rv
ggccguagcccacgac

SEQ ID NO: 3346998 - RNA, 18 nt, Mycobacterium tuberculosis H37Rv
ggccguagcccacgacga

SEQ ID NO: 3346999 - RNA, 14 nt, Mycobacterium tuberculosis H37Rv
ggccguaggcggcg

SEQ ID NO: 3347000 - RNA, 17 nt, Mycobacterium tuberculosis H37Rv
ggccguaggcggcgacc

SEQ ID NO: 3347001 - RNA, 17 nt, Mycobacterium tuberculosis H37Rv
ggccguagucggcgaug

SEQ ID NO: 3347002 - RNA, 17 nt, Mycobacterium tuberculosis H37Rv
ggccguauagcgugacc

SEQ ID NO: 3347003 - RNA, 22 nt, Mycobacterium tuberculosis H37Rv
ggccguauaggcccgggcggcc

SEQ ID NO: 3347004 - RNA, 21 nt, Mycobacterium tuberculosis H37Rv
ggccgucaaucgcaaugaccu

SEQ ID NO: 3347005 - RNA, 18 nt, Mycobacterium tuberculosis H37Rv
ggccgucaccggucggcc

SEQ ID NO: 3347006 - RNA, 20 nt, Mycobacterium tuberculosis H37Rv
ggccgucagccaggugccca

SEQ ID NO: 3347007 - RNA, 21 nt, Mycobacterium tuberculosis H37Rv
ggccgucagccaggugcccaa

SEQ ID NO: 3347008 - RNA, 14 nt, Mycobacterium tuberculosis H37Rv
ggccgucagggugu

SEQ ID NO: 3347009 - RNA, 21 nt, Mycobacterium tuberculosis H37Rv
ggccgucccgcgagcagcccg

SEQ ID NO: 3347010 - RNA, 22 nt, Mycobacterium tuberculosis H37Rv
ggccgucccgcgagcagcccgg

SEQ ID NO: 3347011 - RNA, 16 nt, Mycobacterium tuberculosis H37Rv
ggccguccgcaccggc

SEQ ID NO: 3347012 - RNA, 19 nt, Mycobacterium tuberculosis H37Rv
ggccguccgcaccggcggc

SEQ ID NO: 3347013 - RNA, 23 nt, Mycobacterium tuberculosis H37Rv
ggccguccggcuuggcggcgauc

SEQ ID NO: 3347014 - RNA, 20 nt, Mycobacterium tuberculosis H37Rv
ggccguccgguccgucgggu

SEQ ID NO: 3347015 - RNA, 18 nt, Mycobacterium tuberculosis H37Rv
ggccguccucggucagcu

SEQ ID NO: 3347016 - RNA, 15 nt, Mycobacterium tuberculosis H37Rv
ggccugcacgccggc

SEQ ID NO: 3347017 - RNA, 18 nt, Mycobacterium tuberculosis H37Rv
ggccugcacggcgcugac

SEQ ID NO: 3347018 - RNA, 13 nt, Mycobacterium tuberculosis H37Rv
ggccugcagccga

SEQ ID NO: 3347019 - RNA, 14 nt, Mycobacterium tuberculosis H37Rv
ggccugcagcgcga

SEQ ID NO: 3347020 - RNA, 21 nt, Mycobacterium tuberculosis H37Rv
ggccugccauaggcccacggc

SEQ ID NO: 3347021 - RNA, 14 nt, Mycobacterium tuberculosis H37Rv
ggccugcccagcac

SEQ ID NO: 3347022 - RNA, 14 nt, Mycobacterium tuberculosis H37Rv
ggccugccggcagc

SEQ ID NO: 3347023 - RNA, 16 nt, Mycobacterium tuberculosis H37Rv
ggccugcgccggcgcu

SEQ ID NO: 3347024 - RNA, 20 nt, Mycobacterium tuberculosis H37Rv
ggccugcgcgaccgaccagc

SEQ ID NO: 3347025 - RNA, 15 nt, Mycobacterium tuberculosis H37Rv
ggccugcgcgauccg

SEQ ID NO: 3347026 - RNA, 23 nt, Mycobacterium tuberculosis H37Rv
ggccugcgcuucguccagcgauc

SEQ ID NO: 3347027 - RNA, 13 nt, Mycobacterium tuberculosis H37Rv
ggccugcggcaac

SEQ ID NO: 3347028 - RNA, 19 nt, Mycobacterium tuberculosis H37Rv
ggccugcguccgacgccug

SEQ ID NO: 3347029 - RNA, 14 nt, Mycobacterium tuberculosis H37Rv
ggccugcucgacca

SEQ ID NO: 3347030 - RNA, 22 nt, Mycobacterium tuberculosis H37Rv
ggccugcucgggggccgaccag

SEQ ID NO: 3347031 - RNA, 19 nt, Mycobacterium tuberculosis H37Rv
ggccugcuugucaacccgg

SEQ ID NO: 3347032 - RNA, 18 nt, Mycobacterium tuberculosis H37Rv
ggccuggaucgugccgaa

SEQ ID NO: 3347033 - RNA, 13 nt, Mycobacterium tuberculosis H37Rv
ggccuggcagggu

SEQ ID NO: 3347034 - RNA, 16 nt, Mycobacterium tuberculosis H37Rv
ggccuggccaccuggu

SEQ ID NO: 3347035 - RNA, 17 nt, Mycobacterium tuberculosis H37Rv
ggccugggacggcggca

SEQ ID NO: 3347036 - RNA, 16 nt, Mycobacterium tuberculosis H37Rv
ggccugggccagccgc

SEQ ID NO: 3347037 - RNA, 13 nt, Mycobacterium tuberculosis H37Rv
ggccugggccgca

SEQ ID NO: 3347038 - RNA, 15 nt, Mycobacterium tuberculosis H37Rv
ggccugggccgcaca

SEQ ID NO: 3347039 - RNA, 16 nt, Mycobacterium tuberculosis H37Rv
ggccuggggcagccgg

SEQ ID NO: 3347040 - RNA, 20 nt, Mycobacterium tuberculosis H37Rv
ggccugguacucccgcgauc

SEQ ID NO: 3347041 - RNA, 14 nt, Mycobacterium tuberculosis H37Rv
ggccuggucggcca

SEQ ID NO: 3347042 - RNA, 17 nt, Mycobacterium tuberculosis H37Rv
ggccuggucggccaggu

SEQ ID NO: 3347043 - RNA, 22 nt, Mycobacterium tuberculosis H37Rv
ggccugguuguccguaucgggc

SEQ ID NO: 3347044 - RNA, 18 nt, Mycobacterium tuberculosis H37Rv
ggccugucaggcggcgga

SEQ ID NO: 3347045 - RNA, 14 nt, Mycobacterium tuberculosis H37Rv
ggccugucgaagau

SEQ ID NO: 3347046 - RNA, 16 nt, Mycobacterium tuberculosis H37Rv
ggccugugcgggcagg

SEQ ID NO: 3347047 - RNA, 19 nt, Mycobacterium tuberculosis H37Rv
ggccuguucgccgucgcua

SEQ ID NO: 3347048 - RNA, 23 nt, Mycobacterium tuberculosis H37Rv
ggccuguuuaccuuccucgcccu

SEQ ID NO: 3347049 - RNA, 16 nt, Mycobacterium tuberculosis H37Rv
ggccuucagcguccag

SEQ ID NO: 3347050 - RNA, 16 nt, Mycobacterium tuberculosis H37Rv
ggccuucagcucacca

SEQ ID NO: 3347051 - RNA, 16 nt, Mycobacterium tuberculosis H37Rv
ggccuucggccggcgu

SEQ ID NO: 3347052 - RNA, 18 nt, Mycobacterium tuberculosis H37Rv
ggccuucgggccaggauc

SEQ ID NO: 3347053 - RNA, 18 nt, Mycobacterium tuberculosis H37Rv
ggccuucuccccgaucag

SEQ ID NO: 3347054 - RNA, 18 nt, Mycobacterium tuberculosis H37Rv
ggccuugacgcacgacug

SEQ ID NO: 3347055 - RNA, 22 nt, Mycobacterium tuberculosis H37Rv
ggccuugacgcacgacugugcg

SEQ ID NO: 3347056 - RNA, 14 nt, Mycobacterium tuberculosis H37Rv
ggccuugaucaccg

SEQ ID NO: 3347057 - RNA, 22 nt, Mycobacterium tuberculosis H37Rv
ggccuugccgaucagcuggcuc

SEQ ID NO: 3347058 - RNA, 19 nt, Mycobacterium tuberculosis H37Rv
ggccuugcgucaucggcuc

SEQ ID NO: 3347059 - RNA, 16 nt, Mycobacterium tuberculosis H37Rv
ggccuugcguguacca

SEQ ID NO: 3347060 - RNA, 20 nt, Mycobacterium tuberculosis H37Rv
ggccuugcugcgcgauggcc

SEQ ID NO: 3347061 - RNA, 13 nt, Mycobacterium tuberculosis H37Rv
ggccuuggcggcg

SEQ ID NO: 3347062 - RNA, 15 nt, Mycobacterium tuberculosis H37Rv
ggccuuggcgggauc

SEQ ID NO: 3347063 - RNA, 16 nt, Mycobacterium tuberculosis H37Rv
ggccuuggugcggccg

SEQ ID NO: 3347064 - RNA, 15 nt, Mycobacterium tuberculosis H37Rv
ggccuugugcucgau

SEQ ID NO: 3347065 - RNA, 17 nt, Mycobacterium tuberculosis H37Rv
ggccuuugagcgcggcc

SEQ ID NO: 3347066 - RNA, 18 nt, Mycobacterium tuberculosis H37Rv
ggccuuugucgccuucuu

SEQ ID NO: 3347067 - RNA, 22 nt, Mycobacterium tuberculosis H37Rv
ggccuuuuggcgaaccgcagac

SEQ ID NO: 3347068 - RNA, 18 nt, Mycobacterium tuberculosis H37Rv
ggcgaaaauugcuccacc

SEQ ID NO: 3347069 - RNA, 19 nt, Mycobacterium tuberculosis H37Rv
ggcgaaaauugcuccacca

SEQ ID NO: 3347070 - RNA, 16 nt, Mycobacterium tuberculosis H37Rv
ggcgaaagauggccuc

SEQ ID NO: 3347071 - RNA, 17 nt, Mycobacterium tuberculosis H37Rv
ggcgaaagauggccuca

SEQ ID NO: 3347072 - RNA, 16 nt, Mycobacterium tuberculosis H37Rv
ggcgaaauccgcgauc

SEQ ID NO: 3347073 - RNA, 14 nt, Mycobacterium tuberculosis H37Rv
ggcgaaaucgucga

SEQ ID NO: 3347074 - RNA, 24 nt, Mycobacterium tuberculosis H37Rv
ggcgaaauuccgggccuggccugc

SEQ ID NO: 3347075 - RNA, 11 nt, Mycobacterium tuberculosis H37Rv
ggcgaacacgu

SEQ ID NO: 3347076 - RNA, 14 nt, Mycobacterium tuberculosis H37Rv
ggcgaacacgucgg

SEQ ID NO: 3347077 - RNA, 18 nt, Mycobacterium tuberculosis H37Rv
ggcgaacacgucggccag

SEQ ID NO: 3347078 - RNA, 19 nt, Mycobacterium tuberculosis H37Rv
ggcgaacacgucggccagu

SEQ ID NO: 3347079 - RNA, 23 nt, Mycobacterium tuberculosis H37Rv
ggcgaacagcaugauccgcuggg

SEQ ID NO: 3347080 - RNA, 15 nt, Mycobacterium tuberculosis H37Rv
ggcgaacagccccag

SEQ ID NO: 3347081 - RNA, 15 nt, Mycobacterium tuberculosis H37Rv
ggcgaacccuccgca

SEQ ID NO: 3347082 - RNA, 16 nt, Mycobacterium tuberculosis H37Rv
ggcgaacccuccgcag

SEQ ID NO: 3347083 - RNA, 18 nt, Mycobacterium tuberculosis H37Rv
ggcgaacccuccgcagcu

SEQ ID NO: 3347084 - RNA, 19 nt, Mycobacterium tuberculosis H37Rv
ggcgaacccuccgcagcua

SEQ ID NO: 3347085 - RNA, 23 nt, Mycobacterium tuberculosis H37Rv
ggcgaaccgcagacccucgucgu

SEQ ID NO: 3347086 - RNA, 19 nt, Mycobacterium tuberculosis H37Rv
ggcgaaccgucagcgcgcc

SEQ ID NO: 3347087 - RNA, 20 nt, Mycobacterium tuberculosis H37Rv
ggcgaaccgucagcgcgccg

SEQ ID NO: 3347088 - RNA, 17 nt, Mycobacterium tuberculosis H37Rv
ggcgaaccuugguugcc

SEQ ID NO: 3347089 - RNA, 22 nt, Mycobacterium tuberculosis H37Rv
ggcgaacgcuucaccucgucga

SEQ ID NO: 3347090 - RNA, 16 nt, Mycobacterium tuberculosis H37Rv
ggcgaacucgaggucg

SEQ ID NO: 3347091 - RNA, 17 nt, Mycobacterium tuberculosis H37Rv
ggcgaacugggugcggu

SEQ ID NO: 3347092 - RNA, 12 nt, Mycobacterium tuberculosis H37Rv
ggcgaagcccga

SEQ ID NO: 3347093 - RNA, 15 nt, Mycobacterium tuberculosis H37Rv
ggcgaagcuugacgu

SEQ ID NO: 3347094 - RNA, 23 nt, Mycobacterium tuberculosis H37Rv
ggcgaaggccagcagaaacaucg

SEQ ID NO: 3347095 - RNA, 20 nt, Mycobacterium tuberculosis H37Rv
ggcgaaggccgcgcgcaggg

SEQ ID NO: 3347096 - RNA, 23 nt, Mycobacterium tuberculosis H37Rv
ggcgaagguccgugccgaugccg

SEQ ID NO: 3347097 - RNA, 15 nt, Mycobacterium tuberculosis H37Rv
ggcgaaggucuggcc

SEQ ID NO: 3347098 - RNA, 23 nt, Mycobacterium tuberculosis H37Rv
ggcgaaucuuugguagucugcac

SEQ ID NO: 3347099 - RNA, 14 nt, Mycobacterium tuberculosis H37Rv
ggcgaaugacggcc

SEQ ID NO: 3347100 - RNA, 17 nt, Mycobacterium tuberculosis H37Rv
ggcgaaugacggccagu

SEQ ID NO: 3347101 - RNA, 20 nt, Mycobacterium tuberculosis H37Rv
ggcgaaugcgggccuccugc

SEQ ID NO: 3347102 - RNA, 22 nt, Mycobacterium tuberculosis H37Rv
ggcgacaaucgagaacgcccgc

SEQ ID NO: 3347103 - RNA, 13 nt, Mycobacterium tuberculosis H37Rv
ggcgacacgccag

SEQ ID NO: 3347104 - RNA, 23 nt, Mycobacterium tuberculosis H37Rv
ggcgacacgccagccgugccggu

SEQ ID NO: 3347105 - RNA, 17 nt, Mycobacterium tuberculosis H37Rv
ggcgacagcgcggcggu

SEQ ID NO: 3347106 - RNA, 22 nt, Mycobacterium tuberculosis H37Rv
ggcgacaugaucugccaccgcg

SEQ ID NO: 3347107 - RNA, 22 nt, Mycobacterium tuberculosis H37Rv
ggcgaccaacacgucgagcagc

SEQ ID NO: 3347108 - RNA, 20 nt, Mycobacterium tuberculosis H37Rv
ggcgaccaccaccgccgccg

SEQ ID NO: 3347109 - RNA, 14 nt, Mycobacterium tuberculosis H37Rv
ggcgaccaccagcg

SEQ ID NO: 3347110 - RNA, 17 nt, Mycobacterium tuberculosis H37Rv
ggcgaccaccagcgccg

SEQ ID NO: 3347111 - RNA, 20 nt, Mycobacterium tuberculosis H37Rv
ggcgaccacccccggcaggc

SEQ ID NO: 3347112 - RNA, 22 nt, Mycobacterium tuberculosis H37Rv
ggcgagugaaguuguuggccag

SEQ ID NO: 3347113 - RNA, 21 nt, Mycobacterium tuberculosis H37Rv
ggcgagugucuuagccagcag

SEQ ID NO: 3347114 - RNA, 18 nt, Mycobacterium tuberculosis H37Rv
ggcgaguuaggccgccag

SEQ ID NO: 3347115 - RNA, 20 nt, Mycobacterium tuberculosis H37Rv
ggcgaguuaggccgccagcc

SEQ ID NO: 3347116 - RNA, 18 nt, Mycobacterium tuberculosis H37Rv
ggcgauaaagccgcugaa

SEQ ID NO: 3347117 - RNA, 21 nt, Mycobacterium tuberculosis H37Rv
ggcgauacgcgcgucggguau

SEQ ID NO: 3347118 - RNA, 14 nt, Mycobacterium tuberculosis H37Rv
ggcgaucaacucgg

SEQ ID NO: 3347119 - RNA, 20 nt, Mycobacterium tuberculosis H37Rv
ggcgaucaacucgggcagcg

SEQ ID NO: 3347120 - RNA, 14 nt, Mycobacterium tuberculosis H37Rv
ggcgaucaagccuc

SEQ ID NO: 3347121 - RNA, 13 nt, Mycobacterium tuberculosis H37Rv
ggcgaucaccgag

SEQ ID NO: 3347122 - RNA, 13 nt, Mycobacterium tuberculosis H37Rv
ggcgaucaccgcg

SEQ ID NO: 3347123 - RNA, 19 nt, Mycobacterium tuberculosis H37Rv
ggcgaucaccgcgccggag

SEQ ID NO: 3347124 - RNA, 12 nt, Mycobacterium tuberculosis H37Rv
ggcgaucacgcg

SEQ ID NO: 3347125 - RNA, 16 nt, Mycobacterium tuberculosis H37Rv
ggcgaucagcagccgc

SEQ ID NO: 3347126 - RNA, 23 nt, Mycobacterium tuberculosis H37Rv
ggcgaucagcagccgccgaugau

SEQ ID NO: 3347127 - RNA, 18 nt, Mycobacterium tuberculosis H37Rv
ggcgaucagcagcgccag

SEQ ID NO: 3347128 - RNA, 15 nt, Mycobacterium tuberculosis H37Rv
ggcgauccaggccag

SEQ ID NO: 3347129 - RNA, 23 nt, Mycobacterium tuberculosis H37Rv
ggcgauccgguaggccaucugcu

SEQ ID NO: 3347130 - RNA, 17 nt, Mycobacterium tuberculosis H37Rv
ggcgauccggucggcca

SEQ ID NO: 3347131 - RNA, 23 nt, Mycobacterium tuberculosis H37Rv
ggcgaucgcauccgcgguuggca

SEQ ID NO: 3347132 - RNA, 14 nt, Mycobacterium tuberculosis H37Rv
ggcgaucgccuggg

SEQ ID NO: 3347133 - RNA, 20 nt, Mycobacterium tuberculosis H37Rv
ggcgaucgucaagccgggca

SEQ ID NO: 3347134 - RNA, 17 nt, Mycobacterium tuberculosis H37Rv
ggcgaucgugccgggcc

SEQ ID NO: 3347135 - RNA, 20 nt, Mycobacterium tuberculosis H37Rv
ggcgaucguguccaccggac

SEQ ID NO: 3347136 - RNA, 23 nt, Mycobacterium tuberculosis H37Rv
ggcgaucucgaccguauugacca

SEQ ID NO: 3347137 - RNA, 14 nt, Mycobacterium tuberculosis H37Rv
ggcgaucucgacgg

SEQ ID NO: 3347138 - RNA, 16 nt, Mycobacterium tuberculosis H37Rv
ggcgaucucuaccagc

SEQ ID NO: 3347139 - RNA, 17 nt, Mycobacterium tuberculosis H37Rv
ggcgaucugcugugucg

SEQ ID NO: 3347140 - RNA, 12 nt, Mycobacterium tuberculosis H37Rv
ggcgaucugguc

SEQ ID NO: 3347141 - RNA, 18 nt, Mycobacterium tuberculosis H37Rv
ggcgaucuugcgacgccc

SEQ ID NO: 3347142 - RNA, 16 nt, Mycobacterium tuberculosis H37Rv
ggcgaugaacagcgac

SEQ ID NO: 3347143 - RNA, 18 nt, Mycobacterium tuberculosis H37Rv
ggcgaugaacagcgacgc

SEQ ID NO: 3347144 - RNA, 18 nt, Mycobacterium tuberculosis H37Rv
ggcgaugaccacgccgac

SEQ ID NO: 3347145 - RNA, 14 nt, Mycobacterium tuberculosis H37Rv
ggcgaugaccgggc

SEQ ID NO: 3347146 - RNA, 21 nt, Mycobacterium tuberculosis H37Rv
ggcgaugaccgggcgauucgc

SEQ ID NO: 3347147 - RNA, 16 nt, Mycobacterium tuberculosis H37Rv
ggcgaugagcgcgauc

SEQ ID NO: 3347148 - RNA, 20 nt, Mycobacterium tuberculosis H37Rv
ggcgaugaggaacguuucgc

SEQ ID NO: 3347149 - RNA, 23 nt, Mycobacterium tuberculosis H37Rv
ggcgaugagggcuuguggugagc

SEQ ID NO: 3347150 - RNA, 23 nt, Mycobacterium tuberculosis H37Rv
ggcgaugagguggccgcgcaggg

SEQ ID NO: 3347151 - RNA, 18 nt, Mycobacterium tuberculosis H37Rv
ggcgaugaucgccuucuu

SEQ ID NO: 3347152 - RNA, 14 nt, Mycobacterium tuberculosis H37Rv
ggcgaugcagccgg

SEQ ID NO: 3347153 - RNA, 22 nt, Mycobacterium tuberculosis H37Rv
ggcgaugccgguggggcccucg

SEQ ID NO: 3347154 - RNA, 14 nt, Mycobacterium tuberculosis H37Rv
ggcgaugcgcgccc

SEQ ID NO: 3347155 - RNA, 13 nt, Mycobacterium tuberculosis H37Rv
ggcgaugcgcggg

SEQ ID NO: 3347156 - RNA, 15 nt, Mycobacterium tuberculosis H37Rv
ggcgaugcggcgucg

SEQ ID NO: 3347157 - RNA, 17 nt, Mycobacterium tuberculosis H37Rv
ggcgaugcgggccgcca

SEQ ID NO: 3347158 - RNA, 18 nt, Mycobacterium tuberculosis H37Rv
ggcgaugcguccgcccag

SEQ ID NO: 3347159 - RNA, 19 nt, Mycobacterium tuberculosis H37Rv
ggcgaugcguccgcccagc

SEQ ID NO: 3347160 - RNA, 13 nt, Mycobacterium tuberculosis H37Rv
ggcgaugcugggc

SEQ ID NO: 3347161 - RNA, 17 nt, Mycobacterium tuberculosis H37Rv
ggcgaugcugggcgaga

SEQ ID NO: 3347162 - RNA, 16 nt, Mycobacterium tuberculosis H37Rv
ggcgauggcaccgugg

SEQ ID NO: 3347163 - RNA, 14 nt, Mycobacterium tuberculosis H37Rv
ggcgauggccagca

SEQ ID NO: 3347164 - RNA, 17 nt, Mycobacterium tuberculosis H37Rv
ggcgauggccagcacgg

SEQ ID NO: 3347165 - RNA, 23 nt, Mycobacterium tuberculosis H37Rv
ggcgaugggucugguguccaccg

SEQ ID NO: 3347166 - RNA, 15 nt, Mycobacterium tuberculosis H37Rv
ggcgauggucuccuc

SEQ ID NO: 3347167 - RNA, 16 nt, Mycobacterium tuberculosis H37Rv
ggcgauggucuccucg

SEQ ID NO: 3347168 - RNA, 19 nt, Mycobacterium tuberculosis H37Rv
ggcgaugucggcugguggg

SEQ ID NO: 3347169 - RNA, 12 nt, Mycobacterium tuberculosis H37Rv
ggcgauguucga

SEQ ID NO: 3347170 - RNA, 19 nt, Mycobacterium tuberculosis H37Rv
ggcgauuaccggcacgccg

SEQ ID NO: 3347171 - RNA, 15 nt, Mycobacterium tuberculosis H37Rv
ggcgauuacggccag

SEQ ID NO: 3347172 - RNA, 20 nt, Mycobacterium tuberculosis H37Rv
ggcgauucugcgucugcucg

SEQ ID NO: 3347173 - RNA, 23 nt, Mycobacterium tuberculosis H37Rv
ggcgauucugcgucugcucggcg

SEQ ID NO: 3347174 - RNA, 15 nt, Mycobacterium tuberculosis H37Rv
ggcgauugauccggu

SEQ ID NO: 3347175 - RNA, 23 nt, Mycobacterium tuberculosis H37Rv
ggcgauugcaccauggcgcgacc

SEQ ID NO: 3347176 - RNA, 20 nt, Mycobacterium tuberculosis H37Rv
ggcgauugucggggccgcag

SEQ ID NO: 3347177 - RNA, 18 nt, Mycobacterium tuberculosis H37Rv
ggcgauuuccaucgcgac

SEQ ID NO: 3347178 - RNA, 19 nt, Mycobacterium tuberculosis H37Rv
ggcgauuucggcgccggcg

SEQ ID NO: 3347179 - RNA, 18 nt, Mycobacterium tuberculosis H37Rv
ggcgauuucggcgccugg

SEQ ID NO: 3347180 - RNA, 18 nt, Mycobacterium tuberculosis H37Rv
ggcgauuuugcgucugcu

SEQ ID NO: 3347181 - RNA, 19 nt, Mycobacterium tuberculosis H37Rv
ggcgauuuugcgucugcuc

SEQ ID NO: 3347182 - RNA, 22 nt, Mycobacterium tuberculosis H37Rv
ggcgauuuugcgucugcucgcg

SEQ ID NO: 3347183 - RNA, 21 nt, Mycobacterium tuberculosis H37Rv
ggcgauuuugcgucugcucgg

SEQ ID NO: 3347184 - RNA, 18 nt, Mycobacterium tuberculosis H37Rv
ggcgcaaaccacccgcaa

SEQ ID NO: 3347185 - RNA, 20 nt, Mycobacterium tuberculosis H37Rv
ggcgcaaaccacccgcaaca

SEQ ID NO: 3347186 - RNA, 23 nt, Mycobacterium tuberculosis H37Rv
ggcgcaacaaccgguuggcgauc

SEQ ID NO: 3347187 - RNA, 20 nt, Mycobacterium tuberculosis H37Rv
ggcgcaacgagagcggcucc

SEQ ID NO: 3347188 - RNA, 16 nt, Mycobacterium tuberculosis H37Rv
ggcgcaagcagcccgg

SEQ ID NO: 3347189 - RNA, 14 nt, Mycobacterium tuberculosis H37Rv
ggcgcacagcgagc

SEQ ID NO: 3347190 - RNA, 18 nt, Mycobacterium tuberculosis H37Rv
ggcgcaccaccgccccgc

SEQ ID NO: 3347191 - RNA, 23 nt, Mycobacterium tuberculosis H37Rv
ggcgcaccaucgcggccgcuggg

SEQ ID NO: 3347192 - RNA, 21 nt, Mycobacterium tuberculosis H37Rv
ggcgcaccgcggaccggcguc

SEQ ID NO: 3347193 - RNA, 18 nt, Mycobacterium tuberculosis H37Rv
ggcgcaccugggcugccg

SEQ ID NO: 3347194 - RNA, 16 nt, Mycobacterium tuberculosis H37Rv
ggcgcacgaaaccgca

SEQ ID NO: 3347195 - RNA, 14 nt, Mycobacterium tuberculosis H37Rv
ggcgcacgauggug

SEQ ID NO: 3347196 - RNA, 14 nt, Mycobacterium tuberculosis H37Rv
ggcgcacgcccgca

SEQ ID NO: 3347197 - RNA, 15 nt, Mycobacterium tuberculosis H37Rv
ggcgcacucccggau

SEQ ID NO: 3347198 - RNA, 16 nt, Mycobacterium tuberculosis H37Rv
ggcgcagagucaacgu

SEQ ID NO: 3347199 - RNA, 19 nt, Mycobacterium tuberculosis H37Rv
ggcgcagagucaacgucgu

SEQ ID NO: 3347200 - RNA, 14 nt, Mycobacterium tuberculosis H37Rv
ggcgcagauagcgc

SEQ ID NO: 3347201 - RNA, 23 nt, Mycobacterium tuberculosis H37Rv
ggcgcagauagcgcucgaacucg

SEQ ID NO: 3347202 - RNA, 14 nt, Mycobacterium tuberculosis H37Rv
ggcgcagcaacgca

SEQ ID NO: 3347203 - RNA, 11 nt, Mycobacterium tuberculosis H37Rv
ggcgcagccgg

SEQ ID NO: 3347204 - RNA, 20 nt, Mycobacterium tuberculosis H37Rv
ggcgcagccugccgaugacg

SEQ ID NO: 3347205 - RNA, 15 nt, Mycobacterium tuberculosis H37Rv
ggcgcagcgaccggu

SEQ ID NO: 3347206 - RNA, 16 nt, Mycobacterium tuberculosis H37Rv
ggcgcagcgaccggua

SEQ ID NO: 3347207 - RNA, 13 nt, Mycobacterium tuberculosis H37Rv
ggcgcagcgacgc

SEQ ID NO: 3347208 - RNA, 24 nt, Mycobacterium tuberculosis H37Rv
ggcgccgcaccaagcagcgaccag

SEQ ID NO: 3347209 - RNA, 11 nt, Mycobacterium tuberculosis H37Rv
ggcgccgcaga

SEQ ID NO: 3347210 - RNA, 22 nt, Mycobacterium tuberculosis H37Rv
ggcgccgcagaucaccgccagc

SEQ ID NO: 3347211 - RNA, 19 nt, Mycobacterium tuberculosis H37Rv
ggcgccgcagcgcucgcgu

SEQ ID NO: 3347212 - RNA, 13 nt, Mycobacterium tuberculosis H37Rv
ggcgccgcagggc

SEQ ID NO: 3347213 - RNA, 17 nt, Mycobacterium tuberculosis H37Rv
ggcgccgcauaccagua

SEQ ID NO: 3347214 - RNA, 17 nt, Mycobacterium tuberculosis H37Rv
ggcgccgccaagggccc

SEQ ID NO: 3347215 - RNA, 14 nt, Mycobacterium tuberculosis H37Rv
ggcgccgcccagca

SEQ ID NO: 3347216 - RNA, 12 nt, Mycobacterium tuberculosis H37Rv
ggcgccgcccgc

SEQ ID NO: 3347217 - RNA, 19 nt, Mycobacterium tuberculosis H37Rv
ggcgccgcccgcgccgccg

SEQ ID NO: 3347218 - RNA, 19 nt, Mycobacterium tuberculosis H37Rv
ggcgccgcccuugccgccg

SEQ ID NO: 3347219 - RNA, 16 nt, Mycobacterium tuberculosis H37Rv
ggcgccgccgaccaga

SEQ ID NO: 3347220 - RNA, 17 nt, Mycobacterium tuberculosis H37Rv
ggcgccgccggcaccgg

SEQ ID NO: 3347221 - RNA, 15 nt, Mycobacterium tuberculosis H37Rv
ggcgccgccggcgcc

SEQ ID NO: 3347222 - RNA, 19 nt, Mycobacterium tuberculosis H37Rv
ggcgccgccgugcggguuc

SEQ ID NO: 3347223 - RNA, 22 nt, Mycobacterium tuberculosis H37Rv
ggcgccgccguuaccgccggcg

SEQ ID NO: 3347224 - RNA, 18 nt, Mycobacterium tuberculosis H37Rv
ggcgccgccguugccgcc

SEQ ID NO: 3347225 - RNA, 16 nt, Mycobacterium tuberculosis H37Rv
ggcgccgcgccgauuc

SEQ ID NO: 3347226 - RNA, 22 nt, Mycobacterium tuberculosis H37Rv
ggcgccgcgccgauuccaccgc

SEQ ID NO: 3347227 - RNA, 17 nt, Mycobacterium tuberculosis H37Rv
ggcgccgcgcucgacga

SEQ ID NO: 3347228 - RNA, 19 nt, Mycobacterium tuberculosis H37Rv
ggcgccgcgcucgacgagc

SEQ ID NO: 3347229 - RNA, 15 nt, Mycobacterium tuberculosis H37Rv
ggcgccgcggcuggg

SEQ ID NO: 3347230 - RNA, 19 nt, Mycobacterium tuberculosis H37Rv
ggcgccggaacgagcggcc

SEQ ID NO: 3347231 - RNA, 22 nt, Mycobacterium tuberculosis H37Rv
ggcgccggaacgagcggccgcg

SEQ ID NO: 3347232 - RNA, 15 nt, Mycobacterium tuberculosis H37Rv
ggcgccggacaaacc

SEQ ID NO: 3347233 - RNA, 14 nt, Mycobacterium tuberculosis H37Rv
ggcgccggagccgc

SEQ ID NO: 3347234 - RNA, 13 nt, Mycobacterium tuberculosis H37Rv
ggcgccggccagu

SEQ ID NO: 3347235 - RNA, 14 nt, Mycobacterium tuberculosis H37Rv
ggcgccggcgcaga

SEQ ID NO: 3347236 - RNA, 15 nt, Mycobacterium tuberculosis H37Rv
ggcgccggcgcagau

SEQ ID NO: 3347237 - RNA, 19 nt, Mycobacterium tuberculosis H37Rv
ggcgccggcgcugcugcca

SEQ ID NO: 3347238 - RNA, 17 nt, Mycobacterium tuberculosis H37Rv
ggcgccggcggccgcgg

SEQ ID NO: 3347239 - RNA, 12 nt, Mycobacterium tuberculosis H37Rv
ggcgccggcguc

SEQ ID NO: 3347240 - RNA, 22 nt, Mycobacterium tuberculosis H37Rv
ggcgccggcgucggcgcccagc

SEQ ID NO: 3347241 - RNA, 23 nt, Mycobacterium tuberculosis H37Rv
ggcgccggcgucggcgcccagcu

SEQ ID NO: 3347242 - RNA, 15 nt, Mycobacterium tuberculosis H37Rv
ggcgccggggccgcc

SEQ ID NO: 3347243 - RNA, 18 nt, Mycobacterium tuberculosis H37Rv
ggcgccggggccgccgau

SEQ ID NO: 3347244 - RNA, 12 nt, Mycobacterium tuberculosis H37Rv
ggcgccgggggc

SEQ ID NO: 3347245 - RNA, 19 nt, Mycobacterium tuberculosis H37Rv
ggcgccgggggcgccgccg

SEQ ID NO: 3347246 - RNA, 17 nt, Mycobacterium tuberculosis H37Rv
ggcgccggggggcugcu

SEQ ID NO: 3347247 - RNA, 20 nt, Mycobacterium tuberculosis H37Rv
ggcgccgggucacgugggcc

SEQ ID NO: 3347248 - RNA, 14 nt, Mycobacterium tuberculosis H37Rv
ggcgccggucgccg

SEQ ID NO: 3347249 - RNA, 20 nt, Mycobacterium tuberculosis H37Rv
ggcgccggucgccggcuggg

SEQ ID NO: 3347250 - RNA, 21 nt, Mycobacterium tuberculosis H37Rv
ggcgccggugccgccgggugc

SEQ ID NO: 3347251 - RNA, 16 nt, Mycobacterium tuberculosis H37Rv
ggcgccgucaccgauc

SEQ ID NO: 3347252 - RNA, 13 nt, Mycobacterium tuberculosis H37Rv
ggcgccgucgccg

SEQ ID NO: 3347253 - RNA, 17 nt, Mycobacterium tuberculosis H37Rv
ggcgccgucggagccgg

SEQ ID NO: 3347254 - RNA, 18 nt, Mycobacterium tuberculosis H37Rv
ggcgccgucggagccggc

SEQ ID NO: 3347255 - RNA, 19 nt, Mycobacterium tuberculosis H37Rv
ggcgccgucggccgagucg

SEQ ID NO: 3347256 - RNA, 20 nt, Mycobacterium tuberculosis H37Rv
ggcgccgucguugugccggu

SEQ ID NO: 3347257 - RNA, 24 nt, Mycobacterium tuberculosis H37Rv
ggcgccgucguugugccggucgau

SEQ ID NO: 3347258 - RNA, 20 nt, Mycobacterium tuberculosis H37Rv
ggcgccgugaucagcucgcg

SEQ ID NO: 3347259 - RNA, 18 nt, Mycobacterium tuberculosis H37Rv
ggcgccgugucaccgggu

SEQ ID NO: 3347260 - RNA, 17 nt, Mycobacterium tuberculosis H37Rv
ggcgccguuagcgucgc

SEQ ID NO: 3347261 - RNA, 19 nt, Mycobacterium tuberculosis H37Rv
ggcgccguugucggcggug

SEQ ID NO: 3347262 - RNA, 16 nt, Mycobacterium tuberculosis H37Rv
ggcgccuagcacgaag

SEQ ID NO: 3347263 - RNA, 21 nt, Mycobacterium tuberculosis H37Rv
ggcgccucggugacgucgccg

SEQ ID NO: 3347264 - RNA, 14 nt, Mycobacterium tuberculosis H37Rv
ggcgccugaggugc

SEQ ID NO: 3347265 - RNA, 12 nt, Mycobacterium tuberculosis H37Rv
ggcgccugcugc

SEQ ID NO: 3347266 - RNA, 21 nt, Mycobacterium tuberculosis H37Rv
ggcgccugcugcggccaggga

SEQ ID NO: 3347267 - RNA, 14 nt, Mycobacterium tuberculosis H37Rv
ggcgccuguccugc

SEQ ID NO: 3347268 - RNA, 15 nt, Mycobacterium tuberculosis H37Rv
ggcgccuuccaggcg

SEQ ID NO: 3347269 - RNA, 13 nt, Mycobacterium tuberculosis H37Rv
ggcgccuuggucg

SEQ ID NO: 3347270 - RNA, 19 nt, Mycobacterium tuberculosis H37Rv
ggcgccuuggucgccgccu

SEQ ID NO: 3347271 - RNA, 21 nt, Mycobacterium tuberculosis H37Rv
ggcgcgaaaccaguccaucga

SEQ ID NO: 3347272 - RNA, 20 nt, Mycobacterium tuberculosis H37Rv
ggcgcgaagucuugaccgca

SEQ ID NO: 3347273 - RNA, 13 nt, Mycobacterium tuberculosis H37Rv
ggcgcgaccgcgg

SEQ ID NO: 3347274 - RNA, 15 nt, Mycobacterium tuberculosis H37Rv
ggcgcgaccgcggcg

SEQ ID NO: 3347275 - RNA, 22 nt, Mycobacterium tuberculosis H37Rv
ggcgcgaccggucugaucggcu

SEQ ID NO: 3347276 - RNA, 22 nt, Mycobacterium tuberculosis H37Rv
ggcgcgaccuccgcgaucaccg

SEQ ID NO: 3347277 - RNA, 17 nt, Mycobacterium tuberculosis H37Rv
ggcgcgacguagacgac

SEQ ID NO: 3347278 - RNA, 20 nt, Mycobacterium tuberculosis H37Rv
ggcgcgacguagacgacguc

SEQ ID NO: 3347279 - RNA, 21 nt, Mycobacterium tuberculosis H37Rv
ggcgcgacguaguugccggcu

SEQ ID NO: 3347280 - RNA, 15 nt, Mycobacterium tuberculosis H37Rv
ggcgcgaggacgcug

SEQ ID NO: 3347281 - RNA, 21 nt, Mycobacterium tuberculosis H37Rv
ggcgcgauacagacggggauc

SEQ ID NO: 3347282 - RNA, 22 nt, Mycobacterium tuberculosis H37Rv
ggcgcgauccccgcgcugagca

SEQ ID NO: 3347283 - RNA, 20 nt, Mycobacterium tuberculosis H37Rv
ggcgcgaucgacgcucggcu

SEQ ID NO: 3347284 - RNA, 17 nt, Mycobacterium tuberculosis H37Rv
ggcgcgaucgcgcccgc

SEQ ID NO: 3347285 - RNA, 22 nt, Mycobacterium tuberculosis H37Rv
ggcgcgaucggugccgaagcug

SEQ ID NO: 3347286 - RNA, 20 nt, Mycobacterium tuberculosis H37Rv
ggcgcgcaacguagccagca

SEQ ID NO: 3347287 - RNA, 19 nt, Mycobacterium tuberculosis H37Rv
ggcgcgcaagugcuggccg

SEQ ID NO: 3347288 - RNA, 16 nt, Mycobacterium tuberculosis H37Rv
ggcgcgcaccaccgcg

SEQ ID NO: 3347289 - RNA, 17 nt, Mycobacterium tuberculosis H37Rv
ggcgcgcaccaccgcgg

SEQ ID NO: 3347290 - RNA, 21 nt, Mycobacterium tuberculosis H37Rv
ggcgcgcaccaccgcggcggc

SEQ ID NO: 3347291 - RNA, 22 nt, Mycobacterium tuberculosis H37Rv
ggcgcgcaccaccgcggcggcg

SEQ ID NO: 3347292 - RNA, 15 nt, Mycobacterium tuberculosis H37Rv
ggcgcgcagcgacgc

SEQ ID NO: 3347293 - RNA, 21 nt, Mycobacterium tuberculosis H37Rv
ggcgcgcagcgauucgccuag

SEQ ID NO: 3347294 - RNA, 12 nt, Mycobacterium tuberculosis H37Rv
ggcgcgcagcuc

SEQ ID NO: 3347295 - RNA, 18 nt, Mycobacterium tuberculosis H37Rv
ggcgcgcagguagcgcuc

SEQ ID NO: 3347296 - RNA, 15 nt, Mycobacterium tuberculosis H37Rv
ggcgcgcaucugcuc

SEQ ID NO: 3347297 - RNA, 17 nt, Mycobacterium tuberculosis H37Rv
ggcgcgcaucugcucgg

SEQ ID NO: 3347298 - RNA, 19 nt, Mycobacterium tuberculosis H37Rv
ggcgcgcaucugcucggca

SEQ ID NO: 3347299 - RNA, 23 nt, Mycobacterium tuberculosis H37Rv
ggcgcgccccaccgcgccgagca

SEQ ID NO: 3347300 - RNA, 16 nt, Mycobacterium tuberculosis H37Rv
ggcgcgccgcacccgg

SEQ ID NO: 3347301 - RNA, 21 nt, Mycobacterium tuberculosis H37Rv
ggcgcgccguugccggccacc

SEQ ID NO: 3347302 - RNA, 12 nt, Mycobacterium tuberculosis H37Rv
ggcgcgccugug

SEQ ID NO: 3347303 - RNA, 17 nt, Mycobacterium tuberculosis H37Rv
ggcgcgccugugccacc

SEQ ID NO: 3347304 - RNA, 23 nt, Mycobacterium tuberculosis H37Rv
ggcgcugggauguucgaucagcg

SEQ ID NO: 3347305 - RNA, 16 nt, Mycobacterium tuberculosis H37Rv
ggcgcuguagucgcgc

SEQ ID NO: 3347306 - RNA, 19 nt, Mycobacterium tuberculosis H37Rv
ggcgcuuaugcgucugcuc

SEQ ID NO: 3347307 - RNA, 20 nt, Mycobacterium tuberculosis H37Rv
ggcgcuuaugcgucugcucg

SEQ ID NO: 3347308 - RNA, 21 nt, Mycobacterium tuberculosis H37Rv
ggcgcuuggccggauccucga

SEQ ID NO: 3347309 - RNA, 17 nt, Mycobacterium tuberculosis H37Rv
ggcgcuuugggcugccg

SEQ ID NO: 3347310 - RNA, 16 nt, Mycobacterium tuberculosis H37Rv
ggcggaaaaucggcug

SEQ ID NO: 3347311 - RNA, 19 nt, Mycobacterium tuberculosis H37Rv
ggcggaacaccgacgacac

SEQ ID NO: 3347312 - RNA, 18 nt, Mycobacterium tuberculosis H37Rv
ggcggaaccugucaacau

SEQ ID NO: 3347313 - RNA, 18 nt, Mycobacterium tuberculosis H37Rv
ggcggaagaccggaucgc

SEQ ID NO: 3347314 - RNA, 17 nt, Mycobacterium tuberculosis H37Rv
ggcggaaggacggcagc

SEQ ID NO: 3347315 - RNA, 19 nt, Mycobacterium tuberculosis H37Rv
ggcggaaucgucggcuagc

SEQ ID NO: 3347316 - RNA, 22 nt, Mycobacterium tuberculosis H37Rv
ggcggacaccucgggcgcccgc

SEQ ID NO: 3347317 - RNA, 16 nt, Mycobacterium tuberculosis H37Rv
ggcggacccgcucgcg

SEQ ID NO: 3347318 - RNA, 20 nt, Mycobacterium tuberculosis H37Rv
ggcggacccggugacccgcu

SEQ ID NO: 3347319 - RNA, 15 nt, Mycobacterium tuberculosis H37Rv
ggcggacccucgccg

SEQ ID NO: 3347320 - RNA, 14 nt, Mycobacterium tuberculosis H37Rv
ggcggaccgcagcg

SEQ ID NO: 3347321 - RNA, 19 nt, Mycobacterium tuberculosis H37Rv
ggcggacgccgcgccggcg

SEQ ID NO: 3347322 - RNA, 17 nt, Mycobacterium tuberculosis H37Rv
ggcggacgcgggugcca

SEQ ID NO: 3347323 - RNA, 18 nt, Mycobacterium tuberculosis H37Rv
ggcggacgcgggugccag

SEQ ID NO: 3347324 - RNA, 13 nt, Mycobacterium tuberculosis H37Rv
ggcggacucacga

SEQ ID NO: 3347325 - RNA, 17 nt, Mycobacterium tuberculosis H37Rv
ggcggacugagagaugg

SEQ ID NO: 3347326 - RNA, 13 nt, Mycobacterium tuberculosis H37Rv
ggcggagacggcg

SEQ ID NO: 3347327 - RNA, 15 nt, Mycobacterium tuberculosis H37Rv
ggcggagacggcggc

SEQ ID NO: 3347328 - RNA, 13 nt, Mycobacterium tuberculosis H37Rv
ggcggagccgggu

SEQ ID NO: 3347329 - RNA, 15 nt, Mycobacterium tuberculosis H37Rv
ggcggagccggguga

SEQ ID NO: 3347330 - RNA, 18 nt, Mycobacterium tuberculosis H37Rv
ggcggagcgaugcgggca

SEQ ID NO: 3347331 - RNA, 19 nt, Mycobacterium tuberculosis H37Rv
ggcggagcgggccagcacc

SEQ ID NO: 3347332 - RNA, 14 nt, Mycobacterium tuberculosis H37Rv
ggcggaggccgccu

SEQ ID NO: 3347333 - RNA, 14 nt, Mycobacterium tuberculosis H37Rv
ggcggaggcugggc

SEQ ID NO: 3347334 - RNA, 14 nt, Mycobacterium tuberculosis H37Rv
ggcggauaaccggc

SEQ ID NO: 3347335 - RNA, 17 nt, Mycobacterium tuberculosis H37Rv
ggcggauaguucaccac

SEQ ID NO: 3347336 - RNA, 15 nt, Mycobacterium tuberculosis H37Rv
ggcggauaugaugau

SEQ ID NO: 3347337 - RNA, 20 nt, Mycobacterium tuberculosis H37Rv
ggcggauaugaugaucgguu

SEQ ID NO: 3347338 - RNA, 18 nt, Mycobacterium tuberculosis H37Rv
ggcggaucccgaggcgcc

SEQ ID NO: 3347339 - RNA, 12 nt, Mycobacterium tuberculosis H37Rv
ggcggaucgccg

SEQ ID NO: 3347340 - RNA, 15 nt, Mycobacterium tuberculosis H37Rv
ggcggaucgcgagcg

SEQ ID NO: 3347341 - RNA, 16 nt, Mycobacterium tuberculosis H37Rv
ggcggaucgugcccug

SEQ ID NO: 3347342 - RNA, 18 nt, Mycobacterium tuberculosis H37Rv
ggcggaucugaucggcgc

SEQ ID NO: 3347343 - RNA, 19 nt, Mycobacterium tuberculosis H37Rv
ggcggaucugaucggcgcg

SEQ ID NO: 3347344 - RNA, 20 nt, Mycobacterium tuberculosis H37Rv
ggcggaucuggcuccggcca

SEQ ID NO: 3347345 - RNA, 18 nt, Mycobacterium tuberculosis H37Rv
ggcggaugaugcaacgcc

SEQ ID NO: 3347346 - RNA, 20 nt, Mycobacterium tuberculosis H37Rv
ggcggaugcuguugacccgu

SEQ ID NO: 3347347 - RNA, 16 nt, Mycobacterium tuberculosis H37Rv
ggcggauucggcgcug

SEQ ID NO: 3347348 - RNA, 22 nt, Mycobacterium tuberculosis H37Rv
ggcggcaaacacugcggccugc

SEQ ID NO: 3347349 - RNA, 16 nt, Mycobacterium tuberculosis H37Rv
ggcggcaaagagcagc

SEQ ID NO: 3347350 - RNA, 17 nt, Mycobacterium tuberculosis H37Rv
ggcggcaagcucgacga

SEQ ID NO: 3347351 - RNA, 14 nt, Mycobacterium tuberculosis H37Rv
ggcggcaaggacgg

SEQ ID NO: 3347352 - RNA, 16 nt, Mycobacterium tuberculosis H37Rv
ggcggcacuacgcagc

SEQ ID NO: 3347353 - RNA, 19 nt, Mycobacterium tuberculosis H37Rv
ggcggcacuggauccggga

SEQ ID NO: 3347354 - RNA, 18 nt, Mycobacterium tuberculosis H37Rv
ggcggcagcauauccgcc

SEQ ID NO: 3347355 - RNA, 20 nt, Mycobacterium tuberculosis H37Rv
ggcggcagcgaggcucgcag

SEQ ID NO: 3347356 - RNA, 13 nt, Mycobacterium tuberculosis H37Rv
ggcggcagcgauc

SEQ ID NO: 3347357 - RNA, 12 nt, Mycobacterium tuberculosis H37Rv
ggcggcagcggc

SEQ ID NO: 3347358 - RNA, 18 nt, Mycobacterium tuberculosis H37Rv
ggcggcagcggugcuggu

SEQ ID NO: 3347359 - RNA, 22 nt, Mycobacterium tuberculosis H37Rv
ggcggcagguagaucagcaugc

SEQ ID NO: 3347360 - RNA, 21 nt, Mycobacterium tuberculosis H37Rv
ggcggcaggugcggcggcauc

SEQ ID NO: 3347361 - RNA, 16 nt, Mycobacterium tuberculosis H37Rv
ggcggcagguguuggu

SEQ ID NO: 3347362 - RNA, 20 nt, Mycobacterium tuberculosis H37Rv
ggcggcauacauccaggcug

SEQ ID NO: 3347363 - RNA, 14 nt, Mycobacterium tuberculosis H37Rv
ggcggcauccccag

SEQ ID NO: 3347364 - RNA, 23 nt, Mycobacterium tuberculosis H37Rv
ggcggcauccugcacgacccgcu

SEQ ID NO: 3347365 - RNA, 18 nt, Mycobacterium tuberculosis H37Rv
ggcggcaucgaggccagc

SEQ ID NO: 3347366 - RNA, 23 nt, Mycobacterium tuberculosis H37Rv
ggcggcaucgaggccagcagcug

SEQ ID NO: 3347367 - RNA, 15 nt, Mycobacterium tuberculosis H37Rv
ggcggcaucgccgag

SEQ ID NO: 3347368 - RNA, 20 nt, Mycobacterium tuberculosis H37Rv
ggcggcaucgccgaggugga

SEQ ID NO: 3347369 - RNA, 14 nt, Mycobacterium tuberculosis H37Rv
ggcggcaucggggu

SEQ ID NO: 3347370 - RNA, 19 nt, Mycobacterium tuberculosis H37Rv
ggcggcaucgggguuggug

SEQ ID NO: 3347371 - RNA, 20 nt, Mycobacterium tuberculosis H37Rv
ggcggcaucggugguaacac

SEQ ID NO: 3347372 - RNA, 15 nt, Mycobacterium tuberculosis H37Rv
ggcggcaugcucacc

SEQ ID NO: 3347373 - RNA, 19 nt, Mycobacterium tuberculosis H37Rv
ggcggccaacagcacccgg

SEQ ID NO: 3347374 - RNA, 18 nt, Mycobacterium tuberculosis H37Rv
ggcggccaccagugcggg

SEQ ID NO: 3347375 - RNA, 20 nt, Mycobacterium tuberculosis H37Rv
ggcggccaccgucagcgcga

SEQ ID NO: 3347376 - RNA, 10 nt, Mycobacterium tuberculosis H37Rv
ggcggccagc

SEQ ID NO: 3347377 - RNA, 15 nt, Mycobacterium tuberculosis H37Rv
ggcggccagcaucgg

SEQ ID NO: 3347378 - RNA, 21 nt, Mycobacterium tuberculosis H37Rv
ggcggccagcaucggguggcg

SEQ ID NO: 3347379 - RNA, 15 nt, Mycobacterium tuberculosis H37Rv
ggcggccagcgcacc

SEQ ID NO: 3347380 - RNA, 13 nt, Mycobacterium tuberculosis H37Rv
ggcggccagcgcg

SEQ ID NO: 3347381 - RNA, 20 nt, Mycobacterium tuberculosis H37Rv
ggcggccagcgcgucgccgu

SEQ ID NO: 3347382 - RNA, 16 nt, Mycobacterium tuberculosis H37Rv
ggcggccagcucggcc

SEQ ID NO: 3347383 - RNA, 18 nt, Mycobacterium tuberculosis H37Rv
ggcggccagcucggccag

SEQ ID NO: 3347384 - RNA, 14 nt, Mycobacterium tuberculosis H37Rv
ggcggccagggugc

SEQ ID NO: 3347385 - RNA, 13 nt, Mycobacterium tuberculosis H37Rv
ggcggccaguugc

SEQ ID NO: 3347386 - RNA, 16 nt, Mycobacterium tuberculosis H37Rv
ggcggccaucgacgac

SEQ ID NO: 3347387 - RNA, 18 nt, Mycobacterium tuberculosis H37Rv
ggcggccaugucagcggc

SEQ ID NO: 3347388 - RNA, 20 nt, Mycobacterium tuberculosis H37Rv
ggcggccaugucagcggccu

SEQ ID NO: 3347389 - RNA, 21 nt, Mycobacterium tuberculosis H37Rv
ggcggccaugucagcggccug

SEQ ID NO: 3347390 - RNA, 22 nt, Mycobacterium tuberculosis H37Rv
ggcggccaugucagcggccugc

SEQ ID NO: 3347391 - RNA, 23 nt, Mycobacterium tuberculosis H37Rv
ggcggccaugucagcggccugcu

SEQ ID NO: 3347392 - RNA, 23 nt, Mycobacterium tuberculosis H37Rv
ggcggcccacgcgcacucgacca

SEQ ID NO: 3347393 - RNA, 16 nt, Mycobacterium tuberculosis H37Rv
ggcggcccaucgaccg

SEQ ID NO: 3347394 - RNA, 21 nt, Mycobacterium tuberculosis H37Rv
ggcggccccgcgccaccuccc

SEQ ID NO: 3347395 - RNA, 12 nt, Mycobacterium tuberculosis H37Rv
ggcggcccgcuc

SEQ ID NO: 3347396 - RNA, 22 nt, Mycobacterium tuberculosis H37Rv
ggcggcccgcucgggguugcuc

SEQ ID NO: 3347397 - RNA, 17 nt, Mycobacterium tuberculosis H37Rv
ggcggcccggucuacgc

SEQ ID NO: 3347398 - RNA, 16 nt, Mycobacterium tuberculosis H37Rv
ggcggcccgguggaca

SEQ ID NO: 3347399 - RNA, 19 nt, Mycobacterium tuberculosis H37Rv
ggcggcccguuugccgguu

SEQ ID NO: 3347400 - RNA, 16 nt, Mycobacterium tuberculosis H37Rv
ggcgggcacucagcag

SEQ ID NO: 3347401 - RNA, 23 nt, Mycobacterium tuberculosis H37Rv
ggcgggcacucagcaggggaucg

SEQ ID NO: 3347402 - RNA, 23 nt, Mycobacterium tuberculosis H37Rv
ggcgggcaguugacccaugccga

SEQ ID NO: 3347403 - RNA, 21 nt, Mycobacterium tuberculosis H37Rv
ggcgggcccgaugaggacauc

SEQ ID NO: 3347404 - RNA, 21 nt, Mycobacterium tuberculosis H37Rv
ggcgggcccgccggccccgcc

SEQ ID NO: 3347405 - RNA, 15 nt, Mycobacterium tuberculosis H37Rv
ggcgggcccgggggg

SEQ ID NO: 3347406 - RNA, 13 nt, Mycobacterium tuberculosis H37Rv
ggcgggccgcgcg

SEQ ID NO: 3347407 - RNA, 15 nt, Mycobacterium tuberculosis H37Rv
ggcgggccugcgcga

SEQ ID NO: 3347408 - RNA, 18 nt, Mycobacterium tuberculosis H37Rv
ggcgggcgagugucagca

SEQ ID NO: 3347409 - RNA, 21 nt, Mycobacterium tuberculosis H37Rv
ggcgggcgaucucggcgagca

SEQ ID NO: 3347410 - RNA, 20 nt, Mycobacterium tuberculosis H37Rv
ggcgggcgauuucggcgccg

SEQ ID NO: 3347411 - RNA, 11 nt, Mycobacterium tuberculosis H37Rv
ggcgggcgccu

SEQ ID NO: 3347412 - RNA, 12 nt, Mycobacterium tuberculosis H37Rv
ggcgggcgcggg

SEQ ID NO: 3347413 - RNA, 20 nt, Mycobacterium tuberculosis H37Rv
ggcgggcgcggguggcgcca

SEQ ID NO: 3347414 - RNA, 11 nt, Mycobacterium tuberculosis H37Rv
ggcgggcggca

SEQ ID NO: 3347415 - RNA, 20 nt, Mycobacterium tuberculosis H37Rv
ggcgggcggugggcagcagc

SEQ ID NO: 3347416 - RNA, 13 nt, Mycobacterium tuberculosis H37Rv
ggcgggcucgccc

SEQ ID NO: 3347417 - RNA, 14 nt, Mycobacterium tuberculosis H37Rv
ggcgggcugguguc

SEQ ID NO: 3347418 - RNA, 12 nt, Mycobacterium tuberculosis H37Rv
ggcgggcugguu

SEQ ID NO: 3347419 - RNA, 20 nt, Mycobacterium tuberculosis H37Rv
ggcgggcuuggcgucgacgu

SEQ ID NO: 3347420 - RNA, 19 nt, Mycobacterium tuberculosis H37Rv
ggcggggaaaccggccagc

SEQ ID NO: 3347421 - RNA, 12 nt, Mycobacterium tuberculosis H37Rv
ggcggggaccgc

SEQ ID NO: 3347422 - RNA, 12 nt, Mycobacterium tuberculosis H37Rv
ggcggggauccg

SEQ ID NO: 3347423 - RNA, 15 nt, Mycobacterium tuberculosis H37Rv
ggcggggcggcggug

SEQ ID NO: 3347424 - RNA, 16 nt, Mycobacterium tuberculosis H37Rv
ggcgggggcgucgccg

SEQ ID NO: 3347425 - RNA, 17 nt, Mycobacterium tuberculosis H37Rv
ggcgggguugaucaccg

SEQ ID NO: 3347426 - RNA, 17 nt, Mycobacterium tuberculosis H37Rv
ggcggguccucgcggag

SEQ ID NO: 3347427 - RNA, 15 nt, Mycobacterium tuberculosis H37Rv
ggcgggugccgagcu

SEQ ID NO: 3347428 - RNA, 16 nt, Mycobacterium tuberculosis H37Rv
ggcgguaaagcucacc

SEQ ID NO: 3347429 - RNA, 17 nt, Mycobacterium tuberculosis H37Rv
ggcgguaaaugccugcc

SEQ ID NO: 3347430 - RNA, 15 nt, Mycobacterium tuberculosis H37Rv
ggcgguaaucgcgag

SEQ ID NO: 3347431 - RNA, 16 nt, Mycobacterium tuberculosis H37Rv
ggcgguaccucgucga

SEQ ID NO: 3347432 - RNA, 17 nt, Mycobacterium tuberculosis H37Rv
ggcgguaccucgucgag

SEQ ID NO: 3347433 - RNA, 18 nt, Mycobacterium tuberculosis H37Rv
ggcgguaccucgucgagc

SEQ ID NO: 3347434 - RNA, 17 nt, Mycobacterium tuberculosis H37Rv
ggcgguagacaccccac

SEQ ID NO: 3347435 - RNA, 14 nt, Mycobacterium tuberculosis H37Rv
ggcgguagccgacg

SEQ ID NO: 3347436 - RNA, 18 nt, Mycobacterium tuberculosis H37Rv
ggcgguaguacucgcgca

SEQ ID NO: 3347437 - RNA, 14 nt, Mycobacterium tuberculosis H37Rv
ggcggucaccaccg

SEQ ID NO: 3347438 - RNA, 22 nt, Mycobacterium tuberculosis H37Rv
ggcggucaccaccguggcgccc

SEQ ID NO: 3347439 - RNA, 13 nt, Mycobacterium tuberculosis H37Rv
ggcggucagcggc

SEQ ID NO: 3347440 - RNA, 20 nt, Mycobacterium tuberculosis H37Rv
ggcggucagcggccaaccca

SEQ ID NO: 3347441 - RNA, 15 nt, Mycobacterium tuberculosis H37Rv
ggcggucagcggcuc

SEQ ID NO: 3347442 - RNA, 17 nt, Mycobacterium tuberculosis H37Rv
ggcggucagcggcucgg

SEQ ID NO: 3347443 - RNA, 17 nt, Mycobacterium tuberculosis H37Rv
ggcgguccaaucgccgg

SEQ ID NO: 3347444 - RNA, 16 nt, Mycobacterium tuberculosis H37Rv
ggcggucccugaagcc

SEQ ID NO: 3347445 - RNA, 22 nt, Mycobacterium tuberculosis H37Rv
ggcggucgaucauggcggcagc

SEQ ID NO: 3347446 - RNA, 23 nt, Mycobacterium tuberculosis H37Rv
ggcggucgaucauggcggcagca

SEQ ID NO: 3347447 - RNA, 22 nt, Mycobacterium tuberculosis H37Rv
ggcggucggaaugccgucgccg

SEQ ID NO: 3347448 - RNA, 13 nt, Mycobacterium tuberculosis H37Rv
ggcggucggcaga

SEQ ID NO: 3347449 - RNA, 15 nt, Mycobacterium tuberculosis H37Rv
ggcggucggccggcu

SEQ ID NO: 3347450 - RNA, 14 nt, Mycobacterium tuberculosis H37Rv
ggcggucggccugc

SEQ ID NO: 3347451 - RNA, 23 nt, Mycobacterium tuberculosis H37Rv
ggcggucguugauuucggcggcg

SEQ ID NO: 3347452 - RNA, 22 nt, Mycobacterium tuberculosis H37Rv
ggcggucucacguugugagcca

SEQ ID NO: 3347453 - RNA, 23 nt, Mycobacterium tuberculosis H37Rv
ggcggucugagacucgucgaugc

SEQ ID NO: 3347454 - RNA, 18 nt, Mycobacterium tuberculosis H37Rv
ggcggucugcagugcagc

SEQ ID NO: 3347455 - RNA, 20 nt, Mycobacterium tuberculosis H37Rv
ggcggucugcagugcagcga

SEQ ID NO: 3347456 - RNA, 22 nt, Mycobacterium tuberculosis H37Rv
ggcggucugcagugcagcgauc

SEQ ID NO: 3347457 - RNA, 18 nt, Mycobacterium tuberculosis H37Rv
ggcggucugcgccaaaau

SEQ ID NO: 3347458 - RNA, 22 nt, Mycobacterium tuberculosis H37Rv
ggcggucugggugagcaccugg

SEQ ID NO: 3347459 - RNA, 18 nt, Mycobacterium tuberculosis H37Rv
ggcggucuguaagacagc

SEQ ID NO: 3347460 - RNA, 19 nt, Mycobacterium tuberculosis H37Rv
ggcggucuuuuugggcuug

SEQ ID NO: 3347461 - RNA, 23 nt, Mycobacterium tuberculosis H37Rv
ggcggugaaaucgcacagcgcga

SEQ ID NO: 3347462 - RNA, 20 nt, Mycobacterium tuberculosis H37Rv
ggcggugaacaccgccagca

SEQ ID NO: 3347463 - RNA, 17 nt, Mycobacterium tuberculosis H37Rv
ggcggugacgugguggg

SEQ ID NO: 3347464 - RNA, 21 nt, Mycobacterium tuberculosis H37Rv
ggcggugcacaccgucgcacc

SEQ ID NO: 3347465 - RNA, 15 nt, Mycobacterium tuberculosis H37Rv
ggcggugcagcaggg

SEQ ID NO: 3347466 - RNA, 12 nt, Mycobacterium tuberculosis H37Rv
ggcggugccacc

SEQ ID NO: 3347467 - RNA, 21 nt, Mycobacterium tuberculosis H37Rv
ggcggugccaucgggcgcggu

SEQ ID NO: 3347468 - RNA, 12 nt, Mycobacterium tuberculosis H37Rv
ggcggugcccag

SEQ ID NO: 3347469 - RNA, 12 nt, Mycobacterium tuberculosis H37Rv
ggcggugccggc

SEQ ID NO: 3347470 - RNA, 13 nt, Mycobacterium tuberculosis H37Rv
ggcggugccggcg

SEQ ID NO: 3347471 - RNA, 15 nt, Mycobacterium tuberculosis H37Rv
ggcggugccgucagc

SEQ ID NO: 3347472 - RNA, 14 nt, Mycobacterium tuberculosis H37Rv
ggcggugcgucagc

SEQ ID NO: 3347473 - RNA, 20 nt, Mycobacterium tuberculosis H37Rv
ggcggugcugcuucaacgcg

SEQ ID NO: 3347474 - RNA, 22 nt, Mycobacterium tuberculosis H37Rv
ggcggugcugcuucaacgcguc

SEQ ID NO: 3347475 - RNA, 23 nt, Mycobacterium tuberculosis H37Rv
ggcgguggccacccggccgcgcg

SEQ ID NO: 3347476 - RNA, 15 nt, Mycobacterium tuberculosis H37Rv
ggcgguggcccgauu

SEQ ID NO: 3347477 - RNA, 14 nt, Mycobacterium tuberculosis H37Rv
ggcgguggcgaggu

SEQ ID NO: 3347478 - RNA, 16 nt, Mycobacterium tuberculosis H37Rv
ggcgguggcggugcug

SEQ ID NO: 3347479 - RNA, 17 nt, Mycobacterium tuberculosis H37Rv
ggcggugggcagcagcu

SEQ ID NO: 3347480 - RNA, 19 nt, Mycobacterium tuberculosis H37Rv
ggcggugggcagcagcugg

SEQ ID NO: 3347481 - RNA, 18 nt, Mycobacterium tuberculosis H37Rv
ggcgguggggccggcguc

SEQ ID NO: 3347482 - RNA, 13 nt, Mycobacterium tuberculosis H37Rv
ggcgguggggcug

SEQ ID NO: 3347483 - RNA, 13 nt, Mycobacterium tuberculosis H37Rv
ggcgguggucccg

SEQ ID NO: 3347484 - RNA, 20 nt, Mycobacterium tuberculosis H37Rv
ggcgguguccagaacggugg

SEQ ID NO: 3347485 - RNA, 22 nt, Mycobacterium tuberculosis H37Rv
ggcgguguccagaacgguggcg

SEQ ID NO: 3347486 - RNA, 13 nt, Mycobacterium tuberculosis H37Rv
ggcggugucgacc

SEQ ID NO: 3347487 - RNA, 14 nt, Mycobacterium tuberculosis H37Rv
ggcggugucgaccu

SEQ ID NO: 3347488 - RNA, 13 nt, Mycobacterium tuberculosis H37Rv
ggcggugucggcg

SEQ ID NO: 3347489 - RNA, 16 nt, Mycobacterium tuberculosis H37Rv
ggcggugucggcgccg

SEQ ID NO: 3347490 - RNA, 18 nt, Mycobacterium tuberculosis H37Rv
ggcggugucgucaucggg

SEQ ID NO: 3347491 - RNA, 15 nt, Mycobacterium tuberculosis H37Rv
ggcggugucgucgag

SEQ ID NO: 3347492 - RNA, 23 nt, Mycobacterium tuberculosis H37Rv
ggcggugugcucacgcaucgcga

SEQ ID NO: 3347493 - RNA, 16 nt, Mycobacterium tuberculosis H37Rv
ggcgguuaucgucggg

SEQ ID NO: 3347494 - RNA, 15 nt, Mycobacterium tuberculosis H37Rv
ggcgguugaucgccg

SEQ ID NO: 3347495 - RNA, 16 nt, Mycobacterium tuberculosis H37Rv
ggcgguugaucgccgg

SEQ ID NO: 3347496 - RNA, 16 nt, Mycobacterium tuberculosis H37Rv
ggcguaaucgggaagu

SEQ ID NO: 3347497 - RNA, 21 nt, Mycobacterium tuberculosis H37Rv
ggcgugcucgccgggucagcc

SEQ ID NO: 3347498 - RNA, 18 nt, Mycobacterium tuberculosis H37Rv
ggcgugcugugcucacga

SEQ ID NO: 3347499 - RNA, 24 nt, Mycobacterium tuberculosis H37Rv
ggcgugcuugaccgccuggaagga

SEQ ID NO: 3347500 - RNA, 17 nt, Mycobacterium tuberculosis H37Rv
ggcgugcuugacgagga

SEQ ID NO: 3347501 - RNA, 16 nt, Mycobacterium tuberculosis H37Rv
ggcguggaugcccggu

SEQ ID NO: 3347502 - RNA, 15 nt, Mycobacterium tuberculosis H37Rv
ggcguggccccaccg

SEQ ID NO: 3347503 - RNA, 17 nt, Mycobacterium tuberculosis H37Rv
ggcguggcccucggcga

SEQ ID NO: 3347504 - RNA, 15 nt, Mycobacterium tuberculosis H37Rv
ggcguggcgggggcu

SEQ ID NO: 3347505 - RNA, 12 nt, Mycobacterium tuberculosis H37Rv
ggcguggcuggu

SEQ ID NO: 3347506 - RNA, 20 nt, Mycobacterium tuberculosis H37Rv
ggcgugggugucggcgaagc

SEQ ID NO: 3347507 - RNA, 17 nt, Mycobacterium tuberculosis H37Rv
ggcgugggugucggcua

SEQ ID NO: 3347508 - RNA, 24 nt, Mycobacterium tuberculosis H37Rv
ggcguggucaccccuucgccagcg

SEQ ID NO: 3347509 - RNA, 18 nt, Mycobacterium tuberculosis H37Rv
ggcguggucgcgcggcac

SEQ ID NO: 3347510 - RNA, 18 nt, Mycobacterium tuberculosis H37Rv
ggcguggucggcaaagcg

SEQ ID NO: 3347511 - RNA, 16 nt, Mycobacterium tuberculosis H37Rv
ggcguggucggcggug

SEQ ID NO: 3347512 - RNA, 12 nt, Mycobacterium tuberculosis H37Rv
ggcguggucucg

SEQ ID NO: 3347513 - RNA, 18 nt, Mycobacterium tuberculosis H37Rv
ggcguggucucggucagc

SEQ ID NO: 3347514 - RNA, 16 nt, Mycobacterium tuberculosis H37Rv
ggcguguacgucgauc

SEQ ID NO: 3347515 - RNA, 15 nt, Mycobacterium tuberculosis H37Rv
ggcgugucacgucgc

SEQ ID NO: 3347516 - RNA, 13 nt, Mycobacterium tuberculosis H37Rv
ggcgugucgccgc

SEQ ID NO: 3347517 - RNA, 16 nt, Mycobacterium tuberculosis H37Rv
ggcgugucgccgccac

SEQ ID NO: 3347518 - RNA, 18 nt, Mycobacterium tuberculosis H37Rv
ggcgugucgcgucgcagg

SEQ ID NO: 3347519 - RNA, 19 nt, Mycobacterium tuberculosis H37Rv
ggcguguucgacggcaagc

SEQ ID NO: 3347520 - RNA, 21 nt, Mycobacterium tuberculosis H37Rv
ggcguguuuagcggcugaggg

SEQ ID NO: 3347521 - RNA, 16 nt, Mycobacterium tuberculosis H37Rv
ggcguuacguggugga

SEQ ID NO: 3347522 - RNA, 21 nt, Mycobacterium tuberculosis H37Rv
ggcguucaccacgaucgcgag

SEQ ID NO: 3347523 - RNA, 13 nt, Mycobacterium tuberculosis H37Rv
ggcguucaccugc

SEQ ID NO: 3347524 - RNA, 18 nt, Mycobacterium tuberculosis H37Rv
ggcguucagcggccagca

SEQ ID NO: 3347525 - RNA, 19 nt, Mycobacterium tuberculosis H37Rv
ggcguucagcggccagcag

SEQ ID NO: 3347526 - RNA, 24 nt, Mycobacterium tuberculosis H37Rv
ggcguuccccgagaacggcgggcg

SEQ ID NO: 3347527 - RNA, 21 nt, Mycobacterium tuberculosis H37Rv
ggcguucccgccauugccgcc

SEQ ID NO: 3347528 - RNA, 21 nt, Mycobacterium tuberculosis H37Rv
ggcguucucgauugucgccgc

SEQ ID NO: 3347529 - RNA, 16 nt, Mycobacterium tuberculosis H37Rv
ggcguugaccagcacg

SEQ ID NO: 3347530 - RNA, 12 nt, Mycobacterium tuberculosis H37Rv
ggcguugccgcc

SEQ ID NO: 3347531 - RNA, 15 nt, Mycobacterium tuberculosis H37Rv
ggcguugccgccguu

SEQ ID NO: 3347532 - RNA, 20 nt, Mycobacterium tuberculosis H37Rv
ggcguugcugaugucgccgg

SEQ ID NO: 3347533 - RNA, 14 nt, Mycobacterium tuberculosis H37Rv
ggcguuggcaugag

SEQ ID NO: 3347534 - RNA, 14 nt, Mycobacterium tuberculosis H37Rv
ggcguuggccagca

SEQ ID NO: 3347535 - RNA, 17 nt, Mycobacterium tuberculosis H37Rv
ggcguuggcggcuucgc

SEQ ID NO: 3347536 - RNA, 20 nt, Mycobacterium tuberculosis H37Rv
ggcguugguagccagggcga

SEQ ID NO: 3347537 - RNA, 22 nt, Mycobacterium tuberculosis H37Rv
ggcguugguagccagggcgauc

SEQ ID NO: 3347538 - RNA, 17 nt, Mycobacterium tuberculosis H37Rv
ggcguuguugcggaucg

SEQ ID NO: 3347539 - RNA, 18 nt, Mycobacterium tuberculosis H37Rv
ggcguuucggcgggcgcc

SEQ ID NO: 3347540 - RNA, 22 nt, Mycobacterium tuberculosis H37Rv
ggcguuugagaacaacgggauc

SEQ ID NO: 3347541 - RNA, 22 nt, Mycobacterium tuberculosis H37Rv
ggcguuuucaauuucacugcga

SEQ ID NO: 3347542 - RNA, 22 nt, Mycobacterium tuberculosis H37Rv
ggcuaagccuucggugucgccg

SEQ ID NO: 3347543 - RNA, 16 nt, Mycobacterium tuberculosis H37Rv
ggcuaauagcucgccg

SEQ ID NO: 3347544 - RNA, 20 nt, Mycobacterium tuberculosis H37Rv
ggcuaauagcucgccggcga

SEQ ID NO: 3347545 - RNA, 17 nt, Mycobacterium tuberculosis H37Rv
ggcuaaucagccaggcc

SEQ ID NO: 3347546 - RNA, 15 nt, Mycobacterium tuberculosis H37Rv
ggcuacaucggcggc

SEQ ID NO: 3347547 - RNA, 20 nt, Mycobacterium tuberculosis H37Rv
ggcuacaucggcggcgucga

SEQ ID NO: 3347548 - RNA, 17 nt, Mycobacterium tuberculosis H37Rv
ggcuacccaauaggcga

SEQ ID NO: 3347549 - RNA, 15 nt, Mycobacterium tuberculosis H37Rv
ggcuaccccagggag

SEQ ID NO: 3347550 - RNA, 17 nt, Mycobacterium tuberculosis H37Rv
ggcuaccgcgcucccgg

SEQ ID NO: 3347551 - RNA, 14 nt, Mycobacterium tuberculosis H37Rv
ggcuaccggcagcu

SEQ ID NO: 3347552 - RNA, 20 nt, Mycobacterium tuberculosis H37Rv
ggcuaccggcagcugcucgg

SEQ ID NO: 3347553 - RNA, 18 nt, Mycobacterium tuberculosis H37Rv
ggcuaccuaacccgcgcc

SEQ ID NO: 3347554 - RNA, 17 nt, Mycobacterium tuberculosis H37Rv
ggcuacgacggcgccau

SEQ ID NO: 3347555 - RNA, 15 nt, Mycobacterium tuberculosis H37Rv
ggcuacgccccacug

SEQ ID NO: 3347556 - RNA, 18 nt, Mycobacterium tuberculosis H37Rv
ggcuacgccccacugccg

SEQ ID NO: 3347557 - RNA, 14 nt, Mycobacterium tuberculosis H37Rv
ggcuacgcgcgccc

SEQ ID NO: 3347558 - RNA, 13 nt, Mycobacterium tuberculosis H37Rv
ggcuacggccagu

SEQ ID NO: 3347559 - RNA, 22 nt, Mycobacterium tuberculosis H37Rv
ggcuacucgaaacccauguuug

SEQ ID NO: 3347560 - RNA, 19 nt, Mycobacterium tuberculosis H37Rv
ggcuaggcaccagcggauc

SEQ ID NO: 3347561 - RNA, 21 nt, Mycobacterium tuberculosis H37Rv
ggcuaggcaccagcggaucgc

SEQ ID NO: 3347562 - RNA, 13 nt, Mycobacterium tuberculosis H37Rv
ggcuaggccagca

SEQ ID NO: 3347563 - RNA, 16 nt, Mycobacterium tuberculosis H37Rv
ggcuaggucagcgggc

SEQ ID NO: 3347564 - RNA, 22 nt, Mycobacterium tuberculosis H37Rv
ggcuaguugggugggugcagca

SEQ ID NO: 3347565 - RNA, 15 nt, Mycobacterium tuberculosis H37Rv
ggcuauccaccugcu

SEQ ID NO: 3347566 - RNA, 18 nt, Mycobacterium tuberculosis H37Rv
ggcuaucguggcggcguc

SEQ ID NO: 3347567 - RNA, 15 nt, Mycobacterium tuberculosis H37Rv
ggcuaucugauccag

SEQ ID NO: 3347568 - RNA, 17 nt, Mycobacterium tuberculosis H37Rv
ggcuauggcgcagcugg

SEQ ID NO: 3347569 - RNA, 22 nt, Mycobacterium tuberculosis H37Rv
ggcucacacauagcgauucgcg

SEQ ID NO: 3347570 - RNA, 16 nt, Mycobacterium tuberculosis H37Rv
ggcucacagcacagcg

SEQ ID NO: 3347571 - RNA, 18 nt, Mycobacterium tuberculosis H37Rv
ggcucacagcacagcgca

SEQ ID NO: 3347572 - RNA, 22 nt, Mycobacterium tuberculosis H37Rv
ggcucacaugcccgcaccgucg

SEQ ID NO: 3347573 - RNA, 18 nt, Mycobacterium tuberculosis H37Rv
ggcucaccccguucgagg

SEQ ID NO: 3347574 - RNA, 13 nt, Mycobacterium tuberculosis H37Rv
ggcucacccuugg

SEQ ID NO: 3347575 - RNA, 14 nt, Mycobacterium tuberculosis H37Rv
ggcucacccuugga

SEQ ID NO: 3347576 - RNA, 14 nt, Mycobacterium tuberculosis H37Rv
ggcucaccuucaga

SEQ ID NO: 3347577 - RNA, 19 nt, Mycobacterium tuberculosis H37Rv
ggcucacgucuaacacgcg

SEQ ID NO: 3347578 - RNA, 15 nt, Mycobacterium tuberculosis H37Rv
ggcucacucgccgaa

SEQ ID NO: 3347579 - RNA, 12 nt, Mycobacterium tuberculosis H37Rv
ggcucagcagcg

SEQ ID NO: 3347580 - RNA, 19 nt, Mycobacterium tuberculosis H37Rv
ggcucagcagcgccgcgcg

SEQ ID NO: 3347581 - RNA, 21 nt, Mycobacterium tuberculosis H37Rv
ggcucagcagcgccgcgcggg

SEQ ID NO: 3347582 - RNA, 15 nt, Mycobacterium tuberculosis H37Rv
ggcucagcggcgacc

SEQ ID NO: 3347583 - RNA, 15 nt, Mycobacterium tuberculosis H37Rv
ggcucagcgguggcg

SEQ ID NO: 3347584 - RNA, 22 nt, Mycobacterium tuberculosis H37Rv
ggcucagcgguggcguggugga

SEQ ID NO: 3347585 - RNA, 15 nt, Mycobacterium tuberculosis H37Rv
ggcucagcgugcgcu

SEQ ID NO: 3347586 - RNA, 21 nt, Mycobacterium tuberculosis H37Rv
ggcucagcugggccgcugugc

SEQ ID NO: 3347587 - RNA, 17 nt, Mycobacterium tuberculosis H37Rv
ggcucagcugguggcgg

SEQ ID NO: 3347588 - RNA, 16 nt, Mycobacterium tuberculosis H37Rv
ggcucagucacgcacu

SEQ ID NO: 3347589 - RNA, 20 nt, Mycobacterium tuberculosis H37Rv
ggcucagucacgcacucccg

SEQ ID NO: 3347590 - RNA, 23 nt, Mycobacterium tuberculosis H37Rv
ggcucaucgaagcuucggccuuc

SEQ ID NO: 3347591 - RNA, 12 nt, Mycobacterium tuberculosis H37Rv
ggcucaucgcag

SEQ ID NO: 3347592 - RNA, 12 nt, Mycobacterium tuberculosis H37Rv
ggcucauggcau

SEQ ID NO: 3347593 - RNA, 14 nt, Mycobacterium tuberculosis H37Rv
ggcugcaccggcuu

SEQ ID NO: 3347594 - RNA, 20 nt, Mycobacterium tuberculosis H37Rv
ggcugcaguaaaugggccuc

SEQ ID NO: 3347595 - RNA, 22 nt, Mycobacterium tuberculosis H37Rv
ggcugcagugacucgaucacca

SEQ ID NO: 3347596 - RNA, 21 nt, Mycobacterium tuberculosis H37Rv
ggcugcagugccgcacccaga

SEQ ID NO: 3347597 - RNA, 23 nt, Mycobacterium tuberculosis H37Rv
ggcugcauccuccucgucgacgu

SEQ ID NO: 3347598 - RNA, 21 nt, Mycobacterium tuberculosis H37Rv
ggcugccaccagggccgcagu

SEQ ID NO: 3347599 - RNA, 14 nt, Mycobacterium tuberculosis H37Rv
ggcugccacgaacg

SEQ ID NO: 3347600 - RNA, 16 nt, Mycobacterium tuberculosis H37Rv
ggcugccagugccgcc

SEQ ID NO: 3347601 - RNA, 19 nt, Mycobacterium tuberculosis H37Rv
ggcugccaucccgaucccg

SEQ ID NO: 3347602 - RNA, 22 nt, Mycobacterium tuberculosis H37Rv
ggcugccaucccgaucccggcc

SEQ ID NO: 3347603 - RNA, 22 nt, Mycobacterium tuberculosis H37Rv
ggcugccauuccagaucaacgc

SEQ ID NO: 3347604 - RNA, 18 nt, Mycobacterium tuberculosis H37Rv
ggcugcccaucggugauc

SEQ ID NO: 3347605 - RNA, 20 nt, Mycobacterium tuberculosis H37Rv
ggcugcccaugguggcgauc

SEQ ID NO: 3347606 - RNA, 12 nt, Mycobacterium tuberculosis H37Rv
ggcugcccgaga

SEQ ID NO: 3347607 - RNA, 15 nt, Mycobacterium tuberculosis H37Rv
ggcugcccgagaucg

SEQ ID NO: 3347608 - RNA, 12 nt, Mycobacterium tuberculosis H37Rv
ggcugcccgcgg

SEQ ID NO: 3347609 - RNA, 18 nt, Mycobacterium tuberculosis H37Rv
ggcugcccguucugccca

SEQ ID NO: 3347610 - RNA, 22 nt, Mycobacterium tuberculosis H37Rv
ggcugcccguucugcccaggca

SEQ ID NO: 3347611 - RNA, 20 nt, Mycobacterium tuberculosis H37Rv
ggcugccgaacagcgaaccg

SEQ ID NO: 3347612 - RNA, 23 nt, Mycobacterium tuberculosis H37Rv
ggcugccgaacaguucggcgagc

SEQ ID NO: 3347613 - RNA, 19 nt, Mycobacterium tuberculosis H37Rv
ggcugccgcaaacgcggcg

SEQ ID NO: 3347614 - RNA, 23 nt, Mycobacterium tuberculosis H37Rv
ggcugccgcaaacgcggcgucga

SEQ ID NO: 3347615 - RNA, 20 nt, Mycobacterium tuberculosis H37Rv
ggcugccgcaugcgcuccgg

SEQ ID NO: 3347616 - RNA, 16 nt, Mycobacterium tuberculosis H37Rv
ggcugccgcccaugcc

SEQ ID NO: 3347617 - RNA, 23 nt, Mycobacterium tuberculosis H37Rv
ggcugccgcggcugccaucccga

SEQ ID NO: 3347618 - RNA, 12 nt, Mycobacterium tuberculosis H37Rv
ggcugccggcaa

SEQ ID NO: 3347619 - RNA, 16 nt, Mycobacterium tuberculosis H37Rv
ggcugccgucagccgu

SEQ ID NO: 3347620 - RNA, 17 nt, Mycobacterium tuberculosis H37Rv
ggcugccgucuccuggu

SEQ ID NO: 3347621 - RNA, 20 nt, Mycobacterium tuberculosis H37Rv
ggcugccuccaucaacugca

SEQ ID NO: 3347622 - RNA, 22 nt, Mycobacterium tuberculosis H37Rv
ggcugcgaaagccacucgcgca

SEQ ID NO: 3347623 - RNA, 22 nt, Mycobacterium tuberculosis H37Rv
ggcugcgacaggacgucggcga

SEQ ID NO: 3347624 - RNA, 15 nt, Mycobacterium tuberculosis H37Rv
ggcugcgaccggcuc

SEQ ID NO: 3347625 - RNA, 18 nt, Mycobacterium tuberculosis H37Rv
ggcugcgaccggcuccgg

SEQ ID NO: 3347626 - RNA, 21 nt, Mycobacterium tuberculosis H37Rv
ggcugcgccgggcucgcgauc

SEQ ID NO: 3347627 - RNA, 13 nt, Mycobacterium tuberculosis H37Rv
ggcugcgcgcucg

SEQ ID NO: 3347628 - RNA, 21 nt, Mycobacterium tuberculosis H37Rv
ggcugcgcuuugcacagcggc

SEQ ID NO: 3347629 - RNA, 24 nt, Mycobacterium tuberculosis H37Rv
ggcugcgcuuugcacagcggcauc

SEQ ID NO: 3347630 - RNA, 18 nt, Mycobacterium tuberculosis H37Rv
ggcugcggaggcggguug

SEQ ID NO: 3347631 - RNA, 15 nt, Mycobacterium tuberculosis H37Rv
ggcugcgggcccggc

SEQ ID NO: 3347632 - RNA, 16 nt, Mycobacterium tuberculosis H37Rv
ggcugcgggucggcca

SEQ ID NO: 3347633 - RNA, 21 nt, Mycobacterium tuberculosis H37Rv
ggcugcgucgucugcagaccu

SEQ ID NO: 3347634 - RNA, 14 nt, Mycobacterium tuberculosis H37Rv
ggcugcguggcggg

SEQ ID NO: 3347635 - RNA, 15 nt, Mycobacterium tuberculosis H37Rv
ggcugcguuggcugg

SEQ ID NO: 3347636 - RNA, 14 nt, Mycobacterium tuberculosis H37Rv
ggcugcucgacggc

SEQ ID NO: 3347637 - RNA, 14 nt, Mycobacterium tuberculosis H37Rv
ggcugcuguuggua

SEQ ID NO: 3347638 - RNA, 20 nt, Mycobacterium tuberculosis H37Rv
ggcuggaccacucgccggcg

SEQ ID NO: 3347639 - RNA, 21 nt, Mycobacterium tuberculosis H37Rv
ggcuggaccacucgccggcgg

SEQ ID NO: 3347640 - RNA, 23 nt, Mycobacterium tuberculosis H37Rv
ggcuggaccacucgccggcggac

SEQ ID NO: 3347641 - RNA, 15 nt, Mycobacterium tuberculosis H37Rv
ggcuggacggcgccg

SEQ ID NO: 3347642 - RNA, 16 nt, Mycobacterium tuberculosis H37Rv
ggcuggcaccucccgg

SEQ ID NO: 3347643 - RNA, 17 nt, Mycobacterium tuberculosis H37Rv
ggcuggcaucccgggca

SEQ ID NO: 3347644 - RNA, 22 nt, Mycobacterium tuberculosis H37Rv
ggcuggcaucccgggcagucca

SEQ ID NO: 3347645 - RNA, 24 nt, Mycobacterium tuberculosis H37Rv
ggcuggcccgcaugccggcgcacc

SEQ ID NO: 3347646 - RNA, 18 nt, Mycobacterium tuberculosis H37Rv
ggcuggccgacucgaggu

SEQ ID NO: 3347647 - RNA, 22 nt, Mycobacterium tuberculosis H37Rv
ggcuggcgauggccguccgacc

SEQ ID NO: 3347648 - RNA, 16 nt, Mycobacterium tuberculosis H37Rv
ggcuggcgccccaggu

SEQ ID NO: 3347649 - RNA, 12 nt, Mycobacterium tuberculosis H37Rv
ggcuggcggccu

SEQ ID NO: 3347650 - RNA, 13 nt, Mycobacterium tuberculosis H37Rv
ggcuggcggccua

SEQ ID NO: 3347651 - RNA, 22 nt, Mycobacterium tuberculosis H37Rv
ggcuggcggccuaacucgccug

SEQ ID NO: 3347652 - RNA, 23 nt, Mycobacterium tuberculosis H37Rv
ggcuggcggguuggucccgauga

SEQ ID NO: 3347653 - RNA, 14 nt, Mycobacterium tuberculosis H37Rv
ggcuggcgucaccg

SEQ ID NO: 3347654 - RNA, 21 nt, Mycobacterium tuberculosis H37Rv
ggcuggcugaacauuccggca

SEQ ID NO: 3347655 - RNA, 21 nt, Mycobacterium tuberculosis H37Rv
ggcugggcagaccgaucggca

SEQ ID NO: 3347656 - RNA, 13 nt, Mycobacterium tuberculosis H37Rv
ggcugggcccgcc

SEQ ID NO: 3347657 - RNA, 14 nt, Mycobacterium tuberculosis H37Rv
ggcugggcccgccg

SEQ ID NO: 3347658 - RNA, 14 nt, Mycobacterium tuberculosis H37Rv
ggcugggcgccacc

SEQ ID NO: 3347659 - RNA, 18 nt, Mycobacterium tuberculosis H37Rv
ggcugggcgccaccaucg

SEQ ID NO: 3347660 - RNA, 21 nt, Mycobacterium tuberculosis H37Rv
ggcuggguaugcacccaggca

SEQ ID NO: 3347661 - RNA, 22 nt, Mycobacterium tuberculosis H37Rv
ggcugggucagguugucggcga

SEQ ID NO: 3347662 - RNA, 12 nt, Mycobacterium tuberculosis H37Rv
ggcugguagcug

SEQ ID NO: 3347663 - RNA, 17 nt, Mycobacterium tuberculosis H37Rv
ggcugguaucgagcacc

SEQ ID NO: 3347664 - RNA, 15 nt, Mycobacterium tuberculosis H37Rv
ggcugguccgggugc

SEQ ID NO: 3347665 - RNA, 23 nt, Mycobacterium tuberculosis H37Rv
ggcugguccgggugccggugcgc

SEQ ID NO: 3347666 - RNA, 13 nt, Mycobacterium tuberculosis H37Rv
ggcuggugccaac

SEQ ID NO: 3347667 - RNA, 19 nt, Mycobacterium tuberculosis H37Rv
ggcuggugggggagcggcc

SEQ ID NO: 3347668 - RNA, 20 nt, Mycobacterium tuberculosis H37Rv
ggcugguguccagccaggcg

SEQ ID NO: 3347669 - RNA, 15 nt, Mycobacterium tuberculosis H37Rv
ggcugguuacucacc

SEQ ID NO: 3347670 - RNA, 19 nt, Mycobacterium tuberculosis H37Rv
ggcugguuacucaccaacc

SEQ ID NO: 3347671 - RNA, 19 nt, Mycobacterium tuberculosis H37Rv
ggcugguugaccgaguuga

SEQ ID NO: 3347672 - RNA, 15 nt, Mycobacterium tuberculosis H37Rv
ggcugguuucggccg

SEQ ID NO: 3347673 - RNA, 19 nt, Mycobacterium tuberculosis H37Rv
ggcuguaaaaaugcuucgc

SEQ ID NO: 3347674 - RNA, 22 nt, Mycobacterium tuberculosis H37Rv
ggcuguaacacccggccgccga

SEQ ID NO: 3347675 - RNA, 14 nt, Mycobacterium tuberculosis H37Rv
ggcuguaggcgauc

SEQ ID NO: 3347676 - RNA, 19 nt, Mycobacterium tuberculosis H37Rv
ggcugucacgccugccacc

SEQ ID NO: 3347677 - RNA, 14 nt, Mycobacterium tuberculosis H37Rv
ggcuguccaccgag

SEQ ID NO: 3347678 - RNA, 17 nt, Mycobacterium tuberculosis H37Rv
ggcugucgugauacagc

SEQ ID NO: 3347679 - RNA, 20 nt, Mycobacterium tuberculosis H37Rv
ggcugucgugauacagcucg

SEQ ID NO: 3347680 - RNA, 23 nt, Mycobacterium tuberculosis H37Rv
ggcugucgugauacagcucggug

SEQ ID NO: 3347681 - RNA, 23 nt, Mycobacterium tuberculosis H37Rv
ggcugucgugccucucgggggcc

SEQ ID NO: 3347682 - RNA, 17 nt, Mycobacterium tuberculosis H37Rv
ggcugugaacagcgcgu

SEQ ID NO: 3347683 - RNA, 17 nt, Mycobacterium tuberculosis H37Rv
ggcugugaucgagucgc

SEQ ID NO: 3347684 - RNA, 22 nt, Mycobacterium tuberculosis H37Rv
ggcugugauguuguucagcagg

SEQ ID NO: 3347685 - RNA, 18 nt, Mycobacterium tuberculosis H37Rv
ggcugugcccgaucagcc

SEQ ID NO: 3347686 - RNA, 13 nt, Mycobacterium tuberculosis H37Rv
ggcugugccggcc

SEQ ID NO: 3347687 - RNA, 16 nt, Mycobacterium tuberculosis H37Rv
ggcuguucucgccgaa

SEQ ID NO: 3347688 - RNA, 21 nt, Mycobacterium tuberculosis H37Rv
gggaccgggcguuucccugcc

SEQ ID NO: 3347689 - RNA, 13 nt, Mycobacterium tuberculosis H37Rv
gggaccgguuaua

SEQ ID NO: 3347690 - RNA, 23 nt, Mycobacterium tuberculosis H37Rv
gggaccgugacguaucgccgcgg

SEQ ID NO: 3347691 - RNA, 15 nt, Mycobacterium tuberculosis H37Rv
gggacgacggcaaga

SEQ ID NO: 3347692 - RNA, 16 nt, Mycobacterium tuberculosis H37Rv
gggacgauucucgagu

SEQ ID NO: 3347693 - RNA, 21 nt, Mycobacterium tuberculosis H37Rv
gggacgccuugaucggcgagg

SEQ ID NO: 3347694 - RNA, 12 nt, Mycobacterium tuberculosis H37Rv
gggacggcgaau

SEQ ID NO: 3347695 - RNA, 12 nt, Mycobacterium tuberculosis H37Rv
gggacgggcgcg

SEQ ID NO: 3347696 - RNA, 13 nt, Mycobacterium tuberculosis H37Rv
gggacgggcggcc

SEQ ID NO: 3347697 - RNA, 15 nt, Mycobacterium tuberculosis H37Rv
gggacgugcccggug

SEQ ID NO: 3347698 - RNA, 17 nt, Mycobacterium tuberculosis H37Rv
gggacguuguccaccgc

SEQ ID NO: 3347699 - RNA, 12 nt, Mycobacterium tuberculosis H37Rv
gggacugcagcg

SEQ ID NO: 3347700 - RNA, 22 nt, Mycobacterium tuberculosis H37Rv
gggacugcggauaggugccgcg

SEQ ID NO: 3347701 - RNA, 13 nt, Mycobacterium tuberculosis H37Rv
gggacuggcguga

SEQ ID NO: 3347702 - RNA, 16 nt, Mycobacterium tuberculosis H37Rv
gggacuucgugccucg

SEQ ID NO: 3347703 - RNA, 22 nt, Mycobacterium tuberculosis H37Rv
gggagacgcugcgcgccagaca

SEQ ID NO: 3347704 - RNA, 20 nt, Mycobacterium tuberculosis H37Rv
gggagcacuaccccacaagc

SEQ ID NO: 3347705 - RNA, 18 nt, Mycobacterium tuberculosis H37Rv
gggagcccgagcucaccg

SEQ ID NO: 3347706 - RNA, 20 nt, Mycobacterium tuberculosis H37Rv
gggagcccgagcucaccgca

SEQ ID NO: 3347707 - RNA, 15 nt, Mycobacterium tuberculosis H37Rv
gggagcccggcggcc

SEQ ID NO: 3347708 - RNA, 21 nt, Mycobacterium tuberculosis H37Rv
gggagcgcagcgccggcagca

SEQ ID NO: 3347709 - RNA, 17 nt, Mycobacterium tuberculosis H37Rv
gggagcgcccggcugau

SEQ ID NO: 3347710 - RNA, 14 nt, Mycobacterium tuberculosis H37Rv
gggagcggcguguc

SEQ ID NO: 3347711 - RNA, 12 nt, Mycobacterium tuberculosis H37Rv
gggagcggcugc

SEQ ID NO: 3347712 - RNA, 14 nt, Mycobacterium tuberculosis H37Rv
gggagcggcugcgg

SEQ ID NO: 3347713 - RNA, 23 nt, Mycobacterium tuberculosis H37Rv
gggagcggcuugcgguggcggau

SEQ ID NO: 3347714 - RNA, 20 nt, Mycobacterium tuberculosis H37Rv
gggaggcgcggucgaccuga

SEQ ID NO: 3347715 - RNA, 22 nt, Mycobacterium tuberculosis H37Rv
gggagguacccccagcacccgg

SEQ ID NO: 3347716 - RNA, 17 nt, Mycobacterium tuberculosis H37Rv
gggaguacgggagccgg

SEQ ID NO: 3347717 - RNA, 22 nt, Mycobacterium tuberculosis H37Rv
gggagucgucggcaugggccgg

SEQ ID NO: 3347718 - RNA, 16 nt, Mycobacterium tuberculosis H37Rv
gggagucuucggcgac

SEQ ID NO: 3347719 - RNA, 17 nt, Mycobacterium tuberculosis H37Rv
gggagugcgccggcugg

SEQ ID NO: 3347720 - RNA, 21 nt, Mycobacterium tuberculosis H37Rv
gggagugcgccggcuggcggc

SEQ ID NO: 3347721 - RNA, 23 nt, Mycobacterium tuberculosis H37Rv
gggaguguguccgaaggcuuguc

SEQ ID NO: 3347722 - RNA, 14 nt, Mycobacterium tuberculosis H37Rv
gggauagccgcgac

SEQ ID NO: 3347723 - RNA, 15 nt, Mycobacterium tuberculosis H37Rv
gggauaggccguggu

SEQ ID NO: 3347724 - RNA, 21 nt, Mycobacterium tuberculosis H37Rv
gggaucacaccccaggcaccc

SEQ ID NO: 3347725 - RNA, 21 nt, Mycobacterium tuberculosis H37Rv
gggaucaccggcugcugagga

SEQ ID NO: 3347726 - RNA, 14 nt, Mycobacterium tuberculosis H37Rv
gggaucacgccacc

SEQ ID NO: 3347727 - RNA, 16 nt, Mycobacterium tuberculosis H37Rv
gggaucaggcugggca

SEQ ID NO: 3347728 - RNA, 13 nt, Mycobacterium tuberculosis H37Rv
gggaucaugacca

SEQ ID NO: 3347729 - RNA, 18 nt, Mycobacterium tuberculosis H37Rv
gggauccagcaggccggg

SEQ ID NO: 3347730 - RNA, 17 nt, Mycobacterium tuberculosis H37Rv
gggauccgaagagccag

SEQ ID NO: 3347731 - RNA, 16 nt, Mycobacterium tuberculosis H37Rv
gggauccggcgcagcg

SEQ ID NO: 3347732 - RNA, 14 nt, Mycobacterium tuberculosis H37Rv
gggauccgguggug

SEQ ID NO: 3347733 - RNA, 21 nt, Mycobacterium tuberculosis H37Rv
gggaucgagagccgaccgggu

SEQ ID NO: 3347734 - RNA, 17 nt, Mycobacterium tuberculosis H37Rv
gggaucgccguccagca

SEQ ID NO: 3347735 - RNA, 15 nt, Mycobacterium tuberculosis H37Rv
gggaucgggcccucc

SEQ ID NO: 3347736 - RNA, 16 nt, Mycobacterium tuberculosis H37Rv
gggaucuagaugcgga

SEQ ID NO: 3347737 - RNA, 19 nt, Mycobacterium tuberculosis H37Rv
gggaucuuaggcacucccg

SEQ ID NO: 3347738 - RNA, 20 nt, Mycobacterium tuberculosis H37Rv
gggaugaagaacgcgagcgc

SEQ ID NO: 3347739 - RNA, 22 nt, Mycobacterium tuberculosis H37Rv
gggaugacgguuccggucgggu

SEQ ID NO: 3347740 - RNA, 17 nt, Mycobacterium tuberculosis H37Rv
gggaugcagcugcccgg

SEQ ID NO: 3347741 - RNA, 20 nt, Mycobacterium tuberculosis H37Rv
gggaugcaugucuuguggug

SEQ ID NO: 3347742 - RNA, 14 nt, Mycobacterium tuberculosis H37Rv
gggaugcccgcuga

SEQ ID NO: 3347743 - RNA, 17 nt, Mycobacterium tuberculosis H37Rv
gggaugccggcccccac

SEQ ID NO: 3347744 - RNA, 23 nt, Mycobacterium tuberculosis H37Rv
gggaugcucgauccacugccgcg

SEQ ID NO: 3347745 - RNA, 14 nt, Mycobacterium tuberculosis H37Rv
gggauggccgccga

SEQ ID NO: 3347746 - RNA, 15 nt, Mycobacterium tuberculosis H37Rv
gggaugugcggcugc

SEQ ID NO: 3347747 - RNA, 14 nt, Mycobacterium tuberculosis H37Rv
gggauucggccaga

SEQ ID NO: 3347748 - RNA, 19 nt, Mycobacterium tuberculosis H37Rv
gggauucgucgugcgggcg

SEQ ID NO: 3347749 - RNA, 13 nt, Mycobacterium tuberculosis H37Rv
gggauucguuguc

SEQ ID NO: 3347750 - RNA, 16 nt, Mycobacterium tuberculosis H37Rv
gggauugcgggccugc

SEQ ID NO: 3347751 - RNA, 19 nt, Mycobacterium tuberculosis H37Rv
gggauugcgggccugcacg

SEQ ID NO: 3347752 - RNA, 20 nt, Mycobacterium tuberculosis H37Rv
gggauuuugcgucugcucac

SEQ ID NO: 3347753 - RNA, 19 nt, Mycobacterium tuberculosis H37Rv
gggauuuugcgucugcucg

SEQ ID NO: 3347754 - RNA, 14 nt, Mycobacterium tuberculosis H37Rv
gggcaaaucaagca

SEQ ID NO: 3347755 - RNA, 18 nt, Mycobacterium tuberculosis H37Rv
gggcaaaucaagcacagc

SEQ ID NO: 3347756 - RNA, 18 nt, Mycobacterium tuberculosis H37Rv
gggcaaccacaucaccgg

SEQ ID NO: 3347757 - RNA, 21 nt, Mycobacterium tuberculosis H37Rv
gggcaaccgaaccgguccacu

SEQ ID NO: 3347758 - RNA, 18 nt, Mycobacterium tuberculosis H37Rv
gggcaacgaucagguugg

SEQ ID NO: 3347759 - RNA, 13 nt, Mycobacterium tuberculosis H37Rv
gggcaacgccucg

SEQ ID NO: 3347760 - RNA, 17 nt, Mycobacterium tuberculosis H37Rv
gggcaacucggugacgu

SEQ ID NO: 3347761 - RNA, 16 nt, Mycobacterium tuberculosis H37Rv
gggcaagaaaguucca

SEQ ID NO: 3347762 - RNA, 19 nt, Mycobacterium tuberculosis H37Rv
gggcaaggacaagccgcug

SEQ ID NO: 3347763 - RNA, 21 nt, Mycobacterium tuberculosis H37Rv
gggcaaggacaagccgcugau

SEQ ID NO: 3347764 - RNA, 19 nt, Mycobacterium tuberculosis H37Rv
gggcaagucgcccagccga

SEQ ID NO: 3347765 - RNA, 19 nt, Mycobacterium tuberculosis H37Rv
gggcaauccggucagcgcg

SEQ ID NO: 3347766 - RNA, 22 nt, Mycobacterium tuberculosis H37Rv
gggcaaucgcucugugucgccg

SEQ ID NO: 3347767 - RNA, 18 nt, Mycobacterium tuberculosis H37Rv
gggcacaccgacgccgcc

SEQ ID NO: 3347768 - RNA, 19 nt, Mycobacterium tuberculosis H37Rv
gggcacaccgacgccgcca

SEQ ID NO: 3347769 - RNA, 23 nt, Mycobacterium tuberculosis H37Rv
gggcacaccgacgccgccagguc

SEQ ID NO: 3347770 - RNA, 17 nt, Mycobacterium tuberculosis H37Rv
gggcacaucgggcgugg

SEQ ID NO: 3347771 - RNA, 14 nt, Mycobacterium tuberculosis H37Rv
gggcaccacccgau

SEQ ID NO: 3347772 - RNA, 22 nt, Mycobacterium tuberculosis H37Rv
gggcaccacgcugugcucgacg

SEQ ID NO: 3347773 - RNA, 19 nt, Mycobacterium tuberculosis H37Rv
gggcaccacuuggguggcg

SEQ ID NO: 3347774 - RNA, 22 nt, Mycobacterium tuberculosis H37Rv
gggcaccagcgaauccagccgc

SEQ ID NO: 3347775 - RNA, 17 nt, Mycobacterium tuberculosis H37Rv
gggcaccagucgcccca

SEQ ID NO: 3347776 - RNA, 13 nt, Mycobacterium tuberculosis H37Rv
gggcaccggccgg

SEQ ID NO: 3347777 - RNA, 18 nt, Mycobacterium tuberculosis H37Rv
gggcaccguuaccgccgu

SEQ ID NO: 3347778 - RNA, 20 nt, Mycobacterium tuberculosis H37Rv
gggcaccuggucggccgcaa

SEQ ID NO: 3347779 - RNA, 22 nt, Mycobacterium tuberculosis H37Rv
gggcacgaacaucagaucgccg

SEQ ID NO: 3347780 - RNA, 22 nt, Mycobacterium tuberculosis H37Rv
gggcacgaucgucgcggccaag

SEQ ID NO: 3347781 - RNA, 14 nt, Mycobacterium tuberculosis H37Rv
gggcacgccaugga

SEQ ID NO: 3347782 - RNA, 17 nt, Mycobacterium tuberculosis H37Rv
gggcacgccgccgacgu

SEQ ID NO: 3347783 - RNA, 14 nt, Mycobacterium tuberculosis H37Rv
gggcacgggcaacg

SEQ ID NO: 3347784 - RNA, 17 nt, Mycobacterium tuberculosis H37Rv
gggccgaguucgucagc

SEQ ID NO: 3347785 - RNA, 22 nt, Mycobacterium tuberculosis H37Rv
gggccgaucucuccggcggcga

SEQ ID NO: 3347786 - RNA, 22 nt, Mycobacterium tuberculosis H37Rv
gggccgcacggucagcgcgcac

SEQ ID NO: 3347787 - RNA, 17 nt, Mycobacterium tuberculosis H37Rv
gggccgcaggccagggu

SEQ ID NO: 3347788 - RNA, 12 nt, Mycobacterium tuberculosis H37Rv
gggccgccagcu

SEQ ID NO: 3347789 - RNA, 12 nt, Mycobacterium tuberculosis H37Rv
gggccgccaggc

SEQ ID NO: 3347790 - RNA, 13 nt, Mycobacterium tuberculosis H37Rv
gggccgccaggcg

SEQ ID NO: 3347791 - RNA, 14 nt, Mycobacterium tuberculosis H37Rv
gggccgccgaagcu

SEQ ID NO: 3347792 - RNA, 23 nt, Mycobacterium tuberculosis H37Rv
gggccgccgaagcucaucgccgc

SEQ ID NO: 3347793 - RNA, 16 nt, Mycobacterium tuberculosis H37Rv
gggccgccgagcggac

SEQ ID NO: 3347794 - RNA, 12 nt, Mycobacterium tuberculosis H37Rv
gggccgccgccc

SEQ ID NO: 3347795 - RNA, 13 nt, Mycobacterium tuberculosis H37Rv
gggccgccgcgau

SEQ ID NO: 3347796 - RNA, 14 nt, Mycobacterium tuberculosis H37Rv
gggccgccucgcgg

SEQ ID NO: 3347797 - RNA, 17 nt, Mycobacterium tuberculosis H37Rv
gggccgccuggagcugu

SEQ ID NO: 3347798 - RNA, 23 nt, Mycobacterium tuberculosis H37Rv
gggccgcgcgcagagcguacagg

SEQ ID NO: 3347799 - RNA, 12 nt, Mycobacterium tuberculosis H37Rv
gggccgcgcuga

SEQ ID NO: 3347800 - RNA, 20 nt, Mycobacterium tuberculosis H37Rv
gggccgcggccacaucgcca

SEQ ID NO: 3347801 - RNA, 14 nt, Mycobacterium tuberculosis H37Rv
gggccgcucgccuc

SEQ ID NO: 3347802 - RNA, 17 nt, Mycobacterium tuberculosis H37Rv
gggccgcucgccucgau

SEQ ID NO: 3347803 - RNA, 18 nt, Mycobacterium tuberculosis H37Rv
gggccgcucuucgacauc

SEQ ID NO: 3347804 - RNA, 21 nt, Mycobacterium tuberculosis H37Rv
gggccggaccuuguuggccau

SEQ ID NO: 3347805 - RNA, 21 nt, Mycobacterium tuberculosis H37Rv
gggccggacugaagccgcgag

SEQ ID NO: 3347806 - RNA, 16 nt, Mycobacterium tuberculosis H37Rv
gggccggcaccgcagc

SEQ ID NO: 3347807 - RNA, 17 nt, Mycobacterium tuberculosis H37Rv
gggccggcaccgcagcg

SEQ ID NO: 3347808 - RNA, 15 nt, Mycobacterium tuberculosis H37Rv
gggccggcagcggcu

SEQ ID NO: 3347809 - RNA, 13 nt, Mycobacterium tuberculosis H37Rv
gggccggcgcggu

SEQ ID NO: 3347810 - RNA, 23 nt, Mycobacterium tuberculosis H37Rv
gggccggcuagggcagcagcccg

SEQ ID NO: 3347811 - RNA, 22 nt, Mycobacterium tuberculosis H37Rv
gggccgggcgaucgccugggcu

SEQ ID NO: 3347812 - RNA, 13 nt, Mycobacterium tuberculosis H37Rv
gggccgggcggug

SEQ ID NO: 3347813 - RNA, 20 nt, Mycobacterium tuberculosis H37Rv
gggccgggcuccucugguug

SEQ ID NO: 3347814 - RNA, 13 nt, Mycobacterium tuberculosis H37Rv
gggccgguccggg

SEQ ID NO: 3347815 - RNA, 19 nt, Mycobacterium tuberculosis H37Rv
gggccggucgugccggggc

SEQ ID NO: 3347816 - RNA, 14 nt, Mycobacterium tuberculosis H37Rv
gggccggugcagca

SEQ ID NO: 3347817 - RNA, 12 nt, Mycobacterium tuberculosis H37Rv
gggccggugcga

SEQ ID NO: 3347818 - RNA, 21 nt, Mycobacterium tuberculosis H37Rv
gggccguagaucccgaagcga

SEQ ID NO: 3347819 - RNA, 20 nt, Mycobacterium tuberculosis H37Rv
gggccgucaguuaaaggugg

SEQ ID NO: 3347820 - RNA, 22 nt, Mycobacterium tuberculosis H37Rv
gggccguccggcgccugcugcg

SEQ ID NO: 3347821 - RNA, 13 nt, Mycobacterium tuberculosis H37Rv
gggccguccgggu

SEQ ID NO: 3347822 - RNA, 16 nt, Mycobacterium tuberculosis H37Rv
gggccgucgccgucca

SEQ ID NO: 3347823 - RNA, 15 nt, Mycobacterium tuberculosis H37Rv
gggccgucucgccgu

SEQ ID NO: 3347824 - RNA, 18 nt, Mycobacterium tuberculosis H37Rv
gggccgucucgccgugga

SEQ ID NO: 3347825 - RNA, 20 nt, Mycobacterium tuberculosis H37Rv
gggccgucuugccggccagg

SEQ ID NO: 3347826 - RNA, 22 nt, Mycobacterium tuberculosis H37Rv
gggccgucuugccggccaggau

SEQ ID NO: 3347827 - RNA, 21 nt, Mycobacterium tuberculosis H37Rv
gggccguguucuaccugcacc

SEQ ID NO: 3347828 - RNA, 21 nt, Mycobacterium tuberculosis H37Rv
gggccguuggugaggcccccc

SEQ ID NO: 3347829 - RNA, 21 nt, Mycobacterium tuberculosis H37Rv
gggccguuuguagaucugggc

SEQ ID NO: 3347830 - RNA, 21 nt, Mycobacterium tuberculosis H37Rv
gggccuaucccgaaucucacc

SEQ ID NO: 3347831 - RNA, 19 nt, Mycobacterium tuberculosis H37Rv
gggccucaaggcggccauu

SEQ ID NO: 3347832 - RNA, 17 nt, Mycobacterium tuberculosis H37Rv
gggccucgaccgccagc

SEQ ID NO: 3347833 - RNA, 19 nt, Mycobacterium tuberculosis H37Rv
gggccucguugaccagaac

SEQ ID NO: 3347834 - RNA, 20 nt, Mycobacterium tuberculosis H37Rv
gggccugcacgccggcgcug

SEQ ID NO: 3347835 - RNA, 21 nt, Mycobacterium tuberculosis H37Rv
gggccugccaguccugaugac

SEQ ID NO: 3347836 - RNA, 13 nt, Mycobacterium tuberculosis H37Rv
gggccugcgcaga

SEQ ID NO: 3347837 - RNA, 16 nt, Mycobacterium tuberculosis H37Rv
gggccugggccgcaca

SEQ ID NO: 3347838 - RNA, 21 nt, Mycobacterium tuberculosis H37Rv
gggcgaaacgcccgggcggcg

SEQ ID NO: 3347839 - RNA, 16 nt, Mycobacterium tuberculosis H37Rv
gggcgaauccggcggg

SEQ ID NO: 3347840 - RNA, 18 nt, Mycobacterium tuberculosis H37Rv
gggcgaauccggcgggug

SEQ ID NO: 3347841 - RNA, 18 nt, Mycobacterium tuberculosis H37Rv
gggcgacacccgaugugc

SEQ ID NO: 3347842 - RNA, 21 nt, Mycobacterium tuberculosis H37Rv
gggcgacacccgaugugcccg

SEQ ID NO: 3347843 - RNA, 23 nt, Mycobacterium tuberculosis H37Rv
gggcgacacccgaugugcccggc

SEQ ID NO: 3347844 - RNA, 22 nt, Mycobacterium tuberculosis H37Rv
gggcgaccaccaccgccgccga

SEQ ID NO: 3347845 - RNA, 14 nt, Mycobacterium tuberculosis H37Rv
gggcgaccaccgcg

SEQ ID NO: 3347846 - RNA, 20 nt, Mycobacterium tuberculosis H37Rv
gggcgacccguucucgguga

SEQ ID NO: 3347847 - RNA, 19 nt, Mycobacterium tuberculosis H37Rv
gggcgaccugcggacccac

SEQ ID NO: 3347848 - RNA, 11 nt, Mycobacterium tuberculosis H37Rv
gggcgacgauc

SEQ ID NO: 3347849 - RNA, 13 nt, Mycobacterium tuberculosis H37Rv
gggcgacgcggcg

SEQ ID NO: 3347850 - RNA, 18 nt, Mycobacterium tuberculosis H37Rv
gggcgacgucaucgccga

SEQ ID NO: 3347851 - RNA, 14 nt, Mycobacterium tuberculosis H37Rv
gggcgagaccgcga

SEQ ID NO: 3347852 - RNA, 15 nt, Mycobacterium tuberculosis H37Rv
gggcgagaccgcgag

SEQ ID NO: 3347853 - RNA, 17 nt, Mycobacterium tuberculosis H37Rv
gggcgagaccgcgagca

SEQ ID NO: 3347854 - RNA, 14 nt, Mycobacterium tuberculosis H37Rv
gggcgagagcgcgg

SEQ ID NO: 3347855 - RNA, 20 nt, Mycobacterium tuberculosis H37Rv
gggcgagccaguaccaggua

SEQ ID NO: 3347856 - RNA, 15 nt, Mycobacterium tuberculosis H37Rv
gggcgagcgcggccu

SEQ ID NO: 3347857 - RNA, 20 nt, Mycobacterium tuberculosis H37Rv
gggcgaguagucgacgucga

SEQ ID NO: 3347858 - RNA, 19 nt, Mycobacterium tuberculosis H37Rv
gggcgauauuggacgcgca

SEQ ID NO: 3347859 - RNA, 18 nt, Mycobacterium tuberculosis H37Rv
gggcgaucgacaccguga

SEQ ID NO: 3347860 - RNA, 16 nt, Mycobacterium tuberculosis H37Rv
gggcgaucgucagcca

SEQ ID NO: 3347861 - RNA, 21 nt, Mycobacterium tuberculosis H37Rv
gggcgaucucggcgagcacca

SEQ ID NO: 3347862 - RNA, 14 nt, Mycobacterium tuberculosis H37Rv
gggcgaugcggcgu

SEQ ID NO: 3347863 - RNA, 17 nt, Mycobacterium tuberculosis H37Rv
gggcgauggucgggaug

SEQ ID NO: 3347864 - RNA, 16 nt, Mycobacterium tuberculosis H37Rv
gggcgaugucggcugg

SEQ ID NO: 3347865 - RNA, 16 nt, Mycobacterium tuberculosis H37Rv
gggcgauucugcgucu

SEQ ID NO: 3347866 - RNA, 19 nt, Mycobacterium tuberculosis H37Rv
gggcgauucugcgucugcu

SEQ ID NO: 3347867 - RNA, 22 nt, Mycobacterium tuberculosis H37Rv
gggcgauucugugucugcucgc

SEQ ID NO: 3347868 - RNA, 18 nt, Mycobacterium tuberculosis H37Rv
gggcgauuuugcgucugc

SEQ ID NO: 3347869 - RNA, 20 nt, Mycobacterium tuberculosis H37Rv
gggcgauuuugcgucugcuc

SEQ ID NO: 3347870 - RNA, 21 nt, Mycobacterium tuberculosis H37Rv
gggcgauuuugcgucugcucg

SEQ ID NO: 3347871 - RNA, 19 nt, Mycobacterium tuberculosis H37Rv
gggcgcaacgagagcggcu

SEQ ID NO: 3347872 - RNA, 16 nt, Mycobacterium tuberculosis H37Rv
gggcgcaagcagcccg

SEQ ID NO: 3347873 - RNA, 18 nt, Mycobacterium tuberculosis H37Rv
gggcgcaccaagacgcca

SEQ ID NO: 3347874 - RNA, 15 nt, Mycobacterium tuberculosis H37Rv
gggcgcaccgagcga

SEQ ID NO: 3347875 - RNA, 14 nt, Mycobacterium tuberculosis H37Rv
gggcgcaccgcgga

SEQ ID NO: 3347876 - RNA, 16 nt, Mycobacterium tuberculosis H37Rv
gggcgcagagucaacg

SEQ ID NO: 3347877 - RNA, 16 nt, Mycobacterium tuberculosis H37Rv
gggcgccacgggugac

SEQ ID NO: 3347878 - RNA, 18 nt, Mycobacterium tuberculosis H37Rv
gggcgccacugaccgcga

SEQ ID NO: 3347879 - RNA, 18 nt, Mycobacterium tuberculosis H37Rv
gggcgccaucccgccgcc

SEQ ID NO: 3347880 - RNA, 19 nt, Mycobacterium tuberculosis H37Rv
gggcuuguacgaacugcug

SEQ ID NO: 3347881 - RNA, 19 nt, Mycobacterium tuberculosis H37Rv
gggcuuuagugucugcucg

SEQ ID NO: 3347882 - RNA, 20 nt, Mycobacterium tuberculosis H37Rv
gggcuuucgcgugcggcugc

SEQ ID NO: 3347883 - RNA, 19 nt, Mycobacterium tuberculosis H37Rv
gggcuuuuacgucugcucg

SEQ ID NO: 3347884 - RNA, 20 nt, Mycobacterium tuberculosis H37Rv
gggcuuuuacgucugcucgc

SEQ ID NO: 3347885 - RNA, 18 nt, Mycobacterium tuberculosis H37Rv
gggcuuuugcgucugcuc

SEQ ID NO: 3347886 - RNA, 19 nt, Mycobacterium tuberculosis H37Rv
gggcuuuugcgucugcucg

SEQ ID NO: 3347887 - RNA, 20 nt, Mycobacterium tuberculosis H37Rv
gggcuuuugcgucugcucgc

SEQ ID NO: 3347888 - RNA, 19 nt, Mycobacterium tuberculosis H37Rv
ggggaaaccggccagccga

SEQ ID NO: 3347889 - RNA, 14 nt, Mycobacterium tuberculosis H37Rv
ggggaacaccgcgg

SEQ ID NO: 3347890 - RNA, 15 nt, Mycobacterium tuberculosis H37Rv
ggggaacuuaccgag

SEQ ID NO: 3347891 - RNA, 21 nt, Mycobacterium tuberculosis H37Rv
ggggaacuuaccgaggccaug

SEQ ID NO: 3347892 - RNA, 14 nt, Mycobacterium tuberculosis H37Rv
ggggaagacgaccg

SEQ ID NO: 3347893 - RNA, 19 nt, Mycobacterium tuberculosis H37Rv
ggggaagaucucggccagg

SEQ ID NO: 3347894 - RNA, 21 nt, Mycobacterium tuberculosis H37Rv
ggggaagaucucggccaggau

SEQ ID NO: 3347895 - RNA, 19 nt, Mycobacterium tuberculosis H37Rv
ggggaaguuggcugagcag

SEQ ID NO: 3347896 - RNA, 16 nt, Mycobacterium tuberculosis H37Rv
ggggaccacgccgacg

SEQ ID NO: 3347897 - RNA, 12 nt, Mycobacterium tuberculosis H37Rv
ggggaccagaua

SEQ ID NO: 3347898 - RNA, 14 nt, Mycobacterium tuberculosis H37Rv
ggggaccccgccag

SEQ ID NO: 3347899 - RNA, 21 nt, Mycobacterium tuberculosis H37Rv
ggggacccgcuccaagcgcgg

SEQ ID NO: 3347900 - RNA, 18 nt, Mycobacterium tuberculosis H37Rv
ggggacccggggccguug

SEQ ID NO: 3347901 - RNA, 16 nt, Mycobacterium tuberculosis H37Rv
ggggaccgcggcgcgu

SEQ ID NO: 3347902 - RNA, 21 nt, Mycobacterium tuberculosis H37Rv
ggggaccuauuggucgcucgc

SEQ ID NO: 3347903 - RNA, 18 nt, Mycobacterium tuberculosis H37Rv
ggggaccucuucggugug

SEQ ID NO: 3347904 - RNA, 13 nt, Mycobacterium tuberculosis H37Rv
ggggacgccgcgg

SEQ ID NO: 3347905 - RNA, 14 nt, Mycobacterium tuberculosis H37Rv
ggggacgggucggc

SEQ ID NO: 3347906 - RNA, 17 nt, Mycobacterium tuberculosis H37Rv
ggggacgugcccggugu

SEQ ID NO: 3347907 - RNA, 23 nt, Mycobacterium tuberculosis H37Rv
ggggacucauggccggucugcug

SEQ ID NO: 3347908 - RNA, 20 nt, Mycobacterium tuberculosis H37Rv
ggggacucugccacccagca

SEQ ID NO: 3347909 - RNA, 21 nt, Mycobacterium tuberculosis H37Rv
ggggacucugccacccagcac

SEQ ID NO: 3347910 - RNA, 15 nt, Mycobacterium tuberculosis H37Rv
ggggacuggcaggcc

SEQ ID NO: 3347911 - RNA, 15 nt, Mycobacterium tuberculosis H37Rv
ggggagccggugacg

SEQ ID NO: 3347912 - RNA, 17 nt, Mycobacterium tuberculosis H37Rv
ggggaguaguggugggc

SEQ ID NO: 3347913 - RNA, 16 nt, Mycobacterium tuberculosis H37Rv
ggggaguugcuugcag

SEQ ID NO: 3347914 - RNA, 22 nt, Mycobacterium tuberculosis H37Rv
ggggauaaucguuuucggccug

SEQ ID NO: 3347915 - RNA, 15 nt, Mycobacterium tuberculosis H37Rv
ggggauaccgcuggg

SEQ ID NO: 3347916 - RNA, 17 nt, Mycobacterium tuberculosis H37Rv
ggggaucaccggcugcu

SEQ ID NO: 3347917 - RNA, 18 nt, Mycobacterium tuberculosis H37Rv
ggggaucaccggcugcug

SEQ ID NO: 3347918 - RNA, 18 nt, Mycobacterium tuberculosis H37Rv
ggggaucguccggccggg

SEQ ID NO: 3347919 - RNA, 21 nt, Mycobacterium tuberculosis H37Rv
ggggaugacgguuugcagcgg

SEQ ID NO: 3347920 - RNA, 23 nt, Mycobacterium tuberculosis H37Rv
ggggauucgucgugcgggcgggc

SEQ ID NO: 3347921 - RNA, 20 nt, Mycobacterium tuberculosis H37Rv
ggggauuucgcgucugcucg

SEQ ID NO: 3347922 - RNA, 20 nt, Mycobacterium tuberculosis H37Rv
ggggauuuugcgucugcuca

SEQ ID NO: 3347923 - RNA, 21 nt, Mycobacterium tuberculosis H37Rv
ggggauuuugcgucugcucac

SEQ ID NO: 3347924 - RNA, 20 nt, Mycobacterium tuberculosis H37Rv
ggggauuuugcgucugcucg

SEQ ID NO: 3347925 - RNA, 14 nt, Mycobacterium tuberculosis H37Rv
ggggcaccagcgaa

SEQ ID NO: 3347926 - RNA, 20 nt, Mycobacterium tuberculosis H37Rv
ggggcaccagcgaauccagc

SEQ ID NO: 3347927 - RNA, 21 nt, Mycobacterium tuberculosis H37Rv
ggggcaccguuaccgccgucg

SEQ ID NO: 3347928 - RNA, 20 nt, Mycobacterium tuberculosis H37Rv
ggggcacgacgccggccugg

SEQ ID NO: 3347929 - RNA, 18 nt, Mycobacterium tuberculosis H37Rv
ggggcagccgggcgucgc

SEQ ID NO: 3347930 - RNA, 12 nt, Mycobacterium tuberculosis H37Rv
ggggcagcgcga

SEQ ID NO: 3347931 - RNA, 14 nt, Mycobacterium tuberculosis H37Rv
ggggcagcucaucg

SEQ ID NO: 3347932 - RNA, 15 nt, Mycobacterium tuberculosis H37Rv
ggggcaggaucuccg

SEQ ID NO: 3347933 - RNA, 15 nt, Mycobacterium tuberculosis H37Rv
ggggcaggucgagcg

SEQ ID NO: 3347934 - RNA, 19 nt, Mycobacterium tuberculosis H37Rv
ggggcaucggugcgguucg

SEQ ID NO: 3347935 - RNA, 15 nt, Mycobacterium tuberculosis H37Rv
ggggccacccgcaga

SEQ ID NO: 3347936 - RNA, 15 nt, Mycobacterium tuberculosis H37Rv
ggggccccgcgccgg

SEQ ID NO: 3347937 - RNA, 16 nt, Mycobacterium tuberculosis H37Rv
ggggcccgaccugucc

SEQ ID NO: 3347938 - RNA, 17 nt, Mycobacterium tuberculosis H37Rv
ggggcccggccgccacu

SEQ ID NO: 3347939 - RNA, 22 nt, Mycobacterium tuberculosis H37Rv
ggggccgaauccgauagcccgg

SEQ ID NO: 3347940 - RNA, 15 nt, Mycobacterium tuberculosis H37Rv
ggggccgagccgaca

SEQ ID NO: 3347941 - RNA, 16 nt, Mycobacterium tuberculosis H37Rv
ggggccgcaggccagc

SEQ ID NO: 3347942 - RNA, 17 nt, Mycobacterium tuberculosis H37Rv
ggggccgccgcggccgg

SEQ ID NO: 3347943 - RNA, 22 nt, Mycobacterium tuberculosis H37Rv
ggggccgcgucucggugcagca

SEQ ID NO: 3347944 - RNA, 15 nt, Mycobacterium tuberculosis H37Rv
ggggccgcuggggcg

SEQ ID NO: 3347945 - RNA, 20 nt, Mycobacterium tuberculosis H37Rv
ggggccggacugaagccgcg

SEQ ID NO: 3347946 - RNA, 14 nt, Mycobacterium tuberculosis H37Rv
ggggccggcgucga

SEQ ID NO: 3347947 - RNA, 11 nt, Mycobacterium tuberculosis H37Rv
ggggccgggcg

SEQ ID NO: 3347948 - RNA, 13 nt, Mycobacterium tuberculosis H37Rv
ggggccgggcucc

SEQ ID NO: 3347949 - RNA, 20 nt, Mycobacterium tuberculosis H37Rv
ggggccggggucggcccgcc

SEQ ID NO: 3347950 - RNA, 14 nt, Mycobacterium tuberculosis H37Rv
ggggccggucgggc

SEQ ID NO: 3347951 - RNA, 15 nt, Mycobacterium tuberculosis H37Rv
ggggccggucgggca

SEQ ID NO: 3347952 - RNA, 20 nt, Mycobacterium tuberculosis H37Rv
ggggccgucgucggucaccg

SEQ ID NO: 3347953 - RNA, 22 nt, Mycobacterium tuberculosis H37Rv
ggggccgucgucggucaccgac

SEQ ID NO: 3347954 - RNA, 19 nt, Mycobacterium tuberculosis H37Rv
ggggccgucucgccgugga

SEQ ID NO: 3347955 - RNA, 18 nt, Mycobacterium tuberculosis H37Rv
ggggccugcguccgacgc

SEQ ID NO: 3347956 - RNA, 23 nt, Mycobacterium tuberculosis H37Rv
ggggcgcacgauggugugcagca

SEQ ID NO: 3347957 - RNA, 15 nt, Mycobacterium tuberculosis H37Rv
ggggcgcagcgcggc

SEQ ID NO: 3347958 - RNA, 12 nt, Mycobacterium tuberculosis H37Rv
ggggcgcccggc

SEQ ID NO: 3347959 - RNA, 23 nt, Mycobacterium tuberculosis H37Rv
ggggcgcccggccaggucgacac

SEQ ID NO: 3347960 - RNA, 23 nt, Mycobacterium tuberculosis H37Rv
ggggcgccuuaggcguccgagcg

SEQ ID NO: 3347961 - RNA, 22 nt, Mycobacterium tuberculosis H37Rv
ggggcgccuucaccuggugugc

SEQ ID NO: 3347962 - RNA, 12 nt, Mycobacterium tuberculosis H37Rv
ggggcgcgccgg

SEQ ID NO: 3347963 - RNA, 17 nt, Mycobacterium tuberculosis H37Rv
ggggcgcgccggcuagg

SEQ ID NO: 3347964 - RNA, 11 nt, Mycobacterium tuberculosis H37Rv
ggggcgcgugg

SEQ ID NO: 3347965 - RNA, 17 nt, Mycobacterium tuberculosis H37Rv
ggggcgcgugggcgugc

SEQ ID NO: 3347966 - RNA, 19 nt, Mycobacterium tuberculosis H37Rv
ggggcgcucgcgcgcuggg

SEQ ID NO: 3347967 - RNA, 20 nt, Mycobacterium tuberculosis H37Rv
ggggcgcuuccguggcccaa

SEQ ID NO: 3347968 - RNA, 22 nt, Mycobacterium tuberculosis H37Rv
ggggcgcuuccguggcccaacc

SEQ ID NO: 3347969 - RNA, 14 nt, Mycobacterium tuberculosis H37Rv
ggggcggcgguggg

SEQ ID NO: 3347970 - RNA, 21 nt, Mycobacterium tuberculosis H37Rv
ggggcggucggccggcucguc

SEQ ID NO: 3347971 - RNA, 16 nt, Mycobacterium tuberculosis H37Rv
ggggcguacugugagu

SEQ ID NO: 3347972 - RNA, 10 nt, Mycobacterium tuberculosis H37Rv
ggggcgucgc

SEQ ID NO: 3347973 - RNA, 22 nt, Mycobacterium tuberculosis H37Rv
ggggcgucgcaacccggccugg

SEQ ID NO: 3347974 - RNA, 13 nt, Mycobacterium tuberculosis H37Rv
ggggcgucguucg

SEQ ID NO: 3347975 - RNA, 20 nt, Mycobacterium tuberculosis H37Rv
ggggcgugacagggcggcaa

SEQ ID NO: 3347976 - RNA, 21 nt, Mycobacterium tuberculosis H37Rv
ggguagauguucacgccgccg

SEQ ID NO: 3347977 - RNA, 14 nt, Mycobacterium tuberculosis H37Rv
ggguagccaaccug

SEQ ID NO: 3347978 - RNA, 16 nt, Mycobacterium tuberculosis H37Rv
ggguagccgcccagcg

SEQ ID NO: 3347979 - RNA, 13 nt, Mycobacterium tuberculosis H37Rv
ggguagccgucga

SEQ ID NO: 3347980 - RNA, 19 nt, Mycobacterium tuberculosis H37Rv
ggguagcgcgagcagacgu

SEQ ID NO: 3347981 - RNA, 18 nt, Mycobacterium tuberculosis H37Rv
ggguagcguucaaggucu

SEQ ID NO: 3347982 - RNA, 13 nt, Mycobacterium tuberculosis H37Rv
ggguaggcuccca

SEQ ID NO: 3347983 - RNA, 15 nt, Mycobacterium tuberculosis H37Rv
ggguaguucaccgcg

SEQ ID NO: 3347984 - RNA, 18 nt, Mycobacterium tuberculosis H37Rv
ggguaucaaccggccggu

SEQ ID NO: 3347985 - RNA, 19 nt, Mycobacterium tuberculosis H37Rv
ggguaucgacccuccagca

SEQ ID NO: 3347986 - RNA, 22 nt, Mycobacterium tuberculosis H37Rv
ggguaucgacccuccagcacgc

SEQ ID NO: 3347987 - RNA, 14 nt, Mycobacterium tuberculosis H37Rv
ggguauggcggcga

SEQ ID NO: 3347988 - RNA, 12 nt, Mycobacterium tuberculosis H37Rv
gggucaaccggu

SEQ ID NO: 3347989 - RNA, 20 nt, Mycobacterium tuberculosis H37Rv
gggucaaugcuggcagcggc

SEQ ID NO: 3347990 - RNA, 19 nt, Mycobacterium tuberculosis H37Rv
gggucacaaacccagcauc

SEQ ID NO: 3347991 - RNA, 14 nt, Mycobacterium tuberculosis H37Rv
gggucaccagcgca

SEQ ID NO: 3347992 - RNA, 16 nt, Mycobacterium tuberculosis H37Rv
gggucagcccagccaa

SEQ ID NO: 3347993 - RNA, 12 nt, Mycobacterium tuberculosis H37Rv
gggucagcgccg

SEQ ID NO: 3347994 - RNA, 14 nt, Mycobacterium tuberculosis H37Rv
gggucagcucggug

SEQ ID NO: 3347995 - RNA, 15 nt, Mycobacterium tuberculosis H37Rv
gggucagcucgguga

SEQ ID NO: 3347996 - RNA, 17 nt, Mycobacterium tuberculosis H37Rv
gggucagcugggacccg

SEQ ID NO: 3347997 - RNA, 19 nt, Mycobacterium tuberculosis H37Rv
gggucagcugggacccgag

SEQ ID NO: 3347998 - RNA, 21 nt, Mycobacterium tuberculosis H37Rv
gggucagcugggacccgagca

SEQ ID NO: 3347999 - RNA, 13 nt, Mycobacterium tuberculosis H37Rv
gggucaggccagg

SEQ ID NO: 3348000 - RNA, 15 nt, Mycobacterium tuberculosis H37Rv
gggucaggccagggu

SEQ ID NO: 3348001 - RNA, 20 nt, Mycobacterium tuberculosis H37Rv
gggucagguugucggcgauc

SEQ ID NO: 3348002 - RNA, 13 nt, Mycobacterium tuberculosis H37Rv
gggucaucgccag

SEQ ID NO: 3348003 - RNA, 18 nt, Mycobacterium tuberculosis H37Rv
ggguccaacccgcgauuc

SEQ ID NO: 3348004 - RNA, 17 nt, Mycobacterium tuberculosis H37Rv
ggguccagcgucccgau

SEQ ID NO: 3348005 - RNA, 22 nt, Mycobacterium tuberculosis H37Rv
gggucccaaucgucggccagca

SEQ ID NO: 3348006 - RNA, 20 nt, Mycobacterium tuberculosis H37Rv
ggguccccguaaauaucggg

SEQ ID NO: 3348007 - RNA, 13 nt, Mycobacterium tuberculosis H37Rv
gggucccggccgg

SEQ ID NO: 3348008 - RNA, 22 nt, Mycobacterium tuberculosis H37Rv
gggucccggccgggucuuccgg

SEQ ID NO: 3348009 - RNA, 17 nt, Mycobacterium tuberculosis H37Rv
ggguccgacagccccgg

SEQ ID NO: 3348010 - RNA, 16 nt, Mycobacterium tuberculosis H37Rv
ggguccgccgggcccc

SEQ ID NO: 3348011 - RNA, 13 nt, Mycobacterium tuberculosis H37Rv
ggguccgggccaa

SEQ ID NO: 3348012 - RNA, 19 nt, Mycobacterium tuberculosis H37Rv
ggguccucgagcggcagau

SEQ ID NO: 3348013 - RNA, 22 nt, Mycobacterium tuberculosis H37Rv
gggucgaacaggccggccgcga

SEQ ID NO: 3348014 - RNA, 16 nt, Mycobacterium tuberculosis H37Rv
gggucgaccccggcca

SEQ ID NO: 3348015 - RNA, 17 nt, Mycobacterium tuberculosis H37Rv
gggucgaccccggccag

SEQ ID NO: 3348016 - RNA, 21 nt, Mycobacterium tuberculosis H37Rv
gggucgacgagauccagcgcc

SEQ ID NO: 3348017 - RNA, 18 nt, Mycobacterium tuberculosis H37Rv
gggucgaucaccgacacc

SEQ ID NO: 3348018 - RNA, 15 nt, Mycobacterium tuberculosis H37Rv
gggucgaugucggca

SEQ ID NO: 3348019 - RNA, 12 nt, Mycobacterium tuberculosis H37Rv
gggucgcaaccg

SEQ ID NO: 3348020 - RNA, 15 nt, Mycobacterium tuberculosis H37Rv
gggucgcgagcccgc

SEQ ID NO: 3348021 - RNA, 16 nt, Mycobacterium tuberculosis H37Rv
gggucgcgagcccgcc

SEQ ID NO: 3348022 - RNA, 21 nt, Mycobacterium tuberculosis H37Rv
gggucgcgggguaggcccagc

SEQ ID NO: 3348023 - RNA, 15 nt, Mycobacterium tuberculosis H37Rv
gggucggcacgaccc

SEQ ID NO: 3348024 - RNA, 15 nt, Mycobacterium tuberculosis H37Rv
gggucggcccgccaa

SEQ ID NO: 3348025 - RNA, 18 nt, Mycobacterium tuberculosis H37Rv
gggucggccugcggcacc

SEQ ID NO: 3348026 - RNA, 23 nt, Mycobacterium tuberculosis H37Rv
gggucggcgauggcggcaucgau

SEQ ID NO: 3348027 - RNA, 18 nt, Mycobacterium tuberculosis H37Rv
gggucgggacgcugccgg

SEQ ID NO: 3348028 - RNA, 15 nt, Mycobacterium tuberculosis H37Rv
gggucgggcaccgcg

SEQ ID NO: 3348029 - RNA, 20 nt, Mycobacterium tuberculosis H37Rv
gggucggggaagacgaccgu

SEQ ID NO: 3348030 - RNA, 19 nt, Mycobacterium tuberculosis H37Rv
gggucgggucccagccugg

SEQ ID NO: 3348031 - RNA, 14 nt, Mycobacterium tuberculosis H37Rv
gggucggucaaugc

SEQ ID NO: 3348032 - RNA, 21 nt, Mycobacterium tuberculosis H37Rv
gggucggucacgacggcacgc

SEQ ID NO: 3348033 - RNA, 22 nt, Mycobacterium tuberculosis H37Rv
gggucgguuuccuccggcagca

SEQ ID NO: 3348034 - RNA, 19 nt, Mycobacterium tuberculosis H37Rv
gggucguccgccugcaccg

SEQ ID NO: 3348035 - RNA, 13 nt, Mycobacterium tuberculosis H37Rv
gggucgugccagc

SEQ ID NO: 3348036 - RNA, 20 nt, Mycobacterium tuberculosis H37Rv
gggucgugccccggcgcggu

SEQ ID NO: 3348037 - RNA, 12 nt, Mycobacterium tuberculosis H37Rv
gggucgugcgac

SEQ ID NO: 3348038 - RNA, 18 nt, Mycobacterium tuberculosis H37Rv
gggucguugaggccggug

SEQ ID NO: 3348039 - RNA, 21 nt, Mycobacterium tuberculosis H37Rv
gggucugcgccgccggcggcg

SEQ ID NO: 3348040 - RNA, 12 nt, Mycobacterium tuberculosis H37Rv
gggucugcucau

SEQ ID NO: 3348041 - RNA, 14 nt, Mycobacterium tuberculosis H37Rv
gggucuugacggcg

SEQ ID NO: 3348042 - RNA, 15 nt, Mycobacterium tuberculosis H37Rv
gggucuugccgagca

SEQ ID NO: 3348043 - RNA, 15 nt, Mycobacterium tuberculosis H37Rv
gggucuuugcccgcc

SEQ ID NO: 3348044 - RNA, 13 nt, Mycobacterium tuberculosis H37Rv
gggugaaccaauu

SEQ ID NO: 3348045 - RNA, 20 nt, Mycobacterium tuberculosis H37Rv
gggugaacgcggacaccgcg

SEQ ID NO: 3348046 - RNA, 18 nt, Mycobacterium tuberculosis H37Rv
gggugaccaacacccccc

SEQ ID NO: 3348047 - RNA, 12 nt, Mycobacterium tuberculosis H37Rv
gggugacccgcu

SEQ ID NO: 3348048 - RNA, 15 nt, Mycobacterium tuberculosis H37Rv
gggugagccgagcca

SEQ ID NO: 3348049 - RNA, 13 nt, Mycobacterium tuberculosis H37Rv
gggugagcgaccu

SEQ ID NO: 3348050 - RNA, 17 nt, Mycobacterium tuberculosis H37Rv
gggugagugaccacgcu

SEQ ID NO: 3348051 - RNA, 22 nt, Mycobacterium tuberculosis H37Rv
gggugauagaggauaucgccga

SEQ ID NO: 3348052 - RNA, 22 nt, Mycobacterium tuberculosis H37Rv
gggugaucugggcggugaaggc

SEQ ID NO: 3348053 - RNA, 17 nt, Mycobacterium tuberculosis H37Rv
gggugcagaucgcccca

SEQ ID NO: 3348054 - RNA, 18 nt, Mycobacterium tuberculosis H37Rv
gggugcagaucgccccag

SEQ ID NO: 3348055 - RNA, 13 nt, Mycobacterium tuberculosis H37Rv
gggugcagugacc

SEQ ID NO: 3348056 - RNA, 23 nt, Mycobacterium tuberculosis H37Rv
gggugccagcccguugcaggacg

SEQ ID NO: 3348057 - RNA, 18 nt, Mycobacterium tuberculosis H37Rv
gggugcccggcggccaac

SEQ ID NO: 3348058 - RNA, 22 nt, Mycobacterium tuberculosis H37Rv
gggugccgcgccguagagccgc

SEQ ID NO: 3348059 - RNA, 15 nt, Mycobacterium tuberculosis H37Rv
gggugccggcgccgc

SEQ ID NO: 3348060 - RNA, 15 nt, Mycobacterium tuberculosis H37Rv
gggugccgucgggua

SEQ ID NO: 3348061 - RNA, 20 nt, Mycobacterium tuberculosis H37Rv
gggugccguugcgucugcuc

SEQ ID NO: 3348062 - RNA, 12 nt, Mycobacterium tuberculosis H37Rv
gggugcgagcga

SEQ ID NO: 3348063 - RNA, 14 nt, Mycobacterium tuberculosis H37Rv
gggugcgagcgaca

SEQ ID NO: 3348064 - RNA, 20 nt, Mycobacterium tuberculosis H37Rv
gggugcgccauucgcccggc

SEQ ID NO: 3348065 - RNA, 22 nt, Mycobacterium tuberculosis H37Rv
gggugcgcccggccaagccggc

SEQ ID NO: 3348066 - RNA, 15 nt, Mycobacterium tuberculosis H37Rv
gggugcgccgcagca

SEQ ID NO: 3348067 - RNA, 21 nt, Mycobacterium tuberculosis H37Rv
gggugcgccgucagcccaggu

SEQ ID NO: 3348068 - RNA, 22 nt, Mycobacterium tuberculosis H37Rv
gggugcgcgcgaccauacccgc

SEQ ID NO: 3348069 - RNA, 13 nt, Mycobacterium tuberculosis H37Rv
gggugcgcugcag

SEQ ID NO: 3348070 - RNA, 15 nt, Mycobacterium tuberculosis H37Rv
gggugcgcugcagcg

SEQ ID NO: 3348071 - RNA, 16 nt, Mycobacterium tuberculosis H37Rv
gggugcgggucggcgc

SEQ ID NO: 3348072 - RNA, 19 nt, Mycobacterium tuberculosis H37Rv
gggugcugaugggucaggc

SEQ ID NO: 3348073 - RNA, 16 nt, Mycobacterium tuberculosis H37Rv
gguagccgucgauccc

SEQ ID NO: 3348074 - RNA, 14 nt, Mycobacterium tuberculosis H37Rv
gguagccugaccag

SEQ ID NO: 3348075 - RNA, 13 nt, Mycobacterium tuberculosis H37Rv
gguagcgacgaug

SEQ ID NO: 3348076 - RNA, 16 nt, Mycobacterium tuberculosis H37Rv
gguagcgaucgugcug

SEQ ID NO: 3348077 - RNA, 15 nt, Mycobacterium tuberculosis H37Rv
gguagcgcggguggc

SEQ ID NO: 3348078 - RNA, 21 nt, Mycobacterium tuberculosis H37Rv
gguagcgcucgaucagguugg

SEQ ID NO: 3348079 - RNA, 15 nt, Mycobacterium tuberculosis H37Rv
gguagcggaccugcg

SEQ ID NO: 3348080 - RNA, 12 nt, Mycobacterium tuberculosis H37Rv
gguagcggcgcc

SEQ ID NO: 3348081 - RNA, 16 nt, Mycobacterium tuberculosis H37Rv
gguagcggcgccgccc

SEQ ID NO: 3348082 - RNA, 21 nt, Mycobacterium tuberculosis H37Rv
gguagcguccaggucaugccg

SEQ ID NO: 3348083 - RNA, 21 nt, Mycobacterium tuberculosis H37Rv
gguagcguucaaggucuccag

SEQ ID NO: 3348084 - RNA, 23 nt, Mycobacterium tuberculosis H37Rv
gguagcugugguggugaugggca

SEQ ID NO: 3348085 - RNA, 20 nt, Mycobacterium tuberculosis H37Rv
gguaggaacuacccgccagc

SEQ ID NO: 3348086 - RNA, 15 nt, Mycobacterium tuberculosis H37Rv
gguaggagaucaccu

SEQ ID NO: 3348087 - RNA, 16 nt, Mycobacterium tuberculosis H37Rv
gguaggagcggguggc

SEQ ID NO: 3348088 - RNA, 13 nt, Mycobacterium tuberculosis H37Rv
gguaggccggcaa

SEQ ID NO: 3348089 - RNA, 12 nt, Mycobacterium tuberculosis H37Rv
gguaggcggcca

SEQ ID NO: 3348090 - RNA, 13 nt, Mycobacterium tuberculosis H37Rv
gguaggcgguguc

SEQ ID NO: 3348091 - RNA, 17 nt, Mycobacterium tuberculosis H37Rv
gguaggucaccaggcug

SEQ ID NO: 3348092 - RNA, 16 nt, Mycobacterium tuberculosis H37Rv
gguaggucaccgguca

SEQ ID NO: 3348093 - RNA, 16 nt, Mycobacterium tuberculosis H37Rv
gguaggugacgacguc

SEQ ID NO: 3348094 - RNA, 20 nt, Mycobacterium tuberculosis H37Rv
gguagguucgacggacaccc

SEQ ID NO: 3348095 - RNA, 13 nt, Mycobacterium tuberculosis H37Rv
gguaguagcugac

SEQ ID NO: 3348096 - RNA, 14 nt, Mycobacterium tuberculosis H37Rv
gguagucgcccgug

SEQ ID NO: 3348097 - RNA, 12 nt, Mycobacterium tuberculosis H37Rv
gguagucgccgu

SEQ ID NO: 3348098 - RNA, 17 nt, Mycobacterium tuberculosis H37Rv
gguagucgccgucgggu

SEQ ID NO: 3348099 - RNA, 14 nt, Mycobacterium tuberculosis H37Rv
gguagucgcgguag

SEQ ID NO: 3348100 - RNA, 21 nt, Mycobacterium tuberculosis H37Rv
gguaguucuuggucaggcugg

SEQ ID NO: 3348101 - RNA, 20 nt, Mycobacterium tuberculosis H37Rv
gguaucaaccggccggugau

SEQ ID NO: 3348102 - RNA, 18 nt, Mycobacterium tuberculosis H37Rv
gguaucgacccuccagca

SEQ ID NO: 3348103 - RNA, 22 nt, Mycobacterium tuberculosis H37Rv
gguaucgacccuccagcacgcc

SEQ ID NO: 3348104 - RNA, 17 nt, Mycobacterium tuberculosis H37Rv
gguaucgagggcagccg

SEQ ID NO: 3348105 - RNA, 19 nt, Mycobacterium tuberculosis H37Rv
gguaucgagggcagccgcc

SEQ ID NO: 3348106 - RNA, 17 nt, Mycobacterium tuberculosis H37Rv
gguaucgucccggcgac

SEQ ID NO: 3348107 - RNA, 19 nt, Mycobacterium tuberculosis H37Rv
gguaugagcuuccgcgcgc

SEQ ID NO: 3348108 - RNA, 13 nt, Mycobacterium tuberculosis H37Rv
gguauggcggcga

SEQ ID NO: 3348109 - RNA, 20 nt, Mycobacterium tuberculosis H37Rv
gguauucguggucggccucg

SEQ ID NO: 3348110 - RNA, 14 nt, Mycobacterium tuberculosis H37Rv
ggucaacagcggca

SEQ ID NO: 3348111 - RNA, 15 nt, Mycobacterium tuberculosis H37Rv
ggucaaccgcgucga

SEQ ID NO: 3348112 - RNA, 13 nt, Mycobacterium tuberculosis H37Rv
ggucaacggccga

SEQ ID NO: 3348113 - RNA, 14 nt, Mycobacterium tuberculosis H37Rv
ggucaagacccgca

SEQ ID NO: 3348114 - RNA, 20 nt, Mycobacterium tuberculosis H37Rv
ggucaaugcuggcagcggcc

SEQ ID NO: 3348115 - RNA, 17 nt, Mycobacterium tuberculosis H37Rv
ggucaauugugcggccc

SEQ ID NO: 3348116 - RNA, 13 nt, Mycobacterium tuberculosis H37Rv
ggucaccagcugg

SEQ ID NO: 3348117 - RNA, 20 nt, Mycobacterium tuberculosis H37Rv
ggucacccccggccagcguc

SEQ ID NO: 3348118 - RNA, 18 nt, Mycobacterium tuberculosis H37Rv
ggucaccgaacgacccug

SEQ ID NO: 3348119 - RNA, 19 nt, Mycobacterium tuberculosis H37Rv
ggucaccgcgcagcgaauc

SEQ ID NO: 3348120 - RNA, 19 nt, Mycobacterium tuberculosis H37Rv
ggucaccggacuggugguc

SEQ ID NO: 3348121 - RNA, 20 nt, Mycobacterium tuberculosis H37Rv
ggucaccggcgaccggugcc

SEQ ID NO: 3348122 - RNA, 22 nt, Mycobacterium tuberculosis H37Rv
ggucaccggcuucuccuccaga

SEQ ID NO: 3348123 - RNA, 16 nt, Mycobacterium tuberculosis H37Rv
ggucaccggucaccgc

SEQ ID NO: 3348124 - RNA, 20 nt, Mycobacterium tuberculosis H37Rv
ggucaccgucgagucgacgg

SEQ ID NO: 3348125 - RNA, 12 nt, Mycobacterium tuberculosis H37Rv
ggucaccugcgg

SEQ ID NO: 3348126 - RNA, 12 nt, Mycobacterium tuberculosis H37Rv
ggucaccuucuu

SEQ ID NO: 3348127 - RNA, 16 nt, Mycobacterium tuberculosis H37Rv
ggucacgcagcacccu

SEQ ID NO: 3348128 - RNA, 19 nt, Mycobacterium tuberculosis H37Rv
ggucacgcagucgggcagc

SEQ ID NO: 3348129 - RNA, 23 nt, Mycobacterium tuberculosis H37Rv
ggucacgcagucgggcagcgcuc

SEQ ID NO: 3348130 - RNA, 15 nt, Mycobacterium tuberculosis H37Rv
ggucacgccgucacc

SEQ ID NO: 3348131 - RNA, 17 nt, Mycobacterium tuberculosis H37Rv
ggucacgccgucaccgc

SEQ ID NO: 3348132 - RNA, 22 nt, Mycobacterium tuberculosis H37Rv
ggucacgcgacuugcaccccgu

SEQ ID NO: 3348133 - RNA, 17 nt, Mycobacterium tuberculosis H37Rv
ggucacgguagcguucg

SEQ ID NO: 3348134 - RNA, 22 nt, Mycobacterium tuberculosis H37Rv
ggucacgguucgcccgucgcga

SEQ ID NO: 3348135 - RNA, 13 nt, Mycobacterium tuberculosis H37Rv
ggucacucuggcg

SEQ ID NO: 3348136 - RNA, 19 nt, Mycobacterium tuberculosis H37Rv
ggucacugguccaacgauc

SEQ ID NO: 3348137 - RNA, 15 nt, Mycobacterium tuberculosis H37Rv
ggucagacgccggcc

SEQ ID NO: 3348138 - RNA, 19 nt, Mycobacterium tuberculosis H37Rv
ggucagcaauacggcggcg

SEQ ID NO: 3348139 - RNA, 16 nt, Mycobacterium tuberculosis H37Rv
ggucagcaccaccagc

SEQ ID NO: 3348140 - RNA, 22 nt, Mycobacterium tuberculosis H37Rv
ggucagcacccaacccggcggc

SEQ ID NO: 3348141 - RNA, 23 nt, Mycobacterium tuberculosis H37Rv
ggucagcacccaacccggcggca

SEQ ID NO: 3348142 - RNA, 21 nt, Mycobacterium tuberculosis H37Rv
ggucagcacgcugaccacaac

SEQ ID NO: 3348143 - RNA, 21 nt, Mycobacterium tuberculosis H37Rv
ggucagccccaugaucuggug

SEQ ID NO: 3348144 - RNA, 18 nt, Mycobacterium tuberculosis H37Rv
ggucagcccggcgcgauc

SEQ ID NO: 3348145 - RNA, 14 nt, Mycobacterium tuberculosis H37Rv
ggucagccggccau

SEQ ID NO: 3348146 - RNA, 19 nt, Mycobacterium tuberculosis H37Rv
ggucagcgaccucacugcg

SEQ ID NO: 3348147 - RNA, 20 nt, Mycobacterium tuberculosis H37Rv
ggucagcgaccucacugcgg

SEQ ID NO: 3348148 - RNA, 21 nt, Mycobacterium tuberculosis H37Rv
ggucagcgccgacuccaguuc

SEQ ID NO: 3348149 - RNA, 16 nt, Mycobacterium tuberculosis H37Rv
ggucagcgccggccau

SEQ ID NO: 3348150 - RNA, 16 nt, Mycobacterium tuberculosis H37Rv
ggucagcgcggcgacc

SEQ ID NO: 3348151 - RNA, 21 nt, Mycobacterium tuberculosis H37Rv
ggucagcgcguauggcucacc

SEQ ID NO: 3348152 - RNA, 16 nt, Mycobacterium tuberculosis H37Rv
ggucagcgcugccacc

SEQ ID NO: 3348153 - RNA, 18 nt, Mycobacterium tuberculosis H37Rv
ggucagcgggcuugccgu

SEQ ID NO: 3348154 - RNA, 17 nt, Mycobacterium tuberculosis H37Rv
ggucagcgggucgaccc

SEQ ID NO: 3348155 - RNA, 14 nt, Mycobacterium tuberculosis H37Rv
ggucagcgugcagg

SEQ ID NO: 3348156 - RNA, 17 nt, Mycobacterium tuberculosis H37Rv
ggucagcgugcagguag

SEQ ID NO: 3348157 - RNA, 19 nt, Mycobacterium tuberculosis H37Rv
ggucagcgugccgguggcg

SEQ ID NO: 3348158 - RNA, 13 nt, Mycobacterium tuberculosis H37Rv
ggucagcucgcca

SEQ ID NO: 3348159 - RNA, 18 nt, Mycobacterium tuberculosis H37Rv
ggucagcucgucggcgau

SEQ ID NO: 3348160 - RNA, 21 nt, Mycobacterium tuberculosis H37Rv
ggucagcugacgggccgcugu

SEQ ID NO: 3348161 - RNA, 13 nt, Mycobacterium tuberculosis H37Rv
ggucagcugcugc

SEQ ID NO: 3348162 - RNA, 19 nt, Mycobacterium tuberculosis H37Rv
ggucagcugggacccgagc

SEQ ID NO: 3348163 - RNA, 22 nt, Mycobacterium tuberculosis H37Rv
ggucaggcggccgucgucggcc

SEQ ID NO: 3348164 - RNA, 13 nt, Mycobacterium tuberculosis H37Rv
ggucagggugggc

SEQ ID NO: 3348165 - RNA, 15 nt, Mycobacterium tuberculosis H37Rv
ggucagguccugggu

SEQ ID NO: 3348166 - RNA, 14 nt, Mycobacterium tuberculosis H37Rv
ggucaggucgaggu

SEQ ID NO: 3348167 - RNA, 20 nt, Mycobacterium tuberculosis H37Rv
ggucaggucgagguccucgg

SEQ ID NO: 3348168 - RNA, 18 nt, Mycobacterium tuberculosis H37Rv
ggucagguugucggcgau

SEQ ID NO: 3348169 - RNA, 19 nt, Mycobacterium tuberculosis H37Rv
ggucgacccaacgcagauc

SEQ ID NO: 3348170 - RNA, 14 nt, Mycobacterium tuberculosis H37Rv
ggucgacccggcca

SEQ ID NO: 3348171 - RNA, 18 nt, Mycobacterium tuberculosis H37Rv
ggucgacgaacaccccgg

SEQ ID NO: 3348172 - RNA, 15 nt, Mycobacterium tuberculosis H37Rv
ggucgacggccacgg

SEQ ID NO: 3348173 - RNA, 20 nt, Mycobacterium tuberculosis H37Rv
ggucgacggggcggucggcc

SEQ ID NO: 3348174 - RNA, 22 nt, Mycobacterium tuberculosis H37Rv
ggucgacggguucuuuaccgau

SEQ ID NO: 3348175 - RNA, 17 nt, Mycobacterium tuberculosis H37Rv
ggucgacugggacgacg

SEQ ID NO: 3348176 - RNA, 22 nt, Mycobacterium tuberculosis H37Rv
ggucgagcacgcugcugcgggu

SEQ ID NO: 3348177 - RNA, 18 nt, Mycobacterium tuberculosis H37Rv
ggucgagcaggcgaguga

SEQ ID NO: 3348178 - RNA, 22 nt, Mycobacterium tuberculosis H37Rv
ggucgagcagugccucggcgau

SEQ ID NO: 3348179 - RNA, 21 nt, Mycobacterium tuberculosis H37Rv
ggucgagcgcuucgucgccga

SEQ ID NO: 3348180 - RNA, 14 nt, Mycobacterium tuberculosis H37Rv
ggucgagggcggcg

SEQ ID NO: 3348181 - RNA, 17 nt, Mycobacterium tuberculosis H37Rv
ggucgaggucggcgauc

SEQ ID NO: 3348182 - RNA, 13 nt, Mycobacterium tuberculosis H37Rv
ggucgaggugacu

SEQ ID NO: 3348183 - RNA, 16 nt, Mycobacterium tuberculosis H37Rv
ggucgaguugaagaau

SEQ ID NO: 3348184 - RNA, 21 nt, Mycobacterium tuberculosis H37Rv
ggucgaucaggggcccacccg

SEQ ID NO: 3348185 - RNA, 20 nt, Mycobacterium tuberculosis H37Rv
ggucgaucaugacgagccga

SEQ ID NO: 3348186 - RNA, 17 nt, Mycobacterium tuberculosis H37Rv
ggucgaucauggcggca

SEQ ID NO: 3348187 - RNA, 20 nt, Mycobacterium tuberculosis H37Rv
ggucgauccacucggcgauc

SEQ ID NO: 3348188 - RNA, 12 nt, Mycobacterium tuberculosis H37Rv
ggucgauccggu

SEQ ID NO: 3348189 - RNA, 18 nt, Mycobacterium tuberculosis H37Rv
ggucgauccggugccgaa

SEQ ID NO: 3348190 - RNA, 17 nt, Mycobacterium tuberculosis H37Rv
ggucgaugaccucguca

SEQ ID NO: 3348191 - RNA, 14 nt, Mycobacterium tuberculosis H37Rv
ggucgaugccgaug

SEQ ID NO: 3348192 - RNA, 16 nt, Mycobacterium tuberculosis H37Rv
ggucgaugcugccagc

SEQ ID NO: 3348193 - RNA, 17 nt, Mycobacterium tuberculosis H37Rv
ggucgaugucgucgaca

SEQ ID NO: 3348194 - RNA, 17 nt, Mycobacterium tuberculosis H37Rv
ggucgcaauauccggcc

SEQ ID NO: 3348195 - RNA, 22 nt, Mycobacterium tuberculosis H37Rv
ggucgcaauauccggccgagcc

SEQ ID NO: 3348196 - RNA, 15 nt, Mycobacterium tuberculosis H37Rv
ggucgcacccugcgc

SEQ ID NO: 3348197 - RNA, 14 nt, Mycobacterium tuberculosis H37Rv
ggucgcaccgccgg

SEQ ID NO: 3348198 - RNA, 15 nt, Mycobacterium tuberculosis H37Rv
ggucgcagaccagac

SEQ ID NO: 3348199 - RNA, 16 nt, Mycobacterium tuberculosis H37Rv
ggucgcagcagaccac

SEQ ID NO: 3348200 - RNA, 14 nt, Mycobacterium tuberculosis H37Rv
ggucgcauggucga

SEQ ID NO: 3348201 - RNA, 17 nt, Mycobacterium tuberculosis H37Rv
ggucgcauggucgacga

SEQ ID NO: 3348202 - RNA, 19 nt, Mycobacterium tuberculosis H37Rv
ggucgcauggucgacgaac

SEQ ID NO: 3348203 - RNA, 16 nt, Mycobacterium tuberculosis H37Rv
ggucgcauucugcugc

SEQ ID NO: 3348204 - RNA, 20 nt, Mycobacterium tuberculosis H37Rv
ggucgcauucugcugccagc

SEQ ID NO: 3348205 - RNA, 15 nt, Mycobacterium tuberculosis H37Rv
ggucgccaacgccag

SEQ ID NO: 3348206 - RNA, 19 nt, Mycobacterium tuberculosis H37Rv
ggucgccaacgccagcacc

SEQ ID NO: 3348207 - RNA, 17 nt, Mycobacterium tuberculosis H37Rv
ggucgccaagugcaggg

SEQ ID NO: 3348208 - RNA, 19 nt, Mycobacterium tuberculosis H37Rv
ggucgccaccgccggcagc

SEQ ID NO: 3348209 - RNA, 20 nt, Mycobacterium tuberculosis H37Rv
ggucgccaccgccggcagca

SEQ ID NO: 3348210 - RNA, 20 nt, Mycobacterium tuberculosis H37Rv
ggucgccaccuucgacgaug

SEQ ID NO: 3348211 - RNA, 20 nt, Mycobacterium tuberculosis H37Rv
ggucgccaugucggccaggu

SEQ ID NO: 3348212 - RNA, 22 nt, Mycobacterium tuberculosis H37Rv
ggucgccauguugaagcgaagc

SEQ ID NO: 3348213 - RNA, 19 nt, Mycobacterium tuberculosis H37Rv
ggucgcccaacaccgcgcc

SEQ ID NO: 3348214 - RNA, 13 nt, Mycobacterium tuberculosis H37Rv
ggucgcccaggcc

SEQ ID NO: 3348215 - RNA, 17 nt, Mycobacterium tuberculosis H37Rv
ggucgccccgaugaccg

SEQ ID NO: 3348216 - RNA, 20 nt, Mycobacterium tuberculosis H37Rv
ggucgcccgaucggcggauc

SEQ ID NO: 3348217 - RNA, 19 nt, Mycobacterium tuberculosis H37Rv
ggucgccgccaucagcccu

SEQ ID NO: 3348218 - RNA, 16 nt, Mycobacterium tuberculosis H37Rv
ggucgccggacugcgg

SEQ ID NO: 3348219 - RNA, 18 nt, Mycobacterium tuberculosis H37Rv
ggucgccggacugcggcc

SEQ ID NO: 3348220 - RNA, 14 nt, Mycobacterium tuberculosis H37Rv
ggucgccggcaccg

SEQ ID NO: 3348221 - RNA, 19 nt, Mycobacterium tuberculosis H37Rv
ggucgccggucaucgccga

SEQ ID NO: 3348222 - RNA, 21 nt, Mycobacterium tuberculosis H37Rv
ggucgccucgcuaacucccca

SEQ ID NO: 3348223 - RNA, 19 nt, Mycobacterium tuberculosis H37Rv
ggucgcgacuaccaucgcc

SEQ ID NO: 3348224 - RNA, 19 nt, Mycobacterium tuberculosis H37Rv
ggucgcgagcccgccacag

SEQ ID NO: 3348225 - RNA, 18 nt, Mycobacterium tuberculosis H37Rv
ggucgcgcagcuccaccg

SEQ ID NO: 3348226 - RNA, 15 nt, Mycobacterium tuberculosis H37Rv
ggucgcgcggcaccg

SEQ ID NO: 3348227 - RNA, 17 nt, Mycobacterium tuberculosis H37Rv
ggucgcgcggcaccgau

SEQ ID NO: 3348228 - RNA, 14 nt, Mycobacterium tuberculosis H37Rv
ggucgcgcugaagg

SEQ ID NO: 3348229 - RNA, 20 nt, Mycobacterium tuberculosis H37Rv
ggucgcggagaacgcgucgc

SEQ ID NO: 3348230 - RNA, 18 nt, Mycobacterium tuberculosis H37Rv
ggucgcggaucucaucgg

SEQ ID NO: 3348231 - RNA, 13 nt, Mycobacterium tuberculosis H37Rv
ggucgcggcugcc

SEQ ID NO: 3348232 - RNA, 18 nt, Mycobacterium tuberculosis H37Rv
ggucgcgguggcggcggu

SEQ ID NO: 3348233 - RNA, 16 nt, Mycobacterium tuberculosis H37Rv
ggucgcgucggcugcc

SEQ ID NO: 3348234 - RNA, 14 nt, Mycobacterium tuberculosis H37Rv
ggucgcucgacgac

SEQ ID NO: 3348235 - RNA, 20 nt, Mycobacterium tuberculosis H37Rv
ggucgcugauccgggcgccg

SEQ ID NO: 3348236 - RNA, 22 nt, Mycobacterium tuberculosis H37Rv
ggucgcugauccgggcgccgau

SEQ ID NO: 3348237 - RNA, 13 nt, Mycobacterium tuberculosis H37Rv
ggucgcugcgaug

SEQ ID NO: 3348238 - RNA, 20 nt, Mycobacterium tuberculosis H37Rv
ggucgcugcugcgaucgccg

SEQ ID NO: 3348239 - RNA, 22 nt, Mycobacterium tuberculosis H37Rv
ggucgcugcugcgaucgccgcg

SEQ ID NO: 3348240 - RNA, 21 nt, Mycobacterium tuberculosis H37Rv
ggucgcugcuugcgggcucgu

SEQ ID NO: 3348241 - RNA, 17 nt, Mycobacterium tuberculosis H37Rv
ggucgcugugcagcggg

SEQ ID NO: 3348242 - RNA, 16 nt, Mycobacterium tuberculosis H37Rv
ggucgcuugcugucgu

SEQ ID NO: 3348243 - RNA, 19 nt, Mycobacterium tuberculosis H37Rv
ggucggaccacccggcgcg

SEQ ID NO: 3348244 - RNA, 16 nt, Mycobacterium tuberculosis H37Rv
ggucggcaccaccacg

SEQ ID NO: 3348245 - RNA, 21 nt, Mycobacterium tuberculosis H37Rv
ggucggcaccagguugccgag

SEQ ID NO: 3348246 - RNA, 17 nt, Mycobacterium tuberculosis H37Rv
ggucggcacgacccggg

SEQ ID NO: 3348247 - RNA, 13 nt, Mycobacterium tuberculosis H37Rv
ggucggcagcugg

SEQ ID NO: 3348248 - RNA, 14 nt, Mycobacterium tuberculosis H37Rv
ggucggcagcuggg

SEQ ID NO: 3348249 - RNA, 21 nt, Mycobacterium tuberculosis H37Rv
ggucggcagcuucucgccgac

SEQ ID NO: 3348250 - RNA, 23 nt, Mycobacterium tuberculosis H37Rv
ggucggcagcuucucgccgacga

SEQ ID NO: 3348251 - RNA, 11 nt, Mycobacterium tuberculosis H37Rv
ggucggccacc

SEQ ID NO: 3348252 - RNA, 18 nt, Mycobacterium tuberculosis H37Rv
ggucggccaggucgagca

SEQ ID NO: 3348253 - RNA, 21 nt, Mycobacterium tuberculosis H37Rv
ggucggccaggucgagcaccg

SEQ ID NO: 3348254 - RNA, 15 nt, Mycobacterium tuberculosis H37Rv
ggucggcccuccacc

SEQ ID NO: 3348255 - RNA, 15 nt, Mycobacterium tuberculosis H37Rv
ggucggccggcucgu

SEQ ID NO: 3348256 - RNA, 14 nt, Mycobacterium tuberculosis H37Rv
ggucggccucgaga

SEQ ID NO: 3348257 - RNA, 21 nt, Mycobacterium tuberculosis H37Rv
ggucggccucgagacggucga

SEQ ID NO: 3348258 - RNA, 13 nt, Mycobacterium tuberculosis H37Rv
ggucggccugcgg

SEQ ID NO: 3348259 - RNA, 18 nt, Mycobacterium tuberculosis H37Rv
ggucggccugcggcaccg

SEQ ID NO: 3348260 - RNA, 17 nt, Mycobacterium tuberculosis H37Rv
ggucggcgaacgcggcg

SEQ ID NO: 3348261 - RNA, 20 nt, Mycobacterium tuberculosis H37Rv
ggucggcgaccaccagcgcc

SEQ ID NO: 3348262 - RNA, 21 nt, Mycobacterium tuberculosis H37Rv
ggucggcgaugaugcucgaca

SEQ ID NO: 3348263 - RNA, 13 nt, Mycobacterium tuberculosis H37Rv
ggucggcgguagc

SEQ ID NO: 3348264 - RNA, 19 nt, Mycobacterium tuberculosis H37Rv
ggucggcgguucgaucccg

SEQ ID NO: 3348265 - RNA, 23 nt, Mycobacterium tuberculosis H37Rv
ggugacccgcuauucggcggcau

SEQ ID NO: 3348266 - RNA, 16 nt, Mycobacterium tuberculosis H37Rv
ggugacccgcugggcc

SEQ ID NO: 3348267 - RNA, 19 nt, Mycobacterium tuberculosis H37Rv
ggugacccgugcggccacg

SEQ ID NO: 3348268 - RNA, 16 nt, Mycobacterium tuberculosis H37Rv
ggugacccugguggug

SEQ ID NO: 3348269 - RNA, 19 nt, Mycobacterium tuberculosis H37Rv
ggugaccgacgcggacagg

SEQ ID NO: 3348270 - RNA, 12 nt, Mycobacterium tuberculosis H37Rv
ggugaccggguu

SEQ ID NO: 3348271 - RNA, 23 nt, Mycobacterium tuberculosis H37Rv
ggugaccgguguuccgcccagcg

SEQ ID NO: 3348272 - RNA, 15 nt, Mycobacterium tuberculosis H37Rv
ggugaccucaccaac

SEQ ID NO: 3348273 - RNA, 14 nt, Mycobacterium tuberculosis H37Rv
ggugaccucgucga

SEQ ID NO: 3348274 - RNA, 20 nt, Mycobacterium tuberculosis H37Rv
ggugaccucgucgaccggga

SEQ ID NO: 3348275 - RNA, 16 nt, Mycobacterium tuberculosis H37Rv
ggugaccuugaugcca

SEQ ID NO: 3348276 - RNA, 17 nt, Mycobacterium tuberculosis H37Rv
ggugacgauugccacca

SEQ ID NO: 3348277 - RNA, 16 nt, Mycobacterium tuberculosis H37Rv
ggugacgcaacaucgg

SEQ ID NO: 3348278 - RNA, 14 nt, Mycobacterium tuberculosis H37Rv
ggugacgcccgcuc

SEQ ID NO: 3348279 - RNA, 19 nt, Mycobacterium tuberculosis H37Rv
ggugacgcccgcuccgcgg

SEQ ID NO: 3348280 - RNA, 18 nt, Mycobacterium tuberculosis H37Rv
ggugacgccgccagcacc

SEQ ID NO: 3348281 - RNA, 19 nt, Mycobacterium tuberculosis H37Rv
ggugacgccgccagcaccu

SEQ ID NO: 3348282 - RNA, 17 nt, Mycobacterium tuberculosis H37Rv
ggugacgcgccguaaca

SEQ ID NO: 3348283 - RNA, 17 nt, Mycobacterium tuberculosis H37Rv
ggugacggaguuggccc

SEQ ID NO: 3348284 - RNA, 21 nt, Mycobacterium tuberculosis H37Rv
ggugacgggaucgucggcaac

SEQ ID NO: 3348285 - RNA, 18 nt, Mycobacterium tuberculosis H37Rv
ggugacgguggccggcaa

SEQ ID NO: 3348286 - RNA, 14 nt, Mycobacterium tuberculosis H37Rv
ggugacgucgccgg

SEQ ID NO: 3348287 - RNA, 13 nt, Mycobacterium tuberculosis H37Rv
ggugacuccggcu

SEQ ID NO: 3348288 - RNA, 20 nt, Mycobacterium tuberculosis H37Rv
ggugacugcgggccgcucgg

SEQ ID NO: 3348289 - RNA, 21 nt, Mycobacterium tuberculosis H37Rv
ggugacuucguggccuugaca

SEQ ID NO: 3348290 - RNA, 22 nt, Mycobacterium tuberculosis H37Rv
ggugagacaaaggugccgaccg

SEQ ID NO: 3348291 - RNA, 14 nt, Mycobacterium tuberculosis H37Rv
ggugagaccagguu

SEQ ID NO: 3348292 - RNA, 23 nt, Mycobacterium tuberculosis H37Rv
ggugagcaccugggcgcgcuggc

SEQ ID NO: 3348293 - RNA, 22 nt, Mycobacterium tuberculosis H37Rv
ggugagcagcucggugacaagc

SEQ ID NO: 3348294 - RNA, 17 nt, Mycobacterium tuberculosis H37Rv
ggugagcagggcggcga

SEQ ID NO: 3348295 - RNA, 21 nt, Mycobacterium tuberculosis H37Rv
ggugagccgccaggaccggga

SEQ ID NO: 3348296 - RNA, 15 nt, Mycobacterium tuberculosis H37Rv
ggugagccgguggcc

SEQ ID NO: 3348297 - RNA, 20 nt, Mycobacterium tuberculosis H37Rv
ggugagccgguggcccgccg

SEQ ID NO: 3348298 - RNA, 15 nt, Mycobacterium tuberculosis H37Rv
ggugagcgaccuggg

SEQ ID NO: 3348299 - RNA, 15 nt, Mycobacterium tuberculosis H37Rv
ggugagcgacgcuga

SEQ ID NO: 3348300 - RNA, 22 nt, Mycobacterium tuberculosis H37Rv
ggugagcugcacgccgauaccg

SEQ ID NO: 3348301 - RNA, 23 nt, Mycobacterium tuberculosis H37Rv
ggugagcuggucggcgagcgccc

SEQ ID NO: 3348302 - RNA, 19 nt, Mycobacterium tuberculosis H37Rv
ggugagcuuagcgcauggg

SEQ ID NO: 3348303 - RNA, 15 nt, Mycobacterium tuberculosis H37Rv
ggugaggaagcggcc

SEQ ID NO: 3348304 - RNA, 22 nt, Mycobacterium tuberculosis H37Rv
ggugagggguugcggucgacgu

SEQ ID NO: 3348305 - RNA, 20 nt, Mycobacterium tuberculosis H37Rv
ggugaggucgaucagcggcg

SEQ ID NO: 3348306 - RNA, 17 nt, Mycobacterium tuberculosis H37Rv
ggugaggugaccaacgg

SEQ ID NO: 3348307 - RNA, 21 nt, Mycobacterium tuberculosis H37Rv
ggugaguagauugcugacgag

SEQ ID NO: 3348308 - RNA, 17 nt, Mycobacterium tuberculosis H37Rv
ggugaguccgcugagcg

SEQ ID NO: 3348309 - RNA, 20 nt, Mycobacterium tuberculosis H37Rv
ggugaguccgcugagcgggc

SEQ ID NO: 3348310 - RNA, 13 nt, Mycobacterium tuberculosis H37Rv
ggugagugcgucu

SEQ ID NO: 3348311 - RNA, 22 nt, Mycobacterium tuberculosis H37Rv
ggugagugcgucucgguggcug

SEQ ID NO: 3348312 - RNA, 21 nt, Mycobacterium tuberculosis H37Rv
ggugauagaggauaucgccga

SEQ ID NO: 3348313 - RNA, 14 nt, Mycobacterium tuberculosis H37Rv
ggugaucagcagca

SEQ ID NO: 3348314 - RNA, 15 nt, Mycobacterium tuberculosis H37Rv
ggugaucagcagcag

SEQ ID NO: 3348315 - RNA, 15 nt, Mycobacterium tuberculosis H37Rv
ggugaucagcaggau

SEQ ID NO: 3348316 - RNA, 18 nt, Mycobacterium tuberculosis H37Rv
ggugaucgagguugacgu

SEQ ID NO: 3348317 - RNA, 22 nt, Mycobacterium tuberculosis H37Rv
ggugaucgauccggcuccaccc

SEQ ID NO: 3348318 - RNA, 21 nt, Mycobacterium tuberculosis H37Rv
ggugaucgcggucgacagcuu

SEQ ID NO: 3348319 - RNA, 14 nt, Mycobacterium tuberculosis H37Rv
ggugaugagucagg

SEQ ID NO: 3348320 - RNA, 20 nt, Mycobacterium tuberculosis H37Rv
ggugaugaucgcgccgggcu

SEQ ID NO: 3348321 - RNA, 18 nt, Mycobacterium tuberculosis H37Rv
ggugaugcaugcuaggca

SEQ ID NO: 3348322 - RNA, 16 nt, Mycobacterium tuberculosis H37Rv
ggugaugcccagcgcc

SEQ ID NO: 3348323 - RNA, 18 nt, Mycobacterium tuberculosis H37Rv
ggugaugcccagcgccga

SEQ ID NO: 3348324 - RNA, 17 nt, Mycobacterium tuberculosis H37Rv
ggugauggccgaccagc

SEQ ID NO: 3348325 - RNA, 15 nt, Mycobacterium tuberculosis H37Rv
ggugauggccgacgu

SEQ ID NO: 3348326 - RNA, 17 nt, Mycobacterium tuberculosis H37Rv
ggugauggcuuggacca

SEQ ID NO: 3348327 - RNA, 19 nt, Mycobacterium tuberculosis H37Rv
ggugaugggcaugguggug

SEQ ID NO: 3348328 - RNA, 21 nt, Mycobacterium tuberculosis H37Rv
ggugauggugugcagcagcau

SEQ ID NO: 3348329 - RNA, 16 nt, Mycobacterium tuberculosis H37Rv
ggugauguucagcgcc

SEQ ID NO: 3348330 - RNA, 18 nt, Mycobacterium tuberculosis H37Rv
ggugauugcggccgccga

SEQ ID NO: 3348331 - RNA, 20 nt, Mycobacterium tuberculosis H37Rv
ggugcaacacgccggcccgg

SEQ ID NO: 3348332 - RNA, 15 nt, Mycobacterium tuberculosis H37Rv
ggugcaacgcgccuu

SEQ ID NO: 3348333 - RNA, 14 nt, Mycobacterium tuberculosis H37Rv
ggugcacagcagug

SEQ ID NO: 3348334 - RNA, 15 nt, Mycobacterium tuberculosis H37Rv
ggugcaccgauucca

SEQ ID NO: 3348335 - RNA, 21 nt, Mycobacterium tuberculosis H37Rv
ggugcacgccuugagccgagg

SEQ ID NO: 3348336 - RNA, 19 nt, Mycobacterium tuberculosis H37Rv
ggugcagaucggcucaccg

SEQ ID NO: 3348337 - RNA, 15 nt, Mycobacterium tuberculosis H37Rv
ggugcagcaccagcc

SEQ ID NO: 3348338 - RNA, 16 nt, Mycobacterium tuberculosis H37Rv
ggugcagcacggcgcc

SEQ ID NO: 3348339 - RNA, 12 nt, Mycobacterium tuberculosis H37Rv
ggugcagcgacu

SEQ ID NO: 3348340 - RNA, 15 nt, Mycobacterium tuberculosis H37Rv
ggugcagcgacuccg

SEQ ID NO: 3348341 - RNA, 22 nt, Mycobacterium tuberculosis H37Rv
ggugcagcuccccgccggaacu

SEQ ID NO: 3348342 - RNA, 20 nt, Mycobacterium tuberculosis H37Rv
ggugcaggauucggcggucg

SEQ ID NO: 3348343 - RNA, 18 nt, Mycobacterium tuberculosis H37Rv
ggugcagggugagcacgu

SEQ ID NO: 3348344 - RNA, 11 nt, Mycobacterium tuberculosis H37Rv
ggugcagguga

SEQ ID NO: 3348345 - RNA, 16 nt, Mycobacterium tuberculosis H37Rv
ggugcaggugacgauc

SEQ ID NO: 3348346 - RNA, 12 nt, Mycobacterium tuberculosis H37Rv
ggugcaggugag

SEQ ID NO: 3348347 - RNA, 17 nt, Mycobacterium tuberculosis H37Rv
ggugcaggugagugcgg

SEQ ID NO: 3348348 - RNA, 17 nt, Mycobacterium tuberculosis H37Rv
ggugcaguacgcgcuga

SEQ ID NO: 3348349 - RNA, 22 nt, Mycobacterium tuberculosis H37Rv
ggugcagugaccucgucggcga

SEQ ID NO: 3348350 - RNA, 18 nt, Mycobacterium tuberculosis H37Rv
ggugcaucgccacagucg

SEQ ID NO: 3348351 - RNA, 20 nt, Mycobacterium tuberculosis H37Rv
ggugccacccuugccgccgg

SEQ ID NO: 3348352 - RNA, 18 nt, Mycobacterium tuberculosis H37Rv
ggugccacguucgcgggc

SEQ ID NO: 3348353 - RNA, 21 nt, Mycobacterium tuberculosis H37Rv
ggugccagaccagggcagcgg

SEQ ID NO: 3348354 - RNA, 16 nt, Mycobacterium tuberculosis H37Rv
ggugccagcaggccga

SEQ ID NO: 3348355 - RNA, 21 nt, Mycobacterium tuberculosis H37Rv
ggugccagccggauguugguc

SEQ ID NO: 3348356 - RNA, 17 nt, Mycobacterium tuberculosis H37Rv
ggugccagccggucgau

SEQ ID NO: 3348357 - RNA, 16 nt, Mycobacterium tuberculosis H37Rv
ggugccaucgggcgcg

SEQ ID NO: 3348358 - RNA, 22 nt, Mycobacterium tuberculosis H37Rv
ggugcccaagcaguccacgagc

SEQ ID NO: 3348359 - RNA, 23 nt, Mycobacterium tuberculosis H37Rv
ggugcccagcguggcuggcaccu

SEQ ID NO: 3348360 - RNA, 20 nt, Mycobacterium tuberculosis H37Rv
ggugcccccugguacaccag

SEQ ID NO: 3348361 - RNA, 16 nt, Mycobacterium tuberculosis H37Rv
ggugcugcgcgcggcg

SEQ ID NO: 3348362 - RNA, 15 nt, Mycobacterium tuberculosis H37Rv
ggugcuggucaacag

SEQ ID NO: 3348363 - RNA, 20 nt, Mycobacterium tuberculosis H37Rv
ggugcugguccaggcgguga

SEQ ID NO: 3348364 - RNA, 23 nt, Mycobacterium tuberculosis H37Rv
ggugcuguugcgcggucgcgcga

SEQ ID NO: 3348365 - RNA, 18 nt, Mycobacterium tuberculosis H37Rv
ggugcuuccucgcgagcu

SEQ ID NO: 3348366 - RNA, 22 nt, Mycobacterium tuberculosis H37Rv
ggugcuuccucgcgagcucccu

SEQ ID NO: 3348367 - RNA, 16 nt, Mycobacterium tuberculosis H37Rv
gguggaaaaagcccga

SEQ ID NO: 3348368 - RNA, 21 nt, Mycobacterium tuberculosis H37Rv
gguggaaacugaugucgccga

SEQ ID NO: 3348369 - RNA, 14 nt, Mycobacterium tuberculosis H37Rv
gguggaauccacca

SEQ ID NO: 3348370 - RNA, 17 nt, Mycobacterium tuberculosis H37Rv
gguggaauccaccagcc

SEQ ID NO: 3348371 - RNA, 16 nt, Mycobacterium tuberculosis H37Rv
gguggacaccugcugc

SEQ ID NO: 3348372 - RNA, 12 nt, Mycobacterium tuberculosis H37Rv
gguggacagcaa

SEQ ID NO: 3348373 - RNA, 14 nt, Mycobacterium tuberculosis H37Rv
gguggaccggccug

SEQ ID NO: 3348374 - RNA, 16 nt, Mycobacterium tuberculosis H37Rv
gguggaccggucgaca

SEQ ID NO: 3348375 - RNA, 21 nt, Mycobacterium tuberculosis H37Rv
gguggacgagccagaggugga

SEQ ID NO: 3348376 - RNA, 19 nt, Mycobacterium tuberculosis H37Rv
gguggacgcagagucaacg

SEQ ID NO: 3348377 - RNA, 16 nt, Mycobacterium tuberculosis H37Rv
gguggacggcaggcgg

SEQ ID NO: 3348378 - RNA, 18 nt, Mycobacterium tuberculosis H37Rv
gguggagccgaggugcug

SEQ ID NO: 3348379 - RNA, 16 nt, Mycobacterium tuberculosis H37Rv
gguggagcggcgcggg

SEQ ID NO: 3348380 - RNA, 23 nt, Mycobacterium tuberculosis H37Rv
gguggagcggcgcgggggugggc

SEQ ID NO: 3348381 - RNA, 17 nt, Mycobacterium tuberculosis H37Rv
gguggaguuggcugccg

SEQ ID NO: 3348382 - RNA, 23 nt, Mycobacterium tuberculosis H37Rv
gguggcaccauaauggucgucgc

SEQ ID NO: 3348383 - RNA, 15 nt, Mycobacterium tuberculosis H37Rv
gguggcacgcugagc

SEQ ID NO: 3348384 - RNA, 16 nt, Mycobacterium tuberculosis H37Rv
gguggcagccugcugc

SEQ ID NO: 3348385 - RNA, 14 nt, Mycobacterium tuberculosis H37Rv
gguggcagcgcggc

SEQ ID NO: 3348386 - RNA, 18 nt, Mycobacterium tuberculosis H37Rv
gguggcaucggcggccug

SEQ ID NO: 3348387 - RNA, 22 nt, Mycobacterium tuberculosis H37Rv
gguggcaucggcggccugcucg

SEQ ID NO: 3348388 - RNA, 21 nt, Mycobacterium tuberculosis H37Rv
gguggccagaucgaacgcagc

SEQ ID NO: 3348389 - RNA, 22 nt, Mycobacterium tuberculosis H37Rv
gguggccagaucgaacgcagcc

SEQ ID NO: 3348390 - RNA, 14 nt, Mycobacterium tuberculosis H37Rv
gguggccagcgcgg

SEQ ID NO: 3348391 - RNA, 17 nt, Mycobacterium tuberculosis H37Rv
gguggccagcgucgcga

SEQ ID NO: 3348392 - RNA, 23 nt, Mycobacterium tuberculosis H37Rv
gguggccaggccguaguggccgg

SEQ ID NO: 3348393 - RNA, 14 nt, Mycobacterium tuberculosis H37Rv
gguggccaucaccg

SEQ ID NO: 3348394 - RNA, 17 nt, Mycobacterium tuberculosis H37Rv
gguggccaugacggcuc

SEQ ID NO: 3348395 - RNA, 19 nt, Mycobacterium tuberculosis H37Rv
gguggcccgccggcaacau

SEQ ID NO: 3348396 - RNA, 16 nt, Mycobacterium tuberculosis H37Rv
gguggcccgggccacc

SEQ ID NO: 3348397 - RNA, 13 nt, Mycobacterium tuberculosis H37Rv
gguggcccgggga

SEQ ID NO: 3348398 - RNA, 15 nt, Mycobacterium tuberculosis H37Rv
gguggccgcggcggu

SEQ ID NO: 3348399 - RNA, 19 nt, Mycobacterium tuberculosis H37Rv
gguggccucauccaccgau

SEQ ID NO: 3348400 - RNA, 19 nt, Mycobacterium tuberculosis H37Rv
gguggcgagguggucacgc

SEQ ID NO: 3348401 - RNA, 15 nt, Mycobacterium tuberculosis H37Rv
gguggcgccggggcg

SEQ ID NO: 3348402 - RNA, 17 nt, Mycobacterium tuberculosis H37Rv
gguggcgccgucggccg

SEQ ID NO: 3348403 - RNA, 21 nt, Mycobacterium tuberculosis H37Rv
gguggcgccguugucggcggu

SEQ ID NO: 3348404 - RNA, 20 nt, Mycobacterium tuberculosis H37Rv
gguggcgcugaagccgacga

SEQ ID NO: 3348405 - RNA, 13 nt, Mycobacterium tuberculosis H37Rv
gguggcggccucc

SEQ ID NO: 3348406 - RNA, 20 nt, Mycobacterium tuberculosis H37Rv
gguggcggcgagcagcaggu

SEQ ID NO: 3348407 - RNA, 20 nt, Mycobacterium tuberculosis H37Rv
gguggcggcgcugcgcgauc

SEQ ID NO: 3348408 - RNA, 13 nt, Mycobacterium tuberculosis H37Rv
gguggcggcggcg

SEQ ID NO: 3348409 - RNA, 21 nt, Mycobacterium tuberculosis H37Rv
gguggcggcggugccacgauc

SEQ ID NO: 3348410 - RNA, 23 nt, Mycobacterium tuberculosis H37Rv
gguggcgggguugaucaccgaca

SEQ ID NO: 3348411 - RNA, 13 nt, Mycobacterium tuberculosis H37Rv
gguggcgucaccg

SEQ ID NO: 3348412 - RNA, 23 nt, Mycobacterium tuberculosis H37Rv
gguggcgucaccgccggugcuga

SEQ ID NO: 3348413 - RNA, 23 nt, Mycobacterium tuberculosis H37Rv
gguggcgucaugcccaggugcgu

SEQ ID NO: 3348414 - RNA, 21 nt, Mycobacterium tuberculosis H37Rv
gguggcguggcccucggcgau

SEQ ID NO: 3348415 - RNA, 19 nt, Mycobacterium tuberculosis H37Rv
gguggcguggucucgguca

SEQ ID NO: 3348416 - RNA, 13 nt, Mycobacterium tuberculosis H37Rv
gguggcguggugg

SEQ ID NO: 3348417 - RNA, 18 nt, Mycobacterium tuberculosis H37Rv
gguggcguuacgggcgau

SEQ ID NO: 3348418 - RNA, 18 nt, Mycobacterium tuberculosis H37Rv
gguggcguuugaugcggg

SEQ ID NO: 3348419 - RNA, 22 nt, Mycobacterium tuberculosis H37Rv
gguggcguuugaugcgggcggc

SEQ ID NO: 3348420 - RNA, 20 nt, Mycobacterium tuberculosis H37Rv
gguggcucgggugguuugcg

SEQ ID NO: 3348421 - RNA, 16 nt, Mycobacterium tuberculosis H37Rv
gguggcuugccccgcc

SEQ ID NO: 3348422 - RNA, 21 nt, Mycobacterium tuberculosis H37Rv
gguggcuuuugcgucugcucg

SEQ ID NO: 3348423 - RNA, 13 nt, Mycobacterium tuberculosis H37Rv
ggugggagcagcc

SEQ ID NO: 3348424 - RNA, 19 nt, Mycobacterium tuberculosis H37Rv
ggugggcaagcugaccgcc

SEQ ID NO: 3348425 - RNA, 12 nt, Mycobacterium tuberculosis H37Rv
ggugggcagcag

SEQ ID NO: 3348426 - RNA, 13 nt, Mycobacterium tuberculosis H37Rv
ggugggcagcagc

SEQ ID NO: 3348427 - RNA, 16 nt, Mycobacterium tuberculosis H37Rv
ggugggcagcagcugg

SEQ ID NO: 3348428 - RNA, 14 nt, Mycobacterium tuberculosis H37Rv
ggugggcagcaggc

SEQ ID NO: 3348429 - RNA, 15 nt, Mycobacterium tuberculosis H37Rv
ggugggccagcagca

SEQ ID NO: 3348430 - RNA, 16 nt, Mycobacterium tuberculosis H37Rv
ggugggccagcagcaa

SEQ ID NO: 3348431 - RNA, 14 nt, Mycobacterium tuberculosis H37Rv
ggugggcgggaucg

SEQ ID NO: 3348432 - RNA, 15 nt, Mycobacterium tuberculosis H37Rv
ggugggcgggugcgc

SEQ ID NO: 3348433 - RNA, 15 nt, Mycobacterium tuberculosis H37Rv
ggugggcguggcugg

SEQ ID NO: 3348434 - RNA, 17 nt, Mycobacterium tuberculosis H37Rv
ggugggcuaggucgcgc

SEQ ID NO: 3348435 - RNA, 17 nt, Mycobacterium tuberculosis H37Rv
gguggggcgguggccgg

SEQ ID NO: 3348436 - RNA, 11 nt, Mycobacterium tuberculosis H37Rv
ggugggggcgg

SEQ ID NO: 3348437 - RNA, 15 nt, Mycobacterium tuberculosis H37Rv
gguggggucggucug

SEQ ID NO: 3348438 - RNA, 13 nt, Mycobacterium tuberculosis H37Rv
ggugggucgacga

SEQ ID NO: 3348439 - RNA, 13 nt, Mycobacterium tuberculosis H37Rv
ggugggucggcuu

SEQ ID NO: 3348440 - RNA, 21 nt, Mycobacterium tuberculosis H37Rv
ggugggugacguaggcgcuga

SEQ ID NO: 3348441 - RNA, 16 nt, Mycobacterium tuberculosis H37Rv
ggugguaagacgccga

SEQ ID NO: 3348442 - RNA, 17 nt, Mycobacterium tuberculosis H37Rv
ggugguacagggugugc

SEQ ID NO: 3348443 - RNA, 14 nt, Mycobacterium tuberculosis H37Rv
ggugguaggccggg

SEQ ID NO: 3348444 - RNA, 20 nt, Mycobacterium tuberculosis H37Rv
gguggucacgcagucgggca

SEQ ID NO: 3348445 - RNA, 23 nt, Mycobacterium tuberculosis H37Rv
gguggucacgcagucgggcagcg

SEQ ID NO: 3348446 - RNA, 13 nt, Mycobacterium tuberculosis H37Rv
gguggucagcacc

SEQ ID NO: 3348447 - RNA, 14 nt, Mycobacterium tuberculosis H37Rv
gguggucagguugg

SEQ ID NO: 3348448 - RNA, 15 nt, Mycobacterium tuberculosis H37Rv
gguggucgggcgcaa

SEQ ID NO: 3348449 - RNA, 23 nt, Mycobacterium tuberculosis H37Rv
gguggucugccaaaagggcggca

SEQ ID NO: 3348450 - RNA, 13 nt, Mycobacterium tuberculosis H37Rv
gguggugacacga

SEQ ID NO: 3348451 - RNA, 22 nt, Mycobacterium tuberculosis H37Rv
gguggugaccaaguagucgggu

SEQ ID NO: 3348452 - RNA, 17 nt, Mycobacterium tuberculosis H37Rv
gguggugaguaccaauc

SEQ ID NO: 3348453 - RNA, 18 nt, Mycobacterium tuberculosis H37Rv
gguggugccgcggccacc

SEQ ID NO: 3348454 - RNA, 11 nt, Mycobacterium tuberculosis H37Rv
gguggugcucg

SEQ ID NO: 3348455 - RNA, 13 nt, Mycobacterium tuberculosis H37Rv
ggugguggccggg

SEQ ID NO: 3348456 - RNA, 15 nt, Mycobacterium tuberculosis H37Rv
ggugguggccggggu

SEQ ID NO: 3348457 - RNA, 16 nt, Mycobacterium tuberculosis H37Rv
gguugcccucaccgau

SEQ ID NO: 3348458 - RNA, 22 nt, Mycobacterium tuberculosis H37Rv
gguugccgcaccagucgcgcag

SEQ ID NO: 3348459 - RNA, 15 nt, Mycobacterium tuberculosis H37Rv
gguugccggcggcga

SEQ ID NO: 3348460 - RNA, 15 nt, Mycobacterium tuberculosis H37Rv
gguugccgucagggu

SEQ ID NO: 3348461 - RNA, 23 nt, Mycobacterium tuberculosis H37Rv
gguugccgucagggucagcuggg

SEQ ID NO: 3348462 - RNA, 14 nt, Mycobacterium tuberculosis H37Rv
gguugccugugcgg

SEQ ID NO: 3348463 - RNA, 21 nt, Mycobacterium tuberculosis H37Rv
gguugcgacgugaccggcaau

SEQ ID NO: 3348464 - RNA, 20 nt, Mycobacterium tuberculosis H37Rv
gguugcgcccguacacgauc

SEQ ID NO: 3348465 - RNA, 15 nt, Mycobacterium tuberculosis H37Rv
gguugcggcagcugg

SEQ ID NO: 3348466 - RNA, 13 nt, Mycobacterium tuberculosis H37Rv
gguugcucgagcg

SEQ ID NO: 3348467 - RNA, 18 nt, Mycobacterium tuberculosis H37Rv
gguugcucgagcgguggc

SEQ ID NO: 3348468 - RNA, 23 nt, Mycobacterium tuberculosis H37Rv
gguugcucgagcgguggcgucgu

SEQ ID NO: 3348469 - RNA, 16 nt, Mycobacterium tuberculosis H37Rv
gguuggauacggugcg

SEQ ID NO: 3348470 - RNA, 21 nt, Mycobacterium tuberculosis H37Rv
gguuggcaagcacggcgucga

SEQ ID NO: 3348471 - RNA, 22 nt, Mycobacterium tuberculosis H37Rv
gguuggcauccaaaaucgccug

SEQ ID NO: 3348472 - RNA, 18 nt, Mycobacterium tuberculosis H37Rv
gguuggccgaacagcugc

SEQ ID NO: 3348473 - RNA, 19 nt, Mycobacterium tuberculosis H37Rv
gguuggccgaacagcugcc

SEQ ID NO: 3348474 - RNA, 22 nt, Mycobacterium tuberculosis H37Rv
gguuggcggcugcacgcugcgg

SEQ ID NO: 3348475 - RNA, 21 nt, Mycobacterium tuberculosis H37Rv
gguuggcucggcgcagcacau

SEQ ID NO: 3348476 - RNA, 16 nt, Mycobacterium tuberculosis H37Rv
gguuggcugaugacgc

SEQ ID NO: 3348477 - RNA, 12 nt, Mycobacterium tuberculosis H37Rv
gguugggugugc

SEQ ID NO: 3348478 - RNA, 14 nt, Mycobacterium tuberculosis H37Rv
gguuggucccgaug

SEQ ID NO: 3348479 - RNA, 13 nt, Mycobacterium tuberculosis H37Rv
gguugguccucgg

SEQ ID NO: 3348480 - RNA, 15 nt, Mycobacterium tuberculosis H37Rv
gguuggucggugcug

SEQ ID NO: 3348481 - RNA, 16 nt, Mycobacterium tuberculosis H37Rv
gguuggugcucagcgg

SEQ ID NO: 3348482 - RNA, 17 nt, Mycobacterium tuberculosis H37Rv
gguuguagacggcaccc

SEQ ID NO: 3348483 - RNA, 17 nt, Mycobacterium tuberculosis H37Rv
gguuguccucggcgauc

SEQ ID NO: 3348484 - RNA, 13 nt, Mycobacterium tuberculosis H37Rv
gguugucggcgau

SEQ ID NO: 3348485 - RNA, 19 nt, Mycobacterium tuberculosis H37Rv
gguuguugacgaugaacgc

SEQ ID NO: 3348486 - RNA, 18 nt, Mycobacterium tuberculosis H37Rv
guaaacaagacaugcuga

SEQ ID NO: 3348487 - RNA, 18 nt, Mycobacterium tuberculosis H37Rv
guaaaccgauaucgcugc

SEQ ID NO: 3348488 - RNA, 22 nt, Mycobacterium tuberculosis H37Rv
guaaacguugggaaaagcccgg

SEQ ID NO: 3348489 - RNA, 13 nt, Mycobacterium tuberculosis H37Rv
guaaagccgcgga

SEQ ID NO: 3348490 - RNA, 14 nt, Mycobacterium tuberculosis H37Rv
guaaagcucaccac

SEQ ID NO: 3348491 - RNA, 17 nt, Mycobacterium tuberculosis H37Rv
guaaccagcgccacgau

SEQ ID NO: 3348492 - RNA, 21 nt, Mycobacterium tuberculosis H37Rv
guaaccccaccuggaguccag

SEQ ID NO: 3348493 - RNA, 14 nt, Mycobacterium tuberculosis H37Rv
guaaccccgcacga

SEQ ID NO: 3348494 - RNA, 18 nt, Mycobacterium tuberculosis H37Rv
guaaccggcggcagcgau

SEQ ID NO: 3348495 - RNA, 22 nt, Mycobacterium tuberculosis H37Rv
guaaccguagcccugcucagcu

SEQ ID NO: 3348496 - RNA, 15 nt, Mycobacterium tuberculosis H37Rv
guaaccguccgcgga

SEQ ID NO: 3348497 - RNA, 14 nt, Mycobacterium tuberculosis H37Rv
guaacgcagcggca

SEQ ID NO: 3348498 - RNA, 14 nt, Mycobacterium tuberculosis H37Rv
guaacgccgcucau

SEQ ID NO: 3348499 - RNA, 13 nt, Mycobacterium tuberculosis H37Rv
guaacgcggcacc

SEQ ID NO: 3348500 - RNA, 15 nt, Mycobacterium tuberculosis H37Rv
guaacugcccgcggc

SEQ ID NO: 3348501 - RNA, 12 nt, Mycobacterium tuberculosis H37Rv
guaagcaugccg

SEQ ID NO: 3348502 - RNA, 17 nt, Mycobacterium tuberculosis H37Rv
guaagcgaacagcggca

SEQ ID NO: 3348503 - RNA, 14 nt, Mycobacterium tuberculosis H37Rv
guaagcgaccgacg

SEQ ID NO: 3348504 - RNA, 16 nt, Mycobacterium tuberculosis H37Rv
guaagcgagucgacga

SEQ ID NO: 3348505 - RNA, 22 nt, Mycobacterium tuberculosis H37Rv
guaagcgccaaggcgauggucu

SEQ ID NO: 3348506 - RNA, 12 nt, Mycobacterium tuberculosis H37Rv
guaagcggaugu

SEQ ID NO: 3348507 - RNA, 18 nt, Mycobacterium tuberculosis H37Rv
guaagcgguuguccgguc

SEQ ID NO: 3348508 - RNA, 16 nt, Mycobacterium tuberculosis H37Rv
guaaggcacggguguu

SEQ ID NO: 3348509 - RNA, 21 nt, Mycobacterium tuberculosis H37Rv
guaaggcuugucagccgcgac

SEQ ID NO: 3348510 - RNA, 21 nt, Mycobacterium tuberculosis H37Rv
guaaucaccgaauaccgccgc

SEQ ID NO: 3348511 - RNA, 21 nt, Mycobacterium tuberculosis H37Rv
guaaucagccccguuucgcca

SEQ ID NO: 3348512 - RNA, 17 nt, Mycobacterium tuberculosis H37Rv
guaauccgagcgcggcg

SEQ ID NO: 3348513 - RNA, 15 nt, Mycobacterium tuberculosis H37Rv
guaaugccagcggca

SEQ ID NO: 3348514 - RNA, 22 nt, Mycobacterium tuberculosis H37Rv
guacaaccacccacccgcacca

SEQ ID NO: 3348515 - RNA, 16 nt, Mycobacterium tuberculosis H37Rv
guacaacgacacgccg

SEQ ID NO: 3348516 - RNA, 19 nt, Mycobacterium tuberculosis H37Rv
guacaagcauuggcgucga

SEQ ID NO: 3348517 - RNA, 15 nt, Mycobacterium tuberculosis H37Rv
guacaagucgaccau

SEQ ID NO: 3348518 - RNA, 13 nt, Mycobacterium tuberculosis H37Rv
guacacacgauga

SEQ ID NO: 3348519 - RNA, 12 nt, Mycobacterium tuberculosis H37Rv
guacaccaggcc

SEQ ID NO: 3348520 - RNA, 18 nt, Mycobacterium tuberculosis H37Rv
guacacccgcucgcccgc

SEQ ID NO: 3348521 - RNA, 18 nt, Mycobacterium tuberculosis H37Rv
guacaccgcgcccgccga

SEQ ID NO: 3348522 - RNA, 21 nt, Mycobacterium tuberculosis H37Rv
guacacguccaguggcagcca

SEQ ID NO: 3348523 - RNA, 13 nt, Mycobacterium tuberculosis H37Rv
guacagacacgcg

SEQ ID NO: 3348524 - RNA, 18 nt, Mycobacterium tuberculosis H37Rv
guacagacacgcgcgcuc

SEQ ID NO: 3348525 - RNA, 11 nt, Mycobacterium tuberculosis H37Rv
guacagcgccu

SEQ ID NO: 3348526 - RNA, 15 nt, Mycobacterium tuberculosis H37Rv
guacaggcuguccag

SEQ ID NO: 3348527 - RNA, 15 nt, Mycobacterium tuberculosis H37Rv
guacaggucgccggg

SEQ ID NO: 3348528 - RNA, 17 nt, Mycobacterium tuberculosis H37Rv
guacagugucugccaug

SEQ ID NO: 3348529 - RNA, 16 nt, Mycobacterium tuberculosis H37Rv
guacauacucugcgac

SEQ ID NO: 3348530 - RNA, 13 nt, Mycobacterium tuberculosis H37Rv
guacaucagcgcg

SEQ ID NO: 3348531 - RNA, 13 nt, Mycobacterium tuberculosis H37Rv
guacaugggcaga

SEQ ID NO: 3348532 - RNA, 18 nt, Mycobacterium tuberculosis H37Rv
guaccaaccugcgcggcg

SEQ ID NO: 3348533 - RNA, 15 nt, Mycobacterium tuberculosis H37Rv
guaccaccgcggugu

SEQ ID NO: 3348534 - RNA, 13 nt, Mycobacterium tuberculosis H37Rv
guaccaccggcac

SEQ ID NO: 3348535 - RNA, 15 nt, Mycobacterium tuberculosis H37Rv
guaccaccggcaccg

SEQ ID NO: 3348536 - RNA, 17 nt, Mycobacterium tuberculosis H37Rv
guaccagcccagcggcu

SEQ ID NO: 3348537 - RNA, 15 nt, Mycobacterium tuberculosis H37Rv
guaccagcccgccgu

SEQ ID NO: 3348538 - RNA, 23 nt, Mycobacterium tuberculosis H37Rv
guaccagccgaagaaccggucgc

SEQ ID NO: 3348539 - RNA, 22 nt, Mycobacterium tuberculosis H37Rv
guaccagggugucgucuugcgu

SEQ ID NO: 3348540 - RNA, 13 nt, Mycobacterium tuberculosis H37Rv
guaccaucaccgc

SEQ ID NO: 3348541 - RNA, 19 nt, Mycobacterium tuberculosis H37Rv
guaccaucaccgcgccagc

SEQ ID NO: 3348542 - RNA, 12 nt, Mycobacterium tuberculosis H37Rv
guacccaccucc

SEQ ID NO: 3348543 - RNA, 13 nt, Mycobacterium tuberculosis H37Rv
guacccaccuccc

SEQ ID NO: 3348544 - RNA, 15 nt, Mycobacterium tuberculosis H37Rv
guacccaucugcuca

SEQ ID NO: 3348545 - RNA, 17 nt, Mycobacterium tuberculosis H37Rv
guaccccaacgaccggc

SEQ ID NO: 3348546 - RNA, 14 nt, Mycobacterium tuberculosis H37Rv
guacccccagcacc

SEQ ID NO: 3348547 - RNA, 16 nt, Mycobacterium tuberculosis H37Rv
guacccgaccagcacc

SEQ ID NO: 3348548 - RNA, 15 nt, Mycobacterium tuberculosis H37Rv
guacccgaucagcga

SEQ ID NO: 3348549 - RNA, 16 nt, Mycobacterium tuberculosis H37Rv
guacccggcgacguuc

SEQ ID NO: 3348550 - RNA, 17 nt, Mycobacterium tuberculosis H37Rv
guacccguagcaccaca

SEQ ID NO: 3348551 - RNA, 23 nt, Mycobacterium tuberculosis H37Rv
guaccgacgaagaucgcugcgaa

SEQ ID NO: 3348552 - RNA, 21 nt, Mycobacterium tuberculosis H37Rv
guaccgauagccugcggcggc

SEQ ID NO: 3348553 - RNA, 18 nt, Mycobacterium tuberculosis H37Rv
guaccgccacuggcgcug

SEQ ID NO: 3348554 - RNA, 14 nt, Mycobacterium tuberculosis H37Rv
guagcccagccggg

SEQ ID NO: 3348555 - RNA, 14 nt, Mycobacterium tuberculosis H37Rv
guagcccaucggca

SEQ ID NO: 3348556 - RNA, 13 nt, Mycobacterium tuberculosis H37Rv
guagccgaccagc

SEQ ID NO: 3348557 - RNA, 17 nt, Mycobacterium tuberculosis H37Rv
guagccgaccggcagcg

SEQ ID NO: 3348558 - RNA, 19 nt, Mycobacterium tuberculosis H37Rv
guagccgaccggcagcgau

SEQ ID NO: 3348559 - RNA, 13 nt, Mycobacterium tuberculosis H37Rv
guagccgcccagc

SEQ ID NO: 3348560 - RNA, 17 nt, Mycobacterium tuberculosis H37Rv
guagccgccgucgccgg

SEQ ID NO: 3348561 - RNA, 14 nt, Mycobacterium tuberculosis H37Rv
guagccgcugcacg

SEQ ID NO: 3348562 - RNA, 13 nt, Mycobacterium tuberculosis H37Rv
guagccggccgcu

SEQ ID NO: 3348563 - RNA, 14 nt, Mycobacterium tuberculosis H37Rv
guagccggccgcuu

SEQ ID NO: 3348564 - RNA, 16 nt, Mycobacterium tuberculosis H37Rv
guagccgggaacgcug

SEQ ID NO: 3348565 - RNA, 14 nt, Mycobacterium tuberculosis H37Rv
guagccggugaccg

SEQ ID NO: 3348566 - RNA, 17 nt, Mycobacterium tuberculosis H37Rv
guagccguagccgccgu

SEQ ID NO: 3348567 - RNA, 19 nt, Mycobacterium tuberculosis H37Rv
guagccgucgaucccgguc

SEQ ID NO: 3348568 - RNA, 13 nt, Mycobacterium tuberculosis H37Rv
guagccgucgucg

SEQ ID NO: 3348569 - RNA, 17 nt, Mycobacterium tuberculosis H37Rv
guagccgucgucgucga

SEQ ID NO: 3348570 - RNA, 21 nt, Mycobacterium tuberculosis H37Rv
guagccgugggccacgaugau

SEQ ID NO: 3348571 - RNA, 22 nt, Mycobacterium tuberculosis H37Rv
guagccgugggccacgaugauc

SEQ ID NO: 3348572 - RNA, 17 nt, Mycobacterium tuberculosis H37Rv
guagccguugccgccga

SEQ ID NO: 3348573 - RNA, 16 nt, Mycobacterium tuberculosis H37Rv
guagcgaccucgccgc

SEQ ID NO: 3348574 - RNA, 15 nt, Mycobacterium tuberculosis H37Rv
guagcgagcccacgu

SEQ ID NO: 3348575 - RNA, 14 nt, Mycobacterium tuberculosis H37Rv
guagcgagcgggug

SEQ ID NO: 3348576 - RNA, 20 nt, Mycobacterium tuberculosis H37Rv
guagcgauuccaggauggcc

SEQ ID NO: 3348577 - RNA, 20 nt, Mycobacterium tuberculosis H37Rv
guagcgcaaccgcgcuugga

SEQ ID NO: 3348578 - RNA, 18 nt, Mycobacterium tuberculosis H37Rv
guagcgcaaugcggcccg

SEQ ID NO: 3348579 - RNA, 22 nt, Mycobacterium tuberculosis H37Rv
guagcgcaaugcggcccgggug

SEQ ID NO: 3348580 - RNA, 13 nt, Mycobacterium tuberculosis H37Rv
guagcgcaccaca

SEQ ID NO: 3348581 - RNA, 18 nt, Mycobacterium tuberculosis H37Rv
guagcgcaggagcgcgau

SEQ ID NO: 3348582 - RNA, 13 nt, Mycobacterium tuberculosis H37Rv
guagcgccccgau

SEQ ID NO: 3348583 - RNA, 20 nt, Mycobacterium tuberculosis H37Rv
guagcgcucgaucagguugg

SEQ ID NO: 3348584 - RNA, 16 nt, Mycobacterium tuberculosis H37Rv
guagcggcgccgcccu

SEQ ID NO: 3348585 - RNA, 22 nt, Mycobacterium tuberculosis H37Rv
guagcgggcaaacgaacgggug

SEQ ID NO: 3348586 - RNA, 15 nt, Mycobacterium tuberculosis H37Rv
guagcgggggagcga

SEQ ID NO: 3348587 - RNA, 20 nt, Mycobacterium tuberculosis H37Rv
guagcgguucaucaccguca

SEQ ID NO: 3348588 - RNA, 13 nt, Mycobacterium tuberculosis H37Rv
guagcgucgcacc

SEQ ID NO: 3348589 - RNA, 12 nt, Mycobacterium tuberculosis H37Rv
guagcgugcgac

SEQ ID NO: 3348590 - RNA, 15 nt, Mycobacterium tuberculosis H37Rv
guagcguucccacac

SEQ ID NO: 3348591 - RNA, 20 nt, Mycobacterium tuberculosis H37Rv
guagcuccuugagcaaugac

SEQ ID NO: 3348592 - RNA, 19 nt, Mycobacterium tuberculosis H37Rv
guagcucgguaggccggca

SEQ ID NO: 3348593 - RNA, 16 nt, Mycobacterium tuberculosis H37Rv
guagcucgucgaggaa

SEQ ID NO: 3348594 - RNA, 20 nt, Mycobacterium tuberculosis H37Rv
guagcucgucgaggaagauc

SEQ ID NO: 3348595 - RNA, 20 nt, Mycobacterium tuberculosis H37Rv
guagcucuuugagugccgug

SEQ ID NO: 3348596 - RNA, 14 nt, Mycobacterium tuberculosis H37Rv
guagcugaccaucg

SEQ ID NO: 3348597 - RNA, 15 nt, Mycobacterium tuberculosis H37Rv
guagcugacggccug

SEQ ID NO: 3348598 - RNA, 12 nt, Mycobacterium tuberculosis H37Rv
guagcugcgcag

SEQ ID NO: 3348599 - RNA, 16 nt, Mycobacterium tuberculosis H37Rv
guagcugcgcagcgca

SEQ ID NO: 3348600 - RNA, 19 nt, Mycobacterium tuberculosis H37Rv
guagcuucgaugggcauca

SEQ ID NO: 3348601 - RNA, 20 nt, Mycobacterium tuberculosis H37Rv
guaggaacuacccgccagca

SEQ ID NO: 3348602 - RNA, 22 nt, Mycobacterium tuberculosis H37Rv
guaggacaccaccguggccucg

SEQ ID NO: 3348603 - RNA, 16 nt, Mycobacterium tuberculosis H37Rv
guaggacacguggugg

SEQ ID NO: 3348604 - RNA, 14 nt, Mycobacterium tuberculosis H37Rv
guaggacgccagca

SEQ ID NO: 3348605 - RNA, 19 nt, Mycobacterium tuberculosis H37Rv
guaggacugccagcguugc

SEQ ID NO: 3348606 - RNA, 19 nt, Mycobacterium tuberculosis H37Rv
guaggagaacgucaaaccc

SEQ ID NO: 3348607 - RNA, 20 nt, Mycobacterium tuberculosis H37Rv
guaggcaggaucgccugagc

SEQ ID NO: 3348608 - RNA, 22 nt, Mycobacterium tuberculosis H37Rv
guaggccgagcauccgacacug

SEQ ID NO: 3348609 - RNA, 16 nt, Mycobacterium tuberculosis H37Rv
guaggccucggcagca

SEQ ID NO: 3348610 - RNA, 23 nt, Mycobacterium tuberculosis H37Rv
guaggccugcccccggcgcggcg

SEQ ID NO: 3348611 - RNA, 16 nt, Mycobacterium tuberculosis H37Rv
guaggcgaccgccauu

SEQ ID NO: 3348612 - RNA, 19 nt, Mycobacterium tuberculosis H37Rv
guaggcgccguuguuguag

SEQ ID NO: 3348613 - RNA, 17 nt, Mycobacterium tuberculosis H37Rv
guaggcggaucuuggug

SEQ ID NO: 3348614 - RNA, 13 nt, Mycobacterium tuberculosis H37Rv
guaggcggccagc

SEQ ID NO: 3348615 - RNA, 13 nt, Mycobacterium tuberculosis H37Rv
guaggcggcggcc

SEQ ID NO: 3348616 - RNA, 14 nt, Mycobacterium tuberculosis H37Rv
guaggcggucagau

SEQ ID NO: 3348617 - RNA, 22 nt, Mycobacterium tuberculosis H37Rv
guaggcguuggacgcgaacagc

SEQ ID NO: 3348618 - RNA, 15 nt, Mycobacterium tuberculosis H37Rv
guaggcuggccgccu

SEQ ID NO: 3348619 - RNA, 15 nt, Mycobacterium tuberculosis H37Rv
guaggcuuccagcuc

SEQ ID NO: 3348620 - RNA, 20 nt, Mycobacterium tuberculosis H37Rv
guaggcuuccagcucgucgu

SEQ ID NO: 3348621 - RNA, 22 nt, Mycobacterium tuberculosis H37Rv
guaggcuucgaccguggugguc

SEQ ID NO: 3348622 - RNA, 18 nt, Mycobacterium tuberculosis H37Rv
guagggaugcggccggau

SEQ ID NO: 3348623 - RNA, 12 nt, Mycobacterium tuberculosis H37Rv
guagggcaucgu

SEQ ID NO: 3348624 - RNA, 15 nt, Mycobacterium tuberculosis H37Rv
guagggcaucgucgc

SEQ ID NO: 3348625 - RNA, 14 nt, Mycobacterium tuberculosis H37Rv
guaggggcaggcca

SEQ ID NO: 3348626 - RNA, 13 nt, Mycobacterium tuberculosis H37Rv
guagggugggucg

SEQ ID NO: 3348627 - RNA, 13 nt, Mycobacterium tuberculosis H37Rv
guaggucagcgcg

SEQ ID NO: 3348628 - RNA, 23 nt, Mycobacterium tuberculosis H37Rv
guaggucagcgcgucguccaggg

SEQ ID NO: 3348629 - RNA, 23 nt, Mycobacterium tuberculosis H37Rv
guagguccuugucggccccggcc

SEQ ID NO: 3348630 - RNA, 14 nt, Mycobacterium tuberculosis H37Rv
guaggugacgacgu

SEQ ID NO: 3348631 - RNA, 22 nt, Mycobacterium tuberculosis H37Rv
guaggugauggcuuggaccagc

SEQ ID NO: 3348632 - RNA, 13 nt, Mycobacterium tuberculosis H37Rv
guaggugggcucg

SEQ ID NO: 3348633 - RNA, 15 nt, Mycobacterium tuberculosis H37Rv
guagguugccaugcc

SEQ ID NO: 3348634 - RNA, 17 nt, Mycobacterium tuberculosis H37Rv
guagguuuucggcggcu

SEQ ID NO: 3348635 - RNA, 14 nt, Mycobacterium tuberculosis H37Rv
guaguaguucagcc

SEQ ID NO: 3348636 - RNA, 13 nt, Mycobacterium tuberculosis H37Rv
guaguccagcacg

SEQ ID NO: 3348637 - RNA, 22 nt, Mycobacterium tuberculosis H37Rv
guagucccacugccacuccuga

SEQ ID NO: 3348638 - RNA, 13 nt, Mycobacterium tuberculosis H37Rv
guaguccgcaucc

SEQ ID NO: 3348639 - RNA, 14 nt, Mycobacterium tuberculosis H37Rv
guaguccucggugg

SEQ ID NO: 3348640 - RNA, 16 nt, Mycobacterium tuberculosis H37Rv
guaguccucgguggcc

SEQ ID NO: 3348641 - RNA, 16 nt, Mycobacterium tuberculosis H37Rv
guaguccugcgggccg

SEQ ID NO: 3348642 - RNA, 19 nt, Mycobacterium tuberculosis H37Rv
guagucgcgaccgcgggcc

SEQ ID NO: 3348643 - RNA, 14 nt, Mycobacterium tuberculosis H37Rv
guagucggcgcguc

SEQ ID NO: 3348644 - RNA, 19 nt, Mycobacterium tuberculosis H37Rv
guagucgggcaaggcggcg

SEQ ID NO: 3348645 - RNA, 16 nt, Mycobacterium tuberculosis H37Rv
guagucugcacgucgg

SEQ ID NO: 3348646 - RNA, 18 nt, Mycobacterium tuberculosis H37Rv
guagugcagcugcaauga

SEQ ID NO: 3348647 - RNA, 23 nt, Mycobacterium tuberculosis H37Rv
guagugcguaaggcugugccggc

SEQ ID NO: 3348648 - RNA, 18 nt, Mycobacterium tuberculosis H37Rv
guaguggaagccgaccac

SEQ ID NO: 3348649 - RNA, 22 nt, Mycobacterium tuberculosis H37Rv
guaguucaccaacgcgggaacg

SEQ ID NO: 3348650 - RNA, 14 nt, Mycobacterium tuberculosis H37Rv
guaguucugauuca

SEQ ID NO: 3348651 - RNA, 22 nt, Mycobacterium tuberculosis H37Rv
gucacccggccguugggccacc

SEQ ID NO: 3348652 - RNA, 13 nt, Mycobacterium tuberculosis H37Rv
gucacccguaucg

SEQ ID NO: 3348653 - RNA, 18 nt, Mycobacterium tuberculosis H37Rv
gucaccgacacggugcug

SEQ ID NO: 3348654 - RNA, 18 nt, Mycobacterium tuberculosis H37Rv
gucaccgaugcgccggac

SEQ ID NO: 3348655 - RNA, 18 nt, Mycobacterium tuberculosis H37Rv
gucaccgcaaccgagcug

SEQ ID NO: 3348656 - RNA, 16 nt, Mycobacterium tuberculosis H37Rv
gucaccgccgaccagg

SEQ ID NO: 3348657 - RNA, 11 nt, Mycobacterium tuberculosis H37Rv
gucaccgccgg

SEQ ID NO: 3348658 - RNA, 13 nt, Mycobacterium tuberculosis H37Rv
gucaccgccggga

SEQ ID NO: 3348659 - RNA, 23 nt, Mycobacterium tuberculosis H37Rv
gucaccgccgggaagccgcaucu

SEQ ID NO: 3348660 - RNA, 14 nt, Mycobacterium tuberculosis H37Rv
gucaccgccgggau

SEQ ID NO: 3348661 - RNA, 20 nt, Mycobacterium tuberculosis H37Rv
gucaccgccguugccaagca

SEQ ID NO: 3348662 - RNA, 15 nt, Mycobacterium tuberculosis H37Rv
gucaccgcgacggaa

SEQ ID NO: 3348663 - RNA, 15 nt, Mycobacterium tuberculosis H37Rv
gucaccgcgcagcga

SEQ ID NO: 3348664 - RNA, 17 nt, Mycobacterium tuberculosis H37Rv
gucaccgcgcuggucag

SEQ ID NO: 3348665 - RNA, 14 nt, Mycobacterium tuberculosis H37Rv
gucaccgcgggcau

SEQ ID NO: 3348666 - RNA, 18 nt, Mycobacterium tuberculosis H37Rv
gucaccgcgucaccggag

SEQ ID NO: 3348667 - RNA, 12 nt, Mycobacterium tuberculosis H37Rv
gucaccgcugag

SEQ ID NO: 3348668 - RNA, 16 nt, Mycobacterium tuberculosis H37Rv
gucaccggcgcaccgg

SEQ ID NO: 3348669 - RNA, 14 nt, Mycobacterium tuberculosis H37Rv
gucaccggcgucgc

SEQ ID NO: 3348670 - RNA, 19 nt, Mycobacterium tuberculosis H37Rv
gucaccggcgucgcugccu

SEQ ID NO: 3348671 - RNA, 20 nt, Mycobacterium tuberculosis H37Rv
gucaccggcuucuccuccag

SEQ ID NO: 3348672 - RNA, 14 nt, Mycobacterium tuberculosis H37Rv
gucaccgggugcac

SEQ ID NO: 3348673 - RNA, 16 nt, Mycobacterium tuberculosis H37Rv
gucaccggucaccgcg

SEQ ID NO: 3348674 - RNA, 15 nt, Mycobacterium tuberculosis H37Rv
gucaccguacggcca

SEQ ID NO: 3348675 - RNA, 20 nt, Mycobacterium tuberculosis H37Rv
gucaccgucuugcacgucca

SEQ ID NO: 3348676 - RNA, 13 nt, Mycobacterium tuberculosis H37Rv
gucaccucaccga

SEQ ID NO: 3348677 - RNA, 19 nt, Mycobacterium tuberculosis H37Rv
gucaccugcaucgucgcca

SEQ ID NO: 3348678 - RNA, 13 nt, Mycobacterium tuberculosis H37Rv
gucaccugcgggc

SEQ ID NO: 3348679 - RNA, 15 nt, Mycobacterium tuberculosis H37Rv
gucaccugcugcaac

SEQ ID NO: 3348680 - RNA, 16 nt, Mycobacterium tuberculosis H37Rv
gucaccugcugcaacc

SEQ ID NO: 3348681 - RNA, 16 nt, Mycobacterium tuberculosis H37Rv
gucaccuugaccgggu

SEQ ID NO: 3348682 - RNA, 14 nt, Mycobacterium tuberculosis H37Rv
gucacgaccugcuc

SEQ ID NO: 3348683 - RNA, 14 nt, Mycobacterium tuberculosis H37Rv
gucacgacguccga

SEQ ID NO: 3348684 - RNA, 15 nt, Mycobacterium tuberculosis H37Rv
gucacgacguccgau

SEQ ID NO: 3348685 - RNA, 13 nt, Mycobacterium tuberculosis H37Rv
gucacgaucacga

SEQ ID NO: 3348686 - RNA, 22 nt, Mycobacterium tuberculosis H37Rv
gucacgaucgugccgggaccgg

SEQ ID NO: 3348687 - RNA, 18 nt, Mycobacterium tuberculosis H37Rv
gucacgcacccggcgcaa

SEQ ID NO: 3348688 - RNA, 12 nt, Mycobacterium tuberculosis H37Rv
gucacgcaccgc

SEQ ID NO: 3348689 - RNA, 13 nt, Mycobacterium tuberculosis H37Rv
gucacgcgaggcg

SEQ ID NO: 3348690 - RNA, 13 nt, Mycobacterium tuberculosis H37Rv
gucacggacccuu

SEQ ID NO: 3348691 - RNA, 18 nt, Mycobacterium tuberculosis H37Rv
gucacggcgugaccacug

SEQ ID NO: 3348692 - RNA, 16 nt, Mycobacterium tuberculosis H37Rv
gucacgggcguuguua

SEQ ID NO: 3348693 - RNA, 14 nt, Mycobacterium tuberculosis H37Rv
gucacgggguccga

SEQ ID NO: 3348694 - RNA, 22 nt, Mycobacterium tuberculosis H37Rv
gucacgggguccgaugcgugcc

SEQ ID NO: 3348695 - RNA, 19 nt, Mycobacterium tuberculosis H37Rv
gucacggucguggugcaac

SEQ ID NO: 3348696 - RNA, 20 nt, Mycobacterium tuberculosis H37Rv
gucacggugcguucgugcug

SEQ ID NO: 3348697 - RNA, 17 nt, Mycobacterium tuberculosis H37Rv
gucacguaacgccgcgg

SEQ ID NO: 3348698 - RNA, 19 nt, Mycobacterium tuberculosis H37Rv
gucacguaauuccccaggu

SEQ ID NO: 3348699 - RNA, 19 nt, Mycobacterium tuberculosis H37Rv
gucacuacuccggucccgc

SEQ ID NO: 3348700 - RNA, 11 nt, Mycobacterium tuberculosis H37Rv
gucacugcccu

SEQ ID NO: 3348701 - RNA, 22 nt, Mycobacterium tuberculosis H37Rv
gucacugcccugauugaagccc

SEQ ID NO: 3348702 - RNA, 23 nt, Mycobacterium tuberculosis H37Rv
gucacugcccugauugaagcccc

SEQ ID NO: 3348703 - RNA, 21 nt, Mycobacterium tuberculosis H37Rv
gucacugcgaaaaaucaugcc

SEQ ID NO: 3348704 - RNA, 14 nt, Mycobacterium tuberculosis H37Rv
gucacuguaccggg

SEQ ID NO: 3348705 - RNA, 16 nt, Mycobacterium tuberculosis H37Rv
gucacuguaccgggcg

SEQ ID NO: 3348706 - RNA, 18 nt, Mycobacterium tuberculosis H37Rv
gucagaaaaagccgcgua

SEQ ID NO: 3348707 - RNA, 14 nt, Mycobacterium tuberculosis H37Rv
gucagaacggcggc

SEQ ID NO: 3348708 - RNA, 22 nt, Mycobacterium tuberculosis H37Rv
gucagaauugugugcagcagca

SEQ ID NO: 3348709 - RNA, 12 nt, Mycobacterium tuberculosis H37Rv
gucagacgccgg

SEQ ID NO: 3348710 - RNA, 20 nt, Mycobacterium tuberculosis H37Rv
gucagauggccacccgcgga

SEQ ID NO: 3348711 - RNA, 21 nt, Mycobacterium tuberculosis H37Rv
gucagauguuguacggcccgc

SEQ ID NO: 3348712 - RNA, 16 nt, Mycobacterium tuberculosis H37Rv
gucagcaagaucggca

SEQ ID NO: 3348713 - RNA, 24 nt, Mycobacterium tuberculosis H37Rv
gucagcaauacggcggcgccgccc

SEQ ID NO: 3348714 - RNA, 17 nt, Mycobacterium tuberculosis H37Rv
gucagcacaaacccagu

SEQ ID NO: 3348715 - RNA, 16 nt, Mycobacterium tuberculosis H37Rv
gucagcaccaccagca

SEQ ID NO: 3348716 - RNA, 22 nt, Mycobacterium tuberculosis H37Rv
gucagcacccaacccggcggca

SEQ ID NO: 3348717 - RNA, 16 nt, Mycobacterium tuberculosis H37Rv
gucagcaccccgccgc

SEQ ID NO: 3348718 - RNA, 21 nt, Mycobacterium tuberculosis H37Rv
gucagcagaauccugcgcugc

SEQ ID NO: 3348719 - RNA, 19 nt, Mycobacterium tuberculosis H37Rv
gucagcagaugggcgucgg

SEQ ID NO: 3348720 - RNA, 17 nt, Mycobacterium tuberculosis H37Rv
gucagcagcuccacugg

SEQ ID NO: 3348721 - RNA, 18 nt, Mycobacterium tuberculosis H37Rv
gucagcaugggguagauc

SEQ ID NO: 3348722 - RNA, 21 nt, Mycobacterium tuberculosis H37Rv
gucagccaccaucuggauggc

SEQ ID NO: 3348723 - RNA, 17 nt, Mycobacterium tuberculosis H37Rv
gucagccaccggugagc

SEQ ID NO: 3348724 - RNA, 13 nt, Mycobacterium tuberculosis H37Rv
gucagccaccuga

SEQ ID NO: 3348725 - RNA, 13 nt, Mycobacterium tuberculosis H37Rv
gucagcccagcca

SEQ ID NO: 3348726 - RNA, 17 nt, Mycobacterium tuberculosis H37Rv
gucagccccgacugcgc

SEQ ID NO: 3348727 - RNA, 13 nt, Mycobacterium tuberculosis H37Rv
gucagcccggcgc

SEQ ID NO: 3348728 - RNA, 23 nt, Mycobacterium tuberculosis H37Rv
gucagccgcgcgggucacgaccu

SEQ ID NO: 3348729 - RNA, 20 nt, Mycobacterium tuberculosis H37Rv
gucagccgugccguggugaa

SEQ ID NO: 3348730 - RNA, 17 nt, Mycobacterium tuberculosis H37Rv
gucagccugccagguac

SEQ ID NO: 3348731 - RNA, 20 nt, Mycobacterium tuberculosis H37Rv
gucagcgaacggccaggaca

SEQ ID NO: 3348732 - RNA, 16 nt, Mycobacterium tuberculosis H37Rv
gucagcgacgcacgca

SEQ ID NO: 3348733 - RNA, 22 nt, Mycobacterium tuberculosis H37Rv
gucagcgccgcgcgcgccgcau

SEQ ID NO: 3348734 - RNA, 14 nt, Mycobacterium tuberculosis H37Rv
gucagcgcgcacga

SEQ ID NO: 3348735 - RNA, 18 nt, Mycobacterium tuberculosis H37Rv
gucagcggccugcucggg

SEQ ID NO: 3348736 - RNA, 17 nt, Mycobacterium tuberculosis H37Rv
gucagcggcucggcggg

SEQ ID NO: 3348737 - RNA, 21 nt, Mycobacterium tuberculosis H37Rv
gucagcgucugagcgccggca

SEQ ID NO: 3348738 - RNA, 13 nt, Mycobacterium tuberculosis H37Rv
gucagcgugccgg

SEQ ID NO: 3348739 - RNA, 20 nt, Mycobacterium tuberculosis H37Rv
gucagcguggacgcccgccc

SEQ ID NO: 3348740 - RNA, 21 nt, Mycobacterium tuberculosis H37Rv
gucagcuaauaccugcggauu

SEQ ID NO: 3348741 - RNA, 16 nt, Mycobacterium tuberculosis H37Rv
gucagcucccggcuuc

SEQ ID NO: 3348742 - RNA, 18 nt, Mycobacterium tuberculosis H37Rv
gucagcugggacccgagc

SEQ ID NO: 3348743 - RNA, 22 nt, Mycobacterium tuberculosis H37Rv
gucaggaacaaguagccgucgu

SEQ ID NO: 3348744 - RNA, 21 nt, Mycobacterium tuberculosis H37Rv
gucaggaugaucugcgcggcc

SEQ ID NO: 3348745 - RNA, 23 nt, Mycobacterium tuberculosis H37Rv
gucaggcacaacgcgacgccgcu

SEQ ID NO: 3348746 - RNA, 21 nt, Mycobacterium tuberculosis H37Rv
gucaggcagcuccgccgccga

SEQ ID NO: 3348747 - RNA, 19 nt, Mycobacterium tuberculosis H37Rv
guccagcacggccacguca

SEQ ID NO: 3348748 - RNA, 14 nt, Mycobacterium tuberculosis H37Rv
guccagcagcgacg

SEQ ID NO: 3348749 - RNA, 14 nt, Mycobacterium tuberculosis H37Rv
guccagcagcucgg

SEQ ID NO: 3348750 - RNA, 12 nt, Mycobacterium tuberculosis H37Rv
guccagcagugc

SEQ ID NO: 3348751 - RNA, 17 nt, Mycobacterium tuberculosis H37Rv
guccagccaacgggaac

SEQ ID NO: 3348752 - RNA, 24 nt, Mycobacterium tuberculosis H37Rv
guccagccaacgggaacaacggcg

SEQ ID NO: 3348753 - RNA, 16 nt, Mycobacterium tuberculosis H37Rv
guccagccaccgccgc

SEQ ID NO: 3348754 - RNA, 13 nt, Mycobacterium tuberculosis H37Rv
guccagccaggcg

SEQ ID NO: 3348755 - RNA, 12 nt, Mycobacterium tuberculosis H37Rv
guccagcccaga

SEQ ID NO: 3348756 - RNA, 14 nt, Mycobacterium tuberculosis H37Rv
guccagcccagcgc

SEQ ID NO: 3348757 - RNA, 17 nt, Mycobacterium tuberculosis H37Rv
guccagccggcgcgccg

SEQ ID NO: 3348758 - RNA, 17 nt, Mycobacterium tuberculosis H37Rv
guccagccgggugccgg

SEQ ID NO: 3348759 - RNA, 20 nt, Mycobacterium tuberculosis H37Rv
guccagccguggcggcgggc

SEQ ID NO: 3348760 - RNA, 16 nt, Mycobacterium tuberculosis H37Rv
guccagcgaucccggu

SEQ ID NO: 3348761 - RNA, 17 nt, Mycobacterium tuberculosis H37Rv
guccagcgaucccggug

SEQ ID NO: 3348762 - RNA, 19 nt, Mycobacterium tuberculosis H37Rv
guccagcgauccggggcug

SEQ ID NO: 3348763 - RNA, 20 nt, Mycobacterium tuberculosis H37Rv
guccagcgggaucugaccca

SEQ ID NO: 3348764 - RNA, 13 nt, Mycobacterium tuberculosis H37Rv
guccagcgggcau

SEQ ID NO: 3348765 - RNA, 20 nt, Mycobacterium tuberculosis H37Rv
guccagcgggcauaacccgc

SEQ ID NO: 3348766 - RNA, 15 nt, Mycobacterium tuberculosis H37Rv
guccaggagugcggg

SEQ ID NO: 3348767 - RNA, 18 nt, Mycobacterium tuberculosis H37Rv
guccaggagugcgggcau

SEQ ID NO: 3348768 - RNA, 21 nt, Mycobacterium tuberculosis H37Rv
guccaggaucgcguggcgcac

SEQ ID NO: 3348769 - RNA, 19 nt, Mycobacterium tuberculosis H37Rv
guccaggcacuccagcggc

SEQ ID NO: 3348770 - RNA, 22 nt, Mycobacterium tuberculosis H37Rv
guccaggcagcguaagaccuga

SEQ ID NO: 3348771 - RNA, 13 nt, Mycobacterium tuberculosis H37Rv
guccaggccggca

SEQ ID NO: 3348772 - RNA, 21 nt, Mycobacterium tuberculosis H37Rv
guccaggcggugacguggugg

SEQ ID NO: 3348773 - RNA, 16 nt, Mycobacterium tuberculosis H37Rv
guccaggcugaucccg

SEQ ID NO: 3348774 - RNA, 14 nt, Mycobacterium tuberculosis H37Rv
guccagggcgacga

SEQ ID NO: 3348775 - RNA, 16 nt, Mycobacterium tuberculosis H37Rv
guccaggguggucagu

SEQ ID NO: 3348776 - RNA, 21 nt, Mycobacterium tuberculosis H37Rv
guccagguccaaguccuccac

SEQ ID NO: 3348777 - RNA, 13 nt, Mycobacterium tuberculosis H37Rv
guccaggugaccg

SEQ ID NO: 3348778 - RNA, 20 nt, Mycobacterium tuberculosis H37Rv
guccaggugcgccguggcau

SEQ ID NO: 3348779 - RNA, 21 nt, Mycobacterium tuberculosis H37Rv
guccaggugcgccguggcauc

SEQ ID NO: 3348780 - RNA, 19 nt, Mycobacterium tuberculosis H37Rv
guccauauagaucacugcu

SEQ ID NO: 3348781 - RNA, 23 nt, Mycobacterium tuberculosis H37Rv
guccaucaaccccagcgcaaccu

SEQ ID NO: 3348782 - RNA, 16 nt, Mycobacterium tuberculosis H37Rv
guccaucaccggcggc

SEQ ID NO: 3348783 - RNA, 17 nt, Mycobacterium tuberculosis H37Rv
guccaucaccggcggcc

SEQ ID NO: 3348784 - RNA, 19 nt, Mycobacterium tuberculosis H37Rv
guccauccgcagcagguga

SEQ ID NO: 3348785 - RNA, 16 nt, Mycobacterium tuberculosis H37Rv
guccaucgccaccgcg

SEQ ID NO: 3348786 - RNA, 21 nt, Mycobacterium tuberculosis H37Rv
guccaucgcgcggcugugccc

SEQ ID NO: 3348787 - RNA, 22 nt, Mycobacterium tuberculosis H37Rv
guccaugcggguaaaccaggug

SEQ ID NO: 3348788 - RNA, 15 nt, Mycobacterium tuberculosis H37Rv
guccauguaauucaa

SEQ ID NO: 3348789 - RNA, 21 nt, Mycobacterium tuberculosis H37Rv
guccauguuuugcugcaugcc

SEQ ID NO: 3348790 - RNA, 22 nt, Mycobacterium tuberculosis H37Rv
guccauguuuugcugcaugccg

SEQ ID NO: 3348791 - RNA, 15 nt, Mycobacterium tuberculosis H37Rv
gucccaacacggcga

SEQ ID NO: 3348792 - RNA, 13 nt, Mycobacterium tuberculosis H37Rv
gucccaaucggga

SEQ ID NO: 3348793 - RNA, 15 nt, Mycobacterium tuberculosis H37Rv
gucccaaucgggauc

SEQ ID NO: 3348794 - RNA, 22 nt, Mycobacterium tuberculosis H37Rv
gucccaaucgucggccagcaga

SEQ ID NO: 3348795 - RNA, 21 nt, Mycobacterium tuberculosis H37Rv
gucccaccagguacgcgauca

SEQ ID NO: 3348796 - RNA, 17 nt, Mycobacterium tuberculosis H37Rv
gucccacgccagcgcga

SEQ ID NO: 3348797 - RNA, 14 nt, Mycobacterium tuberculosis H37Rv
gucccacggccggc

SEQ ID NO: 3348798 - RNA, 21 nt, Mycobacterium tuberculosis H37Rv
gucccacguugcugaugcccu

SEQ ID NO: 3348799 - RNA, 17 nt, Mycobacterium tuberculosis H37Rv
gucccagcgccgcagug

SEQ ID NO: 3348800 - RNA, 20 nt, Mycobacterium tuberculosis H37Rv
gucccagcgguagccgagcu

SEQ ID NO: 3348801 - RNA, 15 nt, Mycobacterium tuberculosis H37Rv
gucccagcugaccag

SEQ ID NO: 3348802 - RNA, 18 nt, Mycobacterium tuberculosis H37Rv
gucccagcugaccagcgu

SEQ ID NO: 3348803 - RNA, 19 nt, Mycobacterium tuberculosis H37Rv
gucccagcugaccagcguc

SEQ ID NO: 3348804 - RNA, 20 nt, Mycobacterium tuberculosis H37Rv
gucccagggcacaucgggcg

SEQ ID NO: 3348805 - RNA, 16 nt, Mycobacterium tuberculosis H37Rv
gucccaguacgaucgu

SEQ ID NO: 3348806 - RNA, 16 nt, Mycobacterium tuberculosis H37Rv
gucccaucgcgucggc

SEQ ID NO: 3348807 - RNA, 19 nt, Mycobacterium tuberculosis H37Rv
guccccagacagaccccca

SEQ ID NO: 3348808 - RNA, 17 nt, Mycobacterium tuberculosis H37Rv
guccccagcgccaccgu

SEQ ID NO: 3348809 - RNA, 17 nt, Mycobacterium tuberculosis H37Rv
guccccaggugggcagc

SEQ ID NO: 3348810 - RNA, 19 nt, Mycobacterium tuberculosis H37Rv
guccccaggugggcagcag

SEQ ID NO: 3348811 - RNA, 23 nt, Mycobacterium tuberculosis H37Rv
guccccaggugggcagcaggccc

SEQ ID NO: 3348812 - RNA, 21 nt, Mycobacterium tuberculosis H37Rv
guccccccagauccgcagcgu

SEQ ID NO: 3348813 - RNA, 18 nt, Mycobacterium tuberculosis H37Rv
guccccgaaccgagcgga

SEQ ID NO: 3348814 - RNA, 21 nt, Mycobacterium tuberculosis H37Rv
guccccgcagcucgaccagga

SEQ ID NO: 3348815 - RNA, 17 nt, Mycobacterium tuberculosis H37Rv
guccccgcccggccagc

SEQ ID NO: 3348816 - RNA, 16 nt, Mycobacterium tuberculosis H37Rv
guccccgccgucgcca

SEQ ID NO: 3348817 - RNA, 23 nt, Mycobacterium tuberculosis H37Rv
guccccgcuuggcgagccacggc

SEQ ID NO: 3348818 - RNA, 15 nt, Mycobacterium tuberculosis H37Rv
guccccucggugcca

SEQ ID NO: 3348819 - RNA, 19 nt, Mycobacterium tuberculosis H37Rv
guccccucggugccacugc

SEQ ID NO: 3348820 - RNA, 18 nt, Mycobacterium tuberculosis H37Rv
gucccgauacggccggcc

SEQ ID NO: 3348821 - RNA, 19 nt, Mycobacterium tuberculosis H37Rv
gucccgccgcaccgccgca

SEQ ID NO: 3348822 - RNA, 17 nt, Mycobacterium tuberculosis H37Rv
gucccgccgcgcgucgc

SEQ ID NO: 3348823 - RNA, 14 nt, Mycobacterium tuberculosis H37Rv
gucccgcgagcagc

SEQ ID NO: 3348824 - RNA, 19 nt, Mycobacterium tuberculosis H37Rv
gucccgcgagcagcccggc

SEQ ID NO: 3348825 - RNA, 18 nt, Mycobacterium tuberculosis H37Rv
gucccgcgggccagcacc

SEQ ID NO: 3348826 - RNA, 23 nt, Mycobacterium tuberculosis H37Rv
gucccgcuacaccugcggcguca

SEQ ID NO: 3348827 - RNA, 20 nt, Mycobacterium tuberculosis H37Rv
gucccggcgguuggugcagc

SEQ ID NO: 3348828 - RNA, 18 nt, Mycobacterium tuberculosis H37Rv
gucccggcucgagcucgg

SEQ ID NO: 3348829 - RNA, 12 nt, Mycobacterium tuberculosis H37Rv
gucccggcuggg

SEQ ID NO: 3348830 - RNA, 17 nt, Mycobacterium tuberculosis H37Rv
gucccgggcaccgucgg

SEQ ID NO: 3348831 - RNA, 19 nt, Mycobacterium tuberculosis H37Rv
gucccgguguccagccacg

SEQ ID NO: 3348832 - RNA, 19 nt, Mycobacterium tuberculosis H37Rv
gucccgucgaugugcggua

SEQ ID NO: 3348833 - RNA, 18 nt, Mycobacterium tuberculosis H37Rv
gucccgugcgcgcgcagc

SEQ ID NO: 3348834 - RNA, 14 nt, Mycobacterium tuberculosis H37Rv
gucccucggcggcg

SEQ ID NO: 3348835 - RNA, 16 nt, Mycobacterium tuberculosis H37Rv
gucccugaagccagcg

SEQ ID NO: 3348836 - RNA, 18 nt, Mycobacterium tuberculosis H37Rv
gucccugaagccagcgca

SEQ ID NO: 3348837 - RNA, 16 nt, Mycobacterium tuberculosis H37Rv
guccgaaagccgccga

SEQ ID NO: 3348838 - RNA, 14 nt, Mycobacterium tuberculosis H37Rv
guccgaaccgacgu

SEQ ID NO: 3348839 - RNA, 22 nt, Mycobacterium tuberculosis H37Rv
guccgacaccacggaccagcgc

SEQ ID NO: 3348840 - RNA, 17 nt, Mycobacterium tuberculosis H37Rv
guccgacaccggcggca

SEQ ID NO: 3348841 - RNA, 14 nt, Mycobacterium tuberculosis H37Rv
guccgaccagcggc

SEQ ID NO: 3348842 - RNA, 15 nt, Mycobacterium tuberculosis H37Rv
guccgaccagggauc

SEQ ID NO: 3348843 - RNA, 18 nt, Mycobacterium tuberculosis H37Rv
guccucgagugccgccgu

SEQ ID NO: 3348844 - RNA, 16 nt, Mycobacterium tuberculosis H37Rv
guccucgauccgggcg

SEQ ID NO: 3348845 - RNA, 19 nt, Mycobacterium tuberculosis H37Rv
guccucgccgcacgccggc

SEQ ID NO: 3348846 - RNA, 15 nt, Mycobacterium tuberculosis H37Rv
guccucggcgaucac

SEQ ID NO: 3348847 - RNA, 19 nt, Mycobacterium tuberculosis H37Rv
guccucggcggacccggug

SEQ ID NO: 3348848 - RNA, 16 nt, Mycobacterium tuberculosis H37Rv
guccucgggcaggcgg

SEQ ID NO: 3348849 - RNA, 17 nt, Mycobacterium tuberculosis H37Rv
guccucgucggcgucga

SEQ ID NO: 3348850 - RNA, 20 nt, Mycobacterium tuberculosis H37Rv
guccucgucgucgagguccu

SEQ ID NO: 3348851 - RNA, 18 nt, Mycobacterium tuberculosis H37Rv
guccugaaucgguucggc

SEQ ID NO: 3348852 - RNA, 22 nt, Mycobacterium tuberculosis H37Rv
guccugaaucgguucggccaga

SEQ ID NO: 3348853 - RNA, 19 nt, Mycobacterium tuberculosis H37Rv
guccugacgguacagcucc

SEQ ID NO: 3348854 - RNA, 18 nt, Mycobacterium tuberculosis H37Rv
guccugaugacucauccc

SEQ ID NO: 3348855 - RNA, 19 nt, Mycobacterium tuberculosis H37Rv
guccugccaaugcugcagg

SEQ ID NO: 3348856 - RNA, 21 nt, Mycobacterium tuberculosis H37Rv
guccugccagaagaccuggcg

SEQ ID NO: 3348857 - RNA, 21 nt, Mycobacterium tuberculosis H37Rv
guccugccaguccgcagcguc

SEQ ID NO: 3348858 - RNA, 23 nt, Mycobacterium tuberculosis H37Rv
guccugcgagaggugcugcaccu

SEQ ID NO: 3348859 - RNA, 16 nt, Mycobacterium tuberculosis H37Rv
guccugcgccgcacgc

SEQ ID NO: 3348860 - RNA, 14 nt, Mycobacterium tuberculosis H37Rv
guccugcgggaggc

SEQ ID NO: 3348861 - RNA, 19 nt, Mycobacterium tuberculosis H37Rv
guccugcggguaggugacg

SEQ ID NO: 3348862 - RNA, 13 nt, Mycobacterium tuberculosis H37Rv
guccugcggucgc

SEQ ID NO: 3348863 - RNA, 22 nt, Mycobacterium tuberculosis H37Rv
guccugcuuguagcgcaucgcc

SEQ ID NO: 3348864 - RNA, 15 nt, Mycobacterium tuberculosis H37Rv
guccuggaucagcca

SEQ ID NO: 3348865 - RNA, 20 nt, Mycobacterium tuberculosis H37Rv
guccuggcgaacucgcgcag

SEQ ID NO: 3348866 - RNA, 20 nt, Mycobacterium tuberculosis H37Rv
guccuggcguagugcagcug

SEQ ID NO: 3348867 - RNA, 22 nt, Mycobacterium tuberculosis H37Rv
guccuguccgggcugcaugcgg

SEQ ID NO: 3348868 - RNA, 14 nt, Mycobacterium tuberculosis H37Rv
guccuugcgcagca

SEQ ID NO: 3348869 - RNA, 13 nt, Mycobacterium tuberculosis H37Rv
guccuugcggucc

SEQ ID NO: 3348870 - RNA, 18 nt, Mycobacterium tuberculosis H37Rv
guccuuuuccgccgggcu

SEQ ID NO: 3348871 - RNA, 21 nt, Mycobacterium tuberculosis H37Rv
gucgaaauggauugcggcacg

SEQ ID NO: 3348872 - RNA, 16 nt, Mycobacterium tuberculosis H37Rv
gucgaacaccguccaa

SEQ ID NO: 3348873 - RNA, 14 nt, Mycobacterium tuberculosis H37Rv
gucgaacacgucgg

SEQ ID NO: 3348874 - RNA, 22 nt, Mycobacterium tuberculosis H37Rv
gucgaacagcaccgccggcgac

SEQ ID NO: 3348875 - RNA, 19 nt, Mycobacterium tuberculosis H37Rv
gucgaacaggaucagcgac

SEQ ID NO: 3348876 - RNA, 22 nt, Mycobacterium tuberculosis H37Rv
gucgaacaggccggccgcgauc

SEQ ID NO: 3348877 - RNA, 14 nt, Mycobacterium tuberculosis H37Rv
gucgaacaucaucg

SEQ ID NO: 3348878 - RNA, 22 nt, Mycobacterium tuberculosis H37Rv
gucgaacaugauccgccggcaa

SEQ ID NO: 3348879 - RNA, 13 nt, Mycobacterium tuberculosis H37Rv
gucgaaccaggua

SEQ ID NO: 3348880 - RNA, 17 nt, Mycobacterium tuberculosis H37Rv
gucgaaccaguccucgg

SEQ ID NO: 3348881 - RNA, 19 nt, Mycobacterium tuberculosis H37Rv
gucgaaccaguccucgggc

SEQ ID NO: 3348882 - RNA, 17 nt, Mycobacterium tuberculosis H37Rv
gucgaaccuaccgugua

SEQ ID NO: 3348883 - RNA, 21 nt, Mycobacterium tuberculosis H37Rv
gucgaacgcaugcucgaucgc

SEQ ID NO: 3348884 - RNA, 12 nt, Mycobacterium tuberculosis H37Rv
gucgaacgcccc

SEQ ID NO: 3348885 - RNA, 16 nt, Mycobacterium tuberculosis H37Rv
gucgaacgcguugacc

SEQ ID NO: 3348886 - RNA, 20 nt, Mycobacterium tuberculosis H37Rv
gucgaacgguagcacggucu

SEQ ID NO: 3348887 - RNA, 20 nt, Mycobacterium tuberculosis H37Rv
gucgaacucgccccgcgugu

SEQ ID NO: 3348888 - RNA, 18 nt, Mycobacterium tuberculosis H37Rv
gucgaacuucagcggcgg

SEQ ID NO: 3348889 - RNA, 21 nt, Mycobacterium tuberculosis H37Rv
gucgaacuuugucgcgcugcu

SEQ ID NO: 3348890 - RNA, 20 nt, Mycobacterium tuberculosis H37Rv
gucgaagaauaugccgauga

SEQ ID NO: 3348891 - RNA, 13 nt, Mycobacterium tuberculosis H37Rv
gucgaagagcagg

SEQ ID NO: 3348892 - RNA, 17 nt, Mycobacterium tuberculosis H37Rv
gucgaagaucgccuggg

SEQ ID NO: 3348893 - RNA, 14 nt, Mycobacterium tuberculosis H37Rv
gucgaagcacaugc

SEQ ID NO: 3348894 - RNA, 19 nt, Mycobacterium tuberculosis H37Rv
gucgaagcacaugccgaac

SEQ ID NO: 3348895 - RNA, 20 nt, Mycobacterium tuberculosis H37Rv
gucgaagccccucaccucgg

SEQ ID NO: 3348896 - RNA, 12 nt, Mycobacterium tuberculosis H37Rv
gucgaaguggua

SEQ ID NO: 3348897 - RNA, 22 nt, Mycobacterium tuberculosis H37Rv
gucgaaguuggcgaagcccgac

SEQ ID NO: 3348898 - RNA, 19 nt, Mycobacterium tuberculosis H37Rv
gucgaauaguugaccaggc

SEQ ID NO: 3348899 - RNA, 16 nt, Mycobacterium tuberculosis H37Rv
gucgacaaacagcgcc

SEQ ID NO: 3348900 - RNA, 20 nt, Mycobacterium tuberculosis H37Rv
gucgacaagccgucggcgau

SEQ ID NO: 3348901 - RNA, 19 nt, Mycobacterium tuberculosis H37Rv
gucgacaccgaggaccucg

SEQ ID NO: 3348902 - RNA, 23 nt, Mycobacterium tuberculosis H37Rv
gucgacaccgaggaccucgucac

SEQ ID NO: 3348903 - RNA, 15 nt, Mycobacterium tuberculosis H37Rv
gucgacacggugauc

SEQ ID NO: 3348904 - RNA, 15 nt, Mycobacterium tuberculosis H37Rv
gucgacagcgaaggc

SEQ ID NO: 3348905 - RNA, 20 nt, Mycobacterium tuberculosis H37Rv
gucgacagcgaaggcgccga

SEQ ID NO: 3348906 - RNA, 18 nt, Mycobacterium tuberculosis H37Rv
gucgacagcgucucgccg

SEQ ID NO: 3348907 - RNA, 20 nt, Mycobacterium tuberculosis H37Rv
gucgacaggugccagaccag

SEQ ID NO: 3348908 - RNA, 23 nt, Mycobacterium tuberculosis H37Rv
gucgacaggugccagaccagggc

SEQ ID NO: 3348909 - RNA, 22 nt, Mycobacterium tuberculosis H37Rv
gucgacagucaacagggccagg

SEQ ID NO: 3348910 - RNA, 17 nt, Mycobacterium tuberculosis H37Rv
gucgacaguucaacggg

SEQ ID NO: 3348911 - RNA, 15 nt, Mycobacterium tuberculosis H37Rv
gucgacaucggugac

SEQ ID NO: 3348912 - RNA, 20 nt, Mycobacterium tuberculosis H37Rv
gucgaccaagguguccagca

SEQ ID NO: 3348913 - RNA, 20 nt, Mycobacterium tuberculosis H37Rv
gucgaccaauaccaguccgu

SEQ ID NO: 3348914 - RNA, 22 nt, Mycobacterium tuberculosis H37Rv
gucgaccacgacguucgacgac

SEQ ID NO: 3348915 - RNA, 14 nt, Mycobacterium tuberculosis H37Rv
gucgaccaggccac

SEQ ID NO: 3348916 - RNA, 18 nt, Mycobacterium tuberculosis H37Rv
gucgacccaacgcagauc

SEQ ID NO: 3348917 - RNA, 14 nt, Mycobacterium tuberculosis H37Rv
gucgacccaccaug

SEQ ID NO: 3348918 - RNA, 12 nt, Mycobacterium tuberculosis H37Rv
gucgacccagca

SEQ ID NO: 3348919 - RNA, 15 nt, Mycobacterium tuberculosis H37Rv
gucgacccagcgcgc

SEQ ID NO: 3348920 - RNA, 16 nt, Mycobacterium tuberculosis H37Rv
gucgacccagcgcgcg

SEQ ID NO: 3348921 - RNA, 23 nt, Mycobacterium tuberculosis H37Rv
gucgacccccugccacagcgaca

SEQ ID NO: 3348922 - RNA, 19 nt, Mycobacterium tuberculosis H37Rv
gucgaccccugaaucaccg

SEQ ID NO: 3348923 - RNA, 15 nt, Mycobacterium tuberculosis H37Rv
gucgaccgccgagau

SEQ ID NO: 3348924 - RNA, 17 nt, Mycobacterium tuberculosis H37Rv
gucgaccgcggcccgga

SEQ ID NO: 3348925 - RNA, 17 nt, Mycobacterium tuberculosis H37Rv
gucgacgaacucgccca

SEQ ID NO: 3348926 - RNA, 14 nt, Mycobacterium tuberculosis H37Rv
gucgacgaaucugc

SEQ ID NO: 3348927 - RNA, 16 nt, Mycobacterium tuberculosis H37Rv
gucgacgacaacgaug

SEQ ID NO: 3348928 - RNA, 22 nt, Mycobacterium tuberculosis H37Rv
gucgacgacauacgagcaguga

SEQ ID NO: 3348929 - RNA, 14 nt, Mycobacterium tuberculosis H37Rv
gucgacgacgucgc

SEQ ID NO: 3348930 - RNA, 16 nt, Mycobacterium tuberculosis H37Rv
gucgacgacgucgcgc

SEQ ID NO: 3348931 - RNA, 16 nt, Mycobacterium tuberculosis H37Rv
gucgacgacguggcug

SEQ ID NO: 3348932 - RNA, 13 nt, Mycobacterium tuberculosis H37Rv
gucgacgaucguc

SEQ ID NO: 3348933 - RNA, 15 nt, Mycobacterium tuberculosis H37Rv
gucgacgaucgucuu

SEQ ID NO: 3348934 - RNA, 18 nt, Mycobacterium tuberculosis H37Rv
gucgacgaucucgccggc

SEQ ID NO: 3348935 - RNA, 23 nt, Mycobacterium tuberculosis H37Rv
gucgacgaugucggcaccauagc

SEQ ID NO: 3348936 - RNA, 18 nt, Mycobacterium tuberculosis H37Rv
gucgacgauucccgcgga

SEQ ID NO: 3348937 - RNA, 14 nt, Mycobacterium tuberculosis H37Rv
gucgacgcaugggu

SEQ ID NO: 3348938 - RNA, 12 nt, Mycobacterium tuberculosis H37Rv
gucgacgccgac

SEQ ID NO: 3348939 - RNA, 21 nt, Mycobacterium tuberculosis H37Rv
gucgccggcacacccaucagc

SEQ ID NO: 3348940 - RNA, 18 nt, Mycobacterium tuberculosis H37Rv
gucgccggcauacaccgu

SEQ ID NO: 3348941 - RNA, 14 nt, Mycobacterium tuberculosis H37Rv
gucgccggccuuga

SEQ ID NO: 3348942 - RNA, 18 nt, Mycobacterium tuberculosis H37Rv
gucgccggcgucgagccg

SEQ ID NO: 3348943 - RNA, 14 nt, Mycobacterium tuberculosis H37Rv
gucgccggcugggg

SEQ ID NO: 3348944 - RNA, 18 nt, Mycobacterium tuberculosis H37Rv
gucgccggucaggccgcc

SEQ ID NO: 3348945 - RNA, 14 nt, Mycobacterium tuberculosis H37Rv
gucgccggucaucg

SEQ ID NO: 3348946 - RNA, 12 nt, Mycobacterium tuberculosis H37Rv
gucgccggugcc

SEQ ID NO: 3348947 - RNA, 16 nt, Mycobacterium tuberculosis H37Rv
gucgccguccagucgg

SEQ ID NO: 3348948 - RNA, 18 nt, Mycobacterium tuberculosis H37Rv
gucgccgucgugccaccg

SEQ ID NO: 3348949 - RNA, 21 nt, Mycobacterium tuberculosis H37Rv
gucgccucaccggcgcgagca

SEQ ID NO: 3348950 - RNA, 13 nt, Mycobacterium tuberculosis H37Rv
gucgccuccagca

SEQ ID NO: 3348951 - RNA, 20 nt, Mycobacterium tuberculosis H37Rv
gucgccuccucgugcaggac

SEQ ID NO: 3348952 - RNA, 20 nt, Mycobacterium tuberculosis H37Rv
gucgccuccugccgccgcuc

SEQ ID NO: 3348953 - RNA, 20 nt, Mycobacterium tuberculosis H37Rv
gucgccugcccccgcgcgca

SEQ ID NO: 3348954 - RNA, 18 nt, Mycobacterium tuberculosis H37Rv
gucgccuucggguucggu

SEQ ID NO: 3348955 - RNA, 21 nt, Mycobacterium tuberculosis H37Rv
gucgccuucguaaccacgacg

SEQ ID NO: 3348956 - RNA, 20 nt, Mycobacterium tuberculosis H37Rv
gucgccuucuuggcaggugc

SEQ ID NO: 3348957 - RNA, 22 nt, Mycobacterium tuberculosis H37Rv
gucgcgaaauagcugcggaggg

SEQ ID NO: 3348958 - RNA, 13 nt, Mycobacterium tuberculosis H37Rv
gucgcgacgucgg

SEQ ID NO: 3348959 - RNA, 23 nt, Mycobacterium tuberculosis H37Rv
gucgcgagcccgccacagcccca

SEQ ID NO: 3348960 - RNA, 17 nt, Mycobacterium tuberculosis H37Rv
gucgcgauagccgccgc

SEQ ID NO: 3348961 - RNA, 22 nt, Mycobacterium tuberculosis H37Rv
gucgcgaugcucaaugugccgc

SEQ ID NO: 3348962 - RNA, 15 nt, Mycobacterium tuberculosis H37Rv
gucgcgaugcuuccc

SEQ ID NO: 3348963 - RNA, 14 nt, Mycobacterium tuberculosis H37Rv
gucgcgauugccgc

SEQ ID NO: 3348964 - RNA, 17 nt, Mycobacterium tuberculosis H37Rv
gucgcgcagcuccaccg

SEQ ID NO: 3348965 - RNA, 13 nt, Mycobacterium tuberculosis H37Rv
gucgcgccaggcu

SEQ ID NO: 3348966 - RNA, 16 nt, Mycobacterium tuberculosis H37Rv
gucgcgcccucagccg

SEQ ID NO: 3348967 - RNA, 15 nt, Mycobacterium tuberculosis H37Rv
gucgcgcgaccuggu

SEQ ID NO: 3348968 - RNA, 17 nt, Mycobacterium tuberculosis H37Rv
gucgcgcgaccuggucg

SEQ ID NO: 3348969 - RNA, 22 nt, Mycobacterium tuberculosis H37Rv
gucgcgcgccaagacgaacagc

SEQ ID NO: 3348970 - RNA, 14 nt, Mycobacterium tuberculosis H37Rv
gucgcgcgcucgcg

SEQ ID NO: 3348971 - RNA, 16 nt, Mycobacterium tuberculosis H37Rv
gucgcgcggcaccgau

SEQ ID NO: 3348972 - RNA, 17 nt, Mycobacterium tuberculosis H37Rv
gucgcgcuaaggugggc

SEQ ID NO: 3348973 - RNA, 14 nt, Mycobacterium tuberculosis H37Rv
gucgcgcugaaggu

SEQ ID NO: 3348974 - RNA, 14 nt, Mycobacterium tuberculosis H37Rv
gucgcgcugccggc

SEQ ID NO: 3348975 - RNA, 15 nt, Mycobacterium tuberculosis H37Rv
gucgcgcugccggcc

SEQ ID NO: 3348976 - RNA, 14 nt, Mycobacterium tuberculosis H37Rv
gucgcggacccgcg

SEQ ID NO: 3348977 - RNA, 14 nt, Mycobacterium tuberculosis H37Rv
gucgcggagaacgc

SEQ ID NO: 3348978 - RNA, 19 nt, Mycobacterium tuberculosis H37Rv
gucgcggagaacgcgucgc

SEQ ID NO: 3348979 - RNA, 12 nt, Mycobacterium tuberculosis H37Rv
gucgcggccaag

SEQ ID NO: 3348980 - RNA, 16 nt, Mycobacterium tuberculosis H37Rv
gucgcggccacgguca

SEQ ID NO: 3348981 - RNA, 18 nt, Mycobacterium tuberculosis H37Rv
gucgcggccacggucagc

SEQ ID NO: 3348982 - RNA, 15 nt, Mycobacterium tuberculosis H37Rv
gucgcggccagcagg

SEQ ID NO: 3348983 - RNA, 16 nt, Mycobacterium tuberculosis H37Rv
gucgcggccggcggcc

SEQ ID NO: 3348984 - RNA, 22 nt, Mycobacterium tuberculosis H37Rv
gucgcggccgucgcgggacaac

SEQ ID NO: 3348985 - RNA, 12 nt, Mycobacterium tuberculosis H37Rv
gucgcggccucg

SEQ ID NO: 3348986 - RNA, 13 nt, Mycobacterium tuberculosis H37Rv
gucgcggcggucc

SEQ ID NO: 3348987 - RNA, 15 nt, Mycobacterium tuberculosis H37Rv
gucgcggcguucggc

SEQ ID NO: 3348988 - RNA, 19 nt, Mycobacterium tuberculosis H37Rv
gucgcggcuauggcgccgc

SEQ ID NO: 3348989 - RNA, 21 nt, Mycobacterium tuberculosis H37Rv
gucgcggcuauggcgccgcgg

SEQ ID NO: 3348990 - RNA, 22 nt, Mycobacterium tuberculosis H37Rv
gucgcgggccaagccggagccc

SEQ ID NO: 3348991 - RNA, 18 nt, Mycobacterium tuberculosis H37Rv
gucgcgggccaccaccga

SEQ ID NO: 3348992 - RNA, 21 nt, Mycobacterium tuberculosis H37Rv
gucgcgggcgauggcgagcug

SEQ ID NO: 3348993 - RNA, 15 nt, Mycobacterium tuberculosis H37Rv
gucgcggguccaggc

SEQ ID NO: 3348994 - RNA, 16 nt, Mycobacterium tuberculosis H37Rv
gucgcggguggcuucc

SEQ ID NO: 3348995 - RNA, 15 nt, Mycobacterium tuberculosis H37Rv
gucgcggguguucca

SEQ ID NO: 3348996 - RNA, 21 nt, Mycobacterium tuberculosis H37Rv
gucgcgguaccaucaccgcgc

SEQ ID NO: 3348997 - RNA, 23 nt, Mycobacterium tuberculosis H37Rv
gucgcgguagccuggcuguccgc

SEQ ID NO: 3348998 - RNA, 15 nt, Mycobacterium tuberculosis H37Rv
gucgcgguggcggcg

SEQ ID NO: 3348999 - RNA, 20 nt, Mycobacterium tuberculosis H37Rv
gucgcgguggcggcggugcc

SEQ ID NO: 3349000 - RNA, 13 nt, Mycobacterium tuberculosis H37Rv
gucgcgguggugg

SEQ ID NO: 3349001 - RNA, 22 nt, Mycobacterium tuberculosis H37Rv
gucgcguccacccacgaucagc

SEQ ID NO: 3349002 - RNA, 23 nt, Mycobacterium tuberculosis H37Rv
gucgcgucgcaggauucccaguc

SEQ ID NO: 3349003 - RNA, 16 nt, Mycobacterium tuberculosis H37Rv
gucgcgucggcugccg

SEQ ID NO: 3349004 - RNA, 12 nt, Mycobacterium tuberculosis H37Rv
gucgcguucggc

SEQ ID NO: 3349005 - RNA, 18 nt, Mycobacterium tuberculosis H37Rv
gucgcguuguggcugaau

SEQ ID NO: 3349006 - RNA, 20 nt, Mycobacterium tuberculosis H37Rv
gucgcucacggcccgagccg

SEQ ID NO: 3349007 - RNA, 21 nt, Mycobacterium tuberculosis H37Rv
gucgcucacggcccgagccgc

SEQ ID NO: 3349008 - RNA, 14 nt, Mycobacterium tuberculosis H37Rv
gucgcucgucguca

SEQ ID NO: 3349009 - RNA, 16 nt, Mycobacterium tuberculosis H37Rv
gucgcugaacagacgg

SEQ ID NO: 3349010 - RNA, 17 nt, Mycobacterium tuberculosis H37Rv
gucgcugaagccgucgu

SEQ ID NO: 3349011 - RNA, 18 nt, Mycobacterium tuberculosis H37Rv
gucgcugaagccgucgua

SEQ ID NO: 3349012 - RNA, 18 nt, Mycobacterium tuberculosis H37Rv
gucgcugagcacggcgcg

SEQ ID NO: 3349013 - RNA, 15 nt, Mycobacterium tuberculosis H37Rv
gucgcugauccgggc

SEQ ID NO: 3349014 - RNA, 13 nt, Mycobacterium tuberculosis H37Rv
gucgcugaugagc

SEQ ID NO: 3349015 - RNA, 19 nt, Mycobacterium tuberculosis H37Rv
gucgcugcccgcggugugc

SEQ ID NO: 3349016 - RNA, 21 nt, Mycobacterium tuberculosis H37Rv
gucgcugccgccgccggcggu

SEQ ID NO: 3349017 - RNA, 20 nt, Mycobacterium tuberculosis H37Rv
gucgcugcggcgcuggccag

SEQ ID NO: 3349018 - RNA, 20 nt, Mycobacterium tuberculosis H37Rv
gucgcugcugaacaaccagc

SEQ ID NO: 3349019 - RNA, 16 nt, Mycobacterium tuberculosis H37Rv
gucgcugggugcgcga

SEQ ID NO: 3349020 - RNA, 22 nt, Mycobacterium tuberculosis H37Rv
gucgcuggugggaucgcagcgc

SEQ ID NO: 3349021 - RNA, 19 nt, Mycobacterium tuberculosis H37Rv
gucgcugugcagcggguug

SEQ ID NO: 3349022 - RNA, 21 nt, Mycobacterium tuberculosis H37Rv
gucggaauacaacagcugggu

SEQ ID NO: 3349023 - RNA, 16 nt, Mycobacterium tuberculosis H37Rv
gucggaaugggcgcca

SEQ ID NO: 3349024 - RNA, 22 nt, Mycobacterium tuberculosis H37Rv
gucggacagcgucucggaggcg

SEQ ID NO: 3349025 - RNA, 16 nt, Mycobacterium tuberculosis H37Rv
gucggacauaccgcga

SEQ ID NO: 3349026 - RNA, 19 nt, Mycobacterium tuberculosis H37Rv
gucggaccagcugccggcg

SEQ ID NO: 3349027 - RNA, 18 nt, Mycobacterium tuberculosis H37Rv
gucggaccucgcccauga

SEQ ID NO: 3349028 - RNA, 16 nt, Mycobacterium tuberculosis H37Rv
gucggagagcaugcgg

SEQ ID NO: 3349029 - RNA, 18 nt, Mycobacterium tuberculosis H37Rv
gucggagagcaugcggga

SEQ ID NO: 3349030 - RNA, 16 nt, Mycobacterium tuberculosis H37Rv
gucggagccggccacc

SEQ ID NO: 3349031 - RNA, 23 nt, Mycobacterium tuberculosis H37Rv
gucggaggugaaccccgccggca

SEQ ID NO: 3349032 - RNA, 19 nt, Mycobacterium tuberculosis H37Rv
gucggagucuucgucgucg

SEQ ID NO: 3349033 - RNA, 22 nt, Mycobacterium tuberculosis H37Rv
gucggcaacccacacgcccucg

SEQ ID NO: 3349034 - RNA, 16 nt, Mycobacterium tuberculosis H37Rv
gucggcaacgacccgc

SEQ ID NO: 3349035 - RNA, 20 nt, Mycobacterium tuberculosis H37Rv
gucgggcagcugguagguca

SEQ ID NO: 3349036 - RNA, 14 nt, Mycobacterium tuberculosis H37Rv
gucgggcaugacga

SEQ ID NO: 3349037 - RNA, 14 nt, Mycobacterium tuberculosis H37Rv
gucgggccaggcga

SEQ ID NO: 3349038 - RNA, 17 nt, Mycobacterium tuberculosis H37Rv
gucgggcccagccggac

SEQ ID NO: 3349039 - RNA, 15 nt, Mycobacterium tuberculosis H37Rv
gucgggccugccgga

SEQ ID NO: 3349040 - RNA, 16 nt, Mycobacterium tuberculosis H37Rv
gucgggccugccggag

SEQ ID NO: 3349041 - RNA, 14 nt, Mycobacterium tuberculosis H37Rv
gucgggcggcgucg

SEQ ID NO: 3349042 - RNA, 17 nt, Mycobacterium tuberculosis H37Rv
gucgggcggcgucgaac

SEQ ID NO: 3349043 - RNA, 15 nt, Mycobacterium tuberculosis H37Rv
gucgggcgugucggg

SEQ ID NO: 3349044 - RNA, 19 nt, Mycobacterium tuberculosis H37Rv
gucgggcuaauccagcagc

SEQ ID NO: 3349045 - RNA, 22 nt, Mycobacterium tuberculosis H37Rv
gucgggcucgcauucggcgagc

SEQ ID NO: 3349046 - RNA, 22 nt, Mycobacterium tuberculosis H37Rv
gucgggcuugacccuugggcac

SEQ ID NO: 3349047 - RNA, 16 nt, Mycobacterium tuberculosis H37Rv
gucggggaacgcggcg

SEQ ID NO: 3349048 - RNA, 20 nt, Mycobacterium tuberculosis H37Rv
gucggggaagacgaccgugc

SEQ ID NO: 3349049 - RNA, 22 nt, Mycobacterium tuberculosis H37Rv
gucggggaagacgaccgugcug

SEQ ID NO: 3349050 - RNA, 17 nt, Mycobacterium tuberculosis H37Rv
gucggggagcugcggcg

SEQ ID NO: 3349051 - RNA, 20 nt, Mycobacterium tuberculosis H37Rv
gucggggagcugcggcggcc

SEQ ID NO: 3349052 - RNA, 20 nt, Mycobacterium tuberculosis H37Rv
gucggggccgcaggccaggg

SEQ ID NO: 3349053 - RNA, 22 nt, Mycobacterium tuberculosis H37Rv
gucgggggcuuaugcgucugcu

SEQ ID NO: 3349054 - RNA, 22 nt, Mycobacterium tuberculosis H37Rv
gucgggguacagacacgcgcgc

SEQ ID NO: 3349055 - RNA, 21 nt, Mycobacterium tuberculosis H37Rv
gucggggucguugaggccggu

SEQ ID NO: 3349056 - RNA, 23 nt, Mycobacterium tuberculosis H37Rv
gucgggguuuaguuuaucggccg

SEQ ID NO: 3349057 - RNA, 19 nt, Mycobacterium tuberculosis H37Rv
gucgggguuucaggcggca

SEQ ID NO: 3349058 - RNA, 15 nt, Mycobacterium tuberculosis H37Rv
gucggguaggccgcc

SEQ ID NO: 3349059 - RNA, 17 nt, Mycobacterium tuberculosis H37Rv
gucggguagugcccaca

SEQ ID NO: 3349060 - RNA, 20 nt, Mycobacterium tuberculosis H37Rv
gucgggucaaugcuggcagc

SEQ ID NO: 3349061 - RNA, 17 nt, Mycobacterium tuberculosis H37Rv
gucgggucgaucaccga

SEQ ID NO: 3349062 - RNA, 22 nt, Mycobacterium tuberculosis H37Rv
gucgggucgcaccccggcggcg

SEQ ID NO: 3349063 - RNA, 17 nt, Mycobacterium tuberculosis H37Rv
gucgggugcagcacggc

SEQ ID NO: 3349064 - RNA, 13 nt, Mycobacterium tuberculosis H37Rv
gucggguggcugc

SEQ ID NO: 3349065 - RNA, 16 nt, Mycobacterium tuberculosis H37Rv
gucgggugugcgcaga

SEQ ID NO: 3349066 - RNA, 17 nt, Mycobacterium tuberculosis H37Rv
gucggguugcgacgaac

SEQ ID NO: 3349067 - RNA, 21 nt, Mycobacterium tuberculosis H37Rv
gucggguugguuggcucgcug

SEQ ID NO: 3349068 - RNA, 23 nt, Mycobacterium tuberculosis H37Rv
gucggguugguuggcucgcuggg

SEQ ID NO: 3349069 - RNA, 15 nt, Mycobacterium tuberculosis H37Rv
gucggguuuggccga

SEQ ID NO: 3349070 - RNA, 18 nt, Mycobacterium tuberculosis H37Rv
gucggucaaaccggugcc

SEQ ID NO: 3349071 - RNA, 20 nt, Mycobacterium tuberculosis H37Rv
gucggucaccauggcgccgc

SEQ ID NO: 3349072 - RNA, 23 nt, Mycobacterium tuberculosis H37Rv
gucggucaccgaaugcgggucug

SEQ ID NO: 3349073 - RNA, 18 nt, Mycobacterium tuberculosis H37Rv
gucggucacgacggcacg

SEQ ID NO: 3349074 - RNA, 22 nt, Mycobacterium tuberculosis H37Rv
gucggucagcugugcgacccgc

SEQ ID NO: 3349075 - RNA, 18 nt, Mycobacterium tuberculosis H37Rv
gucggucaucgguugacc

SEQ ID NO: 3349076 - RNA, 12 nt, Mycobacterium tuberculosis H37Rv
gucgguccacuu

SEQ ID NO: 3349077 - RNA, 18 nt, Mycobacterium tuberculosis H37Rv
gucggucgcuucagcgcc

SEQ ID NO: 3349078 - RNA, 22 nt, Mycobacterium tuberculosis H37Rv
gucggucggaucggcgccgcau

SEQ ID NO: 3349079 - RNA, 23 nt, Mycobacterium tuberculosis H37Rv
gucggucggaucggcgccgcaua

SEQ ID NO: 3349080 - RNA, 21 nt, Mycobacterium tuberculosis H37Rv
gucggugaaaugacggcugaa

SEQ ID NO: 3349081 - RNA, 22 nt, Mycobacterium tuberculosis H37Rv
gucggugaaaugacggcugaac

SEQ ID NO: 3349082 - RNA, 17 nt, Mycobacterium tuberculosis H37Rv
gucggugaccguucggc

SEQ ID NO: 3349083 - RNA, 18 nt, Mycobacterium tuberculosis H37Rv
gucggugaccucggcgac

SEQ ID NO: 3349084 - RNA, 23 nt, Mycobacterium tuberculosis H37Rv
gucggugagccgugccgccagca

SEQ ID NO: 3349085 - RNA, 19 nt, Mycobacterium tuberculosis H37Rv
gucggugaggaagcggccg

SEQ ID NO: 3349086 - RNA, 22 nt, Mycobacterium tuberculosis H37Rv
gucggugaggaagcggccggug

SEQ ID NO: 3349087 - RNA, 17 nt, Mycobacterium tuberculosis H37Rv
gucggugaggucgaugc

SEQ ID NO: 3349088 - RNA, 19 nt, Mycobacterium tuberculosis H37Rv
gucggugccgccgccggcg

SEQ ID NO: 3349089 - RNA, 22 nt, Mycobacterium tuberculosis H37Rv
gucggugccgcggacguggucg

SEQ ID NO: 3349090 - RNA, 12 nt, Mycobacterium tuberculosis H37Rv
gucggugccggg

SEQ ID NO: 3349091 - RNA, 17 nt, Mycobacterium tuberculosis H37Rv
gucggugcgcgcagacu

SEQ ID NO: 3349092 - RNA, 18 nt, Mycobacterium tuberculosis H37Rv
gucggugcgcgcggcgac

SEQ ID NO: 3349093 - RNA, 10 nt, Mycobacterium tuberculosis H37Rv
gucggugcgg

SEQ ID NO: 3349094 - RNA, 20 nt, Mycobacterium tuberculosis H37Rv
gucggugcggaacacgaugc

SEQ ID NO: 3349095 - RNA, 15 nt, Mycobacterium tuberculosis H37Rv
gucggugcggugcac

SEQ ID NO: 3349096 - RNA, 21 nt, Mycobacterium tuberculosis H37Rv
gucgguggccgcggcggucug

SEQ ID NO: 3349097 - RNA, 19 nt, Mycobacterium tuberculosis H37Rv
gucggugguaccggcggcg

SEQ ID NO: 3349098 - RNA, 20 nt, Mycobacterium tuberculosis H37Rv
gucgguggucucggcaucca

SEQ ID NO: 3349099 - RNA, 16 nt, Mycobacterium tuberculosis H37Rv
gucggugucgguucgg

SEQ ID NO: 3349100 - RNA, 18 nt, Mycobacterium tuberculosis H37Rv
gucggugugcaucgccgg

SEQ ID NO: 3349101 - RNA, 21 nt, Mycobacterium tuberculosis H37Rv
gucgguguuuggccgccgaau

SEQ ID NO: 3349102 - RNA, 20 nt, Mycobacterium tuberculosis H37Rv
gucgguucagccacgcagca

SEQ ID NO: 3349103 - RNA, 19 nt, Mycobacterium tuberculosis H37Rv
gucgguugauugugcccag

SEQ ID NO: 3349104 - RNA, 20 nt, Mycobacterium tuberculosis H37Rv
gucgguuuccuccggcagca

SEQ ID NO: 3349105 - RNA, 17 nt, Mycobacterium tuberculosis H37Rv
gucguacaugggcagau

SEQ ID NO: 3349106 - RNA, 16 nt, Mycobacterium tuberculosis H37Rv
gucguacccggcaacg

SEQ ID NO: 3349107 - RNA, 18 nt, Mycobacterium tuberculosis H37Rv
gucguacccggcaacggg

SEQ ID NO: 3349108 - RNA, 16 nt, Mycobacterium tuberculosis H37Rv
gucguaccgcggaucg

SEQ ID NO: 3349109 - RNA, 15 nt, Mycobacterium tuberculosis H37Rv
gucguaccgcucggc

SEQ ID NO: 3349110 - RNA, 19 nt, Mycobacterium tuberculosis H37Rv
gucguaccgcucggcggca

SEQ ID NO: 3349111 - RNA, 15 nt, Mycobacterium tuberculosis H37Rv
gucguaccggccuuc

SEQ ID NO: 3349112 - RNA, 16 nt, Mycobacterium tuberculosis H37Rv
gucguacucggcggcc

SEQ ID NO: 3349113 - RNA, 14 nt, Mycobacterium tuberculosis H37Rv
gucguagacggcga

SEQ ID NO: 3349114 - RNA, 16 nt, Mycobacterium tuberculosis H37Rv
gucguagacgguuacc

SEQ ID NO: 3349115 - RNA, 19 nt, Mycobacterium tuberculosis H37Rv
gucguagagauacgggaac

SEQ ID NO: 3349116 - RNA, 20 nt, Mycobacterium tuberculosis H37Rv
gucguagaggugccuuugga

SEQ ID NO: 3349117 - RNA, 19 nt, Mycobacterium tuberculosis H37Rv
gucguagcucgguaggccg

SEQ ID NO: 3349118 - RNA, 14 nt, Mycobacterium tuberculosis H37Rv
gucguaggcgauga

SEQ ID NO: 3349119 - RNA, 15 nt, Mycobacterium tuberculosis H37Rv
gucguagucgucggc

SEQ ID NO: 3349120 - RNA, 15 nt, Mycobacterium tuberculosis H37Rv
gucguaugcggugac

SEQ ID NO: 3349121 - RNA, 21 nt, Mycobacterium tuberculosis H37Rv
gucgucaaacacucugaucug

SEQ ID NO: 3349122 - RNA, 17 nt, Mycobacterium tuberculosis H37Rv
gucgucacggaccgcca

SEQ ID NO: 3349123 - RNA, 17 nt, Mycobacterium tuberculosis H37Rv
gucgucauccuggucac

SEQ ID NO: 3349124 - RNA, 15 nt, Mycobacterium tuberculosis H37Rv
gucgucccagggcug

SEQ ID NO: 3349125 - RNA, 18 nt, Mycobacterium tuberculosis H37Rv
gucgucccagggcugccg

SEQ ID NO: 3349126 - RNA, 19 nt, Mycobacterium tuberculosis H37Rv
gucgucccgauggcggugg

SEQ ID NO: 3349127 - RNA, 15 nt, Mycobacterium tuberculosis H37Rv
gucguccgacgggcc

SEQ ID NO: 3349128 - RNA, 18 nt, Mycobacterium tuberculosis H37Rv
gucguccgccgcagcgca

SEQ ID NO: 3349129 - RNA, 21 nt, Mycobacterium tuberculosis H37Rv
gucguccgcgccaguggccac

SEQ ID NO: 3349130 - RNA, 17 nt, Mycobacterium tuberculosis H37Rv
gucucggggugcacgau

SEQ ID NO: 3349131 - RNA, 16 nt, Mycobacterium tuberculosis H37Rv
gucucgucgccccguu

SEQ ID NO: 3349132 - RNA, 13 nt, Mycobacterium tuberculosis H37Rv
gucucugacgaau

SEQ ID NO: 3349133 - RNA, 17 nt, Mycobacterium tuberculosis H37Rv
gucugacagaccgggca

SEQ ID NO: 3349134 - RNA, 15 nt, Mycobacterium tuberculosis H37Rv
gucugacccaccgcc

SEQ ID NO: 3349135 - RNA, 19 nt, Mycobacterium tuberculosis H37Rv
gucugaccgguucccgggc

SEQ ID NO: 3349136 - RNA, 13 nt, Mycobacterium tuberculosis H37Rv
gucugacgaaucg

SEQ ID NO: 3349137 - RNA, 14 nt, Mycobacterium tuberculosis H37Rv
gucugaucggcuuc

SEQ ID NO: 3349138 - RNA, 21 nt, Mycobacterium tuberculosis H37Rv
gucugcacguacucggccagc

SEQ ID NO: 3349139 - RNA, 15 nt, Mycobacterium tuberculosis H37Rv
gucugcagacggucc

SEQ ID NO: 3349140 - RNA, 14 nt, Mycobacterium tuberculosis H37Rv
gucugccacgucgg

SEQ ID NO: 3349141 - RNA, 14 nt, Mycobacterium tuberculosis H37Rv
gucugccagcaccc

SEQ ID NO: 3349142 - RNA, 12 nt, Mycobacterium tuberculosis H37Rv
gucugccaggcg

SEQ ID NO: 3349143 - RNA, 14 nt, Mycobacterium tuberculosis H37Rv
gucugcccaguguc

SEQ ID NO: 3349144 - RNA, 19 nt, Mycobacterium tuberculosis H37Rv
gucugcccgauacccggug

SEQ ID NO: 3349145 - RNA, 14 nt, Mycobacterium tuberculosis H37Rv
gucugcccgcccag

SEQ ID NO: 3349146 - RNA, 16 nt, Mycobacterium tuberculosis H37Rv
gucugcccgcccagcc

SEQ ID NO: 3349147 - RNA, 14 nt, Mycobacterium tuberculosis H37Rv
gucugcccgcgcuc

SEQ ID NO: 3349148 - RNA, 13 nt, Mycobacterium tuberculosis H37Rv
gucugcgccgccg

SEQ ID NO: 3349149 - RNA, 23 nt, Mycobacterium tuberculosis H37Rv
gucugcgccuucgccagcggcgc

SEQ ID NO: 3349150 - RNA, 17 nt, Mycobacterium tuberculosis H37Rv
gucugcggaccggcgcg

SEQ ID NO: 3349151 - RNA, 12 nt, Mycobacterium tuberculosis H37Rv
gucugcggucau

SEQ ID NO: 3349152 - RNA, 12 nt, Mycobacterium tuberculosis H37Rv
gucugcucgcca

SEQ ID NO: 3349153 - RNA, 16 nt, Mycobacterium tuberculosis H37Rv
gucugcucgccgggca

SEQ ID NO: 3349154 - RNA, 19 nt, Mycobacterium tuberculosis H37Rv
gucugcucgccgggcagcu

SEQ ID NO: 3349155 - RNA, 15 nt, Mycobacterium tuberculosis H37Rv
gucugcugaccggag

SEQ ID NO: 3349156 - RNA, 21 nt, Mycobacterium tuberculosis H37Rv
gucugcugggcacgauggcuc

SEQ ID NO: 3349157 - RNA, 16 nt, Mycobacterium tuberculosis H37Rv
gucuggacaucggccg

SEQ ID NO: 3349158 - RNA, 14 nt, Mycobacterium tuberculosis H37Rv
gucuggcaggccag

SEQ ID NO: 3349159 - RNA, 17 nt, Mycobacterium tuberculosis H37Rv
gucuggccugccccaga

SEQ ID NO: 3349160 - RNA, 17 nt, Mycobacterium tuberculosis H37Rv
gucuggcgcggagcuga

SEQ ID NO: 3349161 - RNA, 23 nt, Mycobacterium tuberculosis H37Rv
gucugggcaagaccgcguuccgg

SEQ ID NO: 3349162 - RNA, 17 nt, Mycobacterium tuberculosis H37Rv
gucugggcuuugcagcg

SEQ ID NO: 3349163 - RNA, 17 nt, Mycobacterium tuberculosis H37Rv
gucuggggacgaaacua

SEQ ID NO: 3349164 - RNA, 17 nt, Mycobacterium tuberculosis H37Rv
gucugggugcagguucu

SEQ ID NO: 3349165 - RNA, 22 nt, Mycobacterium tuberculosis H37Rv
gucugguggucggcgacgucgc

SEQ ID NO: 3349166 - RNA, 19 nt, Mycobacterium tuberculosis H37Rv
gucugguugggccagcucc

SEQ ID NO: 3349167 - RNA, 23 nt, Mycobacterium tuberculosis H37Rv
gucugguugucgaucucggccag

SEQ ID NO: 3349168 - RNA, 18 nt, Mycobacterium tuberculosis H37Rv
gucuguacaacgacacgc

SEQ ID NO: 3349169 - RNA, 23 nt, Mycobacterium tuberculosis H37Rv
gucugugauugcgcgggcaucgu

SEQ ID NO: 3349170 - RNA, 13 nt, Mycobacterium tuberculosis H37Rv
gucugugcucacg

SEQ ID NO: 3349171 - RNA, 14 nt, Mycobacterium tuberculosis H37Rv
gucugugcucacgg

SEQ ID NO: 3349172 - RNA, 18 nt, Mycobacterium tuberculosis H37Rv
gucuucaggccgcgcaug

SEQ ID NO: 3349173 - RNA, 20 nt, Mycobacterium tuberculosis H37Rv
gucuucaggccgcgcauggu

SEQ ID NO: 3349174 - RNA, 17 nt, Mycobacterium tuberculosis H37Rv
gucuucagguccaccgc

SEQ ID NO: 3349175 - RNA, 23 nt, Mycobacterium tuberculosis H37Rv
gucuuccaggagcgccgucaucg

SEQ ID NO: 3349176 - RNA, 14 nt, Mycobacterium tuberculosis H37Rv
gucuuccggugcgc

SEQ ID NO: 3349177 - RNA, 20 nt, Mycobacterium tuberculosis H37Rv
gucuucgucauggccggcca

SEQ ID NO: 3349178 - RNA, 22 nt, Mycobacterium tuberculosis H37Rv
gucuucuuucgccuccggaucc

SEQ ID NO: 3349179 - RNA, 19 nt, Mycobacterium tuberculosis H37Rv
gucuugacggcgccaggca

SEQ ID NO: 3349180 - RNA, 13 nt, Mycobacterium tuberculosis H37Rv
gucuugauguaau

SEQ ID NO: 3349181 - RNA, 14 nt, Mycobacterium tuberculosis H37Rv
gucuugcaucgccg

SEQ ID NO: 3349182 - RNA, 20 nt, Mycobacterium tuberculosis H37Rv
gucuugcaucgccgaugcgg

SEQ ID NO: 3349183 - RNA, 16 nt, Mycobacterium tuberculosis H37Rv
gucuugccggccagga

SEQ ID NO: 3349184 - RNA, 17 nt, Mycobacterium tuberculosis H37Rv
gucuuggacagcagcag

SEQ ID NO: 3349185 - RNA, 21 nt, Mycobacterium tuberculosis H37Rv
gucuuggcccgguccgccauu

SEQ ID NO: 3349186 - RNA, 17 nt, Mycobacterium tuberculosis H37Rv
gucuuggcggcggugca

SEQ ID NO: 3349187 - RNA, 22 nt, Mycobacterium tuberculosis H37Rv
gucuuggcggcggugcagcagg

SEQ ID NO: 3349188 - RNA, 13 nt, Mycobacterium tuberculosis H37Rv
gucuugggucucg

SEQ ID NO: 3349189 - RNA, 14 nt, Mycobacterium tuberculosis H37Rv
gucuugucgccgag

SEQ ID NO: 3349190 - RNA, 22 nt, Mycobacterium tuberculosis H37Rv
gucuuuaggcguggcccagucc

SEQ ID NO: 3349191 - RNA, 20 nt, Mycobacterium tuberculosis H37Rv
gucuuucccggggcuggggg

SEQ ID NO: 3349192 - RNA, 22 nt, Mycobacterium tuberculosis H37Rv
gucuuugcucucggucugcaug

SEQ ID NO: 3349193 - RNA, 23 nt, Mycobacterium tuberculosis H37Rv
gucuuugcucucggucugcaugc

SEQ ID NO: 3349194 - RNA, 23 nt, Mycobacterium tuberculosis H37Rv
gugaaaaaggcgacucggugcgg

SEQ ID NO: 3349195 - RNA, 20 nt, Mycobacterium tuberculosis H37Rv
gugaaacaggacgugucggu

SEQ ID NO: 3349196 - RNA, 16 nt, Mycobacterium tuberculosis H37Rv
gugaaaccggccuucu

SEQ ID NO: 3349197 - RNA, 20 nt, Mycobacterium tuberculosis H37Rv
gugaaagacaacccgcucgg

SEQ ID NO: 3349198 - RNA, 21 nt, Mycobacterium tuberculosis H37Rv
gugaaaguaagccgcgcccau

SEQ ID NO: 3349199 - RNA, 12 nt, Mycobacterium tuberculosis H37Rv
gugaaaguucau

SEQ ID NO: 3349200 - RNA, 19 nt, Mycobacterium tuberculosis H37Rv
gugaaaucgcacagcgcga

SEQ ID NO: 3349201 - RNA, 14 nt, Mycobacterium tuberculosis H37Rv
gugaaaugccgaga

SEQ ID NO: 3349202 - RNA, 12 nt, Mycobacterium tuberculosis H37Rv
gugaacaccccu

SEQ ID NO: 3349203 - RNA, 17 nt, Mycobacterium tuberculosis H37Rv
gugaacaccgccagcag

SEQ ID NO: 3349204 - RNA, 17 nt, Mycobacterium tuberculosis H37Rv
gugaacacgucgcggua

SEQ ID NO: 3349205 - RNA, 13 nt, Mycobacterium tuberculosis H37Rv
gugaacagcaggu

SEQ ID NO: 3349206 - RNA, 16 nt, Mycobacterium tuberculosis H37Rv
gugaaccaacgcgacc

SEQ ID NO: 3349207 - RNA, 20 nt, Mycobacterium tuberculosis H37Rv
gugaaccuggcgacgcgaca

SEQ ID NO: 3349208 - RNA, 15 nt, Mycobacterium tuberculosis H37Rv
gugaacgccggugcg

SEQ ID NO: 3349209 - RNA, 17 nt, Mycobacterium tuberculosis H37Rv
gugaacgcggacaccgc

SEQ ID NO: 3349210 - RNA, 14 nt, Mycobacterium tuberculosis H37Rv
gugaacggcagcac

SEQ ID NO: 3349211 - RNA, 14 nt, Mycobacterium tuberculosis H37Rv
gugaacggcgcggg

SEQ ID NO: 3349212 - RNA, 18 nt, Mycobacterium tuberculosis H37Rv
gugaacggcgcgggccac

SEQ ID NO: 3349213 - RNA, 22 nt, Mycobacterium tuberculosis H37Rv
gugaacggcucgggcagcguca

SEQ ID NO: 3349214 - RNA, 18 nt, Mycobacterium tuberculosis H37Rv
gugaacggugucaacggc

SEQ ID NO: 3349215 - RNA, 14 nt, Mycobacterium tuberculosis H37Rv
gugaacuguccggg

SEQ ID NO: 3349216 - RNA, 15 nt, Mycobacterium tuberculosis H37Rv
gugaacuguccgggu

SEQ ID NO: 3349217 - RNA, 20 nt, Mycobacterium tuberculosis H37Rv
gugaacuucuccaccagcgu

SEQ ID NO: 3349218 - RNA, 18 nt, Mycobacterium tuberculosis H37Rv
gugaaggcaaacaccagc

SEQ ID NO: 3349219 - RNA, 16 nt, Mycobacterium tuberculosis H37Rv
gugaagggauccggaa

SEQ ID NO: 3349220 - RNA, 21 nt, Mycobacterium tuberculosis H37Rv
gugaagggcccacggugcgau

SEQ ID NO: 3349221 - RNA, 16 nt, Mycobacterium tuberculosis H37Rv
gugaaggucaccgucg

SEQ ID NO: 3349222 - RNA, 17 nt, Mycobacterium tuberculosis H37Rv
gugaaggucaccgucga

SEQ ID NO: 3349223 - RNA, 15 nt, Mycobacterium tuberculosis H37Rv
gugaagucggugccg

SEQ ID NO: 3349224 - RNA, 17 nt, Mycobacterium tuberculosis H37Rv
gugaagucggugccgag

SEQ ID NO: 3349225 - RNA, 20 nt, Mycobacterium tuberculosis H37Rv
gugaaguggcgcaccaccuc

SEQ ID NO: 3349226 - RNA, 20 nt, Mycobacterium tuberculosis H37Rv
gugaaucgcacgacgcgaca

SEQ ID NO: 3349227 - RNA, 14 nt, Mycobacterium tuberculosis H37Rv
gugaauggcagcac

SEQ ID NO: 3349228 - RNA, 20 nt, Mycobacterium tuberculosis H37Rv
gugaauuaaggugaccacgg

SEQ ID NO: 3349229 - RNA, 13 nt, Mycobacterium tuberculosis H37Rv
gugaauucgccga

SEQ ID NO: 3349230 - RNA, 21 nt, Mycobacterium tuberculosis H37Rv
gugacaaaucggccaucauga

SEQ ID NO: 3349231 - RNA, 15 nt, Mycobacterium tuberculosis H37Rv
gugacaaauucggcg

SEQ ID NO: 3349232 - RNA, 12 nt, Mycobacterium tuberculosis H37Rv
gugacaacgcga

SEQ ID NO: 3349233 - RNA, 19 nt, Mycobacterium tuberculosis H37Rv
gugacaaggugcgcugggu

SEQ ID NO: 3349234 - RNA, 13 nt, Mycobacterium tuberculosis H37Rv
gugacagcggcau

SEQ ID NO: 3349235 - RNA, 20 nt, Mycobacterium tuberculosis H37Rv
gugacagugcgucgagcauc

SEQ ID NO: 3349236 - RNA, 22 nt, Mycobacterium tuberculosis H37Rv
gugacauaaaccucgccgguga

SEQ ID NO: 3349237 - RNA, 12 nt, Mycobacterium tuberculosis H37Rv
gugacaucgcga

SEQ ID NO: 3349238 - RNA, 17 nt, Mycobacterium tuberculosis H37Rv
gugaccaccccggccaa

SEQ ID NO: 3349239 - RNA, 15 nt, Mycobacterium tuberculosis H37Rv
gugaccacgcugcug

SEQ ID NO: 3349240 - RNA, 16 nt, Mycobacterium tuberculosis H37Rv
gugaccacugaaccgu

SEQ ID NO: 3349241 - RNA, 12 nt, Mycobacterium tuberculosis H37Rv
gugaccagcagg

SEQ ID NO: 3349242 - RNA, 18 nt, Mycobacterium tuberculosis H37Rv
gugaccagcaggccgggc

SEQ ID NO: 3349243 - RNA, 17 nt, Mycobacterium tuberculosis H37Rv
gugaccaggaucgacag

SEQ ID NO: 3349244 - RNA, 13 nt, Mycobacterium tuberculosis H37Rv
gugaccaggccgg

SEQ ID NO: 3349245 - RNA, 15 nt, Mycobacterium tuberculosis H37Rv
gugaccaggcggcgc

SEQ ID NO: 3349246 - RNA, 16 nt, Mycobacterium tuberculosis H37Rv
gugaccaggugccagg

SEQ ID NO: 3349247 - RNA, 23 nt, Mycobacterium tuberculosis H37Rv
gugacccgccggcgacugcagcg

SEQ ID NO: 3349248 - RNA, 14 nt, Mycobacterium tuberculosis H37Rv
gugacccgcugggc

SEQ ID NO: 3349249 - RNA, 19 nt, Mycobacterium tuberculosis H37Rv
gugacccgcugggccgcau

SEQ ID NO: 3349250 - RNA, 21 nt, Mycobacterium tuberculosis H37Rv
gugacccgcugggccgcaucg

SEQ ID NO: 3349251 - RNA, 22 nt, Mycobacterium tuberculosis H37Rv
gugacccucagcaccgcuggca

SEQ ID NO: 3349252 - RNA, 16 nt, Mycobacterium tuberculosis H37Rv
gugaccgaccgccaug

SEQ ID NO: 3349253 - RNA, 16 nt, Mycobacterium tuberculosis H37Rv
gugaccgagccgcgau

SEQ ID NO: 3349254 - RNA, 17 nt, Mycobacterium tuberculosis H37Rv
gugaccgcagucccagc

SEQ ID NO: 3349255 - RNA, 13 nt, Mycobacterium tuberculosis H37Rv
gugaccgcuggug

SEQ ID NO: 3349256 - RNA, 14 nt, Mycobacterium tuberculosis H37Rv
gugaccguggcggg

SEQ ID NO: 3349257 - RNA, 14 nt, Mycobacterium tuberculosis H37Rv
gugaccucaccaac

SEQ ID NO: 3349258 - RNA, 12 nt, Mycobacterium tuberculosis H37Rv
gugaccucgucg

SEQ ID NO: 3349259 - RNA, 23 nt, Mycobacterium tuberculosis H37Rv
gugaccugacgcucggucgccac

SEQ ID NO: 3349260 - RNA, 15 nt, Mycobacterium tuberculosis H37Rv
gugaccugggcgccc

SEQ ID NO: 3349261 - RNA, 12 nt, Mycobacterium tuberculosis H37Rv
gugaccuucgcu

SEQ ID NO: 3349262 - RNA, 22 nt, Mycobacterium tuberculosis H37Rv
gugacgaagccgaccucacggc

SEQ ID NO: 3349263 - RNA, 15 nt, Mycobacterium tuberculosis H37Rv
gugacgagcacaugc

SEQ ID NO: 3349264 - RNA, 13 nt, Mycobacterium tuberculosis H37Rv
gugacgauugcca

SEQ ID NO: 3349265 - RNA, 16 nt, Mycobacterium tuberculosis H37Rv
gugacgccacgaccgc

SEQ ID NO: 3349266 - RNA, 21 nt, Mycobacterium tuberculosis H37Rv
gugacgccacgaccgccgaua

SEQ ID NO: 3349267 - RNA, 18 nt, Mycobacterium tuberculosis H37Rv
gugacgcccgcuccgcgg

SEQ ID NO: 3349268 - RNA, 17 nt, Mycobacterium tuberculosis H37Rv
gugacgccgccagcacc

SEQ ID NO: 3349269 - RNA, 14 nt, Mycobacterium tuberculosis H37Rv
gugacgccggccag

SEQ ID NO: 3349270 - RNA, 23 nt, Mycobacterium tuberculosis H37Rv
gugacgcgccguaacagccggcc

SEQ ID NO: 3349271 - RNA, 23 nt, Mycobacterium tuberculosis H37Rv
gugacgcgcgccggauacaccgg

SEQ ID NO: 3349272 - RNA, 12 nt, Mycobacterium tuberculosis H37Rv
gugacggcggcc

SEQ ID NO: 3349273 - RNA, 14 nt, Mycobacterium tuberculosis H37Rv
gugacggcggccac

SEQ ID NO: 3349274 - RNA, 20 nt, Mycobacterium tuberculosis H37Rv
gugacgguccacgacgucga

SEQ ID NO: 3349275 - RNA, 19 nt, Mycobacterium tuberculosis H37Rv
gugacgguccguucgaugc

SEQ ID NO: 3349276 - RNA, 14 nt, Mycobacterium tuberculosis H37Rv
gugacggucgucga

SEQ ID NO: 3349277 - RNA, 19 nt, Mycobacterium tuberculosis H37Rv
gugacggugaauucacgau

SEQ ID NO: 3349278 - RNA, 15 nt, Mycobacterium tuberculosis H37Rv
gugacgguguuggug

SEQ ID NO: 3349279 - RNA, 20 nt, Mycobacterium tuberculosis H37Rv
gugacguaucgccgcgggcg

SEQ ID NO: 3349280 - RNA, 17 nt, Mycobacterium tuberculosis H37Rv
gugacgugcucucgcuc

SEQ ID NO: 3349281 - RNA, 18 nt, Mycobacterium tuberculosis H37Rv
gugacguuggcaggcagg

SEQ ID NO: 3349282 - RNA, 19 nt, Mycobacterium tuberculosis H37Rv
gugacguuggcaggcaggu

SEQ ID NO: 3349283 - RNA, 23 nt, Mycobacterium tuberculosis H37Rv
gugacuccgcgcgcggacagcau

SEQ ID NO: 3349284 - RNA, 17 nt, Mycobacterium tuberculosis H37Rv
gugacuccggcuggaag

SEQ ID NO: 3349285 - RNA, 13 nt, Mycobacterium tuberculosis H37Rv
gugacuggugaac

SEQ ID NO: 3349286 - RNA, 18 nt, Mycobacterium tuberculosis H37Rv
gugacuuauccggccagu

SEQ ID NO: 3349287 - RNA, 19 nt, Mycobacterium tuberculosis H37Rv
gugacuuauccggccagug

SEQ ID NO: 3349288 - RNA, 20 nt, Mycobacterium tuberculosis H37Rv
gugacuucgguggcgggcuu

SEQ ID NO: 3349289 - RNA, 18 nt, Mycobacterium tuberculosis H37Rv
gugacuuugacccguucc

SEQ ID NO: 3349290 - RNA, 15 nt, Mycobacterium tuberculosis H37Rv
gugagaagaagccca

SEQ ID NO: 3349291 - RNA, 14 nt, Mycobacterium tuberculosis H37Rv
gugagaccagguuc

SEQ ID NO: 3349292 - RNA, 22 nt, Mycobacterium tuberculosis H37Rv
gugagaccagguucucggucgg

SEQ ID NO: 3349293 - RNA, 20 nt, Mycobacterium tuberculosis H37Rv
gugagaccuagcagggugcc

SEQ ID NO: 3349294 - RNA, 23 nt, Mycobacterium tuberculosis H37Rv
gugagaccuagcagggugccggc

SEQ ID NO: 3349295 - RNA, 21 nt, Mycobacterium tuberculosis H37Rv
gugagacugggcgcuggaggc

SEQ ID NO: 3349296 - RNA, 23 nt, Mycobacterium tuberculosis H37Rv
gugagauugguggcccgggccac

SEQ ID NO: 3349297 - RNA, 13 nt, Mycobacterium tuberculosis H37Rv
gugagcaacgcga

SEQ ID NO: 3349298 - RNA, 18 nt, Mycobacterium tuberculosis H37Rv
gugagcaauggcgcgacc

SEQ ID NO: 3349299 - RNA, 15 nt, Mycobacterium tuberculosis H37Rv
gugagcacaccgaca

SEQ ID NO: 3349300 - RNA, 16 nt, Mycobacterium tuberculosis H37Rv
gugagcaccagcagca

SEQ ID NO: 3349301 - RNA, 17 nt, Mycobacterium tuberculosis H37Rv
gugagcaccagcagcac

SEQ ID NO: 3349302 - RNA, 12 nt, Mycobacterium tuberculosis H37Rv
gugagcaccugg

SEQ ID NO: 3349303 - RNA, 16 nt, Mycobacterium tuberculosis H37Rv
gugagcaccugggcgc

SEQ ID NO: 3349304 - RNA, 22 nt, Mycobacterium tuberculosis H37Rv
gugagcagcgggacauccagug

SEQ ID NO: 3349305 - RNA, 14 nt, Mycobacterium tuberculosis H37Rv
gugagcaugcgacg

SEQ ID NO: 3349306 - RNA, 17 nt, Mycobacterium tuberculosis H37Rv
gugagcauggcuagggc

SEQ ID NO: 3349307 - RNA, 14 nt, Mycobacterium tuberculosis H37Rv
gugagccauacgcg

SEQ ID NO: 3349308 - RNA, 16 nt, Mycobacterium tuberculosis H37Rv
gugagccaugccgcuc

SEQ ID NO: 3349309 - RNA, 16 nt, Mycobacterium tuberculosis H37Rv
gugagccccagcgacg

SEQ ID NO: 3349310 - RNA, 22 nt, Mycobacterium tuberculosis H37Rv
gugagcccggcgaucagcagcg

SEQ ID NO: 3349311 - RNA, 15 nt, Mycobacterium tuberculosis H37Rv
gugagccgggcggcc

SEQ ID NO: 3349312 - RNA, 13 nt, Mycobacterium tuberculosis H37Rv
gugagccuuucgu

SEQ ID NO: 3349313 - RNA, 14 nt, Mycobacterium tuberculosis H37Rv
gugagcgagcgcgc

SEQ ID NO: 3349314 - RNA, 13 nt, Mycobacterium tuberculosis H37Rv
gugagcgccgcgg

SEQ ID NO: 3349315 - RNA, 15 nt, Mycobacterium tuberculosis H37Rv
gugagcgccgcggcg

SEQ ID NO: 3349316 - RNA, 20 nt, Mycobacterium tuberculosis H37Rv
gugagcgcgcucaggucauc

SEQ ID NO: 3349317 - RNA, 21 nt, Mycobacterium tuberculosis H37Rv
gugagcucggcugcucgacgg

SEQ ID NO: 3349318 - RNA, 19 nt, Mycobacterium tuberculosis H37Rv
gugagcugcgccagaaucc

SEQ ID NO: 3349319 - RNA, 22 nt, Mycobacterium tuberculosis H37Rv
gugagcuggucggcgagcgccc

SEQ ID NO: 3349320 - RNA, 21 nt, Mycobacterium tuberculosis H37Rv
gugagcuuagcgcaugggccu

SEQ ID NO: 3349321 - RNA, 20 nt, Mycobacterium tuberculosis H37Rv
gugagcuuuaucugcaugcc

SEQ ID NO: 3349322 - RNA, 13 nt, Mycobacterium tuberculosis H37Rv
gugcagcaccagc

SEQ ID NO: 3349323 - RNA, 14 nt, Mycobacterium tuberculosis H37Rv
gugcagcaccagcc

SEQ ID NO: 3349324 - RNA, 17 nt, Mycobacterium tuberculosis H37Rv
gugcagcaccagccacg

SEQ ID NO: 3349325 - RNA, 18 nt, Mycobacterium tuberculosis H37Rv
gugcagcacgugugcggg

SEQ ID NO: 3349326 - RNA, 13 nt, Mycobacterium tuberculosis H37Rv
gugcagcacuugg

SEQ ID NO: 3349327 - RNA, 15 nt, Mycobacterium tuberculosis H37Rv
gugcagcagcgcgcg

SEQ ID NO: 3349328 - RNA, 23 nt, Mycobacterium tuberculosis H37Rv
gugcagcaggaaguagccgagcc

SEQ ID NO: 3349329 - RNA, 16 nt, Mycobacterium tuberculosis H37Rv
gugcagccgcaggugg

SEQ ID NO: 3349330 - RNA, 23 nt, Mycobacterium tuberculosis H37Rv
gugcagcgacuccguaccggguu

SEQ ID NO: 3349331 - RNA, 17 nt, Mycobacterium tuberculosis H37Rv
gugcagcgaucccggca

SEQ ID NO: 3349332 - RNA, 19 nt, Mycobacterium tuberculosis H37Rv
gugcagcgcacgcagccga

SEQ ID NO: 3349333 - RNA, 23 nt, Mycobacterium tuberculosis H37Rv
gugcagcgcgucaaacaccucca

SEQ ID NO: 3349334 - RNA, 17 nt, Mycobacterium tuberculosis H37Rv
gugcagcgugggcagcg

SEQ ID NO: 3349335 - RNA, 20 nt, Mycobacterium tuberculosis H37Rv
gugcagcgugggcagcgcga

SEQ ID NO: 3349336 - RNA, 19 nt, Mycobacterium tuberculosis H37Rv
gugcagcucgauacccagg

SEQ ID NO: 3349337 - RNA, 20 nt, Mycobacterium tuberculosis H37Rv
gugcagcucggucagcguca

SEQ ID NO: 3349338 - RNA, 15 nt, Mycobacterium tuberculosis H37Rv
gugcaggaccagcac

SEQ ID NO: 3349339 - RNA, 19 nt, Mycobacterium tuberculosis H37Rv
gugcaggccgcggagaagg

SEQ ID NO: 3349340 - RNA, 13 nt, Mycobacterium tuberculosis H37Rv
gugcaggcggccg

SEQ ID NO: 3349341 - RNA, 23 nt, Mycobacterium tuberculosis H37Rv
gugcaggcggccgccaguucggc

SEQ ID NO: 3349342 - RNA, 12 nt, Mycobacterium tuberculosis H37Rv
gugcaggcggga

SEQ ID NO: 3349343 - RNA, 15 nt, Mycobacterium tuberculosis H37Rv
gugcaggcugucaau

SEQ ID NO: 3349344 - RNA, 20 nt, Mycobacterium tuberculosis H37Rv
gugcaggucguccaucgcgu

SEQ ID NO: 3349345 - RNA, 16 nt, Mycobacterium tuberculosis H37Rv
gugcaggugaugcaug

SEQ ID NO: 3349346 - RNA, 21 nt, Mycobacterium tuberculosis H37Rv
gugcaggugcccggccaaaau

SEQ ID NO: 3349347 - RNA, 19 nt, Mycobacterium tuberculosis H37Rv
gugcagguggccgucgccg

SEQ ID NO: 3349348 - RNA, 18 nt, Mycobacterium tuberculosis H37Rv
gugcagguugcccucacc

SEQ ID NO: 3349349 - RNA, 23 nt, Mycobacterium tuberculosis H37Rv
gugcauaccgcaauggcggccuu

SEQ ID NO: 3349350 - RNA, 23 nt, Mycobacterium tuberculosis H37Rv
gugcauagcaauccgcacagcga

SEQ ID NO: 3349351 - RNA, 21 nt, Mycobacterium tuberculosis H37Rv
gugcauaucaaccccggugca

SEQ ID NO: 3349352 - RNA, 17 nt, Mycobacterium tuberculosis H37Rv
gugcaucgaucaccgcu

SEQ ID NO: 3349353 - RNA, 18 nt, Mycobacterium tuberculosis H37Rv
gugcaucgaucaccgcuu

SEQ ID NO: 3349354 - RNA, 18 nt, Mycobacterium tuberculosis H37Rv
gugcaucgccugcgccuu

SEQ ID NO: 3349355 - RNA, 18 nt, Mycobacterium tuberculosis H37Rv
gugcauguauuuguugua

SEQ ID NO: 3349356 - RNA, 19 nt, Mycobacterium tuberculosis H37Rv
gugccaaaugaugacgauc

SEQ ID NO: 3349357 - RNA, 22 nt, Mycobacterium tuberculosis H37Rv
gugccaaaugaugacgaucagc

SEQ ID NO: 3349358 - RNA, 13 nt, Mycobacterium tuberculosis H37Rv
gugccaacugcgc

SEQ ID NO: 3349359 - RNA, 18 nt, Mycobacterium tuberculosis H37Rv
gugccaauuccagccccc

SEQ ID NO: 3349360 - RNA, 19 nt, Mycobacterium tuberculosis H37Rv
gugccaauuccagcccccc

SEQ ID NO: 3349361 - RNA, 13 nt, Mycobacterium tuberculosis H37Rv
gugccaccgacgc

SEQ ID NO: 3349362 - RNA, 17 nt, Mycobacterium tuberculosis H37Rv
gugccaccggcuggugc

SEQ ID NO: 3349363 - RNA, 15 nt, Mycobacterium tuberculosis H37Rv
gugccacgaggaccc

SEQ ID NO: 3349364 - RNA, 15 nt, Mycobacterium tuberculosis H37Rv
gugccacgaucggcg

SEQ ID NO: 3349365 - RNA, 13 nt, Mycobacterium tuberculosis H37Rv
gugccacuuccac

SEQ ID NO: 3349366 - RNA, 19 nt, Mycobacterium tuberculosis H37Rv
gugccagaccagggcagcg

SEQ ID NO: 3349367 - RNA, 23 nt, Mycobacterium tuberculosis H37Rv
gugccagaccagggcagcggcca

SEQ ID NO: 3349368 - RNA, 20 nt, Mycobacterium tuberculosis H37Rv
gugccagaucggcggguggc

SEQ ID NO: 3349369 - RNA, 20 nt, Mycobacterium tuberculosis H37Rv
gugccagcaccacgucgacg

SEQ ID NO: 3349370 - RNA, 23 nt, Mycobacterium tuberculosis H37Rv
gugccagcaccacgucgacgaug

SEQ ID NO: 3349371 - RNA, 15 nt, Mycobacterium tuberculosis H37Rv
gugccagcagcagcg

SEQ ID NO: 3349372 - RNA, 14 nt, Mycobacterium tuberculosis H37Rv
gugccagcagggga

SEQ ID NO: 3349373 - RNA, 16 nt, Mycobacterium tuberculosis H37Rv
gugccagcaggggacg

SEQ ID NO: 3349374 - RNA, 12 nt, Mycobacterium tuberculosis H37Rv
gugccagccgga

SEQ ID NO: 3349375 - RNA, 13 nt, Mycobacterium tuberculosis H37Rv
gugccagccggau

SEQ ID NO: 3349376 - RNA, 14 nt, Mycobacterium tuberculosis H37Rv
gugccagcgccccg

SEQ ID NO: 3349377 - RNA, 17 nt, Mycobacterium tuberculosis H37Rv
gugccaggucggcgggc

SEQ ID NO: 3349378 - RNA, 17 nt, Mycobacterium tuberculosis H37Rv
gugccaguacucggcca

SEQ ID NO: 3349379 - RNA, 19 nt, Mycobacterium tuberculosis H37Rv
gugccaguacucggccagc

SEQ ID NO: 3349380 - RNA, 21 nt, Mycobacterium tuberculosis H37Rv
gugccaguacucggccagcgc

SEQ ID NO: 3349381 - RNA, 23 nt, Mycobacterium tuberculosis H37Rv
gugccaguacucggccagcgccu

SEQ ID NO: 3349382 - RNA, 18 nt, Mycobacterium tuberculosis H37Rv
gugccagugccagcgucc

SEQ ID NO: 3349383 - RNA, 20 nt, Mycobacterium tuberculosis H37Rv
gugccauccuuaugcgcggu

SEQ ID NO: 3349384 - RNA, 12 nt, Mycobacterium tuberculosis H37Rv
gugccaucgcca

SEQ ID NO: 3349385 - RNA, 17 nt, Mycobacterium tuberculosis H37Rv
gugcccaagcaguccac

SEQ ID NO: 3349386 - RNA, 13 nt, Mycobacterium tuberculosis H37Rv
gugcccaucggca

SEQ ID NO: 3349387 - RNA, 15 nt, Mycobacterium tuberculosis H37Rv
gugcccaugaugcuc

SEQ ID NO: 3349388 - RNA, 16 nt, Mycobacterium tuberculosis H37Rv
gugcccaugaugguca

SEQ ID NO: 3349389 - RNA, 15 nt, Mycobacterium tuberculosis H37Rv
gugccccacucgggu

SEQ ID NO: 3349390 - RNA, 14 nt, Mycobacterium tuberculosis H37Rv
gugccccgcccggc

SEQ ID NO: 3349391 - RNA, 12 nt, Mycobacterium tuberculosis H37Rv
gugccccgccga

SEQ ID NO: 3349392 - RNA, 14 nt, Mycobacterium tuberculosis H37Rv
gugccccgccgagc

SEQ ID NO: 3349393 - RNA, 23 nt, Mycobacterium tuberculosis H37Rv
gugccccggcgguaccagagcag

SEQ ID NO: 3349394 - RNA, 15 nt, Mycobacterium tuberculosis H37Rv
gugcccgaaggaaaa

SEQ ID NO: 3349395 - RNA, 13 nt, Mycobacterium tuberculosis H37Rv
gugcccgacccgc

SEQ ID NO: 3349396 - RNA, 16 nt, Mycobacterium tuberculosis H37Rv
gugcccgcacugccgc

SEQ ID NO: 3349397 - RNA, 19 nt, Mycobacterium tuberculosis H37Rv
gugcccgcacugccgccgg

SEQ ID NO: 3349398 - RNA, 20 nt, Mycobacterium tuberculosis H37Rv
gugcccgccagucccccgcu

SEQ ID NO: 3349399 - RNA, 13 nt, Mycobacterium tuberculosis H37Rv
gugcccgccccga

SEQ ID NO: 3349400 - RNA, 23 nt, Mycobacterium tuberculosis H37Rv
gugcccgcgaacgaucccgccga

SEQ ID NO: 3349401 - RNA, 13 nt, Mycobacterium tuberculosis H37Rv
gugcccgcgcggc

SEQ ID NO: 3349402 - RNA, 16 nt, Mycobacterium tuberculosis H37Rv
gugcccgcguugccaa

SEQ ID NO: 3349403 - RNA, 23 nt, Mycobacterium tuberculosis H37Rv
gugcccggaauguaguccagcuc

SEQ ID NO: 3349404 - RNA, 16 nt, Mycobacterium tuberculosis H37Rv
gugcccggccaaaaug

SEQ ID NO: 3349405 - RNA, 16 nt, Mycobacterium tuberculosis H37Rv
gugcccggccgccagc

SEQ ID NO: 3349406 - RNA, 15 nt, Mycobacterium tuberculosis H37Rv
gugcccggcggccaa

SEQ ID NO: 3349407 - RNA, 16 nt, Mycobacterium tuberculosis H37Rv
gugcccgucgugcggg

SEQ ID NO: 3349408 - RNA, 22 nt, Mycobacterium tuberculosis H37Rv
gugcccgucgugcggggguggu

SEQ ID NO: 3349409 - RNA, 14 nt, Mycobacterium tuberculosis H37Rv
gugcccgugugcag

SEQ ID NO: 3349410 - RNA, 19 nt, Mycobacterium tuberculosis H37Rv
gugcccugccggcagcggc

SEQ ID NO: 3349411 - RNA, 21 nt, Mycobacterium tuberculosis H37Rv
gugcccuguccggcgccgagg

SEQ ID NO: 3349412 - RNA, 15 nt, Mycobacterium tuberculosis H37Rv
gugccgaaaugggcg

SEQ ID NO: 3349413 - RNA, 17 nt, Mycobacterium tuberculosis H37Rv
gugccgaacagcggguu

SEQ ID NO: 3349414 - RNA, 15 nt, Mycobacterium tuberculosis H37Rv
gugccgaacgccaga

SEQ ID NO: 3349415 - RNA, 15 nt, Mycobacterium tuberculosis H37Rv
gugccgaaguggagc

SEQ ID NO: 3349416 - RNA, 14 nt, Mycobacterium tuberculosis H37Rv
gugccgaccaccag

SEQ ID NO: 3349417 - RNA, 15 nt, Mycobacterium tuberculosis H37Rv
gugccgaccaccagc

SEQ ID NO: 3349418 - RNA, 15 nt, Mycobacterium tuberculosis H37Rv
gugcgcaaucgacac

SEQ ID NO: 3349419 - RNA, 22 nt, Mycobacterium tuberculosis H37Rv
gugcgcaccccgcuugcgcggc

SEQ ID NO: 3349420 - RNA, 13 nt, Mycobacterium tuberculosis H37Rv
gugcgcacggcgg

SEQ ID NO: 3349421 - RNA, 20 nt, Mycobacterium tuberculosis H37Rv
gugcgcagaacaccaccgcc

SEQ ID NO: 3349422 - RNA, 21 nt, Mycobacterium tuberculosis H37Rv
gugcgcagaacaccaccgcca

SEQ ID NO: 3349423 - RNA, 22 nt, Mycobacterium tuberculosis H37Rv
gugcgcagacaucggagaucau

SEQ ID NO: 3349424 - RNA, 21 nt, Mycobacterium tuberculosis H37Rv
gugcgcagcuuggccagccac

SEQ ID NO: 3349425 - RNA, 12 nt, Mycobacterium tuberculosis H37Rv
gugcgcagguac

SEQ ID NO: 3349426 - RNA, 21 nt, Mycobacterium tuberculosis H37Rv
gugcgcauccgucguacacgc

SEQ ID NO: 3349427 - RNA, 16 nt, Mycobacterium tuberculosis H37Rv
gugcgccaccucgacg

SEQ ID NO: 3349428 - RNA, 17 nt, Mycobacterium tuberculosis H37Rv
gugcgccaccucgacgc

SEQ ID NO: 3349429 - RNA, 23 nt, Mycobacterium tuberculosis H37Rv
gugcgccacgaccgcggcggcau

SEQ ID NO: 3349430 - RNA, 20 nt, Mycobacterium tuberculosis H37Rv
gugcgcccaauccaccgauu

SEQ ID NO: 3349431 - RNA, 17 nt, Mycobacterium tuberculosis H37Rv
gugcgcccaggugaucg

SEQ ID NO: 3349432 - RNA, 22 nt, Mycobacterium tuberculosis H37Rv
gugcgcccgacggaguucgacg

SEQ ID NO: 3349433 - RNA, 23 nt, Mycobacterium tuberculosis H37Rv
gugcgcccgacggaguucgacgu

SEQ ID NO: 3349434 - RNA, 24 nt, Mycobacterium tuberculosis H37Rv
gugcgccgaauggcggugggcuug

SEQ ID NO: 3349435 - RNA, 13 nt, Mycobacterium tuberculosis H37Rv
gugcgccgguccu

SEQ ID NO: 3349436 - RNA, 17 nt, Mycobacterium tuberculosis H37Rv
gugcgcgaccacccgcc

SEQ ID NO: 3349437 - RNA, 20 nt, Mycobacterium tuberculosis H37Rv
gugcgcgauaggugcucgcg

SEQ ID NO: 3349438 - RNA, 14 nt, Mycobacterium tuberculosis H37Rv
gugcgcgcgcagcu

SEQ ID NO: 3349439 - RNA, 14 nt, Mycobacterium tuberculosis H37Rv
gugcgcgcggucga

SEQ ID NO: 3349440 - RNA, 19 nt, Mycobacterium tuberculosis H37Rv
gugcgcggcauucucgagc

SEQ ID NO: 3349441 - RNA, 16 nt, Mycobacterium tuberculosis H37Rv
gugcgcggccgcccgu

SEQ ID NO: 3349442 - RNA, 13 nt, Mycobacterium tuberculosis H37Rv
gugcgcguccaga

SEQ ID NO: 3349443 - RNA, 18 nt, Mycobacterium tuberculosis H37Rv
gugcgcgugacgaccagc

SEQ ID NO: 3349444 - RNA, 13 nt, Mycobacterium tuberculosis H37Rv
gugcgcuggaugu

SEQ ID NO: 3349445 - RNA, 19 nt, Mycobacterium tuberculosis H37Rv
gugcggaaaccgcuggggg

SEQ ID NO: 3349446 - RNA, 15 nt, Mycobacterium tuberculosis H37Rv
gugcggaacaccgcc

SEQ ID NO: 3349447 - RNA, 20 nt, Mycobacterium tuberculosis H37Rv
gugcggaagcaucggcugcg

SEQ ID NO: 3349448 - RNA, 14 nt, Mycobacterium tuberculosis H37Rv
gugcggacaguucc

SEQ ID NO: 3349449 - RNA, 17 nt, Mycobacterium tuberculosis H37Rv
gugcggcaacagcgcca

SEQ ID NO: 3349450 - RNA, 17 nt, Mycobacterium tuberculosis H37Rv
gugcggccacucgcccg

SEQ ID NO: 3349451 - RNA, 15 nt, Mycobacterium tuberculosis H37Rv
gugcggccgcggcga

SEQ ID NO: 3349452 - RNA, 13 nt, Mycobacterium tuberculosis H37Rv
gugcggcgcggcg

SEQ ID NO: 3349453 - RNA, 13 nt, Mycobacterium tuberculosis H37Rv
gugcggcggcugc

SEQ ID NO: 3349454 - RNA, 14 nt, Mycobacterium tuberculosis H37Rv
gugcggcggcugcc

SEQ ID NO: 3349455 - RNA, 20 nt, Mycobacterium tuberculosis H37Rv
gugcggcguauugcggccug

SEQ ID NO: 3349456 - RNA, 21 nt, Mycobacterium tuberculosis H37Rv
gugcggcguauugcggccugu

SEQ ID NO: 3349457 - RNA, 18 nt, Mycobacterium tuberculosis H37Rv
gugcggcguuguggcgug

SEQ ID NO: 3349458 - RNA, 13 nt, Mycobacterium tuberculosis H37Rv
gugcggcugcaac

SEQ ID NO: 3349459 - RNA, 20 nt, Mycobacterium tuberculosis H37Rv
gugcgggccacgaucggcug

SEQ ID NO: 3349460 - RNA, 21 nt, Mycobacterium tuberculosis H37Rv
gugcgggccggucgugccggg

SEQ ID NO: 3349461 - RNA, 16 nt, Mycobacterium tuberculosis H37Rv
gugcgguacaucgacc

SEQ ID NO: 3349462 - RNA, 15 nt, Mycobacterium tuberculosis H37Rv
gugcgguaucgguca

SEQ ID NO: 3349463 - RNA, 20 nt, Mycobacterium tuberculosis H37Rv
gugcgguauuugaacgcccg

SEQ ID NO: 3349464 - RNA, 18 nt, Mycobacterium tuberculosis H37Rv
gugcggucucacucaucg

SEQ ID NO: 3349465 - RNA, 16 nt, Mycobacterium tuberculosis H37Rv
gugcggugaccgugaa

SEQ ID NO: 3349466 - RNA, 24 nt, Mycobacterium tuberculosis H37Rv
gugcggugaccgugaacggcucgg

SEQ ID NO: 3349467 - RNA, 18 nt, Mycobacterium tuberculosis H37Rv
gugcggugagauggcggu

SEQ ID NO: 3349468 - RNA, 13 nt, Mycobacterium tuberculosis H37Rv
gugcgguggcagg

SEQ ID NO: 3349469 - RNA, 22 nt, Mycobacterium tuberculosis H37Rv
gugcgguucucguagucaacca

SEQ ID NO: 3349470 - RNA, 17 nt, Mycobacterium tuberculosis H37Rv
gugcgguuggaucggcg

SEQ ID NO: 3349471 - RNA, 21 nt, Mycobacterium tuberculosis H37Rv
gugcgguuucaccgacgacgc

SEQ ID NO: 3349472 - RNA, 20 nt, Mycobacterium tuberculosis H37Rv
gugcguagcccacccgggug

SEQ ID NO: 3349473 - RNA, 13 nt, Mycobacterium tuberculosis H37Rv
gugcgucacagcc

SEQ ID NO: 3349474 - RNA, 15 nt, Mycobacterium tuberculosis H37Rv
gugcguccaggccag

SEQ ID NO: 3349475 - RNA, 14 nt, Mycobacterium tuberculosis H37Rv
gugcguccggugcu

SEQ ID NO: 3349476 - RNA, 17 nt, Mycobacterium tuberculosis H37Rv
gugcguccggugcuggu

SEQ ID NO: 3349477 - RNA, 23 nt, Mycobacterium tuberculosis H37Rv
gugcguccuccccuacugcguug

SEQ ID NO: 3349478 - RNA, 19 nt, Mycobacterium tuberculosis H37Rv
gugcgucgauggcgucggu

SEQ ID NO: 3349479 - RNA, 14 nt, Mycobacterium tuberculosis H37Rv
gugcgucuccagcu

SEQ ID NO: 3349480 - RNA, 19 nt, Mycobacterium tuberculosis H37Rv
gugcgucuccagcugggug

SEQ ID NO: 3349481 - RNA, 14 nt, Mycobacterium tuberculosis H37Rv
gugcgucucggugg

SEQ ID NO: 3349482 - RNA, 14 nt, Mycobacterium tuberculosis H37Rv
gugcgucugcggcg

SEQ ID NO: 3349483 - RNA, 23 nt, Mycobacterium tuberculosis H37Rv
gugcgugcggucgauccggccag

SEQ ID NO: 3349484 - RNA, 22 nt, Mycobacterium tuberculosis H37Rv
gugcguugacucugcguccacc

SEQ ID NO: 3349485 - RNA, 14 nt, Mycobacterium tuberculosis H37Rv
gugcguuggaugaa

SEQ ID NO: 3349486 - RNA, 16 nt, Mycobacterium tuberculosis H37Rv
gugcguuggaugaagu

SEQ ID NO: 3349487 - RNA, 15 nt, Mycobacterium tuberculosis H37Rv
gugcguugucggcug

SEQ ID NO: 3349488 - RNA, 14 nt, Mycobacterium tuberculosis H37Rv
gugcuaaccgacgc

SEQ ID NO: 3349489 - RNA, 19 nt, Mycobacterium tuberculosis H37Rv
gugcucacgcaucgcgaag

SEQ ID NO: 3349490 - RNA, 23 nt, Mycobacterium tuberculosis H37Rv
gugcucagcuucgcgucgggcuu

SEQ ID NO: 3349491 - RNA, 23 nt, Mycobacterium tuberculosis H37Rv
gugcucgaaggaccggcaccugg

SEQ ID NO: 3349492 - RNA, 21 nt, Mycobacterium tuberculosis H37Rv
gugcucgagcaccucggccuc

SEQ ID NO: 3349493 - RNA, 16 nt, Mycobacterium tuberculosis H37Rv
gugcucgccgaccagc

SEQ ID NO: 3349494 - RNA, 22 nt, Mycobacterium tuberculosis H37Rv
gugcucgccggaucuugccgcu

SEQ ID NO: 3349495 - RNA, 14 nt, Mycobacterium tuberculosis H37Rv
gugcucgccggcac

SEQ ID NO: 3349496 - RNA, 22 nt, Mycobacterium tuberculosis H37Rv
gugcucgccguaagcaccagcc

SEQ ID NO: 3349497 - RNA, 19 nt, Mycobacterium tuberculosis H37Rv
gugcucgcgaucugcucgu

SEQ ID NO: 3349498 - RNA, 22 nt, Mycobacterium tuberculosis H37Rv
gugcucggaucggcucgccacc

SEQ ID NO: 3349499 - RNA, 14 nt, Mycobacterium tuberculosis H37Rv
gugcucggugacgu

SEQ ID NO: 3349500 - RNA, 21 nt, Mycobacterium tuberculosis H37Rv
gugcucguagacuugcugcuc

SEQ ID NO: 3349501 - RNA, 14 nt, Mycobacterium tuberculosis H37Rv
gugcucgucgccug

SEQ ID NO: 3349502 - RNA, 17 nt, Mycobacterium tuberculosis H37Rv
gugcucgucguacaugg

SEQ ID NO: 3349503 - RNA, 17 nt, Mycobacterium tuberculosis H37Rv
gugcucucgcucgugca

SEQ ID NO: 3349504 - RNA, 19 nt, Mycobacterium tuberculosis H37Rv
gugcugaacuccgccgcga

SEQ ID NO: 3349505 - RNA, 15 nt, Mycobacterium tuberculosis H37Rv
gugcugaccccgccg

SEQ ID NO: 3349506 - RNA, 20 nt, Mycobacterium tuberculosis H37Rv
gugcugcaaggaauuccggc

SEQ ID NO: 3349507 - RNA, 14 nt, Mycobacterium tuberculosis H37Rv
gugcugcaccuggc

SEQ ID NO: 3349508 - RNA, 17 nt, Mycobacterium tuberculosis H37Rv
gugcugcagaucggccg

SEQ ID NO: 3349509 - RNA, 13 nt, Mycobacterium tuberculosis H37Rv
gugcugccaagca

SEQ ID NO: 3349510 - RNA, 23 nt, Mycobacterium tuberculosis H37Rv
gugcugccaccggccggcgcagu

SEQ ID NO: 3349511 - RNA, 13 nt, Mycobacterium tuberculosis H37Rv
gugcugccgcaca

SEQ ID NO: 3349512 - RNA, 15 nt, Mycobacterium tuberculosis H37Rv
gugcugccgccuugg

SEQ ID NO: 3349513 - RNA, 14 nt, Mycobacterium tuberculosis H37Rv
gugcugccuuggga

SEQ ID NO: 3349514 - RNA, 16 nt, Mycobacterium tuberculosis H37Rv
guggccgcugccagcc

SEQ ID NO: 3349515 - RNA, 18 nt, Mycobacterium tuberculosis H37Rv
guggccgcugccagccgu

SEQ ID NO: 3349516 - RNA, 14 nt, Mycobacterium tuberculosis H37Rv
guggccggacccau

SEQ ID NO: 3349517 - RNA, 16 nt, Mycobacterium tuberculosis H37Rv
guggccggggugccgg

SEQ ID NO: 3349518 - RNA, 16 nt, Mycobacterium tuberculosis H37Rv
guggccgucgccgaag

SEQ ID NO: 3349519 - RNA, 22 nt, Mycobacterium tuberculosis H37Rv
guggccgucgggugcagcacgg

SEQ ID NO: 3349520 - RNA, 22 nt, Mycobacterium tuberculosis H37Rv
guggccgugaagggauccggaa

SEQ ID NO: 3349521 - RNA, 22 nt, Mycobacterium tuberculosis H37Rv
guggccguggguuugagccaau

SEQ ID NO: 3349522 - RNA, 17 nt, Mycobacterium tuberculosis H37Rv
guggccucauccaccga

SEQ ID NO: 3349523 - RNA, 17 nt, Mycobacterium tuberculosis H37Rv
guggccucgucccggac

SEQ ID NO: 3349524 - RNA, 14 nt, Mycobacterium tuberculosis H37Rv
guggccugucgaag

SEQ ID NO: 3349525 - RNA, 13 nt, Mycobacterium tuberculosis H37Rv
guggccuucuggu

SEQ ID NO: 3349526 - RNA, 13 nt, Mycobacterium tuberculosis H37Rv
guggcgagcgccu

SEQ ID NO: 3349527 - RNA, 13 nt, Mycobacterium tuberculosis H37Rv
guggcgaucaucg

SEQ ID NO: 3349528 - RNA, 14 nt, Mycobacterium tuberculosis H37Rv
guggcgccacggca

SEQ ID NO: 3349529 - RNA, 13 nt, Mycobacterium tuberculosis H37Rv
guggcgccaugaa

SEQ ID NO: 3349530 - RNA, 21 nt, Mycobacterium tuberculosis H37Rv
guggcgccaugaagccgggcg

SEQ ID NO: 3349531 - RNA, 18 nt, Mycobacterium tuberculosis H37Rv
guggcgcccauggccacc

SEQ ID NO: 3349532 - RNA, 16 nt, Mycobacterium tuberculosis H37Rv
guggcgccgaccugga

SEQ ID NO: 3349533 - RNA, 14 nt, Mycobacterium tuberculosis H37Rv
guggcgccggccac

SEQ ID NO: 3349534 - RNA, 15 nt, Mycobacterium tuberculosis H37Rv
guggcgccggccacg

SEQ ID NO: 3349535 - RNA, 22 nt, Mycobacterium tuberculosis H37Rv
guggcgccguugucggcgguga

SEQ ID NO: 3349536 - RNA, 13 nt, Mycobacterium tuberculosis H37Rv
guggcggacggcg

SEQ ID NO: 3349537 - RNA, 12 nt, Mycobacterium tuberculosis H37Rv
guggcggccucc

SEQ ID NO: 3349538 - RNA, 12 nt, Mycobacterium tuberculosis H37Rv
guggcggcgcug

SEQ ID NO: 3349539 - RNA, 15 nt, Mycobacterium tuberculosis H37Rv
guggcgggagaucgu

SEQ ID NO: 3349540 - RNA, 19 nt, Mycobacterium tuberculosis H37Rv
guggcgggccggaugacgc

SEQ ID NO: 3349541 - RNA, 21 nt, Mycobacterium tuberculosis H37Rv
guggcgggcugcagccgacag

SEQ ID NO: 3349542 - RNA, 16 nt, Mycobacterium tuberculosis H37Rv
guggcgggcuugccgu

SEQ ID NO: 3349543 - RNA, 16 nt, Mycobacterium tuberculosis H37Rv
guggcgggucagccuu

SEQ ID NO: 3349544 - RNA, 17 nt, Mycobacterium tuberculosis H37Rv
guggcguaauugucgau

SEQ ID NO: 3349545 - RNA, 13 nt, Mycobacterium tuberculosis H37Rv
guggcgucgcucg

SEQ ID NO: 3349546 - RNA, 19 nt, Mycobacterium tuberculosis H37Rv
guggcgugcgcguccagau

SEQ ID NO: 3349547 - RNA, 13 nt, Mycobacterium tuberculosis H37Rv
guggcguguggcu

SEQ ID NO: 3349548 - RNA, 21 nt, Mycobacterium tuberculosis H37Rv
guggcguuacgcucggcgaac

SEQ ID NO: 3349549 - RNA, 19 nt, Mycobacterium tuberculosis H37Rv
guggcguuugaugcgggcg

SEQ ID NO: 3349550 - RNA, 18 nt, Mycobacterium tuberculosis H37Rv
guggcuauuccgacucga

SEQ ID NO: 3349551 - RNA, 14 nt, Mycobacterium tuberculosis H37Rv
guggcucgacgaug

SEQ ID NO: 3349552 - RNA, 14 nt, Mycobacterium tuberculosis H37Rv
guggcucggguggu

SEQ ID NO: 3349553 - RNA, 19 nt, Mycobacterium tuberculosis H37Rv
guggcugaucccggccagg

SEQ ID NO: 3349554 - RNA, 22 nt, Mycobacterium tuberculosis H37Rv
guggcugcgauuuucggcacgg

SEQ ID NO: 3349555 - RNA, 14 nt, Mycobacterium tuberculosis H37Rv
guggcugcuggcgc

SEQ ID NO: 3349556 - RNA, 14 nt, Mycobacterium tuberculosis H37Rv
guggcuucacccaa

SEQ ID NO: 3349557 - RNA, 16 nt, Mycobacterium tuberculosis H37Rv
guggcuuugacugcug

SEQ ID NO: 3349558 - RNA, 21 nt, Mycobacterium tuberculosis H37Rv
guggcuuugacugcugggggu

SEQ ID NO: 3349559 - RNA, 19 nt, Mycobacterium tuberculosis H37Rv
guggcuuuugcgucugcuc

SEQ ID NO: 3349560 - RNA, 18 nt, Mycobacterium tuberculosis H37Rv
gugggacaaagacgccgu

SEQ ID NO: 3349561 - RNA, 14 nt, Mycobacterium tuberculosis H37Rv
gugggacaccaucu

SEQ ID NO: 3349562 - RNA, 16 nt, Mycobacterium tuberculosis H37Rv
gugggacgggcgcguc

SEQ ID NO: 3349563 - RNA, 14 nt, Mycobacterium tuberculosis H37Rv
gugggagcagccga

SEQ ID NO: 3349564 - RNA, 19 nt, Mycobacterium tuberculosis H37Rv
gugggcaagcugaccgcca

SEQ ID NO: 3349565 - RNA, 13 nt, Mycobacterium tuberculosis H37Rv
gugggcacagcga

SEQ ID NO: 3349566 - RNA, 22 nt, Mycobacterium tuberculosis H37Rv
gugggcacagcgaccaucgccg

SEQ ID NO: 3349567 - RNA, 21 nt, Mycobacterium tuberculosis H37Rv
gugggcagauacgagcuguac

SEQ ID NO: 3349568 - RNA, 14 nt, Mycobacterium tuberculosis H37Rv
gugggccacgauga

SEQ ID NO: 3349569 - RNA, 23 nt, Mycobacterium tuberculosis H37Rv
gugggccacuugaugcucgaugc

SEQ ID NO: 3349570 - RNA, 14 nt, Mycobacterium tuberculosis H37Rv
gugggccccgccga

SEQ ID NO: 3349571 - RNA, 18 nt, Mycobacterium tuberculosis H37Rv
gugggccgcccaaagaaa

SEQ ID NO: 3349572 - RNA, 20 nt, Mycobacterium tuberculosis H37Rv
gugggccucgaucagcgccg

SEQ ID NO: 3349573 - RNA, 14 nt, Mycobacterium tuberculosis H37Rv
gugggcgacggcca

SEQ ID NO: 3349574 - RNA, 19 nt, Mycobacterium tuberculosis H37Rv
gugggcgacggccaagauc

SEQ ID NO: 3349575 - RNA, 18 nt, Mycobacterium tuberculosis H37Rv
gugggcgcaacgacgcua

SEQ ID NO: 3349576 - RNA, 17 nt, Mycobacterium tuberculosis H37Rv
gugggcgccgacaccgg

SEQ ID NO: 3349577 - RNA, 16 nt, Mycobacterium tuberculosis H37Rv
gugggcgccgcaaccg

SEQ ID NO: 3349578 - RNA, 13 nt, Mycobacterium tuberculosis H37Rv
gugggcgccgucg

SEQ ID NO: 3349579 - RNA, 19 nt, Mycobacterium tuberculosis H37Rv
gugggcgccgucgccguug

SEQ ID NO: 3349580 - RNA, 15 nt, Mycobacterium tuberculosis H37Rv
gugggcggcucgucg

SEQ ID NO: 3349581 - RNA, 14 nt, Mycobacterium tuberculosis H37Rv
gugggcgugacggg

SEQ ID NO: 3349582 - RNA, 13 nt, Mycobacterium tuberculosis H37Rv
gugggcgugcagg

SEQ ID NO: 3349583 - RNA, 13 nt, Mycobacterium tuberculosis H37Rv
gugggcguggcug

SEQ ID NO: 3349584 - RNA, 13 nt, Mycobacterium tuberculosis H37Rv
gugggcguucccc

SEQ ID NO: 3349585 - RNA, 17 nt, Mycobacterium tuberculosis H37Rv
gugggcucguagcgcgc

SEQ ID NO: 3349586 - RNA, 17 nt, Mycobacterium tuberculosis H37Rv
gugggcuuggcuguggu

SEQ ID NO: 3349587 - RNA, 20 nt, Mycobacterium tuberculosis H37Rv
gugggcuuggcugugguagg

SEQ ID NO: 3349588 - RNA, 12 nt, Mycobacterium tuberculosis H37Rv
gugggcuuggug

SEQ ID NO: 3349589 - RNA, 20 nt, Mycobacterium tuberculosis H37Rv
gugggcuuugccgucgagca

SEQ ID NO: 3349590 - RNA, 20 nt, Mycobacterium tuberculosis H37Rv
gugggcuuuugcgucugcuc

SEQ ID NO: 3349591 - RNA, 19 nt, Mycobacterium tuberculosis H37Rv
guggggauagccgcgucgc

SEQ ID NO: 3349592 - RNA, 13 nt, Mycobacterium tuberculosis H37Rv
guggggaucacga

SEQ ID NO: 3349593 - RNA, 21 nt, Mycobacterium tuberculosis H37Rv
guggggaucacgaucacacca

SEQ ID NO: 3349594 - RNA, 21 nt, Mycobacterium tuberculosis H37Rv
guggggauucguugucgagca

SEQ ID NO: 3349595 - RNA, 19 nt, Mycobacterium tuberculosis H37Rv
guggggccggcgucgauga

SEQ ID NO: 3349596 - RNA, 15 nt, Mycobacterium tuberculosis H37Rv
guggggcgcgccggc

SEQ ID NO: 3349597 - RNA, 14 nt, Mycobacterium tuberculosis H37Rv
gugggguggggagc

SEQ ID NO: 3349598 - RNA, 17 nt, Mycobacterium tuberculosis H37Rv
guggguagccagcgcgc

SEQ ID NO: 3349599 - RNA, 18 nt, Mycobacterium tuberculosis H37Rv
guggguccaacccgcgau

SEQ ID NO: 3349600 - RNA, 17 nt, Mycobacterium tuberculosis H37Rv
gugggugaagagaaguc

SEQ ID NO: 3349601 - RNA, 20 nt, Mycobacterium tuberculosis H37Rv
guggguguuguugugggugg

SEQ ID NO: 3349602 - RNA, 18 nt, Mycobacterium tuberculosis H37Rv
gugguaaccauauggccc

SEQ ID NO: 3349603 - RNA, 21 nt, Mycobacterium tuberculosis H37Rv
gugguaaccauauggcccgcg

SEQ ID NO: 3349604 - RNA, 15 nt, Mycobacterium tuberculosis H37Rv
gugguaagacgccga

SEQ ID NO: 3349605 - RNA, 23 nt, Mycobacterium tuberculosis H37Rv
gugguaccaacgcuucugccugc

SEQ ID NO: 3349606 - RNA, 20 nt, Mycobacterium tuberculosis H37Rv
gugguacgugcgagcccacc

SEQ ID NO: 3349607 - RNA, 20 nt, Mycobacterium tuberculosis H37Rv
gugguacuuucacgcucguu

SEQ ID NO: 3349608 - RNA, 16 nt, Mycobacterium tuberculosis H37Rv
gugguagaggaacaga

SEQ ID NO: 3349609 - RNA, 21 nt, Mycobacterium tuberculosis H37Rv
gugguagcgacgauguuggug

SEQ ID NO: 3349610 - RNA, 18 nt, Mycobacterium tuberculosis H37Rv
gugguaggacgccagcaa

SEQ ID NO: 3349611 - RNA, 22 nt, Mycobacterium tuberculosis H37Rv
gugucguaggcgaugagcgugc

SEQ ID NO: 3349612 - RNA, 17 nt, Mycobacterium tuberculosis H37Rv
gugucgucgaggucagu

SEQ ID NO: 3349613 - RNA, 18 nt, Mycobacterium tuberculosis H37Rv
gugucgucggaccucgcc

SEQ ID NO: 3349614 - RNA, 21 nt, Mycobacterium tuberculosis H37Rv
gugucguucggcgaggacggc

SEQ ID NO: 3349615 - RNA, 22 nt, Mycobacterium tuberculosis H37Rv
gugucucggcugauagggcugu

SEQ ID NO: 3349616 - RNA, 14 nt, Mycobacterium tuberculosis H37Rv
gugugacggcggcc

SEQ ID NO: 3349617 - RNA, 14 nt, Mycobacterium tuberculosis H37Rv
gugugauacagcgc

SEQ ID NO: 3349618 - RNA, 15 nt, Mycobacterium tuberculosis H37Rv
gugugcacgcgggcg

SEQ ID NO: 3349619 - RNA, 13 nt, Mycobacterium tuberculosis H37Rv
gugugcagcagca

SEQ ID NO: 3349620 - RNA, 21 nt, Mycobacterium tuberculosis H37Rv
gugugcaguccgaugccggaa

SEQ ID NO: 3349621 - RNA, 14 nt, Mycobacterium tuberculosis H37Rv
gugugccguggucg

SEQ ID NO: 3349622 - RNA, 18 nt, Mycobacterium tuberculosis H37Rv
gugugccugcgucucgau

SEQ ID NO: 3349623 - RNA, 14 nt, Mycobacterium tuberculosis H37Rv
gugugcgacgacgg

SEQ ID NO: 3349624 - RNA, 16 nt, Mycobacterium tuberculosis H37Rv
gugugcgcaugguggg

SEQ ID NO: 3349625 - RNA, 21 nt, Mycobacterium tuberculosis H37Rv
gugugcgccaaggucugccgg

SEQ ID NO: 3349626 - RNA, 16 nt, Mycobacterium tuberculosis H37Rv
gugugcgugcggucga

SEQ ID NO: 3349627 - RNA, 14 nt, Mycobacterium tuberculosis H37Rv
gugugcucacgcau

SEQ ID NO: 3349628 - RNA, 15 nt, Mycobacterium tuberculosis H37Rv
gugugcugccgcaca

SEQ ID NO: 3349629 - RNA, 15 nt, Mycobacterium tuberculosis H37Rv
gugugcuucgagcac

SEQ ID NO: 3349630 - RNA, 22 nt, Mycobacterium tuberculosis H37Rv
gugugcuucgagcaccgacacc

SEQ ID NO: 3349631 - RNA, 17 nt, Mycobacterium tuberculosis H37Rv
guguggaacauccgcac

SEQ ID NO: 3349632 - RNA, 22 nt, Mycobacterium tuberculosis H37Rv
guguggagcucgcggcgcaggu

SEQ ID NO: 3349633 - RNA, 18 nt, Mycobacterium tuberculosis H37Rv
guguggcaccgugggcgg

SEQ ID NO: 3349634 - RNA, 13 nt, Mycobacterium tuberculosis H37Rv
guguggcagcccc

SEQ ID NO: 3349635 - RNA, 14 nt, Mycobacterium tuberculosis H37Rv
guguggcagcccca

SEQ ID NO: 3349636 - RNA, 21 nt, Mycobacterium tuberculosis H37Rv
guguggcccaaccgcauucgg

SEQ ID NO: 3349637 - RNA, 21 nt, Mycobacterium tuberculosis H37Rv
guguggcuugcgucgcggacg

SEQ ID NO: 3349638 - RNA, 15 nt, Mycobacterium tuberculosis H37Rv
gugugggggucaggg

SEQ ID NO: 3349639 - RNA, 16 nt, Mycobacterium tuberculosis H37Rv
gugugggggucagggg

SEQ ID NO: 3349640 - RNA, 12 nt, Mycobacterium tuberculosis H37Rv
guguggucacca

SEQ ID NO: 3349641 - RNA, 22 nt, Mycobacterium tuberculosis H37Rv
gugugugcaagccgaacaccgu

SEQ ID NO: 3349642 - RNA, 17 nt, Mycobacterium tuberculosis H37Rv
guguuccggucgcccga

SEQ ID NO: 3349643 - RNA, 17 nt, Mycobacterium tuberculosis H37Rv
guguucgacacccucgg

SEQ ID NO: 3349644 - RNA, 21 nt, Mycobacterium tuberculosis H37Rv
guguucgaccgcagggaccgg

SEQ ID NO: 3349645 - RNA, 21 nt, Mycobacterium tuberculosis H37Rv
guguucggugguccuggcgaa

SEQ ID NO: 3349646 - RNA, 22 nt, Mycobacterium tuberculosis H37Rv
guguugagaucgcccgaguuga

SEQ ID NO: 3349647 - RNA, 16 nt, Mycobacterium tuberculosis H37Rv
guguugagcggcagcc

SEQ ID NO: 3349648 - RNA, 20 nt, Mycobacterium tuberculosis H37Rv
guguugaggcguaccagcug

SEQ ID NO: 3349649 - RNA, 14 nt, Mycobacterium tuberculosis H37Rv
guguugagggugcc

SEQ ID NO: 3349650 - RNA, 17 nt, Mycobacterium tuberculosis H37Rv
guguugagggugcccga

SEQ ID NO: 3349651 - RNA, 22 nt, Mycobacterium tuberculosis H37Rv
guguugauguugccggaguuga

SEQ ID NO: 3349652 - RNA, 23 nt, Mycobacterium tuberculosis H37Rv
guguugccagaucagcaccgaca

SEQ ID NO: 3349653 - RNA, 16 nt, Mycobacterium tuberculosis H37Rv
guguugccgaagcccg

SEQ ID NO: 3349654 - RNA, 16 nt, Mycobacterium tuberculosis H37Rv
guguuggccgggucgu

SEQ ID NO: 3349655 - RNA, 23 nt, Mycobacterium tuberculosis H37Rv
guguugguggauucgaucaggcc

SEQ ID NO: 3349656 - RNA, 16 nt, Mycobacterium tuberculosis H37Rv
guguuguaggccgggc

SEQ ID NO: 3349657 - RNA, 15 nt, Mycobacterium tuberculosis H37Rv
guguuguuagccccg

SEQ ID NO: 3349658 - RNA, 15 nt, Mycobacterium tuberculosis H37Rv
guguuuaugguugug

SEQ ID NO: 3349659 - RNA, 23 nt, Mycobacterium tuberculosis H37Rv
guuaaucaaggugaucagcagga

SEQ ID NO: 3349660 - RNA, 13 nt, Mycobacterium tuberculosis H37Rv
guuacccaucgcc

SEQ ID NO: 3349661 - RNA, 22 nt, Mycobacterium tuberculosis H37Rv
guuacccaucgccacacccaaa

SEQ ID NO: 3349662 - RNA, 16 nt, Mycobacterium tuberculosis H37Rv
guuaccgaaggucauc

SEQ ID NO: 3349663 - RNA, 21 nt, Mycobacterium tuberculosis H37Rv
guuaccgccggcgccggugcc

SEQ ID NO: 3349664 - RNA, 18 nt, Mycobacterium tuberculosis H37Rv
guuacgcaucgucagcga

SEQ ID NO: 3349665 - RNA, 13 nt, Mycobacterium tuberculosis H37Rv
guuacggagggca

SEQ ID NO: 3349666 - RNA, 20 nt, Mycobacterium tuberculosis H37Rv
guuacguuguacucgugcgg

SEQ ID NO: 3349667 - RNA, 16 nt, Mycobacterium tuberculosis H37Rv
guuacucgcagcgccg

SEQ ID NO: 3349668 - RNA, 15 nt, Mycobacterium tuberculosis H37Rv
guuacuggagauacc

SEQ ID NO: 3349669 - RNA, 14 nt, Mycobacterium tuberculosis H37Rv
guuagcaccaguuc

SEQ ID NO: 3349670 - RNA, 21 nt, Mycobacterium tuberculosis H37Rv
guuagcauugaguucggccac

SEQ ID NO: 3349671 - RNA, 22 nt, Mycobacterium tuberculosis H37Rv
guuagcauugaguucggccacc

SEQ ID NO: 3349672 - RNA, 22 nt, Mycobacterium tuberculosis H37Rv
guuagccggguuggccggcgcu

SEQ ID NO: 3349673 - RNA, 19 nt, Mycobacterium tuberculosis H37Rv
guuagcgcggccagcagca

SEQ ID NO: 3349674 - RNA, 14 nt, Mycobacterium tuberculosis H37Rv
guuagcggcgggca

SEQ ID NO: 3349675 - RNA, 15 nt, Mycobacterium tuberculosis H37Rv
guuagcggcgggcac

SEQ ID NO: 3349676 - RNA, 22 nt, Mycobacterium tuberculosis H37Rv
guuagcggugaugggggugcac

SEQ ID NO: 3349677 - RNA, 19 nt, Mycobacterium tuberculosis H37Rv
guuaggaguggccgggcgg

SEQ ID NO: 3349678 - RNA, 22 nt, Mycobacterium tuberculosis H37Rv
guuaggcgauaucgcacaugga

SEQ ID NO: 3349679 - RNA, 14 nt, Mycobacterium tuberculosis H37Rv
guuaucgaagcccg

SEQ ID NO: 3349680 - RNA, 22 nt, Mycobacterium tuberculosis H37Rv
guuaugacgugaguuucaccac

SEQ ID NO: 3349681 - RNA, 13 nt, Mycobacterium tuberculosis H37Rv
guuauucggugcg

SEQ ID NO: 3349682 - RNA, 22 nt, Mycobacterium tuberculosis H37Rv
guucaaccggacgcccucacgc

SEQ ID NO: 3349683 - RNA, 17 nt, Mycobacterium tuberculosis H37Rv
guucaccaacgcgggaa

SEQ ID NO: 3349684 - RNA, 16 nt, Mycobacterium tuberculosis H37Rv
guucaccacgucgucg

SEQ ID NO: 3349685 - RNA, 19 nt, Mycobacterium tuberculosis H37Rv
guucacccacuccgccgau

SEQ ID NO: 3349686 - RNA, 15 nt, Mycobacterium tuberculosis H37Rv
guucacccagcggcg

SEQ ID NO: 3349687 - RNA, 15 nt, Mycobacterium tuberculosis H37Rv
guucaccgaggugcc

SEQ ID NO: 3349688 - RNA, 19 nt, Mycobacterium tuberculosis H37Rv
guucaccucggcgacgaug

SEQ ID NO: 3349689 - RNA, 21 nt, Mycobacterium tuberculosis H37Rv
guucaccucggcgacgaugau

SEQ ID NO: 3349690 - RNA, 21 nt, Mycobacterium tuberculosis H37Rv
guucacgccagucccacuggg

SEQ ID NO: 3349691 - RNA, 21 nt, Mycobacterium tuberculosis H37Rv
guucacgcgcggaucggcggc

SEQ ID NO: 3349692 - RNA, 16 nt, Mycobacterium tuberculosis H37Rv
guucacgcucgacgac

SEQ ID NO: 3349693 - RNA, 12 nt, Mycobacterium tuberculosis H37Rv
guucacgguuga

SEQ ID NO: 3349694 - RNA, 16 nt, Mycobacterium tuberculosis H37Rv
guucacguucagccca

SEQ ID NO: 3349695 - RNA, 15 nt, Mycobacterium tuberculosis H37Rv
guucacucucggcgc

SEQ ID NO: 3349696 - RNA, 19 nt, Mycobacterium tuberculosis H37Rv
guucagcaggcccuucagu

SEQ ID NO: 3349697 - RNA, 20 nt, Mycobacterium tuberculosis H37Rv
guucagccacgcagcacggc

SEQ ID NO: 3349698 - RNA, 18 nt, Mycobacterium tuberculosis H37Rv
guucagcccgccgacgau

SEQ ID NO: 3349699 - RNA, 19 nt, Mycobacterium tuberculosis H37Rv
guucagcccgccgacgauc

SEQ ID NO: 3349700 - RNA, 15 nt, Mycobacterium tuberculosis H37Rv
guucagcgaccaaug

SEQ ID NO: 3349701 - RNA, 22 nt, Mycobacterium tuberculosis H37Rv
guucagcgccacguccaucacc

SEQ ID NO: 3349702 - RNA, 14 nt, Mycobacterium tuberculosis H37Rv
guucagcgcuggca

SEQ ID NO: 3349703 - RNA, 17 nt, Mycobacterium tuberculosis H37Rv
guucagcgcuggcaggc

SEQ ID NO: 3349704 - RNA, 19 nt, Mycobacterium tuberculosis H37Rv
guucagcgcuggcaggccg

SEQ ID NO: 3349705 - RNA, 21 nt, Mycobacterium tuberculosis H37Rv
guucagcgcuggcaggccggg

SEQ ID NO: 3349706 - RNA, 16 nt, Mycobacterium tuberculosis H37Rv
guucagcuuccgaauc

SEQ ID NO: 3349707 - RNA, 11 nt, Mycobacterium tuberculosis H37Rv
guucuuggcca

SEQ ID NO: 3349708 - RNA, 16 nt, Mycobacterium tuberculosis H37Rv
guucuugucgaaguaa

SEQ ID NO: 3349709 - RNA, 21 nt, Mycobacterium tuberculosis H37Rv
guugaacaauccgguguugag

SEQ ID NO: 3349710 - RNA, 15 nt, Mycobacterium tuberculosis H37Rv
guugaacauguccag

SEQ ID NO: 3349711 - RNA, 18 nt, Mycobacterium tuberculosis H37Rv
guugaacgccgccagcag

SEQ ID NO: 3349712 - RNA, 21 nt, Mycobacterium tuberculosis H37Rv
guugaacucgaccaccgccgg

SEQ ID NO: 3349713 - RNA, 14 nt, Mycobacterium tuberculosis H37Rv
guugaagaagcccg

SEQ ID NO: 3349714 - RNA, 22 nt, Mycobacterium tuberculosis H37Rv
guugaagaagcccgaguuguuc

SEQ ID NO: 3349715 - RNA, 22 nt, Mycobacterium tuberculosis H37Rv
guugaagaagccgguguugaug

SEQ ID NO: 3349716 - RNA, 22 nt, Mycobacterium tuberculosis H37Rv
guugaaucccagauaugcagga

SEQ ID NO: 3349717 - RNA, 13 nt, Mycobacterium tuberculosis H37Rv
guugacaccaggg

SEQ ID NO: 3349718 - RNA, 20 nt, Mycobacterium tuberculosis H37Rv
guugaccagaaccuggagcc

SEQ ID NO: 3349719 - RNA, 20 nt, Mycobacterium tuberculosis H37Rv
guugacccguacccacgacg

SEQ ID NO: 3349720 - RNA, 20 nt, Mycobacterium tuberculosis H37Rv
guugaccgggucgccgauga

SEQ ID NO: 3349721 - RNA, 14 nt, Mycobacterium tuberculosis H37Rv
guugaccguggucg

SEQ ID NO: 3349722 - RNA, 17 nt, Mycobacterium tuberculosis H37Rv
guugaccuccuccuccg

SEQ ID NO: 3349723 - RNA, 14 nt, Mycobacterium tuberculosis H37Rv
guugaccucgcgca

SEQ ID NO: 3349724 - RNA, 14 nt, Mycobacterium tuberculosis H37Rv
guugaccucgguga

SEQ ID NO: 3349725 - RNA, 13 nt, Mycobacterium tuberculosis H37Rv
guugaccugcgca

SEQ ID NO: 3349726 - RNA, 21 nt, Mycobacterium tuberculosis H37Rv
guugacgaucuccgccaaccg

SEQ ID NO: 3349727 - RNA, 19 nt, Mycobacterium tuberculosis H37Rv
guugacgccgguccccgcc

SEQ ID NO: 3349728 - RNA, 16 nt, Mycobacterium tuberculosis H37Rv
guugacgggcucggca

SEQ ID NO: 3349729 - RNA, 18 nt, Mycobacterium tuberculosis H37Rv
guugacggucagccgcgg

SEQ ID NO: 3349730 - RNA, 18 nt, Mycobacterium tuberculosis H37Rv
guugacggugguccugau

SEQ ID NO: 3349731 - RNA, 18 nt, Mycobacterium tuberculosis H37Rv
guugacggugucuugcca

SEQ ID NO: 3349732 - RNA, 14 nt, Mycobacterium tuberculosis H37Rv
guugacguccaaca

SEQ ID NO: 3349733 - RNA, 14 nt, Mycobacterium tuberculosis H37Rv
guugacgucgagca

SEQ ID NO: 3349734 - RNA, 19 nt, Mycobacterium tuberculosis H37Rv
guugacucugcguccacca

SEQ ID NO: 3349735 - RNA, 17 nt, Mycobacterium tuberculosis H37Rv
guugagauggucaccgg

SEQ ID NO: 3349736 - RNA, 16 nt, Mycobacterium tuberculosis H37Rv
guugagcagcuuggug

SEQ ID NO: 3349737 - RNA, 19 nt, Mycobacterium tuberculosis H37Rv
guugagcagcuugguggcg

SEQ ID NO: 3349738 - RNA, 14 nt, Mycobacterium tuberculosis H37Rv
guugagcuggaccu

SEQ ID NO: 3349739 - RNA, 17 nt, Mycobacterium tuberculosis H37Rv
guugaggacguggacuu

SEQ ID NO: 3349740 - RNA, 20 nt, Mycobacterium tuberculosis H37Rv
guugaggagguccucgacga

SEQ ID NO: 3349741 - RNA, 16 nt, Mycobacterium tuberculosis H37Rv
guugaggccggugaac

SEQ ID NO: 3349742 - RNA, 12 nt, Mycobacterium tuberculosis H37Rv
guugaucagcca

SEQ ID NO: 3349743 - RNA, 15 nt, Mycobacterium tuberculosis H37Rv
guugaucagccagac

SEQ ID NO: 3349744 - RNA, 16 nt, Mycobacterium tuberculosis H37Rv
guugaucagugccagg

SEQ ID NO: 3349745 - RNA, 15 nt, Mycobacterium tuberculosis H37Rv
guugaucgcggacac

SEQ ID NO: 3349746 - RNA, 21 nt, Mycobacterium tuberculosis H37Rv
guugaucgcggacacugcgaa

SEQ ID NO: 3349747 - RNA, 20 nt, Mycobacterium tuberculosis H37Rv
guugaucguggcgaccacga

SEQ ID NO: 3349748 - RNA, 16 nt, Mycobacterium tuberculosis H37Rv
guugaucuggcguuca

SEQ ID NO: 3349749 - RNA, 18 nt, Mycobacterium tuberculosis H37Rv
guugaucuugacggucgc

SEQ ID NO: 3349750 - RNA, 13 nt, Mycobacterium tuberculosis H37Rv
guugaugaacagu

SEQ ID NO: 3349751 - RNA, 13 nt, Mycobacterium tuberculosis H37Rv
guugaugaagguc

SEQ ID NO: 3349752 - RNA, 17 nt, Mycobacterium tuberculosis H37Rv
guugaugcggaugucgu

SEQ ID NO: 3349753 - RNA, 23 nt, Mycobacterium tuberculosis H37Rv
guugaugcguagugcggcgugga

SEQ ID NO: 3349754 - RNA, 19 nt, Mycobacterium tuberculosis H37Rv
guugauguugccggaguug

SEQ ID NO: 3349755 - RNA, 15 nt, Mycobacterium tuberculosis H37Rv
guugauucgugcgau

SEQ ID NO: 3349756 - RNA, 21 nt, Mycobacterium tuberculosis H37Rv
guugcaauacacguugccgau

SEQ ID NO: 3349757 - RNA, 18 nt, Mycobacterium tuberculosis H37Rv
guugcacguucggcgugu

SEQ ID NO: 3349758 - RNA, 21 nt, Mycobacterium tuberculosis H37Rv
guugcacugcucguugaugaa

SEQ ID NO: 3349759 - RNA, 13 nt, Mycobacterium tuberculosis H37Rv
guugcacugcugg

SEQ ID NO: 3349760 - RNA, 15 nt, Mycobacterium tuberculosis H37Rv
guugcagaccgggug

SEQ ID NO: 3349761 - RNA, 12 nt, Mycobacterium tuberculosis H37Rv
guugcagcagca

SEQ ID NO: 3349762 - RNA, 15 nt, Mycobacterium tuberculosis H37Rv
guugcaggcgcagcu

SEQ ID NO: 3349763 - RNA, 18 nt, Mycobacterium tuberculosis H37Rv
guugcaguggcgacgagc

SEQ ID NO: 3349764 - RNA, 16 nt, Mycobacterium tuberculosis H37Rv
guugcaucgccgcgau

SEQ ID NO: 3349765 - RNA, 14 nt, Mycobacterium tuberculosis H37Rv
guugccaacaacau

SEQ ID NO: 3349766 - RNA, 19 nt, Mycobacterium tuberculosis H37Rv
guugccaacgaaccgcuca

SEQ ID NO: 3349767 - RNA, 18 nt, Mycobacterium tuberculosis H37Rv
guugccaagcagcugggc

SEQ ID NO: 3349768 - RNA, 16 nt, Mycobacterium tuberculosis H37Rv
guugccaucaaggcca

SEQ ID NO: 3349769 - RNA, 19 nt, Mycobacterium tuberculosis H37Rv
guugccaucaaggccaccu

SEQ ID NO: 3349770 - RNA, 20 nt, Mycobacterium tuberculosis H37Rv
guugccaucaaggccaccuc

SEQ ID NO: 3349771 - RNA, 17 nt, Mycobacterium tuberculosis H37Rv
guugcccgacccgccga

SEQ ID NO: 3349772 - RNA, 14 nt, Mycobacterium tuberculosis H37Rv
guugcccugcaacc

SEQ ID NO: 3349773 - RNA, 17 nt, Mycobacterium tuberculosis H37Rv
guugccgaagcccgagc

SEQ ID NO: 3349774 - RNA, 17 nt, Mycobacterium tuberculosis H37Rv
guugccgacgagacggc

SEQ ID NO: 3349775 - RNA, 22 nt, Mycobacterium tuberculosis H37Rv
guugccgauccccaggccgcuu

SEQ ID NO: 3349776 - RNA, 18 nt, Mycobacterium tuberculosis H37Rv
guugccgaucccggcgag

SEQ ID NO: 3349777 - RNA, 19 nt, Mycobacterium tuberculosis H37Rv
guugccgaucccggcgagc

SEQ ID NO: 3349778 - RNA, 14 nt, Mycobacterium tuberculosis H37Rv
guugccgccagcgc

SEQ ID NO: 3349779 - RNA, 15 nt, Mycobacterium tuberculosis H37Rv
guugccgccagcgcc

SEQ ID NO: 3349780 - RNA, 19 nt, Mycobacterium tuberculosis H37Rv
guugccgccauuggcaggc

SEQ ID NO: 3349781 - RNA, 12 nt, Mycobacterium tuberculosis H37Rv
guugccgcccgu

SEQ ID NO: 3349782 - RNA, 15 nt, Mycobacterium tuberculosis H37Rv
guugccgccggccau

SEQ ID NO: 3349783 - RNA, 15 nt, Mycobacterium tuberculosis H37Rv
guugccgccggugcc

SEQ ID NO: 3349784 - RNA, 22 nt, Mycobacterium tuberculosis H37Rv
guugccgccggugccgaucagc

SEQ ID NO: 3349785 - RNA, 20 nt, Mycobacterium tuberculosis H37Rv
guugccgccgucaccgccga

SEQ ID NO: 3349786 - RNA, 20 nt, Mycobacterium tuberculosis H37Rv
guugccgccguuaccgccgu

SEQ ID NO: 3349787 - RNA, 22 nt, Mycobacterium tuberculosis H37Rv
guugccgcgaucgggcccagca

SEQ ID NO: 3349788 - RNA, 21 nt, Mycobacterium tuberculosis H37Rv
guugccgcgccacuguagggc

SEQ ID NO: 3349789 - RNA, 13 nt, Mycobacterium tuberculosis H37Rv
guugccggagacg

SEQ ID NO: 3349790 - RNA, 17 nt, Mycobacterium tuberculosis H37Rv
guugccggagacgucgc

SEQ ID NO: 3349791 - RNA, 14 nt, Mycobacterium tuberculosis H37Rv
guugccggcggcga

SEQ ID NO: 3349792 - RNA, 17 nt, Mycobacterium tuberculosis H37Rv
guugccgggguuggucg

SEQ ID NO: 3349793 - RNA, 23 nt, Mycobacterium tuberculosis H37Rv
guugccggucaggcaguccaccg

SEQ ID NO: 3349794 - RNA, 18 nt, Mycobacterium tuberculosis H37Rv
guugccgucagggucagc

SEQ ID NO: 3349795 - RNA, 15 nt, Mycobacterium tuberculosis H37Rv
guugccguccaccga

SEQ ID NO: 3349796 - RNA, 21 nt, Mycobacterium tuberculosis H37Rv
guugccgugacgauucgagca

SEQ ID NO: 3349797 - RNA, 16 nt, Mycobacterium tuberculosis H37Rv
guugccguuggugccg

SEQ ID NO: 3349798 - RNA, 19 nt, Mycobacterium tuberculosis H37Rv
guugccucgucgccgcggu

SEQ ID NO: 3349799 - RNA, 15 nt, Mycobacterium tuberculosis H37Rv
guugccuucuuggcg

SEQ ID NO: 3349800 - RNA, 12 nt, Mycobacterium tuberculosis H37Rv
guugccuuggcg

SEQ ID NO: 3349801 - RNA, 16 nt, Mycobacterium tuberculosis H37Rv
guugcgagccggcgaa

SEQ ID NO: 3349802 - RNA, 13 nt, Mycobacterium tuberculosis H37Rv
guugcgcggauga

SEQ ID NO: 3349803 - RNA, 23 nt, Mycobacterium tuberculosis H37Rv
guugcgcuccaacaacuccagca

SEQ ID NO: 3349804 - RNA, 20 nt, Mycobacterium tuberculosis H37Rv
guuuccaagucggagcgggg

SEQ ID NO: 3349805 - RNA, 16 nt, Mycobacterium tuberculosis H37Rv
guuuccgccgccgcca

SEQ ID NO: 3349806 - RNA, 16 nt, Mycobacterium tuberculosis H37Rv
guuuccucagcugcuc

SEQ ID NO: 3349807 - RNA, 17 nt, Mycobacterium tuberculosis H37Rv
guuucgaacaccgucca

SEQ ID NO: 3349808 - RNA, 14 nt, Mycobacterium tuberculosis H37Rv
guuucgaucucgag

SEQ ID NO: 3349809 - RNA, 16 nt, Mycobacterium tuberculosis H37Rv
guuucgaucucgagca

SEQ ID NO: 3349810 - RNA, 20 nt, Mycobacterium tuberculosis H37Rv
guuucggcgcaugugaaaga

SEQ ID NO: 3349811 - RNA, 17 nt, Mycobacterium tuberculosis H37Rv
guuucucggcguggucg

SEQ ID NO: 3349812 - RNA, 18 nt, Mycobacterium tuberculosis H37Rv
guuucucggcguggucgg

SEQ ID NO: 3349813 - RNA, 20 nt, Mycobacterium tuberculosis H37Rv
guuugagcgcacucaccuug

SEQ ID NO: 3349814 - RNA, 20 nt, Mycobacterium tuberculosis H37Rv
guuugaucaccgugguggcg

SEQ ID NO: 3349815 - RNA, 14 nt, Mycobacterium tuberculosis H37Rv
guuugaucgcaacg

SEQ ID NO: 3349816 - RNA, 23 nt, Mycobacterium tuberculosis H37Rv
guuugaucuccaccuucuggucc

SEQ ID NO: 3349817 - RNA, 17 nt, Mycobacterium tuberculosis H37Rv
guuugaugcgggcggca

SEQ ID NO: 3349818 - RNA, 14 nt, Mycobacterium tuberculosis H37Rv
guuugauuccaggu

SEQ ID NO: 3349819 - RNA, 16 nt, Mycobacterium tuberculosis H37Rv
guuugcacgcaccaca

SEQ ID NO: 3349820 - RNA, 20 nt, Mycobacterium tuberculosis H37Rv
guuugcacgcaccacaaucc

SEQ ID NO: 3349821 - RNA, 16 nt, Mycobacterium tuberculosis H37Rv
guuugcagcgggauca

SEQ ID NO: 3349822 - RNA, 14 nt, Mycobacterium tuberculosis H37Rv
guuugccgguucgg

SEQ ID NO: 3349823 - RNA, 14 nt, Mycobacterium tuberculosis H37Rv
guuugcgaagccca

SEQ ID NO: 3349824 - RNA, 17 nt, Mycobacterium tuberculosis H37Rv
guuugcgaugcccacgg

SEQ ID NO: 3349825 - RNA, 12 nt, Mycobacterium tuberculosis H37Rv
guuugcgggcgg

SEQ ID NO: 3349826 - RNA, 17 nt, Mycobacterium tuberculosis H37Rv
guuuggccaguucggug

SEQ ID NO: 3349827 - RNA, 20 nt, Mycobacterium tuberculosis H37Rv
guuuggccgacagccaccgc

SEQ ID NO: 3349828 - RNA, 19 nt, Mycobacterium tuberculosis H37Rv
guuuggugucgaucagcuc

SEQ ID NO: 3349829 - RNA, 20 nt, Mycobacterium tuberculosis H37Rv
guuuggugucgaucagcucc

SEQ ID NO: 3349830 - RNA, 16 nt, Mycobacterium tuberculosis H37Rv
guuugucgcgguggug

SEQ ID NO: 3349831 - RNA, 19 nt, Mycobacterium tuberculosis H37Rv
guuugucgugucaugcuca

SEQ ID NO: 3349832 - RNA, 17 nt, Mycobacterium tuberculosis H37Rv
guuuguuuuugccuccc

SEQ ID NO: 3349833 - RNA, 18 nt, Mycobacterium tuberculosis H37Rv
guuuuaccucggccgcca

SEQ ID NO: 3349834 - RNA, 16 nt, Mycobacterium tuberculosis H37Rv
guuuucggccgccagu

SEQ ID NO: 3349835 - RNA, 18 nt, Mycobacterium tuberculosis H37Rv
guuuucggccgccaguac

SEQ ID NO: 3349836 - RNA, 21 nt, Mycobacterium tuberculosis H37Rv
guuuucggguugggcaucagg

SEQ ID NO: 3349837 - RNA, 14 nt, Mycobacterium tuberculosis H37Rv
guuuugccgugcca

SEQ ID NO: 3349838 - RNA, 14 nt, Mycobacterium tuberculosis H37Rv
guuuuggaagcccg

SEQ ID NO: 3349839 - RNA, 14 nt, Mycobacterium tuberculosis H37Rv
uaaaaaccaccccc

SEQ ID NO: 3349840 - RNA, 15 nt, Mycobacterium tuberculosis H37Rv
uaaaaagcccagcga

SEQ ID NO: 3349841 - RNA, 20 nt, Mycobacterium tuberculosis H37Rv
uaaaaaggcaggacugaaca

SEQ ID NO: 3349842 - RNA, 23 nt, Mycobacterium tuberculosis H37Rv
uaaaacucgggggcugcacgcuc

SEQ ID NO: 3349843 - RNA, 21 nt, Mycobacterium tuberculosis H37Rv
uaaacaccgcgaacuugcuga

SEQ ID NO: 3349844 - RNA, 16 nt, Mycobacterium tuberculosis H37Rv
uaaacagcgcgccggc

SEQ ID NO: 3349845 - RNA, 20 nt, Mycobacterium tuberculosis H37Rv
uaaacauacaaaaacaccac

SEQ ID NO: 3349846 - RNA, 19 nt, Mycobacterium tuberculosis H37Rv
uaaaccagccaccaccagg

SEQ ID NO: 3349847 - RNA, 12 nt, Mycobacterium tuberculosis H37Rv
uaaaccaggugg

SEQ ID NO: 3349848 - RNA, 20 nt, Mycobacterium tuberculosis H37Rv
uaaaccgauaucgcugcgga

SEQ ID NO: 3349849 - RNA, 20 nt, Mycobacterium tuberculosis H37Rv
uaaaccuggcuaucgcagaa

SEQ ID NO: 3349850 - RNA, 22 nt, Mycobacterium tuberculosis H37Rv
uaaacggcacacgaguacagau

SEQ ID NO: 3349851 - RNA, 11 nt, Mycobacterium tuberculosis H37Rv
uaaagaagccu

SEQ ID NO: 3349852 - RNA, 21 nt, Mycobacterium tuberculosis H37Rv
uaaaugccugcccaccuucga

SEQ ID NO: 3349853 - RNA, 21 nt, Mycobacterium tuberculosis H37Rv
uaaaugggugugcugccaccg

SEQ ID NO: 3349854 - RNA, 16 nt, Mycobacterium tuberculosis H37Rv
uaaccacgacgacgac

SEQ ID NO: 3349855 - RNA, 14 nt, Mycobacterium tuberculosis H37Rv
uaacccagcaccac

SEQ ID NO: 3349856 - RNA, 16 nt, Mycobacterium tuberculosis H37Rv
uaacccagcaccacaa

SEQ ID NO: 3349857 - RNA, 13 nt, Mycobacterium tuberculosis H37Rv
uaacccagcggcg

SEQ ID NO: 3349858 - RNA, 15 nt, Mycobacterium tuberculosis H37Rv
uaacccagcggcgcc

SEQ ID NO: 3349859 - RNA, 20 nt, Mycobacterium tuberculosis H37Rv
uaacccggcuccagcaccgu

SEQ ID NO: 3349860 - RNA, 21 nt, Mycobacterium tuberculosis H37Rv
uaaccgagccgaccggcggca

SEQ ID NO: 3349861 - RNA, 17 nt, Mycobacterium tuberculosis H37Rv
uaaccgcuuggugugau

SEQ ID NO: 3349862 - RNA, 15 nt, Mycobacterium tuberculosis H37Rv
uaaccggccaugucu

SEQ ID NO: 3349863 - RNA, 12 nt, Mycobacterium tuberculosis H37Rv
uaaccggcccga

SEQ ID NO: 3349864 - RNA, 22 nt, Mycobacterium tuberculosis H37Rv
uaaccguugaccucuucgggca

SEQ ID NO: 3349865 - RNA, 14 nt, Mycobacterium tuberculosis H37Rv
uaacgacugacaac

SEQ ID NO: 3349866 - RNA, 21 nt, Mycobacterium tuberculosis H37Rv
uaacgccaagcucggcccagc

SEQ ID NO: 3349867 - RNA, 20 nt, Mycobacterium tuberculosis H37Rv
uaacgcgacaaggucgucga

SEQ ID NO: 3349868 - RNA, 15 nt, Mycobacterium tuberculosis H37Rv
uaacgcggcaccacg

SEQ ID NO: 3349869 - RNA, 15 nt, Mycobacterium tuberculosis H37Rv
uaacggagcggccua

SEQ ID NO: 3349870 - RNA, 13 nt, Mycobacterium tuberculosis H37Rv
uaacgguccucga

SEQ ID NO: 3349871 - RNA, 13 nt, Mycobacterium tuberculosis H37Rv
uaacgucacaccg

SEQ ID NO: 3349872 - RNA, 17 nt, Mycobacterium tuberculosis H37Rv
uaagacggauuguccgg

SEQ ID NO: 3349873 - RNA, 12 nt, Mycobacterium tuberculosis H37Rv
uaagcaccagcc

SEQ ID NO: 3349874 - RNA, 17 nt, Mycobacterium tuberculosis H37Rv
uaagcauucagcgcgcc

SEQ ID NO: 3349875 - RNA, 18 nt, Mycobacterium tuberculosis H37Rv
uaagcccccgcacgcacg

SEQ ID NO: 3349876 - RNA, 19 nt, Mycobacterium tuberculosis H37Rv
uaagccgcgcccaucagug

SEQ ID NO: 3349877 - RNA, 21 nt, Mycobacterium tuberculosis H37Rv
uaagccuucggugucgccgaa

SEQ ID NO: 3349878 - RNA, 22 nt, Mycobacterium tuberculosis H37Rv
uaagccuucggugucgccgaac

SEQ ID NO: 3349879 - RNA, 23 nt, Mycobacterium tuberculosis H37Rv
uaaggagccgggccguccgggua

SEQ ID NO: 3349880 - RNA, 21 nt, Mycobacterium tuberculosis H37Rv
uaaggaucagaacgcggccuc

SEQ ID NO: 3349881 - RNA, 20 nt, Mycobacterium tuberculosis H37Rv
uaaggcacguucagccaggc

SEQ ID NO: 3349882 - RNA, 22 nt, Mycobacterium tuberculosis H37Rv
uaaguguugcgaagcauucagg

SEQ ID NO: 3349883 - RNA, 15 nt, Mycobacterium tuberculosis H37Rv
uaauauuuucccgcc

SEQ ID NO: 3349884 - RNA, 13 nt, Mycobacterium tuberculosis H37Rv
uaaucaagcagcg

SEQ ID NO: 3349885 - RNA, 15 nt, Mycobacterium tuberculosis H37Rv
uaaucaagcagcgug

SEQ ID NO: 3349886 - RNA, 22 nt, Mycobacterium tuberculosis H37Rv
uaaucaaggugaucagcaggau

SEQ ID NO: 3349887 - RNA, 17 nt, Mycobacterium tuberculosis H37Rv
uaauccagcgccgaccu

SEQ ID NO: 3349888 - RNA, 18 nt, Mycobacterium tuberculosis H37Rv
uaauccagcgccgaccuc

SEQ ID NO: 3349889 - RNA, 15 nt, Mycobacterium tuberculosis H37Rv
uaauccccgacaucg

SEQ ID NO: 3349890 - RNA, 17 nt, Mycobacterium tuberculosis H37Rv
uaauccgggcaaucaca

SEQ ID NO: 3349891 - RNA, 22 nt, Mycobacterium tuberculosis H37Rv
uaauccgggcaaucacaucaaa

SEQ ID NO: 3349892 - RNA, 24 nt, Mycobacterium tuberculosis H37Rv
uaaucgcgagaccaacauacagca

SEQ ID NO: 3349893 - RNA, 13 nt, Mycobacterium tuberculosis H37Rv
uaaucguuccgca

SEQ ID NO: 3349894 - RNA, 19 nt, Mycobacterium tuberculosis H37Rv
uaaugaucucggcaaggac

SEQ ID NO: 3349895 - RNA, 15 nt, Mycobacterium tuberculosis H37Rv
uaaugccagcggcac

SEQ ID NO: 3349896 - RNA, 16 nt, Mycobacterium tuberculosis H37Rv
uaaugccagcggcaca

SEQ ID NO: 3349897 - RNA, 16 nt, Mycobacterium tuberculosis H37Rv
uaaugcugcugcagca

SEQ ID NO: 3349898 - RNA, 19 nt, Mycobacterium tuberculosis H37Rv
uaauggccgaguccggcaa

SEQ ID NO: 3349899 - RNA, 17 nt, Mycobacterium tuberculosis H37Rv
uaauggcgugcagaccc

SEQ ID NO: 3349900 - RNA, 19 nt, Mycobacterium tuberculosis H37Rv
uaccuguguugagcggcag

SEQ ID NO: 3349901 - RNA, 13 nt, Mycobacterium tuberculosis H37Rv
uacgaacugcuga

SEQ ID NO: 3349902 - RNA, 11 nt, Mycobacterium tuberculosis H37Rv
uacgaccaaua

SEQ ID NO: 3349903 - RNA, 14 nt, Mycobacterium tuberculosis H37Rv
uacgaggcgggcag

SEQ ID NO: 3349904 - RNA, 16 nt, Mycobacterium tuberculosis H37Rv
uacgcaccgaggccgc

SEQ ID NO: 3349905 - RNA, 20 nt, Mycobacterium tuberculosis H37Rv
uacgcaccgaggccgccgag

SEQ ID NO: 3349906 - RNA, 13 nt, Mycobacterium tuberculosis H37Rv
uacgcaucgccgu

SEQ ID NO: 3349907 - RNA, 19 nt, Mycobacterium tuberculosis H37Rv
uacgcaucucgagcaugcc

SEQ ID NO: 3349908 - RNA, 17 nt, Mycobacterium tuberculosis H37Rv
uacgccaaccgcuucca

SEQ ID NO: 3349909 - RNA, 20 nt, Mycobacterium tuberculosis H37Rv
uacgccccacugccgugccg

SEQ ID NO: 3349910 - RNA, 18 nt, Mycobacterium tuberculosis H37Rv
uacgccgcgccgaaucgc

SEQ ID NO: 3349911 - RNA, 14 nt, Mycobacterium tuberculosis H37Rv
uacgccggccgcgc

SEQ ID NO: 3349912 - RNA, 20 nt, Mycobacterium tuberculosis H37Rv
uacgccggccgcgcugguga

SEQ ID NO: 3349913 - RNA, 15 nt, Mycobacterium tuberculosis H37Rv
uacgccucgacagcg

SEQ ID NO: 3349914 - RNA, 16 nt, Mycobacterium tuberculosis H37Rv
uacgcgacgguguagc

SEQ ID NO: 3349915 - RNA, 22 nt, Mycobacterium tuberculosis H37Rv
uacgcgaucagcgcgcacacgg

SEQ ID NO: 3349916 - RNA, 20 nt, Mycobacterium tuberculosis H37Rv
uacgcgcgcucgcucaccgg

SEQ ID NO: 3349917 - RNA, 14 nt, Mycobacterium tuberculosis H37Rv
uacgcgggugacca

SEQ ID NO: 3349918 - RNA, 21 nt, Mycobacterium tuberculosis H37Rv
uacgcuccgaugaccaggguc

SEQ ID NO: 3349919 - RNA, 18 nt, Mycobacterium tuberculosis H37Rv
uacggaccguggcagcug

SEQ ID NO: 3349920 - RNA, 15 nt, Mycobacterium tuberculosis H37Rv
uacggcccgcaucgu

SEQ ID NO: 3349921 - RNA, 17 nt, Mycobacterium tuberculosis H37Rv
uacggcccggcacccgg

SEQ ID NO: 3349922 - RNA, 19 nt, Mycobacterium tuberculosis H37Rv
uacggccugccgcucgccg

SEQ ID NO: 3349923 - RNA, 16 nt, Mycobacterium tuberculosis H37Rv
uacggcgacacgccag

SEQ ID NO: 3349924 - RNA, 22 nt, Mycobacterium tuberculosis H37Rv
uacggcgaugcggucggccaca

SEQ ID NO: 3349925 - RNA, 20 nt, Mycobacterium tuberculosis H37Rv
uacgggcaggccgcugggcc

SEQ ID NO: 3349926 - RNA, 15 nt, Mycobacterium tuberculosis H37Rv
uacgggucggcgacg

SEQ ID NO: 3349927 - RNA, 13 nt, Mycobacterium tuberculosis H37Rv
uacgggugaucuu

SEQ ID NO: 3349928 - RNA, 18 nt, Mycobacterium tuberculosis H37Rv
uacgguccggcguacucg

SEQ ID NO: 3349929 - RNA, 21 nt, Mycobacterium tuberculosis H37Rv
uacggugguaagacgccgaac

SEQ ID NO: 3349930 - RNA, 16 nt, Mycobacterium tuberculosis H37Rv
uacgguugaugcaucc

SEQ ID NO: 3349931 - RNA, 20 nt, Mycobacterium tuberculosis H37Rv
uacgucgaucaggucgucac

SEQ ID NO: 3349932 - RNA, 16 nt, Mycobacterium tuberculosis H37Rv
uacgucguccagcacc

SEQ ID NO: 3349933 - RNA, 17 nt, Mycobacterium tuberculosis H37Rv
uacgucguccagcacca

SEQ ID NO: 3349934 - RNA, 17 nt, Mycobacterium tuberculosis H37Rv
uacgugcgagcccaccu

SEQ ID NO: 3349935 - RNA, 21 nt, Mycobacterium tuberculosis H37Rv
uacguuacgccgagaugcugc

SEQ ID NO: 3349936 - RNA, 17 nt, Mycobacterium tuberculosis H37Rv
uacguuguacucgugcg

SEQ ID NO: 3349937 - RNA, 19 nt, Mycobacterium tuberculosis H37Rv
uacguuguuugaucgcaac

SEQ ID NO: 3349938 - RNA, 13 nt, Mycobacterium tuberculosis H37Rv
uacuaugccaacg

SEQ ID NO: 3349939 - RNA, 15 nt, Mycobacterium tuberculosis H37Rv
uacucagguggaagu

SEQ ID NO: 3349940 - RNA, 18 nt, Mycobacterium tuberculosis H37Rv
uacucaguguuccgccac

SEQ ID NO: 3349941 - RNA, 16 nt, Mycobacterium tuberculosis H37Rv
uacucgaaacccaugu

SEQ ID NO: 3349942 - RNA, 18 nt, Mycobacterium tuberculosis H37Rv
uacucggccagcucguga

SEQ ID NO: 3349943 - RNA, 19 nt, Mycobacterium tuberculosis H37Rv
uacucggcgacugcgucgg

SEQ ID NO: 3349944 - RNA, 14 nt, Mycobacterium tuberculosis H37Rv
uacucgugaugaau

SEQ ID NO: 3349945 - RNA, 13 nt, Mycobacterium tuberculosis H37Rv
uacugcgaucgcg

SEQ ID NO: 3349946 - RNA, 22 nt, Mycobacterium tuberculosis H37Rv
uacugcggugccacggugaccc

SEQ ID NO: 3349947 - RNA, 11 nt, Mycobacterium tuberculosis H37Rv
uacugcugcuu

SEQ ID NO: 3349948 - RNA, 19 nt, Mycobacterium tuberculosis H37Rv
uacuucaucggcacaggcg

SEQ ID NO: 3349949 - RNA, 10 nt, Mycobacterium tuberculosis H37Rv
uacuugaccg

SEQ ID NO: 3349950 - RNA, 15 nt, Mycobacterium tuberculosis H37Rv
uacuuggcuuccgga

SEQ ID NO: 3349951 - RNA, 21 nt, Mycobacterium tuberculosis H37Rv
uacuuucacgcucguuugcga

SEQ ID NO: 3349952 - RNA, 12 nt, Mycobacterium tuberculosis H37Rv
uacuuuuccagu

SEQ ID NO: 3349953 - RNA, 15 nt, Mycobacterium tuberculosis H37Rv
uagaacguagcgccc

SEQ ID NO: 3349954 - RNA, 20 nt, Mycobacterium tuberculosis H37Rv
uagaacugcaucauggccgu

SEQ ID NO: 3349955 - RNA, 17 nt, Mycobacterium tuberculosis H37Rv
uagaagcacgucgucgc

SEQ ID NO: 3349956 - RNA, 20 nt, Mycobacterium tuberculosis H37Rv
uagaagccgacguugaagcc

SEQ ID NO: 3349957 - RNA, 15 nt, Mycobacterium tuberculosis H37Rv
uagaagucgaucgcc

SEQ ID NO: 3349958 - RNA, 16 nt, Mycobacterium tuberculosis H37Rv
uagaccagugaccgca

SEQ ID NO: 3349959 - RNA, 15 nt, Mycobacterium tuberculosis H37Rv
uagaccaugaagaac

SEQ ID NO: 3349960 - RNA, 17 nt, Mycobacterium tuberculosis H37Rv
uagaccgaaauggucgu

SEQ ID NO: 3349961 - RNA, 18 nt, Mycobacterium tuberculosis H37Rv
uagaccgcagucgcuggg

SEQ ID NO: 3349962 - RNA, 13 nt, Mycobacterium tuberculosis H37Rv
uagaccugguuga

SEQ ID NO: 3349963 - RNA, 21 nt, Mycobacterium tuberculosis H37Rv
uagaccuuggugcccagcagg

SEQ ID NO: 3349964 - RNA, 16 nt, Mycobacterium tuberculosis H37Rv
uagacgaccccgguga

SEQ ID NO: 3349965 - RNA, 19 nt, Mycobacterium tuberculosis H37Rv
uagacggcacccccgacga

SEQ ID NO: 3349966 - RNA, 12 nt, Mycobacterium tuberculosis H37Rv
uagacggcgacg

SEQ ID NO: 3349967 - RNA, 13 nt, Mycobacterium tuberculosis H37Rv
uagagcagcagcg

SEQ ID NO: 3349968 - RNA, 16 nt, Mycobacterium tuberculosis H37Rv
uagaggauaucgccga

SEQ ID NO: 3349969 - RNA, 22 nt, Mycobacterium tuberculosis H37Rv
uagaggauggucagcagcucca

SEQ ID NO: 3349970 - RNA, 18 nt, Mycobacterium tuberculosis H37Rv
uagaucaagaucugcuug

SEQ ID NO: 3349971 - RNA, 17 nt, Mycobacterium tuberculosis H37Rv
uagaucacccgcagccg

SEQ ID NO: 3349972 - RNA, 13 nt, Mycobacterium tuberculosis H37Rv
uagaucagcgccu

SEQ ID NO: 3349973 - RNA, 23 nt, Mycobacterium tuberculosis H37Rv
uagaucauuucgguaauggccgc

SEQ ID NO: 3349974 - RNA, 19 nt, Mycobacterium tuberculosis H37Rv
uagaugcggaacgccgagc

SEQ ID NO: 3349975 - RNA, 15 nt, Mycobacterium tuberculosis H37Rv
uagcaaagccagcgc

SEQ ID NO: 3349976 - RNA, 15 nt, Mycobacterium tuberculosis H37Rv
uagcaauccgcacag

SEQ ID NO: 3349977 - RNA, 20 nt, Mycobacterium tuberculosis H37Rv
uagcaaucggcaggauuccc

SEQ ID NO: 3349978 - RNA, 16 nt, Mycobacterium tuberculosis H37Rv
uagcacaucaugaaga

SEQ ID NO: 3349979 - RNA, 18 nt, Mycobacterium tuberculosis H37Rv
uagcacaucgccggcguc

SEQ ID NO: 3349980 - RNA, 15 nt, Mycobacterium tuberculosis H37Rv
uagcaccacaucggu

SEQ ID NO: 3349981 - RNA, 23 nt, Mycobacterium tuberculosis H37Rv
uagcaccaguucccuacacccau

SEQ ID NO: 3349982 - RNA, 21 nt, Mycobacterium tuberculosis H37Rv
uagcacgggcacgaucgucgc

SEQ ID NO: 3349983 - RNA, 22 nt, Mycobacterium tuberculosis H37Rv
uagcacguugacguccaacagc

SEQ ID NO: 3349984 - RNA, 14 nt, Mycobacterium tuberculosis H37Rv
uagcagaaggccgc

SEQ ID NO: 3349985 - RNA, 11 nt, Mycobacterium tuberculosis H37Rv
uagcagcaccc

SEQ ID NO: 3349986 - RNA, 13 nt, Mycobacterium tuberculosis H37Rv
uagcagcacccgg

SEQ ID NO: 3349987 - RNA, 17 nt, Mycobacterium tuberculosis H37Rv
uagcagcgccagcagcu

SEQ ID NO: 3349988 - RNA, 12 nt, Mycobacterium tuberculosis H37Rv
uagcagcgcggc

SEQ ID NO: 3349989 - RNA, 21 nt, Mycobacterium tuberculosis H37Rv
uagcagggugccggcgccgcc

SEQ ID NO: 3349990 - RNA, 14 nt, Mycobacterium tuberculosis H37Rv
uagcaggucgacgg

SEQ ID NO: 3349991 - RNA, 17 nt, Mycobacterium tuberculosis H37Rv
uagcagguguaggugcc

SEQ ID NO: 3349992 - RNA, 14 nt, Mycobacterium tuberculosis H37Rv
uagcaucgggcgag

SEQ ID NO: 3349993 - RNA, 22 nt, Mycobacterium tuberculosis H37Rv
uagccaagcgagcggucgacgu

SEQ ID NO: 3349994 - RNA, 15 nt, Mycobacterium tuberculosis H37Rv
uagccagauccguca

SEQ ID NO: 3349995 - RNA, 15 nt, Mycobacterium tuberculosis H37Rv
uagccagcagcggcu

SEQ ID NO: 3349996 - RNA, 20 nt, Mycobacterium tuberculosis H37Rv
uagccaggcaaccggucagc

SEQ ID NO: 3349997 - RNA, 22 nt, Mycobacterium tuberculosis H37Rv
uaggccggccggaguccgucgg

SEQ ID NO: 3349998 - RNA, 15 nt, Mycobacterium tuberculosis H37Rv
uaggccucggcagca

SEQ ID NO: 3349999 - RNA, 22 nt, Mycobacterium tuberculosis H37Rv
uaggcgaaaauugcuccaccac

SEQ ID NO: 3350000 - RNA, 17 nt, Mycobacterium tuberculosis H37Rv
uaggcgaaauagcccaa

SEQ ID NO: 3350001 - RNA, 14 nt, Mycobacterium tuberculosis H37Rv
uaggcgaccgccau

SEQ ID NO: 3350002 - RNA, 17 nt, Mycobacterium tuberculosis H37Rv
uaggcgauggcggcgcg

SEQ ID NO: 3350003 - RNA, 20 nt, Mycobacterium tuberculosis H37Rv
uaggcgauucugcgucugcu

SEQ ID NO: 3350004 - RNA, 15 nt, Mycobacterium tuberculosis H37Rv
uaggcgcggucaccg

SEQ ID NO: 3350005 - RNA, 16 nt, Mycobacterium tuberculosis H37Rv
uaggcgcggucaccgc

SEQ ID NO: 3350006 - RNA, 13 nt, Mycobacterium tuberculosis H37Rv
uaggcuccaagca

SEQ ID NO: 3350007 - RNA, 19 nt, Mycobacterium tuberculosis H37Rv
uaggcuccaagcaauucca

SEQ ID NO: 3350008 - RNA, 19 nt, Mycobacterium tuberculosis H37Rv
uaggcuuccggcgcgaccg

SEQ ID NO: 3350009 - RNA, 17 nt, Mycobacterium tuberculosis H37Rv
uaggcuugcaaggucgc

SEQ ID NO: 3350010 - RNA, 16 nt, Mycobacterium tuberculosis H37Rv
uagggcaucgucgccg

SEQ ID NO: 3350011 - RNA, 11 nt, Mycobacterium tuberculosis H37Rv
uagggccgcgu

SEQ ID NO: 3350012 - RNA, 13 nt, Mycobacterium tuberculosis H37Rv
uagggccggugac

SEQ ID NO: 3350013 - RNA, 13 nt, Mycobacterium tuberculosis H37Rv
uagggcuccucgu

SEQ ID NO: 3350014 - RNA, 22 nt, Mycobacterium tuberculosis H37Rv
uagggcugaccgaagaagcccg

SEQ ID NO: 3350015 - RNA, 20 nt, Mycobacterium tuberculosis H37Rv
uagggcuguccgaccucgcc

SEQ ID NO: 3350016 - RNA, 19 nt, Mycobacterium tuberculosis H37Rv
uaggggcuuuugcgucugc

SEQ ID NO: 3350017 - RNA, 21 nt, Mycobacterium tuberculosis H37Rv
uaggguggcgauccacaggcu

SEQ ID NO: 3350018 - RNA, 11 nt, Mycobacterium tuberculosis H37Rv
uaggucaccgg

SEQ ID NO: 3350019 - RNA, 14 nt, Mycobacterium tuberculosis H37Rv
uaggucagcgggcu

SEQ ID NO: 3350020 - RNA, 20 nt, Mycobacterium tuberculosis H37Rv
uaggugacgccgccagcacc

SEQ ID NO: 3350021 - RNA, 16 nt, Mycobacterium tuberculosis H37Rv
uaggugcaugucgaug

SEQ ID NO: 3350022 - RNA, 13 nt, Mycobacterium tuberculosis H37Rv
uaggugggcucgu

SEQ ID NO: 3350023 - RNA, 19 nt, Mycobacterium tuberculosis H37Rv
uaggugucgggcucgcauu

SEQ ID NO: 3350024 - RNA, 12 nt, Mycobacterium tuberculosis H37Rv
uagucagaaccg

SEQ ID NO: 3350025 - RNA, 17 nt, Mycobacterium tuberculosis H37Rv
uagucagaaccgacggc

SEQ ID NO: 3350026 - RNA, 23 nt, Mycobacterium tuberculosis H37Rv
uagucagaugguuggaucgccac

SEQ ID NO: 3350027 - RNA, 21 nt, Mycobacterium tuberculosis H37Rv
uaguccagcucgcugcgcgcc

SEQ ID NO: 3350028 - RNA, 20 nt, Mycobacterium tuberculosis H37Rv
uagucccucaucaccucucc

SEQ ID NO: 3350029 - RNA, 15 nt, Mycobacterium tuberculosis H37Rv
uagucgauuggcugc

SEQ ID NO: 3350030 - RNA, 16 nt, Mycobacterium tuberculosis H37Rv
uagucgcgggccaagc

SEQ ID NO: 3350031 - RNA, 16 nt, Mycobacterium tuberculosis H37Rv
uagucggcggugcaga

SEQ ID NO: 3350032 - RNA, 21 nt, Mycobacterium tuberculosis H37Rv
uagucggcggugcagaucggc

SEQ ID NO: 3350033 - RNA, 23 nt, Mycobacterium tuberculosis H37Rv
uagucgggcaaggcggcggccag

SEQ ID NO: 3350034 - RNA, 21 nt, Mycobacterium tuberculosis H37Rv
uagucuucuuucgccuccgga

SEQ ID NO: 3350035 - RNA, 17 nt, Mycobacterium tuberculosis H37Rv
uagugaucgaucgcggc

SEQ ID NO: 3350036 - RNA, 21 nt, Mycobacterium tuberculosis H37Rv
uagugaugguucaugaacauc

SEQ ID NO: 3350037 - RNA, 20 nt, Mycobacterium tuberculosis H37Rv
uagugcaaugguucgugcac

SEQ ID NO: 3350038 - RNA, 14 nt, Mycobacterium tuberculosis H37Rv
uaguuaacccaggg

SEQ ID NO: 3350039 - RNA, 21 nt, Mycobacterium tuberculosis H37Rv
uaguucaccaacgcgggaacg

SEQ ID NO: 3350040 - RNA, 23 nt, Mycobacterium tuberculosis H37Rv
uaguucagccaggccgcaaugcg

SEQ ID NO: 3350041 - RNA, 22 nt, Mycobacterium tuberculosis H37Rv
uaguugaggccgucgaacggua

SEQ ID NO: 3350042 - RNA, 12 nt, Mycobacterium tuberculosis H37Rv
uaguugcgcggc

SEQ ID NO: 3350043 - RNA, 20 nt, Mycobacterium tuberculosis H37Rv
uaguuuaucggccgugaauu

SEQ ID NO: 3350044 - RNA, 20 nt, Mycobacterium tuberculosis H37Rv
uauagcccguagccgaucag

SEQ ID NO: 3350045 - RNA, 23 nt, Mycobacterium tuberculosis H37Rv
uauagccgguugucgcagcgcac

SEQ ID NO: 3350046 - RNA, 17 nt, Mycobacterium tuberculosis H37Rv
uauagcucacgguggcc

SEQ ID NO: 3350047 - RNA, 15 nt, Mycobacterium tuberculosis H37Rv
uauaggccgcaugcc

SEQ ID NO: 3350048 - RNA, 23 nt, Mycobacterium tuberculosis H37Rv
uaucagccgcgcgccaucgccuc

SEQ ID NO: 3350049 - RNA, 20 nt, Mycobacterium tuberculosis H37Rv
uauccacggucgaccaggac

SEQ ID NO: 3350050 - RNA, 18 nt, Mycobacterium tuberculosis H37Rv
uauccagucgauccuuga

SEQ ID NO: 3350051 - RNA, 17 nt, Mycobacterium tuberculosis H37Rv
uauccggacuugaccag

SEQ ID NO: 3350052 - RNA, 20 nt, Mycobacterium tuberculosis H37Rv
uauccgugaauggcagcacg

SEQ ID NO: 3350053 - RNA, 19 nt, Mycobacterium tuberculosis H37Rv
uaucgaaagccaacucgac

SEQ ID NO: 3350054 - RNA, 20 nt, Mycobacterium tuberculosis H37Rv
uaucgacccgcgcaaccggc

SEQ ID NO: 3350055 - RNA, 22 nt, Mycobacterium tuberculosis H37Rv
uaucgaucggaucggcacccca

SEQ ID NO: 3350056 - RNA, 20 nt, Mycobacterium tuberculosis H37Rv
uaucgcagcguuggccgcug

SEQ ID NO: 3350057 - RNA, 19 nt, Mycobacterium tuberculosis H37Rv
uaucgccaguggugcaccg

SEQ ID NO: 3350058 - RNA, 13 nt, Mycobacterium tuberculosis H37Rv
uaucgccgggaac

SEQ ID NO: 3350059 - RNA, 20 nt, Mycobacterium tuberculosis H37Rv
uaucggcgugcuggcgcaac

SEQ ID NO: 3350060 - RNA, 18 nt, Mycobacterium tuberculosis H37Rv
uaucggcuucgucaucug

SEQ ID NO: 3350061 - RNA, 22 nt, Mycobacterium tuberculosis H37Rv
uaucgggcccccuggaucgcgc

SEQ ID NO: 3350062 - RNA, 12 nt, Mycobacterium tuberculosis H37Rv
uaucggucgacu

SEQ ID NO: 3350063 - RNA, 19 nt, Mycobacterium tuberculosis H37Rv
uaucggugcuggucgccgc

SEQ ID NO: 3350064 - RNA, 12 nt, Mycobacterium tuberculosis H37Rv
uaucgucgacgc

SEQ ID NO: 3350065 - RNA, 18 nt, Mycobacterium tuberculosis H37Rv
uaucgucgacgccgaucg

SEQ ID NO: 3350066 - RNA, 20 nt, Mycobacterium tuberculosis H37Rv
uaucucggugacgaugaacu

SEQ ID NO: 3350067 - RNA, 15 nt, Mycobacterium tuberculosis H37Rv
uaucugccacguuga

SEQ ID NO: 3350068 - RNA, 21 nt, Mycobacterium tuberculosis H37Rv
uaugacuugcgcgcggcaaca

SEQ ID NO: 3350069 - RNA, 17 nt, Mycobacterium tuberculosis H37Rv
uaugccacaggcugcca

SEQ ID NO: 3350070 - RNA, 21 nt, Mycobacterium tuberculosis H37Rv
uaugccaggacuggcaccgcc

SEQ ID NO: 3350071 - RNA, 13 nt, Mycobacterium tuberculosis H37Rv
uaugccgcccgca

SEQ ID NO: 3350072 - RNA, 22 nt, Mycobacterium tuberculosis H37Rv
uaugcgccaucucgacggugac

SEQ ID NO: 3350073 - RNA, 19 nt, Mycobacterium tuberculosis H37Rv
uauggcgaagaccgcauca

SEQ ID NO: 3350074 - RNA, 19 nt, Mycobacterium tuberculosis H37Rv
uauguucggcgguguccua

SEQ ID NO: 3350075 - RNA, 13 nt, Mycobacterium tuberculosis H37Rv
uauuaccgcuugc

SEQ ID NO: 3350076 - RNA, 14 nt, Mycobacterium tuberculosis H37Rv
uauucggcaucgcc

SEQ ID NO: 3350077 - RNA, 20 nt, Mycobacterium tuberculosis H37Rv
uauugagucggcugguccuc

SEQ ID NO: 3350078 - RNA, 16 nt, Mycobacterium tuberculosis H37Rv
uauugcgcccggccau

SEQ ID NO: 3350079 - RNA, 13 nt, Mycobacterium tuberculosis H37Rv
uauuggacugcag

SEQ ID NO: 3350080 - RNA, 14 nt, Mycobacterium tuberculosis H37Rv
uauuggaucgucgg

SEQ ID NO: 3350081 - RNA, 16 nt, Mycobacterium tuberculosis H37Rv
uauugggguggcagcu

SEQ ID NO: 3350082 - RNA, 16 nt, Mycobacterium tuberculosis H37Rv
uauuucucccagccca

SEQ ID NO: 3350083 - RNA, 19 nt, Mycobacterium tuberculosis H37Rv
ucaaaaaccacgcgucgcu

SEQ ID NO: 3350084 - RNA, 20 nt, Mycobacterium tuberculosis H37Rv
ucaaaaagcucggcccuguu

SEQ ID NO: 3350085 - RNA, 15 nt, Mycobacterium tuberculosis H37Rv
ucaaaaucagggugc

SEQ ID NO: 3350086 - RNA, 22 nt, Mycobacterium tuberculosis H37Rv
ucaaacccagcgacgcggccag

SEQ ID NO: 3350087 - RNA, 23 nt, Mycobacterium tuberculosis H37Rv
ucaaaccuauccguucaauuucg

SEQ ID NO: 3350088 - RNA, 19 nt, Mycobacterium tuberculosis H37Rv
ucaaagacccgacgccacg

SEQ ID NO: 3350089 - RNA, 12 nt, Mycobacterium tuberculosis H37Rv
ucaaagcggccu

SEQ ID NO: 3350090 - RNA, 23 nt, Mycobacterium tuberculosis H37Rv
ucaaagcggugccauuguaaaau

SEQ ID NO: 3350091 - RNA, 22 nt, Mycobacterium tuberculosis H37Rv
ucaacaacagccgcagccaggu

SEQ ID NO: 3350092 - RNA, 16 nt, Mycobacterium tuberculosis H37Rv
ucaacaaucggugguc

SEQ ID NO: 3350093 - RNA, 19 nt, Mycobacterium tuberculosis H37Rv
ucaacaccaacgacagcga

SEQ ID NO: 3350094 - RNA, 12 nt, Mycobacterium tuberculosis H37Rv
ucaacagcaccg

SEQ ID NO: 3350095 - RNA, 14 nt, Mycobacterium tuberculosis H37Rv
ucaacagggccagg

SEQ ID NO: 3350096 - RNA, 22 nt, Mycobacterium tuberculosis H37Rv
ucaacaugaguggcaaucccgc

SEQ ID NO: 3350097 - RNA, 15 nt, Mycobacterium tuberculosis H37Rv
ucaaccaagcgugcc

SEQ ID NO: 3350098 - RNA, 16 nt, Mycobacterium tuberculosis H37Rv
ucaaccggccggugau

SEQ ID NO: 3350099 - RNA, 14 nt, Mycobacterium tuberculosis H37Rv
ucaaccgggucagc

SEQ ID NO: 3350100 - RNA, 18 nt, Mycobacterium tuberculosis H37Rv
ucaaccucgccacgcucg

SEQ ID NO: 3350101 - RNA, 16 nt, Mycobacterium tuberculosis H37Rv
ucaaccugcugcagaa

SEQ ID NO: 3350102 - RNA, 15 nt, Mycobacterium tuberculosis H37Rv
ucaacgacaccagau

SEQ ID NO: 3350103 - RNA, 19 nt, Mycobacterium tuberculosis H37Rv
ucaacgacgacgacaagug

SEQ ID NO: 3350104 - RNA, 22 nt, Mycobacterium tuberculosis H37Rv
ucaacgacgacgacaagugccc

SEQ ID NO: 3350105 - RNA, 17 nt, Mycobacterium tuberculosis H37Rv
ucaacgaugguggcgau

SEQ ID NO: 3350106 - RNA, 21 nt, Mycobacterium tuberculosis H37Rv
ucaacgccgcggucaggaugg

SEQ ID NO: 3350107 - RNA, 21 nt, Mycobacterium tuberculosis H37Rv
ucaacgcgaguccgcugcuuc

SEQ ID NO: 3350108 - RNA, 22 nt, Mycobacterium tuberculosis H37Rv
ucaacgcggggaugucgaccgc

SEQ ID NO: 3350109 - RNA, 18 nt, Mycobacterium tuberculosis H37Rv
ucaacgcguugcacagca

SEQ ID NO: 3350110 - RNA, 19 nt, Mycobacterium tuberculosis H37Rv
ucaacgcguugcacagcag

SEQ ID NO: 3350111 - RNA, 15 nt, Mycobacterium tuberculosis H37Rv
ucaacgggaccgauc

SEQ ID NO: 3350112 - RNA, 18 nt, Mycobacterium tuberculosis H37Rv
ucaacgggaugccggcga

SEQ ID NO: 3350113 - RNA, 21 nt, Mycobacterium tuberculosis H37Rv
ucaacgggccgcaucgucgcc

SEQ ID NO: 3350114 - RNA, 22 nt, Mycobacterium tuberculosis H37Rv
ucaacguauccccgaccacuga

SEQ ID NO: 3350115 - RNA, 13 nt, Mycobacterium tuberculosis H37Rv
ucaacgugaacug

SEQ ID NO: 3350116 - RNA, 19 nt, Mycobacterium tuberculosis H37Rv
ucaagagugcucagcgcgc

SEQ ID NO: 3350117 - RNA, 19 nt, Mycobacterium tuberculosis H37Rv
ucaagauuaccgaagcccg

SEQ ID NO: 3350118 - RNA, 12 nt, Mycobacterium tuberculosis H37Rv
ucaagcacagcc

SEQ ID NO: 3350119 - RNA, 14 nt, Mycobacterium tuberculosis H37Rv
ucaagcacagcccg

SEQ ID NO: 3350120 - RNA, 17 nt, Mycobacterium tuberculosis H37Rv
ucaagccacgucgucgc

SEQ ID NO: 3350121 - RNA, 22 nt, Mycobacterium tuberculosis H37Rv
ucaagccggcgcccgccgcgaa

SEQ ID NO: 3350122 - RNA, 20 nt, Mycobacterium tuberculosis H37Rv
ucaagcuggcccgcucauac

SEQ ID NO: 3350123 - RNA, 15 nt, Mycobacterium tuberculosis H37Rv
ucaaggaagccgcgg

SEQ ID NO: 3350124 - RNA, 18 nt, Mycobacterium tuberculosis H37Rv
ucaagggggucgagcgcu

SEQ ID NO: 3350125 - RNA, 14 nt, Mycobacterium tuberculosis H37Rv
ucaaggugaucagc

SEQ ID NO: 3350126 - RNA, 15 nt, Mycobacterium tuberculosis H37Rv
ucaaggugcgccgcc

SEQ ID NO: 3350127 - RNA, 21 nt, Mycobacterium tuberculosis H37Rv
ucaaguggcaaccgcaccgca

SEQ ID NO: 3350128 - RNA, 17 nt, Mycobacterium tuberculosis H37Rv
ucaaguucgccagcaac

SEQ ID NO: 3350129 - RNA, 22 nt, Mycobacterium tuberculosis H37Rv
ucaauaauggcaaccagcuucu

SEQ ID NO: 3350130 - RNA, 23 nt, Mycobacterium tuberculosis H37Rv
ucaaucccuccgccaaggaggcc

SEQ ID NO: 3350131 - RNA, 16 nt, Mycobacterium tuberculosis H37Rv
ucaaucgcgucaucaa

SEQ ID NO: 3350132 - RNA, 13 nt, Mycobacterium tuberculosis H37Rv
ucaaugacaccgg

SEQ ID NO: 3350133 - RNA, 14 nt, Mycobacterium tuberculosis H37Rv
ucaauggcagcuga

SEQ ID NO: 3350134 - RNA, 19 nt, Mycobacterium tuberculosis H37Rv
ucaauuccaugcaguuguc

SEQ ID NO: 3350135 - RNA, 16 nt, Mycobacterium tuberculosis H37Rv
ucaauuggaagacacg

SEQ ID NO: 3350136 - RNA, 12 nt, Mycobacterium tuberculosis H37Rv
ucacaaacccag

SEQ ID NO: 3350137 - RNA, 13 nt, Mycobacterium tuberculosis H37Rv
ucacaaacccagc

SEQ ID NO: 3350138 - RNA, 17 nt, Mycobacterium tuberculosis H37Rv
ucacaaacccagcaucg

SEQ ID NO: 3350139 - RNA, 18 nt, Mycobacterium tuberculosis H37Rv
ucacaacgcgugaccagg

SEQ ID NO: 3350140 - RNA, 20 nt, Mycobacterium tuberculosis H37Rv
ucacaagccgugcagcucgg

SEQ ID NO: 3350141 - RNA, 20 nt, Mycobacterium tuberculosis H37Rv
ucacaagucgacacgccgaa

SEQ ID NO: 3350142 - RNA, 23 nt, Mycobacterium tuberculosis H37Rv
ucacaccacgguuggccaccagc

SEQ ID NO: 3350143 - RNA, 11 nt, Mycobacterium tuberculosis H37Rv
ucacaccagcg

SEQ ID NO: 3350144 - RNA, 20 nt, Mycobacterium tuberculosis H37Rv
ucacaccagcgggcaucgcg

SEQ ID NO: 3350145 - RNA, 15 nt, Mycobacterium tuberculosis H37Rv
ucacacccacaccca

SEQ ID NO: 3350146 - RNA, 22 nt, Mycobacterium tuberculosis H37Rv
ucacacccacacccagcgugcc

SEQ ID NO: 3350147 - RNA, 15 nt, Mycobacterium tuberculosis H37Rv
ucacaccccaggcac

SEQ ID NO: 3350148 - RNA, 16 nt, Mycobacterium tuberculosis H37Rv
ucacaccccaggcacc

SEQ ID NO: 3350149 - RNA, 14 nt, Mycobacterium tuberculosis H37Rv
ucacacgccagccg

SEQ ID NO: 3350150 - RNA, 16 nt, Mycobacterium tuberculosis H37Rv
ucacagcacagcgcag

SEQ ID NO: 3350151 - RNA, 14 nt, Mycobacterium tuberculosis H37Rv
ucacagccaccagc

SEQ ID NO: 3350152 - RNA, 15 nt, Mycobacterium tuberculosis H37Rv
ucacagccaccagcc

SEQ ID NO: 3350153 - RNA, 17 nt, Mycobacterium tuberculosis H37Rv
ucacagcuugagcacac

SEQ ID NO: 3350154 - RNA, 21 nt, Mycobacterium tuberculosis H37Rv
ucacaucggccucugaccagc

SEQ ID NO: 3350155 - RNA, 17 nt, Mycobacterium tuberculosis H37Rv
ucacaugcccgcaccgu

SEQ ID NO: 3350156 - RNA, 18 nt, Mycobacterium tuberculosis H37Rv
ucacaugcccgcaccguc

SEQ ID NO: 3350157 - RNA, 19 nt, Mycobacterium tuberculosis H37Rv
ucacaugcccgcaccgucg

SEQ ID NO: 3350158 - RNA, 15 nt, Mycobacterium tuberculosis H37Rv
ucacauucaacagau

SEQ ID NO: 3350159 - RNA, 15 nt, Mycobacterium tuberculosis H37Rv
ucacauuggccaggu

SEQ ID NO: 3350160 - RNA, 21 nt, Mycobacterium tuberculosis H37Rv
ucaccaaaaacccggugacca

SEQ ID NO: 3350161 - RNA, 20 nt, Mycobacterium tuberculosis H37Rv
ucaccaacccguguggcacg

SEQ ID NO: 3350162 - RNA, 15 nt, Mycobacterium tuberculosis H37Rv
ucaccaaccgcccga

SEQ ID NO: 3350163 - RNA, 17 nt, Mycobacterium tuberculosis H37Rv
ucaccaacgcgggaacg

SEQ ID NO: 3350164 - RNA, 15 nt, Mycobacterium tuberculosis H37Rv
ucaccaaggucggcg

SEQ ID NO: 3350165 - RNA, 16 nt, Mycobacterium tuberculosis H37Rv
ucaccacaugggagcc

SEQ ID NO: 3350166 - RNA, 13 nt, Mycobacterium tuberculosis H37Rv
ucaccaccgaccc

SEQ ID NO: 3350167 - RNA, 15 nt, Mycobacterium tuberculosis H37Rv
ucaccaccgcaccgg

SEQ ID NO: 3350168 - RNA, 17 nt, Mycobacterium tuberculosis H37Rv
ucaccaccgcaccggaa

SEQ ID NO: 3350169 - RNA, 16 nt, Mycobacterium tuberculosis H37Rv
ucaccaccgccagcga

SEQ ID NO: 3350170 - RNA, 15 nt, Mycobacterium tuberculosis H37Rv
ucaccaccggaucgc

SEQ ID NO: 3350171 - RNA, 17 nt, Mycobacterium tuberculosis H37Rv
ucaccaccggcaccgcu

SEQ ID NO: 3350172 - RNA, 21 nt, Mycobacterium tuberculosis H37Rv
ucaccacgccggucgagguga

SEQ ID NO: 3350173 - RNA, 22 nt, Mycobacterium tuberculosis H37Rv
ucaccacgccggucgaggugac

SEQ ID NO: 3350174 - RNA, 12 nt, Mycobacterium tuberculosis H37Rv
ucaccacgucgu

SEQ ID NO: 3350175 - RNA, 12 nt, Mycobacterium tuberculosis H37Rv
ucaccagcaccc

SEQ ID NO: 3350176 - RNA, 19 nt, Mycobacterium tuberculosis H37Rv
ucaccagccgucagcgcgg

SEQ ID NO: 3350177 - RNA, 12 nt, Mycobacterium tuberculosis H37Rv
ucaccagcggcu

SEQ ID NO: 3350178 - RNA, 13 nt, Mycobacterium tuberculosis H37Rv
ucaccagcgguca

SEQ ID NO: 3350179 - RNA, 16 nt, Mycobacterium tuberculosis H37Rv
ucaccagcggucagcc

SEQ ID NO: 3350180 - RNA, 13 nt, Mycobacterium tuberculosis H37Rv
ucaccagcugcga

SEQ ID NO: 3350181 - RNA, 12 nt, Mycobacterium tuberculosis H37Rv
ucaccaugugcu

SEQ ID NO: 3350182 - RNA, 20 nt, Mycobacterium tuberculosis H37Rv
ucacccacauggugauccac

SEQ ID NO: 3350183 - RNA, 16 nt, Mycobacterium tuberculosis H37Rv
ucacccacccgcaccg

SEQ ID NO: 3350184 - RNA, 19 nt, Mycobacterium tuberculosis H37Rv
ucacccacuccgccgauag

SEQ ID NO: 3350185 - RNA, 19 nt, Mycobacterium tuberculosis H37Rv
ucacccacucgacgucguc

SEQ ID NO: 3350186 - RNA, 17 nt, Mycobacterium tuberculosis H37Rv
ucacccagcgccgaccc

SEQ ID NO: 3350187 - RNA, 13 nt, Mycobacterium tuberculosis H37Rv
ucacccagcucgc

SEQ ID NO: 3350188 - RNA, 18 nt, Mycobacterium tuberculosis H37Rv
ucacccagcucgcgcacc

SEQ ID NO: 3350189 - RNA, 19 nt, Mycobacterium tuberculosis H37Rv
ucacccagcucgcgcaccc

SEQ ID NO: 3350190 - RNA, 21 nt, Mycobacterium tuberculosis H37Rv
ucacgcgcggaucggcggccg

SEQ ID NO: 3350191 - RNA, 18 nt, Mycobacterium tuberculosis H37Rv
ucacgcggaaaccaucgc

SEQ ID NO: 3350192 - RNA, 17 nt, Mycobacterium tuberculosis H37Rv
ucacgcucacccggcgu

SEQ ID NO: 3350193 - RNA, 20 nt, Mycobacterium tuberculosis H37Rv
ucacgcucggcguccgccca

SEQ ID NO: 3350194 - RNA, 21 nt, Mycobacterium tuberculosis H37Rv
ucacgcuggccuccagcuugg

SEQ ID NO: 3350195 - RNA, 14 nt, Mycobacterium tuberculosis H37Rv
ucacgcugugcggu

SEQ ID NO: 3350196 - RNA, 15 nt, Mycobacterium tuberculosis H37Rv
ucacggaccgccacc

SEQ ID NO: 3350197 - RNA, 19 nt, Mycobacterium tuberculosis H37Rv
ucacggcggccccggcauu

SEQ ID NO: 3350198 - RNA, 17 nt, Mycobacterium tuberculosis H37Rv
ucacgggcgaucgugcc

SEQ ID NO: 3350199 - RNA, 18 nt, Mycobacterium tuberculosis H37Rv
ucacgggcuccaacaggu

SEQ ID NO: 3350200 - RNA, 21 nt, Mycobacterium tuberculosis H37Rv
ucacgggguccgaugcgugcc

SEQ ID NO: 3350201 - RNA, 23 nt, Mycobacterium tuberculosis H37Rv
ucacggugaucguuccguugugc

SEQ ID NO: 3350202 - RNA, 15 nt, Mycobacterium tuberculosis H37Rv
ucacguaauucccca

SEQ ID NO: 3350203 - RNA, 16 nt, Mycobacterium tuberculosis H37Rv
ucacguaauuccccag

SEQ ID NO: 3350204 - RNA, 17 nt, Mycobacterium tuberculosis H37Rv
ucacguaauuccccagg

SEQ ID NO: 3350205 - RNA, 16 nt, Mycobacterium tuberculosis H37Rv
ucacguggucggccac

SEQ ID NO: 3350206 - RNA, 15 nt, Mycobacterium tuberculosis H37Rv
ucacguucggcgacg

SEQ ID NO: 3350207 - RNA, 17 nt, Mycobacterium tuberculosis H37Rv
ucacucacgacgccguu

SEQ ID NO: 3350208 - RNA, 17 nt, Mycobacterium tuberculosis H37Rv
ucacucccccacacacc

SEQ ID NO: 3350209 - RNA, 15 nt, Mycobacterium tuberculosis H37Rv
ucacucgccgaaucg

SEQ ID NO: 3350210 - RNA, 19 nt, Mycobacterium tuberculosis H37Rv
ucacucggauagccccgug

SEQ ID NO: 3350211 - RNA, 18 nt, Mycobacterium tuberculosis H37Rv
ucacucguugaccggccg

SEQ ID NO: 3350212 - RNA, 13 nt, Mycobacterium tuberculosis H37Rv
ucacugcagcgcc

SEQ ID NO: 3350213 - RNA, 14 nt, Mycobacterium tuberculosis H37Rv
ucacugcgagcgca

SEQ ID NO: 3350214 - RNA, 23 nt, Mycobacterium tuberculosis H37Rv
ucacuggaccacucggcggccac

SEQ ID NO: 3350215 - RNA, 15 nt, Mycobacterium tuberculosis H37Rv
ucacuggugacccug

SEQ ID NO: 3350216 - RNA, 14 nt, Mycobacterium tuberculosis H37Rv
ucagaacaccggcc

SEQ ID NO: 3350217 - RNA, 17 nt, Mycobacterium tuberculosis H37Rv
ucagaacaccggccagg

SEQ ID NO: 3350218 - RNA, 18 nt, Mycobacterium tuberculosis H37Rv
ucagaacaccggccaggc

SEQ ID NO: 3350219 - RNA, 17 nt, Mycobacterium tuberculosis H37Rv
ucagaaccgacggccag

SEQ ID NO: 3350220 - RNA, 21 nt, Mycobacterium tuberculosis H37Rv
ucagaacggcggcagcggcgu

SEQ ID NO: 3350221 - RNA, 17 nt, Mycobacterium tuberculosis H37Rv
ucagaacgugacggucc

SEQ ID NO: 3350222 - RNA, 15 nt, Mycobacterium tuberculosis H37Rv
ucagaaucaggcucg

SEQ ID NO: 3350223 - RNA, 17 nt, Mycobacterium tuberculosis H37Rv
ucagaaugccuggcccg

SEQ ID NO: 3350224 - RNA, 19 nt, Mycobacterium tuberculosis H37Rv
ucagaauugugugcagcag

SEQ ID NO: 3350225 - RNA, 23 nt, Mycobacterium tuberculosis H37Rv
ucagaauugugugcagcagcauc

SEQ ID NO: 3350226 - RNA, 11 nt, Mycobacterium tuberculosis H37Rv
ucagacaacaa

SEQ ID NO: 3350227 - RNA, 19 nt, Mycobacterium tuberculosis H37Rv
ucagaccaaugaccgccag

SEQ ID NO: 3350228 - RNA, 23 nt, Mycobacterium tuberculosis H37Rv
ucagacgccggcccaguucugca

SEQ ID NO: 3350229 - RNA, 18 nt, Mycobacterium tuberculosis H37Rv
ucagacggcgaguaggcg

SEQ ID NO: 3350230 - RNA, 14 nt, Mycobacterium tuberculosis H37Rv
ucagauggccaccc

SEQ ID NO: 3350231 - RNA, 17 nt, Mycobacterium tuberculosis H37Rv
ucagcaacucggccacg

SEQ ID NO: 3350232 - RNA, 15 nt, Mycobacterium tuberculosis H37Rv
ucagcacaaacccag

SEQ ID NO: 3350233 - RNA, 17 nt, Mycobacterium tuberculosis H37Rv
ucagcacccaacccggc

SEQ ID NO: 3350234 - RNA, 19 nt, Mycobacterium tuberculosis H37Rv
ucagcaccccauggccacc

SEQ ID NO: 3350235 - RNA, 21 nt, Mycobacterium tuberculosis H37Rv
ucagcaccgacggcgcaugcg

SEQ ID NO: 3350236 - RNA, 20 nt, Mycobacterium tuberculosis H37Rv
ucagcaccgugacagcggca

SEQ ID NO: 3350237 - RNA, 15 nt, Mycobacterium tuberculosis H37Rv
ucagcacgcugacca

SEQ ID NO: 3350238 - RNA, 17 nt, Mycobacterium tuberculosis H37Rv
ucagcacggugaucagc

SEQ ID NO: 3350239 - RNA, 21 nt, Mycobacterium tuberculosis H37Rv
ucagcacggugaucagcagca

SEQ ID NO: 3350240 - RNA, 17 nt, Mycobacterium tuberculosis H37Rv
ucagcacggugggcgcu

SEQ ID NO: 3350241 - RNA, 19 nt, Mycobacterium tuberculosis H37Rv
ucagcacgguguacgcccg

SEQ ID NO: 3350242 - RNA, 23 nt, Mycobacterium tuberculosis H37Rv
ucagcacguaacgccgcucaucc

SEQ ID NO: 3350243 - RNA, 21 nt, Mycobacterium tuberculosis H37Rv
ucagcacgucgcggccgugga

SEQ ID NO: 3350244 - RNA, 20 nt, Mycobacterium tuberculosis H37Rv
ucagcacguuguucagcccg

SEQ ID NO: 3350245 - RNA, 16 nt, Mycobacterium tuberculosis H37Rv
ucagcagccgccgaug

SEQ ID NO: 3350246 - RNA, 13 nt, Mycobacterium tuberculosis H37Rv
ucagcagcggcga

SEQ ID NO: 3350247 - RNA, 13 nt, Mycobacterium tuberculosis H37Rv
ucagcagcgucgg

SEQ ID NO: 3350248 - RNA, 12 nt, Mycobacterium tuberculosis H37Rv
ucagcagcucca

SEQ ID NO: 3350249 - RNA, 18 nt, Mycobacterium tuberculosis H37Rv
ucagcagcuccacuggcg

SEQ ID NO: 3350250 - RNA, 12 nt, Mycobacterium tuberculosis H37Rv
ucagcagcuguu

SEQ ID NO: 3350251 - RNA, 18 nt, Mycobacterium tuberculosis H37Rv
ucagcaggaucggcagca

SEQ ID NO: 3350252 - RNA, 12 nt, Mycobacterium tuberculosis H37Rv
ucagccaccauc

SEQ ID NO: 3350253 - RNA, 14 nt, Mycobacterium tuberculosis H37Rv
ucagccacgcagca

SEQ ID NO: 3350254 - RNA, 21 nt, Mycobacterium tuberculosis H37Rv
ucagccagcccaggguguccg

SEQ ID NO: 3350255 - RNA, 13 nt, Mycobacterium tuberculosis H37Rv
ucagccaggccag

SEQ ID NO: 3350256 - RNA, 16 nt, Mycobacterium tuberculosis H37Rv
ucagccaguccagcgc

SEQ ID NO: 3350257 - RNA, 19 nt, Mycobacterium tuberculosis H37Rv
ucagccaguccagcgcgcc

SEQ ID NO: 3350258 - RNA, 12 nt, Mycobacterium tuberculosis H37Rv
ucagcccaggug

SEQ ID NO: 3350259 - RNA, 14 nt, Mycobacterium tuberculosis H37Rv
ucagccccagugug

SEQ ID NO: 3350260 - RNA, 16 nt, Mycobacterium tuberculosis H37Rv
ucagccccaugaucug

SEQ ID NO: 3350261 - RNA, 21 nt, Mycobacterium tuberculosis H37Rv
ucagcccgaacucguuggcga

SEQ ID NO: 3350262 - RNA, 13 nt, Mycobacterium tuberculosis H37Rv
ucagcccgcgcag

SEQ ID NO: 3350263 - RNA, 20 nt, Mycobacterium tuberculosis H37Rv
ucagcccggcacugaccgcg

SEQ ID NO: 3350264 - RNA, 18 nt, Mycobacterium tuberculosis H37Rv
ucagcccggccagccgca

SEQ ID NO: 3350265 - RNA, 15 nt, Mycobacterium tuberculosis H37Rv
ucagcccggcgcgcc

SEQ ID NO: 3350266 - RNA, 19 nt, Mycobacterium tuberculosis H37Rv
ucagccgcgcgggucacga

SEQ ID NO: 3350267 - RNA, 23 nt, Mycobacterium tuberculosis H37Rv
ucagccgcgcgggucacgaccug

SEQ ID NO: 3350268 - RNA, 19 nt, Mycobacterium tuberculosis H37Rv
ucagccggaccaccagguc

SEQ ID NO: 3350269 - RNA, 15 nt, Mycobacterium tuberculosis H37Rv
ucagccgguggucug

SEQ ID NO: 3350270 - RNA, 19 nt, Mycobacterium tuberculosis H37Rv
ucagccguccgggcggccu

SEQ ID NO: 3350271 - RNA, 18 nt, Mycobacterium tuberculosis H37Rv
ucagccgugccgugguga

SEQ ID NO: 3350272 - RNA, 16 nt, Mycobacterium tuberculosis H37Rv
ucagccgugcgggccg

SEQ ID NO: 3350273 - RNA, 12 nt, Mycobacterium tuberculosis H37Rv
ucagccguggca

SEQ ID NO: 3350274 - RNA, 15 nt, Mycobacterium tuberculosis H37Rv
ucagcgaagccgggu

SEQ ID NO: 3350275 - RNA, 22 nt, Mycobacterium tuberculosis H37Rv
ucagcgaagccgggucucggug

SEQ ID NO: 3350276 - RNA, 18 nt, Mycobacterium tuberculosis H37Rv
ucagcgacuugcggugcu

SEQ ID NO: 3350277 - RNA, 18 nt, Mycobacterium tuberculosis H37Rv
ucagcgacuugcuggcgu

SEQ ID NO: 3350278 - RNA, 18 nt, Mycobacterium tuberculosis H37Rv
ucagcgaguagccgcuag

SEQ ID NO: 3350279 - RNA, 14 nt, Mycobacterium tuberculosis H37Rv
ucagcgaguggucc

SEQ ID NO: 3350280 - RNA, 16 nt, Mycobacterium tuberculosis H37Rv
ucagcgaguggucccg

SEQ ID NO: 3350281 - RNA, 13 nt, Mycobacterium tuberculosis H37Rv
ucagcgauccucg

SEQ ID NO: 3350282 - RNA, 14 nt, Mycobacterium tuberculosis H37Rv
ucagcgauccucgc

SEQ ID NO: 3350283 - RNA, 16 nt, Mycobacterium tuberculosis H37Rv
ucagcgaugcggcccu

SEQ ID NO: 3350284 - RNA, 19 nt, Mycobacterium tuberculosis H37Rv
ucagcgcacuggccgcuau

SEQ ID NO: 3350285 - RNA, 16 nt, Mycobacterium tuberculosis H37Rv
ucagcgcaucgccgcu

SEQ ID NO: 3350286 - RNA, 15 nt, Mycobacterium tuberculosis H37Rv
ucaguugcacaccga

SEQ ID NO: 3350287 - RNA, 16 nt, Mycobacterium tuberculosis H37Rv
ucauacucgacaccga

SEQ ID NO: 3350288 - RNA, 22 nt, Mycobacterium tuberculosis H37Rv
ucauagaaauacaggcccggca

SEQ ID NO: 3350289 - RNA, 17 nt, Mycobacterium tuberculosis H37Rv
ucauagacagggccgcu

SEQ ID NO: 3350290 - RNA, 20 nt, Mycobacterium tuberculosis H37Rv
ucauagcgcaccaccgucuc

SEQ ID NO: 3350291 - RNA, 22 nt, Mycobacterium tuberculosis H37Rv
ucauaggcccgcacgaucucgu

SEQ ID NO: 3350292 - RNA, 14 nt, Mycobacterium tuberculosis H37Rv
ucaucaacgacacc

SEQ ID NO: 3350293 - RNA, 13 nt, Mycobacterium tuberculosis H37Rv
ucaucaccggcau

SEQ ID NO: 3350294 - RNA, 20 nt, Mycobacterium tuberculosis H37Rv
ucaucaccggcgcaccgucg

SEQ ID NO: 3350295 - RNA, 19 nt, Mycobacterium tuberculosis H37Rv
ucaucacuaaccuggcgua

SEQ ID NO: 3350296 - RNA, 16 nt, Mycobacterium tuberculosis H37Rv
ucaucaggucgucguc

SEQ ID NO: 3350297 - RNA, 19 nt, Mycobacterium tuberculosis H37Rv
ucaucauauccgccccagc

SEQ ID NO: 3350298 - RNA, 15 nt, Mycobacterium tuberculosis H37Rv
ucaucauccacaccg

SEQ ID NO: 3350299 - RNA, 15 nt, Mycobacterium tuberculosis H37Rv
ucaucauggccggau

SEQ ID NO: 3350300 - RNA, 15 nt, Mycobacterium tuberculosis H37Rv
ucauccaccccugag

SEQ ID NO: 3350301 - RNA, 19 nt, Mycobacterium tuberculosis H37Rv
ucauccaccccugagcucc

SEQ ID NO: 3350302 - RNA, 17 nt, Mycobacterium tuberculosis H37Rv
ucauccauccgggccgc

SEQ ID NO: 3350303 - RNA, 21 nt, Mycobacterium tuberculosis H37Rv
ucaucccaagcguccgcugca

SEQ ID NO: 3350304 - RNA, 13 nt, Mycobacterium tuberculosis H37Rv
ucauccccgacug

SEQ ID NO: 3350305 - RNA, 16 nt, Mycobacterium tuberculosis H37Rv
ucaucccgaccagcag

SEQ ID NO: 3350306 - RNA, 17 nt, Mycobacterium tuberculosis H37Rv
ucauccgacaagcuguc

SEQ ID NO: 3350307 - RNA, 19 nt, Mycobacterium tuberculosis H37Rv
ucauccgggcgaccaccac

SEQ ID NO: 3350308 - RNA, 19 nt, Mycobacterium tuberculosis H37Rv
ucauccuggucaccagcca

SEQ ID NO: 3350309 - RNA, 13 nt, Mycobacterium tuberculosis H37Rv
ucaucgaagcuuc

SEQ ID NO: 3350310 - RNA, 20 nt, Mycobacterium tuberculosis H37Rv
ucaucgacgccugcggcggu

SEQ ID NO: 3350311 - RNA, 15 nt, Mycobacterium tuberculosis H37Rv
ucaucgacggugauc

SEQ ID NO: 3350312 - RNA, 17 nt, Mycobacterium tuberculosis H37Rv
ucaucgacguuccagca

SEQ ID NO: 3350313 - RNA, 20 nt, Mycobacterium tuberculosis H37Rv
ucaucgagucgaagaaccug

SEQ ID NO: 3350314 - RNA, 15 nt, Mycobacterium tuberculosis H37Rv
ucaucgcagucaugu

SEQ ID NO: 3350315 - RNA, 13 nt, Mycobacterium tuberculosis H37Rv
ucaucgccagcgg

SEQ ID NO: 3350316 - RNA, 18 nt, Mycobacterium tuberculosis H37Rv
ucaucgcccaccgcaacg

SEQ ID NO: 3350317 - RNA, 18 nt, Mycobacterium tuberculosis H37Rv
ucaucgccgacccgccac

SEQ ID NO: 3350318 - RNA, 19 nt, Mycobacterium tuberculosis H37Rv
ucaucgcggucgccaccgu

SEQ ID NO: 3350319 - RNA, 14 nt, Mycobacterium tuberculosis H37Rv
ucaucggagucaga

SEQ ID NO: 3350320 - RNA, 18 nt, Mycobacterium tuberculosis H37Rv
ucaucggcaaacuccugc

SEQ ID NO: 3350321 - RNA, 16 nt, Mycobacterium tuberculosis H37Rv
ucaucgggcacaucgc

SEQ ID NO: 3350322 - RNA, 21 nt, Mycobacterium tuberculosis H37Rv
ucaucgggguggccaccagcg

SEQ ID NO: 3350323 - RNA, 16 nt, Mycobacterium tuberculosis H37Rv
ucaucgugguaaccau

SEQ ID NO: 3350324 - RNA, 16 nt, Mycobacterium tuberculosis H37Rv
ucaucucgguggacgg

SEQ ID NO: 3350325 - RNA, 21 nt, Mycobacterium tuberculosis H37Rv
ucaucucggugguggccauga

SEQ ID NO: 3350326 - RNA, 14 nt, Mycobacterium tuberculosis H37Rv
ucaucuggucgacc

SEQ ID NO: 3350327 - RNA, 19 nt, Mycobacterium tuberculosis H37Rv
ucaucuguaaccuccucga

SEQ ID NO: 3350328 - RNA, 21 nt, Mycobacterium tuberculosis H37Rv
ucaucuuggcgcgguccucca

SEQ ID NO: 3350329 - RNA, 20 nt, Mycobacterium tuberculosis H37Rv
ucaugcacgccguagcaucg

SEQ ID NO: 3350330 - RNA, 22 nt, Mycobacterium tuberculosis H37Rv
ucaugcagggaauagcggcgcc

SEQ ID NO: 3350331 - RNA, 21 nt, Mycobacterium tuberculosis H37Rv
ucaugccagccgucaccgcga

SEQ ID NO: 3350332 - RNA, 21 nt, Mycobacterium tuberculosis H37Rv
ucaugccauagaugcccgcga

SEQ ID NO: 3350333 - RNA, 20 nt, Mycobacterium tuberculosis H37Rv
ucaugcccaugauggccgcg

SEQ ID NO: 3350334 - RNA, 18 nt, Mycobacterium tuberculosis H37Rv
ucaugcccuuguaggcca

SEQ ID NO: 3350335 - RNA, 15 nt, Mycobacterium tuberculosis H37Rv
ucaugccgcggaccc

SEQ ID NO: 3350336 - RNA, 16 nt, Mycobacterium tuberculosis H37Rv
ucaugcgauucugcgu

SEQ ID NO: 3350337 - RNA, 13 nt, Mycobacterium tuberculosis H37Rv
ucaugcuggaagu

SEQ ID NO: 3350338 - RNA, 22 nt, Mycobacterium tuberculosis H37Rv
ucauggccggucugcugggcac

SEQ ID NO: 3350339 - RNA, 22 nt, Mycobacterium tuberculosis H37Rv
ucaugggaucaggcugggcaga

SEQ ID NO: 3350340 - RNA, 20 nt, Mycobacterium tuberculosis H37Rv
ucaugggcgccaucccgccg

SEQ ID NO: 3350341 - RNA, 17 nt, Mycobacterium tuberculosis H37Rv
ucauguccugggccgcc

SEQ ID NO: 3350342 - RNA, 20 nt, Mycobacterium tuberculosis H37Rv
ucauguggucaacggccgac

SEQ ID NO: 3350343 - RNA, 15 nt, Mycobacterium tuberculosis H37Rv
ucauugcccuugacc

SEQ ID NO: 3350344 - RNA, 23 nt, Mycobacterium tuberculosis H37Rv
ucauuggccuggcuaguugggug

SEQ ID NO: 3350345 - RNA, 14 nt, Mycobacterium tuberculosis H37Rv
ucauugucccggcc

SEQ ID NO: 3350346 - RNA, 16 nt, Mycobacterium tuberculosis H37Rv
uccaaaacaccgccag

SEQ ID NO: 3350347 - RNA, 22 nt, Mycobacterium tuberculosis H37Rv
uccaaaacacucggaaucggcg

SEQ ID NO: 3350348 - RNA, 14 nt, Mycobacterium tuberculosis H37Rv
uccaaaaucgcggc

SEQ ID NO: 3350349 - RNA, 12 nt, Mycobacterium tuberculosis H37Rv
uccaaaccggag

SEQ ID NO: 3350350 - RNA, 17 nt, Mycobacterium tuberculosis H37Rv
uccaaagaccccuaccg

SEQ ID NO: 3350351 - RNA, 18 nt, Mycobacterium tuberculosis H37Rv
uccaaagggaguguuugg

SEQ ID NO: 3350352 - RNA, 18 nt, Mycobacterium tuberculosis H37Rv
uccaacaacuccagcagg

SEQ ID NO: 3350353 - RNA, 19 nt, Mycobacterium tuberculosis H37Rv
uccaacacaaacgccgccg

SEQ ID NO: 3350354 - RNA, 19 nt, Mycobacterium tuberculosis H37Rv
uccaacaggaacaggcaaa

SEQ ID NO: 3350355 - RNA, 19 nt, Mycobacterium tuberculosis H37Rv
uccaacaguucucgcgcuu

SEQ ID NO: 3350356 - RNA, 21 nt, Mycobacterium tuberculosis H37Rv
uccaacccaggguggcgacgu

SEQ ID NO: 3350357 - RNA, 15 nt, Mycobacterium tuberculosis H37Rv
uccaaccgggccggc

SEQ ID NO: 3350358 - RNA, 22 nt, Mycobacterium tuberculosis H37Rv
uccaacgacuguggcgccgccg

SEQ ID NO: 3350359 - RNA, 13 nt, Mycobacterium tuberculosis H37Rv
uccaacgaucagu

SEQ ID NO: 3350360 - RNA, 14 nt, Mycobacterium tuberculosis H37Rv
uccaacgaucaguc

SEQ ID NO: 3350361 - RNA, 11 nt, Mycobacterium tuberculosis H37Rv
uccaacgccgc

SEQ ID NO: 3350362 - RNA, 21 nt, Mycobacterium tuberculosis H37Rv
uccaacucggcccgggugacg

SEQ ID NO: 3350363 - RNA, 18 nt, Mycobacterium tuberculosis H37Rv
uccaacucggcggccagc

SEQ ID NO: 3350364 - RNA, 22 nt, Mycobacterium tuberculosis H37Rv
uccaacugaucccguagccgug

SEQ ID NO: 3350365 - RNA, 19 nt, Mycobacterium tuberculosis H37Rv
uccaagaacggaugccggu

SEQ ID NO: 3350366 - RNA, 20 nt, Mycobacterium tuberculosis H37Rv
uccaagcaauuccaccgccg

SEQ ID NO: 3350367 - RNA, 17 nt, Mycobacterium tuberculosis H37Rv
uccaagcucgacaacug

SEQ ID NO: 3350368 - RNA, 20 nt, Mycobacterium tuberculosis H37Rv
uccaagcucgacaacugccc

SEQ ID NO: 3350369 - RNA, 19 nt, Mycobacterium tuberculosis H37Rv
uccaaggcggucaccaccg

SEQ ID NO: 3350370 - RNA, 20 nt, Mycobacterium tuberculosis H37Rv
uccaaggcucagcagcgccg

SEQ ID NO: 3350371 - RNA, 14 nt, Mycobacterium tuberculosis H37Rv
uccaagucacagcu

SEQ ID NO: 3350372 - RNA, 21 nt, Mycobacterium tuberculosis H37Rv
uccaauacucgccaucgcgga

SEQ ID NO: 3350373 - RNA, 16 nt, Mycobacterium tuberculosis H37Rv
uccaauccacgguugc

SEQ ID NO: 3350374 - RNA, 21 nt, Mycobacterium tuberculosis H37Rv
uccaaugcuguggcccgucau

SEQ ID NO: 3350375 - RNA, 19 nt, Mycobacterium tuberculosis H37Rv
uccaauugcgaaccggccg

SEQ ID NO: 3350376 - RNA, 23 nt, Mycobacterium tuberculosis H37Rv
uccaauugcgcugaagcccaugg

SEQ ID NO: 3350377 - RNA, 17 nt, Mycobacterium tuberculosis H37Rv
uccaauugcggccgcgc

SEQ ID NO: 3350378 - RNA, 14 nt, Mycobacterium tuberculosis H37Rv
uccacaacagcccg

SEQ ID NO: 3350379 - RNA, 15 nt, Mycobacterium tuberculosis H37Rv
uccacaaguagccga

SEQ ID NO: 3350380 - RNA, 12 nt, Mycobacterium tuberculosis H37Rv
uccacaccaggc

SEQ ID NO: 3350381 - RNA, 13 nt, Mycobacterium tuberculosis H37Rv
uccacaccaggcc

SEQ ID NO: 3350382 - RNA, 22 nt, Mycobacterium tuberculosis H37Rv
uccagccgacggcagugcugca

SEQ ID NO: 3350383 - RNA, 15 nt, Mycobacterium tuberculosis H37Rv
uccagccgcgcgccg

SEQ ID NO: 3350384 - RNA, 18 nt, Mycobacterium tuberculosis H37Rv
uccagccgcgcguccggg

SEQ ID NO: 3350385 - RNA, 16 nt, Mycobacterium tuberculosis H37Rv
uccagccgguccagac

SEQ ID NO: 3350386 - RNA, 21 nt, Mycobacterium tuberculosis H37Rv
uccagccgguccagacccagc

SEQ ID NO: 3350387 - RNA, 18 nt, Mycobacterium tuberculosis H37Rv
uccagccgucggcgcugc

SEQ ID NO: 3350388 - RNA, 21 nt, Mycobacterium tuberculosis H37Rv
uccagccgugcggcggcugcc

SEQ ID NO: 3350389 - RNA, 21 nt, Mycobacterium tuberculosis H37Rv
uccagcgagcgcagcacguaa

SEQ ID NO: 3350390 - RNA, 19 nt, Mycobacterium tuberculosis H37Rv
uccagcgauccggggcugg

SEQ ID NO: 3350391 - RNA, 22 nt, Mycobacterium tuberculosis H37Rv
uccagcgcgacguccaccagcc

SEQ ID NO: 3350392 - RNA, 19 nt, Mycobacterium tuberculosis H37Rv
uccagcgcgccacccagca

SEQ ID NO: 3350393 - RNA, 21 nt, Mycobacterium tuberculosis H37Rv
uccagcgcgccacccagcacc

SEQ ID NO: 3350394 - RNA, 13 nt, Mycobacterium tuberculosis H37Rv
uccagcgcgcgcc

SEQ ID NO: 3350395 - RNA, 13 nt, Mycobacterium tuberculosis H37Rv
uccagcgcggccu

SEQ ID NO: 3350396 - RNA, 21 nt, Mycobacterium tuberculosis H37Rv
uccagcgcguaguccgcaucc

SEQ ID NO: 3350397 - RNA, 14 nt, Mycobacterium tuberculosis H37Rv
uccagcggcaccgc

SEQ ID NO: 3350398 - RNA, 21 nt, Mycobacterium tuberculosis H37Rv
uccagcggguggccaucaccg

SEQ ID NO: 3350399 - RNA, 14 nt, Mycobacterium tuberculosis H37Rv
uccagcgucgccgc

SEQ ID NO: 3350400 - RNA, 14 nt, Mycobacterium tuberculosis H37Rv
uccagcucacgaug

SEQ ID NO: 3350401 - RNA, 18 nt, Mycobacterium tuberculosis H37Rv
uccagcucgcugcgcgcc

SEQ ID NO: 3350402 - RNA, 13 nt, Mycobacterium tuberculosis H37Rv
uccagcucggcgg

SEQ ID NO: 3350403 - RNA, 13 nt, Mycobacterium tuberculosis H37Rv
uccagcucgggca

SEQ ID NO: 3350404 - RNA, 20 nt, Mycobacterium tuberculosis H37Rv
uccagcuguacaacgccguc

SEQ ID NO: 3350405 - RNA, 16 nt, Mycobacterium tuberculosis H37Rv
uccagcuugccgaccu

SEQ ID NO: 3350406 - RNA, 19 nt, Mycobacterium tuberculosis H37Rv
uccaggauggccaucagcu

SEQ ID NO: 3350407 - RNA, 23 nt, Mycobacterium tuberculosis H37Rv
uccaggauggccaucagcucgcc

SEQ ID NO: 3350408 - RNA, 19 nt, Mycobacterium tuberculosis H37Rv
uccaggcacuccagcggcg

SEQ ID NO: 3350409 - RNA, 21 nt, Mycobacterium tuberculosis H37Rv
uccaggcccauacgugccgcc

SEQ ID NO: 3350410 - RNA, 21 nt, Mycobacterium tuberculosis H37Rv
uccaggcgcugcagcauggcu

SEQ ID NO: 3350411 - RNA, 18 nt, Mycobacterium tuberculosis H37Rv
uccaggcugaucccgaug

SEQ ID NO: 3350412 - RNA, 22 nt, Mycobacterium tuberculosis H37Rv
uccagggagcggcugcacgccu

SEQ ID NO: 3350413 - RNA, 22 nt, Mycobacterium tuberculosis H37Rv
uccagggugccggucacgucga

SEQ ID NO: 3350414 - RNA, 16 nt, Mycobacterium tuberculosis H37Rv
uccagguagucgcggu

SEQ ID NO: 3350415 - RNA, 20 nt, Mycobacterium tuberculosis H37Rv
uccagguccaaguccuccac

SEQ ID NO: 3350416 - RNA, 12 nt, Mycobacterium tuberculosis H37Rv
uccaggucgaca

SEQ ID NO: 3350417 - RNA, 12 nt, Mycobacterium tuberculosis H37Rv
uccaggucuggg

SEQ ID NO: 3350418 - RNA, 17 nt, Mycobacterium tuberculosis H37Rv
uccagguggucaucgcc

SEQ ID NO: 3350419 - RNA, 15 nt, Mycobacterium tuberculosis H37Rv
uccagguuccagguc

SEQ ID NO: 3350420 - RNA, 18 nt, Mycobacterium tuberculosis H37Rv
uccagguucuucuccacc

SEQ ID NO: 3350421 - RNA, 14 nt, Mycobacterium tuberculosis H37Rv
uccagugcggccuu

SEQ ID NO: 3350422 - RNA, 18 nt, Mycobacterium tuberculosis H37Rv
uccaguggcgccagggcc

SEQ ID NO: 3350423 - RNA, 13 nt, Mycobacterium tuberculosis H37Rv
uccauaccugaau

SEQ ID NO: 3350424 - RNA, 14 nt, Mycobacterium tuberculosis H37Rv
uccauaccugaaug

SEQ ID NO: 3350425 - RNA, 17 nt, Mycobacterium tuberculosis H37Rv
uccaucacggaccaggc

SEQ ID NO: 3350426 - RNA, 19 nt, Mycobacterium tuberculosis H37Rv
uccaucacggaccaggccu

SEQ ID NO: 3350427 - RNA, 14 nt, Mycobacterium tuberculosis H37Rv
uccaucagggccuu

SEQ ID NO: 3350428 - RNA, 15 nt, Mycobacterium tuberculosis H37Rv
uccaucgcgcaccgc

SEQ ID NO: 3350429 - RNA, 14 nt, Mycobacterium tuberculosis H37Rv
uccaucgcgcugcg

SEQ ID NO: 3350430 - RNA, 19 nt, Mycobacterium tuberculosis H37Rv
uccaugaggauuugguggc

SEQ ID NO: 3350431 - RNA, 14 nt, Mycobacterium tuberculosis H37Rv
uccaugauggccgu

SEQ ID NO: 3350432 - RNA, 14 nt, Mycobacterium tuberculosis H37Rv
uccaugcuggggag

SEQ ID NO: 3350433 - RNA, 12 nt, Mycobacterium tuberculosis H37Rv
uccaugucgucg

SEQ ID NO: 3350434 - RNA, 13 nt, Mycobacterium tuberculosis H37Rv
uccaugucgucga

SEQ ID NO: 3350435 - RNA, 15 nt, Mycobacterium tuberculosis H37Rv
uccaugugcccaggu

SEQ ID NO: 3350436 - RNA, 21 nt, Mycobacterium tuberculosis H37Rv
uccauguuuugcugcaugccg

SEQ ID NO: 3350437 - RNA, 23 nt, Mycobacterium tuberculosis H37Rv
uccauuagcacaucgccggcguc

SEQ ID NO: 3350438 - RNA, 17 nt, Mycobacterium tuberculosis H37Rv
uccauucauggccgcga

SEQ ID NO: 3350439 - RNA, 18 nt, Mycobacterium tuberculosis H37Rv
uccauuggaaccugaucc

SEQ ID NO: 3350440 - RNA, 15 nt, Mycobacterium tuberculosis H37Rv
ucccaacacggcgac

SEQ ID NO: 3350441 - RNA, 15 nt, Mycobacterium tuberculosis H37Rv
ucccaaccgcccgug

SEQ ID NO: 3350442 - RNA, 22 nt, Mycobacterium tuberculosis H37Rv
ucccaaucgggaucgcugccag

SEQ ID NO: 3350443 - RNA, 18 nt, Mycobacterium tuberculosis H37Rv
ucccaaucgucggccagc

SEQ ID NO: 3350444 - RNA, 20 nt, Mycobacterium tuberculosis H37Rv
ucccacaggcuuuuccggcg

SEQ ID NO: 3350445 - RNA, 18 nt, Mycobacterium tuberculosis H37Rv
ucccacagguagaccguc

SEQ ID NO: 3350446 - RNA, 22 nt, Mycobacterium tuberculosis H37Rv
ucccacagguuugcgccgcgca

SEQ ID NO: 3350447 - RNA, 17 nt, Mycobacterium tuberculosis H37Rv
ucccaccaccgcucguc

SEQ ID NO: 3350448 - RNA, 20 nt, Mycobacterium tuberculosis H37Rv
ucccaccagcggcggcccuu

SEQ ID NO: 3350449 - RNA, 22 nt, Mycobacterium tuberculosis H37Rv
ucccaccagguacgcgaucagc

SEQ ID NO: 3350450 - RNA, 16 nt, Mycobacterium tuberculosis H37Rv
ucccacgccagcgcga

SEQ ID NO: 3350451 - RNA, 21 nt, Mycobacterium tuberculosis H37Rv
ucccacggccggccgcugcca

SEQ ID NO: 3350452 - RNA, 22 nt, Mycobacterium tuberculosis H37Rv
ucccacggccggccgcugccac

SEQ ID NO: 3350453 - RNA, 23 nt, Mycobacterium tuberculosis H37Rv
ucccacggccggccgcugccacu

SEQ ID NO: 3350454 - RNA, 19 nt, Mycobacterium tuberculosis H37Rv
ucccacggcgguugccccg

SEQ ID NO: 3350455 - RNA, 14 nt, Mycobacterium tuberculosis H37Rv
ucccacugcgcguc

SEQ ID NO: 3350456 - RNA, 14 nt, Mycobacterium tuberculosis H37Rv
ucccacuggagguc

SEQ ID NO: 3350457 - RNA, 17 nt, Mycobacterium tuberculosis H37Rv
ucccacuggaggucguc

SEQ ID NO: 3350458 - RNA, 19 nt, Mycobacterium tuberculosis H37Rv
ucccagagaaucagcgugg

SEQ ID NO: 3350459 - RNA, 16 nt, Mycobacterium tuberculosis H37Rv
ucccagauaugcagga

SEQ ID NO: 3350460 - RNA, 21 nt, Mycobacterium tuberculosis H37Rv
ucccagccuggcaaccacguc

SEQ ID NO: 3350461 - RNA, 11 nt, Mycobacterium tuberculosis H37Rv
ucccagcgccg

SEQ ID NO: 3350462 - RNA, 19 nt, Mycobacterium tuberculosis H37Rv
ucccagcgccgcacagaaa

SEQ ID NO: 3350463 - RNA, 18 nt, Mycobacterium tuberculosis H37Rv
ucccagcugaccagcguc

SEQ ID NO: 3350464 - RNA, 19 nt, Mycobacterium tuberculosis H37Rv
ucccaggcguuuggcgugc

SEQ ID NO: 3350465 - RNA, 21 nt, Mycobacterium tuberculosis H37Rv
ucccagucgcggcgcgaggag

SEQ ID NO: 3350466 - RNA, 15 nt, Mycobacterium tuberculosis H37Rv
ucccauucguagucg

SEQ ID NO: 3350467 - RNA, 17 nt, Mycobacterium tuberculosis H37Rv
uccccacaaucagcccg

SEQ ID NO: 3350468 - RNA, 18 nt, Mycobacterium tuberculosis H37Rv
uccccacaaucagcccga

SEQ ID NO: 3350469 - RNA, 16 nt, Mycobacterium tuberculosis H37Rv
uccccaccgacgccga

SEQ ID NO: 3350470 - RNA, 15 nt, Mycobacterium tuberculosis H37Rv
uccccagacagaccc

SEQ ID NO: 3350471 - RNA, 18 nt, Mycobacterium tuberculosis H37Rv
uccccagaccggcggcua

SEQ ID NO: 3350472 - RNA, 12 nt, Mycobacterium tuberculosis H37Rv
uccccagcacca

SEQ ID NO: 3350473 - RNA, 14 nt, Mycobacterium tuberculosis H37Rv
uccccaggccgcuu

SEQ ID NO: 3350474 - RNA, 22 nt, Mycobacterium tuberculosis H37Rv
uccccaugcagcgcgucgccga

SEQ ID NO: 3350475 - RNA, 23 nt, Mycobacterium tuberculosis H37Rv
uccccaugcagcgcgucgccgaa

SEQ ID NO: 3350476 - RNA, 13 nt, Mycobacterium tuberculosis H37Rv
uccccauugcgcc

SEQ ID NO: 3350477 - RNA, 19 nt, Mycobacterium tuberculosis H37Rv
uccccccguugccgccguu

SEQ ID NO: 3350478 - RNA, 15 nt, Mycobacterium tuberculosis H37Rv
ucccgguguccagcc

SEQ ID NO: 3350479 - RNA, 19 nt, Mycobacterium tuberculosis H37Rv
ucccguacucccguggccg

SEQ ID NO: 3350480 - RNA, 20 nt, Mycobacterium tuberculosis H37Rv
ucccgucucgacaguggcga

SEQ ID NO: 3350481 - RNA, 22 nt, Mycobacterium tuberculosis H37Rv
ucccgugacgaacuucgaugcc

SEQ ID NO: 3350482 - RNA, 17 nt, Mycobacterium tuberculosis H37Rv
ucccguugccgcccacu

SEQ ID NO: 3350483 - RNA, 17 nt, Mycobacterium tuberculosis H37Rv
ucccuauugcugcggug

SEQ ID NO: 3350484 - RNA, 17 nt, Mycobacterium tuberculosis H37Rv
ucccucaugcuggaagu

SEQ ID NO: 3350485 - RNA, 13 nt, Mycobacterium tuberculosis H37Rv
ucccuccgccaag

SEQ ID NO: 3350486 - RNA, 14 nt, Mycobacterium tuberculosis H37Rv
ucccucgacagugc

SEQ ID NO: 3350487 - RNA, 19 nt, Mycobacterium tuberculosis H37Rv
ucccugcaguccacugauc

SEQ ID NO: 3350488 - RNA, 11 nt, Mycobacterium tuberculosis H37Rv
ucccuggccuu

SEQ ID NO: 3350489 - RNA, 18 nt, Mycobacterium tuberculosis H37Rv
ucccuggccuuggugccg

SEQ ID NO: 3350490 - RNA, 20 nt, Mycobacterium tuberculosis H37Rv
ucccuggggccguccggcuu

SEQ ID NO: 3350491 - RNA, 15 nt, Mycobacterium tuberculosis H37Rv
ucccuugccgaccgg

SEQ ID NO: 3350492 - RNA, 19 nt, Mycobacterium tuberculosis H37Rv
ucccuuuguggggccgggc

SEQ ID NO: 3350493 - RNA, 11 nt, Mycobacterium tuberculosis H37Rv
ucccuuuucca

SEQ ID NO: 3350494 - RNA, 15 nt, Mycobacterium tuberculosis H37Rv
uccgaacacggugaa

SEQ ID NO: 3350495 - RNA, 22 nt, Mycobacterium tuberculosis H37Rv
uccgaacggguagacccacauc

SEQ ID NO: 3350496 - RNA, 21 nt, Mycobacterium tuberculosis H37Rv
uccgaacuggucgacgccgag

SEQ ID NO: 3350497 - RNA, 15 nt, Mycobacterium tuberculosis H37Rv
uccgaagagccagca

SEQ ID NO: 3350498 - RNA, 18 nt, Mycobacterium tuberculosis H37Rv
uccgaaggccgccagucc

SEQ ID NO: 3350499 - RNA, 22 nt, Mycobacterium tuberculosis H37Rv
uccgaaguccacgcaccacgag

SEQ ID NO: 3350500 - RNA, 21 nt, Mycobacterium tuberculosis H37Rv
uccgacaagcugucggcgacc

SEQ ID NO: 3350501 - RNA, 17 nt, Mycobacterium tuberculosis H37Rv
uccgacacccgaagccu

SEQ ID NO: 3350502 - RNA, 12 nt, Mycobacterium tuberculosis H37Rv
uccgacaguccg

SEQ ID NO: 3350503 - RNA, 21 nt, Mycobacterium tuberculosis H37Rv
uccgacaguccgcgccggcgg

SEQ ID NO: 3350504 - RNA, 13 nt, Mycobacterium tuberculosis H37Rv
uccgacaugaacc

SEQ ID NO: 3350505 - RNA, 15 nt, Mycobacterium tuberculosis H37Rv
uccgaccagcggccg

SEQ ID NO: 3350506 - RNA, 17 nt, Mycobacterium tuberculosis H37Rv
uccgacccaacgaccac

SEQ ID NO: 3350507 - RNA, 21 nt, Mycobacterium tuberculosis H37Rv
uccgacccaacgaccaccacc

SEQ ID NO: 3350508 - RNA, 15 nt, Mycobacterium tuberculosis H37Rv
uccgaccgguacccg

SEQ ID NO: 3350509 - RNA, 20 nt, Mycobacterium tuberculosis H37Rv
uccgaccucugcguccagca

SEQ ID NO: 3350510 - RNA, 17 nt, Mycobacterium tuberculosis H37Rv
uccgacgaaccgggaca

SEQ ID NO: 3350511 - RNA, 21 nt, Mycobacterium tuberculosis H37Rv
uccgacgcgugucugggaccc

SEQ ID NO: 3350512 - RNA, 17 nt, Mycobacterium tuberculosis H37Rv
uccgacggccgcggcgu

SEQ ID NO: 3350513 - RNA, 15 nt, Mycobacterium tuberculosis H37Rv
uccgacgggccacga

SEQ ID NO: 3350514 - RNA, 22 nt, Mycobacterium tuberculosis H37Rv
uccgacgggccgucgccgucca

SEQ ID NO: 3350515 - RNA, 16 nt, Mycobacterium tuberculosis H37Rv
uccgacgggggucggg

SEQ ID NO: 3350516 - RNA, 15 nt, Mycobacterium tuberculosis H37Rv
uccgacgucggugac

SEQ ID NO: 3350517 - RNA, 17 nt, Mycobacterium tuberculosis H37Rv
uccgacuggccccgcca

SEQ ID NO: 3350518 - RNA, 21 nt, Mycobacterium tuberculosis H37Rv
uccgacuggccccgccagcgg

SEQ ID NO: 3350519 - RNA, 24 nt, Mycobacterium tuberculosis H37Rv
uccgacuggccccgccagcggcag

SEQ ID NO: 3350520 - RNA, 15 nt, Mycobacterium tuberculosis H37Rv
uccgacuugucgccg

SEQ ID NO: 3350521 - RNA, 18 nt, Mycobacterium tuberculosis H37Rv
uccgagccgcgauugugc

SEQ ID NO: 3350522 - RNA, 19 nt, Mycobacterium tuberculosis H37Rv
uccgagcgcggcggcggag

SEQ ID NO: 3350523 - RNA, 22 nt, Mycobacterium tuberculosis H37Rv
uccgagcgcggcggcggaggcu

SEQ ID NO: 3350524 - RNA, 20 nt, Mycobacterium tuberculosis H37Rv
uccgagcuuggccgccgcca

SEQ ID NO: 3350525 - RNA, 17 nt, Mycobacterium tuberculosis H37Rv
uccgaggaauacagcuu

SEQ ID NO: 3350526 - RNA, 18 nt, Mycobacterium tuberculosis H37Rv
uccgaggaauacagcuug

SEQ ID NO: 3350527 - RNA, 19 nt, Mycobacterium tuberculosis H37Rv
uccgaggaauacagcuuga

SEQ ID NO: 3350528 - RNA, 14 nt, Mycobacterium tuberculosis H37Rv
uccgaggccgccau

SEQ ID NO: 3350529 - RNA, 19 nt, Mycobacterium tuberculosis H37Rv
uccgagggaacggugcaca

SEQ ID NO: 3350530 - RNA, 19 nt, Mycobacterium tuberculosis H37Rv
uccgagggcgucgccgccg

SEQ ID NO: 3350531 - RNA, 15 nt, Mycobacterium tuberculosis H37Rv
uccgagggugcguug

SEQ ID NO: 3350532 - RNA, 13 nt, Mycobacterium tuberculosis H37Rv
uccgaucgcagac

SEQ ID NO: 3350533 - RNA, 19 nt, Mycobacterium tuberculosis H37Rv
uccgaugcaucggugcagc

SEQ ID NO: 3350534 - RNA, 20 nt, Mycobacterium tuberculosis H37Rv
uccgaugcaucggugcagcc

SEQ ID NO: 3350535 - RNA, 14 nt, Mycobacterium tuberculosis H37Rv
uccgaugccgacgg

SEQ ID NO: 3350536 - RNA, 20 nt, Mycobacterium tuberculosis H37Rv
uccgaugcgugccgacccgc

SEQ ID NO: 3350537 - RNA, 15 nt, Mycobacterium tuberculosis H37Rv
uccgaugggaaucag

SEQ ID NO: 3350538 - RNA, 18 nt, Mycobacterium tuberculosis H37Rv
uccgaugguaugcccgcc

SEQ ID NO: 3350539 - RNA, 14 nt, Mycobacterium tuberculosis H37Rv
uccgauuccgaacu

SEQ ID NO: 3350540 - RNA, 15 nt, Mycobacterium tuberculosis H37Rv
uccgauuggcgaucu

SEQ ID NO: 3350541 - RNA, 22 nt, Mycobacterium tuberculosis H37Rv
uccgcaaaacgagcuuccacgc

SEQ ID NO: 3350542 - RNA, 21 nt, Mycobacterium tuberculosis H37Rv
uccgcaaccccuggggugcuc

SEQ ID NO: 3350543 - RNA, 17 nt, Mycobacterium tuberculosis H37Rv
uccgcaaccucgccguc

SEQ ID NO: 3350544 - RNA, 18 nt, Mycobacterium tuberculosis H37Rv
uccgcaaugaccuggccg

SEQ ID NO: 3350545 - RNA, 14 nt, Mycobacterium tuberculosis H37Rv
uccgcacagguccg

SEQ ID NO: 3350546 - RNA, 18 nt, Mycobacterium tuberculosis H37Rv
uccgcacagguccggguu

SEQ ID NO: 3350547 - RNA, 14 nt, Mycobacterium tuberculosis H37Rv
uccgcaccacgccc

SEQ ID NO: 3350548 - RNA, 22 nt, Mycobacterium tuberculosis H37Rv
uccgcaccacgcccgacgagga

SEQ ID NO: 3350549 - RNA, 21 nt, Mycobacterium tuberculosis H37Rv
uccgcacccggccgcgcaccc

SEQ ID NO: 3350550 - RNA, 13 nt, Mycobacterium tuberculosis H37Rv
uccgcaccgaaac

SEQ ID NO: 3350551 - RNA, 14 nt, Mycobacterium tuberculosis H37Rv
uccgcacgaucgcc

SEQ ID NO: 3350552 - RNA, 20 nt, Mycobacterium tuberculosis H37Rv
uccgcagaaugucguaggcg

SEQ ID NO: 3350553 - RNA, 13 nt, Mycobacterium tuberculosis H37Rv
uccgccaacucgu

SEQ ID NO: 3350554 - RNA, 19 nt, Mycobacterium tuberculosis H37Rv
uccgccacccgccaacgcc

SEQ ID NO: 3350555 - RNA, 20 nt, Mycobacterium tuberculosis H37Rv
uccgccacggcgggcgaccc

SEQ ID NO: 3350556 - RNA, 21 nt, Mycobacterium tuberculosis H37Rv
uccgccagaauugccggcgau

SEQ ID NO: 3350557 - RNA, 22 nt, Mycobacterium tuberculosis H37Rv
uccgcccagcgaggugggcguc

SEQ ID NO: 3350558 - RNA, 23 nt, Mycobacterium tuberculosis H37Rv
uccgcccagcgaggugggcguca

SEQ ID NO: 3350559 - RNA, 20 nt, Mycobacterium tuberculosis H37Rv
uccgcccauucccagaggcc

SEQ ID NO: 3350560 - RNA, 23 nt, Mycobacterium tuberculosis H37Rv
uccgcccauucccagaggcccgc

SEQ ID NO: 3350561 - RNA, 14 nt, Mycobacterium tuberculosis H37Rv
uccgccccagcugc

SEQ ID NO: 3350562 - RNA, 15 nt, Mycobacterium tuberculosis H37Rv
uccgccccagcugcg

SEQ ID NO: 3350563 - RNA, 17 nt, Mycobacterium tuberculosis H37Rv
uccgccccgcccgcacc

SEQ ID NO: 3350564 - RNA, 20 nt, Mycobacterium tuberculosis H37Rv
uccgccccgcccgcacccau

SEQ ID NO: 3350565 - RNA, 15 nt, Mycobacterium tuberculosis H37Rv
uccgcccgccgaccu

SEQ ID NO: 3350566 - RNA, 12 nt, Mycobacterium tuberculosis H37Rv
uccgcccggugc

SEQ ID NO: 3350567 - RNA, 20 nt, Mycobacterium tuberculosis H37Rv
uccgcccucaguucacgcuc

SEQ ID NO: 3350568 - RNA, 20 nt, Mycobacterium tuberculosis H37Rv
uccgcccucaguucacguuc

SEQ ID NO: 3350569 - RNA, 15 nt, Mycobacterium tuberculosis H37Rv
uccgcccuugccgcc

SEQ ID NO: 3350570 - RNA, 13 nt, Mycobacterium tuberculosis H37Rv
uccgccgaacacc

SEQ ID NO: 3350571 - RNA, 13 nt, Mycobacterium tuberculosis H37Rv
uccgccgagcaga

SEQ ID NO: 3350572 - RNA, 19 nt, Mycobacterium tuberculosis H37Rv
uccgccgagcagacgcaga

SEQ ID NO: 3350573 - RNA, 18 nt, Mycobacterium tuberculosis H37Rv
uccgccgaggccgccguu

SEQ ID NO: 3350574 - RNA, 22 nt, Mycobacterium tuberculosis H37Rv
uccggcgacgcguagcacggcg

SEQ ID NO: 3350575 - RNA, 12 nt, Mycobacterium tuberculosis H37Rv
uccggcgcaccu

SEQ ID NO: 3350576 - RNA, 15 nt, Mycobacterium tuberculosis H37Rv
uccggcgccaccgcc

SEQ ID NO: 3350577 - RNA, 16 nt, Mycobacterium tuberculosis H37Rv
uccggcgccaccgccg

SEQ ID NO: 3350578 - RNA, 13 nt, Mycobacterium tuberculosis H37Rv
uccggcgccagca

SEQ ID NO: 3350579 - RNA, 21 nt, Mycobacterium tuberculosis H37Rv
uccggcgccaggaucgaucgu

SEQ ID NO: 3350580 - RNA, 22 nt, Mycobacterium tuberculosis H37Rv
uccggcgcuccacugaccaggu

SEQ ID NO: 3350581 - RNA, 20 nt, Mycobacterium tuberculosis H37Rv
uccggcggaaacaugugggu

SEQ ID NO: 3350582 - RNA, 21 nt, Mycobacterium tuberculosis H37Rv
uccggcggacccucgccgaag

SEQ ID NO: 3350583 - RNA, 14 nt, Mycobacterium tuberculosis H37Rv
uccggcggcagcgg

SEQ ID NO: 3350584 - RNA, 22 nt, Mycobacterium tuberculosis H37Rv
uccggcggcagcggcgccgccu

SEQ ID NO: 3350585 - RNA, 19 nt, Mycobacterium tuberculosis H37Rv
uccggcggccacgccggcg

SEQ ID NO: 3350586 - RNA, 13 nt, Mycobacterium tuberculosis H37Rv
uccggcggcgacg

SEQ ID NO: 3350587 - RNA, 23 nt, Mycobacterium tuberculosis H37Rv
uccggcgggugccgagcuggcga

SEQ ID NO: 3350588 - RNA, 21 nt, Mycobacterium tuberculosis H37Rv
uccggcguacucggugaucgc

SEQ ID NO: 3350589 - RNA, 17 nt, Mycobacterium tuberculosis H37Rv
uccggcgugcagcaccc

SEQ ID NO: 3350590 - RNA, 14 nt, Mycobacterium tuberculosis H37Rv
uccggcgugggcac

SEQ ID NO: 3350591 - RNA, 17 nt, Mycobacterium tuberculosis H37Rv
uccggcucaccgauccc

SEQ ID NO: 3350592 - RNA, 15 nt, Mycobacterium tuberculosis H37Rv
uccggcucauccgac

SEQ ID NO: 3350593 - RNA, 12 nt, Mycobacterium tuberculosis H37Rv
uccggcuccacc

SEQ ID NO: 3350594 - RNA, 18 nt, Mycobacterium tuberculosis H37Rv
uccggcucgucagguucc

SEQ ID NO: 3350595 - RNA, 20 nt, Mycobacterium tuberculosis H37Rv
uccggcuggaagcggcgacu

SEQ ID NO: 3350596 - RNA, 23 nt, Mycobacterium tuberculosis H37Rv
uccggcuggaagcggcgacuacc

SEQ ID NO: 3350597 - RNA, 22 nt, Mycobacterium tuberculosis H37Rv
uccggcuggugggacgcggccg

SEQ ID NO: 3350598 - RNA, 23 nt, Mycobacterium tuberculosis H37Rv
uccggcuucggcgaacccuccgc

SEQ ID NO: 3350599 - RNA, 16 nt, Mycobacterium tuberculosis H37Rv
uccggcuucguccacc

SEQ ID NO: 3350600 - RNA, 16 nt, Mycobacterium tuberculosis H37Rv
uccgggaccaggccaa

SEQ ID NO: 3350601 - RNA, 22 nt, Mycobacterium tuberculosis H37Rv
uccgggaugaagcucgaccgcc

SEQ ID NO: 3350602 - RNA, 18 nt, Mycobacterium tuberculosis H37Rv
uccgggaugucgaagucg

SEQ ID NO: 3350603 - RNA, 17 nt, Mycobacterium tuberculosis H37Rv
uccgggcaaccgaaccg

SEQ ID NO: 3350604 - RNA, 16 nt, Mycobacterium tuberculosis H37Rv
uccgggcaaccgauga

SEQ ID NO: 3350605 - RNA, 13 nt, Mycobacterium tuberculosis H37Rv
uccgggcagcugg

SEQ ID NO: 3350606 - RNA, 16 nt, Mycobacterium tuberculosis H37Rv
uccgggccaugugggg

SEQ ID NO: 3350607 - RNA, 20 nt, Mycobacterium tuberculosis H37Rv
uccgggccauguggggaccu

SEQ ID NO: 3350608 - RNA, 16 nt, Mycobacterium tuberculosis H37Rv
uccgggccccacggcg

SEQ ID NO: 3350609 - RNA, 15 nt, Mycobacterium tuberculosis H37Rv
uccgggccgaucacc

SEQ ID NO: 3350610 - RNA, 23 nt, Mycobacterium tuberculosis H37Rv
uccgggccgaucaccccggugga

SEQ ID NO: 3350611 - RNA, 15 nt, Mycobacterium tuberculosis H37Rv
uccgggccgccgccc

SEQ ID NO: 3350612 - RNA, 17 nt, Mycobacterium tuberculosis H37Rv
uccgggccuggccugcc

SEQ ID NO: 3350613 - RNA, 16 nt, Mycobacterium tuberculosis H37Rv
uccgggcggccucccg

SEQ ID NO: 3350614 - RNA, 13 nt, Mycobacterium tuberculosis H37Rv
uccggggcuggcu

SEQ ID NO: 3350615 - RNA, 17 nt, Mycobacterium tuberculosis H37Rv
uccggggggauccagca

SEQ ID NO: 3350616 - RNA, 20 nt, Mycobacterium tuberculosis H37Rv
uccggggggauccagcaggc

SEQ ID NO: 3350617 - RNA, 14 nt, Mycobacterium tuberculosis H37Rv
uccggguagcggcg

SEQ ID NO: 3350618 - RNA, 13 nt, Mycobacterium tuberculosis H37Rv
uccgggucgacga

SEQ ID NO: 3350619 - RNA, 12 nt, Mycobacterium tuberculosis H37Rv
uccgggugcaga

SEQ ID NO: 3350620 - RNA, 16 nt, Mycobacterium tuberculosis H37Rv
uccgggugcagaucgc

SEQ ID NO: 3350621 - RNA, 14 nt, Mycobacterium tuberculosis H37Rv
uccgggugccggug

SEQ ID NO: 3350622 - RNA, 16 nt, Mycobacterium tuberculosis H37Rv
uccgguaucggcgacc

SEQ ID NO: 3350623 - RNA, 14 nt, Mycobacterium tuberculosis H37Rv
uccggucgccaagu

SEQ ID NO: 3350624 - RNA, 17 nt, Mycobacterium tuberculosis H37Rv
uccggucgccucaccgg

SEQ ID NO: 3350625 - RNA, 21 nt, Mycobacterium tuberculosis H37Rv
uccggucgcucgauggaucca

SEQ ID NO: 3350626 - RNA, 22 nt, Mycobacterium tuberculosis H37Rv
uccggucgcuguccacugccac

SEQ ID NO: 3350627 - RNA, 21 nt, Mycobacterium tuberculosis H37Rv
uccggucggccagcaagugcg

SEQ ID NO: 3350628 - RNA, 15 nt, Mycobacterium tuberculosis H37Rv
uccggucggccaggc

SEQ ID NO: 3350629 - RNA, 16 nt, Mycobacterium tuberculosis H37Rv
uccggugaacccgauu

SEQ ID NO: 3350630 - RNA, 20 nt, Mycobacterium tuberculosis H37Rv
uccggugcgaucccacccuc

SEQ ID NO: 3350631 - RNA, 17 nt, Mycobacterium tuberculosis H37Rv
uccggugcgccgauccc

SEQ ID NO: 3350632 - RNA, 15 nt, Mycobacterium tuberculosis H37Rv
uccgguggaccgccg

SEQ ID NO: 3350633 - RNA, 20 nt, Mycobacterium tuberculosis H37Rv
uccgguggccaacaccgcca

SEQ ID NO: 3350634 - RNA, 21 nt, Mycobacterium tuberculosis H37Rv
uccgguggccaacaccgccag

SEQ ID NO: 3350635 - RNA, 23 nt, Mycobacterium tuberculosis H37Rv
uccgguggccaacaccgccagca

SEQ ID NO: 3350636 - RNA, 12 nt, Mycobacterium tuberculosis H37Rv
uccgguggucag

SEQ ID NO: 3350637 - RNA, 17 nt, Mycobacterium tuberculosis H37Rv
uccgguggugcucgucg

SEQ ID NO: 3350638 - RNA, 17 nt, Mycobacterium tuberculosis H37Rv
uccggugucgcgaucgc

SEQ ID NO: 3350639 - RNA, 18 nt, Mycobacterium tuberculosis H37Rv
uccggugucgcgaucgcg

SEQ ID NO: 3350640 - RNA, 12 nt, Mycobacterium tuberculosis H37Rv
uccgguguugag

SEQ ID NO: 3350641 - RNA, 14 nt, Mycobacterium tuberculosis H37Rv
uccgguuacgcucg

SEQ ID NO: 3350642 - RNA, 16 nt, Mycobacterium tuberculosis H37Rv
uccgguuacuuuucca

SEQ ID NO: 3350643 - RNA, 15 nt, Mycobacterium tuberculosis H37Rv
uccgguucugggccu

SEQ ID NO: 3350644 - RNA, 18 nt, Mycobacterium tuberculosis H37Rv
uccgguuggacugacguc

SEQ ID NO: 3350645 - RNA, 12 nt, Mycobacterium tuberculosis H37Rv
uccgguuucggg

SEQ ID NO: 3350646 - RNA, 15 nt, Mycobacterium tuberculosis H37Rv
uccgguuucgggugc

SEQ ID NO: 3350647 - RNA, 12 nt, Mycobacterium tuberculosis H37Rv
uccguaggccac

SEQ ID NO: 3350648 - RNA, 16 nt, Mycobacterium tuberculosis H37Rv
uccguaggccacagcc

SEQ ID NO: 3350649 - RNA, 17 nt, Mycobacterium tuberculosis H37Rv
uccguaggccacagccc

SEQ ID NO: 3350650 - RNA, 13 nt, Mycobacterium tuberculosis H37Rv
uccguccucgucc

SEQ ID NO: 3350651 - RNA, 17 nt, Mycobacterium tuberculosis H37Rv
uccgucgagucgccgag

SEQ ID NO: 3350652 - RNA, 17 nt, Mycobacterium tuberculosis H37Rv
uccgucgauggaccgca

SEQ ID NO: 3350653 - RNA, 23 nt, Mycobacterium tuberculosis H37Rv
uccgucgcucacggcccgagccg

SEQ ID NO: 3350654 - RNA, 15 nt, Mycobacterium tuberculosis H37Rv
uccgucggccaggcc

SEQ ID NO: 3350655 - RNA, 19 nt, Mycobacterium tuberculosis H37Rv
uccgucggccaggccacgg

SEQ ID NO: 3350656 - RNA, 19 nt, Mycobacterium tuberculosis H37Rv
uccgucggggacauccgcu

SEQ ID NO: 3350657 - RNA, 19 nt, Mycobacterium tuberculosis H37Rv
uccgucggguagugcccac

SEQ ID NO: 3350658 - RNA, 11 nt, Mycobacterium tuberculosis H37Rv
uccgucgucgg

SEQ ID NO: 3350659 - RNA, 15 nt, Mycobacterium tuberculosis H37Rv
uccgucgucggcguc

SEQ ID NO: 3350660 - RNA, 17 nt, Mycobacterium tuberculosis H37Rv
uccgucugacccaccgc

SEQ ID NO: 3350661 - RNA, 17 nt, Mycobacterium tuberculosis H37Rv
uccgugaauggcagcac

SEQ ID NO: 3350662 - RNA, 23 nt, Mycobacterium tuberculosis H37Rv
uccgugaauggcagcacgaccug

SEQ ID NO: 3350663 - RNA, 13 nt, Mycobacterium tuberculosis H37Rv
uccgugacaccgg

SEQ ID NO: 3350664 - RNA, 15 nt, Mycobacterium tuberculosis H37Rv
uccgugccgaccacc

SEQ ID NO: 3350665 - RNA, 19 nt, Mycobacterium tuberculosis H37Rv
uccgugccgaccaccagca

SEQ ID NO: 3350666 - RNA, 24 nt, Mycobacterium tuberculosis H37Rv
uccgugccgagcuucagcgcgcug

SEQ ID NO: 3350667 - RNA, 14 nt, Mycobacterium tuberculosis H37Rv
uccgugccgaugcc

SEQ ID NO: 3350668 - RNA, 19 nt, Mycobacterium tuberculosis H37Rv
uccguguuucgaacaccgu

SEQ ID NO: 3350669 - RNA, 14 nt, Mycobacterium tuberculosis H37Rv
uccuacggugcagu

SEQ ID NO: 3350670 - RNA, 19 nt, Mycobacterium tuberculosis H37Rv
uccucaaggucggccaggc

SEQ ID NO: 3350671 - RNA, 15 nt, Mycobacterium tuberculosis H37Rv
ucgaaucaggcucca

SEQ ID NO: 3350672 - RNA, 16 nt, Mycobacterium tuberculosis H37Rv
ucgaaugucacaccgg

SEQ ID NO: 3350673 - RNA, 15 nt, Mycobacterium tuberculosis H37Rv
ucgaauuaaagccac

SEQ ID NO: 3350674 - RNA, 22 nt, Mycobacterium tuberculosis H37Rv
ucgaauucgcgcucuggcuccg

SEQ ID NO: 3350675 - RNA, 21 nt, Mycobacterium tuberculosis H37Rv
ucgacaaacagcgccaucgau

SEQ ID NO: 3350676 - RNA, 15 nt, Mycobacterium tuberculosis H37Rv
ucgacaaagcggcug

SEQ ID NO: 3350677 - RNA, 16 nt, Mycobacterium tuberculosis H37Rv
ucgacaaagcggcugc

SEQ ID NO: 3350678 - RNA, 19 nt, Mycobacterium tuberculosis H37Rv
ucgacaacacgccgucgac

SEQ ID NO: 3350679 - RNA, 14 nt, Mycobacterium tuberculosis H37Rv
ucgacaaccucgag

SEQ ID NO: 3350680 - RNA, 17 nt, Mycobacterium tuberculosis H37Rv
ucgacaacugcccgaug

SEQ ID NO: 3350681 - RNA, 14 nt, Mycobacterium tuberculosis H37Rv
ucgacacccguuga

SEQ ID NO: 3350682 - RNA, 15 nt, Mycobacterium tuberculosis H37Rv
ucgacacccguugag

SEQ ID NO: 3350683 - RNA, 13 nt, Mycobacterium tuberculosis H37Rv
ucgacaccgagga

SEQ ID NO: 3350684 - RNA, 12 nt, Mycobacterium tuberculosis H37Rv
ucgacaccgccc

SEQ ID NO: 3350685 - RNA, 14 nt, Mycobacterium tuberculosis H37Rv
ucgacaccgcccga

SEQ ID NO: 3350686 - RNA, 18 nt, Mycobacterium tuberculosis H37Rv
ucgacaccgugaccgccg

SEQ ID NO: 3350687 - RNA, 14 nt, Mycobacterium tuberculosis H37Rv
ucgacacgccgaac

SEQ ID NO: 3350688 - RNA, 17 nt, Mycobacterium tuberculosis H37Rv
ucgacagauugcucggu

SEQ ID NO: 3350689 - RNA, 12 nt, Mycobacterium tuberculosis H37Rv
ucgacagcauca

SEQ ID NO: 3350690 - RNA, 21 nt, Mycobacterium tuberculosis H37Rv
ucgacagccccgcggccagca

SEQ ID NO: 3350691 - RNA, 17 nt, Mycobacterium tuberculosis H37Rv
ucgacaggugccagacc

SEQ ID NO: 3350692 - RNA, 15 nt, Mycobacterium tuberculosis H37Rv
ucgacagguuucccg

SEQ ID NO: 3350693 - RNA, 18 nt, Mycobacterium tuberculosis H37Rv
ucgacaucggugacgguc

SEQ ID NO: 3350694 - RNA, 19 nt, Mycobacterium tuberculosis H37Rv
ucgaccaagguguccagca

SEQ ID NO: 3350695 - RNA, 20 nt, Mycobacterium tuberculosis H37Rv
ucgaccaagguguccagcac

SEQ ID NO: 3350696 - RNA, 14 nt, Mycobacterium tuberculosis H37Rv
ucgaccacgacgug

SEQ ID NO: 3350697 - RNA, 23 nt, Mycobacterium tuberculosis H37Rv
ucgaccagcgccgauaccagcca

SEQ ID NO: 3350698 - RNA, 22 nt, Mycobacterium tuberculosis H37Rv
ucgaccaggccacugccgacca

SEQ ID NO: 3350699 - RNA, 20 nt, Mycobacterium tuberculosis H37Rv
ucgaccaucaccacggccgc

SEQ ID NO: 3350700 - RNA, 14 nt, Mycobacterium tuberculosis H37Rv
ucgaccaugcgacc

SEQ ID NO: 3350701 - RNA, 17 nt, Mycobacterium tuberculosis H37Rv
ucgacccaacgcagauc

SEQ ID NO: 3350702 - RNA, 21 nt, Mycobacterium tuberculosis H37Rv
ucgacccccgcaucggcgcca

SEQ ID NO: 3350703 - RNA, 16 nt, Mycobacterium tuberculosis H37Rv
ucgacccccugccaca

SEQ ID NO: 3350704 - RNA, 17 nt, Mycobacterium tuberculosis H37Rv
ucgacccccugccacag

SEQ ID NO: 3350705 - RNA, 20 nt, Mycobacterium tuberculosis H37Rv
ucgacccccugccacagcga

SEQ ID NO: 3350706 - RNA, 22 nt, Mycobacterium tuberculosis H37Rv
ucgacccccugccacagcgaca

SEQ ID NO: 3350707 - RNA, 21 nt, Mycobacterium tuberculosis H37Rv
ucgacccgaugacccacugca

SEQ ID NO: 3350708 - RNA, 21 nt, Mycobacterium tuberculosis H37Rv
ucgacccgcccauucccauau

SEQ ID NO: 3350709 - RNA, 15 nt, Mycobacterium tuberculosis H37Rv
ucgacccgcgcaacc

SEQ ID NO: 3350710 - RNA, 20 nt, Mycobacterium tuberculosis H37Rv
ucgacccggccaagggugcu

SEQ ID NO: 3350711 - RNA, 16 nt, Mycobacterium tuberculosis H37Rv
ucgacccggucgacgg

SEQ ID NO: 3350712 - RNA, 16 nt, Mycobacterium tuberculosis H37Rv
ucgaccgaacccgacg

SEQ ID NO: 3350713 - RNA, 19 nt, Mycobacterium tuberculosis H37Rv
ucgaccgauagcuggccga

SEQ ID NO: 3350714 - RNA, 22 nt, Mycobacterium tuberculosis H37Rv
ucgaccgccacguaauucccca

SEQ ID NO: 3350715 - RNA, 14 nt, Mycobacterium tuberculosis H37Rv
ucgaccgccgcgag

SEQ ID NO: 3350716 - RNA, 18 nt, Mycobacterium tuberculosis H37Rv
ucgaccgcggccuuggcg

SEQ ID NO: 3350717 - RNA, 21 nt, Mycobacterium tuberculosis H37Rv
ucgaccggaaugcccgggccc

SEQ ID NO: 3350718 - RNA, 22 nt, Mycobacterium tuberculosis H37Rv
ucgaccggacaaacaucgcacc

SEQ ID NO: 3350719 - RNA, 21 nt, Mycobacterium tuberculosis H37Rv
ucgaccggacaaagcugcucg

SEQ ID NO: 3350720 - RNA, 21 nt, Mycobacterium tuberculosis H37Rv
ucgaccggcgggaugcgcgcc

SEQ ID NO: 3350721 - RNA, 16 nt, Mycobacterium tuberculosis H37Rv
ucgaccgucaccggaa

SEQ ID NO: 3350722 - RNA, 16 nt, Mycobacterium tuberculosis H37Rv
ucgaccgugucaccgc

SEQ ID NO: 3350723 - RNA, 22 nt, Mycobacterium tuberculosis H37Rv
ucgaccucagacagcugcacac

SEQ ID NO: 3350724 - RNA, 16 nt, Mycobacterium tuberculosis H37Rv
ucgaccuccaccaaug

SEQ ID NO: 3350725 - RNA, 13 nt, Mycobacterium tuberculosis H37Rv
ucgaccucggcaa

SEQ ID NO: 3350726 - RNA, 18 nt, Mycobacterium tuberculosis H37Rv
ucgaccuggauugccacc

SEQ ID NO: 3350727 - RNA, 12 nt, Mycobacterium tuberculosis H37Rv
ucgacgaacucc

SEQ ID NO: 3350728 - RNA, 19 nt, Mycobacterium tuberculosis H37Rv
ucgacgaagaucgcgugcc

SEQ ID NO: 3350729 - RNA, 22 nt, Mycobacterium tuberculosis H37Rv
ucgacgaagaucuucaccggcc

SEQ ID NO: 3350730 - RNA, 23 nt, Mycobacterium tuberculosis H37Rv
ucgacgaagaucuucaccggccg

SEQ ID NO: 3350731 - RNA, 18 nt, Mycobacterium tuberculosis H37Rv
ucgacgaauaacgcgguc

SEQ ID NO: 3350732 - RNA, 17 nt, Mycobacterium tuberculosis H37Rv
ucgacgacaacgauguc

SEQ ID NO: 3350733 - RNA, 23 nt, Mycobacterium tuberculosis H37Rv
ucgacgacacguugacgaugugc

SEQ ID NO: 3350734 - RNA, 15 nt, Mycobacterium tuberculosis H37Rv
ucgacgaccaccuuc

SEQ ID NO: 3350735 - RNA, 18 nt, Mycobacterium tuberculosis H37Rv
ucgacgagaagacaccgc

SEQ ID NO: 3350736 - RNA, 23 nt, Mycobacterium tuberculosis H37Rv
ucgacgaggccacggggcuuggc

SEQ ID NO: 3350737 - RNA, 12 nt, Mycobacterium tuberculosis H37Rv
ucgacgaucagc

SEQ ID NO: 3350738 - RNA, 21 nt, Mycobacterium tuberculosis H37Rv
ucgacgaucgucuugucgccg

SEQ ID NO: 3350739 - RNA, 19 nt, Mycobacterium tuberculosis H37Rv
ucgacgaucucgccggcga

SEQ ID NO: 3350740 - RNA, 18 nt, Mycobacterium tuberculosis H37Rv
ucgacgaucugcagcacu

SEQ ID NO: 3350741 - RNA, 15 nt, Mycobacterium tuberculosis H37Rv
ucgacgaugcgguca

SEQ ID NO: 3350742 - RNA, 16 nt, Mycobacterium tuberculosis H37Rv
ucgacgcacacccggu

SEQ ID NO: 3350743 - RNA, 23 nt, Mycobacterium tuberculosis H37Rv
ucgacgcaccuauggucaaccgc

SEQ ID NO: 3350744 - RNA, 20 nt, Mycobacterium tuberculosis H37Rv
ucgacgcagugcccgaucgc

SEQ ID NO: 3350745 - RNA, 15 nt, Mycobacterium tuberculosis H37Rv
ucgacgcauuccucg

SEQ ID NO: 3350746 - RNA, 20 nt, Mycobacterium tuberculosis H37Rv
ucgacgccccaggacaccuu

SEQ ID NO: 3350747 - RNA, 18 nt, Mycobacterium tuberculosis H37Rv
ucgacgccgccacccggc

SEQ ID NO: 3350748 - RNA, 19 nt, Mycobacterium tuberculosis H37Rv
ucgacgcgaugacacaccg

SEQ ID NO: 3350749 - RNA, 17 nt, Mycobacterium tuberculosis H37Rv
ucgacgcgcauucgccg

SEQ ID NO: 3350750 - RNA, 23 nt, Mycobacterium tuberculosis H37Rv
ucgacgcggccaacgaacgugcc

SEQ ID NO: 3350751 - RNA, 16 nt, Mycobacterium tuberculosis H37Rv
ucgacgcggcgaccgu

SEQ ID NO: 3350752 - RNA, 17 nt, Mycobacterium tuberculosis H37Rv
ucgacgcggcgaccguc

SEQ ID NO: 3350753 - RNA, 17 nt, Mycobacterium tuberculosis H37Rv
ucgacgcgggagucauc

SEQ ID NO: 3350754 - RNA, 22 nt, Mycobacterium tuberculosis H37Rv
ucgacgcgucucuggcucaccu

SEQ ID NO: 3350755 - RNA, 20 nt, Mycobacterium tuberculosis H37Rv
ucgacgcuguggcucgacga

SEQ ID NO: 3350756 - RNA, 19 nt, Mycobacterium tuberculosis H37Rv
ucgacggcaagcgcaucgc

SEQ ID NO: 3350757 - RNA, 17 nt, Mycobacterium tuberculosis H37Rv
ucgacggccagugcgca

SEQ ID NO: 3350758 - RNA, 21 nt, Mycobacterium tuberculosis H37Rv
ucgacggccucgucgauguuc

SEQ ID NO: 3350759 - RNA, 23 nt, Mycobacterium tuberculosis H37Rv
ucgacggcggccgccacuccgug

SEQ ID NO: 3350760 - RNA, 22 nt, Mycobacterium tuberculosis H37Rv
ucgacggcggccuucggccggc

SEQ ID NO: 3350761 - RNA, 17 nt, Mycobacterium tuberculosis H37Rv
ucgacgggagcgacguc

SEQ ID NO: 3350762 - RNA, 16 nt, Mycobacterium tuberculosis H37Rv
ucgacggugaucaggu

SEQ ID NO: 3350763 - RNA, 15 nt, Mycobacterium tuberculosis H37Rv
ucgacggugccgucg

SEQ ID NO: 3350764 - RNA, 17 nt, Mycobacterium tuberculosis H37Rv
ucgacggugccgucugc

SEQ ID NO: 3350765 - RNA, 17 nt, Mycobacterium tuberculosis H37Rv
ucgacguaaugcgcugc

SEQ ID NO: 3350766 - RNA, 18 nt, Mycobacterium tuberculosis H37Rv
ucgacguaggacugccag

SEQ ID NO: 3350767 - RNA, 11 nt, Mycobacterium tuberculosis H37Rv
ucgauaucagu

SEQ ID NO: 3350768 - RNA, 18 nt, Mycobacterium tuberculosis H37Rv
ucgaucaacaccaaucgg

SEQ ID NO: 3350769 - RNA, 19 nt, Mycobacterium tuberculosis H37Rv
ucgaucaacaggucuaccc

SEQ ID NO: 3350770 - RNA, 16 nt, Mycobacterium tuberculosis H37Rv
ucgaucaccugcagca

SEQ ID NO: 3350771 - RNA, 19 nt, Mycobacterium tuberculosis H37Rv
ucgaucagaaucugccucu

SEQ ID NO: 3350772 - RNA, 19 nt, Mycobacterium tuberculosis H37Rv
ucgaucagcaacucggcca

SEQ ID NO: 3350773 - RNA, 13 nt, Mycobacterium tuberculosis H37Rv
ucgaucagcuccu

SEQ ID NO: 3350774 - RNA, 15 nt, Mycobacterium tuberculosis H37Rv
ucgaucaggucguca

SEQ ID NO: 3350775 - RNA, 15 nt, Mycobacterium tuberculosis H37Rv
ucgauccacugccgc

SEQ ID NO: 3350776 - RNA, 21 nt, Mycobacterium tuberculosis H37Rv
ucgauccggcuccacccccac

SEQ ID NO: 3350777 - RNA, 19 nt, Mycobacterium tuberculosis H37Rv
ucgaucgcggcgcccagga

SEQ ID NO: 3350778 - RNA, 18 nt, Mycobacterium tuberculosis H37Rv
ucgaucggcagccagggc

SEQ ID NO: 3350779 - RNA, 14 nt, Mycobacterium tuberculosis H37Rv
ucgaucgucgacgc

SEQ ID NO: 3350780 - RNA, 16 nt, Mycobacterium tuberculosis H37Rv
ucgaucguuccgcugg

SEQ ID NO: 3350781 - RNA, 14 nt, Mycobacterium tuberculosis H37Rv
ucgaucucgaucga

SEQ ID NO: 3350782 - RNA, 23 nt, Mycobacterium tuberculosis H37Rv
ucgaucugcccccgccggccguc

SEQ ID NO: 3350783 - RNA, 14 nt, Mycobacterium tuberculosis H37Rv
ucgaucugcccggu

SEQ ID NO: 3350784 - RNA, 21 nt, Mycobacterium tuberculosis H37Rv
ucgaugacccauacgaacuca

SEQ ID NO: 3350785 - RNA, 19 nt, Mycobacterium tuberculosis H37Rv
ucgaugaccccgguggucu

SEQ ID NO: 3350786 - RNA, 23 nt, Mycobacterium tuberculosis H37Rv
ucgaugaggcgcagcgccagcgg

SEQ ID NO: 3350787 - RNA, 22 nt, Mycobacterium tuberculosis H37Rv
ucgaugccacaucccacggugg

SEQ ID NO: 3350788 - RNA, 18 nt, Mycobacterium tuberculosis H37Rv
ucgaugccgcguagcugg

SEQ ID NO: 3350789 - RNA, 16 nt, Mycobacterium tuberculosis H37Rv
ucgaugccggcuggcg

SEQ ID NO: 3350790 - RNA, 17 nt, Mycobacterium tuberculosis H37Rv
ucgaugccggcuggcgg

SEQ ID NO: 3350791 - RNA, 20 nt, Mycobacterium tuberculosis H37Rv
ucgaugccguguucagcacc

SEQ ID NO: 3350792 - RNA, 16 nt, Mycobacterium tuberculosis H37Rv
ucgaugcgaucgacga

SEQ ID NO: 3350793 - RNA, 13 nt, Mycobacterium tuberculosis H37Rv
ucgaugcgcugcu

SEQ ID NO: 3350794 - RNA, 16 nt, Mycobacterium tuberculosis H37Rv
ucgauggcaugggcua

SEQ ID NO: 3350795 - RNA, 18 nt, Mycobacterium tuberculosis H37Rv
ucgaugggugcaccgaag

SEQ ID NO: 3350796 - RNA, 20 nt, Mycobacterium tuberculosis H37Rv
ucgauggucauccagccagc

SEQ ID NO: 3350797 - RNA, 23 nt, Mycobacterium tuberculosis H37Rv
ucgauggucucccggcugaugcc

SEQ ID NO: 3350798 - RNA, 22 nt, Mycobacterium tuberculosis H37Rv
ucgauggugcggcccaaccggu

SEQ ID NO: 3350799 - RNA, 21 nt, Mycobacterium tuberculosis H37Rv
ucgauguccaaugcaccguug

SEQ ID NO: 3350800 - RNA, 17 nt, Mycobacterium tuberculosis H37Rv
ucgauguccgcagcacc

SEQ ID NO: 3350801 - RNA, 20 nt, Mycobacterium tuberculosis H37Rv
ucgauguccucgauccgggc

SEQ ID NO: 3350802 - RNA, 18 nt, Mycobacterium tuberculosis H37Rv
ucgauguggcgcuccggc

SEQ ID NO: 3350803 - RNA, 17 nt, Mycobacterium tuberculosis H37Rv
ucgauucccggcgcggu

SEQ ID NO: 3350804 - RNA, 17 nt, Mycobacterium tuberculosis H37Rv
ucgauugccaccgagau

SEQ ID NO: 3350805 - RNA, 15 nt, Mycobacterium tuberculosis H37Rv
ucgauuggcugcgcc

SEQ ID NO: 3350806 - RNA, 14 nt, Mycobacterium tuberculosis H37Rv
ucgauugucgccgc

SEQ ID NO: 3350807 - RNA, 22 nt, Mycobacterium tuberculosis H37Rv
ucgcaacccggccuggagcagc

SEQ ID NO: 3350808 - RNA, 20 nt, Mycobacterium tuberculosis H37Rv
ucgcaacguguccgcagucc

SEQ ID NO: 3350809 - RNA, 23 nt, Mycobacterium tuberculosis H37Rv
ucgcaagcgcggcgaagccgggu

SEQ ID NO: 3350810 - RNA, 12 nt, Mycobacterium tuberculosis H37Rv
ucgcaaugaccu

SEQ ID NO: 3350811 - RNA, 17 nt, Mycobacterium tuberculosis H37Rv
ucgcaaugggcucacac

SEQ ID NO: 3350812 - RNA, 20 nt, Mycobacterium tuberculosis H37Rv
ucgcaauggucguagggugg

SEQ ID NO: 3350813 - RNA, 11 nt, Mycobacterium tuberculosis H37Rv
ucgcaccagcg

SEQ ID NO: 3350814 - RNA, 14 nt, Mycobacterium tuberculosis H37Rv
ucgcacccugcgaa

SEQ ID NO: 3350815 - RNA, 16 nt, Mycobacterium tuberculosis H37Rv
ucgcaccgugggcccu

SEQ ID NO: 3350816 - RNA, 19 nt, Mycobacterium tuberculosis H37Rv
ucgcaccgugucuacgccg

SEQ ID NO: 3350817 - RNA, 17 nt, Mycobacterium tuberculosis H37Rv
ucgcacgacgcgacacg

SEQ ID NO: 3350818 - RNA, 21 nt, Mycobacterium tuberculosis H37Rv
ucgcacgacgcgacacgccgg

SEQ ID NO: 3350819 - RNA, 14 nt, Mycobacterium tuberculosis H37Rv
ucgcacgagccaac

SEQ ID NO: 3350820 - RNA, 18 nt, Mycobacterium tuberculosis H37Rv
ucgcacggaaggcccggc

SEQ ID NO: 3350821 - RNA, 15 nt, Mycobacterium tuberculosis H37Rv
ucgcacggaugaugc

SEQ ID NO: 3350822 - RNA, 19 nt, Mycobacterium tuberculosis H37Rv
ucgcacucauagaacucgc

SEQ ID NO: 3350823 - RNA, 19 nt, Mycobacterium tuberculosis H37Rv
ucgcacucguugccgacca

SEQ ID NO: 3350824 - RNA, 15 nt, Mycobacterium tuberculosis H37Rv
ucgcagacggcugcc

SEQ ID NO: 3350825 - RNA, 17 nt, Mycobacterium tuberculosis H37Rv
ucgcagacggcugccac

SEQ ID NO: 3350826 - RNA, 21 nt, Mycobacterium tuberculosis H37Rv
ucgcagacggcugccacgcgu

SEQ ID NO: 3350827 - RNA, 14 nt, Mycobacterium tuberculosis H37Rv
ucgcagagguauuc

SEQ ID NO: 3350828 - RNA, 14 nt, Mycobacterium tuberculosis H37Rv
ucgcagccacgcgg

SEQ ID NO: 3350829 - RNA, 21 nt, Mycobacterium tuberculosis H37Rv
ucgcagccacgcgggcgcggu

SEQ ID NO: 3350830 - RNA, 15 nt, Mycobacterium tuberculosis H37Rv
ucgcagccgcaccgg

SEQ ID NO: 3350831 - RNA, 18 nt, Mycobacterium tuberculosis H37Rv
ucgcagccgguccagcgc

SEQ ID NO: 3350832 - RNA, 12 nt, Mycobacterium tuberculosis H37Rv
ucgcagcgcaca

SEQ ID NO: 3350833 - RNA, 20 nt, Mycobacterium tuberculosis H37Rv
ucgcaggauucccaguccag

SEQ ID NO: 3350834 - RNA, 20 nt, Mycobacterium tuberculosis H37Rv
ucgcaggcaccccgaucacc

SEQ ID NO: 3350835 - RNA, 21 nt, Mycobacterium tuberculosis H37Rv
ucgcagggaucaccccggccg

SEQ ID NO: 3350836 - RNA, 18 nt, Mycobacterium tuberculosis H37Rv
ucgcaguacuugguugcg

SEQ ID NO: 3350837 - RNA, 18 nt, Mycobacterium tuberculosis H37Rv
ucgcaguccgguuacgcu

SEQ ID NO: 3350838 - RNA, 21 nt, Mycobacterium tuberculosis H37Rv
ucgcaguccgguuacgcucgc

SEQ ID NO: 3350839 - RNA, 19 nt, Mycobacterium tuberculosis H37Rv
ucgcagugacguuccgcuc

SEQ ID NO: 3350840 - RNA, 20 nt, Mycobacterium tuberculosis H37Rv
ucgcagugacguuccgcucg

SEQ ID NO: 3350841 - RNA, 22 nt, Mycobacterium tuberculosis H37Rv
ucgcagugagcagccggaccgu

SEQ ID NO: 3350842 - RNA, 21 nt, Mycobacterium tuberculosis H37Rv
ucgcaguggagggcccggccg

SEQ ID NO: 3350843 - RNA, 22 nt, Mycobacterium tuberculosis H37Rv
ucgcaugauuugagcucaaauc

SEQ ID NO: 3350844 - RNA, 15 nt, Mycobacterium tuberculosis H37Rv
ucgcauucugcugcc

SEQ ID NO: 3350845 - RNA, 23 nt, Mycobacterium tuberculosis H37Rv
ucgccaaaaguacuggcguugcc

SEQ ID NO: 3350846 - RNA, 17 nt, Mycobacterium tuberculosis H37Rv
ucgccaaauaccgugag

SEQ ID NO: 3350847 - RNA, 15 nt, Mycobacterium tuberculosis H37Rv
ucgccaaauccggug

SEQ ID NO: 3350848 - RNA, 20 nt, Mycobacterium tuberculosis H37Rv
ucgccaacgacucacccacc

SEQ ID NO: 3350849 - RNA, 19 nt, Mycobacterium tuberculosis H37Rv
ucgccaagcccaggcgauc

SEQ ID NO: 3350850 - RNA, 20 nt, Mycobacterium tuberculosis H37Rv
ucgccaaggccgucgaccca

SEQ ID NO: 3350851 - RNA, 19 nt, Mycobacterium tuberculosis H37Rv
ucgccaagugcagggcugc

SEQ ID NO: 3350852 - RNA, 18 nt, Mycobacterium tuberculosis H37Rv
ucgccaaugcccaggugu

SEQ ID NO: 3350853 - RNA, 19 nt, Mycobacterium tuberculosis H37Rv
ucgccacaacgcgcgguac

SEQ ID NO: 3350854 - RNA, 20 nt, Mycobacterium tuberculosis H37Rv
ucgccaccagagucaacauc

SEQ ID NO: 3350855 - RNA, 17 nt, Mycobacterium tuberculosis H37Rv
ucgccaccaucaccgcc

SEQ ID NO: 3350856 - RNA, 19 nt, Mycobacterium tuberculosis H37Rv
ucgccaccaucaccgccuu

SEQ ID NO: 3350857 - RNA, 24 nt, Mycobacterium tuberculosis H37Rv
ucgccaccaucguugccggugccg

SEQ ID NO: 3350858 - RNA, 21 nt, Mycobacterium tuberculosis H37Rv
ucgccacccgacaugcgccga

SEQ ID NO: 3350859 - RNA, 21 nt, Mycobacterium tuberculosis H37Rv
ucgccaccgccggcagcaucg

SEQ ID NO: 3350860 - RNA, 18 nt, Mycobacterium tuberculosis H37Rv
ucgccaccggcgccaccg

SEQ ID NO: 3350861 - RNA, 17 nt, Mycobacterium tuberculosis H37Rv
ucgccacgacaggucgc

SEQ ID NO: 3350862 - RNA, 19 nt, Mycobacterium tuberculosis H37Rv
ucgccgcgcuugcgaucgc

SEQ ID NO: 3350863 - RNA, 14 nt, Mycobacterium tuberculosis H37Rv
ucgccgcggcggaa

SEQ ID NO: 3350864 - RNA, 16 nt, Mycobacterium tuberculosis H37Rv
ucgccgcggcggcagc

SEQ ID NO: 3350865 - RNA, 20 nt, Mycobacterium tuberculosis H37Rv
ucgccgcggcggcagcggcg

SEQ ID NO: 3350866 - RNA, 21 nt, Mycobacterium tuberculosis H37Rv
ucgccgcggcggcagcggcga

SEQ ID NO: 3350867 - RNA, 23 nt, Mycobacterium tuberculosis H37Rv
ucgccgcguccucgcccuggccg

SEQ ID NO: 3350868 - RNA, 21 nt, Mycobacterium tuberculosis H37Rv
ucgccgcuaacgcaccugcgc

SEQ ID NO: 3350869 - RNA, 14 nt, Mycobacterium tuberculosis H37Rv
ucgccgcuggccag

SEQ ID NO: 3350870 - RNA, 20 nt, Mycobacterium tuberculosis H37Rv
ucgccgcuggccagcacacc

SEQ ID NO: 3350871 - RNA, 16 nt, Mycobacterium tuberculosis H37Rv
ucgccggaaagcccgu

SEQ ID NO: 3350872 - RNA, 16 nt, Mycobacterium tuberculosis H37Rv
ucgccggaccagagcc

SEQ ID NO: 3350873 - RNA, 19 nt, Mycobacterium tuberculosis H37Rv
ucgccggacugcggcccga

SEQ ID NO: 3350874 - RNA, 16 nt, Mycobacterium tuberculosis H37Rv
ucgccggauagcgcag

SEQ ID NO: 3350875 - RNA, 18 nt, Mycobacterium tuberculosis H37Rv
ucgccggaucuugccgcu

SEQ ID NO: 3350876 - RNA, 22 nt, Mycobacterium tuberculosis H37Rv
ucgccggaugcugucagcagcc

SEQ ID NO: 3350877 - RNA, 23 nt, Mycobacterium tuberculosis H37Rv
ucgccggcacacccaucagcccu

SEQ ID NO: 3350878 - RNA, 15 nt, Mycobacterium tuberculosis H37Rv
ucgccggcacgguga

SEQ ID NO: 3350879 - RNA, 19 nt, Mycobacterium tuberculosis H37Rv
ucgccggccaacugggccg

SEQ ID NO: 3350880 - RNA, 15 nt, Mycobacterium tuberculosis H37Rv
ucgccggccggcccg

SEQ ID NO: 3350881 - RNA, 19 nt, Mycobacterium tuberculosis H37Rv
ucgccggcgaagaccgccg

SEQ ID NO: 3350882 - RNA, 17 nt, Mycobacterium tuberculosis H37Rv
ucgccggcgaaguuggu

SEQ ID NO: 3350883 - RNA, 14 nt, Mycobacterium tuberculosis H37Rv
ucgccggcgccaag

SEQ ID NO: 3350884 - RNA, 15 nt, Mycobacterium tuberculosis H37Rv
ucgccggcggccacc

SEQ ID NO: 3350885 - RNA, 21 nt, Mycobacterium tuberculosis H37Rv
ucgccggcuucgcccagagcc

SEQ ID NO: 3350886 - RNA, 18 nt, Mycobacterium tuberculosis H37Rv
ucgccgggcaacgcgaac

SEQ ID NO: 3350887 - RNA, 22 nt, Mycobacterium tuberculosis H37Rv
ucgccggggacgccgcggcgcc

SEQ ID NO: 3350888 - RNA, 16 nt, Mycobacterium tuberculosis H37Rv
ucgccgggucagcccg

SEQ ID NO: 3350889 - RNA, 16 nt, Mycobacterium tuberculosis H37Rv
ucgccgggugcaggcg

SEQ ID NO: 3350890 - RNA, 11 nt, Mycobacterium tuberculosis H37Rv
ucgccggugac

SEQ ID NO: 3350891 - RNA, 20 nt, Mycobacterium tuberculosis H37Rv
ucgccggugacgacgucgcc

SEQ ID NO: 3350892 - RNA, 20 nt, Mycobacterium tuberculosis H37Rv
ucgccggugacgggguugac

SEQ ID NO: 3350893 - RNA, 19 nt, Mycobacterium tuberculosis H37Rv
ucgccggugcgcgcugacc

SEQ ID NO: 3350894 - RNA, 19 nt, Mycobacterium tuberculosis H37Rv
ucgccguacaucagcgcga

SEQ ID NO: 3350895 - RNA, 21 nt, Mycobacterium tuberculosis H37Rv
ucgccguacaucagcgcgaac

SEQ ID NO: 3350896 - RNA, 19 nt, Mycobacterium tuberculosis H37Rv
ucgccgucaacgccucugc

SEQ ID NO: 3350897 - RNA, 16 nt, Mycobacterium tuberculosis H37Rv
ucgccgucacgcacgc

SEQ ID NO: 3350898 - RNA, 20 nt, Mycobacterium tuberculosis H37Rv
ucgccgucacgcacgccgcg

SEQ ID NO: 3350899 - RNA, 21 nt, Mycobacterium tuberculosis H37Rv
ucgccgucgauguugccgaga

SEQ ID NO: 3350900 - RNA, 15 nt, Mycobacterium tuberculosis H37Rv
ucgccgucgcggcac

SEQ ID NO: 3350901 - RNA, 20 nt, Mycobacterium tuberculosis H37Rv
ucgccgucguacucgaccgc

SEQ ID NO: 3350902 - RNA, 17 nt, Mycobacterium tuberculosis H37Rv
ucgccgucgucgaucga

SEQ ID NO: 3350903 - RNA, 18 nt, Mycobacterium tuberculosis H37Rv
ucgccgugaugcuggucg

SEQ ID NO: 3350904 - RNA, 15 nt, Mycobacterium tuberculosis H37Rv
ucgccgugcgccgug

SEQ ID NO: 3350905 - RNA, 19 nt, Mycobacterium tuberculosis H37Rv
ucgccgugcgccgugcgau

SEQ ID NO: 3350906 - RNA, 13 nt, Mycobacterium tuberculosis H37Rv
ucgccguggugga

SEQ ID NO: 3350907 - RNA, 17 nt, Mycobacterium tuberculosis H37Rv
ucgccguuggagacguc

SEQ ID NO: 3350908 - RNA, 15 nt, Mycobacterium tuberculosis H37Rv
ucgccguugucgucg

SEQ ID NO: 3350909 - RNA, 20 nt, Mycobacterium tuberculosis H37Rv
ucgccuaaacccgugcgggu

SEQ ID NO: 3350910 - RNA, 14 nt, Mycobacterium tuberculosis H37Rv
ucgccucaccggcg

SEQ ID NO: 3350911 - RNA, 24 nt, Mycobacterium tuberculosis H37Rv
ucgccuccagcagguccgcggccg

SEQ ID NO: 3350912 - RNA, 18 nt, Mycobacterium tuberculosis H37Rv
ucgccuccagccggcgaa

SEQ ID NO: 3350913 - RNA, 15 nt, Mycobacterium tuberculosis H37Rv
ucgccuccaggcgcc

SEQ ID NO: 3350914 - RNA, 19 nt, Mycobacterium tuberculosis H37Rv
ucgccuccaggcgccaccc

SEQ ID NO: 3350915 - RNA, 19 nt, Mycobacterium tuberculosis H37Rv
ucgccucgacgcggcaggc

SEQ ID NO: 3350916 - RNA, 21 nt, Mycobacterium tuberculosis H37Rv
ucgccucggacacggcagccu

SEQ ID NO: 3350917 - RNA, 16 nt, Mycobacterium tuberculosis H37Rv
ucgccucggcgcugcg

SEQ ID NO: 3350918 - RNA, 20 nt, Mycobacterium tuberculosis H37Rv
ucgccucggcguaggcgaug

SEQ ID NO: 3350919 - RNA, 13 nt, Mycobacterium tuberculosis H37Rv
ucgccugcaagcu

SEQ ID NO: 3350920 - RNA, 18 nt, Mycobacterium tuberculosis H37Rv
ucgccugcaagcuaagcg

SEQ ID NO: 3350921 - RNA, 17 nt, Mycobacterium tuberculosis H37Rv
ucgccugcacgcccggc

SEQ ID NO: 3350922 - RNA, 15 nt, Mycobacterium tuberculosis H37Rv
ucgccugcgggaacg

SEQ ID NO: 3350923 - RNA, 22 nt, Mycobacterium tuberculosis H37Rv
ucgccuggaagaucacgcgucg

SEQ ID NO: 3350924 - RNA, 15 nt, Mycobacterium tuberculosis H37Rv
ucgccuggaugccga

SEQ ID NO: 3350925 - RNA, 16 nt, Mycobacterium tuberculosis H37Rv
ucgccugggcuuggcg

SEQ ID NO: 3350926 - RNA, 18 nt, Mycobacterium tuberculosis H37Rv
ucgcgaaauagcugcgga

SEQ ID NO: 3350927 - RNA, 20 nt, Mycobacterium tuberculosis H37Rv
ucgcgaagaacgacgccacc

SEQ ID NO: 3350928 - RNA, 15 nt, Mycobacterium tuberculosis H37Rv
ucgcgaagcugugcc

SEQ ID NO: 3350929 - RNA, 18 nt, Mycobacterium tuberculosis H37Rv
ucgcgaagucguccagaa

SEQ ID NO: 3350930 - RNA, 15 nt, Mycobacterium tuberculosis H37Rv
ucgcgacacggccau

SEQ ID NO: 3350931 - RNA, 23 nt, Mycobacterium tuberculosis H37Rv
ucgcgacaucaccgaacggcgag

SEQ ID NO: 3350932 - RNA, 13 nt, Mycobacterium tuberculosis H37Rv
ucgcgacgacgua

SEQ ID NO: 3350933 - RNA, 14 nt, Mycobacterium tuberculosis H37Rv
ucgcgacgaucguc

SEQ ID NO: 3350934 - RNA, 21 nt, Mycobacterium tuberculosis H37Rv
ucgcgacgaugccccgguuga

SEQ ID NO: 3350935 - RNA, 15 nt, Mycobacterium tuberculosis H37Rv
ucgcgacgcgacggu

SEQ ID NO: 3350936 - RNA, 18 nt, Mycobacterium tuberculosis H37Rv
ucgcgacggcccgauccc

SEQ ID NO: 3350937 - RNA, 19 nt, Mycobacterium tuberculosis H37Rv
ucgcgacgucugccaggcg

SEQ ID NO: 3350938 - RNA, 14 nt, Mycobacterium tuberculosis H37Rv
ucgcgagccagcug

SEQ ID NO: 3350939 - RNA, 21 nt, Mycobacterium tuberculosis H37Rv
ucgcgagcccgccacagcccc

SEQ ID NO: 3350940 - RNA, 23 nt, Mycobacterium tuberculosis H37Rv
ucgcgagcccgccacagccccag

SEQ ID NO: 3350941 - RNA, 21 nt, Mycobacterium tuberculosis H37Rv
ucgcgagcucccuaacaucgu

SEQ ID NO: 3350942 - RNA, 21 nt, Mycobacterium tuberculosis H37Rv
ucgcgaucagaaacuccggac

SEQ ID NO: 3350943 - RNA, 18 nt, Mycobacterium tuberculosis H37Rv
ucgcgauccacuccggcg

SEQ ID NO: 3350944 - RNA, 19 nt, Mycobacterium tuberculosis H37Rv
ucgcgauccacuccggcga

SEQ ID NO: 3350945 - RNA, 16 nt, Mycobacterium tuberculosis H37Rv
ucgcgaugacgauguc

SEQ ID NO: 3350946 - RNA, 15 nt, Mycobacterium tuberculosis H37Rv
ucgcgcaaccgggcg

SEQ ID NO: 3350947 - RNA, 22 nt, Mycobacterium tuberculosis H37Rv
ucgcgcaaggcgccgcagggcc

SEQ ID NO: 3350948 - RNA, 20 nt, Mycobacterium tuberculosis H37Rv
ucgcgcacauaggcgaucgc

SEQ ID NO: 3350949 - RNA, 15 nt, Mycobacterium tuberculosis H37Rv
ucgcgcagcuccacc

SEQ ID NO: 3350950 - RNA, 17 nt, Mycobacterium tuberculosis H37Rv
ucgcgcaggaagcccac

SEQ ID NO: 3350951 - RNA, 22 nt, Mycobacterium tuberculosis H37Rv
ucgcgcaggaagcccacgaucg

SEQ ID NO: 3350952 - RNA, 22 nt, Mycobacterium tuberculosis H37Rv
ucgcgcaggucuucaagcucuu

SEQ ID NO: 3350953 - RNA, 20 nt, Mycobacterium tuberculosis H37Rv
ucgcgcaguacuugaccguc

SEQ ID NO: 3350954 - RNA, 14 nt, Mycobacterium tuberculosis H37Rv
ucgcgcaucaacgg

SEQ ID NO: 3350955 - RNA, 20 nt, Mycobacterium tuberculosis H37Rv
ucgcgcaucgccuccucgac

SEQ ID NO: 3350956 - RNA, 23 nt, Mycobacterium tuberculosis H37Rv
ucgcgcauugccgacgcgcggcc

SEQ ID NO: 3350957 - RNA, 13 nt, Mycobacterium tuberculosis H37Rv
ucgcucccccgcu

SEQ ID NO: 3350958 - RNA, 18 nt, Mycobacterium tuberculosis H37Rv
ucgcucccccgcuacgcg

SEQ ID NO: 3350959 - RNA, 15 nt, Mycobacterium tuberculosis H37Rv
ucgcucgccgagcug

SEQ ID NO: 3350960 - RNA, 16 nt, Mycobacterium tuberculosis H37Rv
ucgcucgcgccagguc

SEQ ID NO: 3350961 - RNA, 14 nt, Mycobacterium tuberculosis H37Rv
ucgcucgcugaugc

SEQ ID NO: 3350962 - RNA, 17 nt, Mycobacterium tuberculosis H37Rv
ucgcucgugcacgcuga

SEQ ID NO: 3350963 - RNA, 12 nt, Mycobacterium tuberculosis H37Rv
ucgcugaccgcg

SEQ ID NO: 3350964 - RNA, 20 nt, Mycobacterium tuberculosis H37Rv
ucgcugaccuuguugaccac

SEQ ID NO: 3350965 - RNA, 14 nt, Mycobacterium tuberculosis H37Rv
ucgcugacggccau

SEQ ID NO: 3350966 - RNA, 13 nt, Mycobacterium tuberculosis H37Rv
ucgcugagcagcg

SEQ ID NO: 3350967 - RNA, 15 nt, Mycobacterium tuberculosis H37Rv
ucgcugcaaccgccg

SEQ ID NO: 3350968 - RNA, 16 nt, Mycobacterium tuberculosis H37Rv
ucgcugcaccagcugc

SEQ ID NO: 3350969 - RNA, 23 nt, Mycobacterium tuberculosis H37Rv
ucgcugcccaugcggcaggugcc

SEQ ID NO: 3350970 - RNA, 22 nt, Mycobacterium tuberculosis H37Rv
ucgcugccuucaucggggcuuc

SEQ ID NO: 3350971 - RNA, 21 nt, Mycobacterium tuberculosis H37Rv
ucgcugcgaagccgagcauca

SEQ ID NO: 3350972 - RNA, 17 nt, Mycobacterium tuberculosis H37Rv
ucgcugcgaugcugauc

SEQ ID NO: 3350973 - RNA, 19 nt, Mycobacterium tuberculosis H37Rv
ucgcugcggcgcuggccag

SEQ ID NO: 3350974 - RNA, 19 nt, Mycobacterium tuberculosis H37Rv
ucgcugcggugggccaggu

SEQ ID NO: 3350975 - RNA, 20 nt, Mycobacterium tuberculosis H37Rv
ucgcugcugccgcaccggug

SEQ ID NO: 3350976 - RNA, 16 nt, Mycobacterium tuberculosis H37Rv
ucgcugcugcgaucgc

SEQ ID NO: 3350977 - RNA, 17 nt, Mycobacterium tuberculosis H37Rv
ucgcugcugcgaucgcc

SEQ ID NO: 3350978 - RNA, 22 nt, Mycobacterium tuberculosis H37Rv
ucgcuggcgaugccgagaagac

SEQ ID NO: 3350979 - RNA, 19 nt, Mycobacterium tuberculosis H37Rv
ucgcugggacgggcgcguc

SEQ ID NO: 3350980 - RNA, 18 nt, Mycobacterium tuberculosis H37Rv
ucgcuguaggccagcccg

SEQ ID NO: 3350981 - RNA, 20 nt, Mycobacterium tuberculosis H37Rv
ucgcuguaggccagcccggc

SEQ ID NO: 3350982 - RNA, 15 nt, Mycobacterium tuberculosis H37Rv
ucgcugucggcaugc

SEQ ID NO: 3350983 - RNA, 19 nt, Mycobacterium tuberculosis H37Rv
ucggaaaaccgcaccgucc

SEQ ID NO: 3350984 - RNA, 23 nt, Mycobacterium tuberculosis H37Rv
ucggaaaaccgcaccgucccagu

SEQ ID NO: 3350985 - RNA, 21 nt, Mycobacterium tuberculosis H37Rv
ucggaagaaacgucugccacg

SEQ ID NO: 3350986 - RNA, 15 nt, Mycobacterium tuberculosis H37Rv
ucggaauacaacagc

SEQ ID NO: 3350987 - RNA, 18 nt, Mycobacterium tuberculosis H37Rv
ucggaauacaacagcugg

SEQ ID NO: 3350988 - RNA, 15 nt, Mycobacterium tuberculosis H37Rv
ucggacaacacggcg

SEQ ID NO: 3350989 - RNA, 20 nt, Mycobacterium tuberculosis H37Rv
ucggacaaggacugaccguc

SEQ ID NO: 3350990 - RNA, 14 nt, Mycobacterium tuberculosis H37Rv
ucggacagcgccug

SEQ ID NO: 3350991 - RNA, 14 nt, Mycobacterium tuberculosis H37Rv
ucggacagcgucuc

SEQ ID NO: 3350992 - RNA, 12 nt, Mycobacterium tuberculosis H37Rv
ucggaccacauc

SEQ ID NO: 3350993 - RNA, 18 nt, Mycobacterium tuberculosis H37Rv
ucggaccagcugccggcg

SEQ ID NO: 3350994 - RNA, 20 nt, Mycobacterium tuberculosis H37Rv
ucggacccgcaauuccggug

SEQ ID NO: 3350995 - RNA, 22 nt, Mycobacterium tuberculosis H37Rv
ucggacucgccgacgucgacgc

SEQ ID NO: 3350996 - RNA, 11 nt, Mycobacterium tuberculosis H37Rv
ucggacugggg

SEQ ID NO: 3350997 - RNA, 23 nt, Mycobacterium tuberculosis H37Rv
ucggagaacauguaggucgccgc

SEQ ID NO: 3350998 - RNA, 14 nt, Mycobacterium tuberculosis H37Rv
ucggagagcaugcg

SEQ ID NO: 3350999 - RNA, 20 nt, Mycobacterium tuberculosis H37Rv
ucggagauacucgaguggcg

SEQ ID NO: 3351000 - RNA, 20 nt, Mycobacterium tuberculosis H37Rv
ucggagaugaacucggcgau

SEQ ID NO: 3351001 - RNA, 20 nt, Mycobacterium tuberculosis H37Rv
ucggagauuucgucgcugag

SEQ ID NO: 3351002 - RNA, 22 nt, Mycobacterium tuberculosis H37Rv
ucggagccgacaacgacgucgc

SEQ ID NO: 3351003 - RNA, 17 nt, Mycobacterium tuberculosis H37Rv
ucggaggcgaccacguc

SEQ ID NO: 3351004 - RNA, 12 nt, Mycobacterium tuberculosis H37Rv
ucggaggcgauc

SEQ ID NO: 3351005 - RNA, 22 nt, Mycobacterium tuberculosis H37Rv
ucggagggggaccucuucggug

SEQ ID NO: 3351006 - RNA, 20 nt, Mycobacterium tuberculosis H37Rv
ucggaggugaccucgauggc

SEQ ID NO: 3351007 - RNA, 22 nt, Mycobacterium tuberculosis H37Rv
ucggauacccagccggccuguc

SEQ ID NO: 3351008 - RNA, 21 nt, Mycobacterium tuberculosis H37Rv
ucggaucaucgggaugcggac

SEQ ID NO: 3351009 - RNA, 17 nt, Mycobacterium tuberculosis H37Rv
ucggaucggcgccgcau

SEQ ID NO: 3351010 - RNA, 16 nt, Mycobacterium tuberculosis H37Rv
ucggaucguacggguc

SEQ ID NO: 3351011 - RNA, 15 nt, Mycobacterium tuberculosis H37Rv
ucggaugaccaguga

SEQ ID NO: 3351012 - RNA, 15 nt, Mycobacterium tuberculosis H37Rv
ucggaugucucggca

SEQ ID NO: 3351013 - RNA, 20 nt, Mycobacterium tuberculosis H37Rv
ucggauugcagcgcgauggc

SEQ ID NO: 3351014 - RNA, 24 nt, Mycobacterium tuberculosis H37Rv
ucggcaaccaccucgugggccacu

SEQ ID NO: 3351015 - RNA, 22 nt, Mycobacterium tuberculosis H37Rv
ucggcaaccacggagcccgacu

SEQ ID NO: 3351016 - RNA, 16 nt, Mycobacterium tuberculosis H37Rv
ucggcaacccgcacca

SEQ ID NO: 3351017 - RNA, 15 nt, Mycobacterium tuberculosis H37Rv
ucggcaacgcuggca

SEQ ID NO: 3351018 - RNA, 15 nt, Mycobacterium tuberculosis H37Rv
ucggcaacggcggcg

SEQ ID NO: 3351019 - RNA, 16 nt, Mycobacterium tuberculosis H37Rv
ucggcaacggcggcgu

SEQ ID NO: 3351020 - RNA, 18 nt, Mycobacterium tuberculosis H37Rv
ucggcaacggcggcgugg

SEQ ID NO: 3351021 - RNA, 20 nt, Mycobacterium tuberculosis H37Rv
ucggcaaggacguggcgcug

SEQ ID NO: 3351022 - RNA, 15 nt, Mycobacterium tuberculosis H37Rv
ucggcaagucgacgc

SEQ ID NO: 3351023 - RNA, 23 nt, Mycobacterium tuberculosis H37Rv
ucggcacaggcggccagcaucgc

SEQ ID NO: 3351024 - RNA, 15 nt, Mycobacterium tuberculosis H37Rv
ucggcaccaccgcga

SEQ ID NO: 3351025 - RNA, 18 nt, Mycobacterium tuberculosis H37Rv
ucggcaccagguugccga

SEQ ID NO: 3351026 - RNA, 19 nt, Mycobacterium tuberculosis H37Rv
ucggcaccccacgccugcc

SEQ ID NO: 3351027 - RNA, 22 nt, Mycobacterium tuberculosis H37Rv
ucggcacccggcagagcacgcg

SEQ ID NO: 3351028 - RNA, 17 nt, Mycobacterium tuberculosis H37Rv
ucggcacccucggcguu

SEQ ID NO: 3351029 - RNA, 23 nt, Mycobacterium tuberculosis H37Rv
ucggcaccggugcccaccaccga

SEQ ID NO: 3351030 - RNA, 21 nt, Mycobacterium tuberculosis H37Rv
ucggcaccgucucgcaccgcg

SEQ ID NO: 3351031 - RNA, 16 nt, Mycobacterium tuberculosis H37Rv
ucggcacgacccggga

SEQ ID NO: 3351032 - RNA, 22 nt, Mycobacterium tuberculosis H37Rv
ucggcacgacccgggaaggaac

SEQ ID NO: 3351033 - RNA, 20 nt, Mycobacterium tuberculosis H37Rv
ucggcacgccauaccggcug

SEQ ID NO: 3351034 - RNA, 21 nt, Mycobacterium tuberculosis H37Rv
ucggcacgccgggcaucggcg

SEQ ID NO: 3351035 - RNA, 18 nt, Mycobacterium tuberculosis H37Rv
ucggcacggauuuucgca

SEQ ID NO: 3351036 - RNA, 16 nt, Mycobacterium tuberculosis H37Rv
ucggcacgucguuggg

SEQ ID NO: 3351037 - RNA, 13 nt, Mycobacterium tuberculosis H37Rv
ucggcacuuagcc

SEQ ID NO: 3351038 - RNA, 17 nt, Mycobacterium tuberculosis H37Rv
ucggcacuuagcccgau

SEQ ID NO: 3351039 - RNA, 18 nt, Mycobacterium tuberculosis H37Rv
ucggcacuuagcccgaug

SEQ ID NO: 3351040 - RNA, 22 nt, Mycobacterium tuberculosis H37Rv
ucggcacuuagcccgauggugc

SEQ ID NO: 3351041 - RNA, 17 nt, Mycobacterium tuberculosis H37Rv
ucggcagauggucucga

SEQ ID NO: 3351042 - RNA, 22 nt, Mycobacterium tuberculosis H37Rv
ucggcagcagcgcaacggccag

SEQ ID NO: 3351043 - RNA, 16 nt, Mycobacterium tuberculosis H37Rv
ucggcagcaggacacc

SEQ ID NO: 3351044 - RNA, 17 nt, Mycobacterium tuberculosis H37Rv
ucggcagcaggacaccu

SEQ ID NO: 3351045 - RNA, 18 nt, Mycobacterium tuberculosis H37Rv
ucggcagccaugcggcug

SEQ ID NO: 3351046 - RNA, 12 nt, Mycobacterium tuberculosis H37Rv
ucggcaggcagc

SEQ ID NO: 3351047 - RNA, 19 nt, Mycobacterium tuberculosis H37Rv
ucggcagucccagcgccgc

SEQ ID NO: 3351048 - RNA, 19 nt, Mycobacterium tuberculosis H37Rv
ucggcauggauacgcagca

SEQ ID NO: 3351049 - RNA, 22 nt, Mycobacterium tuberculosis H37Rv
ucggcauguuccuugcggccgc

SEQ ID NO: 3351050 - RNA, 14 nt, Mycobacterium tuberculosis H37Rv
ucggcauugcgcag

SEQ ID NO: 3351051 - RNA, 19 nt, Mycobacterium tuberculosis H37Rv
ucggccaacagguccaccg

SEQ ID NO: 3351052 - RNA, 17 nt, Mycobacterium tuberculosis H37Rv
ucggccacauccagcgc

SEQ ID NO: 3351053 - RNA, 12 nt, Mycobacterium tuberculosis H37Rv
ucggcgccgaag

SEQ ID NO: 3351054 - RNA, 13 nt, Mycobacterium tuberculosis H37Rv
ucggcgccgcaua

SEQ ID NO: 3351055 - RNA, 15 nt, Mycobacterium tuberculosis H37Rv
ucggcgccgcauacc

SEQ ID NO: 3351056 - RNA, 12 nt, Mycobacterium tuberculosis H37Rv
ucggcgccggcg

SEQ ID NO: 3351057 - RNA, 23 nt, Mycobacterium tuberculosis H37Rv
ucggcgccggcggccgcggugcc

SEQ ID NO: 3351058 - RNA, 13 nt, Mycobacterium tuberculosis H37Rv
ucggcgcgcaccu

SEQ ID NO: 3351059 - RNA, 19 nt, Mycobacterium tuberculosis H37Rv
ucggcgcgcaccucggcga

SEQ ID NO: 3351060 - RNA, 14 nt, Mycobacterium tuberculosis H37Rv
ucggcgcgcgacga

SEQ ID NO: 3351061 - RNA, 17 nt, Mycobacterium tuberculosis H37Rv
ucggcgcgcggguuguc

SEQ ID NO: 3351062 - RNA, 14 nt, Mycobacterium tuberculosis H37Rv
ucggcgcggcuguc

SEQ ID NO: 3351063 - RNA, 18 nt, Mycobacterium tuberculosis H37Rv
ucggcgcguccgcaggcg

SEQ ID NO: 3351064 - RNA, 16 nt, Mycobacterium tuberculosis H37Rv
ucggcgcuagcugcug

SEQ ID NO: 3351065 - RNA, 14 nt, Mycobacterium tuberculosis H37Rv
ucggcgcucgucgc

SEQ ID NO: 3351066 - RNA, 22 nt, Mycobacterium tuberculosis H37Rv
ucggcgcugaucgcgcgcaccg

SEQ ID NO: 3351067 - RNA, 15 nt, Mycobacterium tuberculosis H37Rv
ucggcgcugcgcacc

SEQ ID NO: 3351068 - RNA, 16 nt, Mycobacterium tuberculosis H37Rv
ucggcgcugcgcaccg

SEQ ID NO: 3351069 - RNA, 19 nt, Mycobacterium tuberculosis H37Rv
ucggcgcugcgcaccgccg

SEQ ID NO: 3351070 - RNA, 22 nt, Mycobacterium tuberculosis H37Rv
ucggcgcugcggcgugccgggu

SEQ ID NO: 3351071 - RNA, 20 nt, Mycobacterium tuberculosis H37Rv
ucggcggaagaccggaucgc

SEQ ID NO: 3351072 - RNA, 21 nt, Mycobacterium tuberculosis H37Rv
ucggcggaagaccggaucgcc

SEQ ID NO: 3351073 - RNA, 16 nt, Mycobacterium tuberculosis H37Rv
ucggcggacccgguga

SEQ ID NO: 3351074 - RNA, 19 nt, Mycobacterium tuberculosis H37Rv
ucggcggacccggugaccc

SEQ ID NO: 3351075 - RNA, 16 nt, Mycobacterium tuberculosis H37Rv
ucggcggccaacagca

SEQ ID NO: 3351076 - RNA, 15 nt, Mycobacterium tuberculosis H37Rv
ucggcggccaccaug

SEQ ID NO: 3351077 - RNA, 19 nt, Mycobacterium tuberculosis H37Rv
ucggcggccagcgcgucgc

SEQ ID NO: 3351078 - RNA, 20 nt, Mycobacterium tuberculosis H37Rv
ucggcggccagcgcgucgcc

SEQ ID NO: 3351079 - RNA, 23 nt, Mycobacterium tuberculosis H37Rv
ucggcggccggcgccggcgcguc

SEQ ID NO: 3351080 - RNA, 17 nt, Mycobacterium tuberculosis H37Rv
ucggcggccucgcugcu

SEQ ID NO: 3351081 - RNA, 22 nt, Mycobacterium tuberculosis H37Rv
ucggcggccucgcugcucagca

SEQ ID NO: 3351082 - RNA, 18 nt, Mycobacterium tuberculosis H37Rv
ucggcggcgaacagcccc

SEQ ID NO: 3351083 - RNA, 17 nt, Mycobacterium tuberculosis H37Rv
ucggcggcgacguggcg

SEQ ID NO: 3351084 - RNA, 16 nt, Mycobacterium tuberculosis H37Rv
ucggcggcggcgccuu

SEQ ID NO: 3351085 - RNA, 14 nt, Mycobacterium tuberculosis H37Rv
ucggcggcggcguc

SEQ ID NO: 3351086 - RNA, 23 nt, Mycobacterium tuberculosis H37Rv
ucggcggcggggacucugccacc

SEQ ID NO: 3351087 - RNA, 18 nt, Mycobacterium tuberculosis H37Rv
ucggcggcgucuucgucg

SEQ ID NO: 3351088 - RNA, 23 nt, Mycobacterium tuberculosis H37Rv
ucggcggcgucuucgucggaguc

SEQ ID NO: 3351089 - RNA, 19 nt, Mycobacterium tuberculosis H37Rv
ucggcggcucuagaucgcc

SEQ ID NO: 3351090 - RNA, 21 nt, Mycobacterium tuberculosis H37Rv
ucggcggcuucgauugcgcug

SEQ ID NO: 3351091 - RNA, 22 nt, Mycobacterium tuberculosis H37Rv
ucggcggcuucgauugcgcugc

SEQ ID NO: 3351092 - RNA, 22 nt, Mycobacterium tuberculosis H37Rv
ucggcggcuucguggcggcgcg

SEQ ID NO: 3351093 - RNA, 15 nt, Mycobacterium tuberculosis H37Rv
ucggcggcuuggccg

SEQ ID NO: 3351094 - RNA, 14 nt, Mycobacterium tuberculosis H37Rv
ucggcgggagcugc

SEQ ID NO: 3351095 - RNA, 20 nt, Mycobacterium tuberculosis H37Rv
ucggcgggagcugccgggag

SEQ ID NO: 3351096 - RNA, 17 nt, Mycobacterium tuberculosis H37Rv
ucggcgggauccucgaa

SEQ ID NO: 3351097 - RNA, 15 nt, Mycobacterium tuberculosis H37Rv
ucggcgggcggcagc

SEQ ID NO: 3351098 - RNA, 20 nt, Mycobacterium tuberculosis H37Rv
ucggcgggggaccccgccag

SEQ ID NO: 3351099 - RNA, 17 nt, Mycobacterium tuberculosis H37Rv
ucggcgggucaggccag

SEQ ID NO: 3351100 - RNA, 19 nt, Mycobacterium tuberculosis H37Rv
ucggcgguagccgaccagc

SEQ ID NO: 3351101 - RNA, 16 nt, Mycobacterium tuberculosis H37Rv
ucggcggucagcggcu

SEQ ID NO: 3351102 - RNA, 22 nt, Mycobacterium tuberculosis H37Rv
ucggcggugaaaucgcacagcg

SEQ ID NO: 3351103 - RNA, 19 nt, Mycobacterium tuberculosis H37Rv
ucggcggugaacgacgggu

SEQ ID NO: 3351104 - RNA, 24 nt, Mycobacterium tuberculosis H37Rv
ucggcggugaacuucuccaccagc

SEQ ID NO: 3351105 - RNA, 16 nt, Mycobacterium tuberculosis H37Rv
ucggcggugcagaucg

SEQ ID NO: 3351106 - RNA, 15 nt, Mycobacterium tuberculosis H37Rv
ucggcggugccacca

SEQ ID NO: 3351107 - RNA, 21 nt, Mycobacterium tuberculosis H37Rv
ucggcggugccgcggcuaggc

SEQ ID NO: 3351108 - RNA, 22 nt, Mycobacterium tuberculosis H37Rv
ucggcgguguccuacuuuucca

SEQ ID NO: 3351109 - RNA, 16 nt, Mycobacterium tuberculosis H37Rv
ucggcgguucgauccc

SEQ ID NO: 3351110 - RNA, 22 nt, Mycobacterium tuberculosis H37Rv
ucggcguacccguuaugcgccg

SEQ ID NO: 3351111 - RNA, 19 nt, Mycobacterium tuberculosis H37Rv
ucggcguagcgagcgggug

SEQ ID NO: 3351112 - RNA, 17 nt, Mycobacterium tuberculosis H37Rv
ucggcguaggcgauggc

SEQ ID NO: 3351113 - RNA, 17 nt, Mycobacterium tuberculosis H37Rv
ucggcgucauccaccgc

SEQ ID NO: 3351114 - RNA, 15 nt, Mycobacterium tuberculosis H37Rv
ucggcgucgagcucg

SEQ ID NO: 3351115 - RNA, 14 nt, Mycobacterium tuberculosis H37Rv
ucggcgucgcggau

SEQ ID NO: 3351116 - RNA, 20 nt, Mycobacterium tuberculosis H37Rv
ucggcgucguauucgaugcc

SEQ ID NO: 3351117 - RNA, 17 nt, Mycobacterium tuberculosis H37Rv
ucggcgucgucgauggc

SEQ ID NO: 3351118 - RNA, 21 nt, Mycobacterium tuberculosis H37Rv
ucggcgucuguaccacgggcu

SEQ ID NO: 3351119 - RNA, 15 nt, Mycobacterium tuberculosis H37Rv
ucggcgugcaggguc

SEQ ID NO: 3351120 - RNA, 19 nt, Mycobacterium tuberculosis H37Rv
ucggcgugcggacugacgu

SEQ ID NO: 3351121 - RNA, 22 nt, Mycobacterium tuberculosis H37Rv
ucggcguggcaguacaccggcg

SEQ ID NO: 3351122 - RNA, 20 nt, Mycobacterium tuberculosis H37Rv
ucggcguggucgcgcggcac

SEQ ID NO: 3351123 - RNA, 16 nt, Mycobacterium tuberculosis H37Rv
ucggcguguccgccga

SEQ ID NO: 3351124 - RNA, 18 nt, Mycobacterium tuberculosis H37Rv
ucggcguguccgccgaac

SEQ ID NO: 3351125 - RNA, 16 nt, Mycobacterium tuberculosis H37Rv
ucggcgugucucgucg

SEQ ID NO: 3351126 - RNA, 17 nt, Mycobacterium tuberculosis H37Rv
ucggcguuaucgaaggc

SEQ ID NO: 3351127 - RNA, 22 nt, Mycobacterium tuberculosis H37Rv
ucggcguugaucgacaucacca

SEQ ID NO: 3351128 - RNA, 20 nt, Mycobacterium tuberculosis H37Rv
ucggcuaccuuguccggccc

SEQ ID NO: 3351129 - RNA, 23 nt, Mycobacterium tuberculosis H37Rv
ucggcuagcaacgggucgauguc

SEQ ID NO: 3351130 - RNA, 23 nt, Mycobacterium tuberculosis H37Rv
ucggcuaggccggccggaguccg

SEQ ID NO: 3351131 - RNA, 17 nt, Mycobacterium tuberculosis H37Rv
ucggcuaucgcuagccg

SEQ ID NO: 3351132 - RNA, 12 nt, Mycobacterium tuberculosis H37Rv
ucggcucagcaa

SEQ ID NO: 3351133 - RNA, 16 nt, Mycobacterium tuberculosis H37Rv
ucggcugauagggcug

SEQ ID NO: 3351134 - RNA, 16 nt, Mycobacterium tuberculosis H37Rv
ucggcugccaccgcag

SEQ ID NO: 3351135 - RNA, 23 nt, Mycobacterium tuberculosis H37Rv
ucggcugccgcaaacgcggcguc

SEQ ID NO: 3351136 - RNA, 18 nt, Mycobacterium tuberculosis H37Rv
ucggcugccgcgcgcugc

SEQ ID NO: 3351137 - RNA, 14 nt, Mycobacterium tuberculosis H37Rv
ucggcugcggcguc

SEQ ID NO: 3351138 - RNA, 12 nt, Mycobacterium tuberculosis H37Rv
ucggcuggcccg

SEQ ID NO: 3351139 - RNA, 12 nt, Mycobacterium tuberculosis H37Rv
ucggcuggcguc

SEQ ID NO: 3351140 - RNA, 22 nt, Mycobacterium tuberculosis H37Rv
ucggcuggugggggagcggccg

SEQ ID NO: 3351141 - RNA, 18 nt, Mycobacterium tuberculosis H37Rv
ucggcuguugcguucggu

SEQ ID NO: 3351142 - RNA, 18 nt, Mycobacterium tuberculosis H37Rv
ucggcuuccuccucggcg

SEQ ID NO: 3351143 - RNA, 15 nt, Mycobacterium tuberculosis H37Rv
ucggcuugggaaacc

SEQ ID NO: 3351144 - RNA, 16 nt, Mycobacterium tuberculosis H37Rv
ucggcuugggaaaccc

SEQ ID NO: 3351145 - RNA, 20 nt, Mycobacterium tuberculosis H37Rv
ucgggaacgcucgucgacag

SEQ ID NO: 3351146 - RNA, 23 nt, Mycobacterium tuberculosis H37Rv
ucgggacaaagccgaacgacagc

SEQ ID NO: 3351147 - RNA, 22 nt, Mycobacterium tuberculosis H37Rv
ucgggacaaucguccacccgag

SEQ ID NO: 3351148 - RNA, 23 nt, Mycobacterium tuberculosis H37Rv
ucggucagcgucaggugcgcgac

SEQ ID NO: 3351149 - RNA, 15 nt, Mycobacterium tuberculosis H37Rv
ucggucagcugugcg

SEQ ID NO: 3351150 - RNA, 14 nt, Mycobacterium tuberculosis H37Rv
ucggucaguuccuc

SEQ ID NO: 3351151 - RNA, 17 nt, Mycobacterium tuberculosis H37Rv
ucggucaucgguugacc

SEQ ID NO: 3351152 - RNA, 16 nt, Mycobacterium tuberculosis H37Rv
ucggucgccaccgccg

SEQ ID NO: 3351153 - RNA, 12 nt, Mycobacterium tuberculosis H37Rv
ucggucucggcg

SEQ ID NO: 3351154 - RNA, 13 nt, Mycobacterium tuberculosis H37Rv
ucggucugcaugc

SEQ ID NO: 3351155 - RNA, 21 nt, Mycobacterium tuberculosis H37Rv
ucggucuuggcgauccaggcc

SEQ ID NO: 3351156 - RNA, 12 nt, Mycobacterium tuberculosis H37Rv
ucggugaagacg

SEQ ID NO: 3351157 - RNA, 21 nt, Mycobacterium tuberculosis H37Rv
ucggugaaucgucugacgaaa

SEQ ID NO: 3351158 - RNA, 18 nt, Mycobacterium tuberculosis H37Rv
ucggugaaugccgucgcc

SEQ ID NO: 3351159 - RNA, 14 nt, Mycobacterium tuberculosis H37Rv
ucggugacgaaaca

SEQ ID NO: 3351160 - RNA, 16 nt, Mycobacterium tuberculosis H37Rv
ucggugacgaagagca

SEQ ID NO: 3351161 - RNA, 20 nt, Mycobacterium tuberculosis H37Rv
ucggugacggucaaaugaau

SEQ ID NO: 3351162 - RNA, 15 nt, Mycobacterium tuberculosis H37Rv
ucggugacuccggcu

SEQ ID NO: 3351163 - RNA, 19 nt, Mycobacterium tuberculosis H37Rv
ucggugagcagggcggcga

SEQ ID NO: 3351164 - RNA, 22 nt, Mycobacterium tuberculosis H37Rv
ucggugagcccguugaccugcg

SEQ ID NO: 3351165 - RNA, 22 nt, Mycobacterium tuberculosis H37Rv
ucggugagccgugccgccagca

SEQ ID NO: 3351166 - RNA, 16 nt, Mycobacterium tuberculosis H37Rv
ucggugagcgcgucgc

SEQ ID NO: 3351167 - RNA, 15 nt, Mycobacterium tuberculosis H37Rv
ucggugagcgggcaa

SEQ ID NO: 3351168 - RNA, 16 nt, Mycobacterium tuberculosis H37Rv
ucggugagcgggcaag

SEQ ID NO: 3351169 - RNA, 19 nt, Mycobacterium tuberculosis H37Rv
ucggugaucuuguccgggc

SEQ ID NO: 3351170 - RNA, 18 nt, Mycobacterium tuberculosis H37Rv
ucggugauuucggcgucg

SEQ ID NO: 3351171 - RNA, 21 nt, Mycobacterium tuberculosis H37Rv
ucggugauuucggcgucgagu

SEQ ID NO: 3351172 - RNA, 18 nt, Mycobacterium tuberculosis H37Rv
ucggugcacaacgcccac

SEQ ID NO: 3351173 - RNA, 14 nt, Mycobacterium tuberculosis H37Rv
ucggugcagcagcg

SEQ ID NO: 3351174 - RNA, 21 nt, Mycobacterium tuberculosis H37Rv
ucggugcagcccgccgcugaa

SEQ ID NO: 3351175 - RNA, 20 nt, Mycobacterium tuberculosis H37Rv
ucggugccgaacagcggguu

SEQ ID NO: 3351176 - RNA, 19 nt, Mycobacterium tuberculosis H37Rv
ucggugccgcccaggagca

SEQ ID NO: 3351177 - RNA, 21 nt, Mycobacterium tuberculosis H37Rv
ucggugccgcugaugcuggcc

SEQ ID NO: 3351178 - RNA, 23 nt, Mycobacterium tuberculosis H37Rv
ucggugccggggcugccgccguu

SEQ ID NO: 3351179 - RNA, 12 nt, Mycobacterium tuberculosis H37Rv
ucggugcgcggu

SEQ ID NO: 3351180 - RNA, 15 nt, Mycobacterium tuberculosis H37Rv
ucggugcgcuggcgg

SEQ ID NO: 3351181 - RNA, 18 nt, Mycobacterium tuberculosis H37Rv
ucggugcggaacacgaug

SEQ ID NO: 3351182 - RNA, 16 nt, Mycobacterium tuberculosis H37Rv
ucggugcggucaucgc

SEQ ID NO: 3351183 - RNA, 15 nt, Mycobacterium tuberculosis H37Rv
ucggugcggugcaca

SEQ ID NO: 3351184 - RNA, 16 nt, Mycobacterium tuberculosis H37Rv
ucgguggagcgcggga

SEQ ID NO: 3351185 - RNA, 17 nt, Mycobacterium tuberculosis H37Rv
ucgguggagggcgagca

SEQ ID NO: 3351186 - RNA, 21 nt, Mycobacterium tuberculosis H37Rv
ucgguggcaaggccaaccggg

SEQ ID NO: 3351187 - RNA, 20 nt, Mycobacterium tuberculosis H37Rv
ucgguggcaucggcggccug

SEQ ID NO: 3351188 - RNA, 20 nt, Mycobacterium tuberculosis H37Rv
ucgguggcgccgaacgccag

SEQ ID NO: 3351189 - RNA, 15 nt, Mycobacterium tuberculosis H37Rv
ucgguggcggcagca

SEQ ID NO: 3351190 - RNA, 16 nt, Mycobacterium tuberculosis H37Rv
ucggugggcgugacgu

SEQ ID NO: 3351191 - RNA, 12 nt, Mycobacterium tuberculosis H37Rv
ucggugguacgu

SEQ ID NO: 3351192 - RNA, 22 nt, Mycobacterium tuberculosis H37Rv
ucggugguacgugcgagcccac

SEQ ID NO: 3351193 - RNA, 15 nt, Mycobacterium tuberculosis H37Rv
ucggugguccagcgc

SEQ ID NO: 3351194 - RNA, 22 nt, Mycobacterium tuberculosis H37Rv
ucgguguagagagccauguccu

SEQ ID NO: 3351195 - RNA, 14 nt, Mycobacterium tuberculosis H37Rv
ucggugucggccgc

SEQ ID NO: 3351196 - RNA, 15 nt, Mycobacterium tuberculosis H37Rv
ucggugugcaucgcc

SEQ ID NO: 3351197 - RNA, 18 nt, Mycobacterium tuberculosis H37Rv
ucgguguggacugggcca

SEQ ID NO: 3351198 - RNA, 22 nt, Mycobacterium tuberculosis H37Rv
ucgguguggcccaacaccgcca

SEQ ID NO: 3351199 - RNA, 17 nt, Mycobacterium tuberculosis H37Rv
ucgguguucgguggucc

SEQ ID NO: 3351200 - RNA, 14 nt, Mycobacterium tuberculosis H37Rv
ucgguuagcgcggc

SEQ ID NO: 3351201 - RNA, 16 nt, Mycobacterium tuberculosis H37Rv
ucgguuagcgcggcca

SEQ ID NO: 3351202 - RNA, 21 nt, Mycobacterium tuberculosis H37Rv
ucgguucgccccugcacagca

SEQ ID NO: 3351203 - RNA, 22 nt, Mycobacterium tuberculosis H37Rv
ucguaccuaaggcucaccaggc

SEQ ID NO: 3351204 - RNA, 22 nt, Mycobacterium tuberculosis H37Rv
ucguagacagucugcgacugga

SEQ ID NO: 3351205 - RNA, 20 nt, Mycobacterium tuberculosis H37Rv
ucguagacgguuaccgcgaa

SEQ ID NO: 3351206 - RNA, 12 nt, Mycobacterium tuberculosis H37Rv
ucguaggcgaug

SEQ ID NO: 3351207 - RNA, 13 nt, Mycobacterium tuberculosis H37Rv
ucguaggcgauga

SEQ ID NO: 3351208 - RNA, 15 nt, Mycobacterium tuberculosis H37Rv
ucguaggcgaugagc

SEQ ID NO: 3351209 - RNA, 15 nt, Mycobacterium tuberculosis H37Rv
ucguagggacgccga

SEQ ID NO: 3351210 - RNA, 14 nt, Mycobacterium tuberculosis H37Rv
ucguaggugggcuc

SEQ ID NO: 3351211 - RNA, 17 nt, Mycobacterium tuberculosis H37Rv
ucguaugauucacgcuc

SEQ ID NO: 3351212 - RNA, 21 nt, Mycobacterium tuberculosis H37Rv
ucguauucgaugccguaggcg

SEQ ID NO: 3351213 - RNA, 15 nt, Mycobacterium tuberculosis H37Rv
ucguauugauccagg

SEQ ID NO: 3351214 - RNA, 14 nt, Mycobacterium tuberculosis H37Rv
ucgucaccccacca

SEQ ID NO: 3351215 - RNA, 20 nt, Mycobacterium tuberculosis H37Rv
ucgucacgccccucacgugg

SEQ ID NO: 3351216 - RNA, 23 nt, Mycobacterium tuberculosis H37Rv
ucgucacgcggguugcgcggcuu

SEQ ID NO: 3351217 - RNA, 22 nt, Mycobacterium tuberculosis H37Rv
ucgucacggacccuuccgccgc

SEQ ID NO: 3351218 - RNA, 23 nt, Mycobacterium tuberculosis H37Rv
ucgucauugcgaaaaucgaagcc

SEQ ID NO: 3351219 - RNA, 17 nt, Mycobacterium tuberculosis H37Rv
ucguccaccgccgacau

SEQ ID NO: 3351220 - RNA, 17 nt, Mycobacterium tuberculosis H37Rv
ucguccacgaccccggc

SEQ ID NO: 3351221 - RNA, 13 nt, Mycobacterium tuberculosis H37Rv
ucguccagcacca

SEQ ID NO: 3351222 - RNA, 18 nt, Mycobacterium tuberculosis H37Rv
ucguccagcgaucccggu

SEQ ID NO: 3351223 - RNA, 21 nt, Mycobacterium tuberculosis H37Rv
ucguccagcgaucccggugag

SEQ ID NO: 3351224 - RNA, 19 nt, Mycobacterium tuberculosis H37Rv
ucguccagcucggugcugu

SEQ ID NO: 3351225 - RNA, 19 nt, Mycobacterium tuberculosis H37Rv
ucguccaggucggccgccu

SEQ ID NO: 3351226 - RNA, 18 nt, Mycobacterium tuberculosis H37Rv
ucguccaucagcaacacg

SEQ ID NO: 3351227 - RNA, 14 nt, Mycobacterium tuberculosis H37Rv
ucguccccagaccg

SEQ ID NO: 3351228 - RNA, 16 nt, Mycobacterium tuberculosis H37Rv
ucguccccagaccggc

SEQ ID NO: 3351229 - RNA, 21 nt, Mycobacterium tuberculosis H37Rv
ucgucccgcggcgcggagagc

SEQ ID NO: 3351230 - RNA, 20 nt, Mycobacterium tuberculosis H37Rv
ucgucccggcgaccgggucc

SEQ ID NO: 3351231 - RNA, 15 nt, Mycobacterium tuberculosis H37Rv
ucguccgccugcacc

SEQ ID NO: 3351232 - RNA, 13 nt, Mycobacterium tuberculosis H37Rv
ucguccgcugacc

SEQ ID NO: 3351233 - RNA, 13 nt, Mycobacterium tuberculosis H37Rv
ucguccggccacg

SEQ ID NO: 3351234 - RNA, 22 nt, Mycobacterium tuberculosis H37Rv
ucguccggccacgguccggccc

SEQ ID NO: 3351235 - RNA, 16 nt, Mycobacterium tuberculosis H37Rv
ucguccggugcgaucc

SEQ ID NO: 3351236 - RNA, 17 nt, Mycobacterium tuberculosis H37Rv
ucgucgaacauggcacg

SEQ ID NO: 3351237 - RNA, 18 nt, Mycobacterium tuberculosis H37Rv
ucgucgaacuuugucgcg

SEQ ID NO: 3351238 - RNA, 16 nt, Mycobacterium tuberculosis H37Rv
ucgucgaaguagccga

SEQ ID NO: 3351239 - RNA, 17 nt, Mycobacterium tuberculosis H37Rv
ucgucgaaguuggcgaa

SEQ ID NO: 3351240 - RNA, 19 nt, Mycobacterium tuberculosis H37Rv
ucgucgaccaccugagccg

SEQ ID NO: 3351241 - RNA, 13 nt, Mycobacterium tuberculosis H37Rv
ucgucgaccaggc

SEQ ID NO: 3351242 - RNA, 14 nt, Mycobacterium tuberculosis H37Rv
ucgucgaccaggcc

SEQ ID NO: 3351243 - RNA, 17 nt, Mycobacterium tuberculosis H37Rv
ucgucgacccaccaugu

SEQ ID NO: 3351244 - RNA, 22 nt, Mycobacterium tuberculosis H37Rv
ucguucauguagcagcgcggcu

SEQ ID NO: 3351245 - RNA, 17 nt, Mycobacterium tuberculosis H37Rv
ucguucauguccaccgc

SEQ ID NO: 3351246 - RNA, 17 nt, Mycobacterium tuberculosis H37Rv
ucguuccgcuggacgga

SEQ ID NO: 3351247 - RNA, 19 nt, Mycobacterium tuberculosis H37Rv
ucguuccgcuggacggauc

SEQ ID NO: 3351248 - RNA, 16 nt, Mycobacterium tuberculosis H37Rv
ucguugaccggccgga

SEQ ID NO: 3351249 - RNA, 20 nt, Mycobacterium tuberculosis H37Rv
ucguugagaagcgucacagu

SEQ ID NO: 3351250 - RNA, 22 nt, Mycobacterium tuberculosis H37Rv
ucguugaggccggugaacggca

SEQ ID NO: 3351251 - RNA, 17 nt, Mycobacterium tuberculosis H37Rv
ucguugcccgacccgcc

SEQ ID NO: 3351252 - RNA, 13 nt, Mycobacterium tuberculosis H37Rv
ucguugccgaccg

SEQ ID NO: 3351253 - RNA, 19 nt, Mycobacterium tuberculosis H37Rv
ucguugccgcggucggcga

SEQ ID NO: 3351254 - RNA, 19 nt, Mycobacterium tuberculosis H37Rv
ucguugccggacaaccugg

SEQ ID NO: 3351255 - RNA, 15 nt, Mycobacterium tuberculosis H37Rv
ucguugccggugccg

SEQ ID NO: 3351256 - RNA, 16 nt, Mycobacterium tuberculosis H37Rv
ucguugccguagcuga

SEQ ID NO: 3351257 - RNA, 21 nt, Mycobacterium tuberculosis H37Rv
ucguuggccaugccacaacgc

SEQ ID NO: 3351258 - RNA, 23 nt, Mycobacterium tuberculosis H37Rv
ucguugucagcgaacggccagga

SEQ ID NO: 3351259 - RNA, 16 nt, Mycobacterium tuberculosis H37Rv
ucguuguccagcgucu

SEQ ID NO: 3351260 - RNA, 13 nt, Mycobacterium tuberculosis H37Rv
ucguugucgucgc

SEQ ID NO: 3351261 - RNA, 19 nt, Mycobacterium tuberculosis H37Rv
ucguugugccggucgauga

SEQ ID NO: 3351262 - RNA, 16 nt, Mycobacterium tuberculosis H37Rv
ucguuucgaagugccg

SEQ ID NO: 3351263 - RNA, 13 nt, Mycobacterium tuberculosis H37Rv
ucguuucgccagc

SEQ ID NO: 3351264 - RNA, 16 nt, Mycobacterium tuberculosis H37Rv
ucguuuggcgccgccg

SEQ ID NO: 3351265 - RNA, 19 nt, Mycobacterium tuberculosis H37Rv
ucguuuuccagccgacgua

SEQ ID NO: 3351266 - RNA, 20 nt, Mycobacterium tuberculosis H37Rv
ucuaaauaccuuuggcuccc

SEQ ID NO: 3351267 - RNA, 20 nt, Mycobacterium tuberculosis H37Rv
ucuaaugaggucaacgccac

SEQ ID NO: 3351268 - RNA, 19 nt, Mycobacterium tuberculosis H37Rv
ucuaauuggcuugugccca

SEQ ID NO: 3351269 - RNA, 21 nt, Mycobacterium tuberculosis H37Rv
ucuaccaccuugccgaacacu

SEQ ID NO: 3351270 - RNA, 23 nt, Mycobacterium tuberculosis H37Rv
ucuaccuuagcgccguugccgcc

SEQ ID NO: 3351271 - RNA, 15 nt, Mycobacterium tuberculosis H37Rv
ucuaccuuuuuggca

SEQ ID NO: 3351272 - RNA, 18 nt, Mycobacterium tuberculosis H37Rv
ucuagcaaagccagcgca

SEQ ID NO: 3351273 - RNA, 22 nt, Mycobacterium tuberculosis H37Rv
ucuagcggccuaggacgccgcc

SEQ ID NO: 3351274 - RNA, 18 nt, Mycobacterium tuberculosis H37Rv
ucuagcuugacaacccug

SEQ ID NO: 3351275 - RNA, 18 nt, Mycobacterium tuberculosis H37Rv
ucucauccuccugcgccg

SEQ ID NO: 3351276 - RNA, 18 nt, Mycobacterium tuberculosis H37Rv
ucucaugcaucugcuucu

SEQ ID NO: 3351277 - RNA, 23 nt, Mycobacterium tuberculosis H37Rv
ucuccaacacaaacgccgccggg

SEQ ID NO: 3351278 - RNA, 22 nt, Mycobacterium tuberculosis H37Rv
ucuccaagcucgacaacugccc

SEQ ID NO: 3351279 - RNA, 19 nt, Mycobacterium tuberculosis H37Rv
ucuccaccccgucugcagg

SEQ ID NO: 3351280 - RNA, 13 nt, Mycobacterium tuberculosis H37Rv
ucuccaccgcgau

SEQ ID NO: 3351281 - RNA, 14 nt, Mycobacterium tuberculosis H37Rv
ucuccagauguccg

SEQ ID NO: 3351282 - RNA, 20 nt, Mycobacterium tuberculosis H37Rv
ucuccaucaugugcgcgacc

SEQ ID NO: 3351283 - RNA, 12 nt, Mycobacterium tuberculosis H37Rv
ucuccaugcucg

SEQ ID NO: 3351284 - RNA, 23 nt, Mycobacterium tuberculosis H37Rv
ucuccccagagcugguccuccaa

SEQ ID NO: 3351285 - RNA, 16 nt, Mycobacterium tuberculosis H37Rv
ucucccgaccgccgag

SEQ ID NO: 3351286 - RNA, 16 nt, Mycobacterium tuberculosis H37Rv
ucucccggccgcaccc

SEQ ID NO: 3351287 - RNA, 13 nt, Mycobacterium tuberculosis H37Rv
ucucccuugccga

SEQ ID NO: 3351288 - RNA, 14 nt, Mycobacterium tuberculosis H37Rv
ucucccuugccgcc

SEQ ID NO: 3351289 - RNA, 12 nt, Mycobacterium tuberculosis H37Rv
ucuccgccgccc

SEQ ID NO: 3351290 - RNA, 15 nt, Mycobacterium tuberculosis H37Rv
ucuccggcaacagca

SEQ ID NO: 3351291 - RNA, 19 nt, Mycobacterium tuberculosis H37Rv
ucuccggcaacagcaccag

SEQ ID NO: 3351292 - RNA, 21 nt, Mycobacterium tuberculosis H37Rv
ucuccgggucgaugucggggc

SEQ ID NO: 3351293 - RNA, 23 nt, Mycobacterium tuberculosis H37Rv
ucuccgggucgaugucggggccg

SEQ ID NO: 3351294 - RNA, 14 nt, Mycobacterium tuberculosis H37Rv
ucuccuccagagac

SEQ ID NO: 3351295 - RNA, 21 nt, Mycobacterium tuberculosis H37Rv
ucuccuccgcguagagcagca

SEQ ID NO: 3351296 - RNA, 19 nt, Mycobacterium tuberculosis H37Rv
ucuccuccggaaagcucuc

SEQ ID NO: 3351297 - RNA, 14 nt, Mycobacterium tuberculosis H37Rv
ucuccucgugcagc

SEQ ID NO: 3351298 - RNA, 17 nt, Mycobacterium tuberculosis H37Rv
ucuccucuugcaccagg

SEQ ID NO: 3351299 - RNA, 15 nt, Mycobacterium tuberculosis H37Rv
ucuccugcccuccgu

SEQ ID NO: 3351300 - RNA, 16 nt, Mycobacterium tuberculosis H37Rv
ucuccuugagcuucuc

SEQ ID NO: 3351301 - RNA, 22 nt, Mycobacterium tuberculosis H37Rv
ucuccuugggcgacgcggcgcc

SEQ ID NO: 3351302 - RNA, 18 nt, Mycobacterium tuberculosis H37Rv
ucucgaaagccgcggccg

SEQ ID NO: 3351303 - RNA, 13 nt, Mycobacterium tuberculosis H37Rv
ucucgaccagcgc

SEQ ID NO: 3351304 - RNA, 21 nt, Mycobacterium tuberculosis H37Rv
ucucgaccucagacagcugca

SEQ ID NO: 3351305 - RNA, 16 nt, Mycobacterium tuberculosis H37Rv
ucucgagcucggcgaa

SEQ ID NO: 3351306 - RNA, 15 nt, Mycobacterium tuberculosis H37Rv
ucucgaguccaggca

SEQ ID NO: 3351307 - RNA, 23 nt, Mycobacterium tuberculosis H37Rv
ucucgauggucauccagccagca

SEQ ID NO: 3351308 - RNA, 16 nt, Mycobacterium tuberculosis H37Rv
ucucgcagcaacggcg

SEQ ID NO: 3351309 - RNA, 23 nt, Mycobacterium tuberculosis H37Rv
ucucgcagcauguccgcagcggu

SEQ ID NO: 3351310 - RNA, 15 nt, Mycobacterium tuberculosis H37Rv
ucucgcaucggccuc

SEQ ID NO: 3351311 - RNA, 18 nt, Mycobacterium tuberculosis H37Rv
ucucgcaucggccucgag

SEQ ID NO: 3351312 - RNA, 14 nt, Mycobacterium tuberculosis H37Rv
ucucgcccacccgc

SEQ ID NO: 3351313 - RNA, 20 nt, Mycobacterium tuberculosis H37Rv
ucucgcccccagugcacgcu

SEQ ID NO: 3351314 - RNA, 20 nt, Mycobacterium tuberculosis H37Rv
ucucgccgaccuuggcgucg

SEQ ID NO: 3351315 - RNA, 20 nt, Mycobacterium tuberculosis H37Rv
ucucgcgaagaucagcggau

SEQ ID NO: 3351316 - RNA, 16 nt, Mycobacterium tuberculosis H37Rv
ucucgcggaccucggc

SEQ ID NO: 3351317 - RNA, 13 nt, Mycobacterium tuberculosis H37Rv
ucucgcggacgga

SEQ ID NO: 3351318 - RNA, 17 nt, Mycobacterium tuberculosis H37Rv
ucucgcucgugcacgcu

SEQ ID NO: 3351319 - RNA, 19 nt, Mycobacterium tuberculosis H37Rv
ucucgcucgugcacgcuga

SEQ ID NO: 3351320 - RNA, 14 nt, Mycobacterium tuberculosis H37Rv
ucucgcugaccuuu

SEQ ID NO: 3351321 - RNA, 18 nt, Mycobacterium tuberculosis H37Rv
ucucgcuguugaagccgc

SEQ ID NO: 3351322 - RNA, 21 nt, Mycobacterium tuberculosis H37Rv
ucucggaaacggaccuccucg

SEQ ID NO: 3351323 - RNA, 14 nt, Mycobacterium tuberculosis H37Rv
ucucggcaccacag

SEQ ID NO: 3351324 - RNA, 21 nt, Mycobacterium tuberculosis H37Rv
ucucggccgcucguuacgccg

SEQ ID NO: 3351325 - RNA, 12 nt, Mycobacterium tuberculosis H37Rv
ucucggccggcg

SEQ ID NO: 3351326 - RNA, 13 nt, Mycobacterium tuberculosis H37Rv
ucucggccggcgg

SEQ ID NO: 3351327 - RNA, 16 nt, Mycobacterium tuberculosis H37Rv
ucucggcgaacgcgaa

SEQ ID NO: 3351328 - RNA, 16 nt, Mycobacterium tuberculosis H37Rv
ucucggcgagcaccac

SEQ ID NO: 3351329 - RNA, 16 nt, Mycobacterium tuberculosis H37Rv
ucucggcgagcaccgu

SEQ ID NO: 3351330 - RNA, 19 nt, Mycobacterium tuberculosis H37Rv
ucucggcguugccgccguu

SEQ ID NO: 3351331 - RNA, 15 nt, Mycobacterium tuberculosis H37Rv
ucucggucagcccca

SEQ ID NO: 3351332 - RNA, 14 nt, Mycobacterium tuberculosis H37Rv
ucucggucugcaug

SEQ ID NO: 3351333 - RNA, 19 nt, Mycobacterium tuberculosis H37Rv
ucucgguggacggcaggcg

SEQ ID NO: 3351334 - RNA, 19 nt, Mycobacterium tuberculosis H37Rv
ucucguagcgcucagcuga

SEQ ID NO: 3351335 - RNA, 23 nt, Mycobacterium tuberculosis H37Rv
ucucguaucgcacccgccggcgg

SEQ ID NO: 3351336 - RNA, 14 nt, Mycobacterium tuberculosis H37Rv
ucucgucaaccugc

SEQ ID NO: 3351337 - RNA, 12 nt, Mycobacterium tuberculosis H37Rv
ucucgucgucga

SEQ ID NO: 3351338 - RNA, 22 nt, Mycobacterium tuberculosis H37Rv
ucucgucgucgauuagcccacc

SEQ ID NO: 3351339 - RNA, 17 nt, Mycobacterium tuberculosis H37Rv
ucucgucgucgcggccg

SEQ ID NO: 3351340 - RNA, 20 nt, Mycobacterium tuberculosis H37Rv
ucuugccgccgcgccggcag

SEQ ID NO: 3351341 - RNA, 18 nt, Mycobacterium tuberculosis H37Rv
ucuugccgcgccggauga

SEQ ID NO: 3351342 - RNA, 15 nt, Mycobacterium tuberculosis H37Rv
ucuugccggccagga

SEQ ID NO: 3351343 - RNA, 21 nt, Mycobacterium tuberculosis H37Rv
ucuugcgacgcccgccuucga

SEQ ID NO: 3351344 - RNA, 17 nt, Mycobacterium tuberculosis H37Rv
ucuugcgaugugcauuc

SEQ ID NO: 3351345 - RNA, 21 nt, Mycobacterium tuberculosis H37Rv
ucuugcggggucgguagcugg

SEQ ID NO: 3351346 - RNA, 14 nt, Mycobacterium tuberculosis H37Rv
ucuugcugcacgcu

SEQ ID NO: 3351347 - RNA, 15 nt, Mycobacterium tuberculosis H37Rv
ucuuggacagcagca

SEQ ID NO: 3351348 - RNA, 15 nt, Mycobacterium tuberculosis H37Rv
ucuuggcacacaggu

SEQ ID NO: 3351349 - RNA, 13 nt, Mycobacterium tuberculosis H37Rv
ucuuggccagcag

SEQ ID NO: 3351350 - RNA, 19 nt, Mycobacterium tuberculosis H37Rv
ucuuggcgaggauguaguu

SEQ ID NO: 3351351 - RNA, 18 nt, Mycobacterium tuberculosis H37Rv
ucuuggcgauccaggcca

SEQ ID NO: 3351352 - RNA, 19 nt, Mycobacterium tuberculosis H37Rv
ucuuggcgcccgccggcaa

SEQ ID NO: 3351353 - RNA, 20 nt, Mycobacterium tuberculosis H37Rv
ucuuggcgcgguccuccaga

SEQ ID NO: 3351354 - RNA, 13 nt, Mycobacterium tuberculosis H37Rv
ucuugggccggga

SEQ ID NO: 3351355 - RNA, 19 nt, Mycobacterium tuberculosis H37Rv
ucuugggggccaaccgggu

SEQ ID NO: 3351356 - RNA, 17 nt, Mycobacterium tuberculosis H37Rv
ucuuucccgccaccaaa

SEQ ID NO: 3351357 - RNA, 23 nt, Mycobacterium tuberculosis H37Rv
ucuuucgaaaugaggucuuugcu

SEQ ID NO: 3351358 - RNA, 12 nt, Mycobacterium tuberculosis H37Rv
ucuuugagugcc

SEQ ID NO: 3351359 - RNA, 16 nt, Mycobacterium tuberculosis H37Rv
ucuuugccggcgccuu

SEQ ID NO: 3351360 - RNA, 20 nt, Mycobacterium tuberculosis H37Rv
ucuuugcucucggucugcau

SEQ ID NO: 3351361 - RNA, 16 nt, Mycobacterium tuberculosis H37Rv
ucuuugguagucugca

SEQ ID NO: 3351362 - RNA, 14 nt, Mycobacterium tuberculosis H37Rv
ucuuuggucgccgg

SEQ ID NO: 3351363 - RNA, 23 nt, Mycobacterium tuberculosis H37Rv
ucuuuggucgccggaccagagcc

SEQ ID NO: 3351364 - RNA, 16 nt, Mycobacterium tuberculosis H37Rv
ugaaacguccuugaac

SEQ ID NO: 3351365 - RNA, 15 nt, Mycobacterium tuberculosis H37Rv
ugaaaguucaugcca

SEQ ID NO: 3351366 - RNA, 14 nt, Mycobacterium tuberculosis H37Rv
ugaacaccccuccu

SEQ ID NO: 3351367 - RNA, 16 nt, Mycobacterium tuberculosis H37Rv
ugaacaccggcgccuc

SEQ ID NO: 3351368 - RNA, 19 nt, Mycobacterium tuberculosis H37Rv
ugaacaccucauacgccaa

SEQ ID NO: 3351369 - RNA, 19 nt, Mycobacterium tuberculosis H37Rv
ugaacacgaauccggccac

SEQ ID NO: 3351370 - RNA, 20 nt, Mycobacterium tuberculosis H37Rv
ugaacagcgacgccaugguc

SEQ ID NO: 3351371 - RNA, 19 nt, Mycobacterium tuberculosis H37Rv
ugaacauacgaaacaugcg

SEQ ID NO: 3351372 - RNA, 17 nt, Mycobacterium tuberculosis H37Rv
ugaaccaaucgcacgcc

SEQ ID NO: 3351373 - RNA, 23 nt, Mycobacterium tuberculosis H37Rv
ugaaccgguugacacccgggcca

SEQ ID NO: 3351374 - RNA, 17 nt, Mycobacterium tuberculosis H37Rv
ugaaccugcugagccgu

SEQ ID NO: 3351375 - RNA, 15 nt, Mycobacterium tuberculosis H37Rv
ugaacgacauccggc

SEQ ID NO: 3351376 - RNA, 23 nt, Mycobacterium tuberculosis H37Rv
ugaacgacccgcuggcucaucga

SEQ ID NO: 3351377 - RNA, 15 nt, Mycobacterium tuberculosis H37Rv
ugaacgagaugccgc

SEQ ID NO: 3351378 - RNA, 17 nt, Mycobacterium tuberculosis H37Rv
ugaacgagaugccgcga

SEQ ID NO: 3351379 - RNA, 13 nt, Mycobacterium tuberculosis H37Rv
ugaacgcaccaac

SEQ ID NO: 3351380 - RNA, 14 nt, Mycobacterium tuberculosis H37Rv
ugaacgcaccaacg

SEQ ID NO: 3351381 - RNA, 23 nt, Mycobacterium tuberculosis H37Rv
ugaacgcacccgaauuugucggc

SEQ ID NO: 3351382 - RNA, 22 nt, Mycobacterium tuberculosis H37Rv
ugaacgcaugcgagaacgucga

SEQ ID NO: 3351383 - RNA, 18 nt, Mycobacterium tuberculosis H37Rv
ugaacgccagcagcgcga

SEQ ID NO: 3351384 - RNA, 23 nt, Mycobacterium tuberculosis H37Rv
ugaacgccagcagcgcgaucugc

SEQ ID NO: 3351385 - RNA, 17 nt, Mycobacterium tuberculosis H37Rv
ugaacgcccgcuucagc

SEQ ID NO: 3351386 - RNA, 12 nt, Mycobacterium tuberculosis H37Rv
ugaacgccgcca

SEQ ID NO: 3351387 - RNA, 16 nt, Mycobacterium tuberculosis H37Rv
ugaacgcggacaccgc

SEQ ID NO: 3351388 - RNA, 16 nt, Mycobacterium tuberculosis H37Rv
ugaacgcguagucgcg

SEQ ID NO: 3351389 - RNA, 14 nt, Mycobacterium tuberculosis H37Rv
ugaacgcugcccaa

SEQ ID NO: 3351390 - RNA, 22 nt, Mycobacterium tuberculosis H37Rv
ugaacggcaacguuuacgaugc

SEQ ID NO: 3351391 - RNA, 21 nt, Mycobacterium tuberculosis H37Rv
ugaacggcaaggucgcggcca

SEQ ID NO: 3351392 - RNA, 19 nt, Mycobacterium tuberculosis H37Rv
ugaacggcucgggaacuuc

SEQ ID NO: 3351393 - RNA, 20 nt, Mycobacterium tuberculosis H37Rv
ugaacggcucgggcagcguc

SEQ ID NO: 3351394 - RNA, 14 nt, Mycobacterium tuberculosis H37Rv
ugaacucgaagacc

SEQ ID NO: 3351395 - RNA, 18 nt, Mycobacterium tuberculosis H37Rv
ugaacucgaguugcucga

SEQ ID NO: 3351396 - RNA, 22 nt, Mycobacterium tuberculosis H37Rv
ugaacucuggugacggugaagc

SEQ ID NO: 3351397 - RNA, 14 nt, Mycobacterium tuberculosis H37Rv
ugaacuggucgacg

SEQ ID NO: 3351398 - RNA, 16 nt, Mycobacterium tuberculosis H37Rv
ugaagaaagcgaccgu

SEQ ID NO: 3351399 - RNA, 22 nt, Mycobacterium tuberculosis H37Rv
ugaagaacaugcucacgaucac

SEQ ID NO: 3351400 - RNA, 11 nt, Mycobacterium tuberculosis H37Rv
ugaagaagccc

SEQ ID NO: 3351401 - RNA, 20 nt, Mycobacterium tuberculosis H37Rv
ugaagaaugccgucugauca

SEQ ID NO: 3351402 - RNA, 15 nt, Mycobacterium tuberculosis H37Rv
ugaagacaccaggcc

SEQ ID NO: 3351403 - RNA, 23 nt, Mycobacterium tuberculosis H37Rv
ugaagaccaccgcccacagcaac

SEQ ID NO: 3351404 - RNA, 16 nt, Mycobacterium tuberculosis H37Rv
ugaagauaagguauuc

SEQ ID NO: 3351405 - RNA, 20 nt, Mycobacterium tuberculosis H37Rv
ugaagcacacuguucccaca

SEQ ID NO: 3351406 - RNA, 13 nt, Mycobacterium tuberculosis H37Rv
ugaagcaguuggc

SEQ ID NO: 3351407 - RNA, 22 nt, Mycobacterium tuberculosis H37Rv
ugaagccaaaugcgcugucgcc

SEQ ID NO: 3351408 - RNA, 13 nt, Mycobacterium tuberculosis H37Rv
ugaagccagcgca

SEQ ID NO: 3351409 - RNA, 22 nt, Mycobacterium tuberculosis H37Rv
ugaagccagcgcagcaccgaac

SEQ ID NO: 3351410 - RNA, 15 nt, Mycobacterium tuberculosis H37Rv
ugaagccgcgcugcg

SEQ ID NO: 3351411 - RNA, 12 nt, Mycobacterium tuberculosis H37Rv
ugaaggagaucc

SEQ ID NO: 3351412 - RNA, 13 nt, Mycobacterium tuberculosis H37Rv
ugaaggcgccggu

SEQ ID NO: 3351413 - RNA, 21 nt, Mycobacterium tuberculosis H37Rv
ugaaggcggcgauacccaucg

SEQ ID NO: 3351414 - RNA, 22 nt, Mycobacterium tuberculosis H37Rv
ugaagggccgccucgcggauga

SEQ ID NO: 3351415 - RNA, 17 nt, Mycobacterium tuberculosis H37Rv
ugaaggucaccgucgag

SEQ ID NO: 3351416 - RNA, 13 nt, Mycobacterium tuberculosis H37Rv
ugaaguggcacaa

SEQ ID NO: 3351417 - RNA, 15 nt, Mycobacterium tuberculosis H37Rv
ugaaguuggcguggu

SEQ ID NO: 3351418 - RNA, 23 nt, Mycobacterium tuberculosis H37Rv
ugaauaggaagguugaacgccgc

SEQ ID NO: 3351419 - RNA, 21 nt, Mycobacterium tuberculosis H37Rv
ugaauccggcauacaucgccu

SEQ ID NO: 3351420 - RNA, 21 nt, Mycobacterium tuberculosis H37Rv
ugaaucgcgucgagagaacgu

SEQ ID NO: 3351421 - RNA, 20 nt, Mycobacterium tuberculosis H37Rv
ugaaugcuugcgcagcaccg

SEQ ID NO: 3351422 - RNA, 13 nt, Mycobacterium tuberculosis H37Rv
ugaauggcagcac

SEQ ID NO: 3351423 - RNA, 14 nt, Mycobacterium tuberculosis H37Rv
ugaauggcagcacg

SEQ ID NO: 3351424 - RNA, 15 nt, Mycobacterium tuberculosis H37Rv
ugaauguugccgccg

SEQ ID NO: 3351425 - RNA, 13 nt, Mycobacterium tuberculosis H37Rv
ugaauugcgcgcc

SEQ ID NO: 3351426 - RNA, 17 nt, Mycobacterium tuberculosis H37Rv
ugaauuuccccgguagc

SEQ ID NO: 3351427 - RNA, 17 nt, Mycobacterium tuberculosis H37Rv
ugaauuucgaugaggug

SEQ ID NO: 3351428 - RNA, 21 nt, Mycobacterium tuberculosis H37Rv
ugaauuuggugaagccguaga

SEQ ID NO: 3351429 - RNA, 16 nt, Mycobacterium tuberculosis H37Rv
ugacaaagaagugguc

SEQ ID NO: 3351430 - RNA, 13 nt, Mycobacterium tuberculosis H37Rv
ugacacaacaccg

SEQ ID NO: 3351431 - RNA, 14 nt, Mycobacterium tuberculosis H37Rv
ugacacaccgcguc

SEQ ID NO: 3351432 - RNA, 21 nt, Mycobacterium tuberculosis H37Rv
ugacaccagggggcgagagcg

SEQ ID NO: 3351433 - RNA, 17 nt, Mycobacterium tuberculosis H37Rv
ugacacccacggcgcca

SEQ ID NO: 3351434 - RNA, 23 nt, Mycobacterium tuberculosis H37Rv
ugacacccacggcgccaccaccg

SEQ ID NO: 3351435 - RNA, 23 nt, Mycobacterium tuberculosis H37Rv
ugacacccaucgaccgcccgcca

SEQ ID NO: 3351436 - RNA, 16 nt, Mycobacterium tuberculosis H37Rv
ugacgaacccaccgug

SEQ ID NO: 3351437 - RNA, 20 nt, Mycobacterium tuberculosis H37Rv
ugacgaauugguugcccuug

SEQ ID NO: 3351438 - RNA, 18 nt, Mycobacterium tuberculosis H37Rv
ugacgacaaacggcgacc

SEQ ID NO: 3351439 - RNA, 19 nt, Mycobacterium tuberculosis H37Rv
ugacgaccggcuaccggcg

SEQ ID NO: 3351440 - RNA, 19 nt, Mycobacterium tuberculosis H37Rv
ugacgacgcgacacgccga

SEQ ID NO: 3351441 - RNA, 12 nt, Mycobacterium tuberculosis H37Rv
ugacgacggcau

SEQ ID NO: 3351442 - RNA, 20 nt, Mycobacterium tuberculosis H37Rv
ugacgagacgacgaccggcu

SEQ ID NO: 3351443 - RNA, 23 nt, Mycobacterium tuberculosis H37Rv
ugacgagccgguggcgugggcac

SEQ ID NO: 3351444 - RNA, 19 nt, Mycobacterium tuberculosis H37Rv
ugacgaucagcgugaucug

SEQ ID NO: 3351445 - RNA, 15 nt, Mycobacterium tuberculosis H37Rv
ugacgaucaggucgc

SEQ ID NO: 3351446 - RNA, 18 nt, Mycobacterium tuberculosis H37Rv
ugacgaucgagcugacga

SEQ ID NO: 3351447 - RNA, 13 nt, Mycobacterium tuberculosis H37Rv
ugacgaucgcggc

SEQ ID NO: 3351448 - RNA, 12 nt, Mycobacterium tuberculosis H37Rv
ugacgaugccgc

SEQ ID NO: 3351449 - RNA, 21 nt, Mycobacterium tuberculosis H37Rv
ugacgaugguguacugcugcu

SEQ ID NO: 3351450 - RNA, 22 nt, Mycobacterium tuberculosis H37Rv
ugacgauucgagcaacugcucg

SEQ ID NO: 3351451 - RNA, 14 nt, Mycobacterium tuberculosis H37Rv
ugacgauugccacc

SEQ ID NO: 3351452 - RNA, 21 nt, Mycobacterium tuberculosis H37Rv
ugacgauuuccaugcugggga

SEQ ID NO: 3351453 - RNA, 16 nt, Mycobacterium tuberculosis H37Rv
ugacgcacgacugugc

SEQ ID NO: 3351454 - RNA, 22 nt, Mycobacterium tuberculosis H37Rv
ugacgcacgacugugcgccgca

SEQ ID NO: 3351455 - RNA, 13 nt, Mycobacterium tuberculosis H37Rv
ugacgccaacgug

SEQ ID NO: 3351456 - RNA, 23 nt, Mycobacterium tuberculosis H37Rv
ugacgccauucaucggcaucgac

SEQ ID NO: 3351457 - RNA, 14 nt, Mycobacterium tuberculosis H37Rv
ugacgccgagcugg

SEQ ID NO: 3351458 - RNA, 15 nt, Mycobacterium tuberculosis H37Rv
ugacgccguugccgc

SEQ ID NO: 3351459 - RNA, 16 nt, Mycobacterium tuberculosis H37Rv
ugacgccucgacaccc

SEQ ID NO: 3351460 - RNA, 15 nt, Mycobacterium tuberculosis H37Rv
ugacgcgccguaaca

SEQ ID NO: 3351461 - RNA, 14 nt, Mycobacterium tuberculosis H37Rv
ugacgcgcgccgga

SEQ ID NO: 3351462 - RNA, 18 nt, Mycobacterium tuberculosis H37Rv
ugacgcgcgccggauaca

SEQ ID NO: 3351463 - RNA, 15 nt, Mycobacterium tuberculosis H37Rv
ugacgcggccgggcg

SEQ ID NO: 3351464 - RNA, 20 nt, Mycobacterium tuberculosis H37Rv
ugacgcgucagcggcgagca

SEQ ID NO: 3351465 - RNA, 22 nt, Mycobacterium tuberculosis H37Rv
ugacgcguucaacaccgccgac

SEQ ID NO: 3351466 - RNA, 15 nt, Mycobacterium tuberculosis H37Rv
ugacgcuaacgucga

SEQ ID NO: 3351467 - RNA, 17 nt, Mycobacterium tuberculosis H37Rv
ugacgcucggucgccac

SEQ ID NO: 3351468 - RNA, 18 nt, Mycobacterium tuberculosis H37Rv
ugacggcgcaacaccucg

SEQ ID NO: 3351469 - RNA, 15 nt, Mycobacterium tuberculosis H37Rv
ugacggcgccaggca

SEQ ID NO: 3351470 - RNA, 20 nt, Mycobacterium tuberculosis H37Rv
ugacggcgccaggcaccacg

SEQ ID NO: 3351471 - RNA, 18 nt, Mycobacterium tuberculosis H37Rv
ugacggcggggcggcggu

SEQ ID NO: 3351472 - RNA, 17 nt, Mycobacterium tuberculosis H37Rv
ugacggcgucgaccucg

SEQ ID NO: 3351473 - RNA, 19 nt, Mycobacterium tuberculosis H37Rv
ugacggggcugaccgccac

SEQ ID NO: 3351474 - RNA, 20 nt, Mycobacterium tuberculosis H37Rv
ugacgggguugaccgccacc

SEQ ID NO: 3351475 - RNA, 18 nt, Mycobacterium tuberculosis H37Rv
ugacgguacagcuccaca

SEQ ID NO: 3351476 - RNA, 16 nt, Mycobacterium tuberculosis H37Rv
ugacgguccccagguc

SEQ ID NO: 3351477 - RNA, 20 nt, Mycobacterium tuberculosis H37Rv
ugacggugaauucacgaugc

SEQ ID NO: 3351478 - RNA, 15 nt, Mycobacterium tuberculosis H37Rv
ugacggugcaggacc

SEQ ID NO: 3351479 - RNA, 19 nt, Mycobacterium tuberculosis H37Rv
ugacgguguacucgaagcg

SEQ ID NO: 3351480 - RNA, 14 nt, Mycobacterium tuberculosis H37Rv
ugacgguuccgguc

SEQ ID NO: 3351481 - RNA, 20 nt, Mycobacterium tuberculosis H37Rv
ugacgguugccccggcgacc

SEQ ID NO: 3351482 - RNA, 20 nt, Mycobacterium tuberculosis H37Rv
ugacgguuugcggagcaaga

SEQ ID NO: 3351483 - RNA, 19 nt, Mycobacterium tuberculosis H37Rv
ugacguagaagucgaucgc

SEQ ID NO: 3351484 - RNA, 12 nt, Mycobacterium tuberculosis H37Rv
ugacguagacgg

SEQ ID NO: 3351485 - RNA, 17 nt, Mycobacterium tuberculosis H37Rv
ugacguagugcaccgcc

SEQ ID NO: 3351486 - RNA, 19 nt, Mycobacterium tuberculosis H37Rv
ugacguagugcaccgccug

SEQ ID NO: 3351487 - RNA, 23 nt, Mycobacterium tuberculosis H37Rv
ugacgucaagagugcucagcgcg

SEQ ID NO: 3351488 - RNA, 19 nt, Mycobacterium tuberculosis H37Rv
ugacgucacguucggcgca

SEQ ID NO: 3351489 - RNA, 15 nt, Mycobacterium tuberculosis H37Rv
ugacguccaacagcg

SEQ ID NO: 3351490 - RNA, 16 nt, Mycobacterium tuberculosis H37Rv
ugacguccaacagcgc

SEQ ID NO: 3351491 - RNA, 15 nt, Mycobacterium tuberculosis H37Rv
ugacguccagggcca

SEQ ID NO: 3351492 - RNA, 16 nt, Mycobacterium tuberculosis H37Rv
ugacgucgucggccaa

SEQ ID NO: 3351493 - RNA, 16 nt, Mycobacterium tuberculosis H37Rv
ugacgucgucggugcg

SEQ ID NO: 3351494 - RNA, 20 nt, Mycobacterium tuberculosis H37Rv
ugacgucgucggugcgccac

SEQ ID NO: 3351495 - RNA, 12 nt, Mycobacterium tuberculosis H37Rv
ugacgugcauga

SEQ ID NO: 3351496 - RNA, 14 nt, Mycobacterium tuberculosis H37Rv
ugacguugugccuu

SEQ ID NO: 3351497 - RNA, 19 nt, Mycobacterium tuberculosis H37Rv
ugacguuguuggauccggc

SEQ ID NO: 3351498 - RNA, 21 nt, Mycobacterium tuberculosis H37Rv
ugacucagaacguggccguua

SEQ ID NO: 3351499 - RNA, 20 nt, Mycobacterium tuberculosis H37Rv
ugacuccugcggcaccgcug

SEQ ID NO: 3351500 - RNA, 21 nt, Mycobacterium tuberculosis H37Rv
ugacucgaucaccaugaugua

SEQ ID NO: 3351501 - RNA, 17 nt, Mycobacterium tuberculosis H37Rv
ugacucgcuccgaccgg

SEQ ID NO: 3351502 - RNA, 17 nt, Mycobacterium tuberculosis H37Rv
ugacucggccuccgccg

SEQ ID NO: 3351503 - RNA, 18 nt, Mycobacterium tuberculosis H37Rv
ugacucugcguccaccac

SEQ ID NO: 3351504 - RNA, 17 nt, Mycobacterium tuberculosis H37Rv
ugacucugcguccaccg

SEQ ID NO: 3351505 - RNA, 19 nt, Mycobacterium tuberculosis H37Rv
ugacucugcguccaccgga

SEQ ID NO: 3351506 - RNA, 16 nt, Mycobacterium tuberculosis H37Rv
ugacugaacucaacac

SEQ ID NO: 3351507 - RNA, 19 nt, Mycobacterium tuberculosis H37Rv
ugacugcacaccaccgccg

SEQ ID NO: 3351508 - RNA, 14 nt, Mycobacterium tuberculosis H37Rv
ugacugcgaccggu

SEQ ID NO: 3351509 - RNA, 15 nt, Mycobacterium tuberculosis H37Rv
ugagacaaaggugcc

SEQ ID NO: 3351510 - RNA, 20 nt, Mycobacterium tuberculosis H37Rv
ugagacaaaggugccgaccg

SEQ ID NO: 3351511 - RNA, 14 nt, Mycobacterium tuberculosis H37Rv
ugagacgccgucga

SEQ ID NO: 3351512 - RNA, 13 nt, Mycobacterium tuberculosis H37Rv
ugagacucgcucg

SEQ ID NO: 3351513 - RNA, 22 nt, Mycobacterium tuberculosis H37Rv
ugagacugccgccgcuuucgcc

SEQ ID NO: 3351514 - RNA, 16 nt, Mycobacterium tuberculosis H37Rv
ugagacugggcgcugg

SEQ ID NO: 3351515 - RNA, 12 nt, Mycobacterium tuberculosis H37Rv
ugagagaugguc

SEQ ID NO: 3351516 - RNA, 20 nt, Mycobacterium tuberculosis H37Rv
ugagaucgcccgaguugaag

SEQ ID NO: 3351517 - RNA, 23 nt, Mycobacterium tuberculosis H37Rv
ugagaucgcccgaguugaagaag

SEQ ID NO: 3351518 - RNA, 18 nt, Mycobacterium tuberculosis H37Rv
ugagcaaaauggccaccg

SEQ ID NO: 3351519 - RNA, 21 nt, Mycobacterium tuberculosis H37Rv
ugagcaaaauggccaccggcg

SEQ ID NO: 3351520 - RNA, 16 nt, Mycobacterium tuberculosis H37Rv
ugagcaaguccugcag

SEQ ID NO: 3351521 - RNA, 20 nt, Mycobacterium tuberculosis H37Rv
ugagcaaguccugcagcugg

SEQ ID NO: 3351522 - RNA, 21 nt, Mycobacterium tuberculosis H37Rv
ugagcaaugacccgcggguga

SEQ ID NO: 3351523 - RNA, 19 nt, Mycobacterium tuberculosis H37Rv
ugagcacaccgacagcacc

SEQ ID NO: 3351524 - RNA, 12 nt, Mycobacterium tuberculosis H37Rv
ugagcaccagca

SEQ ID NO: 3351525 - RNA, 16 nt, Mycobacterium tuberculosis H37Rv
ugagcaccagcagcac

SEQ ID NO: 3351526 - RNA, 18 nt, Mycobacterium tuberculosis H37Rv
ugagcaccagcagcacca

SEQ ID NO: 3351527 - RNA, 23 nt, Mycobacterium tuberculosis H37Rv
ugagcacccgauaguucuggccc

SEQ ID NO: 3351528 - RNA, 22 nt, Mycobacterium tuberculosis H37Rv
ugagcacgauauugggauacuc

SEQ ID NO: 3351529 - RNA, 22 nt, Mycobacterium tuberculosis H37Rv
ugagcacgcgcaacucgccacg

SEQ ID NO: 3351530 - RNA, 17 nt, Mycobacterium tuberculosis H37Rv
ugagcagacccgugccg

SEQ ID NO: 3351531 - RNA, 19 nt, Mycobacterium tuberculosis H37Rv
ugagcagcgggacauccag

SEQ ID NO: 3351532 - RNA, 12 nt, Mycobacterium tuberculosis H37Rv
ugagcaucaccg

SEQ ID NO: 3351533 - RNA, 13 nt, Mycobacterium tuberculosis H37Rv
ugagcaugcccag

SEQ ID NO: 3351534 - RNA, 23 nt, Mycobacterium tuberculosis H37Rv
ugagcaugcccagcgcacggacc

SEQ ID NO: 3351535 - RNA, 14 nt, Mycobacterium tuberculosis H37Rv
ugagcaugcgacgu

SEQ ID NO: 3351536 - RNA, 15 nt, Mycobacterium tuberculosis H37Rv
ugagcaugucgucgu

SEQ ID NO: 3351537 - RNA, 16 nt, Mycobacterium tuberculosis H37Rv
ugagccaccaacaccg

SEQ ID NO: 3351538 - RNA, 19 nt, Mycobacterium tuberculosis H37Rv
ugagccaccaacaccgcgu

SEQ ID NO: 3351539 - RNA, 15 nt, Mycobacterium tuberculosis H37Rv
ugagccaugccgcuc

SEQ ID NO: 3351540 - RNA, 16 nt, Mycobacterium tuberculosis H37Rv
ugagcccggggagacg

SEQ ID NO: 3351541 - RNA, 19 nt, Mycobacterium tuberculosis H37Rv
ugagcccguugaccugcgc

SEQ ID NO: 3351542 - RNA, 20 nt, Mycobacterium tuberculosis H37Rv
ugagcccguugaccugcgca

SEQ ID NO: 3351543 - RNA, 19 nt, Mycobacterium tuberculosis H37Rv
ugagccgcagcaccucguc

SEQ ID NO: 3351544 - RNA, 20 nt, Mycobacterium tuberculosis H37Rv
ugagccgccccggcauacuc

SEQ ID NO: 3351545 - RNA, 21 nt, Mycobacterium tuberculosis H37Rv
ugagccgcgaaaucaccgcug

SEQ ID NO: 3351546 - RNA, 23 nt, Mycobacterium tuberculosis H37Rv
ugagccgcgaaaucaccgcugag

SEQ ID NO: 3351547 - RNA, 21 nt, Mycobacterium tuberculosis H37Rv
ugagccgcucaucgaucccgu

SEQ ID NO: 3351548 - RNA, 23 nt, Mycobacterium tuberculosis H37Rv
ugagccgggugcgagcgacaccg

SEQ ID NO: 3351549 - RNA, 19 nt, Mycobacterium tuberculosis H37Rv
ugagccggucuugcaucgc

SEQ ID NO: 3351550 - RNA, 15 nt, Mycobacterium tuberculosis H37Rv
ugagccgguggcccg

SEQ ID NO: 3351551 - RNA, 18 nt, Mycobacterium tuberculosis H37Rv
ugagcgaacccgcguuga

SEQ ID NO: 3351552 - RNA, 22 nt, Mycobacterium tuberculosis H37Rv
ugagcgaacgccagugaacgcg

SEQ ID NO: 3351553 - RNA, 21 nt, Mycobacterium tuberculosis H37Rv
ugagcgaccgcgagggccagc

SEQ ID NO: 3351554 - RNA, 21 nt, Mycobacterium tuberculosis H37Rv
ugagcgagcgcgcguagcggg

SEQ ID NO: 3351555 - RNA, 19 nt, Mycobacterium tuberculosis H37Rv
ugagcgccaggccgcacag

SEQ ID NO: 3351556 - RNA, 21 nt, Mycobacterium tuberculosis H37Rv
ugagcgccaggccgcacagca

SEQ ID NO: 3351557 - RNA, 13 nt, Mycobacterium tuberculosis H37Rv
ugagcgccgaugu

SEQ ID NO: 3351558 - RNA, 19 nt, Mycobacterium tuberculosis H37Rv
ugagcgccgauguggccgg

SEQ ID NO: 3351559 - RNA, 23 nt, Mycobacterium tuberculosis H37Rv
ugagcgccgcuaauggauccagc

SEQ ID NO: 3351560 - RNA, 21 nt, Mycobacterium tuberculosis H37Rv
ugagcgccggcaucgcgcaac

SEQ ID NO: 3351561 - RNA, 16 nt, Mycobacterium tuberculosis H37Rv
ugagcgcgcuggccag

SEQ ID NO: 3351562 - RNA, 17 nt, Mycobacterium tuberculosis H37Rv
ugagcgcgcuggccagc

SEQ ID NO: 3351563 - RNA, 20 nt, Mycobacterium tuberculosis H37Rv
ugagcgcggcgacaaucgag

SEQ ID NO: 3351564 - RNA, 20 nt, Mycobacterium tuberculosis H37Rv
ugagcgcggcuacggucgca

SEQ ID NO: 3351565 - RNA, 21 nt, Mycobacterium tuberculosis H37Rv
ugagcgcggguggcagcggcg

SEQ ID NO: 3351566 - RNA, 17 nt, Mycobacterium tuberculosis H37Rv
ugagcgcugcgccgaag

SEQ ID NO: 3351567 - RNA, 22 nt, Mycobacterium tuberculosis H37Rv
ugagcggagcaauuccacgauc

SEQ ID NO: 3351568 - RNA, 20 nt, Mycobacterium tuberculosis H37Rv
ugagcggcagccaagcgagc

SEQ ID NO: 3351569 - RNA, 21 nt, Mycobacterium tuberculosis H37Rv
ugagcggccaccguagccagc

SEQ ID NO: 3351570 - RNA, 16 nt, Mycobacterium tuberculosis H37Rv
ugagcggccagcaucg

SEQ ID NO: 3351571 - RNA, 14 nt, Mycobacterium tuberculosis H37Rv
ugagcggccggcau

SEQ ID NO: 3351572 - RNA, 19 nt, Mycobacterium tuberculosis H37Rv
ugagcgggcaacugcagca

SEQ ID NO: 3351573 - RNA, 17 nt, Mycobacterium tuberculosis H37Rv
ugagcgguaccccccag

SEQ ID NO: 3351574 - RNA, 19 nt, Mycobacterium tuberculosis H37Rv
ugagcguaguaggcagccu

SEQ ID NO: 3351575 - RNA, 15 nt, Mycobacterium tuberculosis H37Rv
ugagcgugucgagcg

SEQ ID NO: 3351576 - RNA, 18 nt, Mycobacterium tuberculosis H37Rv
ugagcuacucacggugau

SEQ ID NO: 3351577 - RNA, 14 nt, Mycobacterium tuberculosis H37Rv
ugagcuagaccgcu

SEQ ID NO: 3351578 - RNA, 20 nt, Mycobacterium tuberculosis H37Rv
ugaggacuugcacgucggcu

SEQ ID NO: 3351579 - RNA, 14 nt, Mycobacterium tuberculosis H37Rv
ugaggaucagcgug

SEQ ID NO: 3351580 - RNA, 21 nt, Mycobacterium tuberculosis H37Rv
ugaggccggugaacgguagca

SEQ ID NO: 3351581 - RNA, 13 nt, Mycobacterium tuberculosis H37Rv
ugaggccgucgaa

SEQ ID NO: 3351582 - RNA, 21 nt, Mycobacterium tuberculosis H37Rv
ugaggccgucgaacgguagca

SEQ ID NO: 3351583 - RNA, 15 nt, Mycobacterium tuberculosis H37Rv
ugagguagccgaggu

SEQ ID NO: 3351584 - RNA, 18 nt, Mycobacterium tuberculosis H37Rv
ugagguagccgaggucgc

SEQ ID NO: 3351585 - RNA, 22 nt, Mycobacterium tuberculosis H37Rv
ugagguaggacucacgcagcgc

SEQ ID NO: 3351586 - RNA, 14 nt, Mycobacterium tuberculosis H37Rv
ugagguaucccggu

SEQ ID NO: 3351587 - RNA, 22 nt, Mycobacterium tuberculosis H37Rv
ugaggucuuugcucucggucug

SEQ ID NO: 3351588 - RNA, 17 nt, Mycobacterium tuberculosis H37Rv
ugaggugaucggaagaa

SEQ ID NO: 3351589 - RNA, 16 nt, Mycobacterium tuberculosis H37Rv
ugagguucaucgccgg

SEQ ID NO: 3351590 - RNA, 15 nt, Mycobacterium tuberculosis H37Rv
ugaguaacacguggg

SEQ ID NO: 3351591 - RNA, 14 nt, Mycobacterium tuberculosis H37Rv
ugaguagguccacg

SEQ ID NO: 3351592 - RNA, 13 nt, Mycobacterium tuberculosis H37Rv
ugagucacccggc

SEQ ID NO: 3351593 - RNA, 23 nt, Mycobacterium tuberculosis H37Rv
ugaguccagccggcgcgccggau

SEQ ID NO: 3351594 - RNA, 20 nt, Mycobacterium tuberculosis H37Rv
ugaguccccaggugggcagc

SEQ ID NO: 3351595 - RNA, 16 nt, Mycobacterium tuberculosis H37Rv
ugaguccgcugagcgg

SEQ ID NO: 3351596 - RNA, 21 nt, Mycobacterium tuberculosis H37Rv
ugagucuuucccgccaccaaa

SEQ ID NO: 3351597 - RNA, 16 nt, Mycobacterium tuberculosis H37Rv
ugagugaccacgcugc

SEQ ID NO: 3351598 - RNA, 22 nt, Mycobacterium tuberculosis H37Rv
ugagugcggacaucguugaccc

SEQ ID NO: 3351599 - RNA, 23 nt, Mycobacterium tuberculosis H37Rv
ugagugcgucucgguggcugcgc

SEQ ID NO: 3351600 - RNA, 19 nt, Mycobacterium tuberculosis H37Rv
ugaguguguuugaguugcc

SEQ ID NO: 3351601 - RNA, 18 nt, Mycobacterium tuberculosis H37Rv
ugaguucggccaccaacc

SEQ ID NO: 3351602 - RNA, 19 nt, Mycobacterium tuberculosis H37Rv
ugaguugcccguucaugcg

SEQ ID NO: 3351603 - RNA, 15 nt, Mycobacterium tuberculosis H37Rv
ugaguuucggcgcau

SEQ ID NO: 3351604 - RNA, 15 nt, Mycobacterium tuberculosis H37Rv
ugauagcggcgcagc

SEQ ID NO: 3351605 - RNA, 17 nt, Mycobacterium tuberculosis H37Rv
ugauaggcgcgcaguga

SEQ ID NO: 3351606 - RNA, 13 nt, Mycobacterium tuberculosis H37Rv
ugauagggcuguc

SEQ ID NO: 3351607 - RNA, 14 nt, Mycobacterium tuberculosis H37Rv
ugauauccggaacc

SEQ ID NO: 3351608 - RNA, 20 nt, Mycobacterium tuberculosis H37Rv
ugauauccggaaccggucag

SEQ ID NO: 3351609 - RNA, 15 nt, Mycobacterium tuberculosis H37Rv
ugauauccguacagu

SEQ ID NO: 3351610 - RNA, 22 nt, Mycobacterium tuberculosis H37Rv
ugaucaaacuaccgaacagugg

SEQ ID NO: 3351611 - RNA, 14 nt, Mycobacterium tuberculosis H37Rv
ugaucaaccggaca

SEQ ID NO: 3351612 - RNA, 20 nt, Mycobacterium tuberculosis H37Rv
ugaucaacuuccgcagcgcc

SEQ ID NO: 3351613 - RNA, 13 nt, Mycobacterium tuberculosis H37Rv
ugaucacaccgag

SEQ ID NO: 3351614 - RNA, 16 nt, Mycobacterium tuberculosis H37Rv
ugaucacaccgagcgc

SEQ ID NO: 3351615 - RNA, 15 nt, Mycobacterium tuberculosis H37Rv
ugaucacauucagca

SEQ ID NO: 3351616 - RNA, 13 nt, Mycobacterium tuberculosis H37Rv
ugaucaccaaccc

SEQ ID NO: 3351617 - RNA, 16 nt, Mycobacterium tuberculosis H37Rv
ugaucaccgacaccgu

SEQ ID NO: 3351618 - RNA, 21 nt, Mycobacterium tuberculosis H37Rv
ugaucaccgggcccgacgcgu

SEQ ID NO: 3351619 - RNA, 14 nt, Mycobacterium tuberculosis H37Rv
ugaucaccgucgua

SEQ ID NO: 3351620 - RNA, 18 nt, Mycobacterium tuberculosis H37Rv
ugaucaggccccacacga

SEQ ID NO: 3351621 - RNA, 17 nt, Mycobacterium tuberculosis H37Rv
ugaucagugccaggugg

SEQ ID NO: 3351622 - RNA, 13 nt, Mycobacterium tuberculosis H37Rv
ugaucaucccggc

SEQ ID NO: 3351623 - RNA, 12 nt, Mycobacterium tuberculosis H37Rv
ugaucaugaacg

SEQ ID NO: 3351624 - RNA, 21 nt, Mycobacterium tuberculosis H37Rv
ugaucaugaacgccagcagcg

SEQ ID NO: 3351625 - RNA, 12 nt, Mycobacterium tuberculosis H37Rv
ugauccagucga

SEQ ID NO: 3351626 - RNA, 19 nt, Mycobacterium tuberculosis H37Rv
ugauccccguugacccaga

SEQ ID NO: 3351627 - RNA, 15 nt, Mycobacterium tuberculosis H37Rv
ugauccgcaccccau

SEQ ID NO: 3351628 - RNA, 18 nt, Mycobacterium tuberculosis H37Rv
ugcacaaccgcugcugcu

SEQ ID NO: 3351629 - RNA, 21 nt, Mycobacterium tuberculosis H37Rv
ugcacacagaggucggucagc

SEQ ID NO: 3351630 - RNA, 13 nt, Mycobacterium tuberculosis H37Rv
ugcacacaggacu

SEQ ID NO: 3351631 - RNA, 12 nt, Mycobacterium tuberculosis H37Rv
ugcacaccaccg

SEQ ID NO: 3351632 - RNA, 23 nt, Mycobacterium tuberculosis H37Rv
ugcacacccgcaaugaccgcgga

SEQ ID NO: 3351633 - RNA, 13 nt, Mycobacterium tuberculosis H37Rv
ugcacaccggcac

SEQ ID NO: 3351634 - RNA, 16 nt, Mycobacterium tuberculosis H37Rv
ugcacacugguggugc

SEQ ID NO: 3351635 - RNA, 21 nt, Mycobacterium tuberculosis H37Rv
ugcacagacacggcagcugca

SEQ ID NO: 3351636 - RNA, 15 nt, Mycobacterium tuberculosis H37Rv
ugcacagacagacag

SEQ ID NO: 3351637 - RNA, 15 nt, Mycobacterium tuberculosis H37Rv
ugcacagcagcguca

SEQ ID NO: 3351638 - RNA, 21 nt, Mycobacterium tuberculosis H37Rv
ugcacagccgggcucucggua

SEQ ID NO: 3351639 - RNA, 17 nt, Mycobacterium tuberculosis H37Rv
ugcacaggauuggccgc

SEQ ID NO: 3351640 - RNA, 18 nt, Mycobacterium tuberculosis H37Rv
ugcacaggcaucguccgc

SEQ ID NO: 3351641 - RNA, 15 nt, Mycobacterium tuberculosis H37Rv
ugcacaggccgacga

SEQ ID NO: 3351642 - RNA, 22 nt, Mycobacterium tuberculosis H37Rv
ugcacaggucagcgcugccacc

SEQ ID NO: 3351643 - RNA, 15 nt, Mycobacterium tuberculosis H37Rv
ugcacauucagcgcc

SEQ ID NO: 3351644 - RNA, 12 nt, Mycobacterium tuberculosis H37Rv
ugcaccagcuca

SEQ ID NO: 3351645 - RNA, 13 nt, Mycobacterium tuberculosis H37Rv
ugcaccagcucac

SEQ ID NO: 3351646 - RNA, 20 nt, Mycobacterium tuberculosis H37Rv
ugcaccagcucacccggagc

SEQ ID NO: 3351647 - RNA, 21 nt, Mycobacterium tuberculosis H37Rv
ugcaccagcucacccggagca

SEQ ID NO: 3351648 - RNA, 16 nt, Mycobacterium tuberculosis H37Rv
ugcaccauucgcaccg

SEQ ID NO: 3351649 - RNA, 20 nt, Mycobacterium tuberculosis H37Rv
ugcacccacaucaccaaaaa

SEQ ID NO: 3351650 - RNA, 20 nt, Mycobacterium tuberculosis H37Rv
ugcacccaccccgaagaugc

SEQ ID NO: 3351651 - RNA, 13 nt, Mycobacterium tuberculosis H37Rv
ugcaccccaugac

SEQ ID NO: 3351652 - RNA, 16 nt, Mycobacterium tuberculosis H37Rv
ugcaccgaagauggcc

SEQ ID NO: 3351653 - RNA, 18 nt, Mycobacterium tuberculosis H37Rv
ugcaccgaagauggccag

SEQ ID NO: 3351654 - RNA, 16 nt, Mycobacterium tuberculosis H37Rv
ugcaccgccgccgccc

SEQ ID NO: 3351655 - RNA, 13 nt, Mycobacterium tuberculosis H37Rv
ugcaccgcggcca

SEQ ID NO: 3351656 - RNA, 22 nt, Mycobacterium tuberculosis H37Rv
ugcaccgcggccagcaccagcu

SEQ ID NO: 3351657 - RNA, 20 nt, Mycobacterium tuberculosis H37Rv
ugcaccggcuugggccaggc

SEQ ID NO: 3351658 - RNA, 21 nt, Mycobacterium tuberculosis H37Rv
ugcaccggcuugggccaggcc

SEQ ID NO: 3351659 - RNA, 12 nt, Mycobacterium tuberculosis H37Rv
ugcaccgucguc

SEQ ID NO: 3351660 - RNA, 15 nt, Mycobacterium tuberculosis H37Rv
ugcaccuccgacggc

SEQ ID NO: 3351661 - RNA, 20 nt, Mycobacterium tuberculosis H37Rv
ugcaccuccgacggccgcgg

SEQ ID NO: 3351662 - RNA, 16 nt, Mycobacterium tuberculosis H37Rv
ugcaccuucuccaccg

SEQ ID NO: 3351663 - RNA, 21 nt, Mycobacterium tuberculosis H37Rv
ugcacgacaucgucgcgacga

SEQ ID NO: 3351664 - RNA, 19 nt, Mycobacterium tuberculosis H37Rv
ugcacgacgacaucgagcc

SEQ ID NO: 3351665 - RNA, 16 nt, Mycobacterium tuberculosis H37Rv
ugcacgacgguguccg

SEQ ID NO: 3351666 - RNA, 15 nt, Mycobacterium tuberculosis H37Rv
ugcacgcacagcccg

SEQ ID NO: 3351667 - RNA, 18 nt, Mycobacterium tuberculosis H37Rv
ugcacgcaccacaaucca

SEQ ID NO: 3351668 - RNA, 18 nt, Mycobacterium tuberculosis H37Rv
ugcacgcccagcgucugu

SEQ ID NO: 3351669 - RNA, 15 nt, Mycobacterium tuberculosis H37Rv
ugcacgccgauaccg

SEQ ID NO: 3351670 - RNA, 22 nt, Mycobacterium tuberculosis H37Rv
ugcacgccgauaccgugcaccu

SEQ ID NO: 3351671 - RNA, 17 nt, Mycobacterium tuberculosis H37Rv
ugcacgccgguggucac

SEQ ID NO: 3351672 - RNA, 18 nt, Mycobacterium tuberculosis H37Rv
ugcacgcgauggccauca

SEQ ID NO: 3351673 - RNA, 16 nt, Mycobacterium tuberculosis H37Rv
ugcacgcgcucgcgca

SEQ ID NO: 3351674 - RNA, 19 nt, Mycobacterium tuberculosis H37Rv
ugcacgcggacaugacagc

SEQ ID NO: 3351675 - RNA, 22 nt, Mycobacterium tuberculosis H37Rv
ugcacgcucugcgccacagcag

SEQ ID NO: 3351676 - RNA, 14 nt, Mycobacterium tuberculosis H37Rv
ugcacgcugcgggu

SEQ ID NO: 3351677 - RNA, 24 nt, Mycobacterium tuberculosis H37Rv
ugcacggacaguuccccgggcucg

SEQ ID NO: 3351678 - RNA, 20 nt, Mycobacterium tuberculosis H37Rv
ugcacggccgagcagguucc

SEQ ID NO: 3351679 - RNA, 12 nt, Mycobacterium tuberculosis H37Rv
ugcacggccggg

SEQ ID NO: 3351680 - RNA, 14 nt, Mycobacterium tuberculosis H37Rv
ugcacggccgucau

SEQ ID NO: 3351681 - RNA, 16 nt, Mycobacterium tuberculosis H37Rv
ugcacggcgcugacga

SEQ ID NO: 3351682 - RNA, 22 nt, Mycobacterium tuberculosis H37Rv
ugcacggcuuuucgacgcugug

SEQ ID NO: 3351683 - RNA, 19 nt, Mycobacterium tuberculosis H37Rv
ugcacggggaccuuggcga

SEQ ID NO: 3351684 - RNA, 16 nt, Mycobacterium tuberculosis H37Rv
ugcacggucaugccgc

SEQ ID NO: 3351685 - RNA, 21 nt, Mycobacterium tuberculosis H37Rv
ugcacggucaugccgccgccg

SEQ ID NO: 3351686 - RNA, 22 nt, Mycobacterium tuberculosis H37Rv
ugcacggucaugccgccgccga

SEQ ID NO: 3351687 - RNA, 13 nt, Mycobacterium tuberculosis H37Rv
ugcacgucagcgg

SEQ ID NO: 3351688 - RNA, 12 nt, Mycobacterium tuberculosis H37Rv
ugcacgugaccc

SEQ ID NO: 3351689 - RNA, 18 nt, Mycobacterium tuberculosis H37Rv
ugcacgugacccuggggu

SEQ ID NO: 3351690 - RNA, 15 nt, Mycobacterium tuberculosis H37Rv
ugcacuacaggguug

SEQ ID NO: 3351691 - RNA, 21 nt, Mycobacterium tuberculosis H37Rv
ugcacugcugguugaugaagg

SEQ ID NO: 3351692 - RNA, 20 nt, Mycobacterium tuberculosis H37Rv
ugcagaaacagccgcagcgg

SEQ ID NO: 3351693 - RNA, 21 nt, Mycobacterium tuberculosis H37Rv
ugcagacaggcggcggccugg

SEQ ID NO: 3351694 - RNA, 18 nt, Mycobacterium tuberculosis H37Rv
ugcagaccuguccggcau

SEQ ID NO: 3351695 - RNA, 13 nt, Mycobacterium tuberculosis H37Rv
ugcagacgggugg

SEQ ID NO: 3351696 - RNA, 15 nt, Mycobacterium tuberculosis H37Rv
ugcagaucacgggug

SEQ ID NO: 3351697 - RNA, 18 nt, Mycobacterium tuberculosis H37Rv
ugcagaucgccccagcca

SEQ ID NO: 3351698 - RNA, 12 nt, Mycobacterium tuberculosis H37Rv
ugcagaucggcc

SEQ ID NO: 3351699 - RNA, 15 nt, Mycobacterium tuberculosis H37Rv
ugcagaucggccgga

SEQ ID NO: 3351700 - RNA, 22 nt, Mycobacterium tuberculosis H37Rv
ugcagaucggccggauacgggc

SEQ ID NO: 3351701 - RNA, 13 nt, Mycobacterium tuberculosis H37Rv
ugcagaucggcuc

SEQ ID NO: 3351702 - RNA, 16 nt, Mycobacterium tuberculosis H37Rv
ugcagaucguagugcg

SEQ ID NO: 3351703 - RNA, 18 nt, Mycobacterium tuberculosis H37Rv
ugcagcaauugcaccuuc

SEQ ID NO: 3351704 - RNA, 19 nt, Mycobacterium tuberculosis H37Rv
ugcagcaauugcaccuucu

SEQ ID NO: 3351705 - RNA, 18 nt, Mycobacterium tuberculosis H37Rv
ugcagcacccccucggcu

SEQ ID NO: 3351706 - RNA, 16 nt, Mycobacterium tuberculosis H37Rv
ugcagcacgauccagc

SEQ ID NO: 3351707 - RNA, 13 nt, Mycobacterium tuberculosis H37Rv
ugcagcacggcuu

SEQ ID NO: 3351708 - RNA, 21 nt, Mycobacterium tuberculosis H37Rv
ugcagcacuuccaagccgacc

SEQ ID NO: 3351709 - RNA, 13 nt, Mycobacterium tuberculosis H37Rv
ugcagcagcgcgc

SEQ ID NO: 3351710 - RNA, 23 nt, Mycobacterium tuberculosis H37Rv
ugcagccagauucauuggccugg

SEQ ID NO: 3351711 - RNA, 13 nt, Mycobacterium tuberculosis H37Rv
ugcagccccacuu

SEQ ID NO: 3351712 - RNA, 14 nt, Mycobacterium tuberculosis H37Rv
ugcagcccgccgcu

SEQ ID NO: 3351713 - RNA, 22 nt, Mycobacterium tuberculosis H37Rv
ugcagcccgccggauccgccag

SEQ ID NO: 3351714 - RNA, 21 nt, Mycobacterium tuberculosis H37Rv
ugcagcccgggcagcaccagc

SEQ ID NO: 3351715 - RNA, 14 nt, Mycobacterium tuberculosis H37Rv
ugcagcccugcgca

SEQ ID NO: 3351716 - RNA, 18 nt, Mycobacterium tuberculosis H37Rv
ugcagcccugcgcagccg

SEQ ID NO: 3351717 - RNA, 13 nt, Mycobacterium tuberculosis H37Rv
ugcagccgaccga

SEQ ID NO: 3351718 - RNA, 22 nt, Mycobacterium tuberculosis H37Rv
ugcagccgaccgaaucagcacg

SEQ ID NO: 3351719 - RNA, 19 nt, Mycobacterium tuberculosis H37Rv
ugcagccgggaaaucucgg

SEQ ID NO: 3351720 - RNA, 21 nt, Mycobacterium tuberculosis H37Rv
ugcagcgaaacaccggccagc

SEQ ID NO: 3351721 - RNA, 23 nt, Mycobacterium tuberculosis H37Rv
ugcagcgaaaugccggugccggg

SEQ ID NO: 3351722 - RNA, 10 nt, Mycobacterium tuberculosis H37Rv
ugcagcgacg

SEQ ID NO: 3351723 - RNA, 15 nt, Mycobacterium tuberculosis H37Rv
ugcagcgcacgcagc

SEQ ID NO: 3351724 - RNA, 22 nt, Neisseria meningitidis MC58
aaaaccccgucauucccgcgca

SEQ ID NO: 3351725 - RNA, 23 nt, Neisseria meningitidis MC58
aaacagcaacccgaaacagcaac

SEQ ID NO: 3351726 - RNA, 13 nt, Neisseria meningitidis MC58
aaaccccgucauu

SEQ ID NO: 3351727 - RNA, 13 nt, Neisseria meningitidis MC58
aaagcagguuuuc

SEQ ID NO: 3351728 - RNA, 23 nt, Neisseria meningitidis MC58
aaauuccuguugcuuuucauuuc

SEQ ID NO: 3351729 - RNA, 22 nt, Neisseria meningitidis MC58
aacaaaaaucaggacaaggcga

SEQ ID NO: 3351730 - RNA, 22 nt, Neisseria meningitidis MC58
aacagcaacuuaaaaccccguc

SEQ ID NO: 3351731 - RNA, 12 nt, Neisseria meningitidis MC58
aacccaaagccu

SEQ ID NO: 3351732 - RNA, 14 nt, Neisseria meningitidis MC58
aacccaaagccucg

SEQ ID NO: 3351733 - RNA, 20 nt, Neisseria meningitidis MC58
aacuuaaaaccccgucauuc

SEQ ID NO: 3351734 - RNA, 14 nt, Neisseria meningitidis MC58
aagggguaaauccu

SEQ ID NO: 3351735 - RNA, 17 nt, Neisseria meningitidis MC58
aaucaggacaaggcgac

SEQ ID NO: 3351736 - RNA, 15 nt, Neisseria meningitidis MC58
aauccaguccguuca

SEQ ID NO: 3351737 - RNA, 20 nt, Neisseria meningitidis MC58
aaugacgggauauggguuuc

SEQ ID NO: 3351738 - RNA, 15 nt, Neisseria meningitidis MC58
acagaaaugccgucu

SEQ ID NO: 3351739 - RNA, 22 nt, Neisseria meningitidis MC58
accccgucauucccgcgcaggc

SEQ ID NO: 3351740 - RNA, 12 nt, Neisseria meningitidis MC58
accgaaaugccg

SEQ ID NO: 3351741 - RNA, 17 nt, Neisseria meningitidis MC58
accgaaaugccgucauu

SEQ ID NO: 3351742 - RNA, 20 nt, Neisseria meningitidis MC58
accgaaaugccgucauuccc

SEQ ID NO: 3351743 - RNA, 16 nt, Neisseria meningitidis MC58
acggcauauugcuuca

SEQ ID NO: 3351744 - RNA, 17 nt, Neisseria meningitidis MC58
acggcauauugcuucaa

SEQ ID NO: 3351745 - RNA, 18 nt, Neisseria meningitidis MC58
acggcgacagaugcccaa

SEQ ID NO: 3351746 - RNA, 20 nt, Neisseria meningitidis MC58
acuuaaaaccccgucauucc

SEQ ID NO: 3351747 - RNA, 15 nt, Neisseria meningitidis MC58
acuuggugcuucagc

SEQ ID NO: 3351748 - RNA, 14 nt, Neisseria meningitidis MC58
agaaaugccgucug

SEQ ID NO: 3351749 - RNA, 15 nt, Neisseria meningitidis MC58
agccggguauuuucc

SEQ ID NO: 3351750 - RNA, 16 nt, Neisseria meningitidis MC58
agccucgucauuucca

SEQ ID NO: 3351751 - RNA, 16 nt, Neisseria meningitidis MC58
agcuaaggcgaggcaa

SEQ ID NO: 3351752 - RNA, 13 nt, Neisseria meningitidis MC58
aggcaacccaguu

SEQ ID NO: 3351753 - RNA, 22 nt, Neisseria meningitidis MC58
aggucugucgguucaggaacuu

SEQ ID NO: 3351754 - RNA, 21 nt, Neisseria meningitidis MC58
aguucagaauaucggcuucga

SEQ ID NO: 3351755 - RNA, 20 nt, Neisseria meningitidis MC58
auaaauuccuguugcuuuuc

SEQ ID NO: 3351756 - RNA, 14 nt, Neisseria meningitidis MC58
auauggguuuccgu

SEQ ID NO: 3351757 - RNA, 20 nt, Neisseria meningitidis MC58
auauugcuucaaagcagguu

SEQ ID NO: 3351758 - RNA, 16 nt, Neisseria meningitidis MC58
aucaauguaauccauu

SEQ ID NO: 3351759 - RNA, 19 nt, Neisseria meningitidis MC58
auccugugucgggcuucag

SEQ ID NO: 3351760 - RNA, 22 nt, Neisseria meningitidis MC58
augcccuuucuuuaugcuuuuu

SEQ ID NO: 3351761 - RNA, 22 nt, Neisseria meningitidis MC58
augccgucauucccgcgcaggc

SEQ ID NO: 3351762 - RNA, 14 nt, Neisseria meningitidis MC58
augccgucugaaag

SEQ ID NO: 3351763 - RNA, 20 nt, Neisseria meningitidis MC58
auguuuaugccgucugaaac

SEQ ID NO: 3351764 - RNA, 18 nt, Neisseria meningitidis MC58
auucacuuggugcuucag

SEQ ID NO: 3351765 - RNA, 20 nt, Neisseria meningitidis MC58
auucccacuuucgugggaau

SEQ ID NO: 3351766 - RNA, 20 nt, Neisseria meningitidis MC58
auucccacuuuugugggaau

SEQ ID NO: 3351767 - RNA, 20 nt, Neisseria meningitidis MC58
auucccgcgcaggcgggaau

SEQ ID NO: 3351768 - RNA, 20 nt, Neisseria meningitidis MC58
auucuguucccgauguuuau

SEQ ID NO: 3351769 - RNA, 14 nt, Neisseria meningitidis MC58
auuuuccauuuuau

SEQ ID NO: 3351770 - RNA, 20 nt, Neisseria meningitidis MC58
auuuuuauggcugauuaaaa

SEQ ID NO: 3351771 - RNA, 21 nt, Neisseria meningitidis MC58
caaaaaucaggacaaggcgac

SEQ ID NO: 3351772 - RNA, 18 nt, Neisseria meningitidis MC58
caaagccucgucauuucc

SEQ ID NO: 3351773 - RNA, 22 nt, Neisseria meningitidis MC58
caacccgaaacagcaacuuaaa

SEQ ID NO: 3351774 - RNA, 23 nt, Neisseria meningitidis MC58
caacuuaaaaccccgucauuccc

SEQ ID NO: 3351775 - RNA, 22 nt, Neisseria meningitidis MC58
caauguaauccauucuguuccc

SEQ ID NO: 3351776 - RNA, 15 nt, Neisseria meningitidis MC58
cacuuucgugggaau

SEQ ID NO: 3351777 - RNA, 18 nt, Neisseria meningitidis MC58
cagaaaugccgucugaaa

SEQ ID NO: 3351778 - RNA, 23 nt, Neisseria meningitidis MC58
cagaauaucggcuucgaccgcuu

SEQ ID NO: 3351779 - RNA, 20 nt, Neisseria meningitidis MC58
cagauaguacggaaccgauu

SEQ ID NO: 3351780 - RNA, 16 nt, Neisseria meningitidis MC58
cagcaacuuaaaaccc

SEQ ID NO: 3351781 - RNA, 20 nt, Neisseria meningitidis MC58
cagcaacuuaaaaccccguc

SEQ ID NO: 3351782 - RNA, 21 nt, Neisseria meningitidis MC58
cagguuuuccgaggcaaccca

SEQ ID NO: 3351783 - RNA, 17 nt, Neisseria meningitidis MC58
caguuucggucauuucc

SEQ ID NO: 3351784 - RNA, 19 nt, Neisseria meningitidis MC58
caguuucggucauuuccga

SEQ ID NO: 3351785 - RNA, 12 nt, Neisseria meningitidis MC58
cauucuguuccc

SEQ ID NO: 3351786 - RNA, 19 nt, Neisseria meningitidis MC58
cauuuccgauaaauuccug

SEQ ID NO: 3351787 - RNA, 16 nt, Neisseria meningitidis MC58
ccaguccguucaguuu

SEQ ID NO: 3351788 - RNA, 16 nt, Neisseria meningitidis MC58
cccacuuuugugggaa

SEQ ID NO: 3351789 - RNA, 17 nt, Neisseria meningitidis MC58
ccccgucauucccgcgc

SEQ ID NO: 3351790 - RNA, 13 nt, Neisseria meningitidis MC58
cccgcgcaggcgg

SEQ ID NO: 3351791 - RNA, 18 nt, Neisseria meningitidis MC58
cccgucauucccgcgcag

SEQ ID NO: 3351792 - RNA, 21 nt, Neisseria meningitidis MC58
cccugcguucuagauucccac

SEQ ID NO: 3351793 - RNA, 20 nt, Neisseria meningitidis MC58
ccgaaaugccgucauucccg

SEQ ID NO: 3351794 - RNA, 21 nt, Neisseria meningitidis MC58
ccgauucacuuggugcuucag

SEQ ID NO: 3351795 - RNA, 12 nt, Neisseria meningitidis MC58
ccgcgcaggcgg

SEQ ID NO: 3351796 - RNA, 13 nt, Neisseria meningitidis MC58
ccgucauucccgc

SEQ ID NO: 3351797 - RNA, 18 nt, Neisseria meningitidis MC58
ccgucauucccgcgcagg

SEQ ID NO: 3351798 - RNA, 24 nt, Neisseria meningitidis MC58
ccgucugaaacccauccugugucg

SEQ ID NO: 3351799 - RNA, 21 nt, Neisseria meningitidis MC58
ccugcgcgggaaugacggcga

SEQ ID NO: 3351800 - RNA, 15 nt, Neisseria meningitidis MC58
cgaagccgcagacag

SEQ ID NO: 3351801 - RNA, 19 nt, Neisseria meningitidis MC58
cgauguuuaugccgucuga

SEQ ID NO: 3351802 - RNA, 21 nt, Neisseria meningitidis MC58
cgauguuuaugccgucugaaa

SEQ ID NO: 3351803 - RNA, 18 nt, Neisseria meningitidis MC58
cgccuucgcccaguuccu

SEQ ID NO: 3351804 - RNA, 21 nt, Neisseria meningitidis MC58
cggauaaaacgguuucuccaa

SEQ ID NO: 3351805 - RNA, 20 nt, Neisseria meningitidis MC58
cgggaauccaguccguucag

SEQ ID NO: 3351806 - RNA, 16 nt, Neisseria meningitidis MC58
cggguauuuuccauuu

SEQ ID NO: 3351807 - RNA, 18 nt, Neisseria meningitidis MC58
cgucauuuccacaaaaaa

SEQ ID NO: 3351808 - RNA, 13 nt, Neisseria meningitidis MC58
cgucugaaaccca

SEQ ID NO: 3351809 - RNA, 12 nt, Neisseria meningitidis MC58
cgugggaaugac

SEQ ID NO: 3351810 - RNA, 16 nt, Neisseria meningitidis MC58
cguucuagauucccac

SEQ ID NO: 3351811 - RNA, 15 nt, Neisseria meningitidis MC58
cuaaggcgaggcaac

SEQ ID NO: 3351812 - RNA, 16 nt, Neisseria meningitidis MC58
cuauaaaucaauguaa

SEQ ID NO: 3351813 - RNA, 14 nt, Neisseria meningitidis MC58
cucgucauuuccac

SEQ ID NO: 3351814 - RNA, 16 nt, Neisseria meningitidis MC58
cugaaaggguuucaga

SEQ ID NO: 3351815 - RNA, 17 nt, Neisseria meningitidis MC58
cugauuaaaacgaaaau

SEQ ID NO: 3351816 - RNA, 19 nt, Neisseria meningitidis MC58
cugcgcgggaaugacggcg

SEQ ID NO: 3351817 - RNA, 18 nt, Neisseria meningitidis MC58
cugcguucuagauuccca

SEQ ID NO: 3351818 - RNA, 14 nt, Neisseria meningitidis MC58
cugcuuucauguaa

SEQ ID NO: 3351819 - RNA, 23 nt, Neisseria meningitidis MC58
cugcuuucauguaauguccuuug

SEQ ID NO: 3351820 - RNA, 15 nt, Neisseria meningitidis MC58
cuguacugguuuuug

SEQ ID NO: 3351821 - RNA, 15 nt, Neisseria meningitidis MC58
cugucgguucaggaa

SEQ ID NO: 3351822 - RNA, 14 nt, Neisseria meningitidis MC58
cuuaucggauaaaa

SEQ ID NO: 3351823 - RNA, 13 nt, Neisseria meningitidis MC58
cuucgcccaguuc

SEQ ID NO: 3351824 - RNA, 18 nt, Neisseria meningitidis MC58
cuuuauaguggauuaaca

SEQ ID NO: 3351825 - RNA, 21 nt, Neisseria meningitidis MC58
cuuuauaguggauuaacaaaa

SEQ ID NO: 3351826 - RNA, 23 nt, Neisseria meningitidis MC58
cuuuauaguggauuaacaaaaau

SEQ ID NO: 3351827 - RNA, 22 nt, Neisseria meningitidis MC58
cuuuucauuucuggauucccac

SEQ ID NO: 3351828 - RNA, 13 nt, Neisseria meningitidis MC58
gaaaugccgucau

SEQ ID NO: 3351829 - RNA, 13 nt, Neisseria meningitidis MC58
gaaaugccgucug

SEQ ID NO: 3351830 - RNA, 23 nt, Neisseria meningitidis MC58
gacgauagccggguauuuuccau

SEQ ID NO: 3351831 - RNA, 22 nt, Neisseria meningitidis MC58
gacggcauuuuuauggcugauu

SEQ ID NO: 3351832 - RNA, 16 nt, Neisseria meningitidis MC58
gaggauuuccaguugc

SEQ ID NO: 3351833 - RNA, 16 nt, Neisseria meningitidis MC58
gaggcaacccaguuca

SEQ ID NO: 3351834 - RNA, 12 nt, Neisseria meningitidis MC58
gcaacccaguuc

SEQ ID NO: 3351835 - RNA, 21 nt, Neisseria meningitidis MC58
gcaacuuaaaaccccgucauu

SEQ ID NO: 3351836 - RNA, 16 nt, Neisseria meningitidis MC58
gccgucauucccgcgc

SEQ ID NO: 3351837 - RNA, 22 nt, Neisseria meningitidis MC58
gccgucauucccgcgcaggcgg

SEQ ID NO: 3351838 - RNA, 15 nt, Neisseria meningitidis MC58
gccuucgcccaguuc

SEQ ID NO: 3351839 - RNA, 16 nt, Neisseria meningitidis MC58
gcugauuaaaacgaaa

SEQ ID NO: 3351840 - RNA, 13 nt, Neisseria meningitidis MC58
gcuucagacggca

SEQ ID NO: 3351841 - RNA, 14 nt, Neisseria meningitidis MC58
gcuucagacggcau

SEQ ID NO: 3351842 - RNA, 23 nt, Neisseria meningitidis MC58
ggcaacgcuguacugguuuuugu

SEQ ID NO: 3351843 - RNA, 16 nt, Neisseria meningitidis MC58
gucauucccgcgcagg

SEQ ID NO: 3351844 - RNA, 17 nt, Neisseria meningitidis MC58
gucgggcuucagacggc

SEQ ID NO: 3351845 - RNA, 11 nt, Neisseria meningitidis MC58
gugggaaugac

SEQ ID NO: 3351846 - RNA, 15 nt, Neisseria meningitidis MC58
guucuagauucccac

SEQ ID NO: 3351847 - RNA, 23 nt, Neisseria meningitidis MC58
guuuaugccgucugaaacccauc

SEQ ID NO: 3351848 - RNA, 13 nt, Neisseria meningitidis MC58
guuucagacggca

SEQ ID NO: 3351849 - RNA, 18 nt, Neisseria meningitidis MC58
uaaaaccccgucauuccc

SEQ ID NO: 3351850 - RNA, 22 nt, Neisseria meningitidis MC58
uaauccacuauaaaucaaugua

SEQ ID NO: 3351851 - RNA, 23 nt, Neisseria meningitidis MC58
uacagauaguacggaaccgauuc

SEQ ID NO: 3351852 - RNA, 20 nt, Neisseria meningitidis MC58
uaguggauuaacaaaaauca

SEQ ID NO: 3351853 - RNA, 20 nt, Neisseria meningitidis MC58
uauaaaucaauguaauccau

SEQ ID NO: 3351854 - RNA, 15 nt, Neisseria meningitidis MC58
uaugccgucugaaac

SEQ ID NO: 3351855 - RNA, 16 nt, Neisseria meningitidis MC58
ucacaacccaaagccu

SEQ ID NO: 3351856 - RNA, 18 nt, Neisseria meningitidis MC58
ucacuuggugcuucagca

SEQ ID NO: 3351857 - RNA, 14 nt, Neisseria meningitidis MC58
ucagacggcauauu

SEQ ID NO: 3351858 - RNA, 17 nt, Neisseria meningitidis MC58
ucagacggcauuuuuau

SEQ ID NO: 3351859 - RNA, 18 nt, Neisseria meningitidis MC58
ucauuuccgauaaauucc

SEQ ID NO: 3351860 - RNA, 16 nt, Neisseria meningitidis MC58
ucauuucuggauuccc

SEQ ID NO: 3351861 - RNA, 20 nt, Neisseria meningitidis MC58
uccaacccugcguucuagau

SEQ ID NO: 3351862 - RNA, 21 nt, Neisseria meningitidis MC58
ucccacuuucgugggaaugac

SEQ ID NO: 3351863 - RNA, 20 nt, Neisseria meningitidis MC58
uccgccugcgcgggaaugac

SEQ ID NO: 3351864 - RNA, 14 nt, Neisseria meningitidis MC58
uccucacaacccaa

SEQ ID NO: 3351865 - RNA, 19 nt, Neisseria meningitidis MC58
uccugugucgggcuucaga

SEQ ID NO: 3351866 - RNA, 13 nt, Neisseria meningitidis MC58
ucgcccaguuccu

SEQ ID NO: 3351867 - RNA, 13 nt, Neisseria meningitidis MC58
ucgucauuuccac

SEQ ID NO: 3351868 - RNA, 18 nt, Neisseria meningitidis MC58
ucgucauuuccacaaaaa

SEQ ID NO: 3351869 - RNA, 21 nt, Neisseria meningitidis MC58
aaaacgguuucuccaacccug

SEQ ID NO: 3351870 - RNA, 15 nt, Neisseria meningitidis MC58
aaacgaaaaugagac

SEQ ID NO: 3351871 - RNA, 16 nt, Neisseria meningitidis MC58
aaaugccgucauuccc

SEQ ID NO: 3351872 - RNA, 15 nt, Neisseria meningitidis MC58
aaaugccgucugaaa

SEQ ID NO: 3351873 - RNA, 19 nt, Neisseria meningitidis MC58
aacccaaagccucgucauu

SEQ ID NO: 3351874 - RNA, 21 nt, Neisseria meningitidis MC58
aacccaaagccucgucauuuc

SEQ ID NO: 3351875 - RNA, 18 nt, Neisseria meningitidis MC58
aacuuaaaaccccgucau

SEQ ID NO: 3351876 - RNA, 16 nt, Neisseria meningitidis MC58
aagccucgucauuucc

SEQ ID NO: 3351877 - RNA, 14 nt, Neisseria meningitidis MC58
aaggcgaggcaacg

SEQ ID NO: 3351878 - RNA, 20 nt, Neisseria meningitidis MC58
aauccaguccguucaguuuc

SEQ ID NO: 3351879 - RNA, 22 nt, Neisseria meningitidis MC58
aauccaguccguucaguuucgg

SEQ ID NO: 3351880 - RNA, 19 nt, Neisseria meningitidis MC58
aaucuaggucugucgguuc

SEQ ID NO: 3351881 - RNA, 20 nt, Neisseria meningitidis MC58
aaucuaggucugucgguuca

SEQ ID NO: 3351882 - RNA, 18 nt, Neisseria meningitidis MC58
aaugacggcggaaggggu

SEQ ID NO: 3351883 - RNA, 17 nt, Neisseria meningitidis MC58
aaugacgggauaugggu

SEQ ID NO: 3351884 - RNA, 15 nt, Neisseria meningitidis MC58
aaugccgucauuccc

SEQ ID NO: 3351885 - RNA, 19 nt, Neisseria meningitidis MC58
aaugccgucugaaaggguu

SEQ ID NO: 3351886 - RNA, 17 nt, Neisseria meningitidis MC58
acagaaaugccgucuga

SEQ ID NO: 3351887 - RNA, 20 nt, Neisseria meningitidis MC58
acagaaaugccgucugaaag

SEQ ID NO: 3351888 - RNA, 19 nt, Neisseria meningitidis MC58
acagcaacuuaaaaccccg

SEQ ID NO: 3351889 - RNA, 20 nt, Neisseria meningitidis MC58
acccaaagccucgucauuuc

SEQ ID NO: 3351890 - RNA, 23 nt, Neisseria meningitidis MC58
acccauccugugucgggcuucag

SEQ ID NO: 3351891 - RNA, 17 nt, Neisseria meningitidis MC58
acccgaaacagcaacuu

SEQ ID NO: 3351892 - RNA, 17 nt, Neisseria meningitidis MC58
acccugcguucuagauu

SEQ ID NO: 3351893 - RNA, 18 nt, Neisseria meningitidis MC58
accgaaaugccgucauuc

SEQ ID NO: 3351894 - RNA, 19 nt, Neisseria meningitidis MC58
accgaaaugccgucauucc

SEQ ID NO: 3351895 - RNA, 21 nt, Neisseria meningitidis MC58
accgauucacuuggugcuuca

SEQ ID NO: 3351896 - RNA, 14 nt, Neisseria meningitidis MC58
acggcauaugcccu

SEQ ID NO: 3351897 - RNA, 14 nt, Neisseria meningitidis MC58
acggcauauugcuu

SEQ ID NO: 3351898 - RNA, 22 nt, Neisseria meningitidis MC58
acggcggaagggguaaauccuc

SEQ ID NO: 3351899 - RNA, 12 nt, Neisseria meningitidis MC58
acggucuuuaua

SEQ ID NO: 3351900 - RNA, 19 nt, Neisseria meningitidis MC58
acuuaaaaccccgucauuc

SEQ ID NO: 3351901 - RNA, 22 nt, Neisseria meningitidis MC58
acuuaaaaccccgucauucccg

SEQ ID NO: 3351902 - RNA, 14 nt, Neisseria meningitidis MC58
acuuggugcuucag

SEQ ID NO: 3351903 - RNA, 13 nt, Neisseria meningitidis MC58
agaaaugccgucu

SEQ ID NO: 3351904 - RNA, 17 nt, Neisseria meningitidis MC58
agaaaugccgucugaaa

SEQ ID NO: 3351905 - RNA, 13 nt, Neisseria meningitidis MC58
agauucccacuuu

SEQ ID NO: 3351906 - RNA, 13 nt, Neisseria meningitidis MC58
agcaacuuaaaac

SEQ ID NO: 3351907 - RNA, 18 nt, Neisseria meningitidis MC58
agcuaaggcgaggcaacg

SEQ ID NO: 3351908 - RNA, 19 nt, Neisseria meningitidis MC58
aggcaacgcuguacugguu

SEQ ID NO: 3351909 - RNA, 13 nt, Neisseria meningitidis MC58
aggguuucagacg

SEQ ID NO: 3351910 - RNA, 17 nt, Neisseria meningitidis MC58
aguggauuaacaaaaau

SEQ ID NO: 3351911 - RNA, 17 nt, Neisseria meningitidis MC58
aguuucggucauuuccg

SEQ ID NO: 3351912 - RNA, 16 nt, Neisseria meningitidis MC58
auaguggauuaacaaa

SEQ ID NO: 3351913 - RNA, 19 nt, Neisseria meningitidis MC58
auaguggauuaacaaaaau

SEQ ID NO: 3351914 - RNA, 19 nt, Neisseria meningitidis MC58
auaugcccuuucuuuaugc

SEQ ID NO: 3351915 - RNA, 20 nt, Neisseria meningitidis MC58
auccugugucgggcuucaga

SEQ ID NO: 3351916 - RNA, 18 nt, Neisseria meningitidis MC58
aucggauaaaacgguuuc

SEQ ID NO: 3351917 - RNA, 13 nt, Neisseria meningitidis MC58
augccgucugaaa

SEQ ID NO: 3351918 - RNA, 14 nt, Neisseria meningitidis MC58
augccgucugaaac

SEQ ID NO: 3351919 - RNA, 15 nt, Neisseria meningitidis MC58
auguuuaugccgucu

SEQ ID NO: 3351920 - RNA, 12 nt, Neisseria meningitidis MC58
auuaacaaaaau

SEQ ID NO: 3351921 - RNA, 14 nt, Neisseria meningitidis MC58
auuuccacaaaaaa

SEQ ID NO: 3351922 - RNA, 20 nt, Neisseria meningitidis MC58
auuuccacaaaaaacagcaa

SEQ ID NO: 3351923 - RNA, 17 nt, Neisseria meningitidis MC58
auuuccgauaaauuccu

SEQ ID NO: 3351924 - RNA, 20 nt, Neisseria meningitidis MC58
auuuccgccugcgcgggaau

SEQ ID NO: 3351925 - RNA, 19 nt, Neisseria meningitidis MC58
auuucuggauucccacuuu

SEQ ID NO: 3351926 - RNA, 13 nt, Neisseria meningitidis MC58
auuuuccauuuua

SEQ ID NO: 3351927 - RNA, 15 nt, Neisseria meningitidis MC58
ucuagauucccacuu

SEQ ID NO: 3351928 - RNA, 14 nt, Neisseria meningitidis MC58
ucuggauucccacu

SEQ ID NO: 3351929 - RNA, 18 nt, Neisseria meningitidis MC58
ugccgggguuggcgauuu

SEQ ID NO: 3351930 - RNA, 13 nt, Neisseria meningitidis MC58
ugccgucugaaag

SEQ ID NO: 3351931 - RNA, 22 nt, Neisseria meningitidis MC58
ugcguccggcguuugacagaaa

SEQ ID NO: 3351932 - RNA, 17 nt, Neisseria meningitidis MC58
ugcguucuagauuccca

SEQ ID NO: 3351933 - RNA, 17 nt, Neisseria meningitidis MC58
uggauuaacaaaaauca

SEQ ID NO: 3351934 - RNA, 21 nt, Neisseria meningitidis MC58
uggauuaacaaaaaucaggac

SEQ ID NO: 3351935 - RNA, 11 nt, Neisseria meningitidis MC58
uggauucccac

SEQ ID NO: 3351936 - RNA, 13 nt, Neisseria meningitidis MC58
uggcgauuuugac

SEQ ID NO: 3351937 - RNA, 19 nt, Neisseria meningitidis MC58
uggcgauuuugaccccgua

SEQ ID NO: 3351938 - RNA, 20 nt, Neisseria meningitidis MC58
uuaaaaccccgucauucccg

SEQ ID NO: 3351939 - RNA, 20 nt, Neisseria meningitidis MC58
uuauaguggauuaacaaaaa

SEQ ID NO: 3351940 - RNA, 13 nt, Neisseria meningitidis MC58
uucagacggcaua

SEQ ID NO: 3351941 - RNA, 13 nt, Neisseria meningitidis MC58
uucagacggcauu

SEQ ID NO: 3351942 - RNA, 18 nt, Neisseria meningitidis MC58
uuccgaggcaacccaguu

SEQ ID NO: 3351943 - RNA, 14 nt, Neisseria meningitidis MC58
uuccucgaggauuu

SEQ ID NO: 3351944 - RNA, 20 nt, Neisseria meningitidis MC58
uucuagauucccacuuucgu

SEQ ID NO: 3351945 - RNA, 18 nt, Neisseria meningitidis MC58
uucuggauucccacuuuu

SEQ ID NO: 3351946 - RNA, 15 nt, Neisseria meningitidis MC58
uugacagaaaugccg

SEQ ID NO: 3351947 - RNA, 18 nt, Neisseria meningitidis MC58
uugccgcgaccgaaaugc

SEQ ID NO: 3351948 - RNA, 14 nt, Neisseria meningitidis MC58
uuuacggcauaugc

SEQ ID NO: 3351949 - RNA, 22 nt, Neisseria meningitidis MC58
uuuauaguggauuaacaaaaau

SEQ ID NO: 3351950 - RNA, 13 nt, Neisseria meningitidis MC58
uuucagacggcau

SEQ ID NO: 3351951 - RNA, 17 nt, Neisseria meningitidis MC58
uuucagacggcauuuuu

SEQ ID NO: 3351952 - RNA, 13 nt, Neisseria meningitidis MC58
uuuccacaaaaaa

SEQ ID NO: 3351953 - RNA, 15 nt, Neisseria meningitidis MC58
uuucuggauucccac

SEQ ID NO: 3351954 - RNA, 16 nt, Neisseria meningitidis MC58
uuucuggauucccacu

SEQ ID NO: 3351955 - RNA, 21 nt, Neisseria meningitidis MC58
uuugccgcgaccgaaaugccg

SEQ ID NO: 3351956 - RNA, 21 nt, Neisseria meningitidis MC58
uuuugccgcgaccgaaaugcc

SEQ ID NO: 3351957 - RNA, 21 nt, Neisseria meningitidis MC58
uuuuuguuaauccacuauaaa

SEQ ID NO: 3351958 - RNA, 23 nt, Neisseria meningitidis MC58
auuuuuauggcugauuaaaacga

SEQ ID NO: 3351959 - RNA, 13 nt, Neisseria meningitidis MC58
caaaaaacagcaa

SEQ ID NO: 3351960 - RNA, 16 nt, Neisseria meningitidis MC58
caaaaaacagcaaccc

SEQ ID NO: 3351961 - RNA, 17 nt, Neisseria meningitidis MC58
caaaaaacagcaacccg

SEQ ID NO: 3351962 - RNA, 20 nt, Neisseria meningitidis MC58
caaaaaacagcaacccgaaa

SEQ ID NO: 3351963 - RNA, 12 nt, Neisseria meningitidis MC58
cacaacccaaag

SEQ ID NO: 3351964 - RNA, 17 nt, Neisseria meningitidis MC58
cacaacccaaagccucg

SEQ ID NO: 3351965 - RNA, 19 nt, Neisseria meningitidis MC58
cacaacccaaagccucguc

SEQ ID NO: 3351966 - RNA, 16 nt, Neisseria meningitidis MC58
cacuuucgugggaaug

SEQ ID NO: 3351967 - RNA, 15 nt, Neisseria meningitidis MC58
cacuuuugugggaau

SEQ ID NO: 3351968 - RNA, 16 nt, Neisseria meningitidis MC58
cacuuuugugggaaug

SEQ ID NO: 3351969 - RNA, 13 nt, Neisseria meningitidis MC58
cagacaguacaga

SEQ ID NO: 3351970 - RNA, 10 nt, Neisseria meningitidis MC58
cagacggcau

SEQ ID NO: 3351971 - RNA, 20 nt, Neisseria meningitidis MC58
cagacggcauauugcuucaa

SEQ ID NO: 3351972 - RNA, 18 nt, Neisseria meningitidis MC58
cagguuuuccgaggcaac

SEQ ID NO: 3351973 - RNA, 19 nt, Neisseria meningitidis MC58
cagguuuuccgaggcaacc

SEQ ID NO: 3351974 - RNA, 23 nt, Neisseria meningitidis MC58
cauccugugucgggcuucagacg

SEQ ID NO: 3351975 - RNA, 18 nt, Neisseria meningitidis MC58
cauguaauguccuuugcg

SEQ ID NO: 3351976 - RNA, 23 nt, Neisseria meningitidis MC58
cauucuguucccgauguuuaugc

SEQ ID NO: 3351977 - RNA, 15 nt, Neisseria meningitidis MC58
cauuuccacaaaaaa

SEQ ID NO: 3351978 - RNA, 18 nt, Neisseria meningitidis MC58
cauuuccgauaaauuccu

SEQ ID NO: 3351979 - RNA, 17 nt, Neisseria meningitidis MC58
cauuucuggauucccac

SEQ ID NO: 3351980 - RNA, 23 nt, Neisseria meningitidis MC58
ccaacccugcguucuagauuccc

SEQ ID NO: 3351981 - RNA, 16 nt, Neisseria meningitidis MC58
cccacuuucgugggaa

SEQ ID NO: 3351982 - RNA, 18 nt, Neisseria meningitidis MC58
cccgcgcaggcgggaauc

SEQ ID NO: 3351983 - RNA, 22 nt, Neisseria meningitidis MC58
cccgucauucccgcgcaggcgg

SEQ ID NO: 3351984 - RNA, 19 nt, Neisseria meningitidis MC58
cccugcguucuagauuccc

SEQ ID NO: 3351985 - RNA, 22 nt, Neisseria meningitidis MC58
cccugcguucuagauucccacu

SEQ ID NO: 3351986 - RNA, 21 nt, Neisseria meningitidis MC58
ccucgucauuuccacaaaaaa

SEQ ID NO: 3351987 - RNA, 17 nt, Neisseria meningitidis MC58
cgaaaugccgucauucc

SEQ ID NO: 3351988 - RNA, 20 nt, Neisseria meningitidis MC58
cgaaaugccgucauucccgc

SEQ ID NO: 3351989 - RNA, 15 nt, Neisseria meningitidis MC58
cgaggauuuccaguu

SEQ ID NO: 3351990 - RNA, 15 nt, Neisseria meningitidis MC58
cgccuucgcccaguu

SEQ ID NO: 3351991 - RNA, 19 nt, Neisseria meningitidis MC58
cgcgggaaugacggcgaca

SEQ ID NO: 3351992 - RNA, 16 nt, Neisseria meningitidis MC58
cgggaaugacggcgac

SEQ ID NO: 3351993 - RNA, 16 nt, Neisseria meningitidis MC58
cgucauucccgcgcag

SEQ ID NO: 3351994 - RNA, 16 nt, Neisseria meningitidis MC58
cguguucggauuuccg

SEQ ID NO: 3351995 - RNA, 12 nt, Neisseria meningitidis MC58
cuagauucccac

SEQ ID NO: 3351996 - RNA, 18 nt, Neisseria meningitidis MC58
cugaaaggguuucagacg

SEQ ID NO: 3351997 - RNA, 19 nt, Neisseria meningitidis MC58
cugugucgggcuucagacg

SEQ ID NO: 3351998 - RNA, 20 nt, Neisseria meningitidis MC58
cuuucgugggaaugacggga

SEQ ID NO: 3351999 - RNA, 21 nt, Neisseria meningitidis MC58
cuuuucauuucuggauuccca

SEQ ID NO: 3352000 - RNA, 10 nt, Neisseria meningitidis MC58
gaaacagcaa

SEQ ID NO: 3352001 - RNA, 22 nt, Neisseria meningitidis MC58
gaaacagcaacuuaaaaccccg

SEQ ID NO: 3352002 - RNA, 16 nt, Neisseria meningitidis MC58
gaaaggguuucagacg

SEQ ID NO: 3352003 - RNA, 20 nt, Neisseria meningitidis MC58
gaaaggguuucagacggcau

SEQ ID NO: 3352004 - RNA, 14 nt, Neisseria meningitidis MC58
gaaaugccgucauu

SEQ ID NO: 3352005 - RNA, 23 nt, Neisseria meningitidis MC58
gaaaugccgucauucccgcgcag

SEQ ID NO: 3352006 - RNA, 13 nt, Neisseria meningitidis MC58
gacaguacagaua

SEQ ID NO: 3352007 - RNA, 22 nt, Neisseria meningitidis MC58
gacggcggaagggguaaauccu

SEQ ID NO: 3352008 - RNA, 21 nt, Neisseria meningitidis MC58
gagcaucccugcuuucaugua

SEQ ID NO: 3352009 - RNA, 15 nt, Neisseria meningitidis MC58
gaggcaacccaguuc

SEQ ID NO: 3352010 - RNA, 14 nt, Neisseria meningitidis MC58
gauguuuaugccgu

SEQ ID NO: 3352011 - RNA, 17 nt, Neisseria meningitidis MC58
gauuaacaaaaaucagg

SEQ ID NO: 3352012 - RNA, 16 nt, Neisseria meningitidis MC58
gcaacccaguucagaa

SEQ ID NO: 3352013 - RNA, 12 nt, Neisseria meningitidis MC58
gcagguuuuccg

SEQ ID NO: 3352014 - RNA, 14 nt, Neisseria meningitidis MC58
gcccaacggucuuu

SEQ ID NO: 3352015 - RNA, 21 nt, Neisseria meningitidis MC58
gccgggguuggcgauuuugac

SEQ ID NO: 3352016 - RNA, 14 nt, Neisseria meningitidis MC58
gccgucauucccgc

SEQ ID NO: 3352017 - RNA, 18 nt, Neisseria meningitidis MC58
gccgucauucccgcgcag

SEQ ID NO: 3352018 - RNA, 16 nt, Neisseria meningitidis MC58
gccuucgcccaguucc

SEQ ID NO: 3352019 - RNA, 18 nt, Neisseria meningitidis MC58
gcgaggcaacgcuguacu

SEQ ID NO: 3352020 - RNA, 21 nt, Neisseria meningitidis MC58
gcgcaggcgggaaucuagguc

SEQ ID NO: 3352021 - RNA, 13 nt, Neisseria meningitidis MC58
gcgcgggaaugac

SEQ ID NO: 3352022 - RNA, 18 nt, Neisseria meningitidis MC58
gcgggaaucuaggucugu

SEQ ID NO: 3352023 - RNA, 20 nt, Neisseria meningitidis MC58
gcguuugacagaaaugccgu

SEQ ID NO: 3352024 - RNA, 14 nt, Neisseria meningitidis MC58
gcuuuucauuucug

SEQ ID NO: 3352025 - RNA, 22 nt, Neisseria meningitidis MC58
gcuuuucauuucuggauuccca

SEQ ID NO: 3352026 - RNA, 22 nt, Neisseria meningitidis MC58
ggauuaacaaaaaucaggacaa

SEQ ID NO: 3352027 - RNA, 23 nt, Neisseria meningitidis MC58
ggcauauugcuucaaagcagguu

SEQ ID NO: 3352028 - RNA, 15 nt, Neisseria meningitidis MC58
ggcuucagacggcau

SEQ ID NO: 3352029 - RNA, 14 nt, Neisseria meningitidis MC58
ggguuucagacggc

SEQ ID NO: 3352030 - RNA, 16 nt, Neisseria meningitidis MC58
ggugcuucagcaccuu

SEQ ID NO: 3352031 - RNA, 11 nt, Neisseria meningitidis MC58
gucauuuccac

SEQ ID NO: 3352032 - RNA, 21 nt, Neisseria meningitidis MC58
gucauuuccgauaaauuccug

SEQ ID NO: 3352033 - RNA, 14 nt, Neisseria meningitidis MC58
guggauuaacaaaa

SEQ ID NO: 3352034 - RNA, 19 nt, Neisseria meningitidis MC58
guggauuaacaaaaaucag

SEQ ID NO: 3352035 - RNA, 17 nt, Neisseria meningitidis MC58
gugggaaugacggcgga

SEQ ID NO: 3352036 - RNA, 16 nt, Neisseria meningitidis MC58
guguucggauuuccgc

SEQ ID NO: 3352037 - RNA, 20 nt, Neisseria meningitidis MC58
guuaauccacuauaaaucaa

SEQ ID NO: 3352038 - RNA, 21 nt, Neisseria meningitidis MC58
guuaauccacuauaaaucaau

SEQ ID NO: 3352039 - RNA, 16 nt, Neisseria meningitidis MC58
guucuagauucccacu

SEQ ID NO: 3352040 - RNA, 14 nt, Neisseria meningitidis MC58
guuuaugccgucug

SEQ ID NO: 3352041 - RNA, 14 nt, Neisseria meningitidis MC58
guuucagacggcau

SEQ ID NO: 3352042 - RNA, 16 nt, Neisseria meningitidis MC58
guuucagacggcauuu

SEQ ID NO: 3352043 - RNA, 16 nt, Neisseria meningitidis MC58
guuucggucauuuccg

SEQ ID NO: 3352044 - RNA, 22 nt, Neisseria meningitidis MC58
guuuuccgaggcaacccaguuc

SEQ ID NO: 3352045 - RNA, 14 nt, Neisseria meningitidis MC58
uaaaaccccgucau

SEQ ID NO: 3352046 - RNA, 20 nt, Neisseria meningitidis MC58
uaaaucaauguaauccauuc

SEQ ID NO: 3352047 - RNA, 12 nt, Neisseria meningitidis MC58
uacugguuuuug

SEQ ID NO: 3352048 - RNA, 21 nt, Neisseria meningitidis MC58
uacugguuuuuguuaauccac

SEQ ID NO: 3352049 - RNA, 12 nt, Neisseria meningitidis MC58
uagauucccacu

SEQ ID NO: 3352050 - RNA, 17 nt, Neisseria meningitidis MC58
uaugcccuuucuuuaug

SEQ ID NO: 3352051 - RNA, 15 nt, Neisseria meningitidis MC58
uauuuuccauuuuau

SEQ ID NO: 3352052 - RNA, 19 nt, Neisseria meningitidis MC58
ucaguuucggucauuuccg

SEQ ID NO: 3352053 - RNA, 12 nt, Neisseria meningitidis MC58
ucauuucuggau

SEQ ID NO: 3352054 - RNA, 13 nt, Neisseria meningitidis MC58
uccacaaaaaaca

SEQ ID NO: 3352055 - RNA, 23 nt, Neisseria meningitidis MC58
uccacaaaaaacagcaacccgaa

SEQ ID NO: 3352056 - RNA, 21 nt, Neisseria meningitidis MC58
uccaguugcgaaucgagcauc

SEQ ID NO: 3352057 - RNA, 21 nt, Neisseria meningitidis MC58
ucccacuuuugugggaaugac

SEQ ID NO: 3352058 - RNA, 12 nt, Neisseria meningitidis MC58
uccgaggcaacc

SEQ ID NO: 3352059 - RNA, 19 nt, Neisseria meningitidis MC58
uccgaggcaacccaguuca

SEQ ID NO: 3352060 - RNA, 14 nt, Neisseria meningitidis MC58
ucuagauucccacu

SEQ ID NO: 3352061 - RNA, 23 nt, Neisseria meningitidis MC58
ucuuugagcuaaggcgaggcaac

SEQ ID NO: 3352062 - RNA, 19 nt, Neisseria meningitidis MC58
ugauuaaaacgaaaaugag

SEQ ID NO: 3352063 - RNA, 19 nt, Neisseria meningitidis MC58
ugccgucugaaacccaucc

SEQ ID NO: 3352064 - RNA, 18 nt, Neisseria meningitidis MC58
ugcguucuagauucccac

SEQ ID NO: 3352065 - RNA, 15 nt, Neisseria meningitidis MC58
uggauuaacaaaaau

SEQ ID NO: 3352066 - RNA, 12 nt, Neisseria meningitidis MC58
uggauucccacu

SEQ ID NO: 3352067 - RNA, 22 nt, Neisseria meningitidis MC58
uggcugauuaaaacgaaaauga

SEQ ID NO: 3352068 - RNA, 16 nt, Neisseria meningitidis MC58
ugugggaaugacggcg

SEQ ID NO: 3352069 - RNA, 16 nt, Neisseria meningitidis MC58
ugugucgggcuucaga

SEQ ID NO: 3352070 - RNA, 18 nt, Neisseria meningitidis MC58
uucauuucuggauuccca

SEQ ID NO: 3352071 - RNA, 14 nt, Neisseria meningitidis MC58
uucccacuuucgug

SEQ ID NO: 3352072 - RNA, 12 nt, Neisseria meningitidis MC58
uucccacuuuug

SEQ ID NO: 3352073 - RNA, 14 nt, Neisseria meningitidis MC58
uucccgcgcaggcg

SEQ ID NO: 3352074 - RNA, 20 nt, Neisseria meningitidis MC58
uucccgcgcaggcgggaauc

SEQ ID NO: 3352075 - RNA, 12 nt, Neisseria meningitidis MC58
uucgugggaaug

SEQ ID NO: 3352076 - RNA, 14 nt, Neisseria meningitidis MC58
uuggugcuucagca

SEQ ID NO: 3352077 - RNA, 20 nt, Neisseria meningitidis MC58
uuuauaguggauuaacaaaa

SEQ ID NO: 3352078 - RNA, 22 nt, Neisseria meningitidis MC58
uuucauuucuggauucccacuu

SEQ ID NO: 3352079 - RNA, 12 nt, Neisseria meningitidis MC58
uuugugggaaug

SEQ ID NO: 3352080 - RNA, 16 nt, Neisseria meningitidis MC58
uuuuguuaauccacua

SEQ ID NO: 3352081 - RNA, 11 nt, Neisseria meningitidis Z2491
aaaaaagccag

SEQ ID NO: 3352082 - RNA, 20 nt, Neisseria meningitidis Z2491
aaaaaaucaaaaacacaaaa

SEQ ID NO: 3352083 - RNA, 13 nt, Neisseria meningitidis Z2491
aaaaaauccaaaa

SEQ ID NO: 3352084 - RNA, 11 nt, Neisseria meningitidis Z2491
aaaaaaugccg

SEQ ID NO: 3352085 - RNA, 23 nt, Neisseria meningitidis Z2491
aaaaaaugccgucugaaagguuu

SEQ ID NO: 3352086 - RNA, 13 nt, Neisseria meningitidis Z2491
aaaaaauuuucaa

SEQ ID NO: 3352087 - RNA, 15 nt, Neisseria meningitidis Z2491
aaaaacaaaaaaaau

SEQ ID NO: 3352088 - RNA, 11 nt, Neisseria meningitidis Z2491
aaaaacagaaa

SEQ ID NO: 3352089 - RNA, 20 nt, Neisseria meningitidis Z2491
aaaaacagaaaccuaaaauu

SEQ ID NO: 3352090 - RNA, 21 nt, Neisseria meningitidis Z2491
aaaaacagcaaucaaaauaaa

SEQ ID NO: 3352091 - RNA, 13 nt, Neisseria meningitidis Z2491
aaaaaccggcuca

SEQ ID NO: 3352092 - RNA, 20 nt, Neisseria meningitidis Z2491
aaaaaccggcucaauauauu

SEQ ID NO: 3352093 - RNA, 15 nt, Neisseria meningitidis Z2491
aaaaaccugcuuguu

SEQ ID NO: 3352094 - RNA, 20 nt, Neisseria meningitidis Z2491
aaaaacgacgagaauuuauc

SEQ ID NO: 3352095 - RNA, 22 nt, Neisseria meningitidis Z2491
aaaaacggcacggcgcaggcaa

SEQ ID NO: 3352096 - RNA, 23 nt, Neisseria meningitidis Z2491
aaaaacuuuucugauuuugagaa

SEQ ID NO: 3352097 - RNA, 17 nt, Neisseria meningitidis Z2491
aaaaagaugccgucuga

SEQ ID NO: 3352098 - RNA, 19 nt, Neisseria meningitidis Z2491
aaaaagaugccgucugaaa

SEQ ID NO: 3352099 - RNA, 14 nt, Neisseria meningitidis Z2491
aaaaagccagcagc

SEQ ID NO: 3352100 - RNA, 16 nt, Neisseria meningitidis Z2491
aaaaagccagcagcag

SEQ ID NO: 3352101 - RNA, 19 nt, Neisseria meningitidis Z2491
aaaaagccgccggaagauu

SEQ ID NO: 3352102 - RNA, 16 nt, Neisseria meningitidis Z2491
aaaaagcuggauuccc

SEQ ID NO: 3352103 - RNA, 18 nt, Neisseria meningitidis Z2491
aaaaagguuuucagacgg

SEQ ID NO: 3352104 - RNA, 19 nt, Neisseria meningitidis Z2491
aaaaauaauugucuuuucc

SEQ ID NO: 3352105 - RNA, 13 nt, Neisseria meningitidis Z2491
aaaaauaccgucu

SEQ ID NO: 3352106 - RNA, 20 nt, Neisseria meningitidis Z2491
aaaaauacuuauaucgucau

SEQ ID NO: 3352107 - RNA, 13 nt, Neisseria meningitidis Z2491
aaaaaucaaaaac

SEQ ID NO: 3352108 - RNA, 14 nt, Neisseria meningitidis Z2491
aaaaaucaaaaaca

SEQ ID NO: 3352109 - RNA, 23 nt, Neisseria meningitidis Z2491
aaaaaucuguggauaaacauuau

SEQ ID NO: 3352110 - RNA, 18 nt, Neisseria meningitidis Z2491
aaaaaugacugaagcuca

SEQ ID NO: 3352111 - RNA, 12 nt, Neisseria meningitidis Z2491
aaaaaugccguc

SEQ ID NO: 3352112 - RNA, 13 nt, Neisseria meningitidis Z2491
aaaaaugccgucu

SEQ ID NO: 3352113 - RNA, 16 nt, Neisseria meningitidis Z2491
aaaaaugccgucugaa

SEQ ID NO: 3352114 - RNA, 19 nt, Neisseria meningitidis Z2491
aaaaaugccgucugaaaaa

SEQ ID NO: 3352115 - RNA, 20 nt, Neisseria meningitidis Z2491
aaaaaugccgucugaacccu

SEQ ID NO: 3352116 - RNA, 10 nt, Neisseria meningitidis Z2491
aaaaaugccu

SEQ ID NO: 3352117 - RNA, 21 nt, Neisseria meningitidis Z2491
aaaaaugcuuaaucaaaucuu

SEQ ID NO: 3352118 - RNA, 10 nt, Neisseria meningitidis Z2491
aaaaauuccu

SEQ ID NO: 3352119 - RNA, 17 nt, Neisseria meningitidis Z2491
aaaaauucuaacucuau

SEQ ID NO: 3352120 - RNA, 13 nt, Neisseria meningitidis Z2491
aaaaauuuaugaa

SEQ ID NO: 3352121 - RNA, 15 nt, Neisseria meningitidis Z2491
aaaaauuuauuuaga

SEQ ID NO: 3352122 - RNA, 21 nt, Neisseria meningitidis Z2491
aaaaauuuauuuagaaacaac

SEQ ID NO: 3352123 - RNA, 14 nt, Neisseria meningitidis Z2491
aaaaauuuucagac

SEQ ID NO: 3352124 - RNA, 15 nt, Neisseria meningitidis Z2491
aaaacaaaaaaaauc

SEQ ID NO: 3352125 - RNA, 15 nt, Neisseria meningitidis Z2491
aaaacaaaaaaucaa

SEQ ID NO: 3352126 - RNA, 17 nt, Neisseria meningitidis Z2491
aaaacaaaaaaucaaaa

SEQ ID NO: 3352127 - RNA, 22 nt, Neisseria meningitidis Z2491
aaaacaaaaaaucaaaaacaga

SEQ ID NO: 3352128 - RNA, 11 nt, Neisseria meningitidis Z2491
aaaacaaaaau

SEQ ID NO: 3352129 - RNA, 13 nt, Neisseria meningitidis Z2491
aaaacaaaaauga

SEQ ID NO: 3352130 - RNA, 17 nt, Neisseria meningitidis Z2491
aaaacaaaaugccgucu

SEQ ID NO: 3352131 - RNA, 14 nt, Neisseria meningitidis Z2491
aaaacaaacaggca

SEQ ID NO: 3352132 - RNA, 17 nt, Neisseria meningitidis Z2491
aaaacaaacaggcagcc

SEQ ID NO: 3352133 - RNA, 23 nt, Neisseria meningitidis Z2491
aaaacaaagacaucccccaacca

SEQ ID NO: 3352134 - RNA, 20 nt, Neisseria meningitidis Z2491
aaaacaaaguugcaauauac

SEQ ID NO: 3352135 - RNA, 9 nt, Neisseria meningitidis Z2491
aaaacaaau

SEQ ID NO: 3352136 - RNA, 19 nt, Neisseria meningitidis Z2491
aaaacaacaaugcaaagaa

SEQ ID NO: 3352137 - RNA, 21 nt, Neisseria meningitidis Z2491
aaaacaagcgauuauuuuuua

SEQ ID NO: 3352138 - RNA, 15 nt, Neisseria meningitidis Z2491
aaaacaaugccgucu

SEQ ID NO: 3352139 - RNA, 14 nt, Neisseria meningitidis Z2491
aaaacagaaaacca

SEQ ID NO: 3352140 - RNA, 15 nt, Neisseria meningitidis Z2491
aaaacagaaaaccaa

SEQ ID NO: 3352141 - RNA, 11 nt, Neisseria meningitidis Z2491
aaaacagaaac

SEQ ID NO: 3352142 - RNA, 16 nt, Neisseria meningitidis Z2491
aaaacagaaaccuaaa

SEQ ID NO: 3352143 - RNA, 17 nt, Neisseria meningitidis Z2491
aaaacagaaaccuaaaa

SEQ ID NO: 3352144 - RNA, 17 nt, Neisseria meningitidis Z2491
aaaacagaaaucccaaa

SEQ ID NO: 3352145 - RNA, 14 nt, Neisseria meningitidis Z2491
aaaacagaaauuaa

SEQ ID NO: 3352146 - RNA, 14 nt, Neisseria meningitidis Z2491
aaaacagcaaaaag

SEQ ID NO: 3352147 - RNA, 18 nt, Neisseria meningitidis Z2491
aaaacagcaaccugaaau

SEQ ID NO: 3352148 - RNA, 17 nt, Neisseria meningitidis Z2491
aaaacagccgaaaacag

SEQ ID NO: 3352149 - RNA, 16 nt, Neisseria meningitidis Z2491
aaaacagccgaaaacc

SEQ ID NO: 3352150 - RNA, 18 nt, Neisseria meningitidis Z2491
aaaacagccgaaaaccug

SEQ ID NO: 3352151 - RNA, 22 nt, Neisseria meningitidis Z2491
aaaacaggaaucggguuucaga

SEQ ID NO: 3352152 - RNA, 18 nt, Neisseria meningitidis Z2491
aaaacagguuuaagucaa

SEQ ID NO: 3352153 - RNA, 15 nt, Neisseria meningitidis Z2491
aaaauuucaucauuc

SEQ ID NO: 3352154 - RNA, 17 nt, Neisseria meningitidis Z2491
aaaauuucuugauuuuu

SEQ ID NO: 3352155 - RNA, 23 nt, Neisseria meningitidis Z2491
aaaauuuggcuguauuuuaauaa

SEQ ID NO: 3352156 - RNA, 22 nt, Neisseria meningitidis Z2491
aaaauuuggcuguguuucaaua

SEQ ID NO: 3352157 - RNA, 14 nt, Neisseria meningitidis Z2491
aaaauuuuaugcuc

SEQ ID NO: 3352158 - RNA, 12 nt, Neisseria meningitidis Z2491
aaacaaaaauga

SEQ ID NO: 3352159 - RNA, 21 nt, Neisseria meningitidis Z2491
aaacaaaauaaacucauugag

SEQ ID NO: 3352160 - RNA, 18 nt, Neisseria meningitidis Z2491
aaacaaaaugccgucuga

SEQ ID NO: 3352161 - RNA, 20 nt, Neisseria meningitidis Z2491
aaacaaaaugccgucugaaa

SEQ ID NO: 3352162 - RNA, 20 nt, Neisseria meningitidis Z2491
aaacaaagcuuuaaacuaua

SEQ ID NO: 3352163 - RNA, 14 nt, Neisseria meningitidis Z2491
aaacaacagaaacc

SEQ ID NO: 3352164 - RNA, 16 nt, Neisseria meningitidis Z2491
aaacaacagccguuug

SEQ ID NO: 3352165 - RNA, 21 nt, Neisseria meningitidis Z2491
aaacaagcgauuauuuuuuag

SEQ ID NO: 3352166 - RNA, 21 nt, Neisseria meningitidis Z2491
aaacaaguuuuccggcagcuu

SEQ ID NO: 3352167 - RNA, 17 nt, Neisseria meningitidis Z2491
aaacaaucaguuuuugu

SEQ ID NO: 3352168 - RNA, 18 nt, Neisseria meningitidis Z2491
aaacaaugccgucugaaa

SEQ ID NO: 3352169 - RNA, 13 nt, Neisseria meningitidis Z2491
aaacacgggguuu

SEQ ID NO: 3352170 - RNA, 13 nt, Neisseria meningitidis Z2491
aaacacuguucag

SEQ ID NO: 3352171 - RNA, 22 nt, Neisseria meningitidis Z2491
aaacacuucuucauuacggauu

SEQ ID NO: 3352172 - RNA, 14 nt, Neisseria meningitidis Z2491
aaacagaaaaacaa

SEQ ID NO: 3352173 - RNA, 17 nt, Neisseria meningitidis Z2491
aaacagaaaaacaaugc

SEQ ID NO: 3352174 - RNA, 18 nt, Neisseria meningitidis Z2491
aaacagaaaaccaaaauc

SEQ ID NO: 3352175 - RNA, 16 nt, Neisseria meningitidis Z2491
aaacagaaacccaaaa

SEQ ID NO: 3352176 - RNA, 18 nt, Neisseria meningitidis Z2491
aaacagaaacccaaaauc

SEQ ID NO: 3352177 - RNA, 20 nt, Neisseria meningitidis Z2491
aaacagaaacccaaaaucgg

SEQ ID NO: 3352178 - RNA, 16 nt, Neisseria meningitidis Z2491
aaacagaaaccuaaaa

SEQ ID NO: 3352179 - RNA, 16 nt, Neisseria meningitidis Z2491
aaacagaaagccaaaa

SEQ ID NO: 3352180 - RNA, 21 nt, Neisseria meningitidis Z2491
aaacagacauugcuaaaacaa

SEQ ID NO: 3352181 - RNA, 14 nt, Neisseria meningitidis Z2491
aaacagagugcgua

SEQ ID NO: 3352182 - RNA, 12 nt, Neisseria meningitidis Z2491
aaacagcaaaaa

SEQ ID NO: 3352183 - RNA, 20 nt, Neisseria meningitidis Z2491
aaacagcaggucgacggcaa

SEQ ID NO: 3352184 - RNA, 16 nt, Neisseria meningitidis Z2491
aaacagcguuuucauu

SEQ ID NO: 3352185 - RNA, 17 nt, Neisseria meningitidis Z2491
aaacagcugaaaacagc

SEQ ID NO: 3352186 - RNA, 16 nt, Neisseria meningitidis Z2491
aaacagcugaaaaccu

SEQ ID NO: 3352187 - RNA, 19 nt, Neisseria meningitidis Z2491
aaacaggcagccuaaaaca

SEQ ID NO: 3352188 - RNA, 21 nt, Neisseria meningitidis Z2491
aaacaggcuucagacggcauu

SEQ ID NO: 3352189 - RNA, 19 nt, Neisseria meningitidis Z2491
aaacauaugccgucugaaa

SEQ ID NO: 3352190 - RNA, 16 nt, Neisseria meningitidis Z2491
aaacaucacggucuuu

SEQ ID NO: 3352191 - RNA, 19 nt, Neisseria meningitidis Z2491
aaacaucacggucuuuuug

SEQ ID NO: 3352192 - RNA, 22 nt, Neisseria meningitidis Z2491
aaacaucacggucuuuuugcuu

SEQ ID NO: 3352193 - RNA, 14 nt, Neisseria meningitidis Z2491
aaacaucugauuuu

SEQ ID NO: 3352194 - RNA, 16 nt, Neisseria meningitidis Z2491
aaacaucugccguaug

SEQ ID NO: 3352195 - RNA, 16 nt, Neisseria meningitidis Z2491
aaacauuaucugacag

SEQ ID NO: 3352196 - RNA, 12 nt, Neisseria meningitidis Z2491
aaacauuuugau

SEQ ID NO: 3352197 - RNA, 15 nt, Neisseria meningitidis Z2491
aaacauuuugauugu

SEQ ID NO: 3352198 - RNA, 15 nt, Neisseria meningitidis Z2491
aaaccaaaaaacaac

SEQ ID NO: 3352199 - RNA, 14 nt, Neisseria meningitidis Z2491
aaaccaaaagccaa

SEQ ID NO: 3352200 - RNA, 22 nt, Neisseria meningitidis Z2491
aaaccaaaagccaaaaaacaca

SEQ ID NO: 3352201 - RNA, 16 nt, Neisseria meningitidis Z2491
aaaccaguacggcguu

SEQ ID NO: 3352202 - RNA, 15 nt, Neisseria meningitidis Z2491
aaaccaguacggugu

SEQ ID NO: 3352203 - RNA, 15 nt, Neisseria meningitidis Z2491
aaaccauauggaaaa

SEQ ID NO: 3352204 - RNA, 12 nt, Neisseria meningitidis Z2491
aaacccgaacca

SEQ ID NO: 3352205 - RNA, 22 nt, Neisseria meningitidis Z2491
aaacccgccugagcaaaugccu

SEQ ID NO: 3352206 - RNA, 16 nt, Neisseria meningitidis Z2491
aaacccuccgccucug

SEQ ID NO: 3352207 - RNA, 15 nt, Neisseria meningitidis Z2491
aaaccgaaacagaaa

SEQ ID NO: 3352208 - RNA, 15 nt, Neisseria meningitidis Z2491
aaaccgaaaccgaac

SEQ ID NO: 3352209 - RNA, 14 nt, Neisseria meningitidis Z2491
aaaccgaacggacu

SEQ ID NO: 3352210 - RNA, 15 nt, Neisseria meningitidis Z2491
aaaccgaugccguca

SEQ ID NO: 3352211 - RNA, 19 nt, Neisseria meningitidis Z2491
aaaccgaugggcuucauca

SEQ ID NO: 3352212 - RNA, 14 nt, Neisseria meningitidis Z2491
aaaccgccauuccc

SEQ ID NO: 3352213 - RNA, 14 nt, Neisseria meningitidis Z2491
aaaccgcucccccu

SEQ ID NO: 3352214 - RNA, 17 nt, Neisseria meningitidis Z2491
aaaccggauucccgccu

SEQ ID NO: 3352215 - RNA, 13 nt, Neisseria meningitidis Z2491
aaaccggcauucu

SEQ ID NO: 3352216 - RNA, 19 nt, Neisseria meningitidis Z2491
aaaccggcauucugcacgc

SEQ ID NO: 3352217 - RNA, 19 nt, Neisseria meningitidis Z2491
aaaccggucggaagaucau

SEQ ID NO: 3352218 - RNA, 16 nt, Neisseria meningitidis Z2491
aaaccguauauuuccc

SEQ ID NO: 3352219 - RNA, 21 nt, Neisseria meningitidis Z2491
aaaccguauauuucccgucug

SEQ ID NO: 3352220 - RNA, 22 nt, Neisseria meningitidis Z2491
aaaccguauauuucccgucugc

SEQ ID NO: 3352221 - RNA, 20 nt, Neisseria meningitidis Z2491
aaaccguguuucagacggca

SEQ ID NO: 3352222 - RNA, 21 nt, Neisseria meningitidis Z2491
aaaccguguuucagacggcau

SEQ ID NO: 3352223 - RNA, 22 nt, Neisseria meningitidis Z2491
aaaccguguuucagacggcauu

SEQ ID NO: 3352224 - RNA, 20 nt, Neisseria meningitidis Z2491
aaaccguuucagacggcauu

SEQ ID NO: 3352225 - RNA, 21 nt, Neisseria meningitidis Z2491
aaaccguuucagacggcauuu

SEQ ID NO: 3352226 - RNA, 14 nt, Neisseria meningitidis Z2491
aaaccuaaaauccg

SEQ ID NO: 3352227 - RNA, 19 nt, Neisseria meningitidis Z2491
aaaccugcaccacgucauu

SEQ ID NO: 3352228 - RNA, 13 nt, Neisseria meningitidis Z2491
aaaccugcaucac

SEQ ID NO: 3352229 - RNA, 22 nt, Neisseria meningitidis Z2491
aaaccugcaucacgucauuccu

SEQ ID NO: 3352230 - RNA, 19 nt, Neisseria meningitidis Z2491
aaaccuguuucagacggca

SEQ ID NO: 3352231 - RNA, 12 nt, Neisseria meningitidis Z2491
aaaccuuaucca

SEQ ID NO: 3352232 - RNA, 17 nt, Neisseria meningitidis Z2491
aaaccuuauccauaucc

SEQ ID NO: 3352233 - RNA, 22 nt, Neisseria meningitidis Z2491
aaacgaaaaugccgucugaaaa

SEQ ID NO: 3352234 - RNA, 23 nt, Neisseria meningitidis Z2491
aaacgaauugaaucaugccgcug

SEQ ID NO: 3352235 - RNA, 20 nt, Neisseria meningitidis Z2491
aaacgcauucagacggcauc

SEQ ID NO: 3352236 - RNA, 14 nt, Neisseria meningitidis Z2491
aaacgccagcacaa

SEQ ID NO: 3352237 - RNA, 13 nt, Neisseria meningitidis Z2491
aaacgccgucuga

SEQ ID NO: 3352238 - RNA, 14 nt, Neisseria meningitidis Z2491
aaacgccgucugaa

SEQ ID NO: 3352239 - RNA, 15 nt, Neisseria meningitidis Z2491
aaacgccgucugaaa

SEQ ID NO: 3352240 - RNA, 21 nt, Neisseria meningitidis Z2491
aaacgcggugaggucgucuga

SEQ ID NO: 3352241 - RNA, 17 nt, Neisseria meningitidis Z2491
aaacggacaacggcacu

SEQ ID NO: 3352242 - RNA, 17 nt, Neisseria meningitidis Z2491
aaacggcacggcgcagg

SEQ ID NO: 3352243 - RNA, 12 nt, Neisseria meningitidis Z2491
aaacggcagcag

SEQ ID NO: 3352244 - RNA, 22 nt, Neisseria meningitidis Z2491
aaacggcagcagcuccgaaccg

SEQ ID NO: 3352245 - RNA, 17 nt, Neisseria meningitidis Z2491
aaacggcaggcaaaaaa

SEQ ID NO: 3352246 - RNA, 13 nt, Neisseria meningitidis Z2491
aaacgggaauccg

SEQ ID NO: 3352247 - RNA, 13 nt, Neisseria meningitidis Z2491
aaacgggaaucua

SEQ ID NO: 3352248 - RNA, 19 nt, Neisseria meningitidis Z2491
aaacggguucggacggcau

SEQ ID NO: 3352249 - RNA, 20 nt, Neisseria meningitidis Z2491
aaacggguucggacggcauu

SEQ ID NO: 3352250 - RNA, 23 nt, Neisseria meningitidis Z2491
aaacggguucggacggcauuuuu

SEQ ID NO: 3352251 - RNA, 14 nt, Neisseria meningitidis Z2491
aaacgguaccugau

SEQ ID NO: 3352252 - RNA, 14 nt, Neisseria meningitidis Z2491
aaacggucgaugug

SEQ ID NO: 3352253 - RNA, 12 nt, Neisseria meningitidis Z2491
aaacgguuuuuc

SEQ ID NO: 3352254 - RNA, 18 nt, Neisseria meningitidis Z2491
aaacgucaucgccgcaaa

SEQ ID NO: 3352255 - RNA, 22 nt, Neisseria meningitidis Z2491
aaaucacggugaaaaaugaaaa

SEQ ID NO: 3352256 - RNA, 15 nt, Neisseria meningitidis Z2491
aaaucagaaaaguuu

SEQ ID NO: 3352257 - RNA, 17 nt, Neisseria meningitidis Z2491
aaaucagaaaccuaaaa

SEQ ID NO: 3352258 - RNA, 14 nt, Neisseria meningitidis Z2491
aaaucaggacaagg

SEQ ID NO: 3352259 - RNA, 13 nt, Neisseria meningitidis Z2491
aaaucauccacag

SEQ ID NO: 3352260 - RNA, 14 nt, Neisseria meningitidis Z2491
aaaucauccacagc

SEQ ID NO: 3352261 - RNA, 15 nt, Neisseria meningitidis Z2491
aaaucaucccaaaca

SEQ ID NO: 3352262 - RNA, 19 nt, Neisseria meningitidis Z2491
aaaucaucuucaugccaug

SEQ ID NO: 3352263 - RNA, 12 nt, Neisseria meningitidis Z2491
aaauccaaaaau

SEQ ID NO: 3352264 - RNA, 20 nt, Neisseria meningitidis Z2491
aaauccagcaaugccgucug

SEQ ID NO: 3352265 - RNA, 21 nt, Neisseria meningitidis Z2491
aaaucccauuauuuucacaaa

SEQ ID NO: 3352266 - RNA, 16 nt, Neisseria meningitidis Z2491
aaauccccccuuaauc

SEQ ID NO: 3352267 - RNA, 18 nt, Neisseria meningitidis Z2491
aaauccccccuuaauccu

SEQ ID NO: 3352268 - RNA, 16 nt, Neisseria meningitidis Z2491
aaaucccgucauuccc

SEQ ID NO: 3352269 - RNA, 20 nt, Neisseria meningitidis Z2491
aaaucccuguguccuuauuu

SEQ ID NO: 3352270 - RNA, 15 nt, Neisseria meningitidis Z2491
aaauccgucauuccc

SEQ ID NO: 3352271 - RNA, 11 nt, Neisseria meningitidis Z2491
aaauccuauuu

SEQ ID NO: 3352272 - RNA, 17 nt, Neisseria meningitidis Z2491
aaauccuauuuucagau

SEQ ID NO: 3352273 - RNA, 17 nt, Neisseria meningitidis Z2491
aaauccugcuuauugca

SEQ ID NO: 3352274 - RNA, 19 nt, Neisseria meningitidis Z2491
aaauccuucaccaucggca

SEQ ID NO: 3352275 - RNA, 23 nt, Neisseria meningitidis Z2491
aaaucgacgacgauuaauaccgc

SEQ ID NO: 3352276 - RNA, 13 nt, Neisseria meningitidis Z2491
aaaucggacggau

SEQ ID NO: 3352277 - RNA, 20 nt, Neisseria meningitidis Z2491
aaaucggauaggcaaaaacc

SEQ ID NO: 3352278 - RNA, 14 nt, Neisseria meningitidis Z2491
aaaucggccauucc

SEQ ID NO: 3352279 - RNA, 14 nt, Neisseria meningitidis Z2491
aaaucggcuuucag

SEQ ID NO: 3352280 - RNA, 21 nt, Neisseria meningitidis Z2491
aaaucggcuuucagacggcau

SEQ ID NO: 3352281 - RNA, 23 nt, Neisseria meningitidis Z2491
aaaucgguuccguacuaucugua

SEQ ID NO: 3352282 - RNA, 23 nt, Neisseria meningitidis Z2491
aaaucucguuauccauacaagaa

SEQ ID NO: 3352283 - RNA, 11 nt, Neisseria meningitidis Z2491
aaaucucuugc

SEQ ID NO: 3352284 - RNA, 16 nt, Neisseria meningitidis Z2491
aaaucugauaagcaag

SEQ ID NO: 3352285 - RNA, 17 nt, Neisseria meningitidis Z2491
aaaucuggauuacugau

SEQ ID NO: 3352286 - RNA, 21 nt, Neisseria meningitidis Z2491
aaaucugugaaaaucagggga

SEQ ID NO: 3352287 - RNA, 15 nt, Neisseria meningitidis Z2491
aaaucuuauagggau

SEQ ID NO: 3352288 - RNA, 16 nt, Neisseria meningitidis Z2491
aaaucuugcaaacccc

SEQ ID NO: 3352289 - RNA, 23 nt, Neisseria meningitidis Z2491
aaaucuugccauucucacaaaaa

SEQ ID NO: 3352290 - RNA, 18 nt, Neisseria meningitidis Z2491
aaaugaaaaaugccgucu

SEQ ID NO: 3352291 - RNA, 21 nt, Neisseria meningitidis Z2491
aaaugacugaaacucaaaaaa

SEQ ID NO: 3352292 - RNA, 21 nt, Neisseria meningitidis Z2491
aaaugacugaaacucaacgaa

SEQ ID NO: 3352293 - RNA, 22 nt, Neisseria meningitidis Z2491
aaaugacugaaacucaacgaac

SEQ ID NO: 3352294 - RNA, 19 nt, Neisseria meningitidis Z2491
aaaugacugaaauucaaaa

SEQ ID NO: 3352295 - RNA, 20 nt, Neisseria meningitidis Z2491
aaaugacugaaauucaaaaa

SEQ ID NO: 3352296 - RNA, 21 nt, Neisseria meningitidis Z2491
aaaugacugaaauucaaaaaa

SEQ ID NO: 3352297 - RNA, 17 nt, Neisseria meningitidis Z2491
aaaugcaaaacuuuucu

SEQ ID NO: 3352298 - RNA, 21 nt, Neisseria meningitidis Z2491
aaaugcaaaacuuuucugauu

SEQ ID NO: 3352299 - RNA, 14 nt, Neisseria meningitidis Z2491
aaaugcagaauaag

SEQ ID NO: 3352300 - RNA, 18 nt, Neisseria meningitidis Z2491
aaaugcagaauaaggcaa

SEQ ID NO: 3352301 - RNA, 22 nt, Neisseria meningitidis Z2491
aaaugccgcaaaugccgucuga

SEQ ID NO: 3352302 - RNA, 16 nt, Neisseria meningitidis Z2491
aaaugccgcaaucuca

SEQ ID NO: 3352303 - RNA, 10 nt, Neisseria meningitidis Z2491
aaaugccguc

SEQ ID NO: 3352304 - RNA, 16 nt, Neisseria meningitidis Z2491
aaaugccgucauuccc

SEQ ID NO: 3352305 - RNA, 18 nt, Neisseria meningitidis Z2491
aaaugccgucauucccgc

SEQ ID NO: 3352306 - RNA, 11 nt, Neisseria meningitidis Z2491
aaaugccgucc

SEQ ID NO: 3352307 - RNA, 11 nt, Neisseria meningitidis Z2491
aaaugccgucu

SEQ ID NO: 3352308 - RNA, 14 nt, Neisseria meningitidis Z2491
aaaugccgucugaa

SEQ ID NO: 3352309 - RNA, 21 nt, Neisseria meningitidis Z2491
aaaugccgucugaaaagauau

SEQ ID NO: 3352310 - RNA, 18 nt, Neisseria meningitidis Z2491
aaaugccgucugaaaccu

SEQ ID NO: 3352311 - RNA, 19 nt, Neisseria meningitidis Z2491
aaaugccgucugaaaggcu

SEQ ID NO: 3352312 - RNA, 15 nt, Neisseria meningitidis Z2491
aaaugccgucugaag

SEQ ID NO: 3352313 - RNA, 21 nt, Neisseria meningitidis Z2491
aaaugccgucugaagcccugu

SEQ ID NO: 3352314 - RNA, 18 nt, Neisseria meningitidis Z2491
aaaugccgucugaagccu

SEQ ID NO: 3352315 - RNA, 23 nt, Neisseria meningitidis Z2491
aaaugccgucugaagccuuucag

SEQ ID NO: 3352316 - RNA, 23 nt, Neisseria meningitidis Z2491
aaaugccgucuggaacuugaaaa

SEQ ID NO: 3352317 - RNA, 20 nt, Neisseria meningitidis Z2491
aaaugccuuauccagaaaau

SEQ ID NO: 3352318 - RNA, 19 nt, Neisseria meningitidis Z2491
aaaugcgccuuugccgccu

SEQ ID NO: 3352319 - RNA, 19 nt, Neisseria meningitidis Z2491
aaaugcucccuaucgccgc

SEQ ID NO: 3352320 - RNA, 16 nt, Neisseria meningitidis Z2491
aaaugcugucugaaac

SEQ ID NO: 3352321 - RNA, 20 nt, Neisseria meningitidis Z2491
aaaugcuguucagacggcau

SEQ ID NO: 3352322 - RNA, 23 nt, Neisseria meningitidis Z2491
aaaugugcauuucuaauuuuuau

SEQ ID NO: 3352323 - RNA, 18 nt, Neisseria meningitidis Z2491
aaauguucagacggcauu

SEQ ID NO: 3352324 - RNA, 19 nt, Neisseria meningitidis Z2491
aaauguucagacggcauuu

SEQ ID NO: 3352325 - RNA, 22 nt, Neisseria meningitidis Z2491
aaauguuccuauaguauagugg

SEQ ID NO: 3352326 - RNA, 13 nt, Neisseria meningitidis Z2491
aaauuaaaauaaa

SEQ ID NO: 3352327 - RNA, 14 nt, Neisseria meningitidis Z2491
aaauuaaaauaaaa

SEQ ID NO: 3352328 - RNA, 18 nt, Neisseria meningitidis Z2491
aaauuaaaauaaaaccga

SEQ ID NO: 3352329 - RNA, 21 nt, Neisseria meningitidis Z2491
aaauuaaaauaaaaccgauaa

SEQ ID NO: 3352330 - RNA, 16 nt, Neisseria meningitidis Z2491
aaauuaaauuuuauuu

SEQ ID NO: 3352331 - RNA, 17 nt, Neisseria meningitidis Z2491
aaauuaaauuuuauuua

SEQ ID NO: 3352332 - RNA, 19 nt, Neisseria meningitidis Z2491
aaauuaaauuuuauuuaaa

SEQ ID NO: 3352333 - RNA, 17 nt, Neisseria meningitidis Z2491
aaauuaagcgugacgaa

SEQ ID NO: 3352334 - RNA, 22 nt, Neisseria meningitidis Z2491
aaauuaagcgugacgaaaauuu

SEQ ID NO: 3352335 - RNA, 21 nt, Neisseria meningitidis Z2491
aaauuacccgaaacccaaaaa

SEQ ID NO: 3352336 - RNA, 21 nt, Neisseria meningitidis Z2491
aaauuagacggcaucuuccuu

SEQ ID NO: 3352337 - RNA, 22 nt, Neisseria meningitidis Z2491
aaauuaucggucagcucuuuga

SEQ ID NO: 3352338 - RNA, 22 nt, Neisseria meningitidis Z2491
aaauuauugccagcauuaauau

SEQ ID NO: 3352339 - RNA, 17 nt, Neisseria meningitidis Z2491
aaauucccuucccuccc

SEQ ID NO: 3352340 - RNA, 23 nt, Neisseria meningitidis Z2491
aaauuccgucagcacguguucca

SEQ ID NO: 3352341 - RNA, 12 nt, Neisseria meningitidis Z2491
aaauuccuaaaa

SEQ ID NO: 3352342 - RNA, 23 nt, Neisseria meningitidis Z2491
aaauuccugcugcuuuucauuuc

SEQ ID NO: 3352343 - RNA, 21 nt, Neisseria meningitidis Z2491
aaauuccuguugcuuuucauu

SEQ ID NO: 3352344 - RNA, 23 nt, Neisseria meningitidis Z2491
aaauuccuguugcuuuucauuuc

SEQ ID NO: 3352345 - RNA, 15 nt, Neisseria meningitidis Z2491
aaauucgucauuccc

SEQ ID NO: 3352346 - RNA, 16 nt, Neisseria meningitidis Z2491
aaauucuagauucccg

SEQ ID NO: 3352347 - RNA, 19 nt, Neisseria meningitidis Z2491
aaauucuagauucccgccu

SEQ ID NO: 3352348 - RNA, 17 nt, Neisseria meningitidis Z2491
aaauucuagauuccugc

SEQ ID NO: 3352349 - RNA, 15 nt, Neisseria meningitidis Z2491
aaauucugaaacuuu

SEQ ID NO: 3352350 - RNA, 14 nt, Neisseria meningitidis Z2491
aaauugaaaugccg

SEQ ID NO: 3352351 - RNA, 18 nt, Neisseria meningitidis Z2491
aaauugaaaugccgucug

SEQ ID NO: 3352352 - RNA, 20 nt, Neisseria meningitidis Z2491
aaauugaaauucgucauucc

SEQ ID NO: 3352353 - RNA, 14 nt, Neisseria meningitidis Z2491
aaauugcauuuuua

SEQ ID NO: 3352354 - RNA, 22 nt, Neisseria meningitidis Z2491
aaauugcauuuuuaauuucuuc

SEQ ID NO: 3352355 - RNA, 21 nt, Neisseria meningitidis Z2491
aacccaaaaucggccauuccc

SEQ ID NO: 3352356 - RNA, 16 nt, Neisseria meningitidis Z2491
aacccaaacacagguu

SEQ ID NO: 3352357 - RNA, 19 nt, Neisseria meningitidis Z2491
aacccaaaccgucauuccc

SEQ ID NO: 3352358 - RNA, 15 nt, Neisseria meningitidis Z2491
aacccgacuucugac

SEQ ID NO: 3352359 - RNA, 21 nt, Neisseria meningitidis Z2491
aacccgacuucugacagcauu

SEQ ID NO: 3352360 - RNA, 14 nt, Neisseria meningitidis Z2491
aacccgauguuuuc

SEQ ID NO: 3352361 - RNA, 18 nt, Neisseria meningitidis Z2491
aacccgauuccuguuuuc

SEQ ID NO: 3352362 - RNA, 14 nt, Neisseria meningitidis Z2491
aacccguaugccgc

SEQ ID NO: 3352363 - RNA, 17 nt, Neisseria meningitidis Z2491
aacccguaugccgccug

SEQ ID NO: 3352364 - RNA, 20 nt, Neisseria meningitidis Z2491
aacccguaugccgccugccu

SEQ ID NO: 3352365 - RNA, 19 nt, Neisseria meningitidis Z2491
aacccuaaaaacuaaaugc

SEQ ID NO: 3352366 - RNA, 18 nt, Neisseria meningitidis Z2491
aacccugaacauaaaugc

SEQ ID NO: 3352367 - RNA, 14 nt, Neisseria meningitidis Z2491
aaccgaaaaaauaa

SEQ ID NO: 3352368 - RNA, 15 nt, Neisseria meningitidis Z2491
aaccgaaaaaauaau

SEQ ID NO: 3352369 - RNA, 17 nt, Neisseria meningitidis Z2491
aaccgaaaaaauaauug

SEQ ID NO: 3352370 - RNA, 15 nt, Neisseria meningitidis Z2491
aaccgaaaacaaagg

SEQ ID NO: 3352371 - RNA, 14 nt, Neisseria meningitidis Z2491
aaccgaaaauaauu

SEQ ID NO: 3352372 - RNA, 12 nt, Neisseria meningitidis Z2491
aaccgaaaccug

SEQ ID NO: 3352373 - RNA, 20 nt, Neisseria meningitidis Z2491
aaccgaacagaccggauucc

SEQ ID NO: 3352374 - RNA, 18 nt, Neisseria meningitidis Z2491
aaccgaaguuuaaagaac

SEQ ID NO: 3352375 - RNA, 13 nt, Neisseria meningitidis Z2491
aaccgaugccguc

SEQ ID NO: 3352376 - RNA, 15 nt, Neisseria meningitidis Z2491
aaccgaugccgucau

SEQ ID NO: 3352377 - RNA, 23 nt, Neisseria meningitidis Z2491
aaccgcauugccgcaaucgccgg

SEQ ID NO: 3352378 - RNA, 19 nt, Neisseria meningitidis Z2491
aaccgccgacacacggauu

SEQ ID NO: 3352379 - RNA, 16 nt, Neisseria meningitidis Z2491
aaccgcgcagcaguuu

SEQ ID NO: 3352380 - RNA, 23 nt, Neisseria meningitidis Z2491
aaccgcucccccuccgccgucau

SEQ ID NO: 3352381 - RNA, 15 nt, Neisseria meningitidis Z2491
aaccgcucugccguc

SEQ ID NO: 3352382 - RNA, 14 nt, Neisseria meningitidis Z2491
aaccgcuucaaggc

SEQ ID NO: 3352383 - RNA, 22 nt, Neisseria meningitidis Z2491
aaccgcuucaaggcgguuuuuu

SEQ ID NO: 3352384 - RNA, 19 nt, Neisseria meningitidis Z2491
aaccgcuugacgcuaccgc

SEQ ID NO: 3352385 - RNA, 23 nt, Neisseria meningitidis Z2491
aaccggauuccuacgaaaacagg

SEQ ID NO: 3352386 - RNA, 17 nt, Neisseria meningitidis Z2491
aaccguaucaaacaaga

SEQ ID NO: 3352387 - RNA, 13 nt, Neisseria meningitidis Z2491
aaccguaucggau

SEQ ID NO: 3352388 - RNA, 22 nt, Neisseria meningitidis Z2491
aaccgucaaacaaaaugccguc

SEQ ID NO: 3352389 - RNA, 19 nt, Neisseria meningitidis Z2491
aaccgucaaauugauuuuu

SEQ ID NO: 3352390 - RNA, 22 nt, Neisseria meningitidis Z2491
aaccgucggcacgaaccgcauu

SEQ ID NO: 3352391 - RNA, 19 nt, Neisseria meningitidis Z2491
aaccguuucagacggcauu

SEQ ID NO: 3352392 - RNA, 18 nt, Neisseria meningitidis Z2491
aaccuaaaaucccgucau

SEQ ID NO: 3352393 - RNA, 20 nt, Neisseria meningitidis Z2491
aaccuaaaauccgucauucc

SEQ ID NO: 3352394 - RNA, 17 nt, Neisseria meningitidis Z2491
aaccuaaaauucgucau

SEQ ID NO: 3352395 - RNA, 17 nt, Neisseria meningitidis Z2491
aaccuacauuccgucau

SEQ ID NO: 3352396 - RNA, 19 nt, Neisseria meningitidis Z2491
aaccucaaacuuucagaua

SEQ ID NO: 3352397 - RNA, 19 nt, Neisseria meningitidis Z2491
aaccucaaacuuucggaua

SEQ ID NO: 3352398 - RNA, 16 nt, Neisseria meningitidis Z2491
aaccucaaaucccguc

SEQ ID NO: 3352399 - RNA, 15 nt, Neisseria meningitidis Z2491
aaccucagccaccag

SEQ ID NO: 3352400 - RNA, 20 nt, Neisseria meningitidis Z2491
aaccucgucauucccgcaaa

SEQ ID NO: 3352401 - RNA, 18 nt, Neisseria meningitidis Z2491
aaccucguucggacggca

SEQ ID NO: 3352402 - RNA, 19 nt, Neisseria meningitidis Z2491
aaccucguucggacggcau

SEQ ID NO: 3352403 - RNA, 20 nt, Neisseria meningitidis Z2491
aaccucuaaacuuucagaua

SEQ ID NO: 3352404 - RNA, 15 nt, Neisseria meningitidis Z2491
aaccugaaaggcaca

SEQ ID NO: 3352405 - RNA, 17 nt, Neisseria meningitidis Z2491
aaccugcaucccgucau

SEQ ID NO: 3352406 - RNA, 19 nt, Neisseria meningitidis Z2491
aaccuguuuuucaaagccc

SEQ ID NO: 3352407 - RNA, 20 nt, Neisseria meningitidis Z2491
aaccuuauaguggauuaaau

SEQ ID NO: 3352408 - RNA, 23 nt, Neisseria meningitidis Z2491
aaccuuauccauauccaaacgca

SEQ ID NO: 3352409 - RNA, 15 nt, Neisseria meningitidis Z2491
aaccuuccgccguau

SEQ ID NO: 3352410 - RNA, 12 nt, Neisseria meningitidis Z2491
aaccuugccaag

SEQ ID NO: 3352411 - RNA, 16 nt, Neisseria meningitidis Z2491
aaccuuucagacggca

SEQ ID NO: 3352412 - RNA, 17 nt, Neisseria meningitidis Z2491
aaccuuucagacggcau

SEQ ID NO: 3352413 - RNA, 20 nt, Neisseria meningitidis Z2491
aaccuuucccguuucagacg

SEQ ID NO: 3352414 - RNA, 18 nt, Neisseria meningitidis Z2491
aacgaaaagcuaaagcaa

SEQ ID NO: 3352415 - RNA, 22 nt, Neisseria meningitidis Z2491
aacgaaauuugacgcauaaaaa

SEQ ID NO: 3352416 - RNA, 23 nt, Neisseria meningitidis Z2491
aacgaagccguagacaguacaaa

SEQ ID NO: 3352417 - RNA, 19 nt, Neisseria meningitidis Z2491
aacgaaugccgucugaaag

SEQ ID NO: 3352418 - RNA, 14 nt, Neisseria meningitidis Z2491
aacgacagcagcag

SEQ ID NO: 3352419 - RNA, 16 nt, Neisseria meningitidis Z2491
aacgacgggauuuuag

SEQ ID NO: 3352420 - RNA, 21 nt, Neisseria meningitidis Z2491
aacgacgguauaaaccaaaau

SEQ ID NO: 3352421 - RNA, 18 nt, Neisseria meningitidis Z2491
aacgacuuccagcaccag

SEQ ID NO: 3352422 - RNA, 19 nt, Neisseria meningitidis Z2491
aacgacuuuggucaguguu

SEQ ID NO: 3352423 - RNA, 13 nt, Neisseria meningitidis Z2491
aacgauacggcgg

SEQ ID NO: 3352424 - RNA, 14 nt, Neisseria meningitidis Z2491
aacgcaaagcugca

SEQ ID NO: 3352425 - RNA, 16 nt, Neisseria meningitidis Z2491
aacgcaaugcgccuuc

SEQ ID NO: 3352426 - RNA, 19 nt, Neisseria meningitidis Z2491
aacgcagccagcaucgcag

SEQ ID NO: 3352427 - RNA, 15 nt, Neisseria meningitidis Z2491
aacgcauucagacgg

SEQ ID NO: 3352428 - RNA, 20 nt, Neisseria meningitidis Z2491
aacgccagcacaaacagcau

SEQ ID NO: 3352429 - RNA, 19 nt, Neisseria meningitidis Z2491
aacgccguacugguuuuug

SEQ ID NO: 3352430 - RNA, 20 nt, Neisseria meningitidis Z2491
aacgccguacugguuuuugu

SEQ ID NO: 3352431 - RNA, 21 nt, Neisseria meningitidis Z2491
aacgccucaaucgcggcggca

SEQ ID NO: 3352432 - RNA, 12 nt, Neisseria meningitidis Z2491
aacgccuucuuc

SEQ ID NO: 3352433 - RNA, 20 nt, Neisseria meningitidis Z2491
aacgcgaaaaugccgucuga

SEQ ID NO: 3352434 - RNA, 23 nt, Neisseria meningitidis Z2491
aacgcgcaaacgcugcauuuguu

SEQ ID NO: 3352435 - RNA, 17 nt, Neisseria meningitidis Z2491
aacgcugcaaaaauuua

SEQ ID NO: 3352436 - RNA, 15 nt, Neisseria meningitidis Z2491
aacgcuucagacggc

SEQ ID NO: 3352437 - RNA, 22 nt, Neisseria meningitidis Z2491
aacggagauucccguuucagac

SEQ ID NO: 3352438 - RNA, 17 nt, Neisseria meningitidis Z2491
aacggauaaaguuugaa

SEQ ID NO: 3352439 - RNA, 17 nt, Neisseria meningitidis Z2491
aacggcacaaacgccag

SEQ ID NO: 3352440 - RNA, 20 nt, Neisseria meningitidis Z2491
aacggcacaaacgccagcac

SEQ ID NO: 3352441 - RNA, 14 nt, Neisseria meningitidis Z2491
aacggcacggcguu

SEQ ID NO: 3352442 - RNA, 19 nt, Neisseria meningitidis Z2491
aacggcaggcaaaaaaaau

SEQ ID NO: 3352443 - RNA, 23 nt, Neisseria meningitidis Z2491
aacggcgcaaccgccggcagugu

SEQ ID NO: 3352444 - RNA, 19 nt, Neisseria meningitidis Z2491
aacggcggcgggcagucau

SEQ ID NO: 3352445 - RNA, 15 nt, Neisseria meningitidis Z2491
aacgggaggaccuca

SEQ ID NO: 3352446 - RNA, 12 nt, Neisseria meningitidis Z2491
aacgggauuuca

SEQ ID NO: 3352447 - RNA, 14 nt, Neisseria meningitidis Z2491
aacgggauuucagc

SEQ ID NO: 3352448 - RNA, 20 nt, Neisseria meningitidis Z2491
aacggucaaaaaaacagcgu

SEQ ID NO: 3352449 - RNA, 14 nt, Neisseria meningitidis Z2491
aacgguguggagag

SEQ ID NO: 3352450 - RNA, 16 nt, Neisseria meningitidis Z2491
aacgguuuuuucugcc

SEQ ID NO: 3352451 - RNA, 18 nt, Neisseria meningitidis Z2491
aacgguuuuuucugccaa

SEQ ID NO: 3352452 - RNA, 17 nt, Neisseria meningitidis Z2491
aacguacaaaugccguc

SEQ ID NO: 3352453 - RNA, 13 nt, Neisseria meningitidis Z2491
aacguaucggaua

SEQ ID NO: 3352454 - RNA, 16 nt, Neisseria meningitidis Z2491
aacguaucggauaaaa

SEQ ID NO: 3352455 - RNA, 16 nt, Neisseria meningitidis Z2491
aacguauucaagcagc

SEQ ID NO: 3352456 - RNA, 15 nt, Neisseria meningitidis Z2491
aaggcuucagacggc

SEQ ID NO: 3352457 - RNA, 18 nt, Neisseria meningitidis Z2491
aaggcuucagacggcauu

SEQ ID NO: 3352458 - RNA, 17 nt, Neisseria meningitidis Z2491
aaggcuuuaagcaauca

SEQ ID NO: 3352459 - RNA, 11 nt, Neisseria meningitidis Z2491
aaggcuuucag

SEQ ID NO: 3352460 - RNA, 16 nt, Neisseria meningitidis Z2491
aaggcuuucagacggc

SEQ ID NO: 3352461 - RNA, 13 nt, Neisseria meningitidis Z2491
aaggcuuucagau

SEQ ID NO: 3352462 - RNA, 18 nt, Neisseria meningitidis Z2491
aaggcuuuuucagacggc

SEQ ID NO: 3352463 - RNA, 14 nt, Neisseria meningitidis Z2491
aagggguaaauccu

SEQ ID NO: 3352464 - RNA, 14 nt, Neisseria meningitidis Z2491
aaggucgucugaaa

SEQ ID NO: 3352465 - RNA, 15 nt, Neisseria meningitidis Z2491
aaggucgucugaaaa

SEQ ID NO: 3352466 - RNA, 16 nt, Neisseria meningitidis Z2491
aaggucucauccuguu

SEQ ID NO: 3352467 - RNA, 14 nt, Neisseria meningitidis Z2491
aaggucucuauuug

SEQ ID NO: 3352468 - RNA, 13 nt, Neisseria meningitidis Z2491
aaggucuggauuc

SEQ ID NO: 3352469 - RNA, 13 nt, Neisseria meningitidis Z2491
aaggugcgguaag

SEQ ID NO: 3352470 - RNA, 14 nt, Neisseria meningitidis Z2491
aaggugggaaucug

SEQ ID NO: 3352471 - RNA, 20 nt, Neisseria meningitidis Z2491
aagguguuauaugcuaucuu

SEQ ID NO: 3352472 - RNA, 14 nt, Neisseria meningitidis Z2491
aagguuaauuaaaa

SEQ ID NO: 3352473 - RNA, 18 nt, Neisseria meningitidis Z2491
aagguuaauuaaaauacg

SEQ ID NO: 3352474 - RNA, 15 nt, Neisseria meningitidis Z2491
aagguucaaacacau

SEQ ID NO: 3352475 - RNA, 16 nt, Neisseria meningitidis Z2491
aagguuuauuugagca

SEQ ID NO: 3352476 - RNA, 11 nt, Neisseria meningitidis Z2491
aagguuuuugc

SEQ ID NO: 3352477 - RNA, 20 nt, Neisseria meningitidis Z2491
aagguuuuugccaagugcaa

SEQ ID NO: 3352478 - RNA, 11 nt, Neisseria meningitidis Z2491
aaguaaaucgg

SEQ ID NO: 3352479 - RNA, 17 nt, Neisseria meningitidis Z2491
aaguacaaaaugccguc

SEQ ID NO: 3352480 - RNA, 16 nt, Neisseria meningitidis Z2491
aaguacucauuuuucg

SEQ ID NO: 3352481 - RNA, 17 nt, Neisseria meningitidis Z2491
aaguaguuucccuguuu

SEQ ID NO: 3352482 - RNA, 20 nt, Neisseria meningitidis Z2491
aaguccaaacaaaaaugccg

SEQ ID NO: 3352483 - RNA, 18 nt, Neisseria meningitidis Z2491
aaguccggcauaaauccu

SEQ ID NO: 3352484 - RNA, 22 nt, Neisseria meningitidis Z2491
aaguccggcauaaauccuucac

SEQ ID NO: 3352485 - RNA, 23 nt, Neisseria meningitidis Z2491
aagucggcuuggcgggaagccag

SEQ ID NO: 3352486 - RNA, 12 nt, Neisseria meningitidis Z2491
aagucugauucu

SEQ ID NO: 3352487 - RNA, 20 nt, Neisseria meningitidis Z2491
aagucugauucuaccgcccc

SEQ ID NO: 3352488 - RNA, 13 nt, Neisseria meningitidis Z2491
aagucuuucagac

SEQ ID NO: 3352489 - RNA, 24 nt, Neisseria meningitidis Z2491
aagugauucaauaggauaggcugc

SEQ ID NO: 3352490 - RNA, 17 nt, Neisseria meningitidis Z2491
aagugccauuuaaaauc

SEQ ID NO: 3352491 - RNA, 19 nt, Neisseria meningitidis Z2491
aagugcggucaaaauuuac

SEQ ID NO: 3352492 - RNA, 20 nt, Neisseria meningitidis Z2491
aagugcggugaaaucuuaua

SEQ ID NO: 3352493 - RNA, 13 nt, Neisseria meningitidis Z2491
aagugggaaucca

SEQ ID NO: 3352494 - RNA, 24 nt, Neisseria meningitidis Z2491
aaguguccggcagccugcucgagc

SEQ ID NO: 3352495 - RNA, 23 nt, Neisseria meningitidis Z2491
aaguguuuucaagaacaggcggc

SEQ ID NO: 3352496 - RNA, 20 nt, Neisseria meningitidis Z2491
aaguuccagacggcauuuuu

SEQ ID NO: 3352497 - RNA, 18 nt, Neisseria meningitidis Z2491
aaguugcuugcgcggcau

SEQ ID NO: 3352498 - RNA, 14 nt, Neisseria meningitidis Z2491
aauaaaaaauaugg

SEQ ID NO: 3352499 - RNA, 14 nt, Neisseria meningitidis Z2491
aauaaaaaaugccg

SEQ ID NO: 3352500 - RNA, 22 nt, Neisseria meningitidis Z2491
aauaaaggcguugggaaagguu

SEQ ID NO: 3352501 - RNA, 15 nt, Neisseria meningitidis Z2491
aauaaaggcugaauu

SEQ ID NO: 3352502 - RNA, 22 nt, Neisseria meningitidis Z2491
aauaaaucaagcgguaagugau

SEQ ID NO: 3352503 - RNA, 19 nt, Neisseria meningitidis Z2491
aauaaauuaaucuccuuuu

SEQ ID NO: 3352504 - RNA, 21 nt, Neisseria meningitidis Z2491
aauaacgguugcacgguuuuc

SEQ ID NO: 3352505 - RNA, 23 nt, Neisseria meningitidis Z2491
aauaacgguugcacgguuuuccu

SEQ ID NO: 3352506 - RNA, 16 nt, Neisseria meningitidis Z2491
aauaacguucaguuca

SEQ ID NO: 3352507 - RNA, 22 nt, Neisseria meningitidis Z2491
aauaacuauaguggauuaacaa

SEQ ID NO: 3352508 - RNA, 16 nt, Neisseria meningitidis Z2491
aauaacuuauauauau

SEQ ID NO: 3352509 - RNA, 15 nt, Neisseria meningitidis Z2491
aauaagucagcgugc

SEQ ID NO: 3352510 - RNA, 18 nt, Neisseria meningitidis Z2491
aauaagucugcgaaacag

SEQ ID NO: 3352511 - RNA, 21 nt, Neisseria meningitidis Z2491
aauaagucugcgaaacagaca

SEQ ID NO: 3352512 - RNA, 13 nt, Neisseria meningitidis Z2491
aauaaugaaaaug

SEQ ID NO: 3352513 - RNA, 17 nt, Neisseria meningitidis Z2491
aauaauggaacaaagaa

SEQ ID NO: 3352514 - RNA, 22 nt, Neisseria meningitidis Z2491
aauaauggaacaaagaaagcag

SEQ ID NO: 3352515 - RNA, 16 nt, Neisseria meningitidis Z2491
aauaauggccuuuucc

SEQ ID NO: 3352516 - RNA, 19 nt, Neisseria meningitidis Z2491
aauaauggccuuuucccuu

SEQ ID NO: 3352517 - RNA, 13 nt, Neisseria meningitidis Z2491
aauaauugaaauc

SEQ ID NO: 3352518 - RNA, 16 nt, Neisseria meningitidis Z2491
aauaauugaaaucaac

SEQ ID NO: 3352519 - RNA, 14 nt, Neisseria meningitidis Z2491
aauaauugccuuuu

SEQ ID NO: 3352520 - RNA, 22 nt, Neisseria meningitidis Z2491
aauacaaaaaugccgucugaaa

SEQ ID NO: 3352521 - RNA, 22 nt, Neisseria meningitidis Z2491
aauacaacaaaaugccgccuga

SEQ ID NO: 3352522 - RNA, 19 nt, Neisseria meningitidis Z2491
aauacauaggguuaauauc

SEQ ID NO: 3352523 - RNA, 18 nt, Neisseria meningitidis Z2491
aauacauccuaaaaauuu

SEQ ID NO: 3352524 - RNA, 20 nt, Neisseria meningitidis Z2491
aauacccaaaugcagaauaa

SEQ ID NO: 3352525 - RNA, 13 nt, Neisseria meningitidis Z2491
aauacccauaccg

SEQ ID NO: 3352526 - RNA, 17 nt, Neisseria meningitidis Z2491
aauaccgcaaccugaaa

SEQ ID NO: 3352527 - RNA, 23 nt, Neisseria meningitidis Z2491
aauaccgucugaaaccugcaacg

SEQ ID NO: 3352528 - RNA, 16 nt, Neisseria meningitidis Z2491
aauaccuuguuuuuuc

SEQ ID NO: 3352529 - RNA, 13 nt, Neisseria meningitidis Z2491
aauacgauaaagu

SEQ ID NO: 3352530 - RNA, 17 nt, Neisseria meningitidis Z2491
aauacgaugccgucuga

SEQ ID NO: 3352531 - RNA, 22 nt, Neisseria meningitidis Z2491
aauacgcaaacuaacuuauaca

SEQ ID NO: 3352532 - RNA, 17 nt, Neisseria meningitidis Z2491
aauacggcaacaucaua

SEQ ID NO: 3352533 - RNA, 16 nt, Neisseria meningitidis Z2491
aauacggcggcggcag

SEQ ID NO: 3352534 - RNA, 19 nt, Neisseria meningitidis Z2491
aauacugaggaaaccaucc

SEQ ID NO: 3352535 - RNA, 20 nt, Neisseria meningitidis Z2491
aauagaaaaccgaaacagaa

SEQ ID NO: 3352536 - RNA, 22 nt, Neisseria meningitidis Z2491
aauagaaaauauuguuauuccc

SEQ ID NO: 3352537 - RNA, 13 nt, Neisseria meningitidis Z2491
aauagcugaaacu

SEQ ID NO: 3352538 - RNA, 14 nt, Neisseria meningitidis Z2491
aauagcugaaacuc

SEQ ID NO: 3352539 - RNA, 13 nt, Neisseria meningitidis Z2491
aauaguacaauau

SEQ ID NO: 3352540 - RNA, 23 nt, Neisseria meningitidis Z2491
aauaguacggaaccgauucacuu

SEQ ID NO: 3352541 - RNA, 19 nt, Neisseria meningitidis Z2491
aauauacuuggcaaaaucu

SEQ ID NO: 3352542 - RNA, 20 nt, Neisseria meningitidis Z2491
aauauccccagugcgaugac

SEQ ID NO: 3352543 - RNA, 16 nt, Neisseria meningitidis Z2491
aauaucgggacgcugc

SEQ ID NO: 3352544 - RNA, 21 nt, Neisseria meningitidis Z2491
aauaucuucuccgaccuauag

SEQ ID NO: 3352545 - RNA, 14 nt, Neisseria meningitidis Z2491
aauaugaaaccauu

SEQ ID NO: 3352546 - RNA, 13 nt, Neisseria meningitidis Z2491
aauaugccgucau

SEQ ID NO: 3352547 - RNA, 20 nt, Neisseria meningitidis Z2491
aauaugccgucugaagccuu

SEQ ID NO: 3352548 - RNA, 18 nt, Neisseria meningitidis Z2491
aauauggaucagacauua

SEQ ID NO: 3352549 - RNA, 20 nt, Neisseria meningitidis Z2491
aauauggcggauuaaaauaa

SEQ ID NO: 3352550 - RNA, 17 nt, Neisseria meningitidis Z2491
aauaugguucagacggc

SEQ ID NO: 3352551 - RNA, 13 nt, Neisseria meningitidis Z2491
aauauuaagaaaa

SEQ ID NO: 3352552 - RNA, 14 nt, Neisseria meningitidis Z2491
aauauuaaucagcg

SEQ ID NO: 3352553 - RNA, 18 nt, Neisseria meningitidis Z2491
aauauuaaugauuaucau

SEQ ID NO: 3352554 - RNA, 18 nt, Neisseria meningitidis Z2491
aauauuacuguuguucua

SEQ ID NO: 3352555 - RNA, 14 nt, Neisseria meningitidis Z2491
aauauuaggaaggu

SEQ ID NO: 3352556 - RNA, 15 nt, Neisseria meningitidis Z2491
aauauucaacuuuga

SEQ ID NO: 3352557 - RNA, 20 nt, Neisseria meningitidis Z2491
aaugacugcccgucccgacu

SEQ ID NO: 3352558 - RNA, 18 nt, Neisseria meningitidis Z2491
aaugagauugagcauaaa

SEQ ID NO: 3352559 - RNA, 18 nt, Neisseria meningitidis Z2491
aaugaugggcugaaauag

SEQ ID NO: 3352560 - RNA, 15 nt, Neisseria meningitidis Z2491
aaugcaaaaacauca

SEQ ID NO: 3352561 - RNA, 16 nt, Neisseria meningitidis Z2491
aaugcaaaaacaucag

SEQ ID NO: 3352562 - RNA, 14 nt, Neisseria meningitidis Z2491
aaugcaaaaagucc

SEQ ID NO: 3352563 - RNA, 19 nt, Neisseria meningitidis Z2491
aaugcaaaaaguccuucac

SEQ ID NO: 3352564 - RNA, 21 nt, Neisseria meningitidis Z2491
aaugcaaaacuuuucugauuu

SEQ ID NO: 3352565 - RNA, 23 nt, Neisseria meningitidis Z2491
aaugcacgguuacacaaauauau

SEQ ID NO: 3352566 - RNA, 18 nt, Neisseria meningitidis Z2491
aaugcacuacuucauuuu

SEQ ID NO: 3352567 - RNA, 20 nt, Neisseria meningitidis Z2491
aaugcacuacuucauuuuuu

SEQ ID NO: 3352568 - RNA, 14 nt, Neisseria meningitidis Z2491
aaugccaaaggcag

SEQ ID NO: 3352569 - RNA, 22 nt, Neisseria meningitidis Z2491
aaugccaaucucuuaaccaugc

SEQ ID NO: 3352570 - RNA, 12 nt, Neisseria meningitidis Z2491
aaugcccaaacc

SEQ ID NO: 3352571 - RNA, 17 nt, Neisseria meningitidis Z2491
aaugcccgaaccgucau

SEQ ID NO: 3352572 - RNA, 17 nt, Neisseria meningitidis Z2491
aaugccgcaaccucaaa

SEQ ID NO: 3352573 - RNA, 13 nt, Neisseria meningitidis Z2491
aaugccgccagcc

SEQ ID NO: 3352574 - RNA, 19 nt, Neisseria meningitidis Z2491
aaugccgccgcaacugccu

SEQ ID NO: 3352575 - RNA, 15 nt, Neisseria meningitidis Z2491
aaugccgucauuccc

SEQ ID NO: 3352576 - RNA, 18 nt, Neisseria meningitidis Z2491
aaugccguccgaaagguu

SEQ ID NO: 3352577 - RNA, 22 nt, Neisseria meningitidis Z2491
aaugccgucugaaaaaccuuuc

SEQ ID NO: 3352578 - RNA, 16 nt, Neisseria meningitidis Z2491
aaugccgucugaaaac

SEQ ID NO: 3352579 - RNA, 21 nt, Neisseria meningitidis Z2491
aaugccgucugaaaacagcaa

SEQ ID NO: 3352580 - RNA, 17 nt, Neisseria meningitidis Z2491
aaugccgucugaaaaga

SEQ ID NO: 3352581 - RNA, 16 nt, Neisseria meningitidis Z2491
aaugccgucugaaaca

SEQ ID NO: 3352582 - RNA, 22 nt, Neisseria meningitidis Z2491
aaugccgucugaaaccuuuuuu

SEQ ID NO: 3352583 - RNA, 17 nt, Neisseria meningitidis Z2491
aaugccgucugaaaguc

SEQ ID NO: 3352584 - RNA, 17 nt, Neisseria meningitidis Z2491
aaugccgucugaacacg

SEQ ID NO: 3352585 - RNA, 15 nt, Neisseria meningitidis Z2491
aaugccgucugaagc

SEQ ID NO: 3352586 - RNA, 19 nt, Neisseria meningitidis Z2491
aaugccgucugaagcccug

SEQ ID NO: 3352587 - RNA, 22 nt, Neisseria meningitidis Z2491
aaugccgucugaagcccugccu

SEQ ID NO: 3352588 - RNA, 23 nt, Neisseria meningitidis Z2491
aaugccgucugaagcccuuucag

SEQ ID NO: 3352589 - RNA, 17 nt, Neisseria meningitidis Z2491
aaugccgucugaagcgu

SEQ ID NO: 3352590 - RNA, 20 nt, Neisseria meningitidis Z2491
aaugccuuucucuguuuuuc

SEQ ID NO: 3352591 - RNA, 14 nt, Neisseria meningitidis Z2491
aaugcgccaaaaaa

SEQ ID NO: 3352592 - RNA, 18 nt, Neisseria meningitidis Z2491
aaugcgccaaaaaauuuu

SEQ ID NO: 3352593 - RNA, 17 nt, Neisseria meningitidis Z2491
aaugcgcgacggcggca

SEQ ID NO: 3352594 - RNA, 15 nt, Neisseria meningitidis Z2491
aaugcguaugcccca

SEQ ID NO: 3352595 - RNA, 18 nt, Neisseria meningitidis Z2491
aaugcugucugaaaccug

SEQ ID NO: 3352596 - RNA, 18 nt, Neisseria meningitidis Z2491
aauggaaaugccgucuga

SEQ ID NO: 3352597 - RNA, 17 nt, Neisseria meningitidis Z2491
aauggauaaaaccgcuc

SEQ ID NO: 3352598 - RNA, 23 nt, Neisseria meningitidis Z2491
aaugguaucgggcauaaaauuug

SEQ ID NO: 3352599 - RNA, 18 nt, Neisseria meningitidis Z2491
aauguauuagaaaugacu

SEQ ID NO: 3352600 - RNA, 19 nt, Neisseria meningitidis Z2491
aaugucaaaauaugccguc

SEQ ID NO: 3352601 - RNA, 17 nt, Neisseria meningitidis Z2491
aauguccguuuucuucu

SEQ ID NO: 3352602 - RNA, 12 nt, Neisseria meningitidis Z2491
aaugucuagauu

SEQ ID NO: 3352603 - RNA, 23 nt, Neisseria meningitidis Z2491
aaugucuucauacgacucaaaau

SEQ ID NO: 3352604 - RNA, 17 nt, Neisseria meningitidis Z2491
aaugugcauuucuaauu

SEQ ID NO: 3352605 - RNA, 23 nt, Neisseria meningitidis Z2491
aaugugcauuucuaauuuuuaua

SEQ ID NO: 3352606 - RNA, 22 nt, Neisseria meningitidis Z2491
aaugugcgccacgccauuuguu

SEQ ID NO: 3352607 - RNA, 15 nt, Neisseria meningitidis Z2491
aaugugguuucagac

SEQ ID NO: 3352608 - RNA, 18 nt, Neisseria meningitidis Z2491
aauguguugauuaaauau

SEQ ID NO: 3352609 - RNA, 15 nt, Neisseria meningitidis Z2491
aauguguuuugaagg

SEQ ID NO: 3352610 - RNA, 14 nt, Neisseria meningitidis Z2491
aauguucagacggc

SEQ ID NO: 3352611 - RNA, 17 nt, Neisseria meningitidis Z2491
aauguucggacggcaua

SEQ ID NO: 3352612 - RNA, 22 nt, Neisseria meningitidis Z2491
aauguugcggcacuagccaaaa

SEQ ID NO: 3352613 - RNA, 13 nt, Neisseria meningitidis Z2491
aauguuucaacgc

SEQ ID NO: 3352614 - RNA, 14 nt, Neisseria meningitidis Z2491
aauuaaaaacaaaa

SEQ ID NO: 3352615 - RNA, 19 nt, Neisseria meningitidis Z2491
aauuaaaaacaaaauagua

SEQ ID NO: 3352616 - RNA, 12 nt, Neisseria meningitidis Z2491
aauuaaauuuaa

SEQ ID NO: 3352617 - RNA, 12 nt, Neisseria meningitidis Z2491
aauuaacaaaaa

SEQ ID NO: 3352618 - RNA, 22 nt, Neisseria meningitidis Z2491
aauuaacaaaaaucaggacaag

SEQ ID NO: 3352619 - RNA, 18 nt, Neisseria meningitidis Z2491
aauuaugaugcggacggc

SEQ ID NO: 3352620 - RNA, 21 nt, Neisseria meningitidis Z2491
aauucaucgcgcugccgucga

SEQ ID NO: 3352621 - RNA, 14 nt, Neisseria meningitidis Z2491
aauucauguuuaua

SEQ ID NO: 3352622 - RNA, 23 nt, Neisseria meningitidis Z2491
aauucccgccaucuaaaaucucg

SEQ ID NO: 3352623 - RNA, 14 nt, Neisseria meningitidis Z2491
aauuccuuucccuc

SEQ ID NO: 3352624 - RNA, 23 nt, Neisseria meningitidis Z2491
aauucgugauucccgagaaaaca

SEQ ID NO: 3352625 - RNA, 13 nt, Neisseria meningitidis Z2491
aauucuacccaaa

SEQ ID NO: 3352626 - RNA, 17 nt, Neisseria meningitidis Z2491
aauucuacccaaauacc

SEQ ID NO: 3352627 - RNA, 22 nt, Neisseria meningitidis Z2491
aauucuguuuggauaugccgua

SEQ ID NO: 3352628 - RNA, 21 nt, Neisseria meningitidis Z2491
aauucuugcagcuuugaguuu

SEQ ID NO: 3352629 - RNA, 14 nt, Neisseria meningitidis Z2491
aauugaaaaauuuu

SEQ ID NO: 3352630 - RNA, 13 nt, Neisseria meningitidis Z2491
aauugaaaauuuu

SEQ ID NO: 3352631 - RNA, 15 nt, Neisseria meningitidis Z2491
aauugaaaauuuuuu

SEQ ID NO: 3352632 - RNA, 13 nt, Neisseria meningitidis Z2491
aauugaaaucaac

SEQ ID NO: 3352633 - RNA, 15 nt, Neisseria meningitidis Z2491
aauugaaaugccguc

SEQ ID NO: 3352634 - RNA, 16 nt, Neisseria meningitidis Z2491
aauugaaaugccgucu

SEQ ID NO: 3352635 - RNA, 14 nt, Neisseria meningitidis Z2491
aauugacaaaaacu

SEQ ID NO: 3352636 - RNA, 14 nt, Neisseria meningitidis Z2491
aauugcauuuuuaa

SEQ ID NO: 3352637 - RNA, 22 nt, Neisseria meningitidis Z2491
aauugcauuuuuaauuucuucu

SEQ ID NO: 3352638 - RNA, 16 nt, Neisseria meningitidis Z2491
aauugccuucaucagc

SEQ ID NO: 3352639 - RNA, 18 nt, Neisseria meningitidis Z2491
aauugccuucaucagcau

SEQ ID NO: 3352640 - RNA, 14 nt, Neisseria meningitidis Z2491
aauuguccauuuuu

SEQ ID NO: 3352641 - RNA, 16 nt, Neisseria meningitidis Z2491
aauugucuuuucccuu

SEQ ID NO: 3352642 - RNA, 22 nt, Neisseria meningitidis Z2491
aauugucuuuucccuugcaaau

SEQ ID NO: 3352643 - RNA, 21 nt, Neisseria meningitidis Z2491
aauuuaaacacuucuucauua

SEQ ID NO: 3352644 - RNA, 15 nt, Neisseria meningitidis Z2491
aauuuaaacaggcac

SEQ ID NO: 3352645 - RNA, 18 nt, Neisseria meningitidis Z2491
aauuuaaaccaguacggc

SEQ ID NO: 3352646 - RNA, 18 nt, Neisseria meningitidis Z2491
aauuuaaaucaguacggc

SEQ ID NO: 3352647 - RNA, 16 nt, Neisseria meningitidis Z2491
aauuuacagcuuuuac

SEQ ID NO: 3352648 - RNA, 16 nt, Neisseria meningitidis Z2491
aauuuauaaacaaaaa

SEQ ID NO: 3352649 - RNA, 21 nt, Neisseria meningitidis Z2491
aauuuauaguggauuaacaaa

SEQ ID NO: 3352650 - RNA, 11 nt, Neisseria meningitidis Z2491
aauuuaucaga

SEQ ID NO: 3352651 - RNA, 18 nt, Neisseria meningitidis Z2491
aauuuauccgaaacaaca

SEQ ID NO: 3352652 - RNA, 21 nt, Neisseria meningitidis Z2491
aauuuauccgaaacaacaaaa

SEQ ID NO: 3352653 - RNA, 17 nt, Neisseria meningitidis Z2491
aauuuauccgaaauaac

SEQ ID NO: 3352654 - RNA, 23 nt, Neisseria meningitidis Z2491
aauuuauccgaagcgacaacaau

SEQ ID NO: 3352655 - RNA, 14 nt, Neisseria meningitidis Z2491
aauuuaucggaaaa

SEQ ID NO: 3352656 - RNA, 15 nt, Neisseria meningitidis Z2491
aauuuaucggaaaaa

SEQ ID NO: 3352657 - RNA, 13 nt, Neisseria meningitidis Z2491
aauuuaugaaaua

SEQ ID NO: 3352658 - RNA, 18 nt, Neisseria meningitidis Z2491
acacucuucgucauuccc

SEQ ID NO: 3352659 - RNA, 15 nt, Neisseria meningitidis Z2491
acacuguuuccaagc

SEQ ID NO: 3352660 - RNA, 12 nt, Neisseria meningitidis Z2491
acagaaaaacaa

SEQ ID NO: 3352661 - RNA, 11 nt, Neisseria meningitidis Z2491
acagaaaacca

SEQ ID NO: 3352662 - RNA, 14 nt, Neisseria meningitidis Z2491
acagaaaaccaaaa

SEQ ID NO: 3352663 - RNA, 15 nt, Neisseria meningitidis Z2491
acagaaaaccaaaaa

SEQ ID NO: 3352664 - RNA, 16 nt, Neisseria meningitidis Z2491
acagaaaaccaaaaac

SEQ ID NO: 3352665 - RNA, 20 nt, Neisseria meningitidis Z2491
acagaaaaccaaaaacagaa

SEQ ID NO: 3352666 - RNA, 16 nt, Neisseria meningitidis Z2491
acagaaaaccaaaauc

SEQ ID NO: 3352667 - RNA, 23 nt, Neisseria meningitidis Z2491
acagaaaaccaaaaucagaaacc

SEQ ID NO: 3352668 - RNA, 13 nt, Neisseria meningitidis Z2491
acagaaaacgccg

SEQ ID NO: 3352669 - RNA, 13 nt, Neisseria meningitidis Z2491
acagaaaccuaaa

SEQ ID NO: 3352670 - RNA, 19 nt, Neisseria meningitidis Z2491
acagaaaccuaaaaucucg

SEQ ID NO: 3352671 - RNA, 19 nt, Neisseria meningitidis Z2491
acagaaaccuaaaauucgu

SEQ ID NO: 3352672 - RNA, 14 nt, Neisseria meningitidis Z2491
acagaaaccucaaa

SEQ ID NO: 3352673 - RNA, 21 nt, Neisseria meningitidis Z2491
acagaaaccugaaaacagaaa

SEQ ID NO: 3352674 - RNA, 13 nt, Neisseria meningitidis Z2491
acagaaaccugca

SEQ ID NO: 3352675 - RNA, 20 nt, Neisseria meningitidis Z2491
acagaaagccaaaaacagaa

SEQ ID NO: 3352676 - RNA, 19 nt, Neisseria meningitidis Z2491
acagaaauucaaaaacaga

SEQ ID NO: 3352677 - RNA, 21 nt, Neisseria meningitidis Z2491
acagaaauuuauaaacaaaaa

SEQ ID NO: 3352678 - RNA, 18 nt, Neisseria meningitidis Z2491
acagaaccgauucacuug

SEQ ID NO: 3352679 - RNA, 17 nt, Neisseria meningitidis Z2491
acagacggaauaggaca

SEQ ID NO: 3352680 - RNA, 17 nt, Neisseria meningitidis Z2491
acagacggccaaacaca

SEQ ID NO: 3352681 - RNA, 13 nt, Neisseria meningitidis Z2491
acagauaaaacca

SEQ ID NO: 3352682 - RNA, 14 nt, Neisseria meningitidis Z2491
acagauuacuaaaa

SEQ ID NO: 3352683 - RNA, 19 nt, Neisseria meningitidis Z2491
acagauugugcauaaggca

SEQ ID NO: 3352684 - RNA, 14 nt, Neisseria meningitidis Z2491
acagcaaccugaaa

SEQ ID NO: 3352685 - RNA, 19 nt, Neisseria meningitidis Z2491
acagcaacuuaaaaccucg

SEQ ID NO: 3352686 - RNA, 21 nt, Neisseria meningitidis Z2491
acagcaauccauucccucucc

SEQ ID NO: 3352687 - RNA, 22 nt, Neisseria meningitidis Z2491
acagcacgauacacaaaaaagc

SEQ ID NO: 3352688 - RNA, 12 nt, Neisseria meningitidis Z2491
acagcacgcggu

SEQ ID NO: 3352689 - RNA, 12 nt, Neisseria meningitidis Z2491
acagcagcagcc

SEQ ID NO: 3352690 - RNA, 21 nt, Neisseria meningitidis Z2491
acagcagcagcccgaacacga

SEQ ID NO: 3352691 - RNA, 20 nt, Neisseria meningitidis Z2491
acagcagccggacagcccau

SEQ ID NO: 3352692 - RNA, 22 nt, Neisseria meningitidis Z2491
acagcauccuuuccucuuucau

SEQ ID NO: 3352693 - RNA, 15 nt, Neisseria meningitidis Z2491
acagcauggcgacaa

SEQ ID NO: 3352694 - RNA, 19 nt, Neisseria meningitidis Z2491
acagcauggcgacaaucuc

SEQ ID NO: 3352695 - RNA, 17 nt, Neisseria meningitidis Z2491
acagccccuaaauuuaa

SEQ ID NO: 3352696 - RNA, 19 nt, Neisseria meningitidis Z2491
acagccgaaaacagcugaa

SEQ ID NO: 3352697 - RNA, 14 nt, Neisseria meningitidis Z2491
acagccgaaaaccu

SEQ ID NO: 3352698 - RNA, 18 nt, Neisseria meningitidis Z2491
acagccgaaacccaaaca

SEQ ID NO: 3352699 - RNA, 18 nt, Neisseria meningitidis Z2491
acagccugucccccaccg

SEQ ID NO: 3352700 - RNA, 21 nt, Neisseria meningitidis Z2491
acagcggcaauauucaaagau

SEQ ID NO: 3352701 - RNA, 19 nt, Neisseria meningitidis Z2491
acagcggccgccaucaaaa

SEQ ID NO: 3352702 - RNA, 22 nt, Neisseria meningitidis Z2491
acagcggccgccaucaaaaagg

SEQ ID NO: 3352703 - RNA, 17 nt, Neisseria meningitidis Z2491
acagcguugccucgccu

SEQ ID NO: 3352704 - RNA, 15 nt, Neisseria meningitidis Z2491
acagcugaaaacagc

SEQ ID NO: 3352705 - RNA, 12 nt, Neisseria meningitidis Z2491
acaggaauuuau

SEQ ID NO: 3352706 - RNA, 21 nt, Neisseria meningitidis Z2491
acaggcagccuaaaacaucaa

SEQ ID NO: 3352707 - RNA, 17 nt, Neisseria meningitidis Z2491
acaggcggauggcguuu

SEQ ID NO: 3352708 - RNA, 21 nt, Neisseria meningitidis Z2491
acaggcgggcguuccacaaau

SEQ ID NO: 3352709 - RNA, 14 nt, Neisseria meningitidis Z2491
acaggcuccguauc

SEQ ID NO: 3352710 - RNA, 19 nt, Neisseria meningitidis Z2491
acagggaaagcagcagccc

SEQ ID NO: 3352711 - RNA, 12 nt, Neisseria meningitidis Z2491
acaggguuuuua

SEQ ID NO: 3352712 - RNA, 13 nt, Neisseria meningitidis Z2491
acaguacaaauag

SEQ ID NO: 3352713 - RNA, 14 nt, Neisseria meningitidis Z2491
acaguacaaauagu

SEQ ID NO: 3352714 - RNA, 22 nt, Neisseria meningitidis Z2491
acagugauggcuucuaaaaauu

SEQ ID NO: 3352715 - RNA, 12 nt, Neisseria meningitidis Z2491
acaguuuggaga

SEQ ID NO: 3352716 - RNA, 13 nt, Neisseria meningitidis Z2491
acaguuuuuccag

SEQ ID NO: 3352717 - RNA, 15 nt, Neisseria meningitidis Z2491
acauaaaaauagcuu

SEQ ID NO: 3352718 - RNA, 13 nt, Neisseria meningitidis Z2491
acauaaaaugccg

SEQ ID NO: 3352719 - RNA, 21 nt, Neisseria meningitidis Z2491
acauaaacagcacgauacaca

SEQ ID NO: 3352720 - RNA, 18 nt, Neisseria meningitidis Z2491
acauaaugcccgagcaaa

SEQ ID NO: 3352721 - RNA, 13 nt, Neisseria meningitidis Z2491
acauaauucaaau

SEQ ID NO: 3352722 - RNA, 13 nt, Neisseria meningitidis Z2491
acauaccgccccu

SEQ ID NO: 3352723 - RNA, 22 nt, Neisseria meningitidis Z2491
acauaccgccccuaaaaugccc

SEQ ID NO: 3352724 - RNA, 22 nt, Neisseria meningitidis Z2491
acauacggauacuccaaaccuu

SEQ ID NO: 3352725 - RNA, 21 nt, Neisseria meningitidis Z2491
acauacuuuguuucaaaaugu

SEQ ID NO: 3352726 - RNA, 20 nt, Neisseria meningitidis Z2491
acauagauggggaugauggg

SEQ ID NO: 3352727 - RNA, 16 nt, Neisseria meningitidis Z2491
acauagguuacuaaaa

SEQ ID NO: 3352728 - RNA, 18 nt, Neisseria meningitidis Z2491
acauauacaucgcgccca

SEQ ID NO: 3352729 - RNA, 21 nt, Neisseria meningitidis Z2491
acauauuucgccgcuucuuuc

SEQ ID NO: 3352730 - RNA, 23 nt, Neisseria meningitidis Z2491
acaucagcaccacuguugccaca

SEQ ID NO: 3352731 - RNA, 22 nt, Neisseria meningitidis Z2491
acaucaucuuauuuauuuuuuc

SEQ ID NO: 3352732 - RNA, 23 nt, Neisseria meningitidis Z2491
acaucccccagccgaaaauacug

SEQ ID NO: 3352733 - RNA, 16 nt, Neisseria meningitidis Z2491
acaucccgucauuccc

SEQ ID NO: 3352734 - RNA, 17 nt, Neisseria meningitidis Z2491
acaucgcucaaauucug

SEQ ID NO: 3352735 - RNA, 13 nt, Neisseria meningitidis Z2491
acaucguucaaac

SEQ ID NO: 3352736 - RNA, 21 nt, Neisseria meningitidis Z2491
acaucguuugcauucugcgga

SEQ ID NO: 3352737 - RNA, 13 nt, Neisseria meningitidis Z2491
acaucugauuuuu

SEQ ID NO: 3352738 - RNA, 19 nt, Neisseria meningitidis Z2491
acaugccaccgucauuccc

SEQ ID NO: 3352739 - RNA, 22 nt, Neisseria meningitidis Z2491
acauggcggugcgguagccgcc

SEQ ID NO: 3352740 - RNA, 12 nt, Neisseria meningitidis Z2491
acauuaaaaaau

SEQ ID NO: 3352741 - RNA, 19 nt, Neisseria meningitidis Z2491
acauuaagauguuuuucca

SEQ ID NO: 3352742 - RNA, 13 nt, Neisseria meningitidis Z2491
acauuacugaaau

SEQ ID NO: 3352743 - RNA, 15 nt, Neisseria meningitidis Z2491
acauuccaucaacaa

SEQ ID NO: 3352744 - RNA, 17 nt, Neisseria meningitidis Z2491
acauuccaucaacaaaa

SEQ ID NO: 3352745 - RNA, 18 nt, Neisseria meningitidis Z2491
acauuccaucaacaaaau

SEQ ID NO: 3352746 - RNA, 15 nt, Neisseria meningitidis Z2491
acauuccgccauucc

SEQ ID NO: 3352747 - RNA, 16 nt, Neisseria meningitidis Z2491
acauuccgucauuccc

SEQ ID NO: 3352748 - RNA, 15 nt, Neisseria meningitidis Z2491
acauucuccguuuca

SEQ ID NO: 3352749 - RNA, 20 nt, Neisseria meningitidis Z2491
acauugccaaauagaaaaua

SEQ ID NO: 3352750 - RNA, 16 nt, Neisseria meningitidis Z2491
acauugcuaaaacaac

SEQ ID NO: 3352751 - RNA, 21 nt, Neisseria meningitidis Z2491
acauuuagaaaaaauauacca

SEQ ID NO: 3352752 - RNA, 23 nt, Neisseria meningitidis Z2491
acauuuaucaggagcaacagaaa

SEQ ID NO: 3352753 - RNA, 23 nt, Neisseria meningitidis Z2491
acauuuaucgggagcaacagaaa

SEQ ID NO: 3352754 - RNA, 15 nt, Neisseria meningitidis Z2491
acauuucagacggca

SEQ ID NO: 3352755 - RNA, 16 nt, Neisseria meningitidis Z2491
acauuucagacggcau

SEQ ID NO: 3352756 - RNA, 17 nt, Neisseria meningitidis Z2491
acauuucagacggcauu

SEQ ID NO: 3352757 - RNA, 14 nt, Neisseria meningitidis Z2491
acauuucggcaagg

SEQ ID NO: 3352758 - RNA, 18 nt, Neisseria meningitidis Z2491
acauuuguuccaauuccu

SEQ ID NO: 3352759 - RNA, 20 nt, Neisseria meningitidis Z2491
accguuuaaaacagcauugc

SEQ ID NO: 3352760 - RNA, 16 nt, Neisseria meningitidis Z2491
accguuuaauuuuguu

SEQ ID NO: 3352761 - RNA, 17 nt, Neisseria meningitidis Z2491
accguuucagacggcau

SEQ ID NO: 3352762 - RNA, 18 nt, Neisseria meningitidis Z2491
accguuucagacggcauu

SEQ ID NO: 3352763 - RNA, 22 nt, Neisseria meningitidis Z2491
accguuuccuccucgccgucuu

SEQ ID NO: 3352764 - RNA, 19 nt, Neisseria meningitidis Z2491
accuaagauauaacuuuaa

SEQ ID NO: 3352765 - RNA, 14 nt, Neisseria meningitidis Z2491
accuacagauuccg

SEQ ID NO: 3352766 - RNA, 20 nt, Neisseria meningitidis Z2491
accuacagauuccgaaggga

SEQ ID NO: 3352767 - RNA, 12 nt, Neisseria meningitidis Z2491
accuacauuccg

SEQ ID NO: 3352768 - RNA, 20 nt, Neisseria meningitidis Z2491
accuagauucccgccugcgc

SEQ ID NO: 3352769 - RNA, 16 nt, Neisseria meningitidis Z2491
accucauucaaacggu

SEQ ID NO: 3352770 - RNA, 22 nt, Neisseria meningitidis Z2491
accucauugccgcccguuuaaa

SEQ ID NO: 3352771 - RNA, 13 nt, Neisseria meningitidis Z2491
accuccagcacca

SEQ ID NO: 3352772 - RNA, 14 nt, Neisseria meningitidis Z2491
accuccagcaccac

SEQ ID NO: 3352773 - RNA, 15 nt, Neisseria meningitidis Z2491
accucccaauccugc

SEQ ID NO: 3352774 - RNA, 13 nt, Neisseria meningitidis Z2491
accucguucggac

SEQ ID NO: 3352775 - RNA, 18 nt, Neisseria meningitidis Z2491
accucguucggacggcau

SEQ ID NO: 3352776 - RNA, 19 nt, Neisseria meningitidis Z2491
accugaaccuuauagugga

SEQ ID NO: 3352777 - RNA, 20 nt, Neisseria meningitidis Z2491
accugcaucacgucauuccu

SEQ ID NO: 3352778 - RNA, 20 nt, Neisseria meningitidis Z2491
accugcccgacagccgcaaa

SEQ ID NO: 3352779 - RNA, 14 nt, Neisseria meningitidis Z2491
accugcugccgucg

SEQ ID NO: 3352780 - RNA, 15 nt, Neisseria meningitidis Z2491
accugcuguuugagc

SEQ ID NO: 3352781 - RNA, 16 nt, Neisseria meningitidis Z2491
accuguuucagacggc

SEQ ID NO: 3352782 - RNA, 15 nt, Neisseria meningitidis Z2491
accuguuuuucaaag

SEQ ID NO: 3352783 - RNA, 14 nt, Neisseria meningitidis Z2491
accuuaacaaucac

SEQ ID NO: 3352784 - RNA, 22 nt, Neisseria meningitidis Z2491
accuuagagaaucguucucuuu

SEQ ID NO: 3352785 - RNA, 12 nt, Neisseria meningitidis Z2491
accuuauagugg

SEQ ID NO: 3352786 - RNA, 18 nt, Neisseria meningitidis Z2491
accuucgggcagcggcaa

SEQ ID NO: 3352787 - RNA, 17 nt, Neisseria meningitidis Z2491
accuucguaauuuuucu

SEQ ID NO: 3352788 - RNA, 15 nt, Neisseria meningitidis Z2491
accuugagccaagca

SEQ ID NO: 3352789 - RNA, 14 nt, Neisseria meningitidis Z2491
accuugcuggcaga

SEQ ID NO: 3352790 - RNA, 20 nt, Neisseria meningitidis Z2491
accuuuccgccgucauuccc

SEQ ID NO: 3352791 - RNA, 16 nt, Neisseria meningitidis Z2491
accuuucgucauuccc

SEQ ID NO: 3352792 - RNA, 13 nt, Neisseria meningitidis Z2491
accuuugagcugg

SEQ ID NO: 3352793 - RNA, 17 nt, Neisseria meningitidis Z2491
accuuugcaaaauuccu

SEQ ID NO: 3352794 - RNA, 17 nt, Neisseria meningitidis Z2491
accuuugcaauaacaua

SEQ ID NO: 3352795 - RNA, 14 nt, Neisseria meningitidis Z2491
accuuuggcggcgu

SEQ ID NO: 3352796 - RNA, 18 nt, Neisseria meningitidis Z2491
accuuugggcggcggcaa

SEQ ID NO: 3352797 - RNA, 23 nt, Neisseria meningitidis Z2491
accuuugggcggcggcaauauuc

SEQ ID NO: 3352798 - RNA, 15 nt, Neisseria meningitidis Z2491
acgaaaacaggaauc

SEQ ID NO: 3352799 - RNA, 17 nt, Neisseria meningitidis Z2491
acgaaaagcuaaagcaa

SEQ ID NO: 3352800 - RNA, 18 nt, Neisseria meningitidis Z2491
acgaaaaguugcaagaau

SEQ ID NO: 3352801 - RNA, 17 nt, Neisseria meningitidis Z2491
acgaaaaugccgucuga

SEQ ID NO: 3352802 - RNA, 19 nt, Neisseria meningitidis Z2491
acgaaagugggaaucuaga

SEQ ID NO: 3352803 - RNA, 19 nt, Neisseria meningitidis Z2491
acgaaaguuggaauccagu

SEQ ID NO: 3352804 - RNA, 22 nt, Neisseria meningitidis Z2491
acgaacaaugcaaaaacaucag

SEQ ID NO: 3352805 - RNA, 17 nt, Neisseria meningitidis Z2491
acgaacaggacaaaaau

SEQ ID NO: 3352806 - RNA, 20 nt, Neisseria meningitidis Z2491
acgaagaacgccaaacccaa

SEQ ID NO: 3352807 - RNA, 19 nt, Neisseria meningitidis Z2491
acgaagagcggcaggaauu

SEQ ID NO: 3352808 - RNA, 12 nt, Neisseria meningitidis Z2491
acgaagccgcag

SEQ ID NO: 3352809 - RNA, 22 nt, Neisseria meningitidis Z2491
acgaaggcuaucacgguugugc

SEQ ID NO: 3352810 - RNA, 15 nt, Neisseria meningitidis Z2491
acgaaucuuauccac

SEQ ID NO: 3352811 - RNA, 15 nt, Neisseria meningitidis Z2491
acgacagcagcagcc

SEQ ID NO: 3352812 - RNA, 18 nt, Neisseria meningitidis Z2491
acgacgcggcugcugccu

SEQ ID NO: 3352813 - RNA, 16 nt, Neisseria meningitidis Z2491
acgacucaaaaucauc

SEQ ID NO: 3352814 - RNA, 12 nt, Neisseria meningitidis Z2491
acgagcaauauu

SEQ ID NO: 3352815 - RNA, 23 nt, Neisseria meningitidis Z2491
acgagguuacaguuuaaucccuu

SEQ ID NO: 3352816 - RNA, 19 nt, Neisseria meningitidis Z2491
acgaguccaagacaggcgg

SEQ ID NO: 3352817 - RNA, 19 nt, Neisseria meningitidis Z2491
acgaguuccgcaaacgccu

SEQ ID NO: 3352818 - RNA, 19 nt, Neisseria meningitidis Z2491
acgauacacaaaaaagcca

SEQ ID NO: 3352819 - RNA, 21 nt, Neisseria meningitidis Z2491
acgauauuacgaacaaugcaa

SEQ ID NO: 3352820 - RNA, 16 nt, Neisseria meningitidis Z2491
acgaugcuggcggggc

SEQ ID NO: 3352821 - RNA, 17 nt, Neisseria meningitidis Z2491
acgauuuugugccguuc

SEQ ID NO: 3352822 - RNA, 22 nt, Neisseria meningitidis Z2491
acgcaaaacacaacuuuuccca

SEQ ID NO: 3352823 - RNA, 17 nt, Neisseria meningitidis Z2491
acgcaaagcugcaagaa

SEQ ID NO: 3352824 - RNA, 14 nt, Neisseria meningitidis Z2491
acgcaauaccaaac

SEQ ID NO: 3352825 - RNA, 17 nt, Neisseria meningitidis Z2491
acgcagccagcaucgca

SEQ ID NO: 3352826 - RNA, 17 nt, Neisseria meningitidis Z2491
acgcaggcuuuugaggc

SEQ ID NO: 3352827 - RNA, 19 nt, Neisseria meningitidis Z2491
acgcaggguuaagaaaacc

SEQ ID NO: 3352828 - RNA, 20 nt, Neisseria meningitidis Z2491
acgcaggguuaagaaaaccu

SEQ ID NO: 3352829 - RNA, 20 nt, Neisseria meningitidis Z2491
acgcauaaaaaugcgccaaa

SEQ ID NO: 3352830 - RNA, 16 nt, Neisseria meningitidis Z2491
acgcauucagacggca

SEQ ID NO: 3352831 - RNA, 17 nt, Neisseria meningitidis Z2491
acgcauucagacggcau

SEQ ID NO: 3352832 - RNA, 18 nt, Neisseria meningitidis Z2491
acgccagcacaaacagca

SEQ ID NO: 3352833 - RNA, 21 nt, Neisseria meningitidis Z2491
acgccagcacaaacagcaugg

SEQ ID NO: 3352834 - RNA, 13 nt, Neisseria meningitidis Z2491
acgccccucccaa

SEQ ID NO: 3352835 - RNA, 18 nt, Neisseria meningitidis Z2491
acgccgccgcgccccaag

SEQ ID NO: 3352836 - RNA, 16 nt, Neisseria meningitidis Z2491
acgccgccguccauca

SEQ ID NO: 3352837 - RNA, 19 nt, Neisseria meningitidis Z2491
acgccguacugguuuaaau

SEQ ID NO: 3352838 - RNA, 18 nt, Neisseria meningitidis Z2491
acgccugguacgcuucgc

SEQ ID NO: 3352839 - RNA, 14 nt, Neisseria meningitidis Z2491
acgcgaaaaugccg

SEQ ID NO: 3352840 - RNA, 22 nt, Neisseria meningitidis Z2491
acgcggcugaaaaaaugccguc

SEQ ID NO: 3352841 - RNA, 16 nt, Neisseria meningitidis Z2491
acgcgggaaugacgag

SEQ ID NO: 3352842 - RNA, 20 nt, Neisseria meningitidis Z2491
acgcggugcugcgccaucag

SEQ ID NO: 3352843 - RNA, 14 nt, Neisseria meningitidis Z2491
acgcggugguuggu

SEQ ID NO: 3352844 - RNA, 18 nt, Neisseria meningitidis Z2491
acgcucaaacacccccga

SEQ ID NO: 3352845 - RNA, 15 nt, Neisseria meningitidis Z2491
acgcucguaaaacgc

SEQ ID NO: 3352846 - RNA, 17 nt, Neisseria meningitidis Z2491
acgcugcaaaaauuuau

SEQ ID NO: 3352847 - RNA, 18 nt, Neisseria meningitidis Z2491
acgcuguaccgguuuaaa

SEQ ID NO: 3352848 - RNA, 23 nt, Neisseria meningitidis Z2491
acgcuguuuuuuguugccugauu

SEQ ID NO: 3352849 - RNA, 22 nt, Neisseria meningitidis Z2491
acgcuucagacggcauuuugau

SEQ ID NO: 3352850 - RNA, 15 nt, Neisseria meningitidis Z2491
acgcuugaaucuuca

SEQ ID NO: 3352851 - RNA, 17 nt, Neisseria meningitidis Z2491
acggaaaguggaacaga

SEQ ID NO: 3352852 - RNA, 18 nt, Neisseria meningitidis Z2491
acggaaaguggaacagaa

SEQ ID NO: 3352853 - RNA, 13 nt, Neisseria meningitidis Z2491
acggacacccgau

SEQ ID NO: 3352854 - RNA, 13 nt, Neisseria meningitidis Z2491
acggagccagccc

SEQ ID NO: 3352855 - RNA, 23 nt, Neisseria meningitidis Z2491
acggaugucgaguucuuuuaaag

SEQ ID NO: 3352856 - RNA, 15 nt, Neisseria meningitidis Z2491
acggcaaaaauuuau

SEQ ID NO: 3352857 - RNA, 19 nt, Neisseria meningitidis Z2491
acggcaaaaauuuauccga

SEQ ID NO: 3352858 - RNA, 13 nt, Neisseria meningitidis Z2491
acggcaacaucau

SEQ ID NO: 3352859 - RNA, 17 nt, Neisseria meningitidis Z2491
acggcaacaucauagaa

SEQ ID NO: 3352860 - RNA, 11 nt, Neisseria meningitidis Z2491
acugccgccgc

SEQ ID NO: 3352861 - RNA, 13 nt, Neisseria meningitidis Z2491
acugccucuuuuc

SEQ ID NO: 3352862 - RNA, 13 nt, Neisseria meningitidis Z2491
acugccugccgca

SEQ ID NO: 3352863 - RNA, 13 nt, Neisseria meningitidis Z2491
acugccugccuuc

SEQ ID NO: 3352864 - RNA, 17 nt, Neisseria meningitidis Z2491
acugcgguucggacggc

SEQ ID NO: 3352865 - RNA, 14 nt, Neisseria meningitidis Z2491
acugcuguuugaca

SEQ ID NO: 3352866 - RNA, 10 nt, Neisseria meningitidis Z2491
acuggauucc

SEQ ID NO: 3352867 - RNA, 14 nt, Neisseria meningitidis Z2491
acuggauucccacu

SEQ ID NO: 3352868 - RNA, 13 nt, Neisseria meningitidis Z2491
acuggauucccgc

SEQ ID NO: 3352869 - RNA, 20 nt, Neisseria meningitidis Z2491
acugggcauacagcucgucc

SEQ ID NO: 3352870 - RNA, 19 nt, Neisseria meningitidis Z2491
acugguugagugcgaccug

SEQ ID NO: 3352871 - RNA, 13 nt, Neisseria meningitidis Z2491
acugguuuaaauu

SEQ ID NO: 3352872 - RNA, 21 nt, Neisseria meningitidis Z2491
acuguaaagauaaaucuaugu

SEQ ID NO: 3352873 - RNA, 22 nt, Neisseria meningitidis Z2491
acuguaaagauaaaucuauguu

SEQ ID NO: 3352874 - RNA, 17 nt, Neisseria meningitidis Z2491
acuguaccaaauuauug

SEQ ID NO: 3352875 - RNA, 15 nt, Neisseria meningitidis Z2491
acuguccggcaugau

SEQ ID NO: 3352876 - RNA, 19 nt, Neisseria meningitidis Z2491
acuguccggcaugauuuuc

SEQ ID NO: 3352877 - RNA, 14 nt, Neisseria meningitidis Z2491
acugucugcggcuu

SEQ ID NO: 3352878 - RNA, 22 nt, Neisseria meningitidis Z2491
acugucugcggcuucgucgccu

SEQ ID NO: 3352879 - RNA, 12 nt, Neisseria meningitidis Z2491
acugugccauug

SEQ ID NO: 3352880 - RNA, 21 nt, Neisseria meningitidis Z2491
acugugccuguuuaaauucau

SEQ ID NO: 3352881 - RNA, 22 nt, Neisseria meningitidis Z2491
acuuaagaaacaaagcuuuaaa

SEQ ID NO: 3352882 - RNA, 15 nt, Neisseria meningitidis Z2491
acuuacgcaacccua

SEQ ID NO: 3352883 - RNA, 20 nt, Neisseria meningitidis Z2491
acuuagcucgaagagaacga

SEQ ID NO: 3352884 - RNA, 13 nt, Neisseria meningitidis Z2491
acuuauacacacg

SEQ ID NO: 3352885 - RNA, 22 nt, Neisseria meningitidis Z2491
acuucaaguccgaacauacggc

SEQ ID NO: 3352886 - RNA, 16 nt, Neisseria meningitidis Z2491
acuucaauagugggaa

SEQ ID NO: 3352887 - RNA, 14 nt, Neisseria meningitidis Z2491
acuucauuuuuuca

SEQ ID NO: 3352888 - RNA, 13 nt, Neisseria meningitidis Z2491
acuuccaaaccgc

SEQ ID NO: 3352889 - RNA, 14 nt, Neisseria meningitidis Z2491
acuuccagcaccag

SEQ ID NO: 3352890 - RNA, 14 nt, Neisseria meningitidis Z2491
acuucgauugccaa

SEQ ID NO: 3352891 - RNA, 15 nt, Neisseria meningitidis Z2491
acuucgauugccaag

SEQ ID NO: 3352892 - RNA, 14 nt, Neisseria meningitidis Z2491
acuucgccauuccc

SEQ ID NO: 3352893 - RNA, 16 nt, Neisseria meningitidis Z2491
acuucguauuccgaca

SEQ ID NO: 3352894 - RNA, 19 nt, Neisseria meningitidis Z2491
acuucugacagcauuucca

SEQ ID NO: 3352895 - RNA, 18 nt, Neisseria meningitidis Z2491
acuugccgcauaaaucaa

SEQ ID NO: 3352896 - RNA, 22 nt, Neisseria meningitidis Z2491
acuugccgcauaaaucaacagc

SEQ ID NO: 3352897 - RNA, 15 nt, Neisseria meningitidis Z2491
acuugcugcaggugc

SEQ ID NO: 3352898 - RNA, 14 nt, Neisseria meningitidis Z2491
acuuggugcuucag

SEQ ID NO: 3352899 - RNA, 22 nt, Neisseria meningitidis Z2491
acuugguggucggcauucaaac

SEQ ID NO: 3352900 - RNA, 15 nt, Neisseria meningitidis Z2491
acuugucaagaaaca

SEQ ID NO: 3352901 - RNA, 17 nt, Neisseria meningitidis Z2491
acuugucaagaaacacg

SEQ ID NO: 3352902 - RNA, 16 nt, Neisseria meningitidis Z2491
acuuguucggguguca

SEQ ID NO: 3352903 - RNA, 19 nt, Neisseria meningitidis Z2491
acuuuaaucccgucauucc

SEQ ID NO: 3352904 - RNA, 13 nt, Neisseria meningitidis Z2491
acuuuauccacca

SEQ ID NO: 3352905 - RNA, 17 nt, Neisseria meningitidis Z2491
acuuucagauaaucuuu

SEQ ID NO: 3352906 - RNA, 16 nt, Neisseria meningitidis Z2491
acuuuccgucauuccc

SEQ ID NO: 3352907 - RNA, 18 nt, Neisseria meningitidis Z2491
acuuugacuuuuuuaccu

SEQ ID NO: 3352908 - RNA, 18 nt, Neisseria meningitidis Z2491
acuuugcguuucuagauu

SEQ ID NO: 3352909 - RNA, 13 nt, Neisseria meningitidis Z2491
acuuuggaacaaa

SEQ ID NO: 3352910 - RNA, 14 nt, Neisseria meningitidis Z2491
acuuuggaacaaaa

SEQ ID NO: 3352911 - RNA, 17 nt, Neisseria meningitidis Z2491
acuuuggaacaaaaaau

SEQ ID NO: 3352912 - RNA, 16 nt, Neisseria meningitidis Z2491
acuuuguuucaaaaug

SEQ ID NO: 3352913 - RNA, 17 nt, Neisseria meningitidis Z2491
acuuuucugauuuuucc

SEQ ID NO: 3352914 - RNA, 16 nt, Neisseria meningitidis Z2491
acuuuugagccgucau

SEQ ID NO: 3352915 - RNA, 19 nt, Neisseria meningitidis Z2491
acuuuuugcgccagcggca

SEQ ID NO: 3352916 - RNA, 16 nt, Neisseria meningitidis Z2491
acuuuuuucaagccuu

SEQ ID NO: 3352917 - RNA, 21 nt, Neisseria meningitidis Z2491
acuuuuuucgauaugaaaaga

SEQ ID NO: 3352918 - RNA, 23 nt, Neisseria meningitidis Z2491
agaaaacagaaagccaaaaacag

SEQ ID NO: 3352919 - RNA, 16 nt, Neisseria meningitidis Z2491
agaaaaccaaaaacag

SEQ ID NO: 3352920 - RNA, 13 nt, Neisseria meningitidis Z2491
agaaaaccaaaau

SEQ ID NO: 3352921 - RNA, 14 nt, Neisseria meningitidis Z2491
agaaaaccaaaauc

SEQ ID NO: 3352922 - RNA, 18 nt, Neisseria meningitidis Z2491
agaaaaccaaaaucagaa

SEQ ID NO: 3352923 - RNA, 18 nt, Neisseria meningitidis Z2491
agaaaaccgaaacagaaa

SEQ ID NO: 3352924 - RNA, 19 nt, Neisseria meningitidis Z2491
agaaaaccugcaucccguc

SEQ ID NO: 3352925 - RNA, 18 nt, Neisseria meningitidis Z2491
agaaaaggucgucugaaa

SEQ ID NO: 3352926 - RNA, 19 nt, Neisseria meningitidis Z2491
agaaaaucaaaaacagaaa

SEQ ID NO: 3352927 - RNA, 19 nt, Neisseria meningitidis Z2491
agaaaaucggacggacgca

SEQ ID NO: 3352928 - RNA, 13 nt, Neisseria meningitidis Z2491
agaaaauugaaau

SEQ ID NO: 3352929 - RNA, 17 nt, Neisseria meningitidis Z2491
agaaacaaagcuuuaaa

SEQ ID NO: 3352930 - RNA, 18 nt, Neisseria meningitidis Z2491
agaaaccacccugccguc

SEQ ID NO: 3352931 - RNA, 13 nt, Neisseria meningitidis Z2491
agaaacccaaaau

SEQ ID NO: 3352932 - RNA, 20 nt, Neisseria meningitidis Z2491
agaaacccgaaacagcaacu

SEQ ID NO: 3352933 - RNA, 19 nt, Neisseria meningitidis Z2491
agaaaccgcucugccguca

SEQ ID NO: 3352934 - RNA, 18 nt, Neisseria meningitidis Z2491
agaaaccuaaaauccguc

SEQ ID NO: 3352935 - RNA, 17 nt, Neisseria meningitidis Z2491
agaaaccuaaaauucgu

SEQ ID NO: 3352936 - RNA, 15 nt, Neisseria meningitidis Z2491
agaaaccucaaaucc

SEQ ID NO: 3352937 - RNA, 19 nt, Neisseria meningitidis Z2491
agaaaccugaaaacagaaa

SEQ ID NO: 3352938 - RNA, 17 nt, Neisseria meningitidis Z2491
agaaagcagaaauaagg

SEQ ID NO: 3352939 - RNA, 20 nt, Neisseria meningitidis Z2491
agaaagcauacggcugauuu

SEQ ID NO: 3352940 - RNA, 15 nt, Neisseria meningitidis Z2491
agaaagccaaaaaca

SEQ ID NO: 3352941 - RNA, 17 nt, Neisseria meningitidis Z2491
agaaagggaauccuuuc

SEQ ID NO: 3352942 - RNA, 13 nt, Neisseria meningitidis Z2491
agaaaguggaauu

SEQ ID NO: 3352943 - RNA, 15 nt, Neisseria meningitidis Z2491
agaaauaaggauaua

SEQ ID NO: 3352944 - RNA, 17 nt, Neisseria meningitidis Z2491
agaaaucagaaaaguuu

SEQ ID NO: 3352945 - RNA, 18 nt, Neisseria meningitidis Z2491
agaaaucugugaaaauca

SEQ ID NO: 3352946 - RNA, 21 nt, Neisseria meningitidis Z2491
agaaaugacggaaacucaaaa

SEQ ID NO: 3352947 - RNA, 15 nt, Neisseria meningitidis Z2491
agaaaugacugaaac

SEQ ID NO: 3352948 - RNA, 21 nt, Neisseria meningitidis Z2491
agaaaugacugaaacucaaaa

SEQ ID NO: 3352949 - RNA, 15 nt, Neisseria meningitidis Z2491
agaaaugacugaaau

SEQ ID NO: 3352950 - RNA, 13 nt, Neisseria meningitidis Z2491
agaaauucaaaaa

SEQ ID NO: 3352951 - RNA, 18 nt, Neisseria meningitidis Z2491
agaaauuuauaaacaaaa

SEQ ID NO: 3352952 - RNA, 20 nt, Neisseria meningitidis Z2491
agaaauuuauaaacaaaaaa

SEQ ID NO: 3352953 - RNA, 14 nt, Neisseria meningitidis Z2491
agaacagaaaacca

SEQ ID NO: 3352954 - RNA, 21 nt, Neisseria meningitidis Z2491
agaacccaaaccgucauuccc

SEQ ID NO: 3352955 - RNA, 15 nt, Neisseria meningitidis Z2491
agaacgguuucuguu

SEQ ID NO: 3352956 - RNA, 14 nt, Neisseria meningitidis Z2491
agaacuucagacgg

SEQ ID NO: 3352957 - RNA, 13 nt, Neisseria meningitidis Z2491
agaagacgugcaa

SEQ ID NO: 3352958 - RNA, 19 nt, Neisseria meningitidis Z2491
agaagauuuuuguuuaucu

SEQ ID NO: 3352959 - RNA, 12 nt, Neisseria meningitidis Z2491
agaagccuugcg

SEQ ID NO: 3352960 - RNA, 12 nt, Neisseria meningitidis Z2491
agaauaaggcaa

SEQ ID NO: 3352961 - RNA, 22 nt, Neisseria meningitidis Z2491
agaauacugccuguaaaaccaa

SEQ ID NO: 3352962 - RNA, 15 nt, Neisseria meningitidis Z2491
agaaucguucucuuu

SEQ ID NO: 3352963 - RNA, 18 nt, Neisseria meningitidis Z2491
agaaugaaaaugccgucu

SEQ ID NO: 3352964 - RNA, 22 nt, Neisseria meningitidis Z2491
agaaugaaaaugccgucugaag

SEQ ID NO: 3352965 - RNA, 23 nt, Neisseria meningitidis Z2491
agaaugccgguuaacggccgggc

SEQ ID NO: 3352966 - RNA, 20 nt, Neisseria meningitidis Z2491
agaaugccgucugaaauguu

SEQ ID NO: 3352967 - RNA, 16 nt, Neisseria meningitidis Z2491
agaaugccgucugaag

SEQ ID NO: 3352968 - RNA, 20 nt, Neisseria meningitidis Z2491
agaauggcaaaauuucagau

SEQ ID NO: 3352969 - RNA, 16 nt, Neisseria meningitidis Z2491
agaauugauucuccca

SEQ ID NO: 3352970 - RNA, 19 nt, Neisseria meningitidis Z2491
agaauuuauacccucucaa

SEQ ID NO: 3352971 - RNA, 17 nt, Neisseria meningitidis Z2491
agaauuuaucagaaaug

SEQ ID NO: 3352972 - RNA, 14 nt, Neisseria meningitidis Z2491
agaauuuaucggaa

SEQ ID NO: 3352973 - RNA, 17 nt, Neisseria meningitidis Z2491
agacaauggagcaggca

SEQ ID NO: 3352974 - RNA, 16 nt, Neisseria meningitidis Z2491
agacaguacaaauagu

SEQ ID NO: 3352975 - RNA, 23 nt, Neisseria meningitidis Z2491
agacaucccccaaccaauauuca

SEQ ID NO: 3352976 - RNA, 13 nt, Neisseria meningitidis Z2491
agacauuaaaaaa

SEQ ID NO: 3352977 - RNA, 14 nt, Neisseria meningitidis Z2491
agacauuaaaaaau

SEQ ID NO: 3352978 - RNA, 21 nt, Neisseria meningitidis Z2491
agacauucaaugcuaaggcaa

SEQ ID NO: 3352979 - RNA, 16 nt, Neisseria meningitidis Z2491
agacauugcuaaaaca

SEQ ID NO: 3352980 - RNA, 17 nt, Neisseria meningitidis Z2491
agaccaaacagaacgca

SEQ ID NO: 3352981 - RNA, 22 nt, Neisseria meningitidis Z2491
agaccgaauuuaaucaagucuu

SEQ ID NO: 3352982 - RNA, 22 nt, Neisseria meningitidis Z2491
agaccgauaacggcggcaauaa

SEQ ID NO: 3352983 - RNA, 19 nt, Neisseria meningitidis Z2491
agaccgucuaaacgguauu

SEQ ID NO: 3352984 - RNA, 15 nt, Neisseria meningitidis Z2491
agaccuagauucccg

SEQ ID NO: 3352985 - RNA, 17 nt, Neisseria meningitidis Z2491
agaccuuugcaauaaca

SEQ ID NO: 3352986 - RNA, 20 nt, Neisseria meningitidis Z2491
agacgacagagcgccgucuc

SEQ ID NO: 3352987 - RNA, 21 nt, Neisseria meningitidis Z2491
agacggagauuuuguuuagac

SEQ ID NO: 3352988 - RNA, 17 nt, Neisseria meningitidis Z2491
agacggcaucaaaaacu

SEQ ID NO: 3352989 - RNA, 14 nt, Neisseria meningitidis Z2491
agacggcaucagua

SEQ ID NO: 3352990 - RNA, 18 nt, Neisseria meningitidis Z2491
agacggcauccgcuuaaa

SEQ ID NO: 3352991 - RNA, 15 nt, Neisseria meningitidis Z2491
agacggcaucgguuu

SEQ ID NO: 3352992 - RNA, 22 nt, Neisseria meningitidis Z2491
agacggcaucguauugcuaaau

SEQ ID NO: 3352993 - RNA, 15 nt, Neisseria meningitidis Z2491
agacggcauuucauu

SEQ ID NO: 3352994 - RNA, 14 nt, Neisseria meningitidis Z2491
agacggcauuucgu

SEQ ID NO: 3352995 - RNA, 13 nt, Neisseria meningitidis Z2491
agacggcauuucu

SEQ ID NO: 3352996 - RNA, 15 nt, Neisseria meningitidis Z2491
agacggcauuucuua

SEQ ID NO: 3352997 - RNA, 15 nt, Neisseria meningitidis Z2491
agacggcauuuucgc

SEQ ID NO: 3352998 - RNA, 15 nt, Neisseria meningitidis Z2491
agacggcauuuuguu

SEQ ID NO: 3352999 - RNA, 19 nt, Neisseria meningitidis Z2491
agacggcauuuuguugccg

SEQ ID NO: 3353000 - RNA, 15 nt, Neisseria meningitidis Z2491
agacggcauuuuugc

SEQ ID NO: 3353001 - RNA, 15 nt, Neisseria meningitidis Z2491
agacggcauuuuugu

SEQ ID NO: 3353002 - RNA, 17 nt, Neisseria meningitidis Z2491
agacggccaaacacauu

SEQ ID NO: 3353003 - RNA, 22 nt, Neisseria meningitidis Z2491
agacggccuuuggaaugguucg

SEQ ID NO: 3353004 - RNA, 17 nt, Neisseria meningitidis Z2491
agacggccuuuuugcuu

SEQ ID NO: 3353005 - RNA, 22 nt, Neisseria meningitidis Z2491
agacggccuuuuugcuuuuaga

SEQ ID NO: 3353006 - RNA, 21 nt, Neisseria meningitidis Z2491
agacggcggcaacagaaauaa

SEQ ID NO: 3353007 - RNA, 19 nt, Neisseria meningitidis Z2491
agacgguauucuuucgcuu

SEQ ID NO: 3353008 - RNA, 23 nt, Neisseria meningitidis Z2491
agacggugugccgaaguuaaauc

SEQ ID NO: 3353009 - RNA, 15 nt, Neisseria meningitidis Z2491
agacugcuuccgugu

SEQ ID NO: 3353010 - RNA, 20 nt, Neisseria meningitidis Z2491
agacuuggugcgcuauucca

SEQ ID NO: 3353011 - RNA, 18 nt, Neisseria meningitidis Z2491
agagaaauggcaguauca

SEQ ID NO: 3353012 - RNA, 15 nt, Neisseria meningitidis Z2491
agagaacgauucucu

SEQ ID NO: 3353013 - RNA, 17 nt, Neisseria meningitidis Z2491
agagaaucguucucuuu

SEQ ID NO: 3353014 - RNA, 18 nt, Neisseria meningitidis Z2491
agagaaucguucucuuug

SEQ ID NO: 3353015 - RNA, 21 nt, Neisseria meningitidis Z2491
agagaaucguucucuuugagc

SEQ ID NO: 3353016 - RNA, 13 nt, Neisseria meningitidis Z2491
agagaaugaagga

SEQ ID NO: 3353017 - RNA, 18 nt, Neisseria meningitidis Z2491
agagauucuggauuccca

SEQ ID NO: 3353018 - RNA, 13 nt, Neisseria meningitidis Z2491
agagcgcaaccuu

SEQ ID NO: 3353019 - RNA, 15 nt, Neisseria meningitidis Z2491
agagcggauucuguu

SEQ ID NO: 3353020 - RNA, 13 nt, Neisseria meningitidis Z2491
agagcugugcagu

SEQ ID NO: 3353021 - RNA, 20 nt, Neisseria meningitidis Z2491
agaggcauaccguugcgugu

SEQ ID NO: 3353022 - RNA, 21 nt, Neisseria meningitidis Z2491
agaggucuugcagguggaauu

SEQ ID NO: 3353023 - RNA, 13 nt, Neisseria meningitidis Z2491
agaguuucaaaau

SEQ ID NO: 3353024 - RNA, 13 nt, Neisseria meningitidis Z2491
agauaaauaccca

SEQ ID NO: 3353025 - RNA, 20 nt, Neisseria meningitidis Z2491
agauacaagaacuuuauccc

SEQ ID NO: 3353026 - RNA, 20 nt, Neisseria meningitidis Z2491
agauacacacaccggcaaac

SEQ ID NO: 3353027 - RNA, 19 nt, Neisseria meningitidis Z2491
agauagaccgcgacuggca

SEQ ID NO: 3353028 - RNA, 15 nt, Neisseria meningitidis Z2491
agauagcauauaaca

SEQ ID NO: 3353029 - RNA, 22 nt, Neisseria meningitidis Z2491
agauagcugaacugcuugaauu

SEQ ID NO: 3353030 - RNA, 21 nt, Neisseria meningitidis Z2491
agauauaacuuuaaucagucg

SEQ ID NO: 3353031 - RNA, 13 nt, Neisseria meningitidis Z2491
agauauagauuuc

SEQ ID NO: 3353032 - RNA, 21 nt, Neisseria meningitidis Z2491
agauauaguggauuaacaaaa

SEQ ID NO: 3353033 - RNA, 14 nt, Neisseria meningitidis Z2491
agauauggaaaugc

SEQ ID NO: 3353034 - RNA, 17 nt, Neisseria meningitidis Z2491
agaucaaggaugccguu

SEQ ID NO: 3353035 - RNA, 18 nt, Neisseria meningitidis Z2491
agaucauaccuaccgccu

SEQ ID NO: 3353036 - RNA, 17 nt, Neisseria meningitidis Z2491
agaucgaccgcuuccuc

SEQ ID NO: 3353037 - RNA, 15 nt, Neisseria meningitidis Z2491
agaugccugcuucgg

SEQ ID NO: 3353038 - RNA, 19 nt, Neisseria meningitidis Z2491
agaugggaauccgggauuu

SEQ ID NO: 3353039 - RNA, 22 nt, Neisseria meningitidis Z2491
agauggggaugaugggauuuag

SEQ ID NO: 3353040 - RNA, 20 nt, Neisseria meningitidis Z2491
agauguauuguccgccgucu

SEQ ID NO: 3353041 - RNA, 21 nt, Neisseria meningitidis Z2491
agauguauuguccgccgucuu

SEQ ID NO: 3353042 - RNA, 18 nt, Neisseria meningitidis Z2491
agauguuuuuccacaaaa

SEQ ID NO: 3353043 - RNA, 18 nt, Neisseria meningitidis Z2491
agauuaucugaaaguuug

SEQ ID NO: 3353044 - RNA, 22 nt, Neisseria meningitidis Z2491
agauucaacgcaagcggcgcau

SEQ ID NO: 3353045 - RNA, 19 nt, Neisseria meningitidis Z2491
agauuccacguucuagauu

SEQ ID NO: 3353046 - RNA, 20 nt, Neisseria meningitidis Z2491
agauuccacguucuagauuc

SEQ ID NO: 3353047 - RNA, 23 nt, Neisseria meningitidis Z2491
agauucccgccugcgcgggaaug

SEQ ID NO: 3353048 - RNA, 22 nt, Neisseria meningitidis Z2491
agauucccguuucagacggcau

SEQ ID NO: 3353049 - RNA, 18 nt, Neisseria meningitidis Z2491
agauucggauaccugcaa

SEQ ID NO: 3353050 - RNA, 11 nt, Neisseria meningitidis Z2491
agauucuagau

SEQ ID NO: 3353051 - RNA, 19 nt, Neisseria meningitidis Z2491
agauucuagauucccgcuu

SEQ ID NO: 3353052 - RNA, 17 nt, Neisseria meningitidis Z2491
agauucuggauucccac

SEQ ID NO: 3353053 - RNA, 19 nt, Neisseria meningitidis Z2491
agauucuugucaaaccaac

SEQ ID NO: 3353054 - RNA, 19 nt, Neisseria meningitidis Z2491
agauugagcauaaaauuuu

SEQ ID NO: 3353055 - RNA, 23 nt, Neisseria meningitidis Z2491
agauugaggaucuugauguguuu

SEQ ID NO: 3353056 - RNA, 19 nt, Neisseria meningitidis Z2491
agauugauaaaagcacaaa

SEQ ID NO: 3353057 - RNA, 23 nt, Neisseria meningitidis Z2491
agauugauaaaagcacaaauuaa

SEQ ID NO: 3353058 - RNA, 14 nt, Neisseria meningitidis Z2491
agauuguuucccag

SEQ ID NO: 3353059 - RNA, 15 nt, Neisseria meningitidis Z2491
agauuucaccgcugc

SEQ ID NO: 3353060 - RNA, 22 nt, Neisseria meningitidis Z2491
agauuuggcaguggcaauuuuu

SEQ ID NO: 3353061 - RNA, 15 nt, Neisseria meningitidis Z2491
agauuuguggcggau

SEQ ID NO: 3353062 - RNA, 19 nt, Neisseria meningitidis Z2491
agauuuuggagcaguaaaa

SEQ ID NO: 3353063 - RNA, 18 nt, Neisseria meningitidis Z2491
agcggaauuuacggugca

SEQ ID NO: 3353064 - RNA, 18 nt, Neisseria meningitidis Z2491
agcggacgauuucccugu

SEQ ID NO: 3353065 - RNA, 16 nt, Neisseria meningitidis Z2491
agcggauucuguugcu

SEQ ID NO: 3353066 - RNA, 22 nt, Neisseria meningitidis Z2491
agcggauuguucggaucggcag

SEQ ID NO: 3353067 - RNA, 16 nt, Neisseria meningitidis Z2491
agcggcaauauucaaa

SEQ ID NO: 3353068 - RNA, 16 nt, Neisseria meningitidis Z2491
agcggcaggaauuuau

SEQ ID NO: 3353069 - RNA, 23 nt, Neisseria meningitidis Z2491
agcggccgccaucaaaaaggcuu

SEQ ID NO: 3353070 - RNA, 17 nt, Neisseria meningitidis Z2491
agcgggaaucuaaaaau

SEQ ID NO: 3353071 - RNA, 13 nt, Neisseria meningitidis Z2491
agcgggaaucuag

SEQ ID NO: 3353072 - RNA, 17 nt, Neisseria meningitidis Z2491
agcgggcgcacuuagcc

SEQ ID NO: 3353073 - RNA, 19 nt, Neisseria meningitidis Z2491
agcggguuuucgauuuccg

SEQ ID NO: 3353074 - RNA, 13 nt, Neisseria meningitidis Z2491
agcgguuucuguu

SEQ ID NO: 3353075 - RNA, 23 nt, Neisseria meningitidis Z2491
agcgguuucuguuuuuuccgaua

SEQ ID NO: 3353076 - RNA, 21 nt, Neisseria meningitidis Z2491
agcgugcggacguucaaaccc

SEQ ID NO: 3353077 - RNA, 22 nt, Neisseria meningitidis Z2491
agcgugcggacguucaaacccu

SEQ ID NO: 3353078 - RNA, 23 nt, Neisseria meningitidis Z2491
agcguguuuguuucagacggcau

SEQ ID NO: 3353079 - RNA, 19 nt, Neisseria meningitidis Z2491
agcguuacuuugcguucac

SEQ ID NO: 3353080 - RNA, 15 nt, Neisseria meningitidis Z2491
agcguugccucgccu

SEQ ID NO: 3353081 - RNA, 14 nt, Neisseria meningitidis Z2491
agcguuggcucgcc

SEQ ID NO: 3353082 - RNA, 24 nt, Neisseria meningitidis Z2491
agcguuggcucgccuugccguacu

SEQ ID NO: 3353083 - RNA, 18 nt, Neisseria meningitidis Z2491
agcuaaggcgaggcaacg

SEQ ID NO: 3353084 - RNA, 19 nt, Neisseria meningitidis Z2491
agcuacggcucguuuaauu

SEQ ID NO: 3353085 - RNA, 17 nt, Neisseria meningitidis Z2491
agcuauccgcacagaaa

SEQ ID NO: 3353086 - RNA, 20 nt, Neisseria meningitidis Z2491
agcuaucuggccuuugucug

SEQ ID NO: 3353087 - RNA, 22 nt, Neisseria meningitidis Z2491
agcucaaagagaacaauucucu

SEQ ID NO: 3353088 - RNA, 23 nt, Neisseria meningitidis Z2491
agcucaguugguagagcgcaacc

SEQ ID NO: 3353089 - RNA, 14 nt, Neisseria meningitidis Z2491
agcuccgaaccgaa

SEQ ID NO: 3353090 - RNA, 22 nt, Neisseria meningitidis Z2491
agcucucccucuuuaaauuuaa

SEQ ID NO: 3353091 - RNA, 12 nt, Neisseria meningitidis Z2491
agcugaaaacag

SEQ ID NO: 3353092 - RNA, 13 nt, Neisseria meningitidis Z2491
agcugaaaacagc

SEQ ID NO: 3353093 - RNA, 16 nt, Neisseria meningitidis Z2491
agcugaaaacagcuga

SEQ ID NO: 3353094 - RNA, 16 nt, Neisseria meningitidis Z2491
agcugcaacugaaacc

SEQ ID NO: 3353095 - RNA, 14 nt, Neisseria meningitidis Z2491
agcugcagacagua

SEQ ID NO: 3353096 - RNA, 20 nt, Neisseria meningitidis Z2491
agcugcgggaaugacgggau

SEQ ID NO: 3353097 - RNA, 22 nt, Neisseria meningitidis Z2491
agcugguagggauacaaaucca

SEQ ID NO: 3353098 - RNA, 17 nt, Neisseria meningitidis Z2491
agcugugguuugccgag

SEQ ID NO: 3353099 - RNA, 19 nt, Neisseria meningitidis Z2491
agcuuccaacucggcaaac

SEQ ID NO: 3353100 - RNA, 21 nt, Neisseria meningitidis Z2491
agcuuccaacucggcaaacgc

SEQ ID NO: 3353101 - RNA, 23 nt, Neisseria meningitidis Z2491
agcuucgccaguuugcgcaugau

SEQ ID NO: 3353102 - RNA, 15 nt, Neisseria meningitidis Z2491
agcuucgucauuccc

SEQ ID NO: 3353103 - RNA, 23 nt, Neisseria meningitidis Z2491
agcuuguggguauuuaccagaaa

SEQ ID NO: 3353104 - RNA, 18 nt, Neisseria meningitidis Z2491
agcuuuagagauucugga

SEQ ID NO: 3353105 - RNA, 20 nt, Neisseria meningitidis Z2491
agcuuugaguuucuagauuc

SEQ ID NO: 3353106 - RNA, 23 nt, Neisseria meningitidis Z2491
agcuuuuugugaucgcgcugaau

SEQ ID NO: 3353107 - RNA, 20 nt, Neisseria meningitidis Z2491
aggaaaaaacauaugccguc

SEQ ID NO: 3353108 - RNA, 18 nt, Neisseria meningitidis Z2491
aggaaucggguuucagac

SEQ ID NO: 3353109 - RNA, 23 nt, Neisseria meningitidis Z2491
aggaaugacuguccgagacagaa

SEQ ID NO: 3353110 - RNA, 11 nt, Neisseria meningitidis Z2491
aggaaugcaaa

SEQ ID NO: 3353111 - RNA, 15 nt, Neisseria meningitidis Z2491
aggacaaagcguuca

SEQ ID NO: 3353112 - RNA, 22 nt, Neisseria meningitidis Z2491
aggacaaagcguucaggugcuu

SEQ ID NO: 3353113 - RNA, 15 nt, Neisseria meningitidis Z2491
aggacggaaauguuc

SEQ ID NO: 3353114 - RNA, 14 nt, Neisseria meningitidis Z2491
aggacggcuuugaa

SEQ ID NO: 3353115 - RNA, 14 nt, Neisseria meningitidis Z2491
aggacggcuuugcc

SEQ ID NO: 3353116 - RNA, 20 nt, Neisseria meningitidis Z2491
aggacguagucggugcuuug

SEQ ID NO: 3353117 - RNA, 20 nt, Neisseria meningitidis Z2491
aggagaaaucagaaaaguuu

SEQ ID NO: 3353118 - RNA, 17 nt, Neisseria meningitidis Z2491
aggauagagaacgauuc

SEQ ID NO: 3353119 - RNA, 16 nt, Neisseria meningitidis Z2491
aggaucuuauccaucc

SEQ ID NO: 3353120 - RNA, 16 nt, Neisseria meningitidis Z2491
aggaugccuagauggc

SEQ ID NO: 3353121 - RNA, 16 nt, Neisseria meningitidis Z2491
aggaugggguuucaga

SEQ ID NO: 3353122 - RNA, 16 nt, Neisseria meningitidis Z2491
aggcaaaaaaagaugc

SEQ ID NO: 3353123 - RNA, 20 nt, Neisseria meningitidis Z2491
aggcaaaaaaagaugccguc

SEQ ID NO: 3353124 - RNA, 19 nt, Neisseria meningitidis Z2491
aggcaaaugcugucugaaa

SEQ ID NO: 3353125 - RNA, 14 nt, Neisseria meningitidis Z2491
aggcaaauuucagu

SEQ ID NO: 3353126 - RNA, 15 nt, Neisseria meningitidis Z2491
aggcaaauuucaguc

SEQ ID NO: 3353127 - RNA, 23 nt, Neisseria meningitidis Z2491
aggcaacaucguacugguuuaaa

SEQ ID NO: 3353128 - RNA, 22 nt, Neisseria meningitidis Z2491
aggcaacgccguaccgguuuuu

SEQ ID NO: 3353129 - RNA, 20 nt, Neisseria meningitidis Z2491
aggcaacgccguacugguuu

SEQ ID NO: 3353130 - RNA, 22 nt, Neisseria meningitidis Z2491
aggcaacgccguacugguuuuu

SEQ ID NO: 3353131 - RNA, 21 nt, Neisseria meningitidis Z2491
aggcaacgcuguacugguuua

SEQ ID NO: 3353132 - RNA, 12 nt, Neisseria meningitidis Z2491
aggcaagcguuc

SEQ ID NO: 3353133 - RNA, 19 nt, Neisseria meningitidis Z2491
aggcaagcguucacgccag

SEQ ID NO: 3353134 - RNA, 15 nt, Neisseria meningitidis Z2491
aggcaaguuccaaga

SEQ ID NO: 3353135 - RNA, 19 nt, Neisseria meningitidis Z2491
aggcacaacgagcguaaga

SEQ ID NO: 3353136 - RNA, 15 nt, Neisseria meningitidis Z2491
aggcacgaagcccuc

SEQ ID NO: 3353137 - RNA, 16 nt, Neisseria meningitidis Z2491
aggcacgaaucuuauc

SEQ ID NO: 3353138 - RNA, 18 nt, Neisseria meningitidis Z2491
aggcacgaaucuuaucca

SEQ ID NO: 3353139 - RNA, 19 nt, Neisseria meningitidis Z2491
aggcacgaaucuuauccac

SEQ ID NO: 3353140 - RNA, 19 nt, Neisseria meningitidis Z2491
aggcacgguaaaccgccag

SEQ ID NO: 3353141 - RNA, 14 nt, Neisseria meningitidis Z2491
aggcagaaauccaa

SEQ ID NO: 3353142 - RNA, 19 nt, Neisseria meningitidis Z2491
aggcagcaaaaaugccguc

SEQ ID NO: 3353143 - RNA, 23 nt, Neisseria meningitidis Z2491
aggcagcaccguuuaaaacagca

SEQ ID NO: 3353144 - RNA, 9 nt, Neisseria meningitidis Z2491
aggcagccu

SEQ ID NO: 3353145 - RNA, 19 nt, Neisseria meningitidis Z2491
aggcagccuaaaacaucaa

SEQ ID NO: 3353146 - RNA, 20 nt, Neisseria meningitidis Z2491
aggcagggaaacgccuucag

SEQ ID NO: 3353147 - RNA, 16 nt, Neisseria meningitidis Z2491
aggcagugccgccaaa

SEQ ID NO: 3353148 - RNA, 22 nt, Neisseria meningitidis Z2491
aggcaguuuuuuuauaguggau

SEQ ID NO: 3353149 - RNA, 15 nt, Neisseria meningitidis Z2491
aggcauacggggagg

SEQ ID NO: 3353150 - RNA, 15 nt, Neisseria meningitidis Z2491
aggcauuauuuuuca

SEQ ID NO: 3353151 - RNA, 16 nt, Neisseria meningitidis Z2491
aggcauugaaauucca

SEQ ID NO: 3353152 - RNA, 19 nt, Neisseria meningitidis Z2491
aggcauugaaauucuagau

SEQ ID NO: 3353153 - RNA, 21 nt, Neisseria meningitidis Z2491
aggcauugaaauucuagauuc

SEQ ID NO: 3353154 - RNA, 14 nt, Neisseria meningitidis Z2491
aggcccaaaacaaa

SEQ ID NO: 3353155 - RNA, 16 nt, Neisseria meningitidis Z2491
aggccgcugguaucuu

SEQ ID NO: 3353156 - RNA, 13 nt, Neisseria meningitidis Z2491
aggccgucugaaa

SEQ ID NO: 3353157 - RNA, 18 nt, Neisseria meningitidis Z2491
aggccgucugaaauccua

SEQ ID NO: 3353158 - RNA, 20 nt, Neisseria meningitidis Z2491
aggccuuugggcgacggcaa

SEQ ID NO: 3353159 - RNA, 17 nt, Neisseria meningitidis Z2491
aggcgcguccaacacgc

SEQ ID NO: 3353160 - RNA, 15 nt, Neisseria meningitidis Z2491
aggcgggaauacaaa

SEQ ID NO: 3353161 - RNA, 15 nt, Neisseria meningitidis Z2491
aggcgggaauccagu

SEQ ID NO: 3353162 - RNA, 18 nt, Neisseria meningitidis Z2491
aggcgggaaucuagaccu

SEQ ID NO: 3353163 - RNA, 13 nt, Neisseria meningitidis Z2491
aggcgggcaggca

SEQ ID NO: 3353164 - RNA, 13 nt, Neisseria meningitidis Z2491
agucugauucuac

SEQ ID NO: 3353165 - RNA, 18 nt, Neisseria meningitidis Z2491
agucugauucuaccgccc

SEQ ID NO: 3353166 - RNA, 16 nt, Neisseria meningitidis Z2491
agucugcgaaacagac

SEQ ID NO: 3353167 - RNA, 19 nt, Neisseria meningitidis Z2491
agucugcgaaacagacauu

SEQ ID NO: 3353168 - RNA, 23 nt, Neisseria meningitidis Z2491
agucugucgccgucggcuuccac

SEQ ID NO: 3353169 - RNA, 12 nt, Neisseria meningitidis Z2491
agucuucggcaa

SEQ ID NO: 3353170 - RNA, 14 nt, Neisseria meningitidis Z2491
agucuucggcaaga

SEQ ID NO: 3353171 - RNA, 13 nt, Neisseria meningitidis Z2491
agucuucggcuuu

SEQ ID NO: 3353172 - RNA, 19 nt, Neisseria meningitidis Z2491
agugauggcuucuaaaaau

SEQ ID NO: 3353173 - RNA, 18 nt, Neisseria meningitidis Z2491
agugcaacacuaguguau

SEQ ID NO: 3353174 - RNA, 13 nt, Neisseria meningitidis Z2491
agugcgaugacga

SEQ ID NO: 3353175 - RNA, 17 nt, Neisseria meningitidis Z2491
agugcgcguuaaagguc

SEQ ID NO: 3353176 - RNA, 22 nt, Neisseria meningitidis Z2491
agugcgugcaguucguugcuuu

SEQ ID NO: 3353177 - RNA, 19 nt, Neisseria meningitidis Z2491
aguggauuaaauuuaaacc

SEQ ID NO: 3353178 - RNA, 21 nt, Neisseria meningitidis Z2491
aguggauuaaauuuaaaccag

SEQ ID NO: 3353179 - RNA, 22 nt, Neisseria meningitidis Z2491
aguggauuaaauuuaaaccagu

SEQ ID NO: 3353180 - RNA, 14 nt, Neisseria meningitidis Z2491
aguggauuaacaaa

SEQ ID NO: 3353181 - RNA, 16 nt, Neisseria meningitidis Z2491
aguggauuaacaaaaa

SEQ ID NO: 3353182 - RNA, 20 nt, Neisseria meningitidis Z2491
aguggauuaacaaaaaccag

SEQ ID NO: 3353183 - RNA, 17 nt, Neisseria meningitidis Z2491
aguggauuaacaaaaau

SEQ ID NO: 3353184 - RNA, 21 nt, Neisseria meningitidis Z2491
aguggauuaacaaaaaucagg

SEQ ID NO: 3353185 - RNA, 17 nt, Neisseria meningitidis Z2491
aguggauuaauaaaaau

SEQ ID NO: 3353186 - RNA, 19 nt, Neisseria meningitidis Z2491
agugucaaggaagcaaaag

SEQ ID NO: 3353187 - RNA, 16 nt, Neisseria meningitidis Z2491
agugugguugaagucc

SEQ ID NO: 3353188 - RNA, 18 nt, Neisseria meningitidis Z2491
aguguuuucaagaacagg

SEQ ID NO: 3353189 - RNA, 13 nt, Neisseria meningitidis Z2491
aguuccaaagccu

SEQ ID NO: 3353190 - RNA, 13 nt, Neisseria meningitidis Z2491
aguuccagacggc

SEQ ID NO: 3353191 - RNA, 16 nt, Neisseria meningitidis Z2491
aguuccagacggcauu

SEQ ID NO: 3353192 - RNA, 24 nt, Neisseria meningitidis Z2491
aguucgggaucggagagacugugc

SEQ ID NO: 3353193 - RNA, 13 nt, Neisseria meningitidis Z2491
aguucgugcaggg

SEQ ID NO: 3353194 - RNA, 13 nt, Neisseria meningitidis Z2491
aguugaaaucaac

SEQ ID NO: 3353195 - RNA, 18 nt, Neisseria meningitidis Z2491
aguugauaauaugaaacc

SEQ ID NO: 3353196 - RNA, 18 nt, Neisseria meningitidis Z2491
aguugauuaaaacaaaaa

SEQ ID NO: 3353197 - RNA, 22 nt, Neisseria meningitidis Z2491
aguugauuaaaacaaaaaugag

SEQ ID NO: 3353198 - RNA, 22 nt, Neisseria meningitidis Z2491
aguuguuugguaaucaguuuuu

SEQ ID NO: 3353199 - RNA, 18 nt, Neisseria meningitidis Z2491
aguuuaaaggaaaugccg

SEQ ID NO: 3353200 - RNA, 21 nt, Neisseria meningitidis Z2491
aguuuaaaggaaaugccgucu

SEQ ID NO: 3353201 - RNA, 19 nt, Neisseria meningitidis Z2491
aguuucaaaauuuauucua

SEQ ID NO: 3353202 - RNA, 16 nt, Neisseria meningitidis Z2491
aguuucagucauuccc

SEQ ID NO: 3353203 - RNA, 17 nt, Neisseria meningitidis Z2491
aguuuccacuaaaugcu

SEQ ID NO: 3353204 - RNA, 17 nt, Neisseria meningitidis Z2491
aguuucccgaaauucca

SEQ ID NO: 3353205 - RNA, 19 nt, Neisseria meningitidis Z2491
aguuucugccccuggcugc

SEQ ID NO: 3353206 - RNA, 22 nt, Neisseria meningitidis Z2491
aguuucuguauuuguauagugg

SEQ ID NO: 3353207 - RNA, 15 nt, Neisseria meningitidis Z2491
aguuugaugccgucu

SEQ ID NO: 3353208 - RNA, 17 nt, Neisseria meningitidis Z2491
aguuugaugccgucuga

SEQ ID NO: 3353209 - RNA, 19 nt, Neisseria meningitidis Z2491
aguuugcgcaugauggcaa

SEQ ID NO: 3353210 - RNA, 19 nt, Neisseria meningitidis Z2491
aguuuguuguucaaauaaa

SEQ ID NO: 3353211 - RNA, 14 nt, Neisseria meningitidis Z2491
aguuuucagacggc

SEQ ID NO: 3353212 - RNA, 16 nt, Neisseria meningitidis Z2491
aguuuucagacggcau

SEQ ID NO: 3353213 - RNA, 16 nt, Neisseria meningitidis Z2491
auaaaaaaugccgucc

SEQ ID NO: 3353214 - RNA, 16 nt, Neisseria meningitidis Z2491
auaaaaaaugccgucu

SEQ ID NO: 3353215 - RNA, 20 nt, Neisseria meningitidis Z2491
auaaaacgguuucuuagauu

SEQ ID NO: 3353216 - RNA, 22 nt, Neisseria meningitidis Z2491
auaaaagacccgucauucccgc

SEQ ID NO: 3353217 - RNA, 15 nt, Neisseria meningitidis Z2491
auaaaaggucuuuuc

SEQ ID NO: 3353218 - RNA, 16 nt, Neisseria meningitidis Z2491
auaaaaggucuuuucu

SEQ ID NO: 3353219 - RNA, 21 nt, Neisseria meningitidis Z2491
auaaaaggucuuuucuaaaau

SEQ ID NO: 3353220 - RNA, 14 nt, Neisseria meningitidis Z2491
auaaaaucccccgc

SEQ ID NO: 3353221 - RNA, 13 nt, Neisseria meningitidis Z2491
auaaaaugccguc

SEQ ID NO: 3353222 - RNA, 23 nt, Neisseria meningitidis Z2491
auaaaaugccgucugaaagggcu

SEQ ID NO: 3353223 - RNA, 23 nt, Neisseria meningitidis Z2491
auaaaaugccgucugaacucagg

SEQ ID NO: 3353224 - RNA, 15 nt, Neisseria meningitidis Z2491
auaaaauuuuaguaa

SEQ ID NO: 3353225 - RNA, 13 nt, Neisseria meningitidis Z2491
auaaacaaaaaac

SEQ ID NO: 3353226 - RNA, 18 nt, Neisseria meningitidis Z2491
auaaacaaaauaaacuca

SEQ ID NO: 3353227 - RNA, 15 nt, Neisseria meningitidis Z2491
auaaacaagauuucc

SEQ ID NO: 3353228 - RNA, 11 nt, Neisseria meningitidis Z2491
auaaacagcac

SEQ ID NO: 3353229 - RNA, 22 nt, Neisseria meningitidis Z2491
auaaacauuaucugacaggaaa

SEQ ID NO: 3353230 - RNA, 21 nt, Neisseria meningitidis Z2491
auaaacauuuuugcguauucg

SEQ ID NO: 3353231 - RNA, 12 nt, Neisseria meningitidis Z2491
auaaaccaaaau

SEQ ID NO: 3353232 - RNA, 16 nt, Neisseria meningitidis Z2491
auaaacgccauaauca

SEQ ID NO: 3353233 - RNA, 21 nt, Neisseria meningitidis Z2491
auaaacgccauaaucacaccg

SEQ ID NO: 3353234 - RNA, 13 nt, Neisseria meningitidis Z2491
auaaacucauuga

SEQ ID NO: 3353235 - RNA, 13 nt, Neisseria meningitidis Z2491
auaaaucaccgca

SEQ ID NO: 3353236 - RNA, 10 nt, Neisseria meningitidis Z2491
auaaaugccg

SEQ ID NO: 3353237 - RNA, 12 nt, Neisseria meningitidis Z2491
auaaauuccuaa

SEQ ID NO: 3353238 - RNA, 17 nt, Neisseria meningitidis Z2491
auaaauuccuaaaacuu

SEQ ID NO: 3353239 - RNA, 16 nt, Neisseria meningitidis Z2491
auaaauuccugccgcu

SEQ ID NO: 3353240 - RNA, 17 nt, Neisseria meningitidis Z2491
auaaauucguuaaugcu

SEQ ID NO: 3353241 - RNA, 20 nt, Neisseria meningitidis Z2491
auaaauucugaaacuuuaau

SEQ ID NO: 3353242 - RNA, 13 nt, Neisseria meningitidis Z2491
auaaauucuugca

SEQ ID NO: 3353243 - RNA, 23 nt, Neisseria meningitidis Z2491
auaaauucuugcaacuuugcguu

SEQ ID NO: 3353244 - RNA, 22 nt, Neisseria meningitidis Z2491
auaaauucuugccgcauuaaaa

SEQ ID NO: 3353245 - RNA, 16 nt, Neisseria meningitidis Z2491
auaaauuugaauagca

SEQ ID NO: 3353246 - RNA, 13 nt, Neisseria meningitidis Z2491
auaaauuuuaaau

SEQ ID NO: 3353247 - RNA, 15 nt, Neisseria meningitidis Z2491
auaaauuuuaaauaa

SEQ ID NO: 3353248 - RNA, 12 nt, Neisseria meningitidis Z2491
auaaauuuuugc

SEQ ID NO: 3353249 - RNA, 21 nt, Neisseria meningitidis Z2491
auaacauagguuacuaaaauu

SEQ ID NO: 3353250 - RNA, 22 nt, Neisseria meningitidis Z2491
auaacauagguuacuaaaauuu

SEQ ID NO: 3353251 - RNA, 20 nt, Neisseria meningitidis Z2491
auaaccuucguaauuuuucu

SEQ ID NO: 3353252 - RNA, 14 nt, Neisseria meningitidis Z2491
auaacgggauuuca

SEQ ID NO: 3353253 - RNA, 23 nt, Neisseria meningitidis Z2491
auaacgguugcacgguuuuccuc

SEQ ID NO: 3353254 - RNA, 18 nt, Neisseria meningitidis Z2491
auaagcaagcaauaccgc

SEQ ID NO: 3353255 - RNA, 17 nt, Neisseria meningitidis Z2491
auaagcgguuuuccccu

SEQ ID NO: 3353256 - RNA, 22 nt, Neisseria meningitidis Z2491
auaagcuguuugcgcuguugca

SEQ ID NO: 3353257 - RNA, 16 nt, Neisseria meningitidis Z2491
auaaggcuuuaagcaa

SEQ ID NO: 3353258 - RNA, 12 nt, Neisseria meningitidis Z2491
auaagguuuuug

SEQ ID NO: 3353259 - RNA, 20 nt, Neisseria meningitidis Z2491
auaauacaaaaaugccgucu

SEQ ID NO: 3353260 - RNA, 14 nt, Neisseria meningitidis Z2491
auaauaugaaacca

SEQ ID NO: 3353261 - RNA, 21 nt, Neisseria meningitidis Z2491
auaauaugaaaccauuacaaa

SEQ ID NO: 3353262 - RNA, 17 nt, Neisseria meningitidis Z2491
auaaucaauuaaaaaca

SEQ ID NO: 3353263 - RNA, 18 nt, Neisseria meningitidis Z2491
auaaucagcccgaaauaa

SEQ ID NO: 3353264 - RNA, 16 nt, Neisseria meningitidis Z2491
auaaucaguuugcuuu

SEQ ID NO: 3353265 - RNA, 18 nt, Neisseria meningitidis Z2491
auauacaaaaugccgucu

SEQ ID NO: 3353266 - RNA, 16 nt, Neisseria meningitidis Z2491
auauacucaauaggau

SEQ ID NO: 3353267 - RNA, 17 nt, Neisseria meningitidis Z2491
auauacugauuuauauu

SEQ ID NO: 3353268 - RNA, 15 nt, Neisseria meningitidis Z2491
auauagauuuuuaug

SEQ ID NO: 3353269 - RNA, 19 nt, Neisseria meningitidis Z2491
auauagccgagcaucacga

SEQ ID NO: 3353270 - RNA, 17 nt, Neisseria meningitidis Z2491
auauaguggauuaacaa

SEQ ID NO: 3353271 - RNA, 23 nt, Neisseria meningitidis Z2491
auauaguggauuaacaaaaauca

SEQ ID NO: 3353272 - RNA, 23 nt, Neisseria meningitidis Z2491
auauaguugauuaaaacaaaaau

SEQ ID NO: 3353273 - RNA, 12 nt, Neisseria meningitidis Z2491
auauauucugau

SEQ ID NO: 3353274 - RNA, 16 nt, Neisseria meningitidis Z2491
auauauucugauuuaa

SEQ ID NO: 3353275 - RNA, 22 nt, Neisseria meningitidis Z2491
auaucaacgcgggaauagcuca

SEQ ID NO: 3353276 - RNA, 13 nt, Neisseria meningitidis Z2491
auaucaugccgcu

SEQ ID NO: 3353277 - RNA, 20 nt, Neisseria meningitidis Z2491
auaucauugcuuacaauccg

SEQ ID NO: 3353278 - RNA, 13 nt, Neisseria meningitidis Z2491
auauccaaacgca

SEQ ID NO: 3353279 - RNA, 19 nt, Neisseria meningitidis Z2491
auauccgaccagagcggca

SEQ ID NO: 3353280 - RNA, 16 nt, Neisseria meningitidis Z2491
auauccgacugugccg

SEQ ID NO: 3353281 - RNA, 21 nt, Neisseria meningitidis Z2491
auauccggcgcggcaaaagua

SEQ ID NO: 3353282 - RNA, 17 nt, Neisseria meningitidis Z2491
auaucgccucauacagc

SEQ ID NO: 3353283 - RNA, 23 nt, Neisseria meningitidis Z2491
auaucgucauucccgcaaaaaca

SEQ ID NO: 3353284 - RNA, 13 nt, Neisseria meningitidis Z2491
auaucuauacuaa

SEQ ID NO: 3353285 - RNA, 15 nt, Neisseria meningitidis Z2491
auaucuauacuaaaa

SEQ ID NO: 3353286 - RNA, 18 nt, Neisseria meningitidis Z2491
auaugccgucugaaaaca

SEQ ID NO: 3353287 - RNA, 20 nt, Neisseria meningitidis Z2491
auaugccgucugaagccuuc

SEQ ID NO: 3353288 - RNA, 13 nt, Neisseria meningitidis Z2491
auaugcggcaggc

SEQ ID NO: 3353289 - RNA, 13 nt, Neisseria meningitidis Z2491
auauggaaaaauc

SEQ ID NO: 3353290 - RNA, 17 nt, Neisseria meningitidis Z2491
auauggauaccgucuga

SEQ ID NO: 3353291 - RNA, 21 nt, Neisseria meningitidis Z2491
auauggugcugauaacauacu

SEQ ID NO: 3353292 - RNA, 14 nt, Neisseria meningitidis Z2491
auaugguucagacg

SEQ ID NO: 3353293 - RNA, 16 nt, Neisseria meningitidis Z2491
auaugguucagacggc

SEQ ID NO: 3353294 - RNA, 23 nt, Neisseria meningitidis Z2491
auauguugcccgucaacacaaaa

SEQ ID NO: 3353295 - RNA, 16 nt, Neisseria meningitidis Z2491
auauguugggaaguua

SEQ ID NO: 3353296 - RNA, 13 nt, Neisseria meningitidis Z2491
auauguuucaaca

SEQ ID NO: 3353297 - RNA, 19 nt, Neisseria meningitidis Z2491
auauguuuucugguuuuua

SEQ ID NO: 3353298 - RNA, 15 nt, Neisseria meningitidis Z2491
auauguuuuuuccug

SEQ ID NO: 3353299 - RNA, 14 nt, Neisseria meningitidis Z2491
auauuaaucagcgc

SEQ ID NO: 3353300 - RNA, 16 nt, Neisseria meningitidis Z2491
auauucaaagauuauc

SEQ ID NO: 3353301 - RNA, 13 nt, Neisseria meningitidis Z2491
auauucaaagguu

SEQ ID NO: 3353302 - RNA, 17 nt, Neisseria meningitidis Z2491
auauucaauugacaaaa

SEQ ID NO: 3353303 - RNA, 23 nt, Neisseria meningitidis Z2491
auauucacuaaauugcauuuuua

SEQ ID NO: 3353304 - RNA, 17 nt, Neisseria meningitidis Z2491
auauucagguaaaacaa

SEQ ID NO: 3353305 - RNA, 22 nt, Neisseria meningitidis Z2491
auauuccaccaucucuaagauu

SEQ ID NO: 3353306 - RNA, 22 nt, Neisseria meningitidis Z2491
auauucgcguaaccguuuaauu

SEQ ID NO: 3353307 - RNA, 22 nt, Neisseria meningitidis Z2491
auauucugauuuaaaaccauaa

SEQ ID NO: 3353308 - RNA, 14 nt, Neisseria meningitidis Z2491
auauucugauuuau

SEQ ID NO: 3353309 - RNA, 20 nt, Neisseria meningitidis Z2491
auauugacggacggcggcag

SEQ ID NO: 3353310 - RNA, 14 nt, Neisseria meningitidis Z2491
auauugagaccuuu

SEQ ID NO: 3353311 - RNA, 20 nt, Neisseria meningitidis Z2491
auauugagaccuuugcaaua

SEQ ID NO: 3353312 - RNA, 22 nt, Neisseria meningitidis Z2491
auauugccagcccccuuccaag

SEQ ID NO: 3353313 - RNA, 16 nt, Neisseria meningitidis Z2491
auauugccguuuuccu

SEQ ID NO: 3353314 - RNA, 18 nt, Neisseria meningitidis Z2491
auauugccguuuuccuuu

SEQ ID NO: 3353315 - RNA, 19 nt, Neisseria meningitidis Z2491
auauugcuccugacggcaa

SEQ ID NO: 3353316 - RNA, 15 nt, Neisseria meningitidis Z2491
auauuggaaagcaau

SEQ ID NO: 3353317 - RNA, 21 nt, Neisseria meningitidis Z2491
auauugguuccgugauaaagc

SEQ ID NO: 3353318 - RNA, 17 nt, Neisseria meningitidis Z2491
auauuguuauucccccg

SEQ ID NO: 3353319 - RNA, 16 nt, Neisseria meningitidis Z2491
auauuguuauuuuuau

SEQ ID NO: 3353320 - RNA, 18 nt, Neisseria meningitidis Z2491
auauuguucagacggcau

SEQ ID NO: 3353321 - RNA, 14 nt, Neisseria meningitidis Z2491
auauuuagcauuua

SEQ ID NO: 3353322 - RNA, 16 nt, Neisseria meningitidis Z2491
auauuuagcauuuaau

SEQ ID NO: 3353323 - RNA, 12 nt, Neisseria meningitidis Z2491
auauuuccugca

SEQ ID NO: 3353324 - RNA, 22 nt, Neisseria meningitidis Z2491
auauuugaaccugaccgaagca

SEQ ID NO: 3353325 - RNA, 22 nt, Neisseria meningitidis Z2491
auauuugccggucggcuggcug

SEQ ID NO: 3353326 - RNA, 13 nt, Neisseria meningitidis Z2491
auauuuucuuccg

SEQ ID NO: 3353327 - RNA, 21 nt, Neisseria meningitidis Z2491
auauuuuugaagacaucguuu

SEQ ID NO: 3353328 - RNA, 13 nt, Neisseria meningitidis Z2491
aucaaaaaauaaa

SEQ ID NO: 3353329 - RNA, 14 nt, Neisseria meningitidis Z2491
aucaaaaacagaaa

SEQ ID NO: 3353330 - RNA, 14 nt, Neisseria meningitidis Z2491
aucaaaaugccguc

SEQ ID NO: 3353331 - RNA, 16 nt, Neisseria meningitidis Z2491
aucaaacaagaaauga

SEQ ID NO: 3353332 - RNA, 18 nt, Neisseria meningitidis Z2491
aucaacaaaaugccgucu

SEQ ID NO: 3353333 - RNA, 21 nt, Neisseria meningitidis Z2491
aucaacagauugucaaaauac

SEQ ID NO: 3353334 - RNA, 13 nt, Neisseria meningitidis Z2491
aucaacguuucua

SEQ ID NO: 3353335 - RNA, 13 nt, Neisseria meningitidis Z2491
aucaagaagaaag

SEQ ID NO: 3353336 - RNA, 14 nt, Neisseria meningitidis Z2491
aucaaggaauucau

SEQ ID NO: 3353337 - RNA, 15 nt, Neisseria meningitidis Z2491
aucaaggaugccguu

SEQ ID NO: 3353338 - RNA, 16 nt, Neisseria meningitidis Z2491
aucaaguuaccggucu

SEQ ID NO: 3353339 - RNA, 21 nt, Neisseria meningitidis Z2491
aucaaucacccgguccaacuu

SEQ ID NO: 3353340 - RNA, 21 nt, Neisseria meningitidis Z2491
aucaaugugccucuucccaau

SEQ ID NO: 3353341 - RNA, 18 nt, Neisseria meningitidis Z2491
aucaauuaaaaacaaaau

SEQ ID NO: 3353342 - RNA, 14 nt, Neisseria meningitidis Z2491
aucacaacggcguu

SEQ ID NO: 3353343 - RNA, 20 nt, Neisseria meningitidis Z2491
aucacagucggugugccgcu

SEQ ID NO: 3353344 - RNA, 19 nt, Neisseria meningitidis Z2491
aucacauaaugcccgagca

SEQ ID NO: 3353345 - RNA, 18 nt, Neisseria meningitidis Z2491
aucaccaucgagcugccu

SEQ ID NO: 3353346 - RNA, 20 nt, Neisseria meningitidis Z2491
aucaccgcaacauuaaauuu

SEQ ID NO: 3353347 - RNA, 22 nt, Neisseria meningitidis Z2491
aucacgcgguagggcaguucca

SEQ ID NO: 3353348 - RNA, 15 nt, Neisseria meningitidis Z2491
aucacguucugaaaa

SEQ ID NO: 3353349 - RNA, 19 nt, Neisseria meningitidis Z2491
aucacguucugaaaaauau

SEQ ID NO: 3353350 - RNA, 14 nt, Neisseria meningitidis Z2491
aucacguuuuccaa

SEQ ID NO: 3353351 - RNA, 15 nt, Neisseria meningitidis Z2491
aucacuccgucuuuc

SEQ ID NO: 3353352 - RNA, 15 nt, Neisseria meningitidis Z2491
aucacuucgcucugc

SEQ ID NO: 3353353 - RNA, 23 nt, Neisseria meningitidis Z2491
aucacuuggaauaugaauacggc

SEQ ID NO: 3353354 - RNA, 17 nt, Neisseria meningitidis Z2491
aucacuuggucuuugcc

SEQ ID NO: 3353355 - RNA, 12 nt, Neisseria meningitidis Z2491
aucagaaaugac

SEQ ID NO: 3353356 - RNA, 13 nt, Neisseria meningitidis Z2491
aucagaaaugacg

SEQ ID NO: 3353357 - RNA, 13 nt, Neisseria meningitidis Z2491
aucagaaaugacu

SEQ ID NO: 3353358 - RNA, 14 nt, Neisseria meningitidis Z2491
aucagaaaugacug

SEQ ID NO: 3353359 - RNA, 15 nt, Neisseria meningitidis Z2491
aucagaaaugacuga

SEQ ID NO: 3353360 - RNA, 20 nt, Neisseria meningitidis Z2491
aucagaaaugacugaaauuc

SEQ ID NO: 3353361 - RNA, 13 nt, Neisseria meningitidis Z2491
aucagaauacugc

SEQ ID NO: 3353362 - RNA, 17 nt, Neisseria meningitidis Z2491
aucagaauacugccugu

SEQ ID NO: 3353363 - RNA, 17 nt, Neisseria meningitidis Z2491
aucagacauuaaaaaau

SEQ ID NO: 3353364 - RNA, 20 nt, Neisseria meningitidis Z2491
aucagacauuaaaaaauaca

SEQ ID NO: 3353365 - RNA, 21 nt, Neisseria meningitidis Z2491
aucagaccgaauuuaaucaag

SEQ ID NO: 3353366 - RNA, 16 nt, Neisseria meningitidis Z2491
aucggcaaugcgcccg

SEQ ID NO: 3353367 - RNA, 12 nt, Neisseria meningitidis Z2491
aucggcuucaga

SEQ ID NO: 3353368 - RNA, 21 nt, Neisseria meningitidis Z2491
aucgggaaaaauagaaucuuu

SEQ ID NO: 3353369 - RNA, 22 nt, Neisseria meningitidis Z2491
aucggggcggcaacggaaauau

SEQ ID NO: 3353370 - RNA, 15 nt, Neisseria meningitidis Z2491
aucguaaaaaugccg

SEQ ID NO: 3353371 - RNA, 17 nt, Neisseria meningitidis Z2491
aucguacugguuuaaau

SEQ ID NO: 3353372 - RNA, 18 nt, Neisseria meningitidis Z2491
aucguacugguuuaaauu

SEQ ID NO: 3353373 - RNA, 19 nt, Neisseria meningitidis Z2491
aucgucaccgcuuuucuuu

SEQ ID NO: 3353374 - RNA, 22 nt, Neisseria meningitidis Z2491
aucgucagaccccuuucggcau

SEQ ID NO: 3353375 - RNA, 14 nt, Neisseria meningitidis Z2491
aucgucauucccgc

SEQ ID NO: 3353376 - RNA, 22 nt, Neisseria meningitidis Z2491
aucgucauucccgcaaaaacaa

SEQ ID NO: 3353377 - RNA, 21 nt, Neisseria meningitidis Z2491
aucguccgccauaaugcccaa

SEQ ID NO: 3353378 - RNA, 13 nt, Neisseria meningitidis Z2491
aucguguaggcag

SEQ ID NO: 3353379 - RNA, 17 nt, Neisseria meningitidis Z2491
aucguucucuuugaguu

SEQ ID NO: 3353380 - RNA, 21 nt, Neisseria meningitidis Z2491
aucguuucugucgccagcauc

SEQ ID NO: 3353381 - RNA, 13 nt, Neisseria meningitidis Z2491
aucguuuuuuccc

SEQ ID NO: 3353382 - RNA, 21 nt, Neisseria meningitidis Z2491
aucuagaaacgcaaagcugca

SEQ ID NO: 3353383 - RNA, 12 nt, Neisseria meningitidis Z2491
aucuagaaauga

SEQ ID NO: 3353384 - RNA, 13 nt, Neisseria meningitidis Z2491
aucuagaaauuua

SEQ ID NO: 3353385 - RNA, 15 nt, Neisseria meningitidis Z2491
aucuagacauucaau

SEQ ID NO: 3353386 - RNA, 19 nt, Neisseria meningitidis Z2491
aucuagacauucaaugcua

SEQ ID NO: 3353387 - RNA, 24 nt, Neisseria meningitidis Z2491
aucuagacauucaaugcuaaggca

SEQ ID NO: 3353388 - RNA, 22 nt, Neisseria meningitidis Z2491
aucuaguacagccccuuaaagu

SEQ ID NO: 3353389 - RNA, 23 nt, Neisseria meningitidis Z2491
aucucaacugacgguacacgucg

SEQ ID NO: 3353390 - RNA, 22 nt, Neisseria meningitidis Z2491
aucucaagaaaccguuuuaccc

SEQ ID NO: 3353391 - RNA, 17 nt, Neisseria meningitidis Z2491
aucucauuuucaaaaug

SEQ ID NO: 3353392 - RNA, 19 nt, Neisseria meningitidis Z2491
aucucauuuucaaaaugca

SEQ ID NO: 3353393 - RNA, 21 nt, Neisseria meningitidis Z2491
aucucauuuucaaaaugcaaa

SEQ ID NO: 3353394 - RNA, 21 nt, Neisseria meningitidis Z2491
aucucgucccaaacaauccca

SEQ ID NO: 3353395 - RNA, 23 nt, Neisseria meningitidis Z2491
aucucgucccaaacaaucccacc

SEQ ID NO: 3353396 - RNA, 15 nt, Neisseria meningitidis Z2491
aucucguuauuucca

SEQ ID NO: 3353397 - RNA, 20 nt, Neisseria meningitidis Z2491
aucucguuauuuccacaaaa

SEQ ID NO: 3353398 - RNA, 13 nt, Neisseria meningitidis Z2491
aucucuuaaccau

SEQ ID NO: 3353399 - RNA, 12 nt, Neisseria meningitidis Z2491
aucugacaggcg

SEQ ID NO: 3353400 - RNA, 21 nt, Neisseria meningitidis Z2491
aucugacgcguuuuaccugcc

SEQ ID NO: 3353401 - RNA, 13 nt, Neisseria meningitidis Z2491
aucugacuugcca

SEQ ID NO: 3353402 - RNA, 20 nt, Neisseria meningitidis Z2491
aucugagaccuuugcaaaaa

SEQ ID NO: 3353403 - RNA, 21 nt, Neisseria meningitidis Z2491
aucugagaccuuugcaaaaau

SEQ ID NO: 3353404 - RNA, 22 nt, Neisseria meningitidis Z2491
aucugagaccuuugcaaaaaua

SEQ ID NO: 3353405 - RNA, 21 nt, Neisseria meningitidis Z2491
aucugauacaccgguuugcuu

SEQ ID NO: 3353406 - RNA, 22 nt, Neisseria meningitidis Z2491
aucugauuuauuuccugaagcg

SEQ ID NO: 3353407 - RNA, 13 nt, Neisseria meningitidis Z2491
aucugauuuuucu

SEQ ID NO: 3353408 - RNA, 15 nt, Neisseria meningitidis Z2491
aucugcaccccaaaa

SEQ ID NO: 3353409 - RNA, 19 nt, Neisseria meningitidis Z2491
aucugcauuauuugggaua

SEQ ID NO: 3353410 - RNA, 20 nt, Neisseria meningitidis Z2491
aucugccccguuuuacccuc

SEQ ID NO: 3353411 - RNA, 16 nt, Neisseria meningitidis Z2491
aucugcugcaaaccgu

SEQ ID NO: 3353412 - RNA, 20 nt, Neisseria meningitidis Z2491
aucugcugcgucaaaccagc

SEQ ID NO: 3353413 - RNA, 21 nt, Neisseria meningitidis Z2491
aucuggaaaccaaaaaacaac

SEQ ID NO: 3353414 - RNA, 14 nt, Neisseria meningitidis Z2491
aucuuauccacaga

SEQ ID NO: 3353415 - RNA, 13 nt, Neisseria meningitidis Z2491
aucuuauccaucc

SEQ ID NO: 3353416 - RNA, 22 nt, Neisseria meningitidis Z2491
aucuucgaggaacaaaaugccg

SEQ ID NO: 3353417 - RNA, 14 nt, Neisseria meningitidis Z2491
aucuugcaaacccc

SEQ ID NO: 3353418 - RNA, 13 nt, Neisseria meningitidis Z2491
aucuugccagccu

SEQ ID NO: 3353419 - RNA, 17 nt, Neisseria meningitidis Z2491
aucuugccauucucaca

SEQ ID NO: 3353420 - RNA, 15 nt, Neisseria meningitidis Z2491
aucuuguuuuucaau

SEQ ID NO: 3353421 - RNA, 16 nt, Neisseria meningitidis Z2491
aucuuguuuuucaauc

SEQ ID NO: 3353422 - RNA, 13 nt, Neisseria meningitidis Z2491
aucuuuacuuguu

SEQ ID NO: 3353423 - RNA, 14 nt, Neisseria meningitidis Z2491
aucuuucaaacauc

SEQ ID NO: 3353424 - RNA, 16 nt, Neisseria meningitidis Z2491
aucuuucaaacaucug

SEQ ID NO: 3353425 - RNA, 22 nt, Neisseria meningitidis Z2491
aucuuugaauauugcuguuguu

SEQ ID NO: 3353426 - RNA, 18 nt, Neisseria meningitidis Z2491
augaaaagaccgucauuc

SEQ ID NO: 3353427 - RNA, 15 nt, Neisseria meningitidis Z2491
augaaaaugccgucu

SEQ ID NO: 3353428 - RNA, 12 nt, Neisseria meningitidis Z2491
augaaaauuugg

SEQ ID NO: 3353429 - RNA, 15 nt, Neisseria meningitidis Z2491
augaaaccauuacaa

SEQ ID NO: 3353430 - RNA, 19 nt, Neisseria meningitidis Z2491
augaaaccauuacaaaugc

SEQ ID NO: 3353431 - RNA, 16 nt, Neisseria meningitidis Z2491
augaaacucaauauaa

SEQ ID NO: 3353432 - RNA, 17 nt, Neisseria meningitidis Z2491
augaaacucaauauaac

SEQ ID NO: 3353433 - RNA, 16 nt, Neisseria meningitidis Z2491
augaaaguuugccgac

SEQ ID NO: 3353434 - RNA, 17 nt, Neisseria meningitidis Z2491
augaaaugccgucugaa

SEQ ID NO: 3353435 - RNA, 23 nt, Neisseria meningitidis Z2491
augaacgauuugaaccauuucca

SEQ ID NO: 3353436 - RNA, 22 nt, Neisseria meningitidis Z2491
augaacuugggccacuuuuugc

SEQ ID NO: 3353437 - RNA, 13 nt, Neisseria meningitidis Z2491
augaagaggauga

SEQ ID NO: 3353438 - RNA, 20 nt, Neisseria meningitidis Z2491
augaauuuaaacaggcacag

SEQ ID NO: 3353439 - RNA, 23 nt, Neisseria meningitidis Z2491
augaauuugacuugcggauugcc

SEQ ID NO: 3353440 - RNA, 15 nt, Neisseria meningitidis Z2491
augacaacccugucc

SEQ ID NO: 3353441 - RNA, 16 nt, Neisseria meningitidis Z2491
augacauuaagauguu

SEQ ID NO: 3353442 - RNA, 13 nt, Neisseria meningitidis Z2491
augacgaaagguu

SEQ ID NO: 3353443 - RNA, 15 nt, Neisseria meningitidis Z2491
augacgaagccgaac

SEQ ID NO: 3353444 - RNA, 19 nt, Neisseria meningitidis Z2491
augacgaauccauccgcac

SEQ ID NO: 3353445 - RNA, 14 nt, Neisseria meningitidis Z2491
augacggaguuuca

SEQ ID NO: 3353446 - RNA, 23 nt, Neisseria meningitidis Z2491
augacgggauauagguuuccgug

SEQ ID NO: 3353447 - RNA, 20 nt, Neisseria meningitidis Z2491
augacgggauuagaguuuca

SEQ ID NO: 3353448 - RNA, 15 nt, Neisseria meningitidis Z2491
augacgguaaagauu

SEQ ID NO: 3353449 - RNA, 14 nt, Neisseria meningitidis Z2491
augacggucaggaa

SEQ ID NO: 3353450 - RNA, 21 nt, Neisseria meningitidis Z2491
augacguggugcagguuucug

SEQ ID NO: 3353451 - RNA, 16 nt, Neisseria meningitidis Z2491
augacugaaacucaaa

SEQ ID NO: 3353452 - RNA, 18 nt, Neisseria meningitidis Z2491
augacugaagcucaaaaa

SEQ ID NO: 3353453 - RNA, 21 nt, Neisseria meningitidis Z2491
augagauugagcauaaaauuu

SEQ ID NO: 3353454 - RNA, 20 nt, Neisseria meningitidis Z2491
augaguccgaggcuguggag

SEQ ID NO: 3353455 - RNA, 12 nt, Neisseria meningitidis Z2491
augaguuuuuug

SEQ ID NO: 3353456 - RNA, 18 nt, Neisseria meningitidis Z2491
augauacgcgacaauaaa

SEQ ID NO: 3353457 - RNA, 15 nt, Neisseria meningitidis Z2491
augaucaguaaaaaa

SEQ ID NO: 3353458 - RNA, 18 nt, Neisseria meningitidis Z2491
augaugccgaacaggcgu

SEQ ID NO: 3353459 - RNA, 15 nt, Neisseria meningitidis Z2491
augaugcguucaaau

SEQ ID NO: 3353460 - RNA, 13 nt, Neisseria meningitidis Z2491
augauggcggcaa

SEQ ID NO: 3353461 - RNA, 21 nt, Neisseria meningitidis Z2491
augaugggauuuaggguucug

SEQ ID NO: 3353462 - RNA, 18 nt, Neisseria meningitidis Z2491
augauuaucauaaaaucu

SEQ ID NO: 3353463 - RNA, 14 nt, Neisseria meningitidis Z2491
augauucauaaaau

SEQ ID NO: 3353464 - RNA, 16 nt, Neisseria meningitidis Z2491
augauucauaaaauau

SEQ ID NO: 3353465 - RNA, 15 nt, Neisseria meningitidis Z2491
augauugacuauuuu

SEQ ID NO: 3353466 - RNA, 17 nt, Neisseria meningitidis Z2491
augauuuucuuuuugau

SEQ ID NO: 3353467 - RNA, 20 nt, Neisseria meningitidis Z2491
auucccgugcaggcgggaau

SEQ ID NO: 3353468 - RNA, 14 nt, Neisseria meningitidis Z2491
auucccguuucaga

SEQ ID NO: 3353469 - RNA, 18 nt, Neisseria meningitidis Z2491
auucccguuuucacggga

SEQ ID NO: 3353470 - RNA, 18 nt, Neisseria meningitidis Z2491
auucccucaaaaacagaa

SEQ ID NO: 3353471 - RNA, 20 nt, Neisseria meningitidis Z2491
auucccuccugcgcgggaau

SEQ ID NO: 3353472 - RNA, 20 nt, Neisseria meningitidis Z2491
auucccugucuuucaauaua

SEQ ID NO: 3353473 - RNA, 21 nt, Neisseria meningitidis Z2491
auucccugucuuucaauauac

SEQ ID NO: 3353474 - RNA, 17 nt, Neisseria meningitidis Z2491
auuccgccgauguaaac

SEQ ID NO: 3353475 - RNA, 21 nt, Neisseria meningitidis Z2491
auuccgccgauguaaaccuaa

SEQ ID NO: 3353476 - RNA, 23 nt, Neisseria meningitidis Z2491
auuccguugcaauguugucgccu

SEQ ID NO: 3353477 - RNA, 17 nt, Neisseria meningitidis Z2491
auuccuacgaaaacagg

SEQ ID NO: 3353478 - RNA, 18 nt, Neisseria meningitidis Z2491
auuccuacgaaaacagga

SEQ ID NO: 3353479 - RNA, 20 nt, Neisseria meningitidis Z2491
auuccugccugcgcgggaau

SEQ ID NO: 3353480 - RNA, 23 nt, Neisseria meningitidis Z2491
auuccugcugcuuuucauuucua

SEQ ID NO: 3353481 - RNA, 18 nt, Neisseria meningitidis Z2491
auuccuguaaaaacaaaa

SEQ ID NO: 3353482 - RNA, 20 nt, Neisseria meningitidis Z2491
auuccuguaaaaacaaaaaa

SEQ ID NO: 3353483 - RNA, 16 nt, Neisseria meningitidis Z2491
auuccugugguuuuuc

SEQ ID NO: 3353484 - RNA, 23 nt, Neisseria meningitidis Z2491
auuccuguugcuuuucauuucua

SEQ ID NO: 3353485 - RNA, 16 nt, Neisseria meningitidis Z2491
auuccuguuguuuuuu

SEQ ID NO: 3353486 - RNA, 20 nt, Neisseria meningitidis Z2491
auuccuguuuucgcgggaau

SEQ ID NO: 3353487 - RNA, 13 nt, Neisseria meningitidis Z2491
auuccuucauggc

SEQ ID NO: 3353488 - RNA, 13 nt, Neisseria meningitidis Z2491
auucgaccagcuc

SEQ ID NO: 3353489 - RNA, 15 nt, Neisseria meningitidis Z2491
auucgaccagcuccc

SEQ ID NO: 3353490 - RNA, 19 nt, Neisseria meningitidis Z2491
auucgacgcgcuugauguc

SEQ ID NO: 3353491 - RNA, 12 nt, Neisseria meningitidis Z2491
auucgagcgcgg

SEQ ID NO: 3353492 - RNA, 20 nt, Neisseria meningitidis Z2491
auucgcacgcaugaagccgu

SEQ ID NO: 3353493 - RNA, 18 nt, Neisseria meningitidis Z2491
auucgccuuaaaaaacaa

SEQ ID NO: 3353494 - RNA, 19 nt, Neisseria meningitidis Z2491
auucgccuuaaaaaacaaa

SEQ ID NO: 3353495 - RNA, 17 nt, Neisseria meningitidis Z2491
auucgcgguugccguca

SEQ ID NO: 3353496 - RNA, 23 nt, Neisseria meningitidis Z2491
auucggagcaagaccaaacagaa

SEQ ID NO: 3353497 - RNA, 21 nt, Neisseria meningitidis Z2491
auucgugggcgcauucggggc

SEQ ID NO: 3353498 - RNA, 19 nt, Neisseria meningitidis Z2491
auucuaaauagcugaaacu

SEQ ID NO: 3353499 - RNA, 16 nt, Neisseria meningitidis Z2491
auucuacccaaauacc

SEQ ID NO: 3353500 - RNA, 21 nt, Neisseria meningitidis Z2491
auucuagauucccgccugcgc

SEQ ID NO: 3353501 - RNA, 15 nt, Neisseria meningitidis Z2491
auucuauuggauaua

SEQ ID NO: 3353502 - RNA, 15 nt, Neisseria meningitidis Z2491
auucucacaaaaaca

SEQ ID NO: 3353503 - RNA, 17 nt, Neisseria meningitidis Z2491
auucucaugaucuucuu

SEQ ID NO: 3353504 - RNA, 22 nt, Neisseria meningitidis Z2491
auucuccaaguuccaauacauu

SEQ ID NO: 3353505 - RNA, 16 nt, Neisseria meningitidis Z2491
auucucccaaaggcaa

SEQ ID NO: 3353506 - RNA, 20 nt, Neisseria meningitidis Z2491
auucucgcgaaagcgggaau

SEQ ID NO: 3353507 - RNA, 12 nt, Neisseria meningitidis Z2491
auucugauuuau

SEQ ID NO: 3353508 - RNA, 13 nt, Neisseria meningitidis Z2491
auucugcaaaaau

SEQ ID NO: 3353509 - RNA, 15 nt, Neisseria meningitidis Z2491
auucugccaaacggc

SEQ ID NO: 3353510 - RNA, 21 nt, Neisseria meningitidis Z2491
auucuguuuggauaugccgua

SEQ ID NO: 3353511 - RNA, 22 nt, Neisseria meningitidis Z2491
auucuucgaucauccauuuaaa

SEQ ID NO: 3353512 - RNA, 13 nt, Neisseria meningitidis Z2491
auucuugaggcau

SEQ ID NO: 3353513 - RNA, 14 nt, Neisseria meningitidis Z2491
auucuugaggcauu

SEQ ID NO: 3353514 - RNA, 22 nt, Neisseria meningitidis Z2491
auucuugaggcauugaaauucc

SEQ ID NO: 3353515 - RNA, 20 nt, Neisseria meningitidis Z2491
auucuugauggcgaaagcaa

SEQ ID NO: 3353516 - RNA, 15 nt, Neisseria meningitidis Z2491
auucuugcaaaauag

SEQ ID NO: 3353517 - RNA, 14 nt, Neisseria meningitidis Z2491
auucuugcaacuuu

SEQ ID NO: 3353518 - RNA, 17 nt, Neisseria meningitidis Z2491
auucuugucaaaccaac

SEQ ID NO: 3353519 - RNA, 20 nt, Neisseria meningitidis Z2491
auucuuucgcuugugaaaau

SEQ ID NO: 3353520 - RNA, 12 nt, Neisseria meningitidis Z2491
auugaaauucca

SEQ ID NO: 3353521 - RNA, 19 nt, Neisseria meningitidis Z2491
auugaaauuccagauuccc

SEQ ID NO: 3353522 - RNA, 19 nt, Neisseria meningitidis Z2491
auugaaauucgucauuccc

SEQ ID NO: 3353523 - RNA, 19 nt, Neisseria meningitidis Z2491
auugaaugucuagauuccc

SEQ ID NO: 3353524 - RNA, 14 nt, Neisseria meningitidis Z2491
auugaccgaaaaau

SEQ ID NO: 3353525 - RNA, 17 nt, Neisseria meningitidis Z2491
auugaccgaaaaauaau

SEQ ID NO: 3353526 - RNA, 13 nt, Neisseria meningitidis Z2491
auugacggacggc

SEQ ID NO: 3353527 - RNA, 23 nt, Neisseria meningitidis Z2491
auugacggacggcggcagauaaa

SEQ ID NO: 3353528 - RNA, 20 nt, Neisseria meningitidis Z2491
auugacuauuuuuuaaucau

SEQ ID NO: 3353529 - RNA, 17 nt, Neisseria meningitidis Z2491
auugagaccuuugcaau

SEQ ID NO: 3353530 - RNA, 12 nt, Neisseria meningitidis Z2491
auugagcaaaaa

SEQ ID NO: 3353531 - RNA, 18 nt, Neisseria meningitidis Z2491
auugagggcacagucggc

SEQ ID NO: 3353532 - RNA, 14 nt, Neisseria meningitidis Z2491
auugcacuaaaacu

SEQ ID NO: 3353533 - RNA, 19 nt, Neisseria meningitidis Z2491
auugccacgccgaacccga

SEQ ID NO: 3353534 - RNA, 18 nt, Neisseria meningitidis Z2491
auugccgccggcuauaca

SEQ ID NO: 3353535 - RNA, 17 nt, Neisseria meningitidis Z2491
auugccguuuuccuuuc

SEQ ID NO: 3353536 - RNA, 23 nt, Neisseria meningitidis Z2491
auugccucuauuuaaaaauuccu

SEQ ID NO: 3353537 - RNA, 11 nt, Neisseria meningitidis Z2491
auugccuucau

SEQ ID NO: 3353538 - RNA, 20 nt, Neisseria meningitidis Z2491
auugccuuuauugugcuaug

SEQ ID NO: 3353539 - RNA, 22 nt, Neisseria meningitidis Z2491
auugccuuuucccugacaaaca

SEQ ID NO: 3353540 - RNA, 23 nt, Neisseria meningitidis Z2491
auugccuuuucccugacaaacag

SEQ ID NO: 3353541 - RNA, 14 nt, Neisseria meningitidis Z2491
auugcggcuuuuuc

SEQ ID NO: 3353542 - RNA, 15 nt, Neisseria meningitidis Z2491
auugcuccugacggc

SEQ ID NO: 3353543 - RNA, 18 nt, Neisseria meningitidis Z2491
auuggauuuggcuuaaaa

SEQ ID NO: 3353544 - RNA, 22 nt, Neisseria meningitidis Z2491
auugggaagucgugcauucagc

SEQ ID NO: 3353545 - RNA, 21 nt, Neisseria meningitidis Z2491
auuguauauuggcauccacau

SEQ ID NO: 3353546 - RNA, 22 nt, Neisseria meningitidis Z2491
auuguauauuggcauccacauu

SEQ ID NO: 3353547 - RNA, 14 nt, Neisseria meningitidis Z2491
auugucaaaauaca

SEQ ID NO: 3353548 - RNA, 23 nt, Neisseria meningitidis Z2491
auugucggaaugugguuucagac

SEQ ID NO: 3353549 - RNA, 17 nt, Neisseria meningitidis Z2491
auugugcccacggggug

SEQ ID NO: 3353550 - RNA, 19 nt, Neisseria meningitidis Z2491
auuguuaaguauuucuauu

SEQ ID NO: 3353551 - RNA, 12 nt, Neisseria meningitidis Z2491
auuguuucccag

SEQ ID NO: 3353552 - RNA, 22 nt, Neisseria meningitidis Z2491
auuguuucugaagccagcccca

SEQ ID NO: 3353553 - RNA, 21 nt, Neisseria meningitidis Z2491
auuguuuguuuuuuucaggcc

SEQ ID NO: 3353554 - RNA, 17 nt, Neisseria meningitidis Z2491
auuguuuucucacgcag

SEQ ID NO: 3353555 - RNA, 14 nt, Neisseria meningitidis Z2491
auuuaaaccaguac

SEQ ID NO: 3353556 - RNA, 20 nt, Neisseria meningitidis Z2491
auuuaaaccaguacggcguu

SEQ ID NO: 3353557 - RNA, 20 nt, Neisseria meningitidis Z2491
auuuaaaucaguacggcguu

SEQ ID NO: 3353558 - RNA, 12 nt, Neisseria meningitidis Z2491
auuuaaauuuaa

SEQ ID NO: 3353559 - RNA, 20 nt, Neisseria meningitidis Z2491
auuuaaauuuaauccacuau

SEQ ID NO: 3353560 - RNA, 20 nt, Neisseria meningitidis Z2491
auuuaaauuuaauccgcuau

SEQ ID NO: 3353561 - RNA, 20 nt, Neisseria meningitidis Z2491
auuuaaauuuaauucacuau

SEQ ID NO: 3353562 - RNA, 13 nt, Neisseria meningitidis Z2491
auuuaaggaaugc

SEQ ID NO: 3353563 - RNA, 13 nt, Neisseria meningitidis Z2491
auuuaauccacua

SEQ ID NO: 3353564 - RNA, 20 nt, Neisseria meningitidis Z2491
auuuaauccacuauaaaaac

SEQ ID NO: 3353565 - RNA, 15 nt, Neisseria meningitidis Z2491
auuuacgauaugcaa

SEQ ID NO: 3353566 - RNA, 13 nt, Neisseria meningitidis Z2491
auuuacggugcag

SEQ ID NO: 3353567 - RNA, 17 nt, Neisseria meningitidis Z2491
auuuagaaaaaauauac

SEQ ID NO: 3353568 - RNA, 12 nt, Neisseria meningitidis Z2491
auuuuugauuuc

SEQ ID NO: 3353569 - RNA, 20 nt, Neisseria meningitidis Z2491
auuuuugcaaaggucucuau

SEQ ID NO: 3353570 - RNA, 19 nt, Neisseria meningitidis Z2491
auuuuugcccgauuuaaag

SEQ ID NO: 3353571 - RNA, 18 nt, Neisseria meningitidis Z2491
auuuuuggcgcauuuuua

SEQ ID NO: 3353572 - RNA, 15 nt, Neisseria meningitidis Z2491
auuuuuguuaaucca

SEQ ID NO: 3353573 - RNA, 23 nt, Neisseria meningitidis Z2491
auuuuuguuaauccacuauaaaa

SEQ ID NO: 3353574 - RNA, 21 nt, Neisseria meningitidis Z2491
auuuuuguuaauccacuauac

SEQ ID NO: 3353575 - RNA, 13 nt, Neisseria meningitidis Z2491
auuuuuuaaucau

SEQ ID NO: 3353576 - RNA, 21 nt, Neisseria meningitidis Z2491
auuuuuuaaucaucguauuuu

SEQ ID NO: 3353577 - RNA, 15 nt, Neisseria meningitidis Z2491
auuuuuucuaaaugu

SEQ ID NO: 3353578 - RNA, 18 nt, Neisseria meningitidis Z2491
auuuuuuggcgcauuuuu

SEQ ID NO: 3353579 - RNA, 19 nt, Neisseria meningitidis Z2491
auuuuuuggcgcauuuuua

SEQ ID NO: 3353580 - RNA, 15 nt, Neisseria meningitidis Z2491
auuuuuuuauuuaaa

SEQ ID NO: 3353581 - RNA, 17 nt, Neisseria meningitidis Z2491
auuuuuuuucuaaccag

SEQ ID NO: 3353582 - RNA, 13 nt, Neisseria meningitidis Z2491
caaaaaaaaaccu

SEQ ID NO: 3353583 - RNA, 17 nt, Neisseria meningitidis Z2491
caaaaaaaaaccuaaaa

SEQ ID NO: 3353584 - RNA, 18 nt, Neisseria meningitidis Z2491
caaaaaaaagccguccga

SEQ ID NO: 3353585 - RNA, 14 nt, Neisseria meningitidis Z2491
caaaaaaacuagau

SEQ ID NO: 3353586 - RNA, 11 nt, Neisseria meningitidis Z2491
caaaaaacaac

SEQ ID NO: 3353587 - RNA, 12 nt, Neisseria meningitidis Z2491
caaaaaacaaca

SEQ ID NO: 3353588 - RNA, 11 nt, Neisseria meningitidis Z2491
caaaaaagcca

SEQ ID NO: 3353589 - RNA, 16 nt, Neisseria meningitidis Z2491
caaaaaagccagcagc

SEQ ID NO: 3353590 - RNA, 11 nt, Neisseria meningitidis Z2491
caaaaaauaaa

SEQ ID NO: 3353591 - RNA, 16 nt, Neisseria meningitidis Z2491
caaaaaaucaaaaaca

SEQ ID NO: 3353592 - RNA, 21 nt, Neisseria meningitidis Z2491
caaaaaaugccgucugaaacc

SEQ ID NO: 3353593 - RNA, 10 nt, Neisseria meningitidis Z2491
caaaaacaga

SEQ ID NO: 3353594 - RNA, 12 nt, Neisseria meningitidis Z2491
caaaaacagaaa

SEQ ID NO: 3353595 - RNA, 16 nt, Neisseria meningitidis Z2491
caaaaacagaaaacca

SEQ ID NO: 3353596 - RNA, 17 nt, Neisseria meningitidis Z2491
caaaaacagaaaaccaa

SEQ ID NO: 3353597 - RNA, 14 nt, Neisseria meningitidis Z2491
caaaaacagaaaau

SEQ ID NO: 3353598 - RNA, 21 nt, Neisseria meningitidis Z2491
caaaaacagaaaccuaaaauc

SEQ ID NO: 3353599 - RNA, 15 nt, Neisseria meningitidis Z2491
caaaaacaucagcca

SEQ ID NO: 3353600 - RNA, 20 nt, Neisseria meningitidis Z2491
caaaaacgaagagcggcagg

SEQ ID NO: 3353601 - RNA, 14 nt, Neisseria meningitidis Z2491
caaaaacggcacgg

SEQ ID NO: 3353602 - RNA, 13 nt, Neisseria meningitidis Z2491
caaaaacucgaaa

SEQ ID NO: 3353603 - RNA, 13 nt, Neisseria meningitidis Z2491
caaaaagaggcau

SEQ ID NO: 3353604 - RNA, 18 nt, Neisseria meningitidis Z2491
caaaaagcuggauuccca

SEQ ID NO: 3353605 - RNA, 15 nt, Neisseria meningitidis Z2491
caaaaaguccuucac

SEQ ID NO: 3353606 - RNA, 16 nt, Neisseria meningitidis Z2491
caaaaauaccgucuga

SEQ ID NO: 3353607 - RNA, 15 nt, Neisseria meningitidis Z2491
caaaaaucaggacaa

SEQ ID NO: 3353608 - RNA, 18 nt, Neisseria meningitidis Z2491
caaaaaugccgucugaaa

SEQ ID NO: 3353609 - RNA, 20 nt, Neisseria meningitidis Z2491
caaaaaugccgucugaaacg

SEQ ID NO: 3353610 - RNA, 19 nt, Neisseria meningitidis Z2491
caaaaaugccgucugaagg

SEQ ID NO: 3353611 - RNA, 12 nt, Neisseria meningitidis Z2491
caaaaauuuauc

SEQ ID NO: 3353612 - RNA, 13 nt, Neisseria meningitidis Z2491
caaaacaaaccca

SEQ ID NO: 3353613 - RNA, 21 nt, Neisseria meningitidis Z2491
caaaacaagcgauuauuuuuu

SEQ ID NO: 3353614 - RNA, 13 nt, Neisseria meningitidis Z2491
caaaacaucgaca

SEQ ID NO: 3353615 - RNA, 22 nt, Neisseria meningitidis Z2491
caaaaccacuuucaucgcuuga

SEQ ID NO: 3353616 - RNA, 17 nt, Neisseria meningitidis Z2491
caaaacgccgcuguuac

SEQ ID NO: 3353617 - RNA, 15 nt, Neisseria meningitidis Z2491
caaaacucaaucaaa

SEQ ID NO: 3353618 - RNA, 16 nt, Neisseria meningitidis Z2491
caaaacuuuucugauu

SEQ ID NO: 3353619 - RNA, 19 nt, Neisseria meningitidis Z2491
caaaacuuuucugauuuuu

SEQ ID NO: 3353620 - RNA, 17 nt, Neisseria meningitidis Z2491
caaaagaccgucugaac

SEQ ID NO: 3353621 - RNA, 14 nt, Neisseria meningitidis Z2491
caaaagccguguga

SEQ ID NO: 3353622 - RNA, 21 nt, Neisseria meningitidis Z2491
caaaagcgcgcguaucaaaaa

SEQ ID NO: 3353623 - RNA, 17 nt, Neisseria meningitidis Z2491
caaaagcgggaauccaa

SEQ ID NO: 3353624 - RNA, 19 nt, Neisseria meningitidis Z2491
caaaagcgggaauccaaac

SEQ ID NO: 3353625 - RNA, 15 nt, Neisseria meningitidis Z2491
caaaaggccgucuga

SEQ ID NO: 3353626 - RNA, 16 nt, Neisseria meningitidis Z2491
caaaaggccgucugaa

SEQ ID NO: 3353627 - RNA, 17 nt, Neisseria meningitidis Z2491
caaaagguucaaacaca

SEQ ID NO: 3353628 - RNA, 15 nt, Neisseria meningitidis Z2491
caaaauaaaaaacaa

SEQ ID NO: 3353629 - RNA, 18 nt, Neisseria meningitidis Z2491
caaaauaaacuugauugc

SEQ ID NO: 3353630 - RNA, 14 nt, Neisseria meningitidis Z2491
caaaauaccgucug

SEQ ID NO: 3353631 - RNA, 18 nt, Neisseria meningitidis Z2491
caaaauagaaaaccgaaa

SEQ ID NO: 3353632 - RNA, 22 nt, Neisseria meningitidis Z2491
caaaauaugccgucauucccgc

SEQ ID NO: 3353633 - RNA, 12 nt, Neisseria meningitidis Z2491
caaaaucagaaa

SEQ ID NO: 3353634 - RNA, 15 nt, Neisseria meningitidis Z2491
caaaaucagaaaccu

SEQ ID NO: 3353635 - RNA, 19 nt, Neisseria meningitidis Z2491
caaaaucagaaaccuaaaa

SEQ ID NO: 3353636 - RNA, 23 nt, Neisseria meningitidis Z2491
caaaaucagaaaccuaaaauccg

SEQ ID NO: 3353637 - RNA, 16 nt, Neisseria meningitidis Z2491
caaaaucagcacaaau

SEQ ID NO: 3353638 - RNA, 17 nt, Neisseria meningitidis Z2491
caaaaucagcacaaaug

SEQ ID NO: 3353639 - RNA, 13 nt, Neisseria meningitidis Z2491
caaaaugccgucu

SEQ ID NO: 3353640 - RNA, 14 nt, Neisseria meningitidis Z2491
caaaaugccgucug

SEQ ID NO: 3353641 - RNA, 15 nt, Neisseria meningitidis Z2491
caaaaugccgucuga

SEQ ID NO: 3353642 - RNA, 17 nt, Neisseria meningitidis Z2491
caaaaugccgucugaaa

SEQ ID NO: 3353643 - RNA, 20 nt, Neisseria meningitidis Z2491
caaaaugccgucugaaaacc

SEQ ID NO: 3353644 - RNA, 19 nt, Neisseria meningitidis Z2491
caaaaugccgucugaaacc

SEQ ID NO: 3353645 - RNA, 17 nt, Neisseria meningitidis Z2491
caaaaugccgucugaag

SEQ ID NO: 3353646 - RNA, 23 nt, Neisseria meningitidis Z2491
caaaaugccgucugaagcgagca

SEQ ID NO: 3353647 - RNA, 14 nt, Neisseria meningitidis Z2491
caaaauuucagauu

SEQ ID NO: 3353648 - RNA, 15 nt, Neisseria meningitidis Z2491
caaacaaaaaugccg

SEQ ID NO: 3353649 - RNA, 23 nt, Neisseria meningitidis Z2491
caaacaccagcaucugauacacc

SEQ ID NO: 3353650 - RNA, 13 nt, Neisseria meningitidis Z2491
caaacaccggcug

SEQ ID NO: 3353651 - RNA, 15 nt, Neisseria meningitidis Z2491
caaacagaaaaacaa

SEQ ID NO: 3353652 - RNA, 16 nt, Neisseria meningitidis Z2491
caaacagaaaaacaau

SEQ ID NO: 3353653 - RNA, 19 nt, Neisseria meningitidis Z2491
caaacaggcagccuaaaac

SEQ ID NO: 3353654 - RNA, 20 nt, Neisseria meningitidis Z2491
caaacaggcuucagacggca

SEQ ID NO: 3353655 - RNA, 20 nt, Neisseria meningitidis Z2491
caaacaucacggucuuuuug

SEQ ID NO: 3353656 - RNA, 16 nt, Neisseria meningitidis Z2491
caaacaucgcucaaau

SEQ ID NO: 3353657 - RNA, 18 nt, Neisseria meningitidis Z2491
caaacaucggcggacagg

SEQ ID NO: 3353658 - RNA, 12 nt, Neisseria meningitidis Z2491
caaacaucugau

SEQ ID NO: 3353659 - RNA, 18 nt, Neisseria meningitidis Z2491
caaacaucugauuuuucu

SEQ ID NO: 3353660 - RNA, 19 nt, Neisseria meningitidis Z2491
caaacaucugauuuuucuu

SEQ ID NO: 3353661 - RNA, 13 nt, Neisseria meningitidis Z2491
caaacauuuugau

SEQ ID NO: 3353662 - RNA, 19 nt, Neisseria meningitidis Z2491
caaaccauacuggaugucg

SEQ ID NO: 3353663 - RNA, 16 nt, Neisseria meningitidis Z2491
caaacccaaugcuuca

SEQ ID NO: 3353664 - RNA, 22 nt, Neisseria meningitidis Z2491
caaaccccauucggagcaagac

SEQ ID NO: 3353665 - RNA, 18 nt, Neisseria meningitidis Z2491
caaaccccuucaaaccaa

SEQ ID NO: 3353666 - RNA, 16 nt, Neisseria meningitidis Z2491
caaacccuccgccucu

SEQ ID NO: 3353667 - RNA, 14 nt, Neisseria meningitidis Z2491
caaacccuuuuucu

SEQ ID NO: 3353668 - RNA, 16 nt, Neisseria meningitidis Z2491
caaaccgaugccguca

SEQ ID NO: 3353669 - RNA, 21 nt, Neisseria meningitidis Z2491
caaaccgaugggcuucaucag

SEQ ID NO: 3353670 - RNA, 16 nt, Neisseria meningitidis Z2491
caaccaagaagcggcg

SEQ ID NO: 3353671 - RNA, 22 nt, Neisseria meningitidis Z2491
caaccagccagccguauuuguc

SEQ ID NO: 3353672 - RNA, 17 nt, Neisseria meningitidis Z2491
caaccggauaccaucuu

SEQ ID NO: 3353673 - RNA, 15 nt, Neisseria meningitidis Z2491
caaccgguccuucca

SEQ ID NO: 3353674 - RNA, 19 nt, Neisseria meningitidis Z2491
caaccgguccuuccaucac

SEQ ID NO: 3353675 - RNA, 15 nt, Neisseria meningitidis Z2491
caaccguccacacau

SEQ ID NO: 3353676 - RNA, 21 nt, Neisseria meningitidis Z2491
caaccugcugcccaugaagag

SEQ ID NO: 3353677 - RNA, 18 nt, Neisseria meningitidis Z2491
caaccuguuuuucaaagc

SEQ ID NO: 3353678 - RNA, 14 nt, Neisseria meningitidis Z2491
caaccuuaacaauc

SEQ ID NO: 3353679 - RNA, 13 nt, Neisseria meningitidis Z2491
caaccuugccaag

SEQ ID NO: 3353680 - RNA, 17 nt, Neisseria meningitidis Z2491
caaccuuuccgccguca

SEQ ID NO: 3353681 - RNA, 19 nt, Neisseria meningitidis Z2491
caacgacuuccagcaccag

SEQ ID NO: 3353682 - RNA, 14 nt, Neisseria meningitidis Z2491
caacgcaagcggcg

SEQ ID NO: 3353683 - RNA, 17 nt, Neisseria meningitidis Z2491
caacgccacccauauaa

SEQ ID NO: 3353684 - RNA, 23 nt, Neisseria meningitidis Z2491
caacgccucgccgaacgagccgu

SEQ ID NO: 3353685 - RNA, 20 nt, Neisseria meningitidis Z2491
caacgcgaaggcgaccgccu

SEQ ID NO: 3353686 - RNA, 23 nt, Neisseria meningitidis Z2491
caacgcuugaaucuucauuccgc

SEQ ID NO: 3353687 - RNA, 22 nt, Neisseria meningitidis Z2491
caacgggaggaccucaaacgaa

SEQ ID NO: 3353688 - RNA, 17 nt, Neisseria meningitidis Z2491
caacguuuuaccguuca

SEQ ID NO: 3353689 - RNA, 23 nt, Neisseria meningitidis Z2491
caacuauuaccgguauuuuuuuc

SEQ ID NO: 3353690 - RNA, 14 nt, Neisseria meningitidis Z2491
caacucuacggguu

SEQ ID NO: 3353691 - RNA, 11 nt, Neisseria meningitidis Z2491
caacugaaacc

SEQ ID NO: 3353692 - RNA, 21 nt, Neisseria meningitidis Z2491
caacugauuguuuuucagaga

SEQ ID NO: 3353693 - RNA, 23 nt, Neisseria meningitidis Z2491
caacuuaaaaccucgucauuccc

SEQ ID NO: 3353694 - RNA, 22 nt, Neisseria meningitidis Z2491
caacuugguggucggcauucaa

SEQ ID NO: 3353695 - RNA, 22 nt, Neisseria meningitidis Z2491
caacuuuuccgcgucauucccg

SEQ ID NO: 3353696 - RNA, 23 nt, Neisseria meningitidis Z2491
caacuuuuccgcgucauucccgc

SEQ ID NO: 3353697 - RNA, 22 nt, Neisseria meningitidis Z2491
caacuuuuuucgauaugaaaag

SEQ ID NO: 3353698 - RNA, 17 nt, Neisseria meningitidis Z2491
caagaacuuuaucccca

SEQ ID NO: 3353699 - RNA, 21 nt, Neisseria meningitidis Z2491
caagaacuuuauccccagcga

SEQ ID NO: 3353700 - RNA, 24 nt, Neisseria meningitidis Z2491
caagaagaaagcggaauacggcaa

SEQ ID NO: 3353701 - RNA, 16 nt, Neisseria meningitidis Z2491
caagaauuuaucaaaa

SEQ ID NO: 3353702 - RNA, 19 nt, Neisseria meningitidis Z2491
caagaauuuaucaaaaaug

SEQ ID NO: 3353703 - RNA, 21 nt, Neisseria meningitidis Z2491
caagaauuuaucaaaaaugac

SEQ ID NO: 3353704 - RNA, 16 nt, Neisseria meningitidis Z2491
caagaccaaacagaac

SEQ ID NO: 3353705 - RNA, 24 nt, Neisseria meningitidis Z2491
caagauuucaucauccugcuuuaa

SEQ ID NO: 3353706 - RNA, 15 nt, Neisseria meningitidis Z2491
caagcaauaccgcaa

SEQ ID NO: 3353707 - RNA, 14 nt, Neisseria meningitidis Z2491
caagcagcaggcgu

SEQ ID NO: 3353708 - RNA, 13 nt, Neisseria meningitidis Z2491
caagcaguugaaa

SEQ ID NO: 3353709 - RNA, 15 nt, Neisseria meningitidis Z2491
caagccaguauccuu

SEQ ID NO: 3353710 - RNA, 16 nt, Neisseria meningitidis Z2491
caagccgacuucuuuu

SEQ ID NO: 3353711 - RNA, 17 nt, Neisseria meningitidis Z2491
caagccgacuuuuucca

SEQ ID NO: 3353712 - RNA, 15 nt, Neisseria meningitidis Z2491
caagccgcauugucc

SEQ ID NO: 3353713 - RNA, 19 nt, Neisseria meningitidis Z2491
caagccuucccguuccaca

SEQ ID NO: 3353714 - RNA, 20 nt, Neisseria meningitidis Z2491
caagccuucccguuccacaa

SEQ ID NO: 3353715 - RNA, 13 nt, Neisseria meningitidis Z2491
caagcgcauggac

SEQ ID NO: 3353716 - RNA, 14 nt, Neisseria meningitidis Z2491
caagcgguaaguga

SEQ ID NO: 3353717 - RNA, 20 nt, Neisseria meningitidis Z2491
caagcgguaagugauuuucc

SEQ ID NO: 3353718 - RNA, 16 nt, Neisseria meningitidis Z2491
caagcguucacgccag

SEQ ID NO: 3353719 - RNA, 21 nt, Neisseria meningitidis Z2491
caagcguucacgccagcaaca

SEQ ID NO: 3353720 - RNA, 13 nt, Neisseria meningitidis Z2491
caagcuacggcuc

SEQ ID NO: 3353721 - RNA, 19 nt, Neisseria meningitidis Z2491
caaggaaugccagcagguu

SEQ ID NO: 3353722 - RNA, 20 nt, Neisseria meningitidis Z2491
caaggaugccguuucagacg

SEQ ID NO: 3353723 - RNA, 22 nt, Neisseria meningitidis Z2491
caaggaugccguuucagacggc

SEQ ID NO: 3353724 - RNA, 17 nt, Neisseria meningitidis Z2491
caaggcaacgaagccgu

SEQ ID NO: 3353725 - RNA, 18 nt, Neisseria meningitidis Z2491
caaggcagcaacgacagc

SEQ ID NO: 3353726 - RNA, 17 nt, Neisseria meningitidis Z2491
caaggcgcggcacacgc

SEQ ID NO: 3353727 - RNA, 17 nt, Neisseria meningitidis Z2491
caaggcggcgagccgca

SEQ ID NO: 3353728 - RNA, 18 nt, Neisseria meningitidis Z2491
caaggcggcgagccgcag

SEQ ID NO: 3353729 - RNA, 17 nt, Neisseria meningitidis Z2491
caaggucgaggaaauuc

SEQ ID NO: 3353730 - RNA, 20 nt, Neisseria meningitidis Z2491
caaggucgaggaaauucugc

SEQ ID NO: 3353731 - RNA, 22 nt, Neisseria meningitidis Z2491
caaggucguauuucgcuucgga

SEQ ID NO: 3353732 - RNA, 16 nt, Neisseria meningitidis Z2491
caagucaaaggcuucg

SEQ ID NO: 3353733 - RNA, 13 nt, Neisseria meningitidis Z2491
caagucuucggca

SEQ ID NO: 3353734 - RNA, 15 nt, Neisseria meningitidis Z2491
caagugaaucgguuu

SEQ ID NO: 3353735 - RNA, 17 nt, Neisseria meningitidis Z2491
caaguguccggcagccu

SEQ ID NO: 3353736 - RNA, 12 nt, Neisseria meningitidis Z2491
caaguuuauccu

SEQ ID NO: 3353737 - RNA, 12 nt, Neisseria meningitidis Z2491
caaguuucagcc

SEQ ID NO: 3353738 - RNA, 16 nt, Neisseria meningitidis Z2491
caauaauaaacgccau

SEQ ID NO: 3353739 - RNA, 18 nt, Neisseria meningitidis Z2491
caauaauggcaaccaaaa

SEQ ID NO: 3353740 - RNA, 20 nt, Neisseria meningitidis Z2491
caauacaacaaaaugccgcc

SEQ ID NO: 3353741 - RNA, 23 nt, Neisseria meningitidis Z2491
caauacacaagguuauuuucuug

SEQ ID NO: 3353742 - RNA, 21 nt, Neisseria meningitidis Z2491
caauacacuguuuccaagccg

SEQ ID NO: 3353743 - RNA, 20 nt, Neisseria meningitidis Z2491
caauaccuugagccaagcaa

SEQ ID NO: 3353744 - RNA, 17 nt, Neisseria meningitidis Z2491
caauaccuuguuuuuuc

SEQ ID NO: 3353745 - RNA, 14 nt, Neisseria meningitidis Z2491
caauacgcaaaaca

SEQ ID NO: 3353746 - RNA, 17 nt, Neisseria meningitidis Z2491
caauacggcggcggcag

SEQ ID NO: 3353747 - RNA, 15 nt, Neisseria meningitidis Z2491
caauacggucgagga

SEQ ID NO: 3353748 - RNA, 17 nt, Neisseria meningitidis Z2491
caauaggauaggcugcu

SEQ ID NO: 3353749 - RNA, 13 nt, Neisseria meningitidis Z2491
caauauaaacaag

SEQ ID NO: 3353750 - RNA, 14 nt, Neisseria meningitidis Z2491
caauauaucgaaca

SEQ ID NO: 3353751 - RNA, 20 nt, Neisseria meningitidis Z2491
caauauuaagaaaaacagca

SEQ ID NO: 3353752 - RNA, 21 nt, Neisseria meningitidis Z2491
caauauuaagaaaaacagcaa

SEQ ID NO: 3353753 - RNA, 16 nt, Neisseria meningitidis Z2491
caauauucauacugug

SEQ ID NO: 3353754 - RNA, 22 nt, Neisseria meningitidis Z2491
caaucacgucaggcacgcgcug

SEQ ID NO: 3353755 - RNA, 14 nt, Neisseria meningitidis Z2491
caaucagaucggca

SEQ ID NO: 3353756 - RNA, 17 nt, Neisseria meningitidis Z2491
caaucagaucggcaaac

SEQ ID NO: 3353757 - RNA, 11 nt, Neisseria meningitidis Z2491
caaucagauug

SEQ ID NO: 3353758 - RNA, 23 nt, Neisseria meningitidis Z2491
caaucagauugggaagucgugca

SEQ ID NO: 3353759 - RNA, 15 nt, Neisseria meningitidis Z2491
caaucaggaaaacag

SEQ ID NO: 3353760 - RNA, 22 nt, Neisseria meningitidis Z2491
caaucaucaucacaauggcgga

SEQ ID NO: 3353761 - RNA, 18 nt, Neisseria meningitidis Z2491
caauccacgcaaucaaga

SEQ ID NO: 3353762 - RNA, 17 nt, Neisseria meningitidis Z2491
caauccauucccucucc

SEQ ID NO: 3353763 - RNA, 15 nt, Neisseria meningitidis Z2491
caaucccgcaacucu

SEQ ID NO: 3353764 - RNA, 16 nt, Neisseria meningitidis Z2491
caaucccguugccaaa

SEQ ID NO: 3353765 - RNA, 22 nt, Neisseria meningitidis Z2491
caauccgcccgaauaaaaaaua

SEQ ID NO: 3353766 - RNA, 21 nt, Neisseria meningitidis Z2491
caauccgcccucucauuugcc

SEQ ID NO: 3353767 - RNA, 22 nt, Neisseria meningitidis Z2491
caauccugcacgcgcuucaaau

SEQ ID NO: 3353768 - RNA, 13 nt, Neisseria meningitidis Z2491
caauccugccuuc

SEQ ID NO: 3353769 - RNA, 21 nt, Neisseria meningitidis Z2491
caaucucaaaucccgucauuc

SEQ ID NO: 3353770 - RNA, 20 nt, Neisseria meningitidis Z2491
caaucuggucgccguucaaa

SEQ ID NO: 3353771 - RNA, 14 nt, Neisseria meningitidis Z2491
cacggcagcacuga

SEQ ID NO: 3353772 - RNA, 15 nt, Neisseria meningitidis Z2491
cacggccggcgcagc

SEQ ID NO: 3353773 - RNA, 21 nt, Neisseria meningitidis Z2491
cacggcguucaacauccgcag

SEQ ID NO: 3353774 - RNA, 19 nt, Neisseria meningitidis Z2491
cacggcuuucgcgccgcgc

SEQ ID NO: 3353775 - RNA, 21 nt, Neisseria meningitidis Z2491
cacgggaaugacgaaagguug

SEQ ID NO: 3353776 - RNA, 14 nt, Neisseria meningitidis Z2491
cacggguucagacg

SEQ ID NO: 3353777 - RNA, 20 nt, Neisseria meningitidis Z2491
cacgguggcaucgucagacc

SEQ ID NO: 3353778 - RNA, 17 nt, Neisseria meningitidis Z2491
cacgguucugcaccgcu

SEQ ID NO: 3353779 - RNA, 20 nt, Neisseria meningitidis Z2491
cacgucguaggcuuuuucca

SEQ ID NO: 3353780 - RNA, 19 nt, Neisseria meningitidis Z2491
cacgucgucgguaaucaca

SEQ ID NO: 3353781 - RNA, 17 nt, Neisseria meningitidis Z2491
cacguucgcaggcuucg

SEQ ID NO: 3353782 - RNA, 21 nt, Neisseria meningitidis Z2491
cacguuugaguacgucgccuu

SEQ ID NO: 3353783 - RNA, 18 nt, Neisseria meningitidis Z2491
cacguuugccaaggcggc

SEQ ID NO: 3353784 - RNA, 16 nt, Neisseria meningitidis Z2491
cacuagccaaaaaaac

SEQ ID NO: 3353785 - RNA, 23 nt, Neisseria meningitidis Z2491
cacuauaauacauugauuuuuau

SEQ ID NO: 3353786 - RNA, 17 nt, Neisseria meningitidis Z2491
cacuauaauccaccaua

SEQ ID NO: 3353787 - RNA, 22 nt, Neisseria meningitidis Z2491
cacuauaaugauugacuauuuu

SEQ ID NO: 3353788 - RNA, 19 nt, Neisseria meningitidis Z2491
cacuauaccaaacggcaua

SEQ ID NO: 3353789 - RNA, 22 nt, Neisseria meningitidis Z2491
cacuauaguuuuuuugaauuuc

SEQ ID NO: 3353790 - RNA, 14 nt, Neisseria meningitidis Z2491
cacucacuuuaauc

SEQ ID NO: 3353791 - RNA, 18 nt, Neisseria meningitidis Z2491
cacugccagccgccgagc

SEQ ID NO: 3353792 - RNA, 13 nt, Neisseria meningitidis Z2491
cacugcccuuuca

SEQ ID NO: 3353793 - RNA, 15 nt, Neisseria meningitidis Z2491
cacugccucuuuuca

SEQ ID NO: 3353794 - RNA, 17 nt, Neisseria meningitidis Z2491
cacugccucuuuucaga

SEQ ID NO: 3353795 - RNA, 13 nt, Neisseria meningitidis Z2491
cacugucugcggc

SEQ ID NO: 3353796 - RNA, 20 nt, Neisseria meningitidis Z2491
cacuucaaccagccagccgu

SEQ ID NO: 3353797 - RNA, 16 nt, Neisseria meningitidis Z2491
cacuucacauuuucua

SEQ ID NO: 3353798 - RNA, 24 nt, Neisseria meningitidis Z2491
cacuugccgcauaaaucaacagca

SEQ ID NO: 3353799 - RNA, 19 nt, Neisseria meningitidis Z2491
cacuuggugcuucagcacc

SEQ ID NO: 3353800 - RNA, 20 nt, Neisseria meningitidis Z2491
cacuuggugcuucagcaccu

SEQ ID NO: 3353801 - RNA, 22 nt, Neisseria meningitidis Z2491
cacuuucgccauaaucugcggc

SEQ ID NO: 3353802 - RNA, 15 nt, Neisseria meningitidis Z2491
cacuuucgugggaau

SEQ ID NO: 3353803 - RNA, 14 nt, Neisseria meningitidis Z2491
cagaaaaccaaaaa

SEQ ID NO: 3353804 - RNA, 17 nt, Neisseria meningitidis Z2491
cagaaaauuucuugauu

SEQ ID NO: 3353805 - RNA, 17 nt, Neisseria meningitidis Z2491
cagaaacagcgaagaca

SEQ ID NO: 3353806 - RNA, 21 nt, Neisseria meningitidis Z2491
cagaaacagcgaagacaggca

SEQ ID NO: 3353807 - RNA, 13 nt, Neisseria meningitidis Z2491
cagaaacccaaaa

SEQ ID NO: 3353808 - RNA, 22 nt, Neisseria meningitidis Z2491
cagaaacccaaaaucggccauu

SEQ ID NO: 3353809 - RNA, 20 nt, Neisseria meningitidis Z2491
cagaaaccgcucugccguca

SEQ ID NO: 3353810 - RNA, 23 nt, Neisseria meningitidis Z2491
cagaaaccgcucugccgucauuc

SEQ ID NO: 3353811 - RNA, 11 nt, Neisseria meningitidis Z2491
cagaaaccuaa

SEQ ID NO: 3353812 - RNA, 13 nt, Neisseria meningitidis Z2491
cagaaaccuaaaa

SEQ ID NO: 3353813 - RNA, 15 nt, Neisseria meningitidis Z2491
cagaaaccuaaaauc

SEQ ID NO: 3353814 - RNA, 17 nt, Neisseria meningitidis Z2491
cagaaaccuaaaauccc

SEQ ID NO: 3353815 - RNA, 16 nt, Neisseria meningitidis Z2491
cagaaaccuaaaauuc

SEQ ID NO: 3353816 - RNA, 15 nt, Neisseria meningitidis Z2491
cagaaagcaaaaccg

SEQ ID NO: 3353817 - RNA, 16 nt, Neisseria meningitidis Z2491
cagaaagccaaaaaca

SEQ ID NO: 3353818 - RNA, 16 nt, Neisseria meningitidis Z2491
cagaaaugacugaaau

SEQ ID NO: 3353819 - RNA, 21 nt, Neisseria meningitidis Z2491
cagaaauuuauaaacaaaaaa

SEQ ID NO: 3353820 - RNA, 22 nt, Neisseria meningitidis Z2491
cagaaauuuauaaacaaaaaac

SEQ ID NO: 3353821 - RNA, 20 nt, Neisseria meningitidis Z2491
cagaacccggcuuaccgccu

SEQ ID NO: 3353822 - RNA, 22 nt, Neisseria meningitidis Z2491
cagaacggcggguucggcaaug

SEQ ID NO: 3353823 - RNA, 16 nt, Neisseria meningitidis Z2491
cagaacguaaaaucug

SEQ ID NO: 3353824 - RNA, 17 nt, Neisseria meningitidis Z2491
cagaaucuguugcggcc

SEQ ID NO: 3353825 - RNA, 24 nt, Neisseria meningitidis Z2491
cagaauuuauuugaacaacaaacu

SEQ ID NO: 3353826 - RNA, 22 nt, Neisseria meningitidis Z2491
cagacaguacaaauaguacaga

SEQ ID NO: 3353827 - RNA, 16 nt, Neisseria meningitidis Z2491
cagacauuaaaaaaua

SEQ ID NO: 3353828 - RNA, 19 nt, Neisseria meningitidis Z2491
cagacauugcuaaaacaac

SEQ ID NO: 3353829 - RNA, 22 nt, Neisseria meningitidis Z2491
cagacauugcuaaaacaacugc

SEQ ID NO: 3353830 - RNA, 12 nt, Neisseria meningitidis Z2491
cagaccgaugcc

SEQ ID NO: 3353831 - RNA, 21 nt, Neisseria meningitidis Z2491
cagaccuucggguaacggcaa

SEQ ID NO: 3353832 - RNA, 16 nt, Neisseria meningitidis Z2491
cagacgaacaccagcc

SEQ ID NO: 3353833 - RNA, 15 nt, Neisseria meningitidis Z2491
cagacggcacuuuca

SEQ ID NO: 3353834 - RNA, 15 nt, Neisseria meningitidis Z2491
cagacggcauauuuu

SEQ ID NO: 3353835 - RNA, 16 nt, Neisseria meningitidis Z2491
cagacggcauuguuuc

SEQ ID NO: 3353836 - RNA, 14 nt, Neisseria meningitidis Z2491
cagacggcauuucc

SEQ ID NO: 3353837 - RNA, 18 nt, Neisseria meningitidis Z2491
cagacggcauuugaccca

SEQ ID NO: 3353838 - RNA, 23 nt, Neisseria meningitidis Z2491
cagacggcauuugacccauuacu

SEQ ID NO: 3353839 - RNA, 19 nt, Neisseria meningitidis Z2491
cagacggcauuuguccauu

SEQ ID NO: 3353840 - RNA, 16 nt, Neisseria meningitidis Z2491
cagacggcauuuuccu

SEQ ID NO: 3353841 - RNA, 17 nt, Neisseria meningitidis Z2491
cagacggcauuuuccuu

SEQ ID NO: 3353842 - RNA, 15 nt, Neisseria meningitidis Z2491
cagacggcauuuugc

SEQ ID NO: 3353843 - RNA, 20 nt, Neisseria meningitidis Z2491
cagacggcauuuuguugccg

SEQ ID NO: 3353844 - RNA, 16 nt, Neisseria meningitidis Z2491
cagacggcauuuuugc

SEQ ID NO: 3353845 - RNA, 20 nt, Neisseria meningitidis Z2491
cagacggcauuuuugugugg

SEQ ID NO: 3353846 - RNA, 18 nt, Neisseria meningitidis Z2491
cagacggcauuuuuuaca

SEQ ID NO: 3353847 - RNA, 18 nt, Neisseria meningitidis Z2491
cagacggcauuuuuucac

SEQ ID NO: 3353848 - RNA, 14 nt, Neisseria meningitidis Z2491
cagacuauuuuugc

SEQ ID NO: 3353849 - RNA, 18 nt, Neisseria meningitidis Z2491
cagagugcguacccaaaa

SEQ ID NO: 3353850 - RNA, 23 nt, Neisseria meningitidis Z2491
cagauaaauacccauaccgaccg

SEQ ID NO: 3353851 - RNA, 21 nt, Neisseria meningitidis Z2491
cagauaacggucgaaacuuuc

SEQ ID NO: 3353852 - RNA, 19 nt, Neisseria meningitidis Z2491
cagauagcgcggacggcgg

SEQ ID NO: 3353853 - RNA, 13 nt, Neisseria meningitidis Z2491
cagauagcugaac

SEQ ID NO: 3353854 - RNA, 20 nt, Neisseria meningitidis Z2491
cagauaguacggaaccgauu

SEQ ID NO: 3353855 - RNA, 22 nt, Neisseria meningitidis Z2491
cagauagucgccgagcagauug

SEQ ID NO: 3353856 - RNA, 15 nt, Neisseria meningitidis Z2491
cagaucggcaaaccc

SEQ ID NO: 3353857 - RNA, 18 nt, Neisseria meningitidis Z2491
cagauuacuaaaacacag

SEQ ID NO: 3353858 - RNA, 15 nt, Neisseria meningitidis Z2491
cagauugauaaaagc

SEQ ID NO: 3353859 - RNA, 18 nt, Neisseria meningitidis Z2491
cagauuuuacguucugga

SEQ ID NO: 3353860 - RNA, 14 nt, Neisseria meningitidis Z2491
cagcaacauuuccu

SEQ ID NO: 3353861 - RNA, 10 nt, Neisseria meningitidis Z2491
cagcaaccug

SEQ ID NO: 3353862 - RNA, 18 nt, Neisseria meningitidis Z2491
cagcaaccugaaauucgu

SEQ ID NO: 3353863 - RNA, 15 nt, Neisseria meningitidis Z2491
cagcaacgacagcag

SEQ ID NO: 3353864 - RNA, 15 nt, Neisseria meningitidis Z2491
cagcaauaaaauaaa

SEQ ID NO: 3353865 - RNA, 19 nt, Neisseria meningitidis Z2491
cagcaauaaaauaaagucc

SEQ ID NO: 3353866 - RNA, 15 nt, Neisseria meningitidis Z2491
cagcaauacgcaaaa

SEQ ID NO: 3353867 - RNA, 19 nt, Neisseria meningitidis Z2491
cagcaauccauucccucuc

SEQ ID NO: 3353868 - RNA, 22 nt, Neisseria meningitidis Z2491
cagcaauccauucccucucccg

SEQ ID NO: 3353869 - RNA, 13 nt, Neisseria meningitidis Z2491
cagcaaugcgucu

SEQ ID NO: 3353870 - RNA, 11 nt, Neisseria meningitidis Z2491
cagcacaaaca

SEQ ID NO: 3353871 - RNA, 19 nt, Neisseria meningitidis Z2491
cagcacaaaugccaaaggc

SEQ ID NO: 3353872 - RNA, 22 nt, Neisseria meningitidis Z2491
caggguucggacggcauuaaaa

SEQ ID NO: 3353873 - RNA, 17 nt, Neisseria meningitidis Z2491
cagguaaaaaauagaaa

SEQ ID NO: 3353874 - RNA, 20 nt, Neisseria meningitidis Z2491
cagguaaaaaauagaaauac

SEQ ID NO: 3353875 - RNA, 14 nt, Neisseria meningitidis Z2491
caggucgacggcaa

SEQ ID NO: 3353876 - RNA, 15 nt, Neisseria meningitidis Z2491
caggucgugcgccgu

SEQ ID NO: 3353877 - RNA, 19 nt, Neisseria meningitidis Z2491
caggugcugggugguggca

SEQ ID NO: 3353878 - RNA, 19 nt, Neisseria meningitidis Z2491
cagguuaucacuuggaaua

SEQ ID NO: 3353879 - RNA, 23 nt, Neisseria meningitidis Z2491
cagguucguuuaguuucggucau

SEQ ID NO: 3353880 - RNA, 14 nt, Neisseria meningitidis Z2491
cagguuguuggaaa

SEQ ID NO: 3353881 - RNA, 15 nt, Neisseria meningitidis Z2491
cagguuguuggaaaa

SEQ ID NO: 3353882 - RNA, 16 nt, Neisseria meningitidis Z2491
cagguuuugguacacg

SEQ ID NO: 3353883 - RNA, 22 nt, Neisseria meningitidis Z2491
caguaaaauuuauuauguauau

SEQ ID NO: 3353884 - RNA, 14 nt, Neisseria meningitidis Z2491
caguaacgccacca

SEQ ID NO: 3353885 - RNA, 14 nt, Neisseria meningitidis Z2491
caguaaugccgccg

SEQ ID NO: 3353886 - RNA, 14 nt, Neisseria meningitidis Z2491
caguacaaauagca

SEQ ID NO: 3353887 - RNA, 22 nt, Neisseria meningitidis Z2491
caguacgcgcugugcaaagaaa

SEQ ID NO: 3353888 - RNA, 17 nt, Neisseria meningitidis Z2491
caguacggcguugccuc

SEQ ID NO: 3353889 - RNA, 15 nt, Neisseria meningitidis Z2491
caguaucaaucuggu

SEQ ID NO: 3353890 - RNA, 16 nt, Neisseria meningitidis Z2491
caguaugauucgcuuu

SEQ ID NO: 3353891 - RNA, 22 nt, Neisseria meningitidis Z2491
caguauuagaaccgaacacaga

SEQ ID NO: 3353892 - RNA, 12 nt, Neisseria meningitidis Z2491
cagucauucccg

SEQ ID NO: 3353893 - RNA, 13 nt, Neisseria meningitidis Z2491
cagucauuuuuga

SEQ ID NO: 3353894 - RNA, 14 nt, Neisseria meningitidis Z2491
cagucccaucccgc

SEQ ID NO: 3353895 - RNA, 14 nt, Neisseria meningitidis Z2491
caguccuacccaaa

SEQ ID NO: 3353896 - RNA, 16 nt, Neisseria meningitidis Z2491
caguccuacccaaaag

SEQ ID NO: 3353897 - RNA, 17 nt, Neisseria meningitidis Z2491
cagucugucgccgucgg

SEQ ID NO: 3353898 - RNA, 22 nt, Neisseria meningitidis Z2491
cagucuuccaacccuccgccgc

SEQ ID NO: 3353899 - RNA, 19 nt, Neisseria meningitidis Z2491
cagucuuuaaauucaacuu

SEQ ID NO: 3353900 - RNA, 17 nt, Neisseria meningitidis Z2491
cagugauggcuucuaaa

SEQ ID NO: 3353901 - RNA, 22 nt, Neisseria meningitidis Z2491
cagugauuucccgucccagcca

SEQ ID NO: 3353902 - RNA, 18 nt, Neisseria meningitidis Z2491
cagugccagcgucaacac

SEQ ID NO: 3353903 - RNA, 19 nt, Neisseria meningitidis Z2491
cagugccgccaaagugcca

SEQ ID NO: 3353904 - RNA, 22 nt, Neisseria meningitidis Z2491
cagugccguuuugucugccgcc

SEQ ID NO: 3353905 - RNA, 15 nt, Neisseria meningitidis Z2491
cagugcggacaccgc

SEQ ID NO: 3353906 - RNA, 19 nt, Neisseria meningitidis Z2491
caguggcaauuuuuuaaau

SEQ ID NO: 3353907 - RNA, 11 nt, Neisseria meningitidis Z2491
caguucagacg

SEQ ID NO: 3353908 - RNA, 16 nt, Neisseria meningitidis Z2491
caguuccaaagccuuc

SEQ ID NO: 3353909 - RNA, 16 nt, Neisseria meningitidis Z2491
caguuccaucgcgucu

SEQ ID NO: 3353910 - RNA, 22 nt, Neisseria meningitidis Z2491
caguuccaucgcgucuucaaaa

SEQ ID NO: 3353911 - RNA, 23 nt, Neisseria meningitidis Z2491
caguucggacaaaccguccaaua

SEQ ID NO: 3353912 - RNA, 14 nt, Neisseria meningitidis Z2491
caguucguucugca

SEQ ID NO: 3353913 - RNA, 21 nt, Neisseria meningitidis Z2491
caguucuacacccaaauccgc

SEQ ID NO: 3353914 - RNA, 22 nt, Neisseria meningitidis Z2491
caguucuacacccaaauccgcc

SEQ ID NO: 3353915 - RNA, 20 nt, Neisseria meningitidis Z2491
caguucuuugauguugugua

SEQ ID NO: 3353916 - RNA, 22 nt, Neisseria meningitidis Z2491
caguugguuugaaccagggauu

SEQ ID NO: 3353917 - RNA, 13 nt, Neisseria meningitidis Z2491
caguuuaaucccu

SEQ ID NO: 3353918 - RNA, 20 nt, Neisseria meningitidis Z2491
caguuucagagccucuucgc

SEQ ID NO: 3353919 - RNA, 18 nt, Neisseria meningitidis Z2491
caguuuccacuaaaugcu

SEQ ID NO: 3353920 - RNA, 19 nt, Neisseria meningitidis Z2491
caguuucggucauuuccga

SEQ ID NO: 3353921 - RNA, 16 nt, Neisseria meningitidis Z2491
caguuuguucaggaag

SEQ ID NO: 3353922 - RNA, 12 nt, Neisseria meningitidis Z2491
caguuuucaacc

SEQ ID NO: 3353923 - RNA, 13 nt, Neisseria meningitidis Z2491
caguuuugcagau

SEQ ID NO: 3353924 - RNA, 22 nt, Neisseria meningitidis Z2491
caguuuuugucuuggucaacca

SEQ ID NO: 3353925 - RNA, 16 nt, Neisseria meningitidis Z2491
caguuuuuucagcggc

SEQ ID NO: 3353926 - RNA, 21 nt, Neisseria meningitidis Z2491
cauaaaaaugcgccaaaaaau

SEQ ID NO: 3353927 - RNA, 19 nt, Neisseria meningitidis Z2491
cauaaaauaugccgucuga

SEQ ID NO: 3353928 - RNA, 19 nt, Neisseria meningitidis Z2491
cauaaaucaacagcagaau

SEQ ID NO: 3353929 - RNA, 14 nt, Neisseria meningitidis Z2491
cauaaauccuucac

SEQ ID NO: 3353930 - RNA, 17 nt, Neisseria meningitidis Z2491
cauaaaugccgucugaa

SEQ ID NO: 3353931 - RNA, 21 nt, Neisseria meningitidis Z2491
cauaaaugcguuuugacaaaa

SEQ ID NO: 3353932 - RNA, 17 nt, Neisseria meningitidis Z2491
cauaaauuuuaaauaaa

SEQ ID NO: 3353933 - RNA, 16 nt, Neisseria meningitidis Z2491
cauaacacacccaugc

SEQ ID NO: 3353934 - RNA, 22 nt, Neisseria meningitidis Z2491
cauaaguuucccgaaauuccaa

SEQ ID NO: 3353935 - RNA, 16 nt, Neisseria meningitidis Z2491
cauaauaaaaauaacg

SEQ ID NO: 3353936 - RNA, 20 nt, Neisseria meningitidis Z2491
cauaaucaauuaaaaacaaa

SEQ ID NO: 3353937 - RNA, 22 nt, Neisseria meningitidis Z2491
cauaaucaauuaaaaacaaaau

SEQ ID NO: 3353938 - RNA, 21 nt, Neisseria meningitidis Z2491
cauaaucacaccgaucaggcu

SEQ ID NO: 3353939 - RNA, 20 nt, Neisseria meningitidis Z2491
cauaaucagcccgaaauaac

SEQ ID NO: 3353940 - RNA, 24 nt, Neisseria meningitidis Z2491
cauaaucagcccgaaauaacucau

SEQ ID NO: 3353941 - RNA, 21 nt, Neisseria meningitidis Z2491
cauacaaacaggcuucagacg

SEQ ID NO: 3353942 - RNA, 16 nt, Neisseria meningitidis Z2491
cauacacagccaaaaa

SEQ ID NO: 3353943 - RNA, 17 nt, Neisseria meningitidis Z2491
cauacacagccaaaaaa

SEQ ID NO: 3353944 - RNA, 15 nt, Neisseria meningitidis Z2491
cauacauagcaggca

SEQ ID NO: 3353945 - RNA, 13 nt, Neisseria meningitidis Z2491
cauaccaugcgaa

SEQ ID NO: 3353946 - RNA, 15 nt, Neisseria meningitidis Z2491
cauaccgaccgcaag

SEQ ID NO: 3353947 - RNA, 23 nt, Neisseria meningitidis Z2491
cauacggaugucgaguucuuuua

SEQ ID NO: 3353948 - RNA, 20 nt, Neisseria meningitidis Z2491
cauacguuuugguugcgccg

SEQ ID NO: 3353949 - RNA, 22 nt, Neisseria meningitidis Z2491
cauacuacgcggcugaaaaaau

SEQ ID NO: 3353950 - RNA, 14 nt, Neisseria meningitidis Z2491
cauacuacugcugu

SEQ ID NO: 3353951 - RNA, 22 nt, Neisseria meningitidis Z2491
cauacuuuguuucaaaauguuc

SEQ ID NO: 3353952 - RNA, 12 nt, Neisseria meningitidis Z2491
cauagaaaggga

SEQ ID NO: 3353953 - RNA, 21 nt, Neisseria meningitidis Z2491
cauagacuguaccaaauuauu

SEQ ID NO: 3353954 - RNA, 15 nt, Neisseria meningitidis Z2491
cauagauaaauuuca

SEQ ID NO: 3353955 - RNA, 16 nt, Neisseria meningitidis Z2491
cauagauaaauuucag

SEQ ID NO: 3353956 - RNA, 20 nt, Neisseria meningitidis Z2491
cauagccuucacgcacagcg

SEQ ID NO: 3353957 - RNA, 19 nt, Neisseria meningitidis Z2491
cauagcguguauuuuggua

SEQ ID NO: 3353958 - RNA, 13 nt, Neisseria meningitidis Z2491
cauagguuacuaa

SEQ ID NO: 3353959 - RNA, 21 nt, Neisseria meningitidis Z2491
cauaguuuccggcaagcaggg

SEQ ID NO: 3353960 - RNA, 14 nt, Neisseria meningitidis Z2491
cauauaacaccuuu

SEQ ID NO: 3353961 - RNA, 16 nt, Neisseria meningitidis Z2491
cauauagacauuuuuu

SEQ ID NO: 3353962 - RNA, 11 nt, Neisseria meningitidis Z2491
cauaucauuua

SEQ ID NO: 3353963 - RNA, 18 nt, Neisseria meningitidis Z2491
cauaucgucgggcugcca

SEQ ID NO: 3353964 - RNA, 12 nt, Neisseria meningitidis Z2491
cauaugccgucu

SEQ ID NO: 3353965 - RNA, 14 nt, Neisseria meningitidis Z2491
cauaugccgucuga

SEQ ID NO: 3353966 - RNA, 15 nt, Neisseria meningitidis Z2491
cauaugccgucugaa

SEQ ID NO: 3353967 - RNA, 16 nt, Neisseria meningitidis Z2491
cauaugccgucugaag

SEQ ID NO: 3353968 - RNA, 17 nt, Neisseria meningitidis Z2491
cauaugccgucugaaga

SEQ ID NO: 3353969 - RNA, 18 nt, Neisseria meningitidis Z2491
cauauggaaaaaucugug

SEQ ID NO: 3353970 - RNA, 21 nt, Neisseria meningitidis Z2491
cauaugguguugaugccgucc

SEQ ID NO: 3353971 - RNA, 14 nt, Neisseria meningitidis Z2491
cauauuuucaguuu

SEQ ID NO: 3353972 - RNA, 12 nt, Neisseria meningitidis Z2491
caucaaaaugac

SEQ ID NO: 3353973 - RNA, 16 nt, Neisseria meningitidis Z2491
cauuguuaaguauuuc

SEQ ID NO: 3353974 - RNA, 23 nt, Neisseria meningitidis Z2491
cauuguuaaguauuucuauuuuu

SEQ ID NO: 3353975 - RNA, 18 nt, Neisseria meningitidis Z2491
cauuguuggaaauggagu

SEQ ID NO: 3353976 - RNA, 15 nt, Neisseria meningitidis Z2491
cauuguuuccgcuuc

SEQ ID NO: 3353977 - RNA, 22 nt, Neisseria meningitidis Z2491
cauuuauaguggauuaacaaaa

SEQ ID NO: 3353978 - RNA, 11 nt, Neisseria meningitidis Z2491
cauuucagacg

SEQ ID NO: 3353979 - RNA, 23 nt, Neisseria meningitidis Z2491
cauuuccaaacccaaugcuucaa

SEQ ID NO: 3353980 - RNA, 18 nt, Neisseria meningitidis Z2491
cauuuccacaucguucaa

SEQ ID NO: 3353981 - RNA, 18 nt, Neisseria meningitidis Z2491
cauuuccgauaaauuccu

SEQ ID NO: 3353982 - RNA, 17 nt, Neisseria meningitidis Z2491
cauuucuagauucccac

SEQ ID NO: 3353983 - RNA, 13 nt, Neisseria meningitidis Z2491
cauuucugauaaa

SEQ ID NO: 3353984 - RNA, 14 nt, Neisseria meningitidis Z2491
cauuucugauaaau

SEQ ID NO: 3353985 - RNA, 18 nt, Neisseria meningitidis Z2491
cauuucuggauucccacu

SEQ ID NO: 3353986 - RNA, 19 nt, Neisseria meningitidis Z2491
cauuugacccauuacugcu

SEQ ID NO: 3353987 - RNA, 14 nt, Neisseria meningitidis Z2491
cauuugagccgcac

SEQ ID NO: 3353988 - RNA, 15 nt, Neisseria meningitidis Z2491
cauuuguuccaauuc

SEQ ID NO: 3353989 - RNA, 18 nt, Neisseria meningitidis Z2491
cauuuucaaaaugcaaaa

SEQ ID NO: 3353990 - RNA, 23 nt, Neisseria meningitidis Z2491
cauuuucaaaaugcaaaacuuuu

SEQ ID NO: 3353991 - RNA, 21 nt, Neisseria meningitidis Z2491
cauuuucaacagcaggaacga

SEQ ID NO: 3353992 - RNA, 17 nt, Neisseria meningitidis Z2491
cauuuuccguugccugc

SEQ ID NO: 3353993 - RNA, 20 nt, Neisseria meningitidis Z2491
cauuuugucgaacgccgcuu

SEQ ID NO: 3353994 - RNA, 21 nt, Neisseria meningitidis Z2491
cauuuugucgaacgccgcuuc

SEQ ID NO: 3353995 - RNA, 19 nt, Neisseria meningitidis Z2491
cauuuuuaauuucuucuau

SEQ ID NO: 3353996 - RNA, 12 nt, Neisseria meningitidis Z2491
cauuuuuuucau

SEQ ID NO: 3353997 - RNA, 15 nt, Neisseria meningitidis Z2491
cauuuuuuucauacc

SEQ ID NO: 3353998 - RNA, 21 nt, Neisseria meningitidis Z2491
ccaaaaaaaccgaaaccgaac

SEQ ID NO: 3353999 - RNA, 19 nt, Neisseria meningitidis Z2491
ccaaaaaacaacaggaauu

SEQ ID NO: 3354000 - RNA, 23 nt, Neisseria meningitidis Z2491
ccaaaaacagaaaccuaaaaucu

SEQ ID NO: 3354001 - RNA, 22 nt, Neisseria meningitidis Z2491
ccaaaaacagaaaccuaaaauu

SEQ ID NO: 3354002 - RNA, 23 nt, Neisseria meningitidis Z2491
ccaaaaacagaaaccugaaaaca

SEQ ID NO: 3354003 - RNA, 20 nt, Neisseria meningitidis Z2491
ccaaaaacggcacggcgcag

SEQ ID NO: 3354004 - RNA, 13 nt, Neisseria meningitidis Z2491
ccaaaacaaauac

SEQ ID NO: 3354005 - RNA, 21 nt, Neisseria meningitidis Z2491
ccaaaacagaaaccuaaaauu

SEQ ID NO: 3354006 - RNA, 17 nt, Neisseria meningitidis Z2491
ccaaaaccgugccgaca

SEQ ID NO: 3354007 - RNA, 19 nt, Neisseria meningitidis Z2491
ccaaaaucgaagaaagcau

SEQ ID NO: 3354008 - RNA, 20 nt, Neisseria meningitidis Z2491
ccaaaaucggccauucccuc

SEQ ID NO: 3354009 - RNA, 15 nt, Neisseria meningitidis Z2491
ccaaaaugcccgcca

SEQ ID NO: 3354010 - RNA, 20 nt, Neisseria meningitidis Z2491
ccaaacccucggcauucccg

SEQ ID NO: 3354011 - RNA, 20 nt, Neisseria meningitidis Z2491
ccaaacccucgucauucucg

SEQ ID NO: 3354012 - RNA, 21 nt, Neisseria meningitidis Z2491
ccaaaccgaugggcuucauca

SEQ ID NO: 3354013 - RNA, 18 nt, Neisseria meningitidis Z2491
ccaaacgagcaauauugg

SEQ ID NO: 3354014 - RNA, 11 nt, Neisseria meningitidis Z2491
ccaaacggcuc

SEQ ID NO: 3354015 - RNA, 13 nt, Neisseria meningitidis Z2491
ccaaacguuuuuc

SEQ ID NO: 3354016 - RNA, 14 nt, Neisseria meningitidis Z2491
ccaaagcauuuuuc

SEQ ID NO: 3354017 - RNA, 18 nt, Neisseria meningitidis Z2491
ccaaaggcagugccgcca

SEQ ID NO: 3354018 - RNA, 19 nt, Neisseria meningitidis Z2491
ccaaaggccuggauucccg

SEQ ID NO: 3354019 - RNA, 13 nt, Neisseria meningitidis Z2491
ccaaagugccaaa

SEQ ID NO: 3354020 - RNA, 14 nt, Neisseria meningitidis Z2491
ccaaauagaaaaua

SEQ ID NO: 3354021 - RNA, 22 nt, Neisseria meningitidis Z2491
ccaaaucaggguaaacagggcu

SEQ ID NO: 3354022 - RNA, 20 nt, Neisseria meningitidis Z2491
ccaaaucgcccguuaccagc

SEQ ID NO: 3354023 - RNA, 17 nt, Neisseria meningitidis Z2491
ccaaaucgucauucccg

SEQ ID NO: 3354024 - RNA, 18 nt, Neisseria meningitidis Z2491
ccaaaucuugcaaacccc

SEQ ID NO: 3354025 - RNA, 18 nt, Neisseria meningitidis Z2491
ccaaaugcagaauaaggc

SEQ ID NO: 3354026 - RNA, 19 nt, Neisseria meningitidis Z2491
ccaaaugcagaauaaggca

SEQ ID NO: 3354027 - RNA, 21 nt, Neisseria meningitidis Z2491
ccaaauuauugccagcauuaa

SEQ ID NO: 3354028 - RNA, 20 nt, Neisseria meningitidis Z2491
ccaacaauauaucgaacagc

SEQ ID NO: 3354029 - RNA, 15 nt, Neisseria meningitidis Z2491
ccaacaggcgggcgu

SEQ ID NO: 3354030 - RNA, 17 nt, Neisseria meningitidis Z2491
ccaacaggguuccgaaa

SEQ ID NO: 3354031 - RNA, 16 nt, Neisseria meningitidis Z2491
ccaacucgacauuuuc

SEQ ID NO: 3354032 - RNA, 15 nt, Neisseria meningitidis Z2491
ccaacucggcaaacg

SEQ ID NO: 3354033 - RNA, 15 nt, Neisseria meningitidis Z2491
ccaagauuucaucau

SEQ ID NO: 3354034 - RNA, 16 nt, Neisseria meningitidis Z2491
ccaagccgacuuuuuc

SEQ ID NO: 3354035 - RNA, 14 nt, Neisseria meningitidis Z2491
ccaagguugucuga

SEQ ID NO: 3354036 - RNA, 15 nt, Neisseria meningitidis Z2491
ccaauacaacaaaau

SEQ ID NO: 3354037 - RNA, 15 nt, Neisseria meningitidis Z2491
ccaauaccaacaccu

SEQ ID NO: 3354038 - RNA, 22 nt, Neisseria meningitidis Z2491
ccaauaccguccccgaaaccga

SEQ ID NO: 3354039 - RNA, 13 nt, Neisseria meningitidis Z2491
ccaauauucauac

SEQ ID NO: 3354040 - RNA, 15 nt, Neisseria meningitidis Z2491
ccaaucucuuaacca

SEQ ID NO: 3354041 - RNA, 16 nt, Neisseria meningitidis Z2491
ccaaugccgucugaaa

SEQ ID NO: 3354042 - RNA, 20 nt, Neisseria meningitidis Z2491
ccaaugccgucugaaaaccu

SEQ ID NO: 3354043 - RNA, 20 nt, Neisseria meningitidis Z2491
ccaaugccgucugaaacccg

SEQ ID NO: 3354044 - RNA, 13 nt, Neisseria meningitidis Z2491
ccaaugcuucaac

SEQ ID NO: 3354045 - RNA, 21 nt, Neisseria meningitidis Z2491
ccaauuaaaccccguucccug

SEQ ID NO: 3354046 - RNA, 20 nt, Neisseria meningitidis Z2491
ccaauuccugcgccaaugcu

SEQ ID NO: 3354047 - RNA, 13 nt, Neisseria meningitidis Z2491
ccacaaaaaacag

SEQ ID NO: 3354048 - RNA, 15 nt, Neisseria meningitidis Z2491
ccacaauauaaucaa

SEQ ID NO: 3354049 - RNA, 22 nt, Neisseria meningitidis Z2491
ccacacacaagccguacauaag

SEQ ID NO: 3354050 - RNA, 14 nt, Neisseria meningitidis Z2491
ccacacgcaggcga

SEQ ID NO: 3354051 - RNA, 23 nt, Neisseria meningitidis Z2491
ccacaguuuuuccaguuugaaau

SEQ ID NO: 3354052 - RNA, 14 nt, Neisseria meningitidis Z2491
ccaccagcccgccg

SEQ ID NO: 3354053 - RNA, 22 nt, Neisseria meningitidis Z2491
ccaccagcccgccgcgcccgca

SEQ ID NO: 3354054 - RNA, 14 nt, Neisseria meningitidis Z2491
ccaccauuguuucc

SEQ ID NO: 3354055 - RNA, 22 nt, Neisseria meningitidis Z2491
ccaccauuguuuccgcuuccau

SEQ ID NO: 3354056 - RNA, 21 nt, Neisseria meningitidis Z2491
ccaccgacauuucauugccgc

SEQ ID NO: 3354057 - RNA, 22 nt, Neisseria meningitidis Z2491
ccaccugaacggcacaaacgcc

SEQ ID NO: 3354058 - RNA, 12 nt, Neisseria meningitidis Z2491
ccacgccaaaaa

SEQ ID NO: 3354059 - RNA, 17 nt, Neisseria meningitidis Z2491
ccacgcccgcaucuuuu

SEQ ID NO: 3354060 - RNA, 19 nt, Neisseria meningitidis Z2491
ccacgcccucggcggcggc

SEQ ID NO: 3354061 - RNA, 17 nt, Neisseria meningitidis Z2491
ccacgccgacugccgcc

SEQ ID NO: 3354062 - RNA, 13 nt, Neisseria meningitidis Z2491
ccacgcucaaaca

SEQ ID NO: 3354063 - RNA, 15 nt, Neisseria meningitidis Z2491
ccacgcucaaacacc

SEQ ID NO: 3354064 - RNA, 23 nt, Neisseria meningitidis Z2491
ccacggggugcggguggcgaagc

SEQ ID NO: 3354065 - RNA, 15 nt, Neisseria meningitidis Z2491
ccacgucauucccac

SEQ ID NO: 3354066 - RNA, 13 nt, Neisseria meningitidis Z2491
ccacuauaacagc

SEQ ID NO: 3354067 - RNA, 22 nt, Neisseria meningitidis Z2491
ccacuauacaucccgucauucc

SEQ ID NO: 3354068 - RNA, 15 nt, Neisseria meningitidis Z2491
ccacuauacuguaau

SEQ ID NO: 3354069 - RNA, 14 nt, Neisseria meningitidis Z2491
ccacuauauuuucg

SEQ ID NO: 3354070 - RNA, 17 nt, Neisseria meningitidis Z2491
ccacugccagccgccga

SEQ ID NO: 3354071 - RNA, 14 nt, Neisseria meningitidis Z2491
ccacuucaaccgcg

SEQ ID NO: 3354072 - RNA, 21 nt, Neisseria meningitidis Z2491
ccacuucaaccgcgauguguc

SEQ ID NO: 3354073 - RNA, 20 nt, Neisseria meningitidis Z2491
ccacuuucgccauaaucugc

SEQ ID NO: 3354074 - RNA, 19 nt, Neisseria meningitidis Z2491
cccgaaaccgaaugccaca

SEQ ID NO: 3354075 - RNA, 22 nt, Neisseria meningitidis Z2491
cccgaauugcgccgacagcagc

SEQ ID NO: 3354076 - RNA, 16 nt, Neisseria meningitidis Z2491
cccgacaauaccguaa

SEQ ID NO: 3354077 - RNA, 14 nt, Neisseria meningitidis Z2491
cccgacugugccca

SEQ ID NO: 3354078 - RNA, 15 nt, Neisseria meningitidis Z2491
cccgauuuguccgac

SEQ ID NO: 3354079 - RNA, 14 nt, Neisseria meningitidis Z2491
cccgccaaacccuc

SEQ ID NO: 3354080 - RNA, 18 nt, Neisseria meningitidis Z2491
cccgccacacccccguca

SEQ ID NO: 3354081 - RNA, 13 nt, Neisseria meningitidis Z2491
cccgcccgcccuu

SEQ ID NO: 3354082 - RNA, 13 nt, Neisseria meningitidis Z2491
cccgccugcgcgg

SEQ ID NO: 3354083 - RNA, 16 nt, Neisseria meningitidis Z2491
cccgccugcgcgggaa

SEQ ID NO: 3354084 - RNA, 16 nt, Neisseria meningitidis Z2491
cccgcgaaagcgggaa

SEQ ID NO: 3354085 - RNA, 18 nt, Neisseria meningitidis Z2491
cccgcgcaggcgggaauc

SEQ ID NO: 3354086 - RNA, 21 nt, Neisseria meningitidis Z2491
cccgcgcaggcgggaauccag

SEQ ID NO: 3354087 - RNA, 23 nt, Neisseria meningitidis Z2491
cccgcgcaggcgguggcgagcca

SEQ ID NO: 3354088 - RNA, 20 nt, Neisseria meningitidis Z2491
cccgcguucgcgggaaugac

SEQ ID NO: 3354089 - RNA, 16 nt, Neisseria meningitidis Z2491
cccgcucaggcgggaa

SEQ ID NO: 3354090 - RNA, 16 nt, Neisseria meningitidis Z2491
cccgcuuucgcgggaa

SEQ ID NO: 3354091 - RNA, 16 nt, Neisseria meningitidis Z2491
cccgcuuuugcgggaa

SEQ ID NO: 3354092 - RNA, 20 nt, Neisseria meningitidis Z2491
cccgcuuuugcgggaaugac

SEQ ID NO: 3354093 - RNA, 22 nt, Neisseria meningitidis Z2491
cccggcgcgaacggagccagcc

SEQ ID NO: 3354094 - RNA, 21 nt, Neisseria meningitidis Z2491
cccgguaacgaagaacgccaa

SEQ ID NO: 3354095 - RNA, 17 nt, Neisseria meningitidis Z2491
cccgguuggaaggcggc

SEQ ID NO: 3354096 - RNA, 15 nt, Neisseria meningitidis Z2491
cccguaugccgccug

SEQ ID NO: 3354097 - RNA, 18 nt, Neisseria meningitidis Z2491
cccguaugccgccugccu

SEQ ID NO: 3354098 - RNA, 18 nt, Neisseria meningitidis Z2491
cccgucauucccgcaaaa

SEQ ID NO: 3354099 - RNA, 17 nt, Neisseria meningitidis Z2491
cccgucauuccucaaaa

SEQ ID NO: 3354100 - RNA, 15 nt, Neisseria meningitidis Z2491
cccgucccgaugccg

SEQ ID NO: 3354101 - RNA, 19 nt, Neisseria meningitidis Z2491
cccgugaaaaaaugccguc

SEQ ID NO: 3354102 - RNA, 15 nt, Neisseria meningitidis Z2491
cccguuuuacccucu

SEQ ID NO: 3354103 - RNA, 18 nt, Neisseria meningitidis Z2491
cccguuuucacgggaaug

SEQ ID NO: 3354104 - RNA, 18 nt, Neisseria meningitidis Z2491
cccguuuuuacgggaaug

SEQ ID NO: 3354105 - RNA, 14 nt, Neisseria meningitidis Z2491
cccuaaaggcuuca

SEQ ID NO: 3354106 - RNA, 22 nt, Neisseria meningitidis Z2491
cccuauguguugcccugauucg

SEQ ID NO: 3354107 - RNA, 16 nt, Neisseria meningitidis Z2491
cccuccgccucugcca

SEQ ID NO: 3354108 - RNA, 18 nt, Neisseria meningitidis Z2491
cccuccugcgcgggaaug

SEQ ID NO: 3354109 - RNA, 20 nt, Neisseria meningitidis Z2491
cccuccugcgcgggaaugau

SEQ ID NO: 3354110 - RNA, 16 nt, Neisseria meningitidis Z2491
cccucgaaagcgggaa

SEQ ID NO: 3354111 - RNA, 17 nt, Neisseria meningitidis Z2491
cccucggcauucccgcc

SEQ ID NO: 3354112 - RNA, 18 nt, Neisseria meningitidis Z2491
cccucggcauucccgcca

SEQ ID NO: 3354113 - RNA, 12 nt, Neisseria meningitidis Z2491
cccucuugccuu

SEQ ID NO: 3354114 - RNA, 13 nt, Neisseria meningitidis Z2491
cccucuuggauaa

SEQ ID NO: 3354115 - RNA, 14 nt, Neisseria meningitidis Z2491
cccugauaaaaaau

SEQ ID NO: 3354116 - RNA, 12 nt, Neisseria meningitidis Z2491
cccugccgcuuc

SEQ ID NO: 3354117 - RNA, 14 nt, Neisseria meningitidis Z2491
cccuguaaacagau

SEQ ID NO: 3354118 - RNA, 16 nt, Neisseria meningitidis Z2491
cccuugcaaauaauug

SEQ ID NO: 3354119 - RNA, 23 nt, Neisseria meningitidis Z2491
ccgaaaacaaaggguuugccgcg

SEQ ID NO: 3354120 - RNA, 22 nt, Neisseria meningitidis Z2491
ccgaaaauacugaggaaaccau

SEQ ID NO: 3354121 - RNA, 19 nt, Neisseria meningitidis Z2491
ccgaaaaucuugccauucu

SEQ ID NO: 3354122 - RNA, 12 nt, Neisseria meningitidis Z2491
ccgaaacaacaa

SEQ ID NO: 3354123 - RNA, 17 nt, Neisseria meningitidis Z2491
ccgaaacaacaaaaccu

SEQ ID NO: 3354124 - RNA, 12 nt, Neisseria meningitidis Z2491
ccgaaacagaaa

SEQ ID NO: 3354125 - RNA, 18 nt, Neisseria meningitidis Z2491
ccgaaacagaaacccaaa

SEQ ID NO: 3354126 - RNA, 23 nt, Neisseria meningitidis Z2491
ccgaaacagaaacccaaaaucgg

SEQ ID NO: 3354127 - RNA, 13 nt, Neisseria meningitidis Z2491
ccgaaacauuccg

SEQ ID NO: 3354128 - RNA, 15 nt, Neisseria meningitidis Z2491
ccgaaacauuccgcc

SEQ ID NO: 3354129 - RNA, 16 nt, Neisseria meningitidis Z2491
ccgaaacauuccgcca

SEQ ID NO: 3354130 - RNA, 16 nt, Neisseria meningitidis Z2491
ccgaaaccaaaagcca

SEQ ID NO: 3354131 - RNA, 20 nt, Neisseria meningitidis Z2491
ccgaaaccaaaagccaaaaa

SEQ ID NO: 3354132 - RNA, 17 nt, Neisseria meningitidis Z2491
ccgaaagcgcggccuuu

SEQ ID NO: 3354133 - RNA, 23 nt, Neisseria meningitidis Z2491
ccgaaaguuugagguucuagauu

SEQ ID NO: 3354134 - RNA, 15 nt, Neisseria meningitidis Z2491
ccgaaaucauccaca

SEQ ID NO: 3354135 - RNA, 16 nt, Neisseria meningitidis Z2491
ccgaaaucauccacag

SEQ ID NO: 3354136 - RNA, 18 nt, Neisseria meningitidis Z2491
ccgaaaucauccacagcc

SEQ ID NO: 3354137 - RNA, 16 nt, Neisseria meningitidis Z2491
ccgaacaccagugcga

SEQ ID NO: 3354138 - RNA, 20 nt, Neisseria meningitidis Z2491
ccgaacagaccggauucccg

SEQ ID NO: 3354139 - RNA, 21 nt, Neisseria meningitidis Z2491
ccgaaccgcgcucauuuuugu

SEQ ID NO: 3354140 - RNA, 17 nt, Neisseria meningitidis Z2491
ccgaaccgucauucccg

SEQ ID NO: 3354141 - RNA, 13 nt, Neisseria meningitidis Z2491
ccgaagacaguac

SEQ ID NO: 3354142 - RNA, 20 nt, Neisseria meningitidis Z2491
ccgaagguaugcgaugcgcc

SEQ ID NO: 3354143 - RNA, 18 nt, Neisseria meningitidis Z2491
ccgaaugauucauaaaau

SEQ ID NO: 3354144 - RNA, 20 nt, Neisseria meningitidis Z2491
ccgaaugauucauaaaauau

SEQ ID NO: 3354145 - RNA, 18 nt, Neisseria meningitidis Z2491
ccgaauugcagcgcgccc

SEQ ID NO: 3354146 - RNA, 18 nt, Neisseria meningitidis Z2491
ccgaauugcgccgacagc

SEQ ID NO: 3354147 - RNA, 17 nt, Neisseria meningitidis Z2491
ccgacaaccgcccagcc

SEQ ID NO: 3354148 - RNA, 20 nt, Neisseria meningitidis Z2491
ccgacaaggcuggauucccg

SEQ ID NO: 3354149 - RNA, 17 nt, Neisseria meningitidis Z2491
ccgacaauacggcggcg

SEQ ID NO: 3354150 - RNA, 19 nt, Neisseria meningitidis Z2491
ccgacaaucaggccggcgg

SEQ ID NO: 3354151 - RNA, 22 nt, Neisseria meningitidis Z2491
ccgacaauuucuccgccagccu

SEQ ID NO: 3354152 - RNA, 22 nt, Neisseria meningitidis Z2491
ccgacagaccuagauucccgcc

SEQ ID NO: 3354153 - RNA, 20 nt, Neisseria meningitidis Z2491
ccgacagcagcuuuugcgcc

SEQ ID NO: 3354154 - RNA, 21 nt, Neisseria meningitidis Z2491
ccgacagccuacuugcccgcc

SEQ ID NO: 3354155 - RNA, 19 nt, Neisseria meningitidis Z2491
ccgacagugcggacaccgc

SEQ ID NO: 3354156 - RNA, 16 nt, Neisseria meningitidis Z2491
ccgacaucccccagcc

SEQ ID NO: 3354157 - RNA, 16 nt, Neisseria meningitidis Z2491
ccgaccagagcggcau

SEQ ID NO: 3354158 - RNA, 21 nt, Neisseria meningitidis Z2491
ccgaccgccccgucauucccg

SEQ ID NO: 3354159 - RNA, 16 nt, Neisseria meningitidis Z2491
ccgaccgccgccgccu

SEQ ID NO: 3354160 - RNA, 19 nt, Neisseria meningitidis Z2491
ccgacggcguaauccgccu

SEQ ID NO: 3354161 - RNA, 18 nt, Neisseria meningitidis Z2491
ccgacggggcuggauucc

SEQ ID NO: 3354162 - RNA, 20 nt, Neisseria meningitidis Z2491
ccgacggggcuggauucccg

SEQ ID NO: 3354163 - RNA, 19 nt, Neisseria meningitidis Z2491
ccgacuuugccguauuuca

SEQ ID NO: 3354164 - RNA, 21 nt, Neisseria meningitidis Z2491
ccgacuuuuucaacuuggugg

SEQ ID NO: 3354165 - RNA, 17 nt, Neisseria meningitidis Z2491
ccgagcguucggguagg

SEQ ID NO: 3354166 - RNA, 16 nt, Neisseria meningitidis Z2491
ccgaggcuguggagca

SEQ ID NO: 3354167 - RNA, 19 nt, Neisseria meningitidis Z2491
ccgauaaauuccuaaaacu

SEQ ID NO: 3354168 - RNA, 21 nt, Neisseria meningitidis Z2491
ccgauaaauuccugccgcucu

SEQ ID NO: 3354169 - RNA, 23 nt, Neisseria meningitidis Z2491
ccgauaauaauccuucagcucuc

SEQ ID NO: 3354170 - RNA, 15 nt, Neisseria meningitidis Z2491
ccgauggauuuuuuu

SEQ ID NO: 3354171 - RNA, 21 nt, Neisseria meningitidis Z2491
ccgauucacuuggugcuucag

SEQ ID NO: 3354172 - RNA, 16 nt, Neisseria meningitidis Z2491
ccgauuuuggguuucu

SEQ ID NO: 3354173 - RNA, 21 nt, Neisseria meningitidis Z2491
ccgcaaaagcgggaaucuaga

SEQ ID NO: 3354174 - RNA, 16 nt, Neisseria meningitidis Z2491
ccgcaaacaccagcau

SEQ ID NO: 3354175 - RNA, 14 nt, Neisseria meningitidis Z2491
ccgucugaaaccgg

SEQ ID NO: 3354176 - RNA, 14 nt, Neisseria meningitidis Z2491
ccgucugaaaccgu

SEQ ID NO: 3354177 - RNA, 15 nt, Neisseria meningitidis Z2491
ccgucugaaaccucg

SEQ ID NO: 3354178 - RNA, 19 nt, Neisseria meningitidis Z2491
ccgucugaaaccugcaacg

SEQ ID NO: 3354179 - RNA, 17 nt, Neisseria meningitidis Z2491
ccgucugaaacgccaaa

SEQ ID NO: 3354180 - RNA, 19 nt, Neisseria meningitidis Z2491
ccgucugaaacgccaaacg

SEQ ID NO: 3354181 - RNA, 14 nt, Neisseria meningitidis Z2491
ccgucugaaacggc

SEQ ID NO: 3354182 - RNA, 17 nt, Neisseria meningitidis Z2491
ccgucugaaacggcauc

SEQ ID NO: 3354183 - RNA, 16 nt, Neisseria meningitidis Z2491
ccgucugaaagggcuu

SEQ ID NO: 3354184 - RNA, 19 nt, Neisseria meningitidis Z2491
ccgucugaaagucuuucag

SEQ ID NO: 3354185 - RNA, 11 nt, Neisseria meningitidis Z2491
ccgucugaaau

SEQ ID NO: 3354186 - RNA, 21 nt, Neisseria meningitidis Z2491
ccgucugaaauccuauuuuca

SEQ ID NO: 3354187 - RNA, 23 nt, Neisseria meningitidis Z2491
ccgucugaaauguucagacggca

SEQ ID NO: 3354188 - RNA, 17 nt, Neisseria meningitidis Z2491
ccgucugaacccgccug

SEQ ID NO: 3354189 - RNA, 14 nt, Neisseria meningitidis Z2491
ccgucugaacccgu

SEQ ID NO: 3354190 - RNA, 23 nt, Neisseria meningitidis Z2491
ccgucugaacgcuucagacggca

SEQ ID NO: 3354191 - RNA, 10 nt, Neisseria meningitidis Z2491
ccgucugaag

SEQ ID NO: 3354192 - RNA, 14 nt, Neisseria meningitidis Z2491
ccgucugaagccug

SEQ ID NO: 3354193 - RNA, 15 nt, Neisseria meningitidis Z2491
ccgucugaagccugu

SEQ ID NO: 3354194 - RNA, 23 nt, Neisseria meningitidis Z2491
ccgucugaagccuucagacggca

SEQ ID NO: 3354195 - RNA, 19 nt, Neisseria meningitidis Z2491
ccgucugaaggcuucagac

SEQ ID NO: 3354196 - RNA, 22 nt, Neisseria meningitidis Z2491
ccgucuugggaaaugccgucug

SEQ ID NO: 3354197 - RNA, 15 nt, Neisseria meningitidis Z2491
ccgugaaauugcguu

SEQ ID NO: 3354198 - RNA, 12 nt, Neisseria meningitidis Z2491
ccgugucaggau

SEQ ID NO: 3354199 - RNA, 23 nt, Neisseria meningitidis Z2491
ccguguuggguucuagauucccg

SEQ ID NO: 3354200 - RNA, 22 nt, Neisseria meningitidis Z2491
ccguuaaggcagagauaaaagc

SEQ ID NO: 3354201 - RNA, 14 nt, Neisseria meningitidis Z2491
ccguuaccaaguuu

SEQ ID NO: 3354202 - RNA, 17 nt, Neisseria meningitidis Z2491
ccguuauucugccgugg

SEQ ID NO: 3354203 - RNA, 19 nt, Neisseria meningitidis Z2491
ccguucaaaguauguacca

SEQ ID NO: 3354204 - RNA, 18 nt, Neisseria meningitidis Z2491
ccguucaauucaaaauug

SEQ ID NO: 3354205 - RNA, 16 nt, Neisseria meningitidis Z2491
ccguugcccauugcca

SEQ ID NO: 3354206 - RNA, 13 nt, Neisseria meningitidis Z2491
ccguugcgugucu

SEQ ID NO: 3354207 - RNA, 21 nt, Neisseria meningitidis Z2491
ccguuggucacggagaaggca

SEQ ID NO: 3354208 - RNA, 17 nt, Neisseria meningitidis Z2491
ccguuucagacggcauc

SEQ ID NO: 3354209 - RNA, 17 nt, Neisseria meningitidis Z2491
ccguuucagacggcauu

SEQ ID NO: 3354210 - RNA, 14 nt, Neisseria meningitidis Z2491
ccguuucccauccu

SEQ ID NO: 3354211 - RNA, 22 nt, Neisseria meningitidis Z2491
ccguuuggcggcauuuucucua

SEQ ID NO: 3354212 - RNA, 18 nt, Neisseria meningitidis Z2491
ccguuuuacccucucccc

SEQ ID NO: 3354213 - RNA, 14 nt, Neisseria meningitidis Z2491
ccguuuuccuuucu

SEQ ID NO: 3354214 - RNA, 16 nt, Neisseria meningitidis Z2491
ccguuuuggcugaaaa

SEQ ID NO: 3354215 - RNA, 12 nt, Neisseria meningitidis Z2491
ccguuuuuacug

SEQ ID NO: 3354216 - RNA, 19 nt, Neisseria meningitidis Z2491
ccuaaaaacuaaaugccaa

SEQ ID NO: 3354217 - RNA, 18 nt, Neisseria meningitidis Z2491
ccuaaaaauuuaauaacu

SEQ ID NO: 3354218 - RNA, 13 nt, Neisseria meningitidis Z2491
ccuaaaacaucaa

SEQ ID NO: 3354219 - RNA, 16 nt, Neisseria meningitidis Z2491
ccuaaaacuuaaaauu

SEQ ID NO: 3354220 - RNA, 21 nt, Neisseria meningitidis Z2491
ccuaaaaucccgucauucccg

SEQ ID NO: 3354221 - RNA, 21 nt, Neisseria meningitidis Z2491
ccuaaaaucucgucauucucg

SEQ ID NO: 3354222 - RNA, 20 nt, Neisseria meningitidis Z2491
ccuaaaauucgucauucccg

SEQ ID NO: 3354223 - RNA, 13 nt, Neisseria meningitidis Z2491
ccuaaagccgucc

SEQ ID NO: 3354224 - RNA, 17 nt, Neisseria meningitidis Z2491
ccuaaugcuuucgcuuu

SEQ ID NO: 3354225 - RNA, 16 nt, Neisseria meningitidis Z2491
ccuaauucuacccaaa

SEQ ID NO: 3354226 - RNA, 14 nt, Neisseria meningitidis Z2491
ccuacacaucgugu

SEQ ID NO: 3354227 - RNA, 18 nt, Neisseria meningitidis Z2491
ccuacgccaaccucagcc

SEQ ID NO: 3354228 - RNA, 19 nt, Neisseria meningitidis Z2491
ccuacgcgggaaugacgag

SEQ ID NO: 3354229 - RNA, 22 nt, Neisseria meningitidis Z2491
ccuauaguggauuaacaaaaau

SEQ ID NO: 3354230 - RNA, 15 nt, Neisseria meningitidis Z2491
ccucaaaaacagaaa

SEQ ID NO: 3354231 - RNA, 23 nt, Neisseria meningitidis Z2491
ccucaaaaacagaaaaccaaaau

SEQ ID NO: 3354232 - RNA, 21 nt, Neisseria meningitidis Z2491
ccucaaaucccgucauucccg

SEQ ID NO: 3354233 - RNA, 17 nt, Neisseria meningitidis Z2491
ccucaacacaccauccu

SEQ ID NO: 3354234 - RNA, 14 nt, Neisseria meningitidis Z2491
ccucacugccgcca

SEQ ID NO: 3354235 - RNA, 20 nt, Neisseria meningitidis Z2491
ccucacugccgccaauccug

SEQ ID NO: 3354236 - RNA, 21 nt, Neisseria meningitidis Z2491
ccucagccaucuacaaaauaa

SEQ ID NO: 3354237 - RNA, 22 nt, Neisseria meningitidis Z2491
ccucagccaucuacaaaauaau

SEQ ID NO: 3354238 - RNA, 20 nt, Neisseria meningitidis Z2491
ccucagcuaugccugccgac

SEQ ID NO: 3354239 - RNA, 12 nt, Neisseria meningitidis Z2491
ccucauugccgc

SEQ ID NO: 3354240 - RNA, 22 nt, Neisseria meningitidis Z2491
ccucauugccgcccguuuaaac

SEQ ID NO: 3354241 - RNA, 23 nt, Neisseria meningitidis Z2491
ccucauugccgcccguuuaaaca

SEQ ID NO: 3354242 - RNA, 20 nt, Neisseria meningitidis Z2491
ccuccaaaggagcaauuaaa

SEQ ID NO: 3354243 - RNA, 22 nt, Neisseria meningitidis Z2491
ccuccaccauuucuuuggccaa

SEQ ID NO: 3354244 - RNA, 18 nt, Neisseria meningitidis Z2491
ccuccaccgucauucccg

SEQ ID NO: 3354245 - RNA, 14 nt, Neisseria meningitidis Z2491
ccuccgcaaacacc

SEQ ID NO: 3354246 - RNA, 18 nt, Neisseria meningitidis Z2491
ccuccgccgucauucccg

SEQ ID NO: 3354247 - RNA, 22 nt, Neisseria meningitidis Z2491
ccucgauuugaaaucugauuuc

SEQ ID NO: 3354248 - RNA, 15 nt, Neisseria meningitidis Z2491
ccucgccgcgcguca

SEQ ID NO: 3354249 - RNA, 14 nt, Neisseria meningitidis Z2491
ccucgccuuagcuc

SEQ ID NO: 3354250 - RNA, 22 nt, Neisseria meningitidis Z2491
ccucgccuugccguacuauuug

SEQ ID NO: 3354251 - RNA, 19 nt, Neisseria meningitidis Z2491
ccucgucauucccgcaaaa

SEQ ID NO: 3354252 - RNA, 20 nt, Neisseria meningitidis Z2491
ccucgucauuuccacaaaaa

SEQ ID NO: 3354253 - RNA, 20 nt, Neisseria meningitidis Z2491
ccucgugccagcgcaccguu

SEQ ID NO: 3354254 - RNA, 21 nt, Neisseria meningitidis Z2491
ccucuauuuaaaaauuccugu

SEQ ID NO: 3354255 - RNA, 21 nt, Neisseria meningitidis Z2491
ccucuccccgacccuccccca

SEQ ID NO: 3354256 - RNA, 14 nt, Neisseria meningitidis Z2491
ccucugccagcucc

SEQ ID NO: 3354257 - RNA, 14 nt, Neisseria meningitidis Z2491
ccucuuucaucaua

SEQ ID NO: 3354258 - RNA, 24 nt, Neisseria meningitidis Z2491
ccucuuucaucauaugcaucagca

SEQ ID NO: 3354259 - RNA, 14 nt, Neisseria meningitidis Z2491
ccugaaaacagaaa

SEQ ID NO: 3354260 - RNA, 15 nt, Neisseria meningitidis Z2491
ccugaaaacagaaac

SEQ ID NO: 3354261 - RNA, 19 nt, Neisseria meningitidis Z2491
ccugaaaacagaaaccuaa

SEQ ID NO: 3354262 - RNA, 17 nt, Neisseria meningitidis Z2491
ccugaacauaaaugccg

SEQ ID NO: 3354263 - RNA, 20 nt, Neisseria meningitidis Z2491
ccugaacauuucagacggca

SEQ ID NO: 3354264 - RNA, 19 nt, Neisseria meningitidis Z2491
ccugaacggcacaaacgcc

SEQ ID NO: 3354265 - RNA, 18 nt, Neisseria meningitidis Z2491
ccugacaaauucccgcca

SEQ ID NO: 3354266 - RNA, 17 nt, Neisseria meningitidis Z2491
ccugacgcuccagcucc

SEQ ID NO: 3354267 - RNA, 14 nt, Neisseria meningitidis Z2491
ccugauaaaaaaua

SEQ ID NO: 3354268 - RNA, 17 nt, Neisseria meningitidis Z2491
ccugauaaaaaauaugg

SEQ ID NO: 3354269 - RNA, 17 nt, Neisseria meningitidis Z2491
ccugauagcagacgaac

SEQ ID NO: 3354270 - RNA, 16 nt, Neisseria meningitidis Z2491
ccugauaguugccguc

SEQ ID NO: 3354271 - RNA, 14 nt, Neisseria meningitidis Z2491
ccugauccaaaccg

SEQ ID NO: 3354272 - RNA, 21 nt, Neisseria meningitidis Z2491
ccugaucuaaaaauucuaacu

SEQ ID NO: 3354273 - RNA, 23 nt, Neisseria meningitidis Z2491
ccugaugaaauuuagauaaugug

SEQ ID NO: 3354274 - RNA, 23 nt, Neisseria meningitidis Z2491
ccugauggcugaugacggcagcc

SEQ ID NO: 3354275 - RNA, 20 nt, Neisseria meningitidis Z2491
ccugauugaccgaaaaauaa

SEQ ID NO: 3354276 - RNA, 20 nt, Neisseria meningitidis Z2491
cgaagaaauagccgccgccg

SEQ ID NO: 3354277 - RNA, 13 nt, Neisseria meningitidis Z2491
cgaagacaggcag

SEQ ID NO: 3354278 - RNA, 14 nt, Neisseria meningitidis Z2491
cgaagacaguacag

SEQ ID NO: 3354279 - RNA, 13 nt, Neisseria meningitidis Z2491
cgaagcgacaaca

SEQ ID NO: 3354280 - RNA, 19 nt, Neisseria meningitidis Z2491
cgaaggcgcggcugccgac

SEQ ID NO: 3354281 - RNA, 22 nt, Neisseria meningitidis Z2491
cgaaggcgcggcugccgaccgc

SEQ ID NO: 3354282 - RNA, 21 nt, Neisseria meningitidis Z2491
cgaaggcgcgguagguuuugc

SEQ ID NO: 3354283 - RNA, 15 nt, Neisseria meningitidis Z2491
cgaaucaacacgccu

SEQ ID NO: 3354284 - RNA, 22 nt, Neisseria meningitidis Z2491
cgaaucugcugcaaaccgucug

SEQ ID NO: 3354285 - RNA, 16 nt, Neisseria meningitidis Z2491
cgaaucuuauccacag

SEQ ID NO: 3354286 - RNA, 18 nt, Neisseria meningitidis Z2491
cgacaaagccgcagacag

SEQ ID NO: 3354287 - RNA, 23 nt, Neisseria meningitidis Z2491
cgacaacacgucggcagucugua

SEQ ID NO: 3354288 - RNA, 15 nt, Neisseria meningitidis Z2491
cgacaaccgcccagc

SEQ ID NO: 3354289 - RNA, 20 nt, Neisseria meningitidis Z2491
cgacaaccguauccgccagu

SEQ ID NO: 3354290 - RNA, 13 nt, Neisseria meningitidis Z2491
cgacaauacggcg

SEQ ID NO: 3354291 - RNA, 18 nt, Neisseria meningitidis Z2491
cgacaauacggcggcggc

SEQ ID NO: 3354292 - RNA, 13 nt, Neisseria meningitidis Z2491
cgacaaucaggcc

SEQ ID NO: 3354293 - RNA, 21 nt, Neisseria meningitidis Z2491
cgacaauuucuccgccagccu

SEQ ID NO: 3354294 - RNA, 13 nt, Neisseria meningitidis Z2491
cgacacccgcccc

SEQ ID NO: 3354295 - RNA, 14 nt, Neisseria meningitidis Z2491
cgacacccgccccg

SEQ ID NO: 3354296 - RNA, 19 nt, Neisseria meningitidis Z2491
cgacagaccuagauucccg

SEQ ID NO: 3354297 - RNA, 22 nt, Neisseria meningitidis Z2491
cgacagccgaaacccaaacaca

SEQ ID NO: 3354298 - RNA, 16 nt, Neisseria meningitidis Z2491
cgacagccgcaaagac

SEQ ID NO: 3354299 - RNA, 19 nt, Neisseria meningitidis Z2491
cgacagccggguaaaauca

SEQ ID NO: 3354300 - RNA, 22 nt, Neisseria meningitidis Z2491
cgacagccuacuugcccgccuu

SEQ ID NO: 3354301 - RNA, 22 nt, Neisseria meningitidis Z2491
cgacagcggccgccaucaaaaa

SEQ ID NO: 3354302 - RNA, 13 nt, Neisseria meningitidis Z2491
cgacaucccccag

SEQ ID NO: 3354303 - RNA, 12 nt, Neisseria meningitidis Z2491
cgaccaccacuu

SEQ ID NO: 3354304 - RNA, 12 nt, Neisseria meningitidis Z2491
cgaccagcuccc

SEQ ID NO: 3354305 - RNA, 19 nt, Neisseria meningitidis Z2491
cgacccgaaucacaaacau

SEQ ID NO: 3354306 - RNA, 21 nt, Neisseria meningitidis Z2491
cgaccgccgccgccuuugcca

SEQ ID NO: 3354307 - RNA, 21 nt, Neisseria meningitidis Z2491
cgaccggauagguugaccaga

SEQ ID NO: 3354308 - RNA, 17 nt, Neisseria meningitidis Z2491
cgacgaagccgcagaca

SEQ ID NO: 3354309 - RNA, 18 nt, Neisseria meningitidis Z2491
cgacgaagccgcagacag

SEQ ID NO: 3354310 - RNA, 15 nt, Neisseria meningitidis Z2491
cgacgaagcugcaga

SEQ ID NO: 3354311 - RNA, 16 nt, Neisseria meningitidis Z2491
cgacgaccaaugccuc

SEQ ID NO: 3354312 - RNA, 15 nt, Neisseria meningitidis Z2491
cgacgagaauuuauc

SEQ ID NO: 3354313 - RNA, 18 nt, Neisseria meningitidis Z2491
cgacgagaauuuaucaga

SEQ ID NO: 3354314 - RNA, 21 nt, Neisseria meningitidis Z2491
cgacgaugccgaacagcuugg

SEQ ID NO: 3354315 - RNA, 14 nt, Neisseria meningitidis Z2491
cgacggcggcaggg

SEQ ID NO: 3354316 - RNA, 19 nt, Neisseria meningitidis Z2491
cgacggcguaauccgccug

SEQ ID NO: 3354317 - RNA, 21 nt, Neisseria meningitidis Z2491
cgacucaaaaucaucuucaug

SEQ ID NO: 3354318 - RNA, 17 nt, Neisseria meningitidis Z2491
cgacuggcacugggaug

SEQ ID NO: 3354319 - RNA, 21 nt, Neisseria meningitidis Z2491
cgacuucugacagcauuucca

SEQ ID NO: 3354320 - RNA, 20 nt, Neisseria meningitidis Z2491
cgacuucuuuuaagaacguc

SEQ ID NO: 3354321 - RNA, 15 nt, Neisseria meningitidis Z2491
cgacuuuuuccagca

SEQ ID NO: 3354322 - RNA, 13 nt, Neisseria meningitidis Z2491
cgagaauuuauca

SEQ ID NO: 3354323 - RNA, 10 nt, Neisseria meningitidis Z2491
cgagacggca

SEQ ID NO: 3354324 - RNA, 18 nt, Neisseria meningitidis Z2491
cgagauaacugccgauuu

SEQ ID NO: 3354325 - RNA, 20 nt, Neisseria meningitidis Z2491
cgagauaacugccgauuucu

SEQ ID NO: 3354326 - RNA, 19 nt, Neisseria meningitidis Z2491
cgagauaaguguuggacaa

SEQ ID NO: 3354327 - RNA, 15 nt, Neisseria meningitidis Z2491
cgagaugacggcugc

SEQ ID NO: 3354328 - RNA, 20 nt, Neisseria meningitidis Z2491
cgagauuuuagauggcggga

SEQ ID NO: 3354329 - RNA, 23 nt, Neisseria meningitidis Z2491
cgagcaauauuggcacgggcgca

SEQ ID NO: 3354330 - RNA, 21 nt, Neisseria meningitidis Z2491
cgagcaggugcuggguggugg

SEQ ID NO: 3354331 - RNA, 15 nt, Neisseria meningitidis Z2491
cgagccaauagccgc

SEQ ID NO: 3354332 - RNA, 18 nt, Neisseria meningitidis Z2491
cgagccaauagccgccgg

SEQ ID NO: 3354333 - RNA, 22 nt, Neisseria meningitidis Z2491
cgagccgcagacgguacaaaua

SEQ ID NO: 3354334 - RNA, 19 nt, Neisseria meningitidis Z2491
cgaggaacaaaaugccgcc

SEQ ID NO: 3354335 - RNA, 20 nt, Neisseria meningitidis Z2491
cgagguuacaguuuaauccc

SEQ ID NO: 3354336 - RNA, 23 nt, Neisseria meningitidis Z2491
cgagugugggguagccuucaaac

SEQ ID NO: 3354337 - RNA, 14 nt, Neisseria meningitidis Z2491
cgaguuuucagacg

SEQ ID NO: 3354338 - RNA, 13 nt, Neisseria meningitidis Z2491
cgauaaaauccgg

SEQ ID NO: 3354339 - RNA, 12 nt, Neisseria meningitidis Z2491
cgauaaauuccu

SEQ ID NO: 3354340 - RNA, 15 nt, Neisseria meningitidis Z2491
cgauaacggcggcaa

SEQ ID NO: 3354341 - RNA, 15 nt, Neisseria meningitidis Z2491
cgauaaggcaagcgu

SEQ ID NO: 3354342 - RNA, 18 nt, Neisseria meningitidis Z2491
cgauacacaaaaaagcca

SEQ ID NO: 3354343 - RNA, 20 nt, Neisseria meningitidis Z2491
cgauaccaagucgucuaaga

SEQ ID NO: 3354344 - RNA, 14 nt, Neisseria meningitidis Z2491
cgauagauucccgu

SEQ ID NO: 3354345 - RNA, 21 nt, Neisseria meningitidis Z2491
cgauauaguggauuaacaaaa

SEQ ID NO: 3354346 - RNA, 14 nt, Neisseria meningitidis Z2491
cgauauuacgaaca

SEQ ID NO: 3354347 - RNA, 19 nt, Neisseria meningitidis Z2491
cgauauucagguaaaacaa

SEQ ID NO: 3354348 - RNA, 18 nt, Neisseria meningitidis Z2491
cgaugauguguuucaaca

SEQ ID NO: 3354349 - RNA, 16 nt, Neisseria meningitidis Z2491
cgaugccgucauuccc

SEQ ID NO: 3354350 - RNA, 12 nt, Neisseria meningitidis Z2491
cgaugccguuca

SEQ ID NO: 3354351 - RNA, 16 nt, Neisseria meningitidis Z2491
cgaugcggauggagga

SEQ ID NO: 3354352 - RNA, 18 nt, Neisseria meningitidis Z2491
cgaugcguuccugccaga

SEQ ID NO: 3354353 - RNA, 14 nt, Neisseria meningitidis Z2491
cgaugcuggcgggg

SEQ ID NO: 3354354 - RNA, 14 nt, Neisseria meningitidis Z2491
cgauggaaccguuu

SEQ ID NO: 3354355 - RNA, 23 nt, Neisseria meningitidis Z2491
cgaugucguugucaaccaaaaaa

SEQ ID NO: 3354356 - RNA, 20 nt, Neisseria meningitidis Z2491
cgauuaagguuaauuaaaau

SEQ ID NO: 3354357 - RNA, 17 nt, Neisseria meningitidis Z2491
cgauuaucgggaaaaau

SEQ ID NO: 3354358 - RNA, 13 nt, Neisseria meningitidis Z2491
cgauuauuuuuua

SEQ ID NO: 3354359 - RNA, 19 nt, Neisseria meningitidis Z2491
cgauucacuuggugcuuca

SEQ ID NO: 3354360 - RNA, 19 nt, Neisseria meningitidis Z2491
cgauuccguacuauuugag

SEQ ID NO: 3354361 - RNA, 16 nt, Neisseria meningitidis Z2491
cgauucuucgacauag

SEQ ID NO: 3354362 - RNA, 18 nt, Neisseria meningitidis Z2491
cgauuugaaccauuucca

SEQ ID NO: 3354363 - RNA, 16 nt, Neisseria meningitidis Z2491
cgauuugguugucagg

SEQ ID NO: 3354364 - RNA, 18 nt, Neisseria meningitidis Z2491
cgauuuuuuuucuaacca

SEQ ID NO: 3354365 - RNA, 18 nt, Neisseria meningitidis Z2491
cgcaaaaacgcagccagc

SEQ ID NO: 3354366 - RNA, 20 nt, Neisseria meningitidis Z2491
cgcaaacaccagcaucugau

SEQ ID NO: 3354367 - RNA, 16 nt, Neisseria meningitidis Z2491
cgcaaaccuuccgccg

SEQ ID NO: 3354368 - RNA, 15 nt, Neisseria meningitidis Z2491
cgcaaacgcugcauu

SEQ ID NO: 3354369 - RNA, 22 nt, Neisseria meningitidis Z2491
cgcaaacggcaggcaaaaaaaa

SEQ ID NO: 3354370 - RNA, 19 nt, Neisseria meningitidis Z2491
cgcaaagucauauuaauua

SEQ ID NO: 3354371 - RNA, 14 nt, Neisseria meningitidis Z2491
cgcaaaugccgucu

SEQ ID NO: 3354372 - RNA, 17 nt, Neisseria meningitidis Z2491
cgcaaaugcguaugccc

SEQ ID NO: 3354373 - RNA, 14 nt, Neisseria meningitidis Z2491
cgcaaccuugccaa

SEQ ID NO: 3354374 - RNA, 16 nt, Neisseria meningitidis Z2491
cgcaaucaagaagaaa

SEQ ID NO: 3354375 - RNA, 21 nt, Neisseria meningitidis Z2491
cgcaaugacgcugcccgccga

SEQ ID NO: 3354376 - RNA, 18 nt, Neisseria meningitidis Z2491
cgcaaugcgccuucuuca

SEQ ID NO: 3354377 - RNA, 19 nt, Neisseria meningitidis Z2491
cgcgcugcgccuaugcaau

SEQ ID NO: 3354378 - RNA, 22 nt, Neisseria meningitidis Z2491
cgcgcuugggcggcaggcuugc

SEQ ID NO: 3354379 - RNA, 22 nt, Neisseria meningitidis Z2491
cgcggcacacgcauuccgacag

SEQ ID NO: 3354380 - RNA, 23 nt, Neisseria meningitidis Z2491
cgcggcccgugaaccaaugccgu

SEQ ID NO: 3354381 - RNA, 16 nt, Neisseria meningitidis Z2491
cgcggccuuugcaaaa

SEQ ID NO: 3354382 - RNA, 14 nt, Neisseria meningitidis Z2491
cgcgggaaugacga

SEQ ID NO: 3354383 - RNA, 18 nt, Neisseria meningitidis Z2491
cgcgggaaugacggcgga

SEQ ID NO: 3354384 - RNA, 16 nt, Neisseria meningitidis Z2491
cgcgggcguucagauu

SEQ ID NO: 3354385 - RNA, 19 nt, Neisseria meningitidis Z2491
cgcgggcugcgucgcgggc

SEQ ID NO: 3354386 - RNA, 20 nt, Neisseria meningitidis Z2491
cgcgguuguggaaggcgggc

SEQ ID NO: 3354387 - RNA, 14 nt, Neisseria meningitidis Z2491
cgcguagccggcca

SEQ ID NO: 3354388 - RNA, 17 nt, Neisseria meningitidis Z2491
cgcguagccggccaaca

SEQ ID NO: 3354389 - RNA, 20 nt, Neisseria meningitidis Z2491
cgcguagccggccaacauca

SEQ ID NO: 3354390 - RNA, 14 nt, Neisseria meningitidis Z2491
cgcgucaaacagac

SEQ ID NO: 3354391 - RNA, 19 nt, Neisseria meningitidis Z2491
cgcgucaaacagacggaau

SEQ ID NO: 3354392 - RNA, 16 nt, Neisseria meningitidis Z2491
cgcguccaacacgcag

SEQ ID NO: 3354393 - RNA, 19 nt, Neisseria meningitidis Z2491
cgcguccagcuuccgcagg

SEQ ID NO: 3354394 - RNA, 19 nt, Neisseria meningitidis Z2491
cgcgucuuccgucugcggc

SEQ ID NO: 3354395 - RNA, 17 nt, Neisseria meningitidis Z2491
cgcgugauuugccgcca

SEQ ID NO: 3354396 - RNA, 17 nt, Neisseria meningitidis Z2491
cgcguucgugcagauaa

SEQ ID NO: 3354397 - RNA, 19 nt, Neisseria meningitidis Z2491
cgcucaaacacccccgaau

SEQ ID NO: 3354398 - RNA, 24 nt, Neisseria meningitidis Z2491
cgcucgcguauccagccgccaucc

SEQ ID NO: 3354399 - RNA, 19 nt, Neisseria meningitidis Z2491
cgcugaugaugauggcggc

SEQ ID NO: 3354400 - RNA, 21 nt, Neisseria meningitidis Z2491
cgcugccgaaaccaaaagcca

SEQ ID NO: 3354401 - RNA, 16 nt, Neisseria meningitidis Z2491
cgcugccgccgcccgg

SEQ ID NO: 3354402 - RNA, 15 nt, Neisseria meningitidis Z2491
cgcuggucggcagua

SEQ ID NO: 3354403 - RNA, 21 nt, Neisseria meningitidis Z2491
cgcuguacugguuuaaauuua

SEQ ID NO: 3354404 - RNA, 19 nt, Neisseria meningitidis Z2491
cgcuguauuugcgccgccc

SEQ ID NO: 3354405 - RNA, 15 nt, Neisseria meningitidis Z2491
cgcuuaaaaaacaac

SEQ ID NO: 3354406 - RNA, 13 nt, Neisseria meningitidis Z2491
cgcuucaaggcgg

SEQ ID NO: 3354407 - RNA, 21 nt, Neisseria meningitidis Z2491
cgcuucagacggcauuuugau

SEQ ID NO: 3354408 - RNA, 21 nt, Neisseria meningitidis Z2491
cgcuucagacggcauuuuuuc

SEQ ID NO: 3354409 - RNA, 20 nt, Neisseria meningitidis Z2491
cgcuucggucggauguuugu

SEQ ID NO: 3354410 - RNA, 23 nt, Neisseria meningitidis Z2491
cgcuugaaucuucauuccgcgca

SEQ ID NO: 3354411 - RNA, 22 nt, Neisseria meningitidis Z2491
cgcuugaccgcagccgaaccca

SEQ ID NO: 3354412 - RNA, 22 nt, Neisseria meningitidis Z2491
cgcuugaggcgaguccgcgcga

SEQ ID NO: 3354413 - RNA, 19 nt, Neisseria meningitidis Z2491
cgcuugauuuucggcggcg

SEQ ID NO: 3354414 - RNA, 16 nt, Neisseria meningitidis Z2491
cgcuuucacgggaaug

SEQ ID NO: 3354415 - RNA, 17 nt, Neisseria meningitidis Z2491
cgcuuucgcauccccga

SEQ ID NO: 3354416 - RNA, 23 nt, Neisseria meningitidis Z2491
cgcuuuugcgggaaugacggcag

SEQ ID NO: 3354417 - RNA, 22 nt, Neisseria meningitidis Z2491
cggaaaaaaggcuucagacggu

SEQ ID NO: 3354418 - RNA, 15 nt, Neisseria meningitidis Z2491
cggaaacagccaggc

SEQ ID NO: 3354419 - RNA, 18 nt, Neisseria meningitidis Z2491
cggaaaccaaucaggcgu

SEQ ID NO: 3354420 - RNA, 18 nt, Neisseria meningitidis Z2491
cggaaaccguauauuucc

SEQ ID NO: 3354421 - RNA, 19 nt, Neisseria meningitidis Z2491
cggaaaccguauauuuccc

SEQ ID NO: 3354422 - RNA, 23 nt, Neisseria meningitidis Z2491
cggaaaccguauauuucccgucu

SEQ ID NO: 3354423 - RNA, 18 nt, Neisseria meningitidis Z2491
cggaaacucaaaaaaccg

SEQ ID NO: 3354424 - RNA, 14 nt, Neisseria meningitidis Z2491
cggaaaguggaaca

SEQ ID NO: 3354425 - RNA, 19 nt, Neisseria meningitidis Z2491
cggaaaucguaggucuuca

SEQ ID NO: 3354426 - RNA, 21 nt, Neisseria meningitidis Z2491
cggaaaugacugaaacucaaa

SEQ ID NO: 3354427 - RNA, 16 nt, Neisseria meningitidis Z2491
cggaaaugaucaggcg

SEQ ID NO: 3354428 - RNA, 14 nt, Neisseria meningitidis Z2491
cggaacacaaaaaa

SEQ ID NO: 3354429 - RNA, 21 nt, Neisseria meningitidis Z2491
cggaacgcgucuuccgucugc

SEQ ID NO: 3354430 - RNA, 16 nt, Neisseria meningitidis Z2491
cggaagugggaaucua

SEQ ID NO: 3354431 - RNA, 22 nt, Neisseria meningitidis Z2491
cggaauaagguuugagcaguuu

SEQ ID NO: 3354432 - RNA, 15 nt, Neisseria meningitidis Z2491
cggaauacggcaaca

SEQ ID NO: 3354433 - RNA, 15 nt, Neisseria meningitidis Z2491
cggacaaaucuggau

SEQ ID NO: 3354434 - RNA, 14 nt, Neisseria meningitidis Z2491
cggacaccgcaauc

SEQ ID NO: 3354435 - RNA, 14 nt, Neisseria meningitidis Z2491
cggacggcauuuug

SEQ ID NO: 3354436 - RNA, 16 nt, Neisseria meningitidis Z2491
cggacggcauuuuuga

SEQ ID NO: 3354437 - RNA, 16 nt, Neisseria meningitidis Z2491
cggacuagauucccgc

SEQ ID NO: 3354438 - RNA, 16 nt, Neisseria meningitidis Z2491
cggagaaguaaucaca

SEQ ID NO: 3354439 - RNA, 18 nt, Neisseria meningitidis Z2491
cggagaggcuuucagacg

SEQ ID NO: 3354440 - RNA, 19 nt, Neisseria meningitidis Z2491
cggagaggcuuucagacgg

SEQ ID NO: 3354441 - RNA, 21 nt, Neisseria meningitidis Z2491
cggagcaagaccaaacagaac

SEQ ID NO: 3354442 - RNA, 17 nt, Neisseria meningitidis Z2491
cggagcagaaucaaaua

SEQ ID NO: 3354443 - RNA, 16 nt, Neisseria meningitidis Z2491
cggaguuucaggcggc

SEQ ID NO: 3354444 - RNA, 15 nt, Neisseria meningitidis Z2491
cggauaaaguuugaa

SEQ ID NO: 3354445 - RNA, 22 nt, Neisseria meningitidis Z2491
cggauacggugucuucaauucc

SEQ ID NO: 3354446 - RNA, 21 nt, Neisseria meningitidis Z2491
cggauagcuucgucauucccg

SEQ ID NO: 3354447 - RNA, 22 nt, Neisseria meningitidis Z2491
cggauagcuucgucauucccgc

SEQ ID NO: 3354448 - RNA, 13 nt, Neisseria meningitidis Z2491
cggauaggcaaaa

SEQ ID NO: 3354449 - RNA, 14 nt, Neisseria meningitidis Z2491
cggaugaauuuaaa

SEQ ID NO: 3354450 - RNA, 20 nt, Neisseria meningitidis Z2491
cggauguauucggauucccu

SEQ ID NO: 3354451 - RNA, 14 nt, Neisseria meningitidis Z2491
cggauguccgacca

SEQ ID NO: 3354452 - RNA, 22 nt, Neisseria meningitidis Z2491
cggauguccgcgcccacgcccu

SEQ ID NO: 3354453 - RNA, 15 nt, Neisseria meningitidis Z2491
cggauguucaaacac

SEQ ID NO: 3354454 - RNA, 17 nt, Neisseria meningitidis Z2491
cggauguucaaacacgg

SEQ ID NO: 3354455 - RNA, 13 nt, Neisseria meningitidis Z2491
cggauucccgccu

SEQ ID NO: 3354456 - RNA, 16 nt, Neisseria meningitidis Z2491
cggauuguuuggaaau

SEQ ID NO: 3354457 - RNA, 16 nt, Neisseria meningitidis Z2491
cggauuucuccgucgg

SEQ ID NO: 3354458 - RNA, 16 nt, Neisseria meningitidis Z2491
cggauuuuagguuucu

SEQ ID NO: 3354459 - RNA, 21 nt, Neisseria meningitidis Z2491
cggauuuuagguuucugauuu

SEQ ID NO: 3354460 - RNA, 14 nt, Neisseria meningitidis Z2491
cggcaaacuuuccg

SEQ ID NO: 3354461 - RNA, 19 nt, Neisseria meningitidis Z2491
cggcaaaguuauucaauuu

SEQ ID NO: 3354462 - RNA, 18 nt, Neisseria meningitidis Z2491
cggcaacauaaacaaagc

SEQ ID NO: 3354463 - RNA, 20 nt, Neisseria meningitidis Z2491
cggcaacaucauagaaauca

SEQ ID NO: 3354464 - RNA, 23 nt, Neisseria meningitidis Z2491
cggcaaccgggguucgaaucccc

SEQ ID NO: 3354465 - RNA, 18 nt, Neisseria meningitidis Z2491
cggcaaccgguccuucca

SEQ ID NO: 3354466 - RNA, 20 nt, Neisseria meningitidis Z2491
cggcaaggcgaggcaacgac

SEQ ID NO: 3354467 - RNA, 21 nt, Neisseria meningitidis Z2491
cggcaauaauggcaaccaaaa

SEQ ID NO: 3354468 - RNA, 19 nt, Neisseria meningitidis Z2491
cggcaaugaggcaauagaa

SEQ ID NO: 3354469 - RNA, 16 nt, Neisseria meningitidis Z2491
cggcacaaccgcccua

SEQ ID NO: 3354470 - RNA, 23 nt, Neisseria meningitidis Z2491
cggcacaagaugccccacgccga

SEQ ID NO: 3354471 - RNA, 16 nt, Neisseria meningitidis Z2491
cggcacggcagggaca

SEQ ID NO: 3354472 - RNA, 17 nt, Neisseria meningitidis Z2491
cggcacggcgcaggcaa

SEQ ID NO: 3354473 - RNA, 22 nt, Neisseria meningitidis Z2491
cggcacggcguuccaaauauuu

SEQ ID NO: 3354474 - RNA, 16 nt, Neisseria meningitidis Z2491
cggcacuagccaaaaa

SEQ ID NO: 3354475 - RNA, 23 nt, Neisseria meningitidis Z2491
cggcacuuucauucacacggccg

SEQ ID NO: 3354476 - RNA, 15 nt, Neisseria meningitidis Z2491
cggcaggaacacggc

SEQ ID NO: 3354477 - RNA, 14 nt, Neisseria meningitidis Z2491
cggggaacugccau

SEQ ID NO: 3354478 - RNA, 15 nt, Neisseria meningitidis Z2491
cggggcggucagcgg

SEQ ID NO: 3354479 - RNA, 13 nt, Neisseria meningitidis Z2491
cgggguaauccaa

SEQ ID NO: 3354480 - RNA, 16 nt, Neisseria meningitidis Z2491
cgggguucgaaucccc

SEQ ID NO: 3354481 - RNA, 23 nt, Neisseria meningitidis Z2491
cgggguuuaucagaaaugacuga

SEQ ID NO: 3354482 - RNA, 22 nt, Neisseria meningitidis Z2491
cggguaaaaucacggugaaaaa

SEQ ID NO: 3354483 - RNA, 14 nt, Neisseria meningitidis Z2491
cggguacuguugca

SEQ ID NO: 3354484 - RNA, 18 nt, Neisseria meningitidis Z2491
cgggucgcggucggacca

SEQ ID NO: 3354485 - RNA, 16 nt, Neisseria meningitidis Z2491
cgggucgcuuuauuuu

SEQ ID NO: 3354486 - RNA, 17 nt, Neisseria meningitidis Z2491
cgggucuccgagcauca

SEQ ID NO: 3354487 - RNA, 16 nt, Neisseria meningitidis Z2491
cgggugaugccgacgu

SEQ ID NO: 3354488 - RNA, 18 nt, Neisseria meningitidis Z2491
cgggugauggagcugugu

SEQ ID NO: 3354489 - RNA, 19 nt, Neisseria meningitidis Z2491
cggguggcgaagccggcgg

SEQ ID NO: 3354490 - RNA, 12 nt, Neisseria meningitidis Z2491
cggguuacgccg

SEQ ID NO: 3354491 - RNA, 19 nt, Neisseria meningitidis Z2491
cggguucagacggcaucag

SEQ ID NO: 3354492 - RNA, 16 nt, Neisseria meningitidis Z2491
cggguucggacggcau

SEQ ID NO: 3354493 - RNA, 16 nt, Neisseria meningitidis Z2491
cggguucguaaaaggc

SEQ ID NO: 3354494 - RNA, 23 nt, Neisseria meningitidis Z2491
cggguuugcuuucgcugccgccg

SEQ ID NO: 3354495 - RNA, 18 nt, Neisseria meningitidis Z2491
cggguuuucgauuuccga

SEQ ID NO: 3354496 - RNA, 12 nt, Neisseria meningitidis Z2491
cgguaaauuccu

SEQ ID NO: 3354497 - RNA, 16 nt, Neisseria meningitidis Z2491
cgguaaauuccuaaaa

SEQ ID NO: 3354498 - RNA, 14 nt, Neisseria meningitidis Z2491
cgguaaauuuugac

SEQ ID NO: 3354499 - RNA, 17 nt, Neisseria meningitidis Z2491
cgguaaccacgacgcag

SEQ ID NO: 3354500 - RNA, 16 nt, Neisseria meningitidis Z2491
cgguagggcaguucca

SEQ ID NO: 3354501 - RNA, 19 nt, Neisseria meningitidis Z2491
cgguagggcaguuccaaag

SEQ ID NO: 3354502 - RNA, 14 nt, Neisseria meningitidis Z2491
cgguagguuuugcu

SEQ ID NO: 3354503 - RNA, 22 nt, Neisseria meningitidis Z2491
cgguauuuggggcgaaaacagc

SEQ ID NO: 3354504 - RNA, 17 nt, Neisseria meningitidis Z2491
cgguauuuuuuucuuaa

SEQ ID NO: 3354505 - RNA, 20 nt, Neisseria meningitidis Z2491
cggucaaaaucggcauucuc

SEQ ID NO: 3354506 - RNA, 13 nt, Neisseria meningitidis Z2491
cggucaggcuuuu

SEQ ID NO: 3354507 - RNA, 13 nt, Neisseria meningitidis Z2491
cgguccguucagu

SEQ ID NO: 3354508 - RNA, 15 nt, Neisseria meningitidis Z2491
cgguccuuccaucac

SEQ ID NO: 3354509 - RNA, 20 nt, Neisseria meningitidis Z2491
cggucgaaacuuuccaccgc

SEQ ID NO: 3354510 - RNA, 15 nt, Neisseria meningitidis Z2491
cggucuguccgaccu

SEQ ID NO: 3354511 - RNA, 14 nt, Neisseria meningitidis Z2491
cggugcgcggcagc

SEQ ID NO: 3354512 - RNA, 16 nt, Neisseria meningitidis Z2491
cggugcugcugccgcc

SEQ ID NO: 3354513 - RNA, 22 nt, Neisseria meningitidis Z2491
cgguguaacggauaaaguuuga

SEQ ID NO: 3354514 - RNA, 15 nt, Neisseria meningitidis Z2491
cgguguaucuuuuug

SEQ ID NO: 3354515 - RNA, 22 nt, Neisseria meningitidis Z2491
cggugugcauccgacaggcaaa

SEQ ID NO: 3354516 - RNA, 17 nt, Neisseria meningitidis Z2491
cgguuacuggauucccg

SEQ ID NO: 3354517 - RNA, 18 nt, Neisseria meningitidis Z2491
cgguuacuggauucccgc

SEQ ID NO: 3354518 - RNA, 16 nt, Neisseria meningitidis Z2491
cgguucggacacgccc

SEQ ID NO: 3354519 - RNA, 12 nt, Neisseria meningitidis Z2491
cgguugaaacuc

SEQ ID NO: 3354520 - RNA, 17 nt, Neisseria meningitidis Z2491
cgguugaucauuucagg

SEQ ID NO: 3354521 - RNA, 23 nt, Neisseria meningitidis Z2491
cgguugcguaucaaaaaauaaag

SEQ ID NO: 3354522 - RNA, 17 nt, Neisseria meningitidis Z2491
cgguuggaaggcggcgg

SEQ ID NO: 3354523 - RNA, 19 nt, Neisseria meningitidis Z2491
cgguuuaaaguuaauccac

SEQ ID NO: 3354524 - RNA, 20 nt, Neisseria meningitidis Z2491
cgguuuaaauuuaauccacu

SEQ ID NO: 3354525 - RNA, 14 nt, Neisseria meningitidis Z2491
cgguuuccaacuga

SEQ ID NO: 3354526 - RNA, 14 nt, Neisseria meningitidis Z2491
cgguuugccgucug

SEQ ID NO: 3354527 - RNA, 15 nt, Neisseria meningitidis Z2491
cgguuugccgucuga

SEQ ID NO: 3354528 - RNA, 16 nt, Neisseria meningitidis Z2491
cgguuugguuuucaaa

SEQ ID NO: 3354529 - RNA, 13 nt, Neisseria meningitidis Z2491
cgguuuucagacg

SEQ ID NO: 3354530 - RNA, 19 nt, Neisseria meningitidis Z2491
cgguuuuccccuguaaaca

SEQ ID NO: 3354531 - RNA, 21 nt, Neisseria meningitidis Z2491
cgguuuuccccuguaaacaga

SEQ ID NO: 3354532 - RNA, 14 nt, Neisseria meningitidis Z2491
cgguuuucuauuuu

SEQ ID NO: 3354533 - RNA, 16 nt, Neisseria meningitidis Z2491
cgguuuuuguucaucc

SEQ ID NO: 3354534 - RNA, 18 nt, Neisseria meningitidis Z2491
cgguuuuuuugcgaauaa

SEQ ID NO: 3354535 - RNA, 14 nt, Neisseria meningitidis Z2491
cguaaacgaauuuc

SEQ ID NO: 3354536 - RNA, 19 nt, Neisseria meningitidis Z2491
cguaaauuguccauuuuuc

SEQ ID NO: 3354537 - RNA, 16 nt, Neisseria meningitidis Z2491
cguaacaaugcggaaa

SEQ ID NO: 3354538 - RNA, 15 nt, Neisseria meningitidis Z2491
cguaacccauucacc

SEQ ID NO: 3354539 - RNA, 15 nt, Neisseria meningitidis Z2491
cguaauagccugaca

SEQ ID NO: 3354540 - RNA, 19 nt, Neisseria meningitidis Z2491
cguaauuccggcagccugc

SEQ ID NO: 3354541 - RNA, 13 nt, Neisseria meningitidis Z2491
cguaauuuuucuc

SEQ ID NO: 3354542 - RNA, 13 nt, Neisseria meningitidis Z2491
cguaccaaaaccg

SEQ ID NO: 3354543 - RNA, 19 nt, Neisseria meningitidis Z2491
cguaccaaccguccacaca

SEQ ID NO: 3354544 - RNA, 13 nt, Neisseria meningitidis Z2491
cguacccacgccc

SEQ ID NO: 3354545 - RNA, 18 nt, Neisseria meningitidis Z2491
cguacgcaggcuggggau

SEQ ID NO: 3354546 - RNA, 12 nt, Neisseria meningitidis Z2491
cguaggaaugac

SEQ ID NO: 3354547 - RNA, 14 nt, Neisseria meningitidis Z2491
cguaggcggcggcc

SEQ ID NO: 3354548 - RNA, 18 nt, Neisseria meningitidis Z2491
cguauauucugcaaaaau

SEQ ID NO: 3354549 - RNA, 12 nt, Neisseria meningitidis Z2491
cguauauuuccc

SEQ ID NO: 3354550 - RNA, 16 nt, Neisseria meningitidis Z2491
cguaucaaaaaauaaa

SEQ ID NO: 3354551 - RNA, 13 nt, Neisseria meningitidis Z2491
cguauccagccgc

SEQ ID NO: 3354552 - RNA, 17 nt, Neisseria meningitidis Z2491
cguauccagccgccauc

SEQ ID NO: 3354553 - RNA, 21 nt, Neisseria meningitidis Z2491
cguauccauagauaaauuuca

SEQ ID NO: 3354554 - RNA, 15 nt, Neisseria meningitidis Z2491
cguaucggcggcaag

SEQ ID NO: 3354555 - RNA, 21 nt, Neisseria meningitidis Z2491
cguaugaaacaauccgcccga

SEQ ID NO: 3354556 - RNA, 13 nt, Neisseria meningitidis Z2491
cguaugcaaaaac

SEQ ID NO: 3354557 - RNA, 14 nt, Neisseria meningitidis Z2491
cguaugcaaaaaca

SEQ ID NO: 3354558 - RNA, 17 nt, Neisseria meningitidis Z2491
cguaugccgccugccug

SEQ ID NO: 3354559 - RNA, 14 nt, Neisseria meningitidis Z2491
cguauuugagugcg

SEQ ID NO: 3354560 - RNA, 19 nt, Neisseria meningitidis Z2491
cguauuugagugcggcaag

SEQ ID NO: 3354561 - RNA, 15 nt, Neisseria meningitidis Z2491
cgucaaacaacauca

SEQ ID NO: 3354562 - RNA, 21 nt, Neisseria meningitidis Z2491
cgucaaauuucguuaacagac

SEQ ID NO: 3354563 - RNA, 13 nt, Neisseria meningitidis Z2491
cgucaacacaaaa

SEQ ID NO: 3354564 - RNA, 17 nt, Neisseria meningitidis Z2491
cgucaacacaaaauaaa

SEQ ID NO: 3354565 - RNA, 20 nt, Neisseria meningitidis Z2491
cgucagcgauacaucucugg

SEQ ID NO: 3354566 - RNA, 18 nt, Neisseria meningitidis Z2491
cgucaggcacgaagcccu

SEQ ID NO: 3354567 - RNA, 21 nt, Neisseria meningitidis Z2491
cgucaggcacgcgcugcggca

SEQ ID NO: 3354568 - RNA, 12 nt, Neisseria meningitidis Z2491
cgucauucccac

SEQ ID NO: 3354569 - RNA, 21 nt, Neisseria meningitidis Z2491
cgucauucccgugcaggcggg

SEQ ID NO: 3354570 - RNA, 22 nt, Neisseria meningitidis Z2491
cgucauuccucaaaaacagaaa

SEQ ID NO: 3354571 - RNA, 16 nt, Neisseria meningitidis Z2491
cgucccaaacaauccc

SEQ ID NO: 3354572 - RNA, 18 nt, Neisseria meningitidis Z2491
cguccguaccgcgcgcca

SEQ ID NO: 3354573 - RNA, 17 nt, Neisseria meningitidis Z2491
cgucgaagaaguggguc

SEQ ID NO: 3354574 - RNA, 14 nt, Neisseria meningitidis Z2491
cgucggcaagguuu

SEQ ID NO: 3354575 - RNA, 21 nt, Neisseria meningitidis Z2491
cgucggcagucuguaccgcau

SEQ ID NO: 3354576 - RNA, 16 nt, Neisseria meningitidis Z2491
cgucgggauucagaug

SEQ ID NO: 3354577 - RNA, 12 nt, Neisseria meningitidis Z2491
cgucuauuuucg

SEQ ID NO: 3354578 - RNA, 20 nt, Neisseria meningitidis Z2491
cgucugaaaagauauuguuc

SEQ ID NO: 3354579 - RNA, 20 nt, Neisseria meningitidis Z2491
cuaaaauucgucauucccgc

SEQ ID NO: 3354580 - RNA, 21 nt, Neisseria meningitidis Z2491
cuaaaauuucgucauucccgc

SEQ ID NO: 3354581 - RNA, 15 nt, Neisseria meningitidis Z2491
cuaaaauuuuaugcu

SEQ ID NO: 3354582 - RNA, 15 nt, Neisseria meningitidis Z2491
cuaaacuuucagaua

SEQ ID NO: 3354583 - RNA, 13 nt, Neisseria meningitidis Z2491
cuaaagaaaccgu

SEQ ID NO: 3354584 - RNA, 16 nt, Neisseria meningitidis Z2491
cuaaaggcuucagacg

SEQ ID NO: 3354585 - RNA, 20 nt, Neisseria meningitidis Z2491
cuaaauacaaaaggccgucu

SEQ ID NO: 3354586 - RNA, 17 nt, Neisseria meningitidis Z2491
cuaaauagcguuuuaau

SEQ ID NO: 3354587 - RNA, 20 nt, Neisseria meningitidis Z2491
cuaaauagcugaaacucaac

SEQ ID NO: 3354588 - RNA, 20 nt, Neisseria meningitidis Z2491
cuaaauugcauuuuuaauuu

SEQ ID NO: 3354589 - RNA, 22 nt, Neisseria meningitidis Z2491
cuaacaaauaauguucaaugaa

SEQ ID NO: 3354590 - RNA, 15 nt, Neisseria meningitidis Z2491
cuaaccgaaaauaau

SEQ ID NO: 3354591 - RNA, 21 nt, Neisseria meningitidis Z2491
cuaaccgaaaauaauugccuu

SEQ ID NO: 3354592 - RNA, 14 nt, Neisseria meningitidis Z2491
cuaacucuauuucc

SEQ ID NO: 3354593 - RNA, 12 nt, Neisseria meningitidis Z2491
cuaagaaaccgu

SEQ ID NO: 3354594 - RNA, 15 nt, Neisseria meningitidis Z2491
cuaagauauaacuuu

SEQ ID NO: 3354595 - RNA, 20 nt, Neisseria meningitidis Z2491
cuaagcgucccgacgcuugu

SEQ ID NO: 3354596 - RNA, 12 nt, Neisseria meningitidis Z2491
cuaaggcgagcc

SEQ ID NO: 3354597 - RNA, 13 nt, Neisseria meningitidis Z2491
cuaaggcgaggca

SEQ ID NO: 3354598 - RNA, 18 nt, Neisseria meningitidis Z2491
cuaaggcgaggcaacgac

SEQ ID NO: 3354599 - RNA, 18 nt, Neisseria meningitidis Z2491
cuaaggucuagauucccg

SEQ ID NO: 3354600 - RNA, 18 nt, Neisseria meningitidis Z2491
cuaaucccgucauuccca

SEQ ID NO: 3354601 - RNA, 17 nt, Neisseria meningitidis Z2491
cuaaugcuuucgcuuuu

SEQ ID NO: 3354602 - RNA, 15 nt, Neisseria meningitidis Z2491
cuaauucgugauucc

SEQ ID NO: 3354603 - RNA, 16 nt, Neisseria meningitidis Z2491
cuaauucuacccaaau

SEQ ID NO: 3354604 - RNA, 13 nt, Neisseria meningitidis Z2491
cuaauuuuuauag

SEQ ID NO: 3354605 - RNA, 17 nt, Neisseria meningitidis Z2491
cuaauuuuuauagugga

SEQ ID NO: 3354606 - RNA, 17 nt, Neisseria meningitidis Z2491
cuacauuccgucauucc

SEQ ID NO: 3354607 - RNA, 16 nt, Neisseria meningitidis Z2491
cuacccaaaaggaagu

SEQ ID NO: 3354608 - RNA, 16 nt, Neisseria meningitidis Z2491
cuacccaaauaccccc

SEQ ID NO: 3354609 - RNA, 21 nt, Neisseria meningitidis Z2491
cuacccgguuuugcgccucgc

SEQ ID NO: 3354610 - RNA, 21 nt, Neisseria meningitidis Z2491
cuacgacucgcuugcugguaa

SEQ ID NO: 3354611 - RNA, 18 nt, Neisseria meningitidis Z2491
cuacgcgggaaugacgag

SEQ ID NO: 3354612 - RNA, 18 nt, Neisseria meningitidis Z2491
cuacggcucguuuaauua

SEQ ID NO: 3354613 - RNA, 17 nt, Neisseria meningitidis Z2491
cuacguucuagauuccc

SEQ ID NO: 3354614 - RNA, 18 nt, Neisseria meningitidis Z2491
cuacguucuagauucccg

SEQ ID NO: 3354615 - RNA, 17 nt, Neisseria meningitidis Z2491
cuacuguaaaucgucau

SEQ ID NO: 3354616 - RNA, 15 nt, Neisseria meningitidis Z2491
cuacuucauuuuuuc

SEQ ID NO: 3354617 - RNA, 19 nt, Neisseria meningitidis Z2491
cuacuucauuuuuucaagc

SEQ ID NO: 3354618 - RNA, 17 nt, Neisseria meningitidis Z2491
cuagaaacgcaaagcug

SEQ ID NO: 3354619 - RNA, 15 nt, Neisseria meningitidis Z2491
cuagaaacucaaagc

SEQ ID NO: 3354620 - RNA, 23 nt, Neisseria meningitidis Z2491
cuagaaucucguuauuuccacaa

SEQ ID NO: 3354621 - RNA, 16 nt, Neisseria meningitidis Z2491
cuagacauucaaugcu

SEQ ID NO: 3354622 - RNA, 21 nt, Neisseria meningitidis Z2491
cuagacauucaaugcuaaggc

SEQ ID NO: 3354623 - RNA, 11 nt, Neisseria meningitidis Z2491
cuagauuccca

SEQ ID NO: 3354624 - RNA, 11 nt, Neisseria meningitidis Z2491
cuagauucccg

SEQ ID NO: 3354625 - RNA, 14 nt, Neisseria meningitidis Z2491
cuagauucccgccu

SEQ ID NO: 3354626 - RNA, 21 nt, Neisseria meningitidis Z2491
cuagauucccgccugcgcggg

SEQ ID NO: 3354627 - RNA, 21 nt, Neisseria meningitidis Z2491
cuagauucccgcuuuugcggg

SEQ ID NO: 3354628 - RNA, 12 nt, Neisseria meningitidis Z2491
cuagauucccgu

SEQ ID NO: 3354629 - RNA, 16 nt, Neisseria meningitidis Z2491
cuaggacacugcccuu

SEQ ID NO: 3354630 - RNA, 12 nt, Neisseria meningitidis Z2491
cuagggaaaugc

SEQ ID NO: 3354631 - RNA, 22 nt, Neisseria meningitidis Z2491
cuaggggcgguuugcggcggca

SEQ ID NO: 3354632 - RNA, 23 nt, Neisseria meningitidis Z2491
cuaggggcgguuugcggcggcaa

SEQ ID NO: 3354633 - RNA, 21 nt, Neisseria meningitidis Z2491
cuauaaaaggucuuuucuaaa

SEQ ID NO: 3354634 - RNA, 22 nt, Neisseria meningitidis Z2491
cuauaaaauuggaaaugacgac

SEQ ID NO: 3354635 - RNA, 13 nt, Neisseria meningitidis Z2491
cuauaauacaaaa

SEQ ID NO: 3354636 - RNA, 20 nt, Neisseria meningitidis Z2491
cuauaauacauugauuuuua

SEQ ID NO: 3354637 - RNA, 20 nt, Neisseria meningitidis Z2491
cuauaauccaccauauuuga

SEQ ID NO: 3354638 - RNA, 15 nt, Neisseria meningitidis Z2491
cuauacaucccguca

SEQ ID NO: 3354639 - RNA, 18 nt, Neisseria meningitidis Z2491
cuauaccaaacggcauau

SEQ ID NO: 3354640 - RNA, 14 nt, Neisseria meningitidis Z2491
cuauacuaaaaccg

SEQ ID NO: 3354641 - RNA, 17 nt, Neisseria meningitidis Z2491
cuauacuguaaucaggg

SEQ ID NO: 3354642 - RNA, 15 nt, Neisseria meningitidis Z2491
cuauaguauagugga

SEQ ID NO: 3354643 - RNA, 19 nt, Neisseria meningitidis Z2491
cuauaguggauuaacaaaa

SEQ ID NO: 3354644 - RNA, 17 nt, Neisseria meningitidis Z2491
cuauaucgucauucccg

SEQ ID NO: 3354645 - RNA, 14 nt, Neisseria meningitidis Z2491
cuaucccuuaagaa

SEQ ID NO: 3354646 - RNA, 18 nt, Neisseria meningitidis Z2491
cuauccgcacagaaaccu

SEQ ID NO: 3354647 - RNA, 21 nt, Neisseria meningitidis Z2491
cuauccgcacagaaaccugca

SEQ ID NO: 3354648 - RNA, 12 nt, Neisseria meningitidis Z2491
cuauguuaugug

SEQ ID NO: 3354649 - RNA, 19 nt, Neisseria meningitidis Z2491
cuauuaccgguauuuuuuu

SEQ ID NO: 3354650 - RNA, 22 nt, Neisseria meningitidis Z2491
cuauuacgaacaggacaaaaau

SEQ ID NO: 3354651 - RNA, 10 nt, Neisseria meningitidis Z2491
cuauugccuu

SEQ ID NO: 3354652 - RNA, 17 nt, Neisseria meningitidis Z2491
cuauugccuuuauugug

SEQ ID NO: 3354653 - RNA, 22 nt, Neisseria meningitidis Z2491
cuauuuguacugucugcggcuc

SEQ ID NO: 3354654 - RNA, 20 nt, Neisseria meningitidis Z2491
cuauuuguucgauauuuuug

SEQ ID NO: 3354655 - RNA, 18 nt, Neisseria meningitidis Z2491
cuauuuucagauggccuu

SEQ ID NO: 3354656 - RNA, 21 nt, Neisseria meningitidis Z2491
cuauuuuucugaaaaauuuau

SEQ ID NO: 3354657 - RNA, 10 nt, Neisseria meningitidis Z2491
cuauuuuugu

SEQ ID NO: 3354658 - RNA, 14 nt, Neisseria meningitidis Z2491
cucaaaaaaacuag

SEQ ID NO: 3354659 - RNA, 22 nt, Neisseria meningitidis Z2491
cucaaaaaaacuagauucccac

SEQ ID NO: 3354660 - RNA, 21 nt, Neisseria meningitidis Z2491
cucaaaaaaccggauucccgc

SEQ ID NO: 3354661 - RNA, 23 nt, Neisseria meningitidis Z2491
cucaaaaaaccggauucccgccu

SEQ ID NO: 3354662 - RNA, 21 nt, Neisseria meningitidis Z2491
cucaaaaaacuggauucccac

SEQ ID NO: 3354663 - RNA, 12 nt, Neisseria meningitidis Z2491
cucaaaaacaga

SEQ ID NO: 3354664 - RNA, 14 nt, Neisseria meningitidis Z2491
cucaaaaacagaaa

SEQ ID NO: 3354665 - RNA, 17 nt, Neisseria meningitidis Z2491
cucaaaaacagaaaacc

SEQ ID NO: 3354666 - RNA, 18 nt, Neisseria meningitidis Z2491
cucaaaaacagaaaacca

SEQ ID NO: 3354667 - RNA, 19 nt, Neisseria meningitidis Z2491
cucaaaaacagaaaaccaa

SEQ ID NO: 3354668 - RNA, 19 nt, Neisseria meningitidis Z2491
cucaaaaagcuggauuccc

SEQ ID NO: 3354669 - RNA, 22 nt, Neisseria meningitidis Z2491
cucaaacagcaggucgacggca

SEQ ID NO: 3354670 - RNA, 14 nt, Neisseria meningitidis Z2491
cucaaagagaacga

SEQ ID NO: 3354671 - RNA, 14 nt, Neisseria meningitidis Z2491
cucaaauaaaaugc

SEQ ID NO: 3354672 - RNA, 14 nt, Neisseria meningitidis Z2491
cucaaauaggcauu

SEQ ID NO: 3354673 - RNA, 14 nt, Neisseria meningitidis Z2491
cucaaaucccguca

SEQ ID NO: 3354674 - RNA, 17 nt, Neisseria meningitidis Z2491
cucaacagcuuaaaauc

SEQ ID NO: 3354675 - RNA, 17 nt, Neisseria meningitidis Z2491
cucaaccuguuuuucaa

SEQ ID NO: 3354676 - RNA, 19 nt, Neisseria meningitidis Z2491
cucaacgaaccuggauucc

SEQ ID NO: 3354677 - RNA, 13 nt, Neisseria meningitidis Z2491
cucaagaaaccgu

SEQ ID NO: 3354678 - RNA, 13 nt, Neisseria meningitidis Z2491
cucaagacaauca

SEQ ID NO: 3354679 - RNA, 23 nt, Neisseria meningitidis Z2491
cucaauaagucugcgaaacagac

SEQ ID NO: 3354680 - RNA, 20 nt, Neisseria meningitidis Z2491
cugaacccuuugggcguuca

SEQ ID NO: 3354681 - RNA, 20 nt, Neisseria meningitidis Z2491
cugaaccuguguucagacgg

SEQ ID NO: 3354682 - RNA, 16 nt, Neisseria meningitidis Z2491
cugaaccuuauagugg

SEQ ID NO: 3354683 - RNA, 16 nt, Neisseria meningitidis Z2491
cugaacgcuucagacg

SEQ ID NO: 3354684 - RNA, 19 nt, Neisseria meningitidis Z2491
cugaagcaccaaguaaauc

SEQ ID NO: 3354685 - RNA, 18 nt, Neisseria meningitidis Z2491
cugaagccagccccacca

SEQ ID NO: 3354686 - RNA, 22 nt, Neisseria meningitidis Z2491
cugaagccagccccaccauugu

SEQ ID NO: 3354687 - RNA, 14 nt, Neisseria meningitidis Z2491
cugaagcccacccu

SEQ ID NO: 3354688 - RNA, 20 nt, Neisseria meningitidis Z2491
cugaagcccacccuaccauu

SEQ ID NO: 3354689 - RNA, 22 nt, Neisseria meningitidis Z2491
cugaagcccacccuaccauugu

SEQ ID NO: 3354690 - RNA, 20 nt, Neisseria meningitidis Z2491
cugaagcccuguuucggguu

SEQ ID NO: 3354691 - RNA, 21 nt, Neisseria meningitidis Z2491
cugaagccgcuucagacggca

SEQ ID NO: 3354692 - RNA, 16 nt, Neisseria meningitidis Z2491
cugaagccuucagaca

SEQ ID NO: 3354693 - RNA, 19 nt, Neisseria meningitidis Z2491
cugaagccuucagacaaca

SEQ ID NO: 3354694 - RNA, 20 nt, Neisseria meningitidis Z2491
cugaagccuucagacaacaa

SEQ ID NO: 3354695 - RNA, 16 nt, Neisseria meningitidis Z2491
cugaagccuucagacg

SEQ ID NO: 3354696 - RNA, 19 nt, Neisseria meningitidis Z2491
cugaagccuucagacggca

SEQ ID NO: 3354697 - RNA, 14 nt, Neisseria meningitidis Z2491
cugaagcguauuuc

SEQ ID NO: 3354698 - RNA, 16 nt, Neisseria meningitidis Z2491
cugaagcguauuucua

SEQ ID NO: 3354699 - RNA, 12 nt, Neisseria meningitidis Z2491
cugaagcguguu

SEQ ID NO: 3354700 - RNA, 18 nt, Neisseria meningitidis Z2491
cugaagcucaaaaaaccg

SEQ ID NO: 3354701 - RNA, 12 nt, Neisseria meningitidis Z2491
cugaaggcuuca

SEQ ID NO: 3354702 - RNA, 21 nt, Neisseria meningitidis Z2491
cugaaucagguugaaaaugcc

SEQ ID NO: 3354703 - RNA, 23 nt, Neisseria meningitidis Z2491
cugaaugcccauuuguuggaugu

SEQ ID NO: 3354704 - RNA, 21 nt, Neisseria meningitidis Z2491
cugaauugacaugguauagag

SEQ ID NO: 3354705 - RNA, 13 nt, Neisseria meningitidis Z2491
cugaauugcuuga

SEQ ID NO: 3354706 - RNA, 11 nt, Neisseria meningitidis Z2491
cugacaaacag

SEQ ID NO: 3354707 - RNA, 16 nt, Neisseria meningitidis Z2491
cugacagcauuuccac

SEQ ID NO: 3354708 - RNA, 13 nt, Neisseria meningitidis Z2491
cugacaggaaauu

SEQ ID NO: 3354709 - RNA, 17 nt, Neisseria meningitidis Z2491
cugacaggaaauuucca

SEQ ID NO: 3354710 - RNA, 20 nt, Neisseria meningitidis Z2491
cugacaggaaauuuccaaau

SEQ ID NO: 3354711 - RNA, 22 nt, Neisseria meningitidis Z2491
cugaccguguuuccaaggcagc

SEQ ID NO: 3354712 - RNA, 14 nt, Neisseria meningitidis Z2491
cugacgaaaccaga

SEQ ID NO: 3354713 - RNA, 18 nt, Neisseria meningitidis Z2491
cugacgcguuuuaccugc

SEQ ID NO: 3354714 - RNA, 15 nt, Neisseria meningitidis Z2491
cugacggacacgccc

SEQ ID NO: 3354715 - RNA, 15 nt, Neisseria meningitidis Z2491
cugacggucugcaaa

SEQ ID NO: 3354716 - RNA, 14 nt, Neisseria meningitidis Z2491
cugacguaaaaaac

SEQ ID NO: 3354717 - RNA, 20 nt, Neisseria meningitidis Z2491
cugacuaaccgaaaauaauu

SEQ ID NO: 3354718 - RNA, 19 nt, Neisseria meningitidis Z2491
cugacuagguaauacauaa

SEQ ID NO: 3354719 - RNA, 16 nt, Neisseria meningitidis Z2491
cugagaacuucagacg

SEQ ID NO: 3354720 - RNA, 13 nt, Neisseria meningitidis Z2491
cugauaaaaaaua

SEQ ID NO: 3354721 - RNA, 18 nt, Neisseria meningitidis Z2491
cugauaguugccgucaaa

SEQ ID NO: 3354722 - RNA, 19 nt, Neisseria meningitidis Z2491
cugaugaugauggcggcaa

SEQ ID NO: 3354723 - RNA, 18 nt, Neisseria meningitidis Z2491
cugaugauuuuuucaaca

SEQ ID NO: 3354724 - RNA, 19 nt, Neisseria meningitidis Z2491
cugaugauuuuuucaacac

SEQ ID NO: 3354725 - RNA, 17 nt, Neisseria meningitidis Z2491
cugauggccgguaaaca

SEQ ID NO: 3354726 - RNA, 20 nt, Neisseria meningitidis Z2491
cugauggcugaugacggcag

SEQ ID NO: 3354727 - RNA, 15 nt, Neisseria meningitidis Z2491
cugauucuaccgccc

SEQ ID NO: 3354728 - RNA, 20 nt, Neisseria meningitidis Z2491
cugauugaccgaaaaauaau

SEQ ID NO: 3354729 - RNA, 18 nt, Neisseria meningitidis Z2491
cugauuuaaauuuaaucc

SEQ ID NO: 3354730 - RNA, 20 nt, Neisseria meningitidis Z2491
cugauuuaaauuuaauccac

SEQ ID NO: 3354731 - RNA, 20 nt, Neisseria meningitidis Z2491
cugauuuaaauuuaauccgc

SEQ ID NO: 3354732 - RNA, 21 nt, Neisseria meningitidis Z2491
cugauuuaaauuuaauccgcu

SEQ ID NO: 3354733 - RNA, 14 nt, Neisseria meningitidis Z2491
cugauuuauuuccu

SEQ ID NO: 3354734 - RNA, 17 nt, Neisseria meningitidis Z2491
cugauuucguaauccgc

SEQ ID NO: 3354735 - RNA, 16 nt, Neisseria meningitidis Z2491
cugauuuuguuuuuga

SEQ ID NO: 3354736 - RNA, 17 nt, Neisseria meningitidis Z2491
cugauuuuguuuuugag

SEQ ID NO: 3354737 - RNA, 22 nt, Neisseria meningitidis Z2491
cugauuuuguuuuugagagaau

SEQ ID NO: 3354738 - RNA, 15 nt, Neisseria meningitidis Z2491
cugauuuuuccuacu

SEQ ID NO: 3354739 - RNA, 20 nt, Neisseria meningitidis Z2491
cugauuuuuguuaauccacu

SEQ ID NO: 3354740 - RNA, 23 nt, Neisseria meningitidis Z2491
cugcaaaacaucguuugcauucu

SEQ ID NO: 3354741 - RNA, 15 nt, Neisseria meningitidis Z2491
cugcaagaauuuauc

SEQ ID NO: 3354742 - RNA, 23 nt, Neisseria meningitidis Z2491
cugcaagaauuuaucggaaauga

SEQ ID NO: 3354743 - RNA, 17 nt, Neisseria meningitidis Z2491
cugcaagcagcaggcgu

SEQ ID NO: 3354744 - RNA, 22 nt, Neisseria meningitidis Z2491
cugcaagcagcaggcguucgga

SEQ ID NO: 3354745 - RNA, 17 nt, Neisseria meningitidis Z2491
cugcaaggcgaggcaac

SEQ ID NO: 3354746 - RNA, 19 nt, Neisseria meningitidis Z2491
cugcaccacgucauuccca

SEQ ID NO: 3354747 - RNA, 23 nt, Neisseria meningitidis Z2491
cugcacgaaaggaugguuuugcg

SEQ ID NO: 3354748 - RNA, 18 nt, Neisseria meningitidis Z2491
cugcacgcgcuucaaauc

SEQ ID NO: 3354749 - RNA, 18 nt, Neisseria meningitidis Z2491
cugcagccgucauucccg

SEQ ID NO: 3354750 - RNA, 19 nt, Neisseria meningitidis Z2491
cugcagccgucauucccgc

SEQ ID NO: 3354751 - RNA, 20 nt, Neisseria meningitidis Z2491
cugcagcuucgucgccuugu

SEQ ID NO: 3354752 - RNA, 21 nt, Neisseria meningitidis Z2491
cugcaggugcagcggaaaugg

SEQ ID NO: 3354753 - RNA, 22 nt, Neisseria meningitidis Z2491
cugcaggugcagcggaaauggu

SEQ ID NO: 3354754 - RNA, 20 nt, Neisseria meningitidis Z2491
cugcaguaacuucaaacccc

SEQ ID NO: 3354755 - RNA, 14 nt, Neisseria meningitidis Z2491
cugcaguugggcga

SEQ ID NO: 3354756 - RNA, 14 nt, Neisseria meningitidis Z2491
cugcauauaggcaa

SEQ ID NO: 3354757 - RNA, 20 nt, Neisseria meningitidis Z2491
cugcaucccgucauucccgc

SEQ ID NO: 3354758 - RNA, 18 nt, Neisseria meningitidis Z2491
cugccaauagaauuuaua

SEQ ID NO: 3354759 - RNA, 17 nt, Neisseria meningitidis Z2491
cugccacauuuguucca

SEQ ID NO: 3354760 - RNA, 22 nt, Neisseria meningitidis Z2491
cugccagucuuuaaauucaacu

SEQ ID NO: 3354761 - RNA, 12 nt, Neisseria meningitidis Z2491
cugccauuaguu

SEQ ID NO: 3354762 - RNA, 19 nt, Neisseria meningitidis Z2491
cugcccaaauccagcaaug

SEQ ID NO: 3354763 - RNA, 21 nt, Neisseria meningitidis Z2491
cugccccguuuuacccucucc

SEQ ID NO: 3354764 - RNA, 18 nt, Neisseria meningitidis Z2491
cugcccgaaugcggggaa

SEQ ID NO: 3354765 - RNA, 15 nt, Neisseria meningitidis Z2491
cugcccgacagccgc

SEQ ID NO: 3354766 - RNA, 17 nt, Neisseria meningitidis Z2491
cugcccgcuuuugaguu

SEQ ID NO: 3354767 - RNA, 20 nt, Neisseria meningitidis Z2491
cugcccguauuugagugcgg

SEQ ID NO: 3354768 - RNA, 21 nt, Neisseria meningitidis Z2491
cugcccguauuugagugcggc

SEQ ID NO: 3354769 - RNA, 15 nt, Neisseria meningitidis Z2491
cugccgcacaagccc

SEQ ID NO: 3354770 - RNA, 16 nt, Neisseria meningitidis Z2491
cugccgcacaagcccu

SEQ ID NO: 3354771 - RNA, 13 nt, Neisseria meningitidis Z2491
cugccgccccauu

SEQ ID NO: 3354772 - RNA, 19 nt, Neisseria meningitidis Z2491
cugccgccgcccgggccgg

SEQ ID NO: 3354773 - RNA, 14 nt, Neisseria meningitidis Z2491
cugccgccgcgccu

SEQ ID NO: 3354774 - RNA, 11 nt, Neisseria meningitidis Z2491
cugccggcaaa

SEQ ID NO: 3354775 - RNA, 14 nt, Neisseria meningitidis Z2491
cugccguauuuauu

SEQ ID NO: 3354776 - RNA, 16 nt, Neisseria meningitidis Z2491
cugccgucauucccgc

SEQ ID NO: 3354777 - RNA, 23 nt, Neisseria meningitidis Z2491
cugccgucauucccgcaaaagcg

SEQ ID NO: 3354778 - RNA, 20 nt, Neisseria meningitidis Z2491
cugccgucauucccgcgcag

SEQ ID NO: 3354779 - RNA, 18 nt, Neisseria meningitidis Z2491
cugccgugaugccccaau

SEQ ID NO: 3354780 - RNA, 17 nt, Neisseria meningitidis Z2491
cugccgugggugcuuug

SEQ ID NO: 3354781 - RNA, 21 nt, Neisseria meningitidis Z2491
cuguuuucgcgggaauccggu

SEQ ID NO: 3354782 - RNA, 14 nt, Neisseria meningitidis Z2491
cuguuuucuguuug

SEQ ID NO: 3354783 - RNA, 18 nt, Neisseria meningitidis Z2491
cuguuuuuagucuuuuuu

SEQ ID NO: 3354784 - RNA, 18 nt, Neisseria meningitidis Z2491
cuguuuuucaaagcccaa

SEQ ID NO: 3354785 - RNA, 17 nt, Neisseria meningitidis Z2491
cuguuuuuccgacaaau

SEQ ID NO: 3354786 - RNA, 19 nt, Neisseria meningitidis Z2491
cuguuuuugagggaaugac

SEQ ID NO: 3354787 - RNA, 19 nt, Neisseria meningitidis Z2491
cuguuuuugugggaaugac

SEQ ID NO: 3354788 - RNA, 12 nt, Neisseria meningitidis Z2491
cuguuuuuuccg

SEQ ID NO: 3354789 - RNA, 21 nt, Neisseria meningitidis Z2491
cuuaaaaccucgucauucccg

SEQ ID NO: 3354790 - RNA, 22 nt, Neisseria meningitidis Z2491
cuuaaaaccucgucauucccgc

SEQ ID NO: 3354791 - RNA, 17 nt, Neisseria meningitidis Z2491
cuuaacagggaaagcag

SEQ ID NO: 3354792 - RNA, 21 nt, Neisseria meningitidis Z2491
cuuaacagggaaagcagcagc

SEQ ID NO: 3354793 - RNA, 24 nt, Neisseria meningitidis Z2491
cuuaacagggaaagcagcagcccu

SEQ ID NO: 3354794 - RNA, 23 nt, Neisseria meningitidis Z2491
cuuaacccugaacauaaaugccg

SEQ ID NO: 3354795 - RNA, 20 nt, Neisseria meningitidis Z2491
cuuaagauuuguggcggauu

SEQ ID NO: 3354796 - RNA, 15 nt, Neisseria meningitidis Z2491
cuuaauacguuuuuc

SEQ ID NO: 3354797 - RNA, 16 nt, Neisseria meningitidis Z2491
cuuaauacguuuuucu

SEQ ID NO: 3354798 - RNA, 13 nt, Neisseria meningitidis Z2491
cuuaauccucucc

SEQ ID NO: 3354799 - RNA, 15 nt, Neisseria meningitidis Z2491
cuuacaauccgcuuu

SEQ ID NO: 3354800 - RNA, 16 nt, Neisseria meningitidis Z2491
cuuacaauccgcuuuu

SEQ ID NO: 3354801 - RNA, 19 nt, Neisseria meningitidis Z2491
cuuacaauccgcuuuuuaa

SEQ ID NO: 3354802 - RNA, 20 nt, Neisseria meningitidis Z2491
cuuacccgcuuuuuucagau

SEQ ID NO: 3354803 - RNA, 20 nt, Neisseria meningitidis Z2491
cuuacggauggcauagccgc

SEQ ID NO: 3354804 - RNA, 16 nt, Neisseria meningitidis Z2491
cuuagaacaacaguaa

SEQ ID NO: 3354805 - RNA, 21 nt, Neisseria meningitidis Z2491
cuuagaaggugggucaauggg

SEQ ID NO: 3354806 - RNA, 19 nt, Neisseria meningitidis Z2491
cuuauagucugagacggcg

SEQ ID NO: 3354807 - RNA, 20 nt, Neisseria meningitidis Z2491
cuuauaguggauuaaauuua

SEQ ID NO: 3354808 - RNA, 10 nt, Neisseria meningitidis Z2491
cuuauccaca

SEQ ID NO: 3354809 - RNA, 13 nt, Neisseria meningitidis Z2491
cuuauccauccca

SEQ ID NO: 3354810 - RNA, 17 nt, Neisseria meningitidis Z2491
cuuaucuaaaggaaugg

SEQ ID NO: 3354811 - RNA, 19 nt, Neisseria meningitidis Z2491
cuuaugcuucggucagguu

SEQ ID NO: 3354812 - RNA, 14 nt, Neisseria meningitidis Z2491
cuuauguuuaauca

SEQ ID NO: 3354813 - RNA, 17 nt, Neisseria meningitidis Z2491
cuuauuuaucaaaacag

SEQ ID NO: 3354814 - RNA, 16 nt, Neisseria meningitidis Z2491
cuuauuucacuuccaa

SEQ ID NO: 3354815 - RNA, 12 nt, Neisseria meningitidis Z2491
cuucaaaggaaa

SEQ ID NO: 3354816 - RNA, 19 nt, Neisseria meningitidis Z2491
cuucaacaccugcagauug

SEQ ID NO: 3354817 - RNA, 15 nt, Neisseria meningitidis Z2491
cuucaacagacggcg

SEQ ID NO: 3354818 - RNA, 19 nt, Neisseria meningitidis Z2491
cuucaaccacgcuucugau

SEQ ID NO: 3354819 - RNA, 21 nt, Neisseria meningitidis Z2491
cuucacacguucgcaggcuuc

SEQ ID NO: 3354820 - RNA, 22 nt, Neisseria meningitidis Z2491
cuucacgccgccgcgccccaag

SEQ ID NO: 3354821 - RNA, 13 nt, Neisseria meningitidis Z2491
cuucagacggcau

SEQ ID NO: 3354822 - RNA, 18 nt, Neisseria meningitidis Z2491
cuucagacggcauuuuuc

SEQ ID NO: 3354823 - RNA, 18 nt, Neisseria meningitidis Z2491
cuucagacggcauuuuuu

SEQ ID NO: 3354824 - RNA, 19 nt, Neisseria meningitidis Z2491
cuucagacggcauuuuuua

SEQ ID NO: 3354825 - RNA, 16 nt, Neisseria meningitidis Z2491
cuucagauggcuuugu

SEQ ID NO: 3354826 - RNA, 14 nt, Neisseria meningitidis Z2491
cuucagcucucccu

SEQ ID NO: 3354827 - RNA, 23 nt, Neisseria meningitidis Z2491
cuucaggauguuuucggcauggc

SEQ ID NO: 3354828 - RNA, 22 nt, Neisseria meningitidis Z2491
cuucaguuccaucgcgucuuca

SEQ ID NO: 3354829 - RNA, 18 nt, Neisseria meningitidis Z2491
cuucauaccccacugcca

SEQ ID NO: 3354830 - RNA, 15 nt, Neisseria meningitidis Z2491
cuucaucagcauuuc

SEQ ID NO: 3354831 - RNA, 19 nt, Neisseria meningitidis Z2491
cuucauccguugcuucaau

SEQ ID NO: 3354832 - RNA, 20 nt, Neisseria meningitidis Z2491
cuucaucucgccaaucucac

SEQ ID NO: 3354833 - RNA, 12 nt, Neisseria meningitidis Z2491
cuucaucugccg

SEQ ID NO: 3354834 - RNA, 15 nt, Neisseria meningitidis Z2491
cuucauuccgcgcag

SEQ ID NO: 3354835 - RNA, 16 nt, Neisseria meningitidis Z2491
cuuccaacgcgcgcag

SEQ ID NO: 3354836 - RNA, 20 nt, Neisseria meningitidis Z2491
cuuccaaggcacgguaaacc

SEQ ID NO: 3354837 - RNA, 20 nt, Neisseria meningitidis Z2491
cuuccacaccguucagcccg

SEQ ID NO: 3354838 - RNA, 20 nt, Neisseria meningitidis Z2491
cuuccagcaauuucugcacu

SEQ ID NO: 3354839 - RNA, 19 nt, Neisseria meningitidis Z2491
cuuccaucgucauucccgc

SEQ ID NO: 3354840 - RNA, 23 nt, Neisseria meningitidis Z2491
cuuccccauaugccgucugaaga

SEQ ID NO: 3354841 - RNA, 23 nt, Neisseria meningitidis Z2491
cuucccgggucgcuuuauuuugu

SEQ ID NO: 3354842 - RNA, 16 nt, Neisseria meningitidis Z2491
cuuccgaggcggcuuu

SEQ ID NO: 3354843 - RNA, 17 nt, Neisseria meningitidis Z2491
cuuccgauuauaucggc

SEQ ID NO: 3354844 - RNA, 17 nt, Neisseria meningitidis Z2491
cuuccgcauaauaaaaa

SEQ ID NO: 3354845 - RNA, 18 nt, Neisseria meningitidis Z2491
cuuccgucaaaaaugccu

SEQ ID NO: 3354846 - RNA, 18 nt, Neisseria meningitidis Z2491
cuuccguguguauagugg

SEQ ID NO: 3354847 - RNA, 23 nt, Neisseria meningitidis Z2491
cuuccuuuaauuaagauccuccc

SEQ ID NO: 3354848 - RNA, 14 nt, Neisseria meningitidis Z2491
cuuccuuuuuaaag

SEQ ID NO: 3354849 - RNA, 16 nt, Neisseria meningitidis Z2491
cuucgacguugccuuc

SEQ ID NO: 3354850 - RNA, 22 nt, Neisseria meningitidis Z2491
cuucgcgacgguauugaugucu

SEQ ID NO: 3354851 - RNA, 14 nt, Neisseria meningitidis Z2491
cuucgcgccgcccg

SEQ ID NO: 3354852 - RNA, 13 nt, Neisseria meningitidis Z2491
cuucggauaaauu

SEQ ID NO: 3354853 - RNA, 21 nt, Neisseria meningitidis Z2491
cuucgggcagcggcaauauuc

SEQ ID NO: 3354854 - RNA, 13 nt, Neisseria meningitidis Z2491
cuucgggcgugcc

SEQ ID NO: 3354855 - RNA, 21 nt, Neisseria meningitidis Z2491
cuucgggcgugccggucagga

SEQ ID NO: 3354856 - RNA, 23 nt, Neisseria meningitidis Z2491
cuucgguuguauuuuuauuauua

SEQ ID NO: 3354857 - RNA, 11 nt, Neisseria meningitidis Z2491
cuucguauucc

SEQ ID NO: 3354858 - RNA, 15 nt, Neisseria meningitidis Z2491
cuucgucuuuuccuu

SEQ ID NO: 3354859 - RNA, 16 nt, Neisseria meningitidis Z2491
cuucgucuuuuccuuc

SEQ ID NO: 3354860 - RNA, 20 nt, Neisseria meningitidis Z2491
cuucuaaaaauucuucuuuc

SEQ ID NO: 3354861 - RNA, 17 nt, Neisseria meningitidis Z2491
cuucuaacaaauaaugu

SEQ ID NO: 3354862 - RNA, 15 nt, Neisseria meningitidis Z2491
cuucuauaaagccua

SEQ ID NO: 3354863 - RNA, 13 nt, Neisseria meningitidis Z2491
cuucuuacccaau

SEQ ID NO: 3354864 - RNA, 15 nt, Neisseria meningitidis Z2491
cuucuucgagggcau

SEQ ID NO: 3354865 - RNA, 13 nt, Neisseria meningitidis Z2491
cuucuucgucuuu

SEQ ID NO: 3354866 - RNA, 13 nt, Neisseria meningitidis Z2491
cuucuucuaaaaa

SEQ ID NO: 3354867 - RNA, 17 nt, Neisseria meningitidis Z2491
cuucuuuccauccauca

SEQ ID NO: 3354868 - RNA, 21 nt, Neisseria meningitidis Z2491
cuucuuugcugacaaucggcu

SEQ ID NO: 3354869 - RNA, 21 nt, Neisseria meningitidis Z2491
cuugaaauacgguacuggugg

SEQ ID NO: 3354870 - RNA, 17 nt, Neisseria meningitidis Z2491
cuugaguuucuguauuu

SEQ ID NO: 3354871 - RNA, 16 nt, Neisseria meningitidis Z2491
cuugauggcgaaagca

SEQ ID NO: 3354872 - RNA, 14 nt, Neisseria meningitidis Z2491
cuugcaaaauagaa

SEQ ID NO: 3354873 - RNA, 13 nt, Neisseria meningitidis Z2491
cuugcaaaccccu

SEQ ID NO: 3354874 - RNA, 21 nt, Neisseria meningitidis Z2491
cuugcaaaccccucaacacac

SEQ ID NO: 3354875 - RNA, 16 nt, Neisseria meningitidis Z2491
cuugcaacuuugcguu

SEQ ID NO: 3354876 - RNA, 16 nt, Neisseria meningitidis Z2491
cuugcagcuuugaguu

SEQ ID NO: 3354877 - RNA, 18 nt, Neisseria meningitidis Z2491
cuugcccacgcacccaaa

SEQ ID NO: 3354878 - RNA, 13 nt, Neisseria meningitidis Z2491
cuugccccaaaaa

SEQ ID NO: 3354879 - RNA, 14 nt, Neisseria meningitidis Z2491
cuugccccaaaaag

SEQ ID NO: 3354880 - RNA, 16 nt, Neisseria meningitidis Z2491
cuugccccaaaaagcc

SEQ ID NO: 3354881 - RNA, 10 nt, Neisseria meningitidis Z2491
cuugccgccg

SEQ ID NO: 3354882 - RNA, 17 nt, Neisseria meningitidis Z2491
cuuuuuucuguuuggcu

SEQ ID NO: 3354883 - RNA, 16 nt, Neisseria meningitidis Z2491
cuuuuuugaauuuuug

SEQ ID NO: 3354884 - RNA, 15 nt, Neisseria meningitidis Z2491
gaaaaaaaaucguuc

SEQ ID NO: 3354885 - RNA, 14 nt, Neisseria meningitidis Z2491
gaaaaaacagaaac

SEQ ID NO: 3354886 - RNA, 10 nt, Neisseria meningitidis Z2491
gaaaaaauaa

SEQ ID NO: 3354887 - RNA, 12 nt, Neisseria meningitidis Z2491
gaaaaaauaauu

SEQ ID NO: 3354888 - RNA, 21 nt, Neisseria meningitidis Z2491
gaaaaaaugccgucugaaacg

SEQ ID NO: 3354889 - RNA, 22 nt, Neisseria meningitidis Z2491
gaaaaacgacgagaauuuauca

SEQ ID NO: 3354890 - RNA, 16 nt, Neisseria meningitidis Z2491
gaaaaaguccagcaua

SEQ ID NO: 3354891 - RNA, 11 nt, Neisseria meningitidis Z2491
gaaaaauaaug

SEQ ID NO: 3354892 - RNA, 21 nt, Neisseria meningitidis Z2491
gaaaaaucuguggauaaacau

SEQ ID NO: 3354893 - RNA, 23 nt, Neisseria meningitidis Z2491
gaaaaaugccgucugaagccuuc

SEQ ID NO: 3354894 - RNA, 16 nt, Neisseria meningitidis Z2491
gaaaaauuuucagacg

SEQ ID NO: 3354895 - RNA, 20 nt, Neisseria meningitidis Z2491
gaaaaauuuucagacgaccu

SEQ ID NO: 3354896 - RNA, 20 nt, Neisseria meningitidis Z2491
gaaaacagaaaaucaaaaac

SEQ ID NO: 3354897 - RNA, 12 nt, Neisseria meningitidis Z2491
gaaaacagaaac

SEQ ID NO: 3354898 - RNA, 23 nt, Neisseria meningitidis Z2491
gaaaacagaaagccaaaaacaga

SEQ ID NO: 3354899 - RNA, 18 nt, Neisseria meningitidis Z2491
gaaaacagcgaguuuuuc

SEQ ID NO: 3354900 - RNA, 13 nt, Neisseria meningitidis Z2491
gaaaacagcugaa

SEQ ID NO: 3354901 - RNA, 15 nt, Neisseria meningitidis Z2491
gaaaaccaaaaacag

SEQ ID NO: 3354902 - RNA, 17 nt, Neisseria meningitidis Z2491
gaaaaccaaaaacagca

SEQ ID NO: 3354903 - RNA, 23 nt, Neisseria meningitidis Z2491
gaaaaccaaaaucagaaaccuaa

SEQ ID NO: 3354904 - RNA, 21 nt, Neisseria meningitidis Z2491
gaaaaccaccgccaucaggaa

SEQ ID NO: 3354905 - RNA, 17 nt, Neisseria meningitidis Z2491
gaaaaccgaaacagaaa

SEQ ID NO: 3354906 - RNA, 18 nt, Neisseria meningitidis Z2491
gaaaaccgaaacagaaac

SEQ ID NO: 3354907 - RNA, 22 nt, Neisseria meningitidis Z2491
gaaaaccgaugcgggaacuuga

SEQ ID NO: 3354908 - RNA, 16 nt, Neisseria meningitidis Z2491
gaaaaccuugccgccc

SEQ ID NO: 3354909 - RNA, 15 nt, Neisseria meningitidis Z2491
gaaaacgccgucuga

SEQ ID NO: 3354910 - RNA, 21 nt, Neisseria meningitidis Z2491
gaaaacggguucggacggcau

SEQ ID NO: 3354911 - RNA, 18 nt, Neisseria meningitidis Z2491
gaaaacgucuuacucaau

SEQ ID NO: 3354912 - RNA, 21 nt, Neisseria meningitidis Z2491
gaaaacuuggagauucuagau

SEQ ID NO: 3354913 - RNA, 19 nt, Neisseria meningitidis Z2491
gaaaagauauuguucagac

SEQ ID NO: 3354914 - RNA, 14 nt, Neisseria meningitidis Z2491
gaaaagcuaaagca

SEQ ID NO: 3354915 - RNA, 10 nt, Neisseria meningitidis Z2491
gaaaauaaua

SEQ ID NO: 3354916 - RNA, 16 nt, Neisseria meningitidis Z2491
gaaaaucaggggauua

SEQ ID NO: 3354917 - RNA, 16 nt, Neisseria meningitidis Z2491
gaaaauccgccaaccu

SEQ ID NO: 3354918 - RNA, 22 nt, Neisseria meningitidis Z2491
gaaaaugccguccgaaagguuu

SEQ ID NO: 3354919 - RNA, 16 nt, Neisseria meningitidis Z2491
gaaaaugccgucugaa

SEQ ID NO: 3354920 - RNA, 22 nt, Neisseria meningitidis Z2491
gaaaaugccgucugaaaccuuu

SEQ ID NO: 3354921 - RNA, 20 nt, Neisseria meningitidis Z2491
gaaaaugguaucgggcauaa

SEQ ID NO: 3354922 - RNA, 14 nt, Neisseria meningitidis Z2491
gaaaauuucuugau

SEQ ID NO: 3354923 - RNA, 23 nt, Neisseria meningitidis Z2491
gaaacaaaauguucagacggcau

SEQ ID NO: 3354924 - RNA, 12 nt, Neisseria meningitidis Z2491
gaaacaacaaaa

SEQ ID NO: 3354925 - RNA, 15 nt, Neisseria meningitidis Z2491
gaaacaacugaaacc

SEQ ID NO: 3354926 - RNA, 14 nt, Neisseria meningitidis Z2491
gaaacagaaaccca

SEQ ID NO: 3354927 - RNA, 20 nt, Neisseria meningitidis Z2491
gaaacagacauugcuaaaac

SEQ ID NO: 3354928 - RNA, 22 nt, Neisseria meningitidis Z2491
gaaacagacauugcuaaaacaa

SEQ ID NO: 3354929 - RNA, 20 nt, Neisseria meningitidis Z2491
gaaacagaucgguuucccgu

SEQ ID NO: 3354930 - RNA, 18 nt, Neisseria meningitidis Z2491
gaaacagccaggcgcagg

SEQ ID NO: 3354931 - RNA, 23 nt, Neisseria meningitidis Z2491
gaaacagccaggcgcagguuuug

SEQ ID NO: 3354932 - RNA, 19 nt, Neisseria meningitidis Z2491
gaaacagguuucagacggc

SEQ ID NO: 3354933 - RNA, 14 nt, Neisseria meningitidis Z2491
gaaacauagccuuc

SEQ ID NO: 3354934 - RNA, 18 nt, Neisseria meningitidis Z2491
gaaaccaaaaaacaacag

SEQ ID NO: 3354935 - RNA, 12 nt, Neisseria meningitidis Z2491
gaaacccaaaca

SEQ ID NO: 3354936 - RNA, 23 nt, Neisseria meningitidis Z2491
gaaaccccuaaaggcuucagacg

SEQ ID NO: 3354937 - RNA, 16 nt, Neisseria meningitidis Z2491
gaaacccgauuccugu

SEQ ID NO: 3354938 - RNA, 16 nt, Neisseria meningitidis Z2491
gaaaccguauauuucc

SEQ ID NO: 3354939 - RNA, 20 nt, Neisseria meningitidis Z2491
gaaaccguuucagacggcau

SEQ ID NO: 3354940 - RNA, 19 nt, Neisseria meningitidis Z2491
gaaaccuaaaaucccguca

SEQ ID NO: 3354941 - RNA, 14 nt, Neisseria meningitidis Z2491
gaaaccuaaaauuc

SEQ ID NO: 3354942 - RNA, 17 nt, Neisseria meningitidis Z2491
gaaaccucaaaucccgu

SEQ ID NO: 3354943 - RNA, 21 nt, Neisseria meningitidis Z2491
gaaaccucguucggacggcau

SEQ ID NO: 3354944 - RNA, 16 nt, Neisseria meningitidis Z2491
gaaaccugaaauaugg

SEQ ID NO: 3354945 - RNA, 23 nt, Neisseria meningitidis Z2491
gaaaccuguaccguuucagacgg

SEQ ID NO: 3354946 - RNA, 21 nt, Neisseria meningitidis Z2491
gaaaccuguuucagacggcau

SEQ ID NO: 3354947 - RNA, 14 nt, Neisseria meningitidis Z2491
gaaacgaaaaugcc

SEQ ID NO: 3354948 - RNA, 16 nt, Neisseria meningitidis Z2491
gaaacgaugacggcga

SEQ ID NO: 3354949 - RNA, 16 nt, Neisseria meningitidis Z2491
gaaacgcauucagacg

SEQ ID NO: 3354950 - RNA, 18 nt, Neisseria meningitidis Z2491
gaaacgcauucagacggc

SEQ ID NO: 3354951 - RNA, 20 nt, Neisseria meningitidis Z2491
gaaacgcauucagacggcau

SEQ ID NO: 3354952 - RNA, 20 nt, Neisseria meningitidis Z2491
gaaacgcgccuucaugcggc

SEQ ID NO: 3354953 - RNA, 14 nt, Neisseria meningitidis Z2491
gaaacggacaaacc

SEQ ID NO: 3354954 - RNA, 15 nt, Neisseria meningitidis Z2491
gaaacggacaaaccg

SEQ ID NO: 3354955 - RNA, 15 nt, Neisseria meningitidis Z2491
gaaacggacaacggc

SEQ ID NO: 3354956 - RNA, 16 nt, Neisseria meningitidis Z2491
gaaacggacaacggca

SEQ ID NO: 3354957 - RNA, 19 nt, Neisseria meningitidis Z2491
gaaacggugggucaacauu

SEQ ID NO: 3354958 - RNA, 19 nt, Neisseria meningitidis Z2491
gaaacgguuguucaaaucg

SEQ ID NO: 3354959 - RNA, 19 nt, Neisseria meningitidis Z2491
gaaacgugguucaacguuc

SEQ ID NO: 3354960 - RNA, 19 nt, Neisseria meningitidis Z2491
gaaacguuucagacggcau

SEQ ID NO: 3354961 - RNA, 22 nt, Neisseria meningitidis Z2491
gaaacucaaaaaaacuagauuc

SEQ ID NO: 3354962 - RNA, 16 nt, Neisseria meningitidis Z2491
gaaacucaaaaaaccg

SEQ ID NO: 3354963 - RNA, 17 nt, Neisseria meningitidis Z2491
gaaacucaaaaaaccgg

SEQ ID NO: 3354964 - RNA, 18 nt, Neisseria meningitidis Z2491
gaaacucaacgcacugga

SEQ ID NO: 3354965 - RNA, 21 nt, Neisseria meningitidis Z2491
gaaacuuaucgggaaaaacgg

SEQ ID NO: 3354966 - RNA, 11 nt, Neisseria meningitidis Z2491
gaaagagaaaa

SEQ ID NO: 3354967 - RNA, 18 nt, Neisseria meningitidis Z2491
gaaagagggaaucuagaa

SEQ ID NO: 3354968 - RNA, 19 nt, Neisseria meningitidis Z2491
gaaagagggaaucuagaaa

SEQ ID NO: 3354969 - RNA, 13 nt, Neisseria meningitidis Z2491
gaaagcagcagcc

SEQ ID NO: 3354970 - RNA, 18 nt, Neisseria meningitidis Z2491
gaaagccaaaaacagaaa

SEQ ID NO: 3354971 - RNA, 22 nt, Neisseria meningitidis Z2491
gaaagccaaaaacagaaaccua

SEQ ID NO: 3354972 - RNA, 18 nt, Neisseria meningitidis Z2491
gaaagccuuucagacggc

SEQ ID NO: 3354973 - RNA, 15 nt, Neisseria meningitidis Z2491
gaaagcgggaaugcc

SEQ ID NO: 3354974 - RNA, 14 nt, Neisseria meningitidis Z2491
gaaagcuuccaacu

SEQ ID NO: 3354975 - RNA, 17 nt, Neisseria meningitidis Z2491
gaaaggcuucagacggc

SEQ ID NO: 3354976 - RNA, 19 nt, Neisseria meningitidis Z2491
gaaaggcuucagacggcau

SEQ ID NO: 3354977 - RNA, 20 nt, Neisseria meningitidis Z2491
gaaaggcuuuuucagacggc

SEQ ID NO: 3354978 - RNA, 22 nt, Neisseria meningitidis Z2491
gaaaggcuuuuucagacggcau

SEQ ID NO: 3354979 - RNA, 18 nt, Neisseria meningitidis Z2491
gaaagguugcgggaaucc

SEQ ID NO: 3354980 - RNA, 18 nt, Neisseria meningitidis Z2491
gaaagguugugggaaucc

SEQ ID NO: 3354981 - RNA, 18 nt, Neisseria meningitidis Z2491
gaaagguuuucagacggc

SEQ ID NO: 3354982 - RNA, 15 nt, Neisseria meningitidis Z2491
gaaaguggaacagaa

SEQ ID NO: 3354983 - RNA, 18 nt, Neisseria meningitidis Z2491
gaauauuuccucacugcc

SEQ ID NO: 3354984 - RNA, 20 nt, Neisseria meningitidis Z2491
gaaucacaauauagccgccc

SEQ ID NO: 3354985 - RNA, 22 nt, Neisseria meningitidis Z2491
gaaucagaccgaauuuaaucaa

SEQ ID NO: 3354986 - RNA, 16 nt, Neisseria meningitidis Z2491
gaaucaggcaaauuuc

SEQ ID NO: 3354987 - RNA, 19 nt, Neisseria meningitidis Z2491
gaaucagguugaaaaugcc

SEQ ID NO: 3354988 - RNA, 15 nt, Neisseria meningitidis Z2491
gaauccaauccgucc

SEQ ID NO: 3354989 - RNA, 23 nt, Neisseria meningitidis Z2491
gaauccagaacguaaaaucugaa

SEQ ID NO: 3354990 - RNA, 14 nt, Neisseria meningitidis Z2491
gaauccagugcguu

SEQ ID NO: 3354991 - RNA, 23 nt, Neisseria meningitidis Z2491
gaauccagugcguugaguuucag

SEQ ID NO: 3354992 - RNA, 23 nt, Neisseria meningitidis Z2491
gaauccaguuucuugaguuucag

SEQ ID NO: 3354993 - RNA, 18 nt, Neisseria meningitidis Z2491
gaauccaucaauuuccac

SEQ ID NO: 3354994 - RNA, 14 nt, Neisseria meningitidis Z2491
gaauccgguuuuuu

SEQ ID NO: 3354995 - RNA, 20 nt, Neisseria meningitidis Z2491
gaaucuagaaacgcaaagcu

SEQ ID NO: 3354996 - RNA, 16 nt, Neisseria meningitidis Z2491
gaaucuagaaacucaa

SEQ ID NO: 3354997 - RNA, 23 nt, Neisseria meningitidis Z2491
gaaucuagaacccaacacggcaa

SEQ ID NO: 3354998 - RNA, 23 nt, Neisseria meningitidis Z2491
gaaucuagaacguaaaaucucaa

SEQ ID NO: 3354999 - RNA, 12 nt, Neisseria meningitidis Z2491
gaaucuagaauc

SEQ ID NO: 3355000 - RNA, 14 nt, Neisseria meningitidis Z2491
gaaucuagaauccc

SEQ ID NO: 3355001 - RNA, 14 nt, Neisseria meningitidis Z2491
gaaucuagacauuc

SEQ ID NO: 3355002 - RNA, 16 nt, Neisseria meningitidis Z2491
gaaucuagacauucaa

SEQ ID NO: 3355003 - RNA, 22 nt, Neisseria meningitidis Z2491
gaaucuagacauucaaugcuaa

SEQ ID NO: 3355004 - RNA, 13 nt, Neisseria meningitidis Z2491
gaaucuagaccuu

SEQ ID NO: 3355005 - RNA, 20 nt, Neisseria meningitidis Z2491
gaaucuagugcguugaguuu

SEQ ID NO: 3355006 - RNA, 18 nt, Neisseria meningitidis Z2491
gaaucucguuauuuccac

SEQ ID NO: 3355007 - RNA, 20 nt, Neisseria meningitidis Z2491
gaaucugcugcaaaccgucu

SEQ ID NO: 3355008 - RNA, 15 nt, Neisseria meningitidis Z2491
gaaucuggaaaccaa

SEQ ID NO: 3355009 - RNA, 16 nt, Neisseria meningitidis Z2491
gaaucuuauccacaga

SEQ ID NO: 3355010 - RNA, 20 nt, Neisseria meningitidis Z2491
gaaugaaaaugccgucugaa

SEQ ID NO: 3355011 - RNA, 20 nt, Neisseria meningitidis Z2491
gaaugaauagucaggcugcc

SEQ ID NO: 3355012 - RNA, 19 nt, Neisseria meningitidis Z2491
gaaugacaggauguagguu

SEQ ID NO: 3355013 - RNA, 15 nt, Neisseria meningitidis Z2491
gaaugacgaaaaguu

SEQ ID NO: 3355014 - RNA, 15 nt, Neisseria meningitidis Z2491
gaaugacgaaagguu

SEQ ID NO: 3355015 - RNA, 17 nt, Neisseria meningitidis Z2491
gaaugacgaaguuucag

SEQ ID NO: 3355016 - RNA, 21 nt, Neisseria meningitidis Z2491
gaaugacgagauuuuagguua

SEQ ID NO: 3355017 - RNA, 18 nt, Neisseria meningitidis Z2491
gaaugacgcgaacagaaa

SEQ ID NO: 3355018 - RNA, 12 nt, Neisseria meningitidis Z2491
gaaugacggcag

SEQ ID NO: 3355019 - RNA, 18 nt, Neisseria meningitidis Z2491
gaaugacggcagagcggu

SEQ ID NO: 3355020 - RNA, 16 nt, Neisseria meningitidis Z2491
gaaugacggggguuug

SEQ ID NO: 3355021 - RNA, 19 nt, Neisseria meningitidis Z2491
gaaugacgugguguagguu

SEQ ID NO: 3355022 - RNA, 14 nt, Neisseria meningitidis Z2491
gaaugacugaaacu

SEQ ID NO: 3355023 - RNA, 18 nt, Neisseria meningitidis Z2491
gaaugacugaaacucaaa

SEQ ID NO: 3355024 - RNA, 18 nt, Neisseria meningitidis Z2491
gaaugauucauaaaauau

SEQ ID NO: 3355025 - RNA, 16 nt, Neisseria meningitidis Z2491
gaaugccgaggguuug

SEQ ID NO: 3355026 - RNA, 18 nt, Neisseria meningitidis Z2491
gaaugccgucugaagccg

SEQ ID NO: 3355027 - RNA, 17 nt, Neisseria meningitidis Z2491
gaaugccuuucucuguu

SEQ ID NO: 3355028 - RNA, 17 nt, Neisseria meningitidis Z2491
gaauggccgauuuuggg

SEQ ID NO: 3355029 - RNA, 23 nt, Neisseria meningitidis Z2491
gaauggccgauuuuggguuucug

SEQ ID NO: 3355030 - RNA, 20 nt, Neisseria meningitidis Z2491
gaauugcgccgacagcagcu

SEQ ID NO: 3355031 - RNA, 22 nt, Neisseria meningitidis Z2491
gaauuuaaucaagucuuccggu

SEQ ID NO: 3355032 - RNA, 21 nt, Neisseria meningitidis Z2491
gaauuuauccgaaacaacaaa

SEQ ID NO: 3355033 - RNA, 19 nt, Neisseria meningitidis Z2491
gaauuuaucggaaaugacc

SEQ ID NO: 3355034 - RNA, 20 nt, Neisseria meningitidis Z2491
gaauuugucggcaaucuucc

SEQ ID NO: 3355035 - RNA, 12 nt, Neisseria meningitidis Z2491
gacaaaauaccg

SEQ ID NO: 3355036 - RNA, 13 nt, Neisseria meningitidis Z2491
gacaaaauccagu

SEQ ID NO: 3355037 - RNA, 21 nt, Neisseria meningitidis Z2491
gacaaaauuaaaguuucagaa

SEQ ID NO: 3355038 - RNA, 15 nt, Neisseria meningitidis Z2491
gacaaaucuggauuc

SEQ ID NO: 3355039 - RNA, 23 nt, Neisseria meningitidis Z2491
gacaacggucguggcaacuucca

SEQ ID NO: 3355040 - RNA, 19 nt, Neisseria meningitidis Z2491
gacaaggccgacaggcguu

SEQ ID NO: 3355041 - RNA, 17 nt, Neisseria meningitidis Z2491
gacaaggcggcgaagcc

SEQ ID NO: 3355042 - RNA, 14 nt, Neisseria meningitidis Z2491
gacaaggcuggauu

SEQ ID NO: 3355043 - RNA, 15 nt, Neisseria meningitidis Z2491
gacaauacggcggcg

SEQ ID NO: 3355044 - RNA, 20 nt, Neisseria meningitidis Z2491
gacaauacggcggcggcagg

SEQ ID NO: 3355045 - RNA, 11 nt, Neisseria meningitidis Z2491
gacaaucacag

SEQ ID NO: 3355046 - RNA, 13 nt, Neisseria meningitidis Z2491
gacaaucaggaaa

SEQ ID NO: 3355047 - RNA, 14 nt, Neisseria meningitidis Z2491
gacaaucaggaaaa

SEQ ID NO: 3355048 - RNA, 19 nt, Neisseria meningitidis Z2491
gacaaucucgucccaaaca

SEQ ID NO: 3355049 - RNA, 13 nt, Neisseria meningitidis Z2491
gacacaaugaaag

SEQ ID NO: 3355050 - RNA, 18 nt, Neisseria meningitidis Z2491
gacacgaccgaccggcau

SEQ ID NO: 3355051 - RNA, 16 nt, Neisseria meningitidis Z2491
gacacggcuuaucuaa

SEQ ID NO: 3355052 - RNA, 18 nt, Neisseria meningitidis Z2491
gacacuucacauuuucua

SEQ ID NO: 3355053 - RNA, 15 nt, Neisseria meningitidis Z2491
gacagacggccaaac

SEQ ID NO: 3355054 - RNA, 13 nt, Neisseria meningitidis Z2491
gacagauguuuuc

SEQ ID NO: 3355055 - RNA, 21 nt, Neisseria meningitidis Z2491
gacagcagccggacagcccau

SEQ ID NO: 3355056 - RNA, 14 nt, Neisseria meningitidis Z2491
gacagcauuuccac

SEQ ID NO: 3355057 - RNA, 18 nt, Neisseria meningitidis Z2491
gacagccccuaaauuuaa

SEQ ID NO: 3355058 - RNA, 20 nt, Neisseria meningitidis Z2491
gacagccgaaacccaaacac

SEQ ID NO: 3355059 - RNA, 21 nt, Neisseria meningitidis Z2491
gacaggcaaaugcugucugaa

SEQ ID NO: 3355060 - RNA, 20 nt, Neisseria meningitidis Z2491
gacaggcauuugcacacguu

SEQ ID NO: 3355061 - RNA, 16 nt, Neisseria meningitidis Z2491
gacaggcuuuuuucug

SEQ ID NO: 3355062 - RNA, 20 nt, Neisseria meningitidis Z2491
gacaggucggacauuugacu

SEQ ID NO: 3355063 - RNA, 22 nt, Neisseria meningitidis Z2491
gacaguaaccguagcaacugaa

SEQ ID NO: 3355064 - RNA, 13 nt, Neisseria meningitidis Z2491
gacaguacaaaua

SEQ ID NO: 3355065 - RNA, 14 nt, Neisseria meningitidis Z2491
gacaguacaaauag

SEQ ID NO: 3355066 - RNA, 15 nt, Neisseria meningitidis Z2491
gacaguacaaauagu

SEQ ID NO: 3355067 - RNA, 18 nt, Neisseria meningitidis Z2491
gacagugcagcgacaaca

SEQ ID NO: 3355068 - RNA, 22 nt, Neisseria meningitidis Z2491
gacauaccgccccuaaaaugcc

SEQ ID NO: 3355069 - RNA, 16 nt, Neisseria meningitidis Z2491
gacauacucuucaaca

SEQ ID NO: 3355070 - RNA, 14 nt, Neisseria meningitidis Z2491
gacaugcaagcaua

SEQ ID NO: 3355071 - RNA, 16 nt, Neisseria meningitidis Z2491
gacaugguuugcaguc

SEQ ID NO: 3355072 - RNA, 15 nt, Neisseria meningitidis Z2491
gacauuaaaaaauac

SEQ ID NO: 3355073 - RNA, 18 nt, Neisseria meningitidis Z2491
gacauuaagauguuuuuc

SEQ ID NO: 3355074 - RNA, 12 nt, Neisseria meningitidis Z2491
gacauugcuaaa

SEQ ID NO: 3355075 - RNA, 22 nt, Neisseria meningitidis Z2491
gaccagcggcgcgguauuccca

SEQ ID NO: 3355076 - RNA, 22 nt, Neisseria meningitidis Z2491
gaccagcucccaaucccgauaa

SEQ ID NO: 3355077 - RNA, 20 nt, Neisseria meningitidis Z2491
gaccaguucccacgcccugu

SEQ ID NO: 3355078 - RNA, 18 nt, Neisseria meningitidis Z2491
gaccauaaagagcaggac

SEQ ID NO: 3355079 - RNA, 18 nt, Neisseria meningitidis Z2491
gacccacgccaaaccgau

SEQ ID NO: 3355080 - RNA, 17 nt, Neisseria meningitidis Z2491
gaccccgauuuguccga

SEQ ID NO: 3355081 - RNA, 13 nt, Neisseria meningitidis Z2491
gacccgaaucaca

SEQ ID NO: 3355082 - RNA, 23 nt, Neisseria meningitidis Z2491
gaccgaaacucaacgaaccugga

SEQ ID NO: 3355083 - RNA, 14 nt, Neisseria meningitidis Z2491
gaccgccgccgccu

SEQ ID NO: 3355084 - RNA, 18 nt, Neisseria meningitidis Z2491
gaggcggaaucgaaccgc

SEQ ID NO: 3355085 - RNA, 14 nt, Neisseria meningitidis Z2491
gaggcugcauucga

SEQ ID NO: 3355086 - RNA, 11 nt, Neisseria meningitidis Z2491
gagggaaugac

SEQ ID NO: 3355087 - RNA, 15 nt, Neisseria meningitidis Z2491
gagggaaugacggga

SEQ ID NO: 3355088 - RNA, 23 nt, Neisseria meningitidis Z2491
gagggaaugacgggauuugagau

SEQ ID NO: 3355089 - RNA, 14 nt, Neisseria meningitidis Z2491
gagggcguuuuugu

SEQ ID NO: 3355090 - RNA, 22 nt, Neisseria meningitidis Z2491
gagggcuucuuugacggcgggc

SEQ ID NO: 3355091 - RNA, 14 nt, Neisseria meningitidis Z2491
gagggugagggaga

SEQ ID NO: 3355092 - RNA, 14 nt, Neisseria meningitidis Z2491
gagguaguuuuugg

SEQ ID NO: 3355093 - RNA, 16 nt, Neisseria meningitidis Z2491
gagguguuggaaucag

SEQ ID NO: 3355094 - RNA, 14 nt, Neisseria meningitidis Z2491
gagguugacggcuu

SEQ ID NO: 3355095 - RNA, 14 nt, Neisseria meningitidis Z2491
gaguccaagacagg

SEQ ID NO: 3355096 - RNA, 20 nt, Neisseria meningitidis Z2491
gagucccaguucgccgcaga

SEQ ID NO: 3355097 - RNA, 14 nt, Neisseria meningitidis Z2491
gagucuggcggcau

SEQ ID NO: 3355098 - RNA, 16 nt, Neisseria meningitidis Z2491
gaguuucagcuauuua

SEQ ID NO: 3355099 - RNA, 14 nt, Neisseria meningitidis Z2491
gauaaaaaauaugg

SEQ ID NO: 3355100 - RNA, 18 nt, Neisseria meningitidis Z2491
gauaaaaauaccgucuga

SEQ ID NO: 3355101 - RNA, 22 nt, Neisseria meningitidis Z2491
gauaaauucuugaggcauugaa

SEQ ID NO: 3355102 - RNA, 19 nt, Neisseria meningitidis Z2491
gauaaauugccuuagcauu

SEQ ID NO: 3355103 - RNA, 16 nt, Neisseria meningitidis Z2491
gauaaggcaagcguuc

SEQ ID NO: 3355104 - RNA, 14 nt, Neisseria meningitidis Z2491
gauaaguuuccgua

SEQ ID NO: 3355105 - RNA, 19 nt, Neisseria meningitidis Z2491
gauaaguuuccgugcggac

SEQ ID NO: 3355106 - RNA, 21 nt, Neisseria meningitidis Z2491
gauaauagugccgucaaauua

SEQ ID NO: 3355107 - RNA, 13 nt, Neisseria meningitidis Z2491
gauaaucuuuucg

SEQ ID NO: 3355108 - RNA, 17 nt, Neisseria meningitidis Z2491
gauacacaaaaaagcca

SEQ ID NO: 3355109 - RNA, 20 nt, Neisseria meningitidis Z2491
gauacacaaaaaagccagca

SEQ ID NO: 3355110 - RNA, 21 nt, Neisseria meningitidis Z2491
gauacacaaaaaagccagcag

SEQ ID NO: 3355111 - RNA, 16 nt, Neisseria meningitidis Z2491
gauacuccaaaccuuu

SEQ ID NO: 3355112 - RNA, 21 nt, Neisseria meningitidis Z2491
gauagccgcccaaugccgucu

SEQ ID NO: 3355113 - RNA, 14 nt, Neisseria meningitidis Z2491
gauagcgagacggc

SEQ ID NO: 3355114 - RNA, 16 nt, Neisseria meningitidis Z2491
gauagcgagacggcau

SEQ ID NO: 3355115 - RNA, 17 nt, Neisseria meningitidis Z2491
gauagcuucgucauucc

SEQ ID NO: 3355116 - RNA, 18 nt, Neisseria meningitidis Z2491
gauaggcaaaaaccggcu

SEQ ID NO: 3355117 - RNA, 14 nt, Neisseria meningitidis Z2491
gauaguugccguca

SEQ ID NO: 3355118 - RNA, 14 nt, Neisseria meningitidis Z2491
gauauaacuuuaau

SEQ ID NO: 3355119 - RNA, 15 nt, Neisseria meningitidis Z2491
gauauagguuuccgu

SEQ ID NO: 3355120 - RNA, 14 nt, Neisseria meningitidis Z2491
gauaucgccucaua

SEQ ID NO: 3355121 - RNA, 15 nt, Neisseria meningitidis Z2491
gauauuguucagacg

SEQ ID NO: 3355122 - RNA, 13 nt, Neisseria meningitidis Z2491
gauauuuucuucc

SEQ ID NO: 3355123 - RNA, 11 nt, Neisseria meningitidis Z2491
gauauuuuuga

SEQ ID NO: 3355124 - RNA, 17 nt, Neisseria meningitidis Z2491
gaucaaacgauaaugcg

SEQ ID NO: 3355125 - RNA, 21 nt, Neisseria meningitidis Z2491
gaucaacguuucuauuuuccc

SEQ ID NO: 3355126 - RNA, 20 nt, Neisseria meningitidis Z2491
gaucagacauuaaaaaauac

SEQ ID NO: 3355127 - RNA, 16 nt, Neisseria meningitidis Z2491
gaucaggcggauuucu

SEQ ID NO: 3355128 - RNA, 16 nt, Neisseria meningitidis Z2491
gaucuugggcaaugcu

SEQ ID NO: 3355129 - RNA, 17 nt, Neisseria meningitidis Z2491
gaugaaauuuagauaau

SEQ ID NO: 3355130 - RNA, 20 nt, Neisseria meningitidis Z2491
gaugaauccgucggcaaggu

SEQ ID NO: 3355131 - RNA, 23 nt, Neisseria meningitidis Z2491
gaugaauuuaaacaggcacaguu

SEQ ID NO: 3355132 - RNA, 11 nt, Neisseria meningitidis Z2491
gaugacggcag

SEQ ID NO: 3355133 - RNA, 22 nt, Neisseria meningitidis Z2491
gaugacgguaucgccguuuugc

SEQ ID NO: 3355134 - RNA, 14 nt, Neisseria meningitidis Z2491
gaugacugccuuac

SEQ ID NO: 3355135 - RNA, 14 nt, Neisseria meningitidis Z2491
gaugaggaugacgg

SEQ ID NO: 3355136 - RNA, 16 nt, Neisseria meningitidis Z2491
gaugaggcggaacgcg

SEQ ID NO: 3355137 - RNA, 15 nt, Neisseria meningitidis Z2491
gaugaucaguaaaaa

SEQ ID NO: 3355138 - RNA, 21 nt, Neisseria meningitidis Z2491
gaugaugacggucaggaagau

SEQ ID NO: 3355139 - RNA, 13 nt, Neisseria meningitidis Z2491
gaugaugcggaaa

SEQ ID NO: 3355140 - RNA, 21 nt, Neisseria meningitidis Z2491
gaugauuuuuucaacaccaaa

SEQ ID NO: 3355141 - RNA, 15 nt, Neisseria meningitidis Z2491
gaugcauaucuucag

SEQ ID NO: 3355142 - RNA, 14 nt, Neisseria meningitidis Z2491
gaugccgucuaaag

SEQ ID NO: 3355143 - RNA, 20 nt, Neisseria meningitidis Z2491
gaugccgucugaaacggcau

SEQ ID NO: 3355144 - RNA, 20 nt, Neisseria meningitidis Z2491
gaugcugcggaugggggcgu

SEQ ID NO: 3355145 - RNA, 17 nt, Neisseria meningitidis Z2491
gauggccgguaaacagc

SEQ ID NO: 3355146 - RNA, 14 nt, Neisseria meningitidis Z2491
gauggcugaaauug

SEQ ID NO: 3355147 - RNA, 19 nt, Neisseria meningitidis Z2491
gauggcugcuuuggcagca

SEQ ID NO: 3355148 - RNA, 19 nt, Neisseria meningitidis Z2491
gaugguuuugccgcugcug

SEQ ID NO: 3355149 - RNA, 14 nt, Neisseria meningitidis Z2491
gaugucgugcaaua

SEQ ID NO: 3355150 - RNA, 18 nt, Neisseria meningitidis Z2491
gauguggguaaacggcag

SEQ ID NO: 3355151 - RNA, 22 nt, Neisseria meningitidis Z2491
gauguggguuugcccauagaaa

SEQ ID NO: 3355152 - RNA, 16 nt, Neisseria meningitidis Z2491
gaugugguagagaaaa

SEQ ID NO: 3355153 - RNA, 17 nt, Neisseria meningitidis Z2491
gaugugguagagaaaau

SEQ ID NO: 3355154 - RNA, 15 nt, Neisseria meningitidis Z2491
gauguguuucaacac

SEQ ID NO: 3355155 - RNA, 16 nt, Neisseria meningitidis Z2491
gauguguuucaacacc

SEQ ID NO: 3355156 - RNA, 22 nt, Neisseria meningitidis Z2491
gauguucggcaagaucggaaau

SEQ ID NO: 3355157 - RNA, 13 nt, Neisseria meningitidis Z2491
gauguucugucuc

SEQ ID NO: 3355158 - RNA, 12 nt, Neisseria meningitidis Z2491
gauuaacaaaaa

SEQ ID NO: 3355159 - RNA, 14 nt, Neisseria meningitidis Z2491
gauuaacaaaaacc

SEQ ID NO: 3355160 - RNA, 15 nt, Neisseria meningitidis Z2491
gauuaacaaaaacca

SEQ ID NO: 3355161 - RNA, 17 nt, Neisseria meningitidis Z2491
gauuaacaaaaaccagu

SEQ ID NO: 3355162 - RNA, 17 nt, Neisseria meningitidis Z2491
gauuaacaaaaaucagg

SEQ ID NO: 3355163 - RNA, 21 nt, Neisseria meningitidis Z2491
gauuaacguauucaagcagca

SEQ ID NO: 3355164 - RNA, 20 nt, Neisseria meningitidis Z2491
gauuaagguuaauuaaaaua

SEQ ID NO: 3355165 - RNA, 17 nt, Neisseria meningitidis Z2491
gauuaauaaaaaucagg

SEQ ID NO: 3355166 - RNA, 22 nt, Neisseria meningitidis Z2491
gauuaauccgcuuccaaaacca

SEQ ID NO: 3355167 - RNA, 23 nt, Neisseria meningitidis Z2491
gauuaauccgcuuccaaaaccac

SEQ ID NO: 3355168 - RNA, 21 nt, Neisseria meningitidis Z2491
gauuaauuccggaaucagacc

SEQ ID NO: 3355169 - RNA, 12 nt, Neisseria meningitidis Z2491
gauuacuuauuu

SEQ ID NO: 3355170 - RNA, 23 nt, Neisseria meningitidis Z2491
gauuacuuauuuaucaaaacagu

SEQ ID NO: 3355171 - RNA, 20 nt, Neisseria meningitidis Z2491
gauuauaguggauuaaauuu

SEQ ID NO: 3355172 - RNA, 15 nt, Neisseria meningitidis Z2491
gauuauauuugucca

SEQ ID NO: 3355173 - RNA, 15 nt, Neisseria meningitidis Z2491
gauuaucugaaaguu

SEQ ID NO: 3355174 - RNA, 21 nt, Neisseria meningitidis Z2491
gauucaaccccaggauaaagg

SEQ ID NO: 3355175 - RNA, 21 nt, Neisseria meningitidis Z2491
gauucaaucggugucuuuccg

SEQ ID NO: 3355176 - RNA, 22 nt, Neisseria meningitidis Z2491
gauucacuuggugcuucagcac

SEQ ID NO: 3355177 - RNA, 16 nt, Neisseria meningitidis Z2491
gauucaggcuuuccgu

SEQ ID NO: 3355178 - RNA, 14 nt, Neisseria meningitidis Z2491
gauucauaaaauau

SEQ ID NO: 3355179 - RNA, 20 nt, Neisseria meningitidis Z2491
gauucauaaaauauuugcac

SEQ ID NO: 3355180 - RNA, 20 nt, Neisseria meningitidis Z2491
gauucccacuuucgugggaa

SEQ ID NO: 3355181 - RNA, 20 nt, Neisseria meningitidis Z2491
gauuccuguuuucagacggc

SEQ ID NO: 3355182 - RNA, 20 nt, Neisseria meningitidis Z2491
gauucucccaaaggcaauaa

SEQ ID NO: 3355183 - RNA, 20 nt, Neisseria meningitidis Z2491
gauucucuaaggugcugaag

SEQ ID NO: 3355184 - RNA, 17 nt, Neisseria meningitidis Z2491
gauucuugucaaaccaa

SEQ ID NO: 3355185 - RNA, 15 nt, Neisseria meningitidis Z2491
gcaaucaaaauaaac

SEQ ID NO: 3355186 - RNA, 16 nt, Neisseria meningitidis Z2491
gcaaucagugcggcau

SEQ ID NO: 3355187 - RNA, 20 nt, Neisseria meningitidis Z2491
gcaauccacgcaaucaagaa

SEQ ID NO: 3355188 - RNA, 22 nt, Neisseria meningitidis Z2491
gcaaucguuucugucgccagca

SEQ ID NO: 3355189 - RNA, 18 nt, Neisseria meningitidis Z2491
gcaaucugaaauuuugcc

SEQ ID NO: 3355190 - RNA, 19 nt, Neisseria meningitidis Z2491
gcaaucugaaauuuugcca

SEQ ID NO: 3355191 - RNA, 16 nt, Neisseria meningitidis Z2491
gcaaugcacuacuuca

SEQ ID NO: 3355192 - RNA, 14 nt, Neisseria meningitidis Z2491
gcaaugccgucuga

SEQ ID NO: 3355193 - RNA, 22 nt, Neisseria meningitidis Z2491
gcaauuccugcacguugccuug

SEQ ID NO: 3355194 - RNA, 20 nt, Neisseria meningitidis Z2491
gcaauuuaucggaaaugacu

SEQ ID NO: 3355195 - RNA, 23 nt, Neisseria meningitidis Z2491
gcaauuuaucggaaaugacugaa

SEQ ID NO: 3355196 - RNA, 20 nt, Neisseria meningitidis Z2491
gcaauuuaucgggaaugacu

SEQ ID NO: 3355197 - RNA, 23 nt, Neisseria meningitidis Z2491
gcaauuuaucgggaaugacugaa

SEQ ID NO: 3355198 - RNA, 16 nt, Neisseria meningitidis Z2491
gcacaaacgccagcac

SEQ ID NO: 3355199 - RNA, 21 nt, Neisseria meningitidis Z2491
gcacaaacgccagcacaaaca

SEQ ID NO: 3355200 - RNA, 15 nt, Neisseria meningitidis Z2491
gcacaaggcggcggc

SEQ ID NO: 3355201 - RNA, 17 nt, Neisseria meningitidis Z2491
gcacacgcauuccgaca

SEQ ID NO: 3355202 - RNA, 20 nt, Neisseria meningitidis Z2491
gcacacguuugccguugaug

SEQ ID NO: 3355203 - RNA, 20 nt, Neisseria meningitidis Z2491
gcacagaaaccugcaccacg

SEQ ID NO: 3355204 - RNA, 18 nt, Neisseria meningitidis Z2491
gcacagccuauuuuucug

SEQ ID NO: 3355205 - RNA, 20 nt, Neisseria meningitidis Z2491
gcacagcgugcgcguguuug

SEQ ID NO: 3355206 - RNA, 19 nt, Neisseria meningitidis Z2491
gcacaggcucaaacagcag

SEQ ID NO: 3355207 - RNA, 20 nt, Neisseria meningitidis Z2491
gcacagucggcauacacggc

SEQ ID NO: 3355208 - RNA, 16 nt, Neisseria meningitidis Z2491
gcacauuccaucaaca

SEQ ID NO: 3355209 - RNA, 17 nt, Neisseria meningitidis Z2491
gcacauuuuuuucauac

SEQ ID NO: 3355210 - RNA, 15 nt, Neisseria meningitidis Z2491
gcaccaauucuucaa

SEQ ID NO: 3355211 - RNA, 18 nt, Neisseria meningitidis Z2491
gcaccacgucauucccac

SEQ ID NO: 3355212 - RNA, 19 nt, Neisseria meningitidis Z2491
gcaccacgucauucccacg

SEQ ID NO: 3355213 - RNA, 19 nt, Neisseria meningitidis Z2491
gcaccauugacguaguuua

SEQ ID NO: 3355214 - RNA, 12 nt, Neisseria meningitidis Z2491
gcaccgccgccc

SEQ ID NO: 3355215 - RNA, 20 nt, Neisseria meningitidis Z2491
gcaccgugugcgacaacggc

SEQ ID NO: 3355216 - RNA, 22 nt, Neisseria meningitidis Z2491
gcaccguuaacgauacggcggc

SEQ ID NO: 3355217 - RNA, 23 nt, Neisseria meningitidis Z2491
gcaccguuaacgauacggcggca

SEQ ID NO: 3355218 - RNA, 14 nt, Neisseria meningitidis Z2491
gcaccguuuuccac

SEQ ID NO: 3355219 - RNA, 14 nt, Neisseria meningitidis Z2491
gcaccuccauaauc

SEQ ID NO: 3355220 - RNA, 16 nt, Neisseria meningitidis Z2491
gcaccuuagacaaucg

SEQ ID NO: 3355221 - RNA, 21 nt, Neisseria meningitidis Z2491
gcaccuuagacaaucguucuc

SEQ ID NO: 3355222 - RNA, 14 nt, Neisseria meningitidis Z2491
gcaccuuagagaau

SEQ ID NO: 3355223 - RNA, 21 nt, Neisseria meningitidis Z2491
gcaccuuagagaaucguucuc

SEQ ID NO: 3355224 - RNA, 16 nt, Neisseria meningitidis Z2491
gcacgaaucuuaucca

SEQ ID NO: 3355225 - RNA, 14 nt, Neisseria meningitidis Z2491
gcacgauacacaaa

SEQ ID NO: 3355226 - RNA, 14 nt, Neisseria meningitidis Z2491
gcacgccgccgugu

SEQ ID NO: 3355227 - RNA, 16 nt, Neisseria meningitidis Z2491
gcacggcguucaacau

SEQ ID NO: 3355228 - RNA, 24 nt, Neisseria meningitidis Z2491
gcacgguaaaccgccagccugccg

SEQ ID NO: 3355229 - RNA, 19 nt, Neisseria meningitidis Z2491
gcacgguggcaucgucaga

SEQ ID NO: 3355230 - RNA, 20 nt, Neisseria meningitidis Z2491
gcacuacuucauuuuuucaa

SEQ ID NO: 3355231 - RNA, 21 nt, Neisseria meningitidis Z2491
gcacuagccaaaaaaaccgaa

SEQ ID NO: 3355232 - RNA, 11 nt, Neisseria meningitidis Z2491
gcagaaauaag

SEQ ID NO: 3355233 - RNA, 15 nt, Neisseria meningitidis Z2491
gcagaauaaggcaau

SEQ ID NO: 3355234 - RNA, 20 nt, Neisseria meningitidis Z2491
gcagacaaucagaucggcaa

SEQ ID NO: 3355235 - RNA, 18 nt, Neisseria meningitidis Z2491
gcagacgaacaccagccc

SEQ ID NO: 3355236 - RNA, 15 nt, Neisseria meningitidis Z2491
gcagauggcuguguu

SEQ ID NO: 3355237 - RNA, 18 nt, Neisseria meningitidis Z2491
gcagauggcuguguuccg

SEQ ID NO: 3355238 - RNA, 17 nt, Neisseria meningitidis Z2491
gcagauguucggcaaga

SEQ ID NO: 3355239 - RNA, 22 nt, Neisseria meningitidis Z2491
gcagauguucggcaagaucgga

SEQ ID NO: 3355240 - RNA, 14 nt, Neisseria meningitidis Z2491
gcagcaacgacagc

SEQ ID NO: 3355241 - RNA, 14 nt, Neisseria meningitidis Z2491
gcagcagagcugug

SEQ ID NO: 3355242 - RNA, 17 nt, Neisseria meningitidis Z2491
gcagcagcccuccccag

SEQ ID NO: 3355243 - RNA, 22 nt, Neisseria meningitidis Z2491
gcagcaguuuugccggcgcggu

SEQ ID NO: 3355244 - RNA, 15 nt, Neisseria meningitidis Z2491
gcagccauauuuuuu

SEQ ID NO: 3355245 - RNA, 23 nt, Neisseria meningitidis Z2491
gcagcccgaacacgaccaacgcc

SEQ ID NO: 3355246 - RNA, 13 nt, Neisseria meningitidis Z2491
gcagccggggcag

SEQ ID NO: 3355247 - RNA, 16 nt, Neisseria meningitidis Z2491
gcagccggggcaggcg

SEQ ID NO: 3355248 - RNA, 15 nt, Neisseria meningitidis Z2491
gcagccuaaaacauc

SEQ ID NO: 3355249 - RNA, 19 nt, Neisseria meningitidis Z2491
gcagccugcagcagagcug

SEQ ID NO: 3355250 - RNA, 19 nt, Neisseria meningitidis Z2491
gcagccugcucgagcggca

SEQ ID NO: 3355251 - RNA, 12 nt, Neisseria meningitidis Z2491
gcagcgacggau

SEQ ID NO: 3355252 - RNA, 15 nt, Neisseria meningitidis Z2491
gcagcgacggauguc

SEQ ID NO: 3355253 - RNA, 20 nt, Neisseria meningitidis Z2491
gcagcggaaaugguccgaac

SEQ ID NO: 3355254 - RNA, 12 nt, Neisseria meningitidis Z2491
gcagcuccgaac

SEQ ID NO: 3355255 - RNA, 16 nt, Neisseria meningitidis Z2491
gcagcuccgaaccgaa

SEQ ID NO: 3355256 - RNA, 18 nt, Neisseria meningitidis Z2491
gcagcuuaugcuguugca

SEQ ID NO: 3355257 - RNA, 16 nt, Neisseria meningitidis Z2491
gcagcuucgucgccuu

SEQ ID NO: 3355258 - RNA, 22 nt, Neisseria meningitidis Z2491
gcagcuucgucgccuuguccug

SEQ ID NO: 3355259 - RNA, 15 nt, Neisseria meningitidis Z2491
gcagcuugacgacaa

SEQ ID NO: 3355260 - RNA, 19 nt, Neisseria meningitidis Z2491
gcagcuuugcguuucuaga

SEQ ID NO: 3355261 - RNA, 20 nt, Neisseria meningitidis Z2491
gcaggauaaguguuuucaag

SEQ ID NO: 3355262 - RNA, 19 nt, Neisseria meningitidis Z2491
gcaggauuuuaagcuguug

SEQ ID NO: 3355263 - RNA, 22 nt, Neisseria meningitidis Z2491
gcaggcaaacgcgauuuucgac

SEQ ID NO: 3355264 - RNA, 19 nt, Neisseria meningitidis Z2491
gcaggcacaaggcggcggc

SEQ ID NO: 3355265 - RNA, 20 nt, Neisseria meningitidis Z2491
gcaggcacaaggcggcggca

SEQ ID NO: 3355266 - RNA, 15 nt, Neisseria meningitidis Z2491
gcaggcagaaaucca

SEQ ID NO: 3355267 - RNA, 22 nt, Neisseria meningitidis Z2491
gcaggcagcguucgacgaugga

SEQ ID NO: 3355268 - RNA, 20 nt, Neisseria meningitidis Z2491
gcaggcagugcaugaauuug

SEQ ID NO: 3355269 - RNA, 20 nt, Neisseria meningitidis Z2491
gcaggcgaccgccgccgcaa

SEQ ID NO: 3355270 - RNA, 14 nt, Neisseria meningitidis Z2491
gcaggcgggaaucu

SEQ ID NO: 3355271 - RNA, 18 nt, Neisseria meningitidis Z2491
gcaggcgggaaucuagaa

SEQ ID NO: 3355272 - RNA, 19 nt, Neisseria meningitidis Z2491
gcaggcgggaaucuagaaa

SEQ ID NO: 3355273 - RNA, 22 nt, Neisseria meningitidis Z2491
gcaggcgggaaucuagaaauga

SEQ ID NO: 3355274 - RNA, 18 nt, Neisseria meningitidis Z2491
gcaggcguuuuucagacg

SEQ ID NO: 3355275 - RNA, 18 nt, Neisseria meningitidis Z2491
gcaggcuuuugaggcugc

SEQ ID NO: 3355276 - RNA, 20 nt, Neisseria meningitidis Z2491
gcaggcuuuugaggcugccg

SEQ ID NO: 3355277 - RNA, 16 nt, Neisseria meningitidis Z2491
gcagggcuuuugccag

SEQ ID NO: 3355278 - RNA, 24 nt, Neisseria meningitidis Z2491
gcagguaggguguauggcguagcu

SEQ ID NO: 3355279 - RNA, 15 nt, Neisseria meningitidis Z2491
gcaggucgacggcaa

SEQ ID NO: 3355280 - RNA, 16 nt, Neisseria meningitidis Z2491
gcagguuguuggaaaa

SEQ ID NO: 3355281 - RNA, 18 nt, Neisseria meningitidis Z2491
gcagguuucugugcggau

SEQ ID NO: 3355282 - RNA, 18 nt, Neisseria meningitidis Z2491
gcaguaacuucaaacccc

SEQ ID NO: 3355283 - RNA, 20 nt, Neisseria meningitidis Z2491
gcagucuaucaguucuacac

SEQ ID NO: 3355284 - RNA, 22 nt, Neisseria meningitidis Z2491
gcagucuuccaacccuccgccg

SEQ ID NO: 3355285 - RNA, 22 nt, Neisseria meningitidis Z2491
gcccaauaccguccccgaaacc

SEQ ID NO: 3355286 - RNA, 16 nt, Neisseria meningitidis Z2491
gcccaaugccgucuga

SEQ ID NO: 3355287 - RNA, 15 nt, Neisseria meningitidis Z2491
gcccacgcccucggc

SEQ ID NO: 3355288 - RNA, 19 nt, Neisseria meningitidis Z2491
gcccacgcccucggcggcg

SEQ ID NO: 3355289 - RNA, 20 nt, Neisseria meningitidis Z2491
gcccacggggugcggguggc

SEQ ID NO: 3355290 - RNA, 21 nt, Neisseria meningitidis Z2491
gcccaucgguuugacgcagga

SEQ ID NO: 3355291 - RNA, 16 nt, Neisseria meningitidis Z2491
gcccaucgucuagagg

SEQ ID NO: 3355292 - RNA, 17 nt, Neisseria meningitidis Z2491
gccccaaaaagaggcau

SEQ ID NO: 3355293 - RNA, 14 nt, Neisseria meningitidis Z2491
gccccaauaccaac

SEQ ID NO: 3355294 - RNA, 18 nt, Neisseria meningitidis Z2491
gccccacauaaacagcac

SEQ ID NO: 3355295 - RNA, 15 nt, Neisseria meningitidis Z2491
gccccaguucuucga

SEQ ID NO: 3355296 - RNA, 12 nt, Neisseria meningitidis Z2491
gccccggcuggu

SEQ ID NO: 3355297 - RNA, 21 nt, Neisseria meningitidis Z2491
gccccguuuuacccucucccc

SEQ ID NO: 3355298 - RNA, 17 nt, Neisseria meningitidis Z2491
gcccgaauaaaaaauau

SEQ ID NO: 3355299 - RNA, 20 nt, Neisseria meningitidis Z2491
gcccgaauaaaaaauaugga

SEQ ID NO: 3355300 - RNA, 18 nt, Neisseria meningitidis Z2491
gcccgaauugcgccgaca

SEQ ID NO: 3355301 - RNA, 22 nt, Neisseria meningitidis Z2491
gcccgaauugcgccgacagcag

SEQ ID NO: 3355302 - RNA, 17 nt, Neisseria meningitidis Z2491
gcccgacaucaagcugu

SEQ ID NO: 3355303 - RNA, 18 nt, Neisseria meningitidis Z2491
gcccgagauuacagaaac

SEQ ID NO: 3355304 - RNA, 18 nt, Neisseria meningitidis Z2491
gcccgcaaucugaaauuu

SEQ ID NO: 3355305 - RNA, 21 nt, Neisseria meningitidis Z2491
gcccgcagccggggcaggcgg

SEQ ID NO: 3355306 - RNA, 20 nt, Neisseria meningitidis Z2491
gcccggaaaggcaaacccga

SEQ ID NO: 3355307 - RNA, 15 nt, Neisseria meningitidis Z2491
gcccgucaacacaaa

SEQ ID NO: 3355308 - RNA, 17 nt, Neisseria meningitidis Z2491
gcccgucccgacucaua

SEQ ID NO: 3355309 - RNA, 21 nt, Neisseria meningitidis Z2491
gcccgucccgaugccgcaacc

SEQ ID NO: 3355310 - RNA, 20 nt, Neisseria meningitidis Z2491
gcccucagcuaugccugccg

SEQ ID NO: 3355311 - RNA, 20 nt, Neisseria meningitidis Z2491
gcccucucauuugccgaaca

SEQ ID NO: 3355312 - RNA, 13 nt, Neisseria meningitidis Z2491
gcccugcauggga

SEQ ID NO: 3355313 - RNA, 17 nt, Neisseria meningitidis Z2491
gcccugccgcuucacac

SEQ ID NO: 3355314 - RNA, 13 nt, Neisseria meningitidis Z2491
gcccuuucagacg

SEQ ID NO: 3355315 - RNA, 19 nt, Neisseria meningitidis Z2491
gcccuuuuguaaaggaagu

SEQ ID NO: 3355316 - RNA, 15 nt, Neisseria meningitidis Z2491
gccgaaaccaaaagc

SEQ ID NO: 3355317 - RNA, 14 nt, Neisseria meningitidis Z2491
gccgaauugcagcg

SEQ ID NO: 3355318 - RNA, 16 nt, Neisseria meningitidis Z2491
gccgacacacggauuu

SEQ ID NO: 3355319 - RNA, 13 nt, Neisseria meningitidis Z2491
gccgaccgccaua

SEQ ID NO: 3355320 - RNA, 15 nt, Neisseria meningitidis Z2491
gccgacgaccaaugc

SEQ ID NO: 3355321 - RNA, 17 nt, Neisseria meningitidis Z2491
gccgacuuuuuccagca

SEQ ID NO: 3355322 - RNA, 17 nt, Neisseria meningitidis Z2491
gccgagcaggugcuggg

SEQ ID NO: 3355323 - RNA, 16 nt, Neisseria meningitidis Z2491
gccgaugcagcgacgg

SEQ ID NO: 3355324 - RNA, 18 nt, Neisseria meningitidis Z2491
gccgaugcagcgacggau

SEQ ID NO: 3355325 - RNA, 23 nt, Neisseria meningitidis Z2491
gccgauucggcguugcccggaaa

SEQ ID NO: 3355326 - RNA, 20 nt, Neisseria meningitidis Z2491
gccgauuuuggguuucuguu

SEQ ID NO: 3355327 - RNA, 14 nt, Neisseria meningitidis Z2491
gccgcaaaccgggc

SEQ ID NO: 3355328 - RNA, 14 nt, Neisseria meningitidis Z2491
gccgcaaaugccgu

SEQ ID NO: 3355329 - RNA, 14 nt, Neisseria meningitidis Z2491
gccgcaaucgccgg

SEQ ID NO: 3355330 - RNA, 13 nt, Neisseria meningitidis Z2491
gccgcacaaaccg

SEQ ID NO: 3355331 - RNA, 14 nt, Neisseria meningitidis Z2491
gccgcacaaaccgc

SEQ ID NO: 3355332 - RNA, 16 nt, Neisseria meningitidis Z2491
gccgcagacaguacaa

SEQ ID NO: 3355333 - RNA, 21 nt, Neisseria meningitidis Z2491
gccgcagcaaaauauggcuga

SEQ ID NO: 3355334 - RNA, 20 nt, Neisseria meningitidis Z2491
gccgcauaaaucaacagcag

SEQ ID NO: 3355335 - RNA, 22 nt, Neisseria meningitidis Z2491
gccgcauugucccugugcgccg

SEQ ID NO: 3355336 - RNA, 14 nt, Neisseria meningitidis Z2491
gccgccaaagugcc

SEQ ID NO: 3355337 - RNA, 18 nt, Neisseria meningitidis Z2491
gccgccauaucguccgcc

SEQ ID NO: 3355338 - RNA, 18 nt, Neisseria meningitidis Z2491
gccgccaugucgcgggcg

SEQ ID NO: 3355339 - RNA, 14 nt, Neisseria meningitidis Z2491
gccgccccaaugcg

SEQ ID NO: 3355340 - RNA, 18 nt, Neisseria meningitidis Z2491
gccgccccuuaugccuuu

SEQ ID NO: 3355341 - RNA, 18 nt, Neisseria meningitidis Z2491
gccgcccgcccggcagga

SEQ ID NO: 3355342 - RNA, 19 nt, Neisseria meningitidis Z2491
gccgcccgucccgaugccg

SEQ ID NO: 3355343 - RNA, 12 nt, Neisseria meningitidis Z2491
gccgccgcccgg

SEQ ID NO: 3355344 - RNA, 13 nt, Neisseria meningitidis Z2491
gccgccgccgaca

SEQ ID NO: 3355345 - RNA, 21 nt, Neisseria meningitidis Z2491
gccgccggaagauuccggcgg

SEQ ID NO: 3355346 - RNA, 13 nt, Neisseria meningitidis Z2491
gccgccguccauc

SEQ ID NO: 3355347 - RNA, 18 nt, Neisseria meningitidis Z2491
gccgccgucuugggaaau

SEQ ID NO: 3355348 - RNA, 20 nt, Neisseria meningitidis Z2491
gccgccugaugauuuuuuca

SEQ ID NO: 3355349 - RNA, 12 nt, Neisseria meningitidis Z2491
gccgccugccug

SEQ ID NO: 3355350 - RNA, 14 nt, Neisseria meningitidis Z2491
gccgccuuguccug

SEQ ID NO: 3355351 - RNA, 13 nt, Neisseria meningitidis Z2491
gccgccuuugcca

SEQ ID NO: 3355352 - RNA, 23 nt, Neisseria meningitidis Z2491
gccgccuuuuuccacgccgggca

SEQ ID NO: 3355353 - RNA, 20 nt, Neisseria meningitidis Z2491
gccgcgauuccggcgcggcg

SEQ ID NO: 3355354 - RNA, 17 nt, Neisseria meningitidis Z2491
gccgcgccgauguccug

SEQ ID NO: 3355355 - RNA, 22 nt, Neisseria meningitidis Z2491
gccgcgccugcguuugccgcca

SEQ ID NO: 3355356 - RNA, 21 nt, Neisseria meningitidis Z2491
gccgcuguacgaauccgccgg

SEQ ID NO: 3355357 - RNA, 20 nt, Neisseria meningitidis Z2491
gccgcuguauuugcgccgcc

SEQ ID NO: 3355358 - RNA, 18 nt, Neisseria meningitidis Z2491
gccgcuucaccgacaccg

SEQ ID NO: 3355359 - RNA, 22 nt, Neisseria meningitidis Z2491
gccggaaaaccuugccgcccgu

SEQ ID NO: 3355360 - RNA, 19 nt, Neisseria meningitidis Z2491
gccggaaauaccgacggcg

SEQ ID NO: 3355361 - RNA, 20 nt, Neisseria meningitidis Z2491
gccggaagauuccggcggcu

SEQ ID NO: 3355362 - RNA, 13 nt, Neisseria meningitidis Z2491
gccggcgaugccg

SEQ ID NO: 3355363 - RNA, 13 nt, Neisseria meningitidis Z2491
gccggcggcgagc

SEQ ID NO: 3355364 - RNA, 14 nt, Neisseria meningitidis Z2491
gccggggcaaacau

SEQ ID NO: 3355365 - RNA, 19 nt, Neisseria meningitidis Z2491
gccguagauguggucggca

SEQ ID NO: 3355366 - RNA, 20 nt, Neisseria meningitidis Z2491
gccguauuuuuuaaccaacu

SEQ ID NO: 3355367 - RNA, 14 nt, Neisseria meningitidis Z2491
gccgucaaucagcu

SEQ ID NO: 3355368 - RNA, 14 nt, Neisseria meningitidis Z2491
gccgucauucccgc

SEQ ID NO: 3355369 - RNA, 21 nt, Neisseria meningitidis Z2491
gccgucauucccgcaaaagcg

SEQ ID NO: 3355370 - RNA, 17 nt, Neisseria meningitidis Z2491
gccgucauucccgcgca

SEQ ID NO: 3355371 - RNA, 18 nt, Neisseria meningitidis Z2491
gccgucauucccgcgcag

SEQ ID NO: 3355372 - RNA, 21 nt, Neisseria meningitidis Z2491
gccguccgaaagguuuucgga

SEQ ID NO: 3355373 - RNA, 15 nt, Neisseria meningitidis Z2491
gccguccgaaccgca

SEQ ID NO: 3355374 - RNA, 16 nt, Neisseria meningitidis Z2491
gccgucugaaaccugu

SEQ ID NO: 3355375 - RNA, 15 nt, Neisseria meningitidis Z2491
gccgucugaaaggcu

SEQ ID NO: 3355376 - RNA, 15 nt, Neisseria meningitidis Z2491
gccgucugaaagggc

SEQ ID NO: 3355377 - RNA, 13 nt, Neisseria meningitidis Z2491
gccgucugaaauc

SEQ ID NO: 3355378 - RNA, 15 nt, Neisseria meningitidis Z2491
gccgucugaaauguu

SEQ ID NO: 3355379 - RNA, 23 nt, Neisseria meningitidis Z2491
gccgucugaaauguucagacggc

SEQ ID NO: 3355380 - RNA, 18 nt, Neisseria meningitidis Z2491
gccgucugaacccgccug

SEQ ID NO: 3355381 - RNA, 11 nt, Neisseria meningitidis Z2491
gccgucugaag

SEQ ID NO: 3355382 - RNA, 16 nt, Neisseria meningitidis Z2491
gccgucugaagcccug

SEQ ID NO: 3355383 - RNA, 14 nt, Neisseria meningitidis Z2491
gccgucugaagccu

SEQ ID NO: 3355384 - RNA, 15 nt, Neisseria meningitidis Z2491
gccgucugaagccug

SEQ ID NO: 3355385 - RNA, 21 nt, Neisseria meningitidis Z2491
gccgucugaagccuucagacg

SEQ ID NO: 3355386 - RNA, 16 nt, Neisseria meningitidis Z2491
gccgucugaagcggaa

SEQ ID NO: 3355387 - RNA, 22 nt, Neisseria meningitidis Z2491
gcggaaaaaucauaagacggau

SEQ ID NO: 3355388 - RNA, 22 nt, Neisseria meningitidis Z2491
gcggaaacuuaucggguaaaac

SEQ ID NO: 3355389 - RNA, 19 nt, Neisseria meningitidis Z2491
gcggaaaucguaggucuuc

SEQ ID NO: 3355390 - RNA, 20 nt, Neisseria meningitidis Z2491
gcggacuggauucccgccug

SEQ ID NO: 3355391 - RNA, 16 nt, Neisseria meningitidis Z2491
gcggacuuaagaaaca

SEQ ID NO: 3355392 - RNA, 17 nt, Neisseria meningitidis Z2491
gcggacuuaagaaacaa

SEQ ID NO: 3355393 - RNA, 12 nt, Neisseria meningitidis Z2491
gcggagaggcuu

SEQ ID NO: 3355394 - RNA, 16 nt, Neisseria meningitidis Z2491
gcggagguugacggcu

SEQ ID NO: 3355395 - RNA, 14 nt, Neisseria meningitidis Z2491
gcggaugaauuuaa

SEQ ID NO: 3355396 - RNA, 18 nt, Neisseria meningitidis Z2491
gcggauugcccgaugccg

SEQ ID NO: 3355397 - RNA, 20 nt, Neisseria meningitidis Z2491
gcggcaaauuccgucagcac

SEQ ID NO: 3355398 - RNA, 14 nt, Neisseria meningitidis Z2491
gcggcaauauucaa

SEQ ID NO: 3355399 - RNA, 18 nt, Neisseria meningitidis Z2491
gcggcaauauucaaagau

SEQ ID NO: 3355400 - RNA, 13 nt, Neisseria meningitidis Z2491
gcggcaaugccgu

SEQ ID NO: 3355401 - RNA, 20 nt, Neisseria meningitidis Z2491
gcggcagauaaauacccaua

SEQ ID NO: 3355402 - RNA, 14 nt, Neisseria meningitidis Z2491
gcggcaggcagggu

SEQ ID NO: 3355403 - RNA, 19 nt, Neisseria meningitidis Z2491
gcggcagggucggcgacgg

SEQ ID NO: 3355404 - RNA, 20 nt, Neisseria meningitidis Z2491
gcggcagggucggcgacggc

SEQ ID NO: 3355405 - RNA, 19 nt, Neisseria meningitidis Z2491
gcggcaggucuucgggcag

SEQ ID NO: 3355406 - RNA, 17 nt, Neisseria meningitidis Z2491
gcggcagugguuggcga

SEQ ID NO: 3355407 - RNA, 15 nt, Neisseria meningitidis Z2491
gcggccgcgcccgca

SEQ ID NO: 3355408 - RNA, 12 nt, Neisseria meningitidis Z2491
gcggccugguug

SEQ ID NO: 3355409 - RNA, 14 nt, Neisseria meningitidis Z2491
gcggcgagcagggu

SEQ ID NO: 3355410 - RNA, 18 nt, Neisseria meningitidis Z2491
gcggcgagccgcagacgg

SEQ ID NO: 3355411 - RNA, 12 nt, Neisseria meningitidis Z2491
gcggcgcggcgg

SEQ ID NO: 3355412 - RNA, 15 nt, Neisseria meningitidis Z2491
gcggcgcggcgggcg

SEQ ID NO: 3355413 - RNA, 11 nt, Neisseria meningitidis Z2491
gcggcggauuc

SEQ ID NO: 3355414 - RNA, 15 nt, Neisseria meningitidis Z2491
gcggcgguaucaggc

SEQ ID NO: 3355415 - RNA, 14 nt, Neisseria meningitidis Z2491
gcggcgguuuccug

SEQ ID NO: 3355416 - RNA, 22 nt, Neisseria meningitidis Z2491
gcggcucugaaaccauaccgcc

SEQ ID NO: 3355417 - RNA, 13 nt, Neisseria meningitidis Z2491
gcggcugcgggcg

SEQ ID NO: 3355418 - RNA, 13 nt, Neisseria meningitidis Z2491
gcggcuugccgcc

SEQ ID NO: 3355419 - RNA, 15 nt, Neisseria meningitidis Z2491
gcggcuugccgccgc

SEQ ID NO: 3355420 - RNA, 13 nt, Neisseria meningitidis Z2491
gcggcuugggcga

SEQ ID NO: 3355421 - RNA, 18 nt, Neisseria meningitidis Z2491
gcgggaacuugauucaag

SEQ ID NO: 3355422 - RNA, 16 nt, Neisseria meningitidis Z2491
gcgggaagccagggcg

SEQ ID NO: 3355423 - RNA, 19 nt, Neisseria meningitidis Z2491
gcgggaagccagggcggau

SEQ ID NO: 3355424 - RNA, 14 nt, Neisseria meningitidis Z2491
gcgggaauagcuca

SEQ ID NO: 3355425 - RNA, 17 nt, Neisseria meningitidis Z2491
gcgggaauccaaacuug

SEQ ID NO: 3355426 - RNA, 13 nt, Neisseria meningitidis Z2491
gcgggaauccaga

SEQ ID NO: 3355427 - RNA, 21 nt, Neisseria meningitidis Z2491
gcgggaauccagacauucaau

SEQ ID NO: 3355428 - RNA, 13 nt, Neisseria meningitidis Z2491
gcgggaauccagg

SEQ ID NO: 3355429 - RNA, 20 nt, Neisseria meningitidis Z2491
gcgggaauccggaaacgaaa

SEQ ID NO: 3355430 - RNA, 21 nt, Neisseria meningitidis Z2491
gcgggaaucuaaaaauccaac

SEQ ID NO: 3355431 - RNA, 20 nt, Neisseria meningitidis Z2491
gcgggaaucuagaaacucaa

SEQ ID NO: 3355432 - RNA, 17 nt, Neisseria meningitidis Z2491
gcgggaaucuagaccuu

SEQ ID NO: 3355433 - RNA, 11 nt, Neisseria meningitidis Z2491
gcgggaaugac

SEQ ID NO: 3355434 - RNA, 20 nt, Neisseria meningitidis Z2491
gcgggaaugacgaauccauc

SEQ ID NO: 3355435 - RNA, 15 nt, Neisseria meningitidis Z2491
gcgggaaugacggau

SEQ ID NO: 3355436 - RNA, 16 nt, Neisseria meningitidis Z2491
gcgggaaugacggcag

SEQ ID NO: 3355437 - RNA, 16 nt, Neisseria meningitidis Z2491
gcgggaaugacgggau

SEQ ID NO: 3355438 - RNA, 18 nt, Neisseria meningitidis Z2491
gcgggauuacugccgcaa

SEQ ID NO: 3355439 - RNA, 19 nt, Neisseria meningitidis Z2491
gcgggccuuuggcggcggc

SEQ ID NO: 3355440 - RNA, 20 nt, Neisseria meningitidis Z2491
gcgggccuuuggcggcggca

SEQ ID NO: 3355441 - RNA, 16 nt, Neisseria meningitidis Z2491
gcgggcgggguugcug

SEQ ID NO: 3355442 - RNA, 13 nt, Neisseria meningitidis Z2491
gcgggcuauaggg

SEQ ID NO: 3355443 - RNA, 17 nt, Neisseria meningitidis Z2491
gcgggcuuggaaaucuu

SEQ ID NO: 3355444 - RNA, 18 nt, Neisseria meningitidis Z2491
gcggggcaacgccguacc

SEQ ID NO: 3355445 - RNA, 22 nt, Neisseria meningitidis Z2491
gcggguggcgaagccggcggcg

SEQ ID NO: 3355446 - RNA, 22 nt, Neisseria meningitidis Z2491
gcggguuuggaaugcgcgacgg

SEQ ID NO: 3355447 - RNA, 20 nt, Neisseria meningitidis Z2491
gcggguuuugccgaaauccu

SEQ ID NO: 3355448 - RNA, 17 nt, Neisseria meningitidis Z2491
gcgguaauuuccgacca

SEQ ID NO: 3355449 - RNA, 14 nt, Neisseria meningitidis Z2491
gcgguagccgccuu

SEQ ID NO: 3355450 - RNA, 19 nt, Neisseria meningitidis Z2491
gcgguaggauguggguuug

SEQ ID NO: 3355451 - RNA, 14 nt, Neisseria meningitidis Z2491
gcggucauuuaucg

SEQ ID NO: 3355452 - RNA, 23 nt, Neisseria meningitidis Z2491
gcgguccaaaacggcggcagccu

SEQ ID NO: 3355453 - RNA, 18 nt, Neisseria meningitidis Z2491
gcggucgcaucggcggcg

SEQ ID NO: 3355454 - RNA, 22 nt, Neisseria meningitidis Z2491
gcggucggagaggucuugcagg

SEQ ID NO: 3355455 - RNA, 13 nt, Neisseria meningitidis Z2491
gcggugcgcggca

SEQ ID NO: 3355456 - RNA, 23 nt, Neisseria meningitidis Z2491
gcggugcgcuaaggagcuguucg

SEQ ID NO: 3355457 - RNA, 19 nt, Neisseria meningitidis Z2491
gcgguuguggaaggcgggc

SEQ ID NO: 3355458 - RNA, 14 nt, Neisseria meningitidis Z2491
gcgguuugcggcgg

SEQ ID NO: 3355459 - RNA, 20 nt, Neisseria meningitidis Z2491
gcguaaaacgguguggagag

SEQ ID NO: 3355460 - RNA, 19 nt, Neisseria meningitidis Z2491
gcguaacaaugcggaaaug

SEQ ID NO: 3355461 - RNA, 18 nt, Neisseria meningitidis Z2491
gcguacuuuauccaccaa

SEQ ID NO: 3355462 - RNA, 18 nt, Neisseria meningitidis Z2491
gcguagccggccaacauc

SEQ ID NO: 3355463 - RNA, 19 nt, Neisseria meningitidis Z2491
gcguaggguugaagaaacc

SEQ ID NO: 3355464 - RNA, 16 nt, Neisseria meningitidis Z2491
gcguaggucagcccgg

SEQ ID NO: 3355465 - RNA, 18 nt, Neisseria meningitidis Z2491
gcguaggucagcccggcg

SEQ ID NO: 3355466 - RNA, 17 nt, Neisseria meningitidis Z2491
gcguaucaaaaaauaaa

SEQ ID NO: 3355467 - RNA, 15 nt, Neisseria meningitidis Z2491
gcguauccagccgcc

SEQ ID NO: 3355468 - RNA, 15 nt, Neisseria meningitidis Z2491
gcgucaaaaacgggc

SEQ ID NO: 3355469 - RNA, 14 nt, Neisseria meningitidis Z2491
gcgucaaaccagcu

SEQ ID NO: 3355470 - RNA, 13 nt, Neisseria meningitidis Z2491
gcgucauucccgc

SEQ ID NO: 3355471 - RNA, 21 nt, Neisseria meningitidis Z2491
gcguccaacacgcagccgagc

SEQ ID NO: 3355472 - RNA, 15 nt, Neisseria meningitidis Z2491
gcgugacgaaaauuu

SEQ ID NO: 3355473 - RNA, 18 nt, Neisseria meningitidis Z2491
gcgugcggacguucaaac

SEQ ID NO: 3355474 - RNA, 19 nt, Neisseria meningitidis Z2491
gcgugcgguguucagcauu

SEQ ID NO: 3355475 - RNA, 13 nt, Neisseria meningitidis Z2491
gcguggaggggca

SEQ ID NO: 3355476 - RNA, 19 nt, Neisseria meningitidis Z2491
gcguguauuuugguagcug

SEQ ID NO: 3355477 - RNA, 16 nt, Neisseria meningitidis Z2491
gcguguuugccgcgau

SEQ ID NO: 3355478 - RNA, 22 nt, Neisseria meningitidis Z2491
gcguguuuguuucagacggcau

SEQ ID NO: 3355479 - RNA, 23 nt, Neisseria meningitidis Z2491
gcguuacacuuugggcuucgacg

SEQ ID NO: 3355480 - RNA, 17 nt, Neisseria meningitidis Z2491
gcguucaacauccgcag

SEQ ID NO: 3355481 - RNA, 19 nt, Neisseria meningitidis Z2491
gcguucgcgggaaugacgg

SEQ ID NO: 3355482 - RNA, 20 nt, Neisseria meningitidis Z2491
gcguucggauucggaugccu

SEQ ID NO: 3355483 - RNA, 12 nt, Neisseria meningitidis Z2491
gcguucgugcag

SEQ ID NO: 3355484 - RNA, 16 nt, Neisseria meningitidis Z2491
gcguucuucuucgacg

SEQ ID NO: 3355485 - RNA, 16 nt, Neisseria meningitidis Z2491
gcguuguccaaacccg

SEQ ID NO: 3355486 - RNA, 20 nt, Neisseria meningitidis Z2491
gcguuguccaaacccgcccg

SEQ ID NO: 3355487 - RNA, 19 nt, Neisseria meningitidis Z2491
gcguuuugacaaaaucagu

SEQ ID NO: 3355488 - RNA, 14 nt, Neisseria meningitidis Z2491
gcguuuuggcucau

SEQ ID NO: 3355489 - RNA, 19 nt, Neisseria meningitidis Z2491
gcuugagcgacagcggccg

SEQ ID NO: 3355490 - RNA, 19 nt, Neisseria meningitidis Z2491
gcuugaucugcaccccaaa

SEQ ID NO: 3355491 - RNA, 21 nt, Neisseria meningitidis Z2491
gcuugcccacgcacccaaacg

SEQ ID NO: 3355492 - RNA, 23 nt, Neisseria meningitidis Z2491
gcuugcccacgcacccaaacggc

SEQ ID NO: 3355493 - RNA, 14 nt, Neisseria meningitidis Z2491
gcuugccgccgcca

SEQ ID NO: 3355494 - RNA, 14 nt, Neisseria meningitidis Z2491
gcuugguuuugcuu

SEQ ID NO: 3355495 - RNA, 19 nt, Neisseria meningitidis Z2491
gcuugugaaugcggcggca

SEQ ID NO: 3355496 - RNA, 17 nt, Neisseria meningitidis Z2491
gcuuuaagcaaucaucu

SEQ ID NO: 3355497 - RNA, 14 nt, Neisseria meningitidis Z2491
gcuuuaauucucca

SEQ ID NO: 3355498 - RNA, 20 nt, Neisseria meningitidis Z2491
gcuuuaccguuucagugcca

SEQ ID NO: 3355499 - RNA, 11 nt, Neisseria meningitidis Z2491
gcuuucagacg

SEQ ID NO: 3355500 - RNA, 16 nt, Neisseria meningitidis Z2491
gcuuucagacggcauu

SEQ ID NO: 3355501 - RNA, 22 nt, Neisseria meningitidis Z2491
gcuuuccaguugggcuuugagu

SEQ ID NO: 3355502 - RNA, 22 nt, Neisseria meningitidis Z2491
gcuuucggguaugccagcgcga

SEQ ID NO: 3355503 - RNA, 19 nt, Neisseria meningitidis Z2491
gcuuuggcagcccauucug

SEQ ID NO: 3355504 - RNA, 21 nt, Neisseria meningitidis Z2491
gcuuuguaagaguucguccca

SEQ ID NO: 3355505 - RNA, 19 nt, Neisseria meningitidis Z2491
gcuuuuagccuuuuguuuu

SEQ ID NO: 3355506 - RNA, 13 nt, Neisseria meningitidis Z2491
gcuuuugcagaau

SEQ ID NO: 3355507 - RNA, 18 nt, Neisseria meningitidis Z2491
gcuuuuucagacggcauu

SEQ ID NO: 3355508 - RNA, 12 nt, Neisseria meningitidis Z2491
gcuuuuuccugu

SEQ ID NO: 3355509 - RNA, 13 nt, Neisseria meningitidis Z2491
gcuuuuuucuguu

SEQ ID NO: 3355510 - RNA, 12 nt, Neisseria meningitidis Z2491
ggaaaaaaccga

SEQ ID NO: 3355511 - RNA, 18 nt, Neisseria meningitidis Z2491
ggaaaaacagcaaccuuu

SEQ ID NO: 3355512 - RNA, 18 nt, Neisseria meningitidis Z2491
ggaaaaccguguuucaga

SEQ ID NO: 3355513 - RNA, 13 nt, Neisseria meningitidis Z2491
ggaaaccaaaaaa

SEQ ID NO: 3355514 - RNA, 14 nt, Neisseria meningitidis Z2491
ggaaacucaaaaaa

SEQ ID NO: 3355515 - RNA, 18 nt, Neisseria meningitidis Z2491
ggaaacuuuucauaucau

SEQ ID NO: 3355516 - RNA, 15 nt, Neisseria meningitidis Z2491
ggaaaggcaaaugcc

SEQ ID NO: 3355517 - RNA, 21 nt, Neisseria meningitidis Z2491
ggaaagugauuuugucggcaa

SEQ ID NO: 3355518 - RNA, 18 nt, Neisseria meningitidis Z2491
ggaaaguggaacagaaag

SEQ ID NO: 3355519 - RNA, 20 nt, Neisseria meningitidis Z2491
ggaaaguggguguagcgugg

SEQ ID NO: 3355520 - RNA, 17 nt, Neisseria meningitidis Z2491
ggaaaucguaggucuuc

SEQ ID NO: 3355521 - RNA, 13 nt, Neisseria meningitidis Z2491
ggaaaugacugaa

SEQ ID NO: 3355522 - RNA, 20 nt, Neisseria meningitidis Z2491
ggaaaugacugaaacucaaa

SEQ ID NO: 3355523 - RNA, 16 nt, Neisseria meningitidis Z2491
ggaaaugccgucugaa

SEQ ID NO: 3355524 - RNA, 17 nt, Neisseria meningitidis Z2491
ggaaaugucgcccgaca

SEQ ID NO: 3355525 - RNA, 21 nt, Neisseria meningitidis Z2491
ggaaauugccuucaucagcau

SEQ ID NO: 3355526 - RNA, 22 nt, Neisseria meningitidis Z2491
ggaaauugccuucaucagcauu

SEQ ID NO: 3355527 - RNA, 14 nt, Neisseria meningitidis Z2491
ggaacaaaaaauau

SEQ ID NO: 3355528 - RNA, 17 nt, Neisseria meningitidis Z2491
ggaacaaagaaagcaga

SEQ ID NO: 3355529 - RNA, 18 nt, Neisseria meningitidis Z2491
ggaacgcgucaaccuuaa

SEQ ID NO: 3355530 - RNA, 19 nt, Neisseria meningitidis Z2491
ggaaggaugggguuucaga

SEQ ID NO: 3355531 - RNA, 17 nt, Neisseria meningitidis Z2491
ggaaggcggggcgguca

SEQ ID NO: 3355532 - RNA, 22 nt, Neisseria meningitidis Z2491
ggaaguaaccccuuccaaauca

SEQ ID NO: 3355533 - RNA, 16 nt, Neisseria meningitidis Z2491
ggaauaagucagcgug

SEQ ID NO: 3355534 - RNA, 18 nt, Neisseria meningitidis Z2491
ggaauagcucaguuggua

SEQ ID NO: 3355535 - RNA, 23 nt, Neisseria meningitidis Z2491
ggaauaugguugaaacccggcca

SEQ ID NO: 3355536 - RNA, 23 nt, Neisseria meningitidis Z2491
ggaauccagacauucaaugcuaa

SEQ ID NO: 3355537 - RNA, 15 nt, Neisseria meningitidis Z2491
ggaauccaguuucuu

SEQ ID NO: 3355538 - RNA, 12 nt, Neisseria meningitidis Z2491
ggaaucuagaaa

SEQ ID NO: 3355539 - RNA, 12 nt, Neisseria meningitidis Z2491
ggaaucuagaac

SEQ ID NO: 3355540 - RNA, 20 nt, Neisseria meningitidis Z2491
ggaaucuagaaccucuaaac

SEQ ID NO: 3355541 - RNA, 12 nt, Neisseria meningitidis Z2491
ggaaucuagaau

SEQ ID NO: 3355542 - RNA, 14 nt, Neisseria meningitidis Z2491
ggaaucuagacauu

SEQ ID NO: 3355543 - RNA, 23 nt, Neisseria meningitidis Z2491
ggaaucuagacauucaaugcuaa

SEQ ID NO: 3355544 - RNA, 19 nt, Neisseria meningitidis Z2491
ggaaucuaggucuuuaaac

SEQ ID NO: 3355545 - RNA, 17 nt, Neisseria meningitidis Z2491
ggaaugacgaaagguug

SEQ ID NO: 3355546 - RNA, 23 nt, Neisseria meningitidis Z2491
ggaaugacgcggaaaaguugcug

SEQ ID NO: 3355547 - RNA, 16 nt, Neisseria meningitidis Z2491
ggaaugacggcagagc

SEQ ID NO: 3355548 - RNA, 19 nt, Neisseria meningitidis Z2491
ggaaugacgggaugcaggu

SEQ ID NO: 3355549 - RNA, 16 nt, Neisseria meningitidis Z2491
ggaaugacugaaacuc

SEQ ID NO: 3355550 - RNA, 13 nt, Neisseria meningitidis Z2491
ggaaugauggggu

SEQ ID NO: 3355551 - RNA, 17 nt, Neisseria meningitidis Z2491
ggaaugaugggguuuuu

SEQ ID NO: 3355552 - RNA, 19 nt, Neisseria meningitidis Z2491
ggaaugcguuuucggguuc

SEQ ID NO: 3355553 - RNA, 21 nt, Neisseria meningitidis Z2491
ggaauuugcggcaaauuuaca

SEQ ID NO: 3355554 - RNA, 17 nt, Neisseria meningitidis Z2491
ggaauuuugcaaagguc

SEQ ID NO: 3355555 - RNA, 23 nt, Neisseria meningitidis Z2491
ggacaaaaaaccaaaacagaaac

SEQ ID NO: 3355556 - RNA, 19 nt, Neisseria meningitidis Z2491
ggacaaaguuggcaaggaa

SEQ ID NO: 3355557 - RNA, 14 nt, Neisseria meningitidis Z2491
ggacaacggcacug

SEQ ID NO: 3355558 - RNA, 18 nt, Neisseria meningitidis Z2491
ggacagaaacgaaaaugc

SEQ ID NO: 3355559 - RNA, 16 nt, Neisseria meningitidis Z2491
ggacagcggcaauauu

SEQ ID NO: 3355560 - RNA, 22 nt, Neisseria meningitidis Z2491
ggacagcggcaauauucaaaga

SEQ ID NO: 3355561 - RNA, 19 nt, Neisseria meningitidis Z2491
ggacagcguaacuuccgaa

SEQ ID NO: 3355562 - RNA, 17 nt, Neisseria meningitidis Z2491
ggacagcgugaaaccuu

SEQ ID NO: 3355563 - RNA, 20 nt, Neisseria meningitidis Z2491
ggacgcgugcaaucagugcg

SEQ ID NO: 3355564 - RNA, 21 nt, Neisseria meningitidis Z2491
ggagaaaauauagccgaccgc

SEQ ID NO: 3355565 - RNA, 13 nt, Neisseria meningitidis Z2491
ggagaaugccguc

SEQ ID NO: 3355566 - RNA, 21 nt, Neisseria meningitidis Z2491
ggagacauucgcguucggcuu

SEQ ID NO: 3355567 - RNA, 23 nt, Neisseria meningitidis Z2491
ggagcaggcacaaggcggcggca

SEQ ID NO: 3355568 - RNA, 15 nt, Neisseria meningitidis Z2491
ggagccuaucaucag

SEQ ID NO: 3355569 - RNA, 13 nt, Neisseria meningitidis Z2491
ggagcgguuucug

SEQ ID NO: 3355570 - RNA, 14 nt, Neisseria meningitidis Z2491
ggagcgguuucugu

SEQ ID NO: 3355571 - RNA, 14 nt, Neisseria meningitidis Z2491
ggagguaacgguuu

SEQ ID NO: 3355572 - RNA, 15 nt, Neisseria meningitidis Z2491
ggaguccuuauuggg

SEQ ID NO: 3355573 - RNA, 12 nt, Neisseria meningitidis Z2491
ggauaaacauua

SEQ ID NO: 3355574 - RNA, 15 nt, Neisseria meningitidis Z2491
ggauaaacauuaucu

SEQ ID NO: 3355575 - RNA, 20 nt, Neisseria meningitidis Z2491
ggauaaggucgagcaggaug

SEQ ID NO: 3355576 - RNA, 18 nt, Neisseria meningitidis Z2491
ggauaauucauacaaauu

SEQ ID NO: 3355577 - RNA, 12 nt, Neisseria meningitidis Z2491
ggauacaaaucc

SEQ ID NO: 3355578 - RNA, 14 nt, Neisseria meningitidis Z2491
ggauaggcaaaaac

SEQ ID NO: 3355579 - RNA, 23 nt, Neisseria meningitidis Z2491
ggauauucccccgcgcaggcggu

SEQ ID NO: 3355580 - RNA, 15 nt, Neisseria meningitidis Z2491
ggauauuuucuuccg

SEQ ID NO: 3355581 - RNA, 16 nt, Neisseria meningitidis Z2491
ggaucagacauuaaaa

SEQ ID NO: 3355582 - RNA, 20 nt, Neisseria meningitidis Z2491
ggaucagacauuaaaaaaua

SEQ ID NO: 3355583 - RNA, 19 nt, Neisseria meningitidis Z2491
ggaugacgguaucgccguu

SEQ ID NO: 3355584 - RNA, 17 nt, Neisseria meningitidis Z2491
ggaugccgcgccgccgg

SEQ ID NO: 3355585 - RNA, 20 nt, Neisseria meningitidis Z2491
ggaugccugcucaaauaggc

SEQ ID NO: 3355586 - RNA, 14 nt, Neisseria meningitidis Z2491
ggauggggugcggc

SEQ ID NO: 3355587 - RNA, 23 nt, Neisseria meningitidis Z2491
ggauguucaaacacgggcaaccu

SEQ ID NO: 3355588 - RNA, 22 nt, Neisseria meningitidis Z2491
ggauguuugaguccgaccgccg

SEQ ID NO: 3355589 - RNA, 13 nt, Neisseria meningitidis Z2491
ggauuaaaauaaa

SEQ ID NO: 3355590 - RNA, 19 nt, Neisseria meningitidis Z2491
ggcggauuaaaauaaaaau

SEQ ID NO: 3355591 - RNA, 13 nt, Neisseria meningitidis Z2491
ggcggcaucccac

SEQ ID NO: 3355592 - RNA, 13 nt, Neisseria meningitidis Z2491
ggcggcggcagcg

SEQ ID NO: 3355593 - RNA, 16 nt, Neisseria meningitidis Z2491
ggcggcggcgaggaag

SEQ ID NO: 3355594 - RNA, 16 nt, Neisseria meningitidis Z2491
ggcgggaauagcucag

SEQ ID NO: 3355595 - RNA, 16 nt, Neisseria meningitidis Z2491
ggcgggaaucuagaca

SEQ ID NO: 3355596 - RNA, 19 nt, Neisseria meningitidis Z2491
ggcgggaauuugucgggaa

SEQ ID NO: 3355597 - RNA, 18 nt, Neisseria meningitidis Z2491
ggcgggcaggcggcugcg

SEQ ID NO: 3355598 - RNA, 15 nt, Neisseria meningitidis Z2491
ggcgguaucaggcag

SEQ ID NO: 3355599 - RNA, 14 nt, Neisseria meningitidis Z2491
ggcgguuugccguc

SEQ ID NO: 3355600 - RNA, 17 nt, Neisseria meningitidis Z2491
ggcgguuugcggcggca

SEQ ID NO: 3355601 - RNA, 15 nt, Neisseria meningitidis Z2491
ggcguaacgcgguaa

SEQ ID NO: 3355602 - RNA, 15 nt, Neisseria meningitidis Z2491
ggcguaggcggcggc

SEQ ID NO: 3355603 - RNA, 16 nt, Neisseria meningitidis Z2491
ggcguaggcggcggcc

SEQ ID NO: 3355604 - RNA, 22 nt, Neisseria meningitidis Z2491
ggcguaggucagcccggcggug

SEQ ID NO: 3355605 - RNA, 19 nt, Neisseria meningitidis Z2491
ggcguauaaagauacaaga

SEQ ID NO: 3355606 - RNA, 14 nt, Neisseria meningitidis Z2491
ggcguauauggcug

SEQ ID NO: 3355607 - RNA, 20 nt, Neisseria meningitidis Z2491
ggcgugcgcgcccagaggga

SEQ ID NO: 3355608 - RNA, 13 nt, Neisseria meningitidis Z2491
ggcguucaaauca

SEQ ID NO: 3355609 - RNA, 18 nt, Neisseria meningitidis Z2491
ggcguucaacauccgcag

SEQ ID NO: 3355610 - RNA, 15 nt, Neisseria meningitidis Z2491
ggcguucuucuucga

SEQ ID NO: 3355611 - RNA, 22 nt, Neisseria meningitidis Z2491
ggcguugccucgccuugccgua

SEQ ID NO: 3355612 - RNA, 15 nt, Neisseria meningitidis Z2491
ggcguuggcucgccu

SEQ ID NO: 3355613 - RNA, 23 nt, Neisseria meningitidis Z2491
ggcguuggcucgccuuagcucaa

SEQ ID NO: 3355614 - RNA, 19 nt, Neisseria meningitidis Z2491
ggcguugguugaacguuug

SEQ ID NO: 3355615 - RNA, 21 nt, Neisseria meningitidis Z2491
ggcguuuuuguuuuauauucu

SEQ ID NO: 3355616 - RNA, 17 nt, Neisseria meningitidis Z2491
ggcucaaugaaaauuug

SEQ ID NO: 3355617 - RNA, 12 nt, Neisseria meningitidis Z2491
ggcugaaauaga

SEQ ID NO: 3355618 - RNA, 14 nt, Neisseria meningitidis Z2491
ggcugagggcuucu

SEQ ID NO: 3355619 - RNA, 16 nt, Neisseria meningitidis Z2491
ggcugccgaccgcgca

SEQ ID NO: 3355620 - RNA, 20 nt, Neisseria meningitidis Z2491
ggcugcgucgcgggcggggu

SEQ ID NO: 3355621 - RNA, 22 nt, Neisseria meningitidis Z2491
ggcugcuuuggcagcacaggca

SEQ ID NO: 3355622 - RNA, 18 nt, Neisseria meningitidis Z2491
ggcuguaugccgucugaa

SEQ ID NO: 3355623 - RNA, 21 nt, Neisseria meningitidis Z2491
ggcuguaugccgucugaaacc

SEQ ID NO: 3355624 - RNA, 22 nt, Neisseria meningitidis Z2491
ggcuguaugccgucugaaaccu

SEQ ID NO: 3355625 - RNA, 23 nt, Neisseria meningitidis Z2491
ggcugucggggauuuugcggcuu

SEQ ID NO: 3355626 - RNA, 16 nt, Neisseria meningitidis Z2491
ggcuuaaaccuuaucc

SEQ ID NO: 3355627 - RNA, 21 nt, Neisseria meningitidis Z2491
ggcuuacucguucggcagccu

SEQ ID NO: 3355628 - RNA, 17 nt, Neisseria meningitidis Z2491
ggcuucagacggcauuu

SEQ ID NO: 3355629 - RNA, 19 nt, Neisseria meningitidis Z2491
ggcuucgucgccuuguccu

SEQ ID NO: 3355630 - RNA, 15 nt, Neisseria meningitidis Z2491
ggcuugagcgacagc

SEQ ID NO: 3355631 - RNA, 15 nt, Neisseria meningitidis Z2491
ggcuugggcgacggc

SEQ ID NO: 3355632 - RNA, 16 nt, Neisseria meningitidis Z2491
ggcuugggcgacggcg

SEQ ID NO: 3355633 - RNA, 23 nt, Neisseria meningitidis Z2491
ggcuuucagacggccuuuggaau

SEQ ID NO: 3355634 - RNA, 22 nt, Neisseria meningitidis Z2491
ggcuuucagauagcgcggacgg

SEQ ID NO: 3355635 - RNA, 17 nt, Neisseria meningitidis Z2491
ggcuuugccguuuuuca

SEQ ID NO: 3355636 - RNA, 18 nt, Neisseria meningitidis Z2491
ggcuuuuucagacggcau

SEQ ID NO: 3355637 - RNA, 12 nt, Neisseria meningitidis Z2491
ggcuuuuuucug

SEQ ID NO: 3355638 - RNA, 18 nt, Neisseria meningitidis Z2491
gggaaaaauagaaucuuu

SEQ ID NO: 3355639 - RNA, 17 nt, Neisseria meningitidis Z2491
gggaaagcagcagcccu

SEQ ID NO: 3355640 - RNA, 12 nt, Neisseria meningitidis Z2491
gggaacggcauc

SEQ ID NO: 3355641 - RNA, 15 nt, Neisseria meningitidis Z2491
gggaauagcucaguu

SEQ ID NO: 3355642 - RNA, 16 nt, Neisseria meningitidis Z2491
gggaaucuagaaacuc

SEQ ID NO: 3355643 - RNA, 17 nt, Neisseria meningitidis Z2491
gggaaucuagaaaugaa

SEQ ID NO: 3355644 - RNA, 18 nt, Neisseria meningitidis Z2491
gggaaucuagaaaugaaa

SEQ ID NO: 3355645 - RNA, 21 nt, Neisseria meningitidis Z2491
gggaaucuagaaaugaaaaac

SEQ ID NO: 3355646 - RNA, 19 nt, Neisseria meningitidis Z2491
gggaaucuagaaccucaaa

SEQ ID NO: 3355647 - RNA, 20 nt, Neisseria meningitidis Z2491
gggaaugacgaaaaguugca

SEQ ID NO: 3355648 - RNA, 15 nt, Neisseria meningitidis Z2491
gggaaugacgaaucc

SEQ ID NO: 3355649 - RNA, 19 nt, Neisseria meningitidis Z2491
gggaaugacggaauguagg

SEQ ID NO: 3355650 - RNA, 13 nt, Neisseria meningitidis Z2491
gggaaugacggag

SEQ ID NO: 3355651 - RNA, 19 nt, Neisseria meningitidis Z2491
gggaaugacgggaugcagg

SEQ ID NO: 3355652 - RNA, 16 nt, Neisseria meningitidis Z2491
gggaaugacugaaacu

SEQ ID NO: 3355653 - RNA, 20 nt, Neisseria meningitidis Z2491
gggaaugacugaaacucaaa

SEQ ID NO: 3355654 - RNA, 20 nt, Neisseria meningitidis Z2491
gggaauguauuagaaaugac

SEQ ID NO: 3355655 - RNA, 16 nt, Neisseria meningitidis Z2491
gggaauuaugaugcgg

SEQ ID NO: 3355656 - RNA, 20 nt, Neisseria meningitidis Z2491
gggacagacggccaaacaca

SEQ ID NO: 3355657 - RNA, 19 nt, Neisseria meningitidis Z2491
gggacauucuuaagaugaa

SEQ ID NO: 3355658 - RNA, 16 nt, Neisseria meningitidis Z2491
gggacuuugcggcugu

SEQ ID NO: 3355659 - RNA, 12 nt, Neisseria meningitidis Z2491
gggagggaaagg

SEQ ID NO: 3355660 - RNA, 16 nt, Neisseria meningitidis Z2491
gggauuuugcggcuug

SEQ ID NO: 3355661 - RNA, 17 nt, Neisseria meningitidis Z2491
gggauuuuucaaaugca

SEQ ID NO: 3355662 - RNA, 13 nt, Neisseria meningitidis Z2491
gggcaaagcggca

SEQ ID NO: 3355663 - RNA, 19 nt, Neisseria meningitidis Z2491
gggcaacgcuugaaucuuc

SEQ ID NO: 3355664 - RNA, 16 nt, Neisseria meningitidis Z2491
gggcaacggcaauauu

SEQ ID NO: 3355665 - RNA, 16 nt, Neisseria meningitidis Z2491
gggcagcggcaauauu

SEQ ID NO: 3355666 - RNA, 21 nt, Neisseria meningitidis Z2491
gggcaggcggcugcgggcgcg

SEQ ID NO: 3355667 - RNA, 11 nt, Neisseria meningitidis Z2491
gggcaggcuga

SEQ ID NO: 3355668 - RNA, 19 nt, Neisseria meningitidis Z2491
gggcagguuuugguacacg

SEQ ID NO: 3355669 - RNA, 23 nt, Neisseria meningitidis Z2491
gggcauccauaaucaaaaccagc

SEQ ID NO: 3355670 - RNA, 21 nt, Neisseria meningitidis Z2491
gggcauuaucaguauuuucua

SEQ ID NO: 3355671 - RNA, 20 nt, Neisseria meningitidis Z2491
gggcauuguuaaguauuucu

SEQ ID NO: 3355672 - RNA, 15 nt, Neisseria meningitidis Z2491
gggccuuuggcggcg

SEQ ID NO: 3355673 - RNA, 23 nt, Neisseria meningitidis Z2491
gggcgaaaauagacgaaaaccug

SEQ ID NO: 3355674 - RNA, 17 nt, Neisseria meningitidis Z2491
gggcgacggcaauauuc

SEQ ID NO: 3355675 - RNA, 19 nt, Neisseria meningitidis Z2491
gggcgcgguuggcggcggc

SEQ ID NO: 3355676 - RNA, 17 nt, Neisseria meningitidis Z2491
gggcggcggcaauauuc

SEQ ID NO: 3355677 - RNA, 18 nt, Neisseria meningitidis Z2491
gggcgguuugcggcggca

SEQ ID NO: 3355678 - RNA, 23 nt, Neisseria meningitidis Z2491
gggcgugccaauucaaaaaccug

SEQ ID NO: 3355679 - RNA, 19 nt, Neisseria meningitidis Z2491
gggcgugccgaugaguccg

SEQ ID NO: 3355680 - RNA, 20 nt, Neisseria meningitidis Z2491
gggcguucagacggcauugu

SEQ ID NO: 3355681 - RNA, 12 nt, Neisseria meningitidis Z2491
gggcugaagccc

SEQ ID NO: 3355682 - RNA, 19 nt, Neisseria meningitidis Z2491
gggcugcggucgggcgcgu

SEQ ID NO: 3355683 - RNA, 18 nt, Neisseria meningitidis Z2491
gggcugcgucgcgggcgg

SEQ ID NO: 3355684 - RNA, 19 nt, Neisseria meningitidis Z2491
ggggauuuggguagaauua

SEQ ID NO: 3355685 - RNA, 23 nt, Neisseria meningitidis Z2491
ggggcgggacaauacggggguga

SEQ ID NO: 3355686 - RNA, 18 nt, Neisseria meningitidis Z2491
ggggcgguuugcggcggc

SEQ ID NO: 3355687 - RNA, 19 nt, Neisseria meningitidis Z2491
ggguacaaccaaugcggca

SEQ ID NO: 3355688 - RNA, 19 nt, Neisseria meningitidis Z2491
gggugauacuuauagugaa

SEQ ID NO: 3355689 - RNA, 21 nt, Neisseria meningitidis Z2491
ggguggcgaagccggcggcga

SEQ ID NO: 3355690 - RNA, 16 nt, Neisseria meningitidis Z2491
ggguuaagaaaaccug

SEQ ID NO: 3355691 - RNA, 14 nt, Neisseria meningitidis Z2491
guaccgggcaggcu

SEQ ID NO: 3355692 - RNA, 19 nt, Neisseria meningitidis Z2491
guaccguuucagacggcau

SEQ ID NO: 3355693 - RNA, 18 nt, Neisseria meningitidis Z2491
guaccugaugaucgccga

SEQ ID NO: 3355694 - RNA, 16 nt, Neisseria meningitidis Z2491
guacgcgggcaaacaa

SEQ ID NO: 3355695 - RNA, 19 nt, Neisseria meningitidis Z2491
guacgcuucgcgguuggcu

SEQ ID NO: 3355696 - RNA, 15 nt, Neisseria meningitidis Z2491
guacggauuguauau

SEQ ID NO: 3355697 - RNA, 20 nt, Neisseria meningitidis Z2491
guacggcaaggcgaggcaac

SEQ ID NO: 3355698 - RNA, 18 nt, Neisseria meningitidis Z2491
guacuaucuguacugucu

SEQ ID NO: 3355699 - RNA, 20 nt, Neisseria meningitidis Z2491
guacuaucuguacugucugc

SEQ ID NO: 3355700 - RNA, 13 nt, Neisseria meningitidis Z2491
guacuauuuacac

SEQ ID NO: 3355701 - RNA, 18 nt, Neisseria meningitidis Z2491
guacugcaaggcgaggca

SEQ ID NO: 3355702 - RNA, 14 nt, Neisseria meningitidis Z2491
guacugguuuuugu

SEQ ID NO: 3355703 - RNA, 18 nt, Neisseria meningitidis Z2491
guagccggccaacaucag

SEQ ID NO: 3355704 - RNA, 12 nt, Neisseria meningitidis Z2491
guagccuucaaa

SEQ ID NO: 3355705 - RNA, 16 nt, Neisseria meningitidis Z2491
guagcggugugcgccg

SEQ ID NO: 3355706 - RNA, 17 nt, Neisseria meningitidis Z2491
guagcgugggucggguu

SEQ ID NO: 3355707 - RNA, 15 nt, Neisseria meningitidis Z2491
guaggcuuuuuccaa

SEQ ID NO: 3355708 - RNA, 15 nt, Neisseria meningitidis Z2491
guaggucuucagcuu

SEQ ID NO: 3355709 - RNA, 22 nt, Neisseria meningitidis Z2491
guaggucuucagcuugagcguu

SEQ ID NO: 3355710 - RNA, 19 nt, Neisseria meningitidis Z2491
guagugugguugaagucca

SEQ ID NO: 3355711 - RNA, 16 nt, Neisseria meningitidis Z2491
guaguugguuuugaca

SEQ ID NO: 3355712 - RNA, 15 nt, Neisseria meningitidis Z2491
guauagcccaaaucu

SEQ ID NO: 3355713 - RNA, 14 nt, Neisseria meningitidis Z2491
guauaguaauaaau

SEQ ID NO: 3355714 - RNA, 13 nt, Neisseria meningitidis Z2491
guaucaaacaaga

SEQ ID NO: 3355715 - RNA, 20 nt, Neisseria meningitidis Z2491
guaucaagcccugaaaggga

SEQ ID NO: 3355716 - RNA, 17 nt, Neisseria meningitidis Z2491
guaucacaacacaguag

SEQ ID NO: 3355717 - RNA, 16 nt, Neisseria meningitidis Z2491
guaucaggcaguuuga

SEQ ID NO: 3355718 - RNA, 12 nt, Neisseria meningitidis Z2491
guauccauacca

SEQ ID NO: 3355719 - RNA, 16 nt, Neisseria meningitidis Z2491
guauccauaccaaaca

SEQ ID NO: 3355720 - RNA, 13 nt, Neisseria meningitidis Z2491
guaucccaguugu

SEQ ID NO: 3355721 - RNA, 15 nt, Neisseria meningitidis Z2491
guaucccaguugugc

SEQ ID NO: 3355722 - RNA, 15 nt, Neisseria meningitidis Z2491
guauccggauuuccu

SEQ ID NO: 3355723 - RNA, 23 nt, Neisseria meningitidis Z2491
guauccucaucguucaacagcag

SEQ ID NO: 3355724 - RNA, 15 nt, Neisseria meningitidis Z2491
guaucgauuuucggg

SEQ ID NO: 3355725 - RNA, 21 nt, Neisseria meningitidis Z2491
guaucgcguaaggcauacggg

SEQ ID NO: 3355726 - RNA, 15 nt, Neisseria meningitidis Z2491
guaucggauugccgu

SEQ ID NO: 3355727 - RNA, 21 nt, Neisseria meningitidis Z2491
guaucucaaccuguuuuucaa

SEQ ID NO: 3355728 - RNA, 21 nt, Neisseria meningitidis Z2491
guaugccgucugaaaccugua

SEQ ID NO: 3355729 - RNA, 19 nt, Neisseria meningitidis Z2491
guaugcgaaucugcugcaa

SEQ ID NO: 3355730 - RNA, 12 nt, Neisseria meningitidis Z2491
guauguaccaag

SEQ ID NO: 3355731 - RNA, 21 nt, Neisseria meningitidis Z2491
guauuggcacacaagcgcaug

SEQ ID NO: 3355732 - RNA, 20 nt, Neisseria meningitidis Z2491
guauugggaugauuuuguuc

SEQ ID NO: 3355733 - RNA, 14 nt, Neisseria meningitidis Z2491
guauuucagacagg

SEQ ID NO: 3355734 - RNA, 16 nt, Neisseria meningitidis Z2491
guauuucagacaggau

SEQ ID NO: 3355735 - RNA, 22 nt, Neisseria meningitidis Z2491
guauuugcugacguaaaaaacu

SEQ ID NO: 3355736 - RNA, 18 nt, Neisseria meningitidis Z2491
guauuuuacaaucagaau

SEQ ID NO: 3355737 - RNA, 12 nt, Neisseria meningitidis Z2491
gucaaaaaugcc

SEQ ID NO: 3355738 - RNA, 17 nt, Neisseria meningitidis Z2491
gucaaacagaaaaacaa

SEQ ID NO: 3355739 - RNA, 22 nt, Neisseria meningitidis Z2491
gucaacacaaaauaaaaaacaa

SEQ ID NO: 3355740 - RNA, 13 nt, Neisseria meningitidis Z2491
gucaaccaaaaaa

SEQ ID NO: 3355741 - RNA, 12 nt, Neisseria meningitidis Z2491
gucaaccuuaac

SEQ ID NO: 3355742 - RNA, 14 nt, Neisseria meningitidis Z2491
gucaacucuuccau

SEQ ID NO: 3355743 - RNA, 16 nt, Neisseria meningitidis Z2491
gucaagcaaaaaaugc

SEQ ID NO: 3355744 - RNA, 23 nt, Neisseria meningitidis Z2491
gucaauacacaagguuauuuucu

SEQ ID NO: 3355745 - RNA, 14 nt, Neisseria meningitidis Z2491
gucagaaucgccuc

SEQ ID NO: 3355746 - RNA, 12 nt, Neisseria meningitidis Z2491
gucagacggcau

SEQ ID NO: 3355747 - RNA, 17 nt, Neisseria meningitidis Z2491
gucagcccggcgguguc

SEQ ID NO: 3355748 - RNA, 11 nt, Neisseria meningitidis Z2491
gucaggcugcc

SEQ ID NO: 3355749 - RNA, 15 nt, Neisseria meningitidis Z2491
gucaucgccgcaaau

SEQ ID NO: 3355750 - RNA, 16 nt, Neisseria meningitidis Z2491
gucaucuuucaaacau

SEQ ID NO: 3355751 - RNA, 12 nt, Neisseria meningitidis Z2491
gucauucccacg

SEQ ID NO: 3355752 - RNA, 14 nt, Neisseria meningitidis Z2491
gucauucccacgga

SEQ ID NO: 3355753 - RNA, 21 nt, Neisseria meningitidis Z2491
gucauucccacggaaguggga

SEQ ID NO: 3355754 - RNA, 15 nt, Neisseria meningitidis Z2491
gucauucccgcaaaa

SEQ ID NO: 3355755 - RNA, 19 nt, Neisseria meningitidis Z2491
gucauucccgcaaaaacaa

SEQ ID NO: 3355756 - RNA, 18 nt, Neisseria meningitidis Z2491
gucauucccgcaaaagcg

SEQ ID NO: 3355757 - RNA, 21 nt, Neisseria meningitidis Z2491
gucauucccgccacuuuccgu

SEQ ID NO: 3355758 - RNA, 19 nt, Neisseria meningitidis Z2491
gucauucccgcgaaagagg

SEQ ID NO: 3355759 - RNA, 22 nt, Neisseria meningitidis Z2491
gucauuccuacgaaaacagaaa

SEQ ID NO: 3355760 - RNA, 19 nt, Neisseria meningitidis Z2491
gucauuccuguaaaaacaa

SEQ ID NO: 3355761 - RNA, 11 nt, Neisseria meningitidis Z2491
gucauuuccac

SEQ ID NO: 3355762 - RNA, 19 nt, Neisseria meningitidis Z2491
gucauuuccgauaaauucc

SEQ ID NO: 3355763 - RNA, 21 nt, Neisseria meningitidis Z2491
gucauuuccgauaaauuccug

SEQ ID NO: 3355764 - RNA, 14 nt, Neisseria meningitidis Z2491
guccaaaucggcaa

SEQ ID NO: 3355765 - RNA, 16 nt, Neisseria meningitidis Z2491
guccacaagccgccga

SEQ ID NO: 3355766 - RNA, 22 nt, Neisseria meningitidis Z2491
guccaccugaacggcacaaacg

SEQ ID NO: 3355767 - RNA, 13 nt, Neisseria meningitidis Z2491
guccaugauuuuu

SEQ ID NO: 3355768 - RNA, 20 nt, Neisseria meningitidis Z2491
gucccaaauauuggcgggcg

SEQ ID NO: 3355769 - RNA, 22 nt, Neisseria meningitidis Z2491
gucccuaaauuuaugucgggga

SEQ ID NO: 3355770 - RNA, 13 nt, Neisseria meningitidis Z2491
gucccugccgguu

SEQ ID NO: 3355771 - RNA, 21 nt, Neisseria meningitidis Z2491
guccgaacgcgaaaaugccgu

SEQ ID NO: 3355772 - RNA, 17 nt, Neisseria meningitidis Z2491
guccgaccauuugcuua

SEQ ID NO: 3355773 - RNA, 16 nt, Neisseria meningitidis Z2491
guccgcacccgcaacc

SEQ ID NO: 3355774 - RNA, 17 nt, Neisseria meningitidis Z2491
guccgccauuuccaaac

SEQ ID NO: 3355775 - RNA, 24 nt, Neisseria meningitidis Z2491
guccggcagccugcucgagcggca

SEQ ID NO: 3355776 - RNA, 20 nt, Neisseria meningitidis Z2491
guccggcauaaauccuucac

SEQ ID NO: 3355777 - RNA, 16 nt, Neisseria meningitidis Z2491
guccggcaugauuuuc

SEQ ID NO: 3355778 - RNA, 23 nt, Neisseria meningitidis Z2491
guccggugugcauccgacaggca

SEQ ID NO: 3355779 - RNA, 14 nt, Neisseria meningitidis Z2491
guccgguuuccguu

SEQ ID NO: 3355780 - RNA, 18 nt, Neisseria meningitidis Z2491
guccugaccgcgcugcuc

SEQ ID NO: 3355781 - RNA, 13 nt, Neisseria meningitidis Z2491
guccugauuuaaa

SEQ ID NO: 3355782 - RNA, 14 nt, Neisseria meningitidis Z2491
guccugauuuaaau

SEQ ID NO: 3355783 - RNA, 16 nt, Neisseria meningitidis Z2491
guccugauuuuuguua

SEQ ID NO: 3355784 - RNA, 19 nt, Neisseria meningitidis Z2491
guccugccugcgcgagaau

SEQ ID NO: 3355785 - RNA, 15 nt, Neisseria meningitidis Z2491
guccuuauuucugcu

SEQ ID NO: 3355786 - RNA, 22 nt, Neisseria meningitidis Z2491
guccuuccaucacguuuuccaa

SEQ ID NO: 3355787 - RNA, 15 nt, Neisseria meningitidis Z2491
gucgaaguggcuggc

SEQ ID NO: 3355788 - RNA, 17 nt, Neisseria meningitidis Z2491
gucgagcaggaugcugc

SEQ ID NO: 3355789 - RNA, 18 nt, Neisseria meningitidis Z2491
gucgagccaugcgugccc

SEQ ID NO: 3355790 - RNA, 19 nt, Neisseria meningitidis Z2491
gucgaggaaccagcggucg

SEQ ID NO: 3355791 - RNA, 19 nt, Neisseria meningitidis Z2491
gucgauauagaaaugccgu

SEQ ID NO: 3355792 - RNA, 14 nt, Neisseria meningitidis Z2491
gucgauguuuuugu

SEQ ID NO: 3355793 - RNA, 21 nt, Neisseria meningitidis Z2491
guuauuaagugaguaaaaaca

SEQ ID NO: 3355794 - RNA, 13 nt, Neisseria meningitidis Z2491
guuauuauuuucc

SEQ ID NO: 3355795 - RNA, 15 nt, Neisseria meningitidis Z2491
guuauuauuuuccau

SEQ ID NO: 3355796 - RNA, 13 nt, Neisseria meningitidis Z2491
guuauucccccga

SEQ ID NO: 3355797 - RNA, 13 nt, Neisseria meningitidis Z2491
guuauuuucacaa

SEQ ID NO: 3355798 - RNA, 22 nt, Neisseria meningitidis Z2491
guuauuuucacaaaaacagaaa

SEQ ID NO: 3355799 - RNA, 13 nt, Neisseria meningitidis Z2491
guuauuuucuuga

SEQ ID NO: 3355800 - RNA, 17 nt, Neisseria meningitidis Z2491
guuauuuuuaucguguu

SEQ ID NO: 3355801 - RNA, 20 nt, Neisseria meningitidis Z2491
guucaaugaacguuuuaucu

SEQ ID NO: 3355802 - RNA, 12 nt, Neisseria meningitidis Z2491
guucagacggca

SEQ ID NO: 3355803 - RNA, 13 nt, Neisseria meningitidis Z2491
guucagacggcau

SEQ ID NO: 3355804 - RNA, 20 nt, Neisseria meningitidis Z2491
guucagacggcaucaaaaac

SEQ ID NO: 3355805 - RNA, 15 nt, Neisseria meningitidis Z2491
guucagacggcauuu

SEQ ID NO: 3355806 - RNA, 17 nt, Neisseria meningitidis Z2491
guucagacggcauuuuc

SEQ ID NO: 3355807 - RNA, 18 nt, Neisseria meningitidis Z2491
guucagacggcauuuuug

SEQ ID NO: 3355808 - RNA, 16 nt, Neisseria meningitidis Z2491
guucaggaaggacugg

SEQ ID NO: 3355809 - RNA, 19 nt, Neisseria meningitidis Z2491
guuccaaauauuuccugca

SEQ ID NO: 3355810 - RNA, 14 nt, Neisseria meningitidis Z2491
guuccaauuccugu

SEQ ID NO: 3355811 - RNA, 14 nt, Neisseria meningitidis Z2491
guuccagacggcau

SEQ ID NO: 3355812 - RNA, 16 nt, Neisseria meningitidis Z2491
guuccgaaaucaucca

SEQ ID NO: 3355813 - RNA, 22 nt, Neisseria meningitidis Z2491
guuccgcauaagcgcaaaugcg

SEQ ID NO: 3355814 - RNA, 18 nt, Neisseria meningitidis Z2491
guuccgcgccgcaaaccg

SEQ ID NO: 3355815 - RNA, 15 nt, Neisseria meningitidis Z2491
guuccguacuauuug

SEQ ID NO: 3355816 - RNA, 21 nt, Neisseria meningitidis Z2491
guuccuccacuaaaaaaucca

SEQ ID NO: 3355817 - RNA, 14 nt, Neisseria meningitidis Z2491
guucgagcaggaac

SEQ ID NO: 3355818 - RNA, 13 nt, Neisseria meningitidis Z2491
guucggacggcau

SEQ ID NO: 3355819 - RNA, 20 nt, Neisseria meningitidis Z2491
guucggacggcauuuuguuu

SEQ ID NO: 3355820 - RNA, 21 nt, Neisseria meningitidis Z2491
guucggacggcauuuuugacg

SEQ ID NO: 3355821 - RNA, 18 nt, Neisseria meningitidis Z2491
guucggcaagaucggaaa

SEQ ID NO: 3355822 - RNA, 21 nt, Neisseria meningitidis Z2491
guucggcagccuuaacaggga

SEQ ID NO: 3355823 - RNA, 19 nt, Neisseria meningitidis Z2491
guucgggcagucuuccaac

SEQ ID NO: 3355824 - RNA, 17 nt, Neisseria meningitidis Z2491
guucguaggaaugacgu

SEQ ID NO: 3355825 - RNA, 20 nt, Neisseria meningitidis Z2491
guucgugcaggguuuucuuc

SEQ ID NO: 3355826 - RNA, 17 nt, Neisseria meningitidis Z2491
guucgugggaaugacgg

SEQ ID NO: 3355827 - RNA, 17 nt, Neisseria meningitidis Z2491
guucuaaggucuagauu

SEQ ID NO: 3355828 - RNA, 20 nt, Neisseria meningitidis Z2491
guucuaaggucuagauuccc

SEQ ID NO: 3355829 - RNA, 12 nt, Neisseria meningitidis Z2491
guucuagauucc

SEQ ID NO: 3355830 - RNA, 15 nt, Neisseria meningitidis Z2491
guucuggauucccac

SEQ ID NO: 3355831 - RNA, 18 nt, Neisseria meningitidis Z2491
guucuggauucccacuuu

SEQ ID NO: 3355832 - RNA, 20 nt, Neisseria meningitidis Z2491
guucuuuuuggcgcauuuuu

SEQ ID NO: 3355833 - RNA, 15 nt, Neisseria meningitidis Z2491
guugaaugugcgcca

SEQ ID NO: 3355834 - RNA, 15 nt, Neisseria meningitidis Z2491
guugaccagaccgau

SEQ ID NO: 3355835 - RNA, 16 nt, Neisseria meningitidis Z2491
guugcaagaaugacgg

SEQ ID NO: 3355836 - RNA, 18 nt, Neisseria meningitidis Z2491
guugccgucaacgacuuu

SEQ ID NO: 3355837 - RNA, 21 nt, Neisseria meningitidis Z2491
guugccucgccuuagcucaaa

SEQ ID NO: 3355838 - RNA, 20 nt, Neisseria meningitidis Z2491
guugccuuuaugagaaaaag

SEQ ID NO: 3355839 - RNA, 20 nt, Neisseria meningitidis Z2491
guugcgccgaagcccauguc

SEQ ID NO: 3355840 - RNA, 14 nt, Neisseria meningitidis Z2491
guugcggugcugcu

SEQ ID NO: 3355841 - RNA, 21 nt, Neisseria meningitidis Z2491
guugcucccgauaaaugccgc

SEQ ID NO: 3355842 - RNA, 19 nt, Neisseria meningitidis Z2491
guugcuugagcauaccggc

SEQ ID NO: 3355843 - RNA, 23 nt, Neisseria meningitidis Z2491
guuggaaaaguacaaaaugccgu

SEQ ID NO: 3355844 - RNA, 17 nt, Neisseria meningitidis Z2491
guuggaaggcggcggca

SEQ ID NO: 3355845 - RNA, 13 nt, Neisseria meningitidis Z2491
guuggcagcaaaa

SEQ ID NO: 3355846 - RNA, 15 nt, Neisseria meningitidis Z2491
guuggccgcuuucaa

SEQ ID NO: 3355847 - RNA, 13 nt, Neisseria meningitidis Z2491
guugggaaagguu

SEQ ID NO: 3355848 - RNA, 14 nt, Neisseria meningitidis Z2491
guugggcgauggcg

SEQ ID NO: 3355849 - RNA, 19 nt, Neisseria meningitidis Z2491
guugucggaacagcaucaa

SEQ ID NO: 3355850 - RNA, 13 nt, Neisseria meningitidis Z2491
guuguucagaaaa

SEQ ID NO: 3355851 - RNA, 14 nt, Neisseria meningitidis Z2491
guuuaaaacagcau

SEQ ID NO: 3355852 - RNA, 18 nt, Neisseria meningitidis Z2491
guuuaaaggaaaugccgu

SEQ ID NO: 3355853 - RNA, 13 nt, Neisseria meningitidis Z2491
guuuaaauucauc

SEQ ID NO: 3355854 - RNA, 17 nt, Neisseria meningitidis Z2491
guuuaaauuuaauccac

SEQ ID NO: 3355855 - RNA, 20 nt, Neisseria meningitidis Z2491
guuuaacuugucaagaaaca

SEQ ID NO: 3355856 - RNA, 21 nt, Neisseria meningitidis Z2491
guuuaagacguggugcuaaaa

SEQ ID NO: 3355857 - RNA, 19 nt, Neisseria meningitidis Z2491
guuuaaucccuuugagcuu

SEQ ID NO: 3355858 - RNA, 21 nt, Neisseria meningitidis Z2491
guuuaauuaaaacucuccuga

SEQ ID NO: 3355859 - RNA, 14 nt, Neisseria meningitidis Z2491
guuuaauuuuguug

SEQ ID NO: 3355860 - RNA, 20 nt, Neisseria meningitidis Z2491
guuuacggucagaaaauuuc

SEQ ID NO: 3355861 - RNA, 22 nt, Neisseria meningitidis Z2491
guuuacggucagaaaauuucuu

SEQ ID NO: 3355862 - RNA, 22 nt, Neisseria meningitidis Z2491
guuuagacggucuggcauauuc

SEQ ID NO: 3355863 - RNA, 22 nt, Neisseria meningitidis Z2491
guuuagcggagcaguuuuucaa

SEQ ID NO: 3355864 - RNA, 18 nt, Neisseria meningitidis Z2491
guuuauccguucaauugc

SEQ ID NO: 3355865 - RNA, 19 nt, Neisseria meningitidis Z2491
guuuauccguucaauugcu

SEQ ID NO: 3355866 - RNA, 14 nt, Neisseria meningitidis Z2491
guuuaucuuuucuu

SEQ ID NO: 3355867 - RNA, 21 nt, Neisseria meningitidis Z2491
guuucaaaccucauucaaacg

SEQ ID NO: 3355868 - RNA, 17 nt, Neisseria meningitidis Z2491
guuucaacgacuuccag

SEQ ID NO: 3355869 - RNA, 20 nt, Neisseria meningitidis Z2491
guuucaacgacuuccagcac

SEQ ID NO: 3355870 - RNA, 17 nt, Neisseria meningitidis Z2491
guuucaaggcggcggcg

SEQ ID NO: 3355871 - RNA, 21 nt, Neisseria meningitidis Z2491
guuucacuuguuuucggguaa

SEQ ID NO: 3355872 - RNA, 16 nt, Neisseria meningitidis Z2491
guuucagacggcauuu

SEQ ID NO: 3355873 - RNA, 20 nt, Neisseria meningitidis Z2491
guuucagacggcauuugacu

SEQ ID NO: 3355874 - RNA, 21 nt, Neisseria meningitidis Z2491
guuucagacggcauuugacuu

SEQ ID NO: 3355875 - RNA, 21 nt, Neisseria meningitidis Z2491
guuucagacggcauuuuguug

SEQ ID NO: 3355876 - RNA, 19 nt, Neisseria meningitidis Z2491
guuucagacggcauuuuug

SEQ ID NO: 3355877 - RNA, 11 nt, Neisseria meningitidis Z2491
guuucagauug

SEQ ID NO: 3355878 - RNA, 16 nt, Neisseria meningitidis Z2491
guuucaggaauuugcg

SEQ ID NO: 3355879 - RNA, 21 nt, Neisseria meningitidis Z2491
guuuccaaagugauuuccgcu

SEQ ID NO: 3355880 - RNA, 18 nt, Neisseria meningitidis Z2491
guuuccaauacaacaaaa

SEQ ID NO: 3355881 - RNA, 21 nt, Neisseria meningitidis Z2491
guuuccaauacaacaaaaugc

SEQ ID NO: 3355882 - RNA, 16 nt, Neisseria meningitidis Z2491
guuuccacuaaaugcu

SEQ ID NO: 3355883 - RNA, 20 nt, Neisseria meningitidis Z2491
guuucccccguaccgggcag

SEQ ID NO: 3355884 - RNA, 17 nt, Neisseria meningitidis Z2491
guuuccgggcggugcgu

SEQ ID NO: 3355885 - RNA, 14 nt, Neisseria meningitidis Z2491
guuuccuccucgcc

SEQ ID NO: 3355886 - RNA, 12 nt, Neisseria meningitidis Z2491
guuuccugcagg

SEQ ID NO: 3355887 - RNA, 17 nt, Neisseria meningitidis Z2491
guuucggauaaauuuug

SEQ ID NO: 3355888 - RNA, 23 nt, Neisseria meningitidis Z2491
guuucggucauuuccgauaaauu

SEQ ID NO: 3355889 - RNA, 16 nt, Neisseria meningitidis Z2491
guuucguaaauccauu

SEQ ID NO: 3355890 - RNA, 14 nt, Neisseria meningitidis Z2491
guuucgugccuucu

SEQ ID NO: 3355891 - RNA, 16 nt, Neisseria meningitidis Z2491
guuucuagauucccac

SEQ ID NO: 3355892 - RNA, 13 nt, Neisseria meningitidis Z2491
guuucugauuuug

SEQ ID NO: 3355893 - RNA, 23 nt, Neisseria meningitidis Z2491
guuucuguauuuguauaguggau

SEQ ID NO: 3355894 - RNA, 16 nt, Neisseria meningitidis Z2491
uaaauccuucaccauc

SEQ ID NO: 3355895 - RNA, 22 nt, Neisseria meningitidis Z2491
uaaaugccaaucucuuaaccau

SEQ ID NO: 3355896 - RNA, 17 nt, Neisseria meningitidis Z2491
uaaaugccgcaaucuca

SEQ ID NO: 3355897 - RNA, 14 nt, Neisseria meningitidis Z2491
uaaaugcucaccuu

SEQ ID NO: 3355898 - RNA, 15 nt, Neisseria meningitidis Z2491
uaaauuaaucuccuu

SEQ ID NO: 3355899 - RNA, 15 nt, Neisseria meningitidis Z2491
uaaauucaucgcgcu

SEQ ID NO: 3355900 - RNA, 23 nt, Neisseria meningitidis Z2491
uaaauucucgucguuuuucauuu

SEQ ID NO: 3355901 - RNA, 11 nt, Neisseria meningitidis Z2491
uaaauuuaaaa

SEQ ID NO: 3355902 - RNA, 15 nt, Neisseria meningitidis Z2491
uaaauuuaaaccagu

SEQ ID NO: 3355903 - RNA, 19 nt, Neisseria meningitidis Z2491
uaaauuuaaaccaguacgg

SEQ ID NO: 3355904 - RNA, 23 nt, Neisseria meningitidis Z2491
uaaauuuaaaccaguacggcguu

SEQ ID NO: 3355905 - RNA, 20 nt, Neisseria meningitidis Z2491
uaaauuuaauccacuauaau

SEQ ID NO: 3355906 - RNA, 15 nt, Neisseria meningitidis Z2491
uaaauuuaauucacu

SEQ ID NO: 3355907 - RNA, 17 nt, Neisseria meningitidis Z2491
uaaauuuuuaaaaccgu

SEQ ID NO: 3355908 - RNA, 13 nt, Neisseria meningitidis Z2491
uaacaaaaaccag

SEQ ID NO: 3355909 - RNA, 14 nt, Neisseria meningitidis Z2491
uaacaaaaaccggu

SEQ ID NO: 3355910 - RNA, 14 nt, Neisseria meningitidis Z2491
uaacaaaaaucagg

SEQ ID NO: 3355911 - RNA, 18 nt, Neisseria meningitidis Z2491
uaacaaaaaucaggacaa

SEQ ID NO: 3355912 - RNA, 17 nt, Neisseria meningitidis Z2491
uaacaaucacuauuaaa

SEQ ID NO: 3355913 - RNA, 19 nt, Neisseria meningitidis Z2491
uaacaaucacuauuaaaau

SEQ ID NO: 3355914 - RNA, 19 nt, Neisseria meningitidis Z2491
uaacaggcaacccgcuuua

SEQ ID NO: 3355915 - RNA, 18 nt, Neisseria meningitidis Z2491
uaacagggaaagcagcag

SEQ ID NO: 3355916 - RNA, 18 nt, Neisseria meningitidis Z2491
uaacauagguuacuaaaa

SEQ ID NO: 3355917 - RNA, 20 nt, Neisseria meningitidis Z2491
uaaccauacuucauuaaagu

SEQ ID NO: 3355918 - RNA, 14 nt, Neisseria meningitidis Z2491
uaaccgaaaauaau

SEQ ID NO: 3355919 - RNA, 14 nt, Neisseria meningitidis Z2491
uaaccgaaaccuga

SEQ ID NO: 3355920 - RNA, 21 nt, Neisseria meningitidis Z2491
uaaccgaaaccugacaguaac

SEQ ID NO: 3355921 - RNA, 17 nt, Neisseria meningitidis Z2491
uaaccgcuucaaggcgg

SEQ ID NO: 3355922 - RNA, 19 nt, Neisseria meningitidis Z2491
uaaccguaucaaacaagaa

SEQ ID NO: 3355923 - RNA, 16 nt, Neisseria meningitidis Z2491
uaaccuuguuccucca

SEQ ID NO: 3355924 - RNA, 14 nt, Neisseria meningitidis Z2491
uaaccuuugaauau

SEQ ID NO: 3355925 - RNA, 19 nt, Neisseria meningitidis Z2491
uaacgccgccguccaucac

SEQ ID NO: 3355926 - RNA, 15 nt, Neisseria meningitidis Z2491
uaacgggauuucagc

SEQ ID NO: 3355927 - RNA, 17 nt, Neisseria meningitidis Z2491
uaacgggcaauuuucaa

SEQ ID NO: 3355928 - RNA, 16 nt, Neisseria meningitidis Z2491
uaacguacaaaugccg

SEQ ID NO: 3355929 - RNA, 11 nt, Neisseria meningitidis Z2491
uaacguauucg

SEQ ID NO: 3355930 - RNA, 21 nt, Neisseria meningitidis Z2491
uaacucuaaaccgucauuccu

SEQ ID NO: 3355931 - RNA, 16 nt, Neisseria meningitidis Z2491
uaacugcaagaacagc

SEQ ID NO: 3355932 - RNA, 15 nt, Neisseria meningitidis Z2491
uaacuuauacacacg

SEQ ID NO: 3355933 - RNA, 12 nt, Neisseria meningitidis Z2491
uaacuuccacac

SEQ ID NO: 3355934 - RNA, 13 nt, Neisseria meningitidis Z2491
uaagaaaaccugc

SEQ ID NO: 3355935 - RNA, 22 nt, Neisseria meningitidis Z2491
uaagaagaagacgugcaauaca

SEQ ID NO: 3355936 - RNA, 21 nt, Neisseria meningitidis Z2491
uaagccgguauaaacaaaaua

SEQ ID NO: 3355937 - RNA, 13 nt, Neisseria meningitidis Z2491
uaaggcaauuucu

SEQ ID NO: 3355938 - RNA, 19 nt, Neisseria meningitidis Z2491
uaaggcagagauaaaagca

SEQ ID NO: 3355939 - RNA, 20 nt, Neisseria meningitidis Z2491
uaaggcauacggggaggaaa

SEQ ID NO: 3355940 - RNA, 14 nt, Neisseria meningitidis Z2491
uaaggcgagccaac

SEQ ID NO: 3355941 - RNA, 21 nt, Neisseria meningitidis Z2491
uaaggcuuauuucacuuccaa

SEQ ID NO: 3355942 - RNA, 23 nt, Neisseria meningitidis Z2491
uaagugaguaaaaacaauuuuau

SEQ ID NO: 3355943 - RNA, 13 nt, Neisseria meningitidis Z2491
uaaguguuuucaa

SEQ ID NO: 3355944 - RNA, 17 nt, Neisseria meningitidis Z2491
uaaguguuuucaagaac

SEQ ID NO: 3355945 - RNA, 15 nt, Neisseria meningitidis Z2491
uaauaaauuaaucuc

SEQ ID NO: 3355946 - RNA, 21 nt, Neisseria meningitidis Z2491
uaauaauguguugauuaaaua

SEQ ID NO: 3355947 - RNA, 22 nt, Neisseria meningitidis Z2491
uaauaauguguugauuaaauau

SEQ ID NO: 3355948 - RNA, 16 nt, Neisseria meningitidis Z2491
uaauacaaaaaugccg

SEQ ID NO: 3355949 - RNA, 17 nt, Neisseria meningitidis Z2491
uaauacguuuuucucgu

SEQ ID NO: 3355950 - RNA, 22 nt, Neisseria meningitidis Z2491
uaauagugccgucaaauuacuu

SEQ ID NO: 3355951 - RNA, 21 nt, Neisseria meningitidis Z2491
uaauauaucgauugcgcuuca

SEQ ID NO: 3355952 - RNA, 13 nt, Neisseria meningitidis Z2491
uaauaugaaacca

SEQ ID NO: 3355953 - RNA, 12 nt, Neisseria meningitidis Z2491
uaaucaaaucuu

SEQ ID NO: 3355954 - RNA, 18 nt, Neisseria meningitidis Z2491
uaaucaauuaaaaacaaa

SEQ ID NO: 3355955 - RNA, 20 nt, Neisseria meningitidis Z2491
uaaucaauuaaaaacaaaau

SEQ ID NO: 3355956 - RNA, 15 nt, Neisseria meningitidis Z2491
uaaucacuauaccaa

SEQ ID NO: 3355957 - RNA, 18 nt, Neisseria meningitidis Z2491
uaaucagcuauauauagu

SEQ ID NO: 3355958 - RNA, 15 nt, Neisseria meningitidis Z2491
uaaucaucguauuuu

SEQ ID NO: 3355959 - RNA, 16 nt, Neisseria meningitidis Z2491
uaaucauguuauuauu

SEQ ID NO: 3355960 - RNA, 23 nt, Neisseria meningitidis Z2491
uaaucauguuauuauuuuccaua

SEQ ID NO: 3355961 - RNA, 17 nt, Neisseria meningitidis Z2491
uaaucauguugccguca

SEQ ID NO: 3355962 - RNA, 14 nt, Neisseria meningitidis Z2491
uaauccacuauaaa

SEQ ID NO: 3355963 - RNA, 20 nt, Neisseria meningitidis Z2491
uaauccacuauaauacaaaa

SEQ ID NO: 3355964 - RNA, 18 nt, Neisseria meningitidis Z2491
uaauccacuauaaugauu

SEQ ID NO: 3355965 - RNA, 16 nt, Neisseria meningitidis Z2491
uaauccgccugcgcca

SEQ ID NO: 3355966 - RNA, 17 nt, Neisseria meningitidis Z2491
uaauccgcuauaacagc

SEQ ID NO: 3355967 - RNA, 20 nt, Neisseria meningitidis Z2491
uaauccgcuauaacagcaac

SEQ ID NO: 3355968 - RNA, 19 nt, Neisseria meningitidis Z2491
uaauccgcuauaauuuauu

SEQ ID NO: 3355969 - RNA, 16 nt, Neisseria meningitidis Z2491
uaauccgcuuccaaaa

SEQ ID NO: 3355970 - RNA, 15 nt, Neisseria meningitidis Z2491
uaauccuucagcucu

SEQ ID NO: 3355971 - RNA, 13 nt, Neisseria meningitidis Z2491
uaaucucaaaucc

SEQ ID NO: 3355972 - RNA, 19 nt, Neisseria meningitidis Z2491
uaaucuccuuuuuuuucua

SEQ ID NO: 3355973 - RNA, 18 nt, Neisseria meningitidis Z2491
uaaucugauuuauuuccu

SEQ ID NO: 3355974 - RNA, 16 nt, Neisseria meningitidis Z2491
uaaucuuucagcaaau

SEQ ID NO: 3355975 - RNA, 14 nt, Neisseria meningitidis Z2491
uaaucuuugaauau

SEQ ID NO: 3355976 - RNA, 21 nt, Neisseria meningitidis Z2491
uaaucuuugaauauugcuguu

SEQ ID NO: 3355977 - RNA, 20 nt, Neisseria meningitidis Z2491
uaaugacaugguuugcaguc

SEQ ID NO: 3355978 - RNA, 16 nt, Neisseria meningitidis Z2491
uaaugcccauucccac

SEQ ID NO: 3355979 - RNA, 20 nt, Neisseria meningitidis Z2491
uaaugcgguguaucuuuuug

SEQ ID NO: 3355980 - RNA, 17 nt, Neisseria meningitidis Z2491
uaaugcuuucgcuuuuu

SEQ ID NO: 3355981 - RNA, 13 nt, Neisseria meningitidis Z2491
uaauuaaaauacg

SEQ ID NO: 3355982 - RNA, 22 nt, Neisseria meningitidis Z2491
uaauuauaguggauuaacaaaa

SEQ ID NO: 3355983 - RNA, 23 nt, Neisseria meningitidis Z2491
uaauucggcaauuugacacuuca

SEQ ID NO: 3355984 - RNA, 13 nt, Neisseria meningitidis Z2491
uaauucggcuaga

SEQ ID NO: 3355985 - RNA, 19 nt, Neisseria meningitidis Z2491
uaauucuacccaaauaccc

SEQ ID NO: 3355986 - RNA, 18 nt, Neisseria meningitidis Z2491
uaauucuacccaaauccc

SEQ ID NO: 3355987 - RNA, 14 nt, Neisseria meningitidis Z2491
uaauugucuuuucc

SEQ ID NO: 3355988 - RNA, 10 nt, Neisseria meningitidis Z2491
uaauuucaau

SEQ ID NO: 3355989 - RNA, 12 nt, Neisseria meningitidis Z2491
uaauuuccaaau

SEQ ID NO: 3355990 - RNA, 18 nt, Neisseria meningitidis Z2491
uacaaaaaugccgucuga

SEQ ID NO: 3355991 - RNA, 17 nt, Neisseria meningitidis Z2491
uacaaaaggccgucuga

SEQ ID NO: 3355992 - RNA, 18 nt, Neisseria meningitidis Z2491
uacaaaauaaucuuccuu

SEQ ID NO: 3355993 - RNA, 12 nt, Neisseria meningitidis Z2491
uacaaaaugccg

SEQ ID NO: 3355994 - RNA, 17 nt, Neisseria meningitidis Z2491
uacaaaaugccgucuga

SEQ ID NO: 3355995 - RNA, 22 nt, Neisseria meningitidis Z2491
uacaaacaggcuucagacggca

SEQ ID NO: 3355996 - RNA, 20 nt, Neisseria meningitidis Z2491
uagcauauaacaccuuucaa

SEQ ID NO: 3355997 - RNA, 22 nt, Neisseria meningitidis Z2491
uagcaugguuaagagauuggca

SEQ ID NO: 3355998 - RNA, 20 nt, Neisseria meningitidis Z2491
uagcauuuaauucacgacuu

SEQ ID NO: 3355999 - RNA, 15 nt, Neisseria meningitidis Z2491
uagccaaaaaaaccg

SEQ ID NO: 3356000 - RNA, 24 nt, Neisseria meningitidis Z2491
uagccaaaaaaaccgaaaccgaac

SEQ ID NO: 3356001 - RNA, 19 nt, Neisseria meningitidis Z2491
uagccggccaacaucagca

SEQ ID NO: 3356002 - RNA, 14 nt, Neisseria meningitidis Z2491
uagcggaauuuacg

SEQ ID NO: 3356003 - RNA, 16 nt, Neisseria meningitidis Z2491
uagcguguauuuuggu

SEQ ID NO: 3356004 - RNA, 23 nt, Neisseria meningitidis Z2491
uagcucaaagagaacaauucucu

SEQ ID NO: 3356005 - RNA, 22 nt, Neisseria meningitidis Z2491
uagcucaguugguagagcgcaa

SEQ ID NO: 3356006 - RNA, 16 nt, Neisseria meningitidis Z2491
uagcuucgucauuccc

SEQ ID NO: 3356007 - RNA, 22 nt, Neisseria meningitidis Z2491
uaggacgcaggguuaagaaaac

SEQ ID NO: 3356008 - RNA, 21 nt, Neisseria meningitidis Z2491
uaggcaaguuccaagauggcg

SEQ ID NO: 3356009 - RNA, 16 nt, Neisseria meningitidis Z2491
uaggcaauugaaaaau

SEQ ID NO: 3356010 - RNA, 15 nt, Neisseria meningitidis Z2491
uaggcaauugaaaau

SEQ ID NO: 3356011 - RNA, 23 nt, Neisseria meningitidis Z2491
uaggcggcggccugguugauguc

SEQ ID NO: 3356012 - RNA, 22 nt, Neisseria meningitidis Z2491
uaggcggcggcgguuuccugca

SEQ ID NO: 3356013 - RNA, 17 nt, Neisseria meningitidis Z2491
uagggaaauucaaauua

SEQ ID NO: 3356014 - RNA, 14 nt, Neisseria meningitidis Z2491
uagggguuucagac

SEQ ID NO: 3356015 - RNA, 18 nt, Neisseria meningitidis Z2491
uaggguuaauaucagauu

SEQ ID NO: 3356016 - RNA, 20 nt, Neisseria meningitidis Z2491
uaggguucugauuuuguuuu

SEQ ID NO: 3356017 - RNA, 15 nt, Neisseria meningitidis Z2491
uagguauuuugcgcc

SEQ ID NO: 3356018 - RNA, 15 nt, Neisseria meningitidis Z2491
uagguuacuaaaauu

SEQ ID NO: 3356019 - RNA, 18 nt, Neisseria meningitidis Z2491
uagguuucugauuuuggu

SEQ ID NO: 3356020 - RNA, 19 nt, Neisseria meningitidis Z2491
uagguuucugauuuugguu

SEQ ID NO: 3356021 - RNA, 14 nt, Neisseria meningitidis Z2491
uagguuugcaggaa

SEQ ID NO: 3356022 - RNA, 11 nt, Neisseria meningitidis Z2491
uagguuuuguu

SEQ ID NO: 3356023 - RNA, 15 nt, Neisseria meningitidis Z2491
uaguaauaaauuaau

SEQ ID NO: 3356024 - RNA, 20 nt, Neisseria meningitidis Z2491
uaguacagccccuuaaaguu

SEQ ID NO: 3356025 - RNA, 16 nt, Neisseria meningitidis Z2491
uaguacggcaaggcga

SEQ ID NO: 3356026 - RNA, 23 nt, Neisseria meningitidis Z2491
uaguauaguggauuaacaaaaau

SEQ ID NO: 3356027 - RNA, 15 nt, Neisseria meningitidis Z2491
uagucaggcugccuu

SEQ ID NO: 3356028 - RNA, 14 nt, Neisseria meningitidis Z2491
uaguggauuaaauu

SEQ ID NO: 3356029 - RNA, 17 nt, Neisseria meningitidis Z2491
uaguggauuaaauuuaa

SEQ ID NO: 3356030 - RNA, 18 nt, Neisseria meningitidis Z2491
uaguggauuaaauuuaaa

SEQ ID NO: 3356031 - RNA, 19 nt, Neisseria meningitidis Z2491
uaguggauuaaauuuaaac

SEQ ID NO: 3356032 - RNA, 19 nt, Neisseria meningitidis Z2491
uaguggauuaaauuuaaau

SEQ ID NO: 3356033 - RNA, 20 nt, Neisseria meningitidis Z2491
uaguggauuaacaaaaacca

SEQ ID NO: 3356034 - RNA, 20 nt, Neisseria meningitidis Z2491
uaguggauuaacaaaaauca

SEQ ID NO: 3356035 - RNA, 22 nt, Neisseria meningitidis Z2491
uaguggauuaacaaaaaucagg

SEQ ID NO: 3356036 - RNA, 15 nt, Neisseria meningitidis Z2491
uaguucacuauaccg

SEQ ID NO: 3356037 - RNA, 19 nt, Neisseria meningitidis Z2491
uaguugauuaaaacaaaaa

SEQ ID NO: 3356038 - RNA, 19 nt, Neisseria meningitidis Z2491
uaguugccgucaaagaaca

SEQ ID NO: 3356039 - RNA, 17 nt, Neisseria meningitidis Z2491
uaguuuuuugaguuuca

SEQ ID NO: 3356040 - RNA, 23 nt, Neisseria meningitidis Z2491
uauaaaaggucuuuucuaaaaua

SEQ ID NO: 3356041 - RNA, 14 nt, Neisseria meningitidis Z2491
uauaaaauuggaaa

SEQ ID NO: 3356042 - RNA, 15 nt, Neisseria meningitidis Z2491
uauaaacaaaaaaca

SEQ ID NO: 3356043 - RNA, 17 nt, Neisseria meningitidis Z2491
uauaaagauacaagaac

SEQ ID NO: 3356044 - RNA, 15 nt, Neisseria meningitidis Z2491
uauaacgacuguaaa

SEQ ID NO: 3356045 - RNA, 17 nt, Neisseria meningitidis Z2491
uauaaugcccauuccca

SEQ ID NO: 3356046 - RNA, 19 nt, Neisseria meningitidis Z2491
uauacacacgguuuucaca

SEQ ID NO: 3356047 - RNA, 20 nt, Neisseria meningitidis Z2491
uauaccugcccgacagccgc

SEQ ID NO: 3356048 - RNA, 13 nt, Neisseria meningitidis Z2491
uauacuggcaaau

SEQ ID NO: 3356049 - RNA, 14 nt, Neisseria meningitidis Z2491
uauacuuggcaaaa

SEQ ID NO: 3356050 - RNA, 21 nt, Neisseria meningitidis Z2491
uauagccgccccaaugcggcg

SEQ ID NO: 3356051 - RNA, 22 nt, Neisseria meningitidis Z2491
uauaguggauuaaauuuaaacc

SEQ ID NO: 3356052 - RNA, 18 nt, Neisseria meningitidis Z2491
uauaguggauuaacaaaa

SEQ ID NO: 3356053 - RNA, 19 nt, Neisseria meningitidis Z2491
uauaguggauuaacaaaaa

SEQ ID NO: 3356054 - RNA, 13 nt, Neisseria meningitidis Z2491
uauauauucugau

SEQ ID NO: 3356055 - RNA, 21 nt, Neisseria meningitidis Z2491
uauaucgaacagccuguccaa

SEQ ID NO: 3356056 - RNA, 16 nt, Neisseria meningitidis Z2491
uauaugaguguaucgg

SEQ ID NO: 3356057 - RNA, 12 nt, Neisseria meningitidis Z2491
uauauuggcauc

SEQ ID NO: 3356058 - RNA, 19 nt, Neisseria meningitidis Z2491
uauauuuguccaugauuuu

SEQ ID NO: 3356059 - RNA, 19 nt, Neisseria meningitidis Z2491
uauauuuuuucuaaauguu

SEQ ID NO: 3356060 - RNA, 23 nt, Neisseria meningitidis Z2491
uaucacgcuccccauauagacug

SEQ ID NO: 3356061 - RNA, 14 nt, Neisseria meningitidis Z2491
uaucagaaaugacu

SEQ ID NO: 3356062 - RNA, 14 nt, Neisseria meningitidis Z2491
uaucagauuuugga

SEQ ID NO: 3356063 - RNA, 15 nt, Neisseria meningitidis Z2491
uaucaguauuuucua

SEQ ID NO: 3356064 - RNA, 17 nt, Neisseria meningitidis Z2491
uaucaguauuuucuauu

SEQ ID NO: 3356065 - RNA, 19 nt, Neisseria meningitidis Z2491
uaucauaaaaucuauuauu

SEQ ID NO: 3356066 - RNA, 20 nt, Neisseria meningitidis Z2491
uaucaucagauugauaaaag

SEQ ID NO: 3356067 - RNA, 15 nt, Neisseria meningitidis Z2491
uaucauugcuuacaa

SEQ ID NO: 3356068 - RNA, 15 nt, Neisseria meningitidis Z2491
uauccacagagauug

SEQ ID NO: 3356069 - RNA, 17 nt, Neisseria meningitidis Z2491
uauccaccaacugguca

SEQ ID NO: 3356070 - RNA, 13 nt, Neisseria meningitidis Z2491
uauccccagugcg

SEQ ID NO: 3356071 - RNA, 16 nt, Neisseria meningitidis Z2491
uaucccuuaagaaucg

SEQ ID NO: 3356072 - RNA, 14 nt, Neisseria meningitidis Z2491
uauccgaagcgaca

SEQ ID NO: 3356073 - RNA, 22 nt, Neisseria meningitidis Z2491
uauccgaccagagcggcauuuc

SEQ ID NO: 3356074 - RNA, 20 nt, Neisseria meningitidis Z2491
uauccgcacacgaacugccu

SEQ ID NO: 3356075 - RNA, 16 nt, Neisseria meningitidis Z2491
uauccggcuuuccaug

SEQ ID NO: 3356076 - RNA, 15 nt, Neisseria meningitidis Z2491
uaucgccucauacag

SEQ ID NO: 3356077 - RNA, 13 nt, Neisseria meningitidis Z2491
uaucgcuguaaua

SEQ ID NO: 3356078 - RNA, 16 nt, Neisseria meningitidis Z2491
uaucggaaaugacuga

SEQ ID NO: 3356079 - RNA, 13 nt, Neisseria meningitidis Z2491
uaucgggaaaaau

SEQ ID NO: 3356080 - RNA, 21 nt, Neisseria meningitidis Z2491
uaucgggcagugccguuuugu

SEQ ID NO: 3356081 - RNA, 18 nt, Neisseria meningitidis Z2491
uaucgguauagugaacua

SEQ ID NO: 3356082 - RNA, 22 nt, Neisseria meningitidis Z2491
uaucgucauucccgcaaaaaca

SEQ ID NO: 3356083 - RNA, 15 nt, Neisseria meningitidis Z2491
uaucguuuuccaaau

SEQ ID NO: 3356084 - RNA, 21 nt, Neisseria meningitidis Z2491
uaucucaaccuguuuuucaaa

SEQ ID NO: 3356085 - RNA, 22 nt, Neisseria meningitidis Z2491
uaucugcauuauuugggauauu

SEQ ID NO: 3356086 - RNA, 18 nt, Neisseria meningitidis Z2491
uaucugcugccaucucaa

SEQ ID NO: 3356087 - RNA, 16 nt, Neisseria meningitidis Z2491
uaucuguacugucugc

SEQ ID NO: 3356088 - RNA, 22 nt, Neisseria meningitidis Z2491
uaucuucguccgugccgaaaua

SEQ ID NO: 3356089 - RNA, 12 nt, Neisseria meningitidis Z2491
uaucuuuaagug

SEQ ID NO: 3356090 - RNA, 18 nt, Neisseria meningitidis Z2491
uaucuuuaagugauucaa

SEQ ID NO: 3356091 - RNA, 19 nt, Neisseria meningitidis Z2491
uaucuuucagcaauaaaau

SEQ ID NO: 3356092 - RNA, 11 nt, Neisseria meningitidis Z2491
uaugaaacaau

SEQ ID NO: 3356093 - RNA, 12 nt, Neisseria meningitidis Z2491
uaugaaacaauc

SEQ ID NO: 3356094 - RNA, 13 nt, Neisseria meningitidis Z2491
uaugaaaccauua

SEQ ID NO: 3356095 - RNA, 18 nt, Neisseria meningitidis Z2491
uaugacaagacgacaggc

SEQ ID NO: 3356096 - RNA, 22 nt, Neisseria meningitidis Z2491
uaugcaaaugcacgguuacaca

SEQ ID NO: 3356097 - RNA, 21 nt, Neisseria meningitidis Z2491
ucaaagauuaucugaaaguuu

SEQ ID NO: 3356098 - RNA, 21 nt, Neisseria meningitidis Z2491
ucaaauaggcauugguaaaca

SEQ ID NO: 3356099 - RNA, 17 nt, Neisseria meningitidis Z2491
ucaaaucccgucauucc

SEQ ID NO: 3356100 - RNA, 15 nt, Neisseria meningitidis Z2491
ucaaauuuauuugaa

SEQ ID NO: 3356101 - RNA, 13 nt, Neisseria meningitidis Z2491
ucaacaaaaugcc

SEQ ID NO: 3356102 - RNA, 14 nt, Neisseria meningitidis Z2491
ucaacaaaaugccg

SEQ ID NO: 3356103 - RNA, 11 nt, Neisseria meningitidis Z2491
ucaacacaaaa

SEQ ID NO: 3356104 - RNA, 15 nt, Neisseria meningitidis Z2491
ucaacacccugauuc

SEQ ID NO: 3356105 - RNA, 14 nt, Neisseria meningitidis Z2491
ucaacaccugcaga

SEQ ID NO: 3356106 - RNA, 16 nt, Neisseria meningitidis Z2491
ucaacacgcccuucca

SEQ ID NO: 3356107 - RNA, 15 nt, Neisseria meningitidis Z2491
ucaacagacggcguu

SEQ ID NO: 3356108 - RNA, 19 nt, Neisseria meningitidis Z2491
ucaacagauugucaaaaua

SEQ ID NO: 3356109 - RNA, 19 nt, Neisseria meningitidis Z2491
ucaacagcagcgaaggcgc

SEQ ID NO: 3356110 - RNA, 23 nt, Neisseria meningitidis Z2491
ucaacccguaugccgccugccug

SEQ ID NO: 3356111 - RNA, 16 nt, Neisseria meningitidis Z2491
ucaaccgaaaaggaaa

SEQ ID NO: 3356112 - RNA, 18 nt, Neisseria meningitidis Z2491
ucaaccggucaguuguuu

SEQ ID NO: 3356113 - RNA, 11 nt, Neisseria meningitidis Z2491
ucaaccuguuu

SEQ ID NO: 3356114 - RNA, 13 nt, Neisseria meningitidis Z2491
ucaaccuguuuuu

SEQ ID NO: 3356115 - RNA, 16 nt, Neisseria meningitidis Z2491
ucaaccuguuuuucaa

SEQ ID NO: 3356116 - RNA, 21 nt, Neisseria meningitidis Z2491
ucaacgaaccuggauucccgc

SEQ ID NO: 3356117 - RNA, 20 nt, Neisseria meningitidis Z2491
ucaacgcacuggauucccgc

SEQ ID NO: 3356118 - RNA, 16 nt, Neisseria meningitidis Z2491
ucaacggcacggcguu

SEQ ID NO: 3356119 - RNA, 20 nt, Neisseria meningitidis Z2491
ucaacguuucuauuuucccu

SEQ ID NO: 3356120 - RNA, 19 nt, Neisseria meningitidis Z2491
ucaacugauuguuuuucag

SEQ ID NO: 3356121 - RNA, 18 nt, Neisseria meningitidis Z2491
ucaacuuauugcggcuuu

SEQ ID NO: 3356122 - RNA, 11 nt, Neisseria meningitidis Z2491
ucaagaacagg

SEQ ID NO: 3356123 - RNA, 18 nt, Neisseria meningitidis Z2491
ucaagacaaucaaaguca

SEQ ID NO: 3356124 - RNA, 17 nt, Neisseria meningitidis Z2491
ucaagcaaaaaaugccg

SEQ ID NO: 3356125 - RNA, 18 nt, Neisseria meningitidis Z2491
ucaagcaaaaaaugccgu

SEQ ID NO: 3356126 - RNA, 13 nt, Neisseria meningitidis Z2491
ucaagcaaaucua

SEQ ID NO: 3356127 - RNA, 19 nt, Neisseria meningitidis Z2491
ucaagcaaaucuaaauagc

SEQ ID NO: 3356128 - RNA, 21 nt, Neisseria meningitidis Z2491
ucaagccuucccguuccacaa

SEQ ID NO: 3356129 - RNA, 22 nt, Neisseria meningitidis Z2491
ucaaguggggggaauacgguuu

SEQ ID NO: 3356130 - RNA, 22 nt, Neisseria meningitidis Z2491
ucaaguuccagacggcauuuuu

SEQ ID NO: 3356131 - RNA, 21 nt, Neisseria meningitidis Z2491
ucaauaacgguugcacgguuu

SEQ ID NO: 3356132 - RNA, 13 nt, Neisseria meningitidis Z2491
ucaauauuaggaa

SEQ ID NO: 3356133 - RNA, 19 nt, Neisseria meningitidis Z2491
ucaauauuaggaagguuuu

SEQ ID NO: 3356134 - RNA, 16 nt, Neisseria meningitidis Z2491
ucaaucaaugugccuc

SEQ ID NO: 3356135 - RNA, 16 nt, Neisseria meningitidis Z2491
ucaaucagccccgcca

SEQ ID NO: 3356136 - RNA, 16 nt, Neisseria meningitidis Z2491
ucaaucccguugccaa

SEQ ID NO: 3356137 - RNA, 14 nt, Neisseria meningitidis Z2491
ucaaucucauuuuc

SEQ ID NO: 3356138 - RNA, 21 nt, Neisseria meningitidis Z2491
ucaauugcuuauuuguucaaa

SEQ ID NO: 3356139 - RNA, 13 nt, Neisseria meningitidis Z2491
ucaauuucaacug

SEQ ID NO: 3356140 - RNA, 19 nt, Neisseria meningitidis Z2491
ucacaaaaacagaaaacca

SEQ ID NO: 3356141 - RNA, 21 nt, Neisseria meningitidis Z2491
ucacaaaaacagaaaaccaaa

SEQ ID NO: 3356142 - RNA, 22 nt, Neisseria meningitidis Z2491
ucacaaaaacagaaaaccaaaa

SEQ ID NO: 3356143 - RNA, 20 nt, Neisseria meningitidis Z2491
ucacaaaaacagaaauucaa

SEQ ID NO: 3356144 - RNA, 18 nt, Neisseria meningitidis Z2491
ucacaacggcguuuucaa

SEQ ID NO: 3356145 - RNA, 18 nt, Neisseria meningitidis Z2491
ucacaauauagccgcccc

SEQ ID NO: 3356146 - RNA, 19 nt, Neisseria meningitidis Z2491
ucacacggccggcgcagcu

SEQ ID NO: 3356147 - RNA, 15 nt, Neisseria meningitidis Z2491
ucacacguucgcagg

SEQ ID NO: 3356148 - RNA, 16 nt, Neisseria meningitidis Z2491
ucacauaaauccguuc

SEQ ID NO: 3356149 - RNA, 21 nt, Neisseria meningitidis Z2491
ucacaucguuggauuugucuu

SEQ ID NO: 3356150 - RNA, 22 nt, Neisseria meningitidis Z2491
ucacauuuucuauuugauuuuc

SEQ ID NO: 3356151 - RNA, 23 nt, Neisseria meningitidis Z2491
ucaccaaaccgucguuuuuuucc

SEQ ID NO: 3356152 - RNA, 16 nt, Neisseria meningitidis Z2491
ucaccaucacgcugcc

SEQ ID NO: 3356153 - RNA, 16 nt, Neisseria meningitidis Z2491
ucaccaucgagcugcc

SEQ ID NO: 3356154 - RNA, 18 nt, Neisseria meningitidis Z2491
ucaccgacaaucaggccg

SEQ ID NO: 3356155 - RNA, 15 nt, Neisseria meningitidis Z2491
ucaccgcagccgcca

SEQ ID NO: 3356156 - RNA, 13 nt, Neisseria meningitidis Z2491
ucacgauugagac

SEQ ID NO: 3356157 - RNA, 21 nt, Neisseria meningitidis Z2491
ucacgccguguuucaaggcgg

SEQ ID NO: 3356158 - RNA, 17 nt, Neisseria meningitidis Z2491
ucacgccuuuccccuuc

SEQ ID NO: 3356159 - RNA, 21 nt, Neisseria meningitidis Z2491
ucacgcugccggcaaauucca

SEQ ID NO: 3356160 - RNA, 23 nt, Neisseria meningitidis Z2491
ucacggagaaggcaauaauaaac

SEQ ID NO: 3356161 - RNA, 23 nt, Neisseria meningitidis Z2491
ucacggcuuugucgguaaaaaug

SEQ ID NO: 3356162 - RNA, 19 nt, Neisseria meningitidis Z2491
ucacguccgccauuuccaa

SEQ ID NO: 3356163 - RNA, 16 nt, Neisseria meningitidis Z2491
ucacguucugaaaaau

SEQ ID NO: 3356164 - RNA, 18 nt, Neisseria meningitidis Z2491
ucacuaaauugcauuuuu

SEQ ID NO: 3356165 - RNA, 15 nt, Neisseria meningitidis Z2491
ucacuauaccaaacg

SEQ ID NO: 3356166 - RNA, 23 nt, Neisseria meningitidis Z2491
ucacuauaccaaacggcauaucc

SEQ ID NO: 3356167 - RNA, 23 nt, Neisseria meningitidis Z2491
ucacuauauuuucccgacaggcg

SEQ ID NO: 3356168 - RNA, 12 nt, Neisseria meningitidis Z2491
ucacuauuaaaa

SEQ ID NO: 3356169 - RNA, 18 nt, Neisseria meningitidis Z2491
ucacuuggaauaugaaua

SEQ ID NO: 3356170 - RNA, 15 nt, Neisseria meningitidis Z2491
ucacuuggugcuuca

SEQ ID NO: 3356171 - RNA, 18 nt, Neisseria meningitidis Z2491
ucacuuggugcuucagca

SEQ ID NO: 3356172 - RNA, 21 nt, Neisseria meningitidis Z2491
ucacuuggugcuucagcaccu

SEQ ID NO: 3356173 - RNA, 20 nt, Neisseria meningitidis Z2491
ucacuuuaaucaauccgaaa

SEQ ID NO: 3356174 - RNA, 11 nt, Neisseria meningitidis Z2491
ucagaaaccua

SEQ ID NO: 3356175 - RNA, 16 nt, Neisseria meningitidis Z2491
ucagaaaccuaaaauc

SEQ ID NO: 3356176 - RNA, 21 nt, Neisseria meningitidis Z2491
ucagaaaugacggaaacucaa

SEQ ID NO: 3356177 - RNA, 19 nt, Neisseria meningitidis Z2491
ucagaaaugacugaaauuc

SEQ ID NO: 3356178 - RNA, 23 nt, Neisseria meningitidis Z2491
ucagaaguuacucgaaacuuaaa

SEQ ID NO: 3356179 - RNA, 18 nt, Neisseria meningitidis Z2491
ucagaauugauucuccca

SEQ ID NO: 3356180 - RNA, 21 nt, Neisseria meningitidis Z2491
ucagacauugacgguugcagc

SEQ ID NO: 3356181 - RNA, 18 nt, Neisseria meningitidis Z2491
ucagacggcaucaaaaug

SEQ ID NO: 3356182 - RNA, 16 nt, Neisseria meningitidis Z2491
ucagacggcaucagua

SEQ ID NO: 3356183 - RNA, 19 nt, Neisseria meningitidis Z2491
ucagacggcauuucgagga

SEQ ID NO: 3356184 - RNA, 16 nt, Neisseria meningitidis Z2491
ucagacggcauuugac

SEQ ID NO: 3356185 - RNA, 24 nt, Neisseria meningitidis Z2491
ucagacggcauuuuccuugcaacc

SEQ ID NO: 3356186 - RNA, 15 nt, Neisseria meningitidis Z2491
ucagacggcauuuug

SEQ ID NO: 3356187 - RNA, 17 nt, Neisseria meningitidis Z2491
ucagacggcauuuugau

SEQ ID NO: 3356188 - RNA, 22 nt, Neisseria meningitidis Z2491
ucagacggcauuuugcugccgg

SEQ ID NO: 3356189 - RNA, 21 nt, Neisseria meningitidis Z2491
ucagacggcauuuuguuucgg

SEQ ID NO: 3356190 - RNA, 15 nt, Neisseria meningitidis Z2491
ucagacggcauuuuu

SEQ ID NO: 3356191 - RNA, 19 nt, Neisseria meningitidis Z2491
ucagacggcauuuuuucac

SEQ ID NO: 3356192 - RNA, 20 nt, Neisseria meningitidis Z2491
ucagacgguauucuuucgcu

SEQ ID NO: 3356193 - RNA, 22 nt, Neisseria meningitidis Z2491
ucagacgguauuuuuuauccgg

SEQ ID NO: 3356194 - RNA, 16 nt, Neisseria meningitidis Z2491
ucagauaaucuuugaa

SEQ ID NO: 3356195 - RNA, 20 nt, Neisseria meningitidis Z2491
ucagauggccuuuacucauu

SEQ ID NO: 3356196 - RNA, 20 nt, Neisseria meningitidis Z2491
ucagauguuucggcgcaucc

SEQ ID NO: 3356197 - RNA, 11 nt, Neisseria meningitidis Z2491
uccacggccac

SEQ ID NO: 3356198 - RNA, 15 nt, Neisseria meningitidis Z2491
uccacuauaaaaaau

SEQ ID NO: 3356199 - RNA, 14 nt, Neisseria meningitidis Z2491
uccacuauaaaagg

SEQ ID NO: 3356200 - RNA, 19 nt, Neisseria meningitidis Z2491
uccacuauacuauaggaac

SEQ ID NO: 3356201 - RNA, 14 nt, Neisseria meningitidis Z2491
uccacuauauuuuc

SEQ ID NO: 3356202 - RNA, 20 nt, Neisseria meningitidis Z2491
uccagaacguaaaaucucaa

SEQ ID NO: 3356203 - RNA, 20 nt, Neisseria meningitidis Z2491
uccagaacguaaaaucugaa

SEQ ID NO: 3356204 - RNA, 11 nt, Neisseria meningitidis Z2491
uccagacggca

SEQ ID NO: 3356205 - RNA, 14 nt, Neisseria meningitidis Z2491
uccagcaaacggua

SEQ ID NO: 3356206 - RNA, 14 nt, Neisseria meningitidis Z2491
uccagcaaugccgu

SEQ ID NO: 3356207 - RNA, 23 nt, Neisseria meningitidis Z2491
uccagcaaugcgucuuccaacgc

SEQ ID NO: 3356208 - RNA, 15 nt, Neisseria meningitidis Z2491
uccagcaccacaccu

SEQ ID NO: 3356209 - RNA, 16 nt, Neisseria meningitidis Z2491
uccagcgugcggacgu

SEQ ID NO: 3356210 - RNA, 23 nt, Neisseria meningitidis Z2491
uccagcgugcggacguucaaacc

SEQ ID NO: 3356211 - RNA, 20 nt, Neisseria meningitidis Z2491
uccagcuccggccaaaaaaa

SEQ ID NO: 3356212 - RNA, 20 nt, Neisseria meningitidis Z2491
uccagugcguugaguuucag

SEQ ID NO: 3356213 - RNA, 21 nt, Neisseria meningitidis Z2491
uccagugcguugaguuucagc

SEQ ID NO: 3356214 - RNA, 22 nt, Neisseria meningitidis Z2491
uccauaaaauacaugacauuaa

SEQ ID NO: 3356215 - RNA, 19 nt, Neisseria meningitidis Z2491
uccauaauccaagauuuca

SEQ ID NO: 3356216 - RNA, 18 nt, Neisseria meningitidis Z2491
uccaucaacaaaaugccg

SEQ ID NO: 3356217 - RNA, 20 nt, Neisseria meningitidis Z2491
uccaucccauauuccacagu

SEQ ID NO: 3356218 - RNA, 18 nt, Neisseria meningitidis Z2491
uccaucgcgucuucaaaa

SEQ ID NO: 3356219 - RNA, 20 nt, Neisseria meningitidis Z2491
uccaucgcgucuucaaaauc

SEQ ID NO: 3356220 - RNA, 12 nt, Neisseria meningitidis Z2491
uccaugauuuuu

SEQ ID NO: 3356221 - RNA, 18 nt, Neisseria meningitidis Z2491
uccauucgugggcgcauu

SEQ ID NO: 3356222 - RNA, 15 nt, Neisseria meningitidis Z2491
ucccaaaggcaauaa

SEQ ID NO: 3356223 - RNA, 21 nt, Neisseria meningitidis Z2491
ucccaauauuaagaaaaacag

SEQ ID NO: 3356224 - RNA, 13 nt, Neisseria meningitidis Z2491
ucccacgaaagug

SEQ ID NO: 3356225 - RNA, 14 nt, Neisseria meningitidis Z2491
ucccacgaaagugg

SEQ ID NO: 3356226 - RNA, 14 nt, Neisseria meningitidis Z2491
ucccacggaagugg

SEQ ID NO: 3356227 - RNA, 21 nt, Neisseria meningitidis Z2491
ucccacuuccgugggaaugac

SEQ ID NO: 3356228 - RNA, 23 nt, Neisseria meningitidis Z2491
ucccauacuacugcuguuugaca

SEQ ID NO: 3356229 - RNA, 15 nt, Neisseria meningitidis Z2491
uccccauaugccguc

SEQ ID NO: 3356230 - RNA, 18 nt, Neisseria meningitidis Z2491
ucccccacaggggaggga

SEQ ID NO: 3356231 - RNA, 17 nt, Neisseria meningitidis Z2491
ucccccguaccgggcag

SEQ ID NO: 3356232 - RNA, 14 nt, Neisseria meningitidis Z2491
uccccgacccuccc

SEQ ID NO: 3356233 - RNA, 19 nt, Neisseria meningitidis Z2491
uccccgguauaaaaaagau

SEQ ID NO: 3356234 - RNA, 20 nt, Neisseria meningitidis Z2491
uccccucggggucuuuggca

SEQ ID NO: 3356235 - RNA, 23 nt, Neisseria meningitidis Z2491
ucccgacagccgaaacccaaaca

SEQ ID NO: 3356236 - RNA, 20 nt, Neisseria meningitidis Z2491
ucccgacgcuugucccacag

SEQ ID NO: 3356237 - RNA, 14 nt, Neisseria meningitidis Z2491
ucccgaugccgcaa

SEQ ID NO: 3356238 - RNA, 17 nt, Neisseria meningitidis Z2491
ucccgcaaaaacaaaaa

SEQ ID NO: 3356239 - RNA, 16 nt, Neisseria meningitidis Z2491
ucccgcaaaaacgcag

SEQ ID NO: 3356240 - RNA, 23 nt, Neisseria meningitidis Z2491
ucccgcaaaagcgggaauccaaa

SEQ ID NO: 3356241 - RNA, 17 nt, Neisseria meningitidis Z2491
ucccgcgagaacagaaa

SEQ ID NO: 3356242 - RNA, 21 nt, Neisseria meningitidis Z2491
ucccgcuuucgcgggaaugac

SEQ ID NO: 3356243 - RNA, 21 nt, Neisseria meningitidis Z2491
ucccgcuuuugcgggaaugac

SEQ ID NO: 3356244 - RNA, 18 nt, Neisseria meningitidis Z2491
ucccguccggcaaacauc

SEQ ID NO: 3356245 - RNA, 16 nt, Neisseria meningitidis Z2491
ucccgugguuuuucgg

SEQ ID NO: 3356246 - RNA, 13 nt, Neisseria meningitidis Z2491
ucccguuucagac

SEQ ID NO: 3356247 - RNA, 20 nt, Neisseria meningitidis Z2491
ucccguuucagacggcauuu

SEQ ID NO: 3356248 - RNA, 15 nt, Neisseria meningitidis Z2491
ucccguuugaaaaca

SEQ ID NO: 3356249 - RNA, 22 nt, Neisseria meningitidis Z2491
ucccucccgacagccgaaaccc

SEQ ID NO: 3356250 - RNA, 13 nt, Neisseria meningitidis Z2491
ucccucgaaagcg

SEQ ID NO: 3356251 - RNA, 15 nt, Neisseria meningitidis Z2491
ucccucgccuugccg

SEQ ID NO: 3356252 - RNA, 23 nt, Neisseria meningitidis Z2491
ucccugaauaaaacgcgugcagg

SEQ ID NO: 3356253 - RNA, 22 nt, Neisseria meningitidis Z2491
ucccugacaaucaggaaaacag

SEQ ID NO: 3356254 - RNA, 17 nt, Neisseria meningitidis Z2491
ucccuucccucccgaca

SEQ ID NO: 3356255 - RNA, 19 nt, Neisseria meningitidis Z2491
uccgaaacaacaaaaccua

SEQ ID NO: 3356256 - RNA, 20 nt, Neisseria meningitidis Z2491
uccgaaacaacaaaaccuau

SEQ ID NO: 3356257 - RNA, 20 nt, Neisseria meningitidis Z2491
uccgaaacaaugccgucuga

SEQ ID NO: 3356258 - RNA, 16 nt, Neisseria meningitidis Z2491
uccgaaagguuuucgg

SEQ ID NO: 3356259 - RNA, 19 nt, Neisseria meningitidis Z2491
uccgaagcgacaacaaucu

SEQ ID NO: 3356260 - RNA, 17 nt, Neisseria meningitidis Z2491
uccgacaaauuccuaaa

SEQ ID NO: 3356261 - RNA, 23 nt, Neisseria meningitidis Z2491
uccgacaaauuccuaaaacuuaa

SEQ ID NO: 3356262 - RNA, 23 nt, Neisseria meningitidis Z2491
uccgacaggcaaaugcugucuga

SEQ ID NO: 3356263 - RNA, 14 nt, Neisseria meningitidis Z2491
uccgaccgccgccg

SEQ ID NO: 3356264 - RNA, 21 nt, Neisseria meningitidis Z2491
uccgacgugugaguagcggug

SEQ ID NO: 3356265 - RNA, 16 nt, Neisseria meningitidis Z2491
uccgaggcuguggagc

SEQ ID NO: 3356266 - RNA, 16 nt, Neisseria meningitidis Z2491
uccgaguggcuuccuu

SEQ ID NO: 3356267 - RNA, 23 nt, Neisseria meningitidis Z2491
uccgaguggcuuccuuuuuaaag

SEQ ID NO: 3356268 - RNA, 20 nt, Neisseria meningitidis Z2491
uccgauaaauuccuguugcu

SEQ ID NO: 3356269 - RNA, 13 nt, Neisseria meningitidis Z2491
uccgauagauucc

SEQ ID NO: 3356270 - RNA, 18 nt, Neisseria meningitidis Z2491
uccgcaaacaaaaugccg

SEQ ID NO: 3356271 - RNA, 18 nt, Neisseria meningitidis Z2491
uccgcaaacaccagcauc

SEQ ID NO: 3356272 - RNA, 19 nt, Neisseria meningitidis Z2491
uccgcaacgcgcaaacccg

SEQ ID NO: 3356273 - RNA, 17 nt, Neisseria meningitidis Z2491
uccgcacagaaaccugc

SEQ ID NO: 3356274 - RNA, 14 nt, Neisseria meningitidis Z2491
uccgcaggcuccuu

SEQ ID NO: 3356275 - RNA, 16 nt, Neisseria meningitidis Z2491
uccgcauaauaaaaau

SEQ ID NO: 3356276 - RNA, 16 nt, Neisseria meningitidis Z2491
uccgccaaaaacggca

SEQ ID NO: 3356277 - RNA, 12 nt, Neisseria meningitidis Z2491
uccgccaaacca

SEQ ID NO: 3356278 - RNA, 14 nt, Neisseria meningitidis Z2491
uccgccauucccgu

SEQ ID NO: 3356279 - RNA, 21 nt, Neisseria meningitidis Z2491
uccgcccgaauaaaaaauaug

SEQ ID NO: 3356280 - RNA, 17 nt, Neisseria meningitidis Z2491
uccgccgucauucccgc

SEQ ID NO: 3356281 - RNA, 18 nt, Neisseria meningitidis Z2491
uccgccucugccagcucc

SEQ ID NO: 3356282 - RNA, 21 nt, Neisseria meningitidis Z2491
uccgcgccaaaucggacggau

SEQ ID NO: 3356283 - RNA, 12 nt, Neisseria meningitidis Z2491
uccgcgcccacg

SEQ ID NO: 3356284 - RNA, 16 nt, Neisseria meningitidis Z2491
uccgcgucauucccgc

SEQ ID NO: 3356285 - RNA, 19 nt, Neisseria meningitidis Z2491
uccgcuauauauucugauu

SEQ ID NO: 3356286 - RNA, 19 nt, Neisseria meningitidis Z2491
uccgcuauauuccaccauc

SEQ ID NO: 3356287 - RNA, 13 nt, Neisseria meningitidis Z2491
uccgcuugaaaca

SEQ ID NO: 3356288 - RNA, 16 nt, Neisseria meningitidis Z2491
uccgcuugccgaaagc

SEQ ID NO: 3356289 - RNA, 12 nt, Neisseria meningitidis Z2491
uccggauuuccu

SEQ ID NO: 3356290 - RNA, 18 nt, Neisseria meningitidis Z2491
uccggcaagccuuucaac

SEQ ID NO: 3356291 - RNA, 13 nt, Neisseria meningitidis Z2491
uccggcagccugc

SEQ ID NO: 3356292 - RNA, 15 nt, Neisseria meningitidis Z2491
uccggcaugauuuuc

SEQ ID NO: 3356293 - RNA, 23 nt, Neisseria meningitidis Z2491
uccggcuccgguucguuuugcaa

SEQ ID NO: 3356294 - RNA, 23 nt, Neisseria meningitidis Z2491
uccggcugcgcguaaucccauuu

SEQ ID NO: 3356295 - RNA, 15 nt, Neisseria meningitidis Z2491
uccgguaaauuccua

SEQ ID NO: 3356296 - RNA, 14 nt, Neisseria meningitidis Z2491
uccgguucccugcc

SEQ ID NO: 3356297 - RNA, 17 nt, Neisseria meningitidis Z2491
uccguaaauuguccauu

SEQ ID NO: 3356298 - RNA, 15 nt, Neisseria meningitidis Z2491
ucggcagucggucug

SEQ ID NO: 3356299 - RNA, 16 nt, Neisseria meningitidis Z2491
ucggcagugauuuccc

SEQ ID NO: 3356300 - RNA, 18 nt, Neisseria meningitidis Z2491
ucggcagugauuucccgu

SEQ ID NO: 3356301 - RNA, 13 nt, Neisseria meningitidis Z2491
ucggcauucccgc

SEQ ID NO: 3356302 - RNA, 20 nt, Neisseria meningitidis Z2491
ucggcauuuucguccuugcu

SEQ ID NO: 3356303 - RNA, 16 nt, Neisseria meningitidis Z2491
ucggccugcccugcca

SEQ ID NO: 3356304 - RNA, 14 nt, Neisseria meningitidis Z2491
ucggcguuuuucag

SEQ ID NO: 3356305 - RNA, 18 nt, Neisseria meningitidis Z2491
ucggcucgccgccuuugc

SEQ ID NO: 3356306 - RNA, 18 nt, Neisseria meningitidis Z2491
ucggcuucgcgggcugcg

SEQ ID NO: 3356307 - RNA, 22 nt, Neisseria meningitidis Z2491
ucggcuugagcgacagcggccg

SEQ ID NO: 3356308 - RNA, 11 nt, Neisseria meningitidis Z2491
ucgggaaaaau

SEQ ID NO: 3356309 - RNA, 18 nt, Neisseria meningitidis Z2491
ucgggaaugacugaaacu

SEQ ID NO: 3356310 - RNA, 16 nt, Neisseria meningitidis Z2491
ucgggauucagauguu

SEQ ID NO: 3356311 - RNA, 16 nt, Neisseria meningitidis Z2491
ucgggcaaaagccagc

SEQ ID NO: 3356312 - RNA, 22 nt, Neisseria meningitidis Z2491
ucgggcaacggcaauauucaaa

SEQ ID NO: 3356313 - RNA, 22 nt, Neisseria meningitidis Z2491
ucgggcaacucgauuuccgcga

SEQ ID NO: 3356314 - RNA, 19 nt, Neisseria meningitidis Z2491
ucgggcaauauucuuugaa

SEQ ID NO: 3356315 - RNA, 21 nt, Neisseria meningitidis Z2491
ucgggcggcgguuugccgucu

SEQ ID NO: 3356316 - RNA, 22 nt, Neisseria meningitidis Z2491
ucggguaacggcaauauucaaa

SEQ ID NO: 3356317 - RNA, 11 nt, Neisseria meningitidis Z2491
ucggguacaac

SEQ ID NO: 3356318 - RNA, 11 nt, Neisseria meningitidis Z2491
ucgguuucccg

SEQ ID NO: 3356319 - RNA, 13 nt, Neisseria meningitidis Z2491
ucgguuucuucuu

SEQ ID NO: 3356320 - RNA, 14 nt, Neisseria meningitidis Z2491
ucgguuucuucuuc

SEQ ID NO: 3356321 - RNA, 13 nt, Neisseria meningitidis Z2491
ucgguuuuuuccg

SEQ ID NO: 3356322 - RNA, 21 nt, Neisseria meningitidis Z2491
ucguagccgucgccccaaaaa

SEQ ID NO: 3356323 - RNA, 18 nt, Neisseria meningitidis Z2491
ucguaggcuuuuuccaau

SEQ ID NO: 3356324 - RNA, 23 nt, Neisseria meningitidis Z2491
ucguauugcuaaauuucuagaag

SEQ ID NO: 3356325 - RNA, 19 nt, Neisseria meningitidis Z2491
ucgucagaccccuuucggc

SEQ ID NO: 3356326 - RNA, 23 nt, Neisseria meningitidis Z2491
ucgucaugcaccugcauaaucag

SEQ ID NO: 3356327 - RNA, 13 nt, Neisseria meningitidis Z2491
ucgucauucccac

SEQ ID NO: 3356328 - RNA, 13 nt, Neisseria meningitidis Z2491
ucgucauuuccac

SEQ ID NO: 3356329 - RNA, 15 nt, Neisseria meningitidis Z2491
ucgucgggcugccaa

SEQ ID NO: 3356330 - RNA, 21 nt, Neisseria meningitidis Z2491
ucgucugaaaaauuuucagac

SEQ ID NO: 3356331 - RNA, 13 nt, Neisseria meningitidis Z2491
ucgugauucccga

SEQ ID NO: 3356332 - RNA, 16 nt, Neisseria meningitidis Z2491
ucgugcaggguuuucu

SEQ ID NO: 3356333 - RNA, 15 nt, Neisseria meningitidis Z2491
ucguuacaaauuuaa

SEQ ID NO: 3356334 - RNA, 17 nt, Neisseria meningitidis Z2491
ucguuacaaauuuaaac

SEQ ID NO: 3356335 - RNA, 13 nt, Neisseria meningitidis Z2491
ucguuauuuccac

SEQ ID NO: 3356336 - RNA, 14 nt, Neisseria meningitidis Z2491
ucguuauuuccaca

SEQ ID NO: 3356337 - RNA, 13 nt, Neisseria meningitidis Z2491
ucguucaacagca

SEQ ID NO: 3356338 - RNA, 17 nt, Neisseria meningitidis Z2491
ucguugcguaggaugcc

SEQ ID NO: 3356339 - RNA, 22 nt, Neisseria meningitidis Z2491
ucguugugcggcaaaacgccuu

SEQ ID NO: 3356340 - RNA, 15 nt, Neisseria meningitidis Z2491
ucguuuuccuccgca

SEQ ID NO: 3356341 - RNA, 16 nt, Neisseria meningitidis Z2491
ucguuuuuuuccugcc

SEQ ID NO: 3356342 - RNA, 16 nt, Neisseria meningitidis Z2491
ucuaaaccgucauucc

SEQ ID NO: 3356343 - RNA, 17 nt, Neisseria meningitidis Z2491
ucuaaauagcugaaacu

SEQ ID NO: 3356344 - RNA, 15 nt, Neisseria meningitidis Z2491
ucuaaccagccaacc

SEQ ID NO: 3356345 - RNA, 17 nt, Neisseria meningitidis Z2491
ucuaagauuuacagcga

SEQ ID NO: 3356346 - RNA, 17 nt, Neisseria meningitidis Z2491
ucuaaucgcgucauucc

SEQ ID NO: 3356347 - RNA, 20 nt, Neisseria meningitidis Z2491
ucuagaaacgcaaagcugca

SEQ ID NO: 3356348 - RNA, 20 nt, Neisseria meningitidis Z2491
ucuagaaacucaaagcugca

SEQ ID NO: 3356349 - RNA, 18 nt, Neisseria meningitidis Z2491
ucuagaaaugaaaaacga

SEQ ID NO: 3356350 - RNA, 19 nt, Neisseria meningitidis Z2491
ucuagaacguggaaucuaa

SEQ ID NO: 3356351 - RNA, 21 nt, Neisseria meningitidis Z2491
ucuagaaucucggacuuucag

SEQ ID NO: 3356352 - RNA, 12 nt, Neisseria meningitidis Z2491
ucuagacauuca

SEQ ID NO: 3356353 - RNA, 16 nt, Neisseria meningitidis Z2491
ucuagacauucaaugc

SEQ ID NO: 3356354 - RNA, 17 nt, Neisseria meningitidis Z2491
ucuagacauucaaugcu

SEQ ID NO: 3356355 - RNA, 18 nt, Neisseria meningitidis Z2491
ucuagacauucaaugcua

SEQ ID NO: 3356356 - RNA, 23 nt, Neisseria meningitidis Z2491
ucuagacauucaaugcuaaggca

SEQ ID NO: 3356357 - RNA, 19 nt, Neisseria meningitidis Z2491
ucuagauucccacuuucgu

SEQ ID NO: 3356358 - RNA, 14 nt, Neisseria meningitidis Z2491
ucuagauucccgcc

SEQ ID NO: 3356359 - RNA, 13 nt, Neisseria meningitidis Z2491
ucuagauucccgu

SEQ ID NO: 3356360 - RNA, 14 nt, Neisseria meningitidis Z2491
ucuagggaaaugcc

SEQ ID NO: 3356361 - RNA, 15 nt, Neisseria meningitidis Z2491
ucuagggaaaugccc

SEQ ID NO: 3356362 - RNA, 20 nt, Neisseria meningitidis Z2491
ucuauaaagccuaaauacaa

SEQ ID NO: 3356363 - RNA, 20 nt, Neisseria meningitidis Z2491
ucuauaguggauuaacaaaa

SEQ ID NO: 3356364 - RNA, 21 nt, Neisseria meningitidis Z2491
ucuauaguggauuaacaaaaa

SEQ ID NO: 3356365 - RNA, 20 nt, Neisseria meningitidis Z2491
ucuauaucuucguccgugcc

SEQ ID NO: 3356366 - RNA, 17 nt, Neisseria meningitidis Z2491
ucuauuggauauaauuu

SEQ ID NO: 3356367 - RNA, 15 nt, Neisseria meningitidis Z2491
ucuauuucccggcaa

SEQ ID NO: 3356368 - RNA, 14 nt, Neisseria meningitidis Z2491
ucuauuugauuuuc

SEQ ID NO: 3356369 - RNA, 21 nt, Neisseria meningitidis Z2491
ucuauuuucgccccaaauacc

SEQ ID NO: 3356370 - RNA, 12 nt, Neisseria meningitidis Z2491
ucucaaaauauu

SEQ ID NO: 3356371 - RNA, 17 nt, Neisseria meningitidis Z2491
ucucaaacguugagccu

SEQ ID NO: 3356372 - RNA, 17 nt, Neisseria meningitidis Z2491
ucucagacuauuucggc

SEQ ID NO: 3356373 - RNA, 17 nt, Neisseria meningitidis Z2491
ucucagggcuggcaaaa

SEQ ID NO: 3356374 - RNA, 22 nt, Neisseria meningitidis Z2491
ucucauugguaaacaguuucag

SEQ ID NO: 3356375 - RNA, 14 nt, Neisseria meningitidis Z2491
ucucauuuucaaaa

SEQ ID NO: 3356376 - RNA, 18 nt, Neisseria meningitidis Z2491
ucuccaaguuccaauaca

SEQ ID NO: 3356377 - RNA, 15 nt, Neisseria meningitidis Z2491
ucuccgucauuccca

SEQ ID NO: 3356378 - RNA, 15 nt, Neisseria meningitidis Z2491
ucuccugaucuaaaa

SEQ ID NO: 3356379 - RNA, 18 nt, Neisseria meningitidis Z2491
ucuccugaucuaaaaauu

SEQ ID NO: 3356380 - RNA, 17 nt, Neisseria meningitidis Z2491
ucugaaaaauuuucaga

SEQ ID NO: 3356381 - RNA, 18 nt, Neisseria meningitidis Z2491
ucugaaacaaaauguuca

SEQ ID NO: 3356382 - RNA, 20 nt, Neisseria meningitidis Z2491
ucugaaacccgauuccuguu

SEQ ID NO: 3356383 - RNA, 23 nt, Neisseria meningitidis Z2491
ucugaaacccgauuccuguuuuc

SEQ ID NO: 3356384 - RNA, 18 nt, Neisseria meningitidis Z2491
ucugaaacccggaaaaaa

SEQ ID NO: 3356385 - RNA, 17 nt, Neisseria meningitidis Z2491
ucugaaaccuuuuuuua

SEQ ID NO: 3356386 - RNA, 14 nt, Neisseria meningitidis Z2491
ucugaaacggcauc

SEQ ID NO: 3356387 - RNA, 15 nt, Neisseria meningitidis Z2491
ucugaaacuuuaauu

SEQ ID NO: 3356388 - RNA, 18 nt, Neisseria meningitidis Z2491
ucugaaagccuuucagac

SEQ ID NO: 3356389 - RNA, 17 nt, Neisseria meningitidis Z2491
ucugaaaggcuucagac

SEQ ID NO: 3356390 - RNA, 13 nt, Neisseria meningitidis Z2491
ucugaaagguuuu

SEQ ID NO: 3356391 - RNA, 22 nt, Neisseria meningitidis Z2491
ucugaaauguucagacggcauu

SEQ ID NO: 3356392 - RNA, 14 nt, Neisseria meningitidis Z2491
ucugaaauuucaga

SEQ ID NO: 3356393 - RNA, 15 nt, Neisseria meningitidis Z2491
ucugaacaucuuuca

SEQ ID NO: 3356394 - RNA, 16 nt, Neisseria meningitidis Z2491
ucugaacgcuucagac

SEQ ID NO: 3356395 - RNA, 20 nt, Neisseria meningitidis Z2491
ucugaagccagccccaccau

SEQ ID NO: 3356396 - RNA, 17 nt, Neisseria meningitidis Z2491
ucugaagcccugccugc

SEQ ID NO: 3356397 - RNA, 16 nt, Neisseria meningitidis Z2491
ucugaagccuucagac

SEQ ID NO: 3356398 - RNA, 23 nt, Neisseria meningitidis Z2491
ucugaagccuucagacaacaagc

SEQ ID NO: 3356399 - RNA, 21 nt, Neisseria meningitidis Z2491
ucugaagccuucagacggcau

SEQ ID NO: 3356400 - RNA, 14 nt, Neisseria meningitidis Z2491
ucuuuuaauuucaa

SEQ ID NO: 3356401 - RNA, 16 nt, Neisseria meningitidis Z2491
ucuuuuauuuucaaac

SEQ ID NO: 3356402 - RNA, 14 nt, Neisseria meningitidis Z2491
ugaaaaaaugccgu

SEQ ID NO: 3356403 - RNA, 16 nt, Neisseria meningitidis Z2491
ugaaaaaaugccgucu

SEQ ID NO: 3356404 - RNA, 20 nt, Neisseria meningitidis Z2491
ugaaaaaaugccgucugaaa

SEQ ID NO: 3356405 - RNA, 21 nt, Neisseria meningitidis Z2491
ugaaaaacgacgagaauuuau

SEQ ID NO: 3356406 - RNA, 12 nt, Neisseria meningitidis Z2491
ugaaaaauuuau

SEQ ID NO: 3356407 - RNA, 14 nt, Neisseria meningitidis Z2491
ugaaaaauuuucag

SEQ ID NO: 3356408 - RNA, 16 nt, Neisseria meningitidis Z2491
ugaaaacagaaaccua

SEQ ID NO: 3356409 - RNA, 16 nt, Neisseria meningitidis Z2491
ugaaaacgggaaucua

SEQ ID NO: 3356410 - RNA, 15 nt, Neisseria meningitidis Z2491
ugaaaagucuuucag

SEQ ID NO: 3356411 - RNA, 15 nt, Neisseria meningitidis Z2491
ugaaaauauagugga

SEQ ID NO: 3356412 - RNA, 14 nt, Neisseria meningitidis Z2491
ugaaaaugccgucu

SEQ ID NO: 3356413 - RNA, 21 nt, Neisseria meningitidis Z2491
ugaaaaugccgucugaaaccu

SEQ ID NO: 3356414 - RNA, 22 nt, Neisseria meningitidis Z2491
ugaaaaugugcauuucuaauuu

SEQ ID NO: 3356415 - RNA, 23 nt, Neisseria meningitidis Z2491
ugaaacaaacccccgcuuuugcg

SEQ ID NO: 3356416 - RNA, 22 nt, Neisseria meningitidis Z2491
ugaaaccaaaucggcuuucaga

SEQ ID NO: 3356417 - RNA, 23 nt, Neisseria meningitidis Z2491
ugaaaccauaccgccuucaucaa

SEQ ID NO: 3356418 - RNA, 15 nt, Neisseria meningitidis Z2491
ugaaaccauuacaaa

SEQ ID NO: 3356419 - RNA, 17 nt, Neisseria meningitidis Z2491
ugaaacccggaaaaaag

SEQ ID NO: 3356420 - RNA, 19 nt, Neisseria meningitidis Z2491
ugaaacccgucauucccac

SEQ ID NO: 3356421 - RNA, 20 nt, Neisseria meningitidis Z2491
ugaaacccgucauucccacg

SEQ ID NO: 3356422 - RNA, 16 nt, Neisseria meningitidis Z2491
ugaaaccuuugauuuc

SEQ ID NO: 3356423 - RNA, 16 nt, Neisseria meningitidis Z2491
ugaaacgaacaaaccc

SEQ ID NO: 3356424 - RNA, 17 nt, Neisseria meningitidis Z2491
ugaaacgcauucagacg

SEQ ID NO: 3356425 - RNA, 22 nt, Neisseria meningitidis Z2491
ugaaacgcauucagacggcauc

SEQ ID NO: 3356426 - RNA, 17 nt, Neisseria meningitidis Z2491
ugaaacggacaaaccgc

SEQ ID NO: 3356427 - RNA, 17 nt, Neisseria meningitidis Z2491
ugaaacggcggcagggu

SEQ ID NO: 3356428 - RNA, 16 nt, Neisseria meningitidis Z2491
ugaaacucaaaaaacc

SEQ ID NO: 3356429 - RNA, 17 nt, Neisseria meningitidis Z2491
ugaaacucaaaaaaccg

SEQ ID NO: 3356430 - RNA, 16 nt, Neisseria meningitidis Z2491
ugaaacucaaaaaacu

SEQ ID NO: 3356431 - RNA, 19 nt, Neisseria meningitidis Z2491
ugaaacucaaaaaacugga

SEQ ID NO: 3356432 - RNA, 17 nt, Neisseria meningitidis Z2491
ugaaacuuuaauuuugu

SEQ ID NO: 3356433 - RNA, 12 nt, Neisseria meningitidis Z2491
ugaaagagaaaa

SEQ ID NO: 3356434 - RNA, 17 nt, Neisseria meningitidis Z2491
ugaaaggcuucagacgg

SEQ ID NO: 3356435 - RNA, 20 nt, Neisseria meningitidis Z2491
ugaaaggcuuucagacggca

SEQ ID NO: 3356436 - RNA, 22 nt, Neisseria meningitidis Z2491
ugaaaggcuuuuucagacggca

SEQ ID NO: 3356437 - RNA, 22 nt, Neisseria meningitidis Z2491
ugaaagggcuucagacggcauu

SEQ ID NO: 3356438 - RNA, 18 nt, Neisseria meningitidis Z2491
ugaaauaaaaaaugccgu

SEQ ID NO: 3356439 - RNA, 22 nt, Neisseria meningitidis Z2491
ugaaauacauaggguuaauauc

SEQ ID NO: 3356440 - RNA, 19 nt, Neisseria meningitidis Z2491
ugaaauaugguucagacgg

SEQ ID NO: 3356441 - RNA, 21 nt, Neisseria meningitidis Z2491
ugaaauaugguucagacggca

SEQ ID NO: 3356442 - RNA, 15 nt, Neisseria meningitidis Z2491
ugaaaucaacagauu

SEQ ID NO: 3356443 - RNA, 20 nt, Neisseria meningitidis Z2491
ugaaaucaacagauuacuaa

SEQ ID NO: 3356444 - RNA, 22 nt, Neisseria meningitidis Z2491
ugaaaucaacagauuacuaaaa

SEQ ID NO: 3356445 - RNA, 12 nt, Neisseria meningitidis Z2491
ugaaaucaacgg

SEQ ID NO: 3356446 - RNA, 15 nt, Neisseria meningitidis Z2491
ugaaaucaacggauu

SEQ ID NO: 3356447 - RNA, 21 nt, Neisseria meningitidis Z2491
ugaaauccuauuuucagaugg

SEQ ID NO: 3356448 - RNA, 19 nt, Neisseria meningitidis Z2491
ugaaaugccgucugaaaac

SEQ ID NO: 3356449 - RNA, 23 nt, Neisseria meningitidis Z2491
ugaaaugccgucugaacagcauu

SEQ ID NO: 3356450 - RNA, 16 nt, Neisseria meningitidis Z2491
ugaaauguucagacgg

SEQ ID NO: 3356451 - RNA, 17 nt, Neisseria meningitidis Z2491
ugaaauucgucauuccc

SEQ ID NO: 3356452 - RNA, 21 nt, Neisseria meningitidis Z2491
ugaaauugaagcgucccaaau

SEQ ID NO: 3356453 - RNA, 14 nt, Neisseria meningitidis Z2491
ugaaauuucagacg

SEQ ID NO: 3356454 - RNA, 12 nt, Neisseria meningitidis Z2491
ugaaauuuugcc

SEQ ID NO: 3356455 - RNA, 19 nt, Neisseria meningitidis Z2491
ugaacacggguucagacgg

SEQ ID NO: 3356456 - RNA, 19 nt, Neisseria meningitidis Z2491
ugaacacuucuucgggcgu

SEQ ID NO: 3356457 - RNA, 11 nt, Neisseria meningitidis Z2491
ugaacauuccg

SEQ ID NO: 3356458 - RNA, 13 nt, Neisseria meningitidis Z2491
ugaacauuucaga

SEQ ID NO: 3356459 - RNA, 16 nt, Neisseria meningitidis Z2491
ugaacauuucagacgg

SEQ ID NO: 3356460 - RNA, 20 nt, Neisseria meningitidis Z2491
ugaacauuucagacggcauu

SEQ ID NO: 3356461 - RNA, 16 nt, Neisseria meningitidis Z2491
ugaaccggcacaggcu

SEQ ID NO: 3356462 - RNA, 18 nt, Neisseria meningitidis Z2491
ugaaccgucauucccacg

SEQ ID NO: 3356463 - RNA, 20 nt, Neisseria meningitidis Z2491
ugaaccuuauaguggauuaa

SEQ ID NO: 3356464 - RNA, 22 nt, Neisseria meningitidis Z2491
ugaacgcgcgggaauagcucag

SEQ ID NO: 3356465 - RNA, 23 nt, Neisseria meningitidis Z2491
ugaacucaggcuucagacggcau

SEQ ID NO: 3356466 - RNA, 20 nt, Neisseria meningitidis Z2491
ugaagauggcugaaauucaa

SEQ ID NO: 3356467 - RNA, 21 nt, Neisseria meningitidis Z2491
ugaagauggcugaaauugaaa

SEQ ID NO: 3356468 - RNA, 16 nt, Neisseria meningitidis Z2491
ugaagcaccaagugaa

SEQ ID NO: 3356469 - RNA, 23 nt, Neisseria meningitidis Z2491
ugaagcaggcguuuuucagacgg

SEQ ID NO: 3356470 - RNA, 19 nt, Neisseria meningitidis Z2491
ugaagccagccccaccauu

SEQ ID NO: 3356471 - RNA, 18 nt, Neisseria meningitidis Z2491
ugaagcccuuucagacgg

SEQ ID NO: 3356472 - RNA, 22 nt, Neisseria meningitidis Z2491
ugaagccuucagacaacaagcc

SEQ ID NO: 3356473 - RNA, 19 nt, Neisseria meningitidis Z2491
ugaagccuucagacggcau

SEQ ID NO: 3356474 - RNA, 20 nt, Neisseria meningitidis Z2491
ugaagccuucagacggcauu

SEQ ID NO: 3356475 - RNA, 16 nt, Neisseria meningitidis Z2491
ugaagcgagcagcuuc

SEQ ID NO: 3356476 - RNA, 15 nt, Neisseria meningitidis Z2491
ugaagcucaaaaaac

SEQ ID NO: 3356477 - RNA, 16 nt, Neisseria meningitidis Z2491
ugaaggcuucagacgg

SEQ ID NO: 3356478 - RNA, 18 nt, Neisseria meningitidis Z2491
ugaagucguuggcagcaa

SEQ ID NO: 3356479 - RNA, 17 nt, Neisseria meningitidis Z2491
ugaauagucaggcugcc

SEQ ID NO: 3356480 - RNA, 22 nt, Neisseria meningitidis Z2491
ugaauauuccgccgauguaaac

SEQ ID NO: 3356481 - RNA, 13 nt, Neisseria meningitidis Z2491
ugaauauugccgc

SEQ ID NO: 3356482 - RNA, 17 nt, Neisseria meningitidis Z2491
ugaaucagguugaaaau

SEQ ID NO: 3356483 - RNA, 21 nt, Neisseria meningitidis Z2491
ugaaucagguugaaaaugccg

SEQ ID NO: 3356484 - RNA, 17 nt, Neisseria meningitidis Z2491
ugaaucgucauucccgc

SEQ ID NO: 3356485 - RNA, 14 nt, Neisseria meningitidis Z2491
ugaaucugacuugc

SEQ ID NO: 3356486 - RNA, 16 nt, Neisseria meningitidis Z2491
ugaaugccuuucucug

SEQ ID NO: 3356487 - RNA, 22 nt, Neisseria meningitidis Z2491
ugaaugccuuucucuguuuuuc

SEQ ID NO: 3356488 - RNA, 19 nt, Neisseria meningitidis Z2491
ugaaugucuagauucccgc

SEQ ID NO: 3356489 - RNA, 20 nt, Neisseria meningitidis Z2491
ugaaugucuagauucccgcc

SEQ ID NO: 3356490 - RNA, 20 nt, Neisseria meningitidis Z2491
ugaaugugcgccacgccauu

SEQ ID NO: 3356491 - RNA, 19 nt, Neisseria meningitidis Z2491
ugaauuaaaugcuaaauau

SEQ ID NO: 3356492 - RNA, 20 nt, Neisseria meningitidis Z2491
ugaauuaaaugcuaaauauc

SEQ ID NO: 3356493 - RNA, 21 nt, Neisseria meningitidis Z2491
ugaauuaaauuuaaaccagua

SEQ ID NO: 3356494 - RNA, 16 nt, Neisseria meningitidis Z2491
ugaauuucauuuuuca

SEQ ID NO: 3356495 - RNA, 18 nt, Neisseria meningitidis Z2491
ugaauuuuauugauucaa

SEQ ID NO: 3356496 - RNA, 15 nt, Neisseria meningitidis Z2491
ugacaaaaacuuuuc

SEQ ID NO: 3356497 - RNA, 17 nt, Neisseria meningitidis Z2491
ugacaaucaggaaaaca

SEQ ID NO: 3356498 - RNA, 19 nt, Neisseria meningitidis Z2491
ugacaaucaggaaaacagc

SEQ ID NO: 3356499 - RNA, 19 nt, Neisseria meningitidis Z2491
ugacacaaagccuucuucu

SEQ ID NO: 3356500 - RNA, 19 nt, Neisseria meningitidis Z2491
ugcaagcaguugaaaucaa

SEQ ID NO: 3356501 - RNA, 14 nt, Neisseria meningitidis Z2491
ugcaauacacuguu

SEQ ID NO: 3356502 - RNA, 22 nt, Neisseria meningitidis Z2491
ugcaauacacuguuuccaagcc

SEQ ID NO: 3356503 - RNA, 17 nt, Neisseria meningitidis Z2491
ugcaauauacugauuua

SEQ ID NO: 3356504 - RNA, 23 nt, Neisseria meningitidis Z2491
ugcaauauucgugaaacgucggu

SEQ ID NO: 3356505 - RNA, 23 nt, Neisseria meningitidis Z2491
ugcaaucagugcggcaucguauu

SEQ ID NO: 3356506 - RNA, 23 nt, Neisseria meningitidis Z2491
ugcaaugcacuacuucauuuuuu

SEQ ID NO: 3356507 - RNA, 15 nt, Neisseria meningitidis Z2491
ugcacacguuugccg

SEQ ID NO: 3356508 - RNA, 19 nt, Neisseria meningitidis Z2491
ugcaccgcgucauucccac

SEQ ID NO: 3356509 - RNA, 20 nt, Neisseria meningitidis Z2491
ugcaccgcgucauucccacg

SEQ ID NO: 3356510 - RNA, 19 nt, Neisseria meningitidis Z2491
ugcacgcgcuucaaaucgu

SEQ ID NO: 3356511 - RNA, 14 nt, Neisseria meningitidis Z2491
ugcacuacuucauu

SEQ ID NO: 3356512 - RNA, 14 nt, Neisseria meningitidis Z2491
ugcacucacuuugc

SEQ ID NO: 3356513 - RNA, 17 nt, Neisseria meningitidis Z2491
ugcacucacuuugcuca

SEQ ID NO: 3356514 - RNA, 18 nt, Neisseria meningitidis Z2491
ugcacugcgcgaugcaua

SEQ ID NO: 3356515 - RNA, 19 nt, Neisseria meningitidis Z2491
ugcacugcgcgaugcauau

SEQ ID NO: 3356516 - RNA, 22 nt, Neisseria meningitidis Z2491
ugcagauucuugucaaaccaac

SEQ ID NO: 3356517 - RNA, 17 nt, Neisseria meningitidis Z2491
ugcagcagagcugugca

SEQ ID NO: 3356518 - RNA, 21 nt, Neisseria meningitidis Z2491
ugcagcauauguuugcugcug

SEQ ID NO: 3356519 - RNA, 23 nt, Neisseria meningitidis Z2491
ugcagcauauguuugcugcugua

SEQ ID NO: 3356520 - RNA, 22 nt, Neisseria meningitidis Z2491
ugcaggaucuuauccaucccau

SEQ ID NO: 3356521 - RNA, 19 nt, Neisseria meningitidis Z2491
ugcaggcguagucuuagaa

SEQ ID NO: 3356522 - RNA, 20 nt, Neisseria meningitidis Z2491
ugcaggcguagucuuagaag

SEQ ID NO: 3356523 - RNA, 17 nt, Neisseria meningitidis Z2491
ugcaggcguaugccuuu

SEQ ID NO: 3356524 - RNA, 12 nt, Neisseria meningitidis Z2491
ugcaucccguca

SEQ ID NO: 3356525 - RNA, 15 nt, Neisseria meningitidis Z2491
ugcauccgacaggca

SEQ ID NO: 3356526 - RNA, 16 nt, Neisseria meningitidis Z2491
ugcauccgacaggcaa

SEQ ID NO: 3356527 - RNA, 22 nt, Neisseria meningitidis Z2491
ugcaugaugccgaacaggcguu

SEQ ID NO: 3356528 - RNA, 17 nt, Neisseria meningitidis Z2491
ugcauuucuaauuuuua

SEQ ID NO: 3356529 - RNA, 15 nt, Neisseria meningitidis Z2491
ugcauuuguucggua

SEQ ID NO: 3356530 - RNA, 18 nt, Neisseria meningitidis Z2491
ugcauuuugaaaaugaga

SEQ ID NO: 3356531 - RNA, 14 nt, Neisseria meningitidis Z2491
ugccaaugccgucu

SEQ ID NO: 3356532 - RNA, 19 nt, Neisseria meningitidis Z2491
ugccaauucaaaaaccugc

SEQ ID NO: 3356533 - RNA, 23 nt, Neisseria meningitidis Z2491
ugccacaauauaaucaaacucac

SEQ ID NO: 3356534 - RNA, 21 nt, Neisseria meningitidis Z2491
ugccaccgcgcgccaaggcuu

SEQ ID NO: 3356535 - RNA, 15 nt, Neisseria meningitidis Z2491
ugccaccgugcgcug

SEQ ID NO: 3356536 - RNA, 12 nt, Neisseria meningitidis Z2491
ugccacuugguc

SEQ ID NO: 3356537 - RNA, 23 nt, Neisseria meningitidis Z2491
ugccagcacucucuggggcggga

SEQ ID NO: 3356538 - RNA, 16 nt, Neisseria meningitidis Z2491
ugccagccgccgagca

SEQ ID NO: 3356539 - RNA, 16 nt, Neisseria meningitidis Z2491
ugccagccugcccauc

SEQ ID NO: 3356540 - RNA, 11 nt, Neisseria meningitidis Z2491
ugccagcuccg

SEQ ID NO: 3356541 - RNA, 20 nt, Neisseria meningitidis Z2491
ugccagucuuuaaauucaac

SEQ ID NO: 3356542 - RNA, 22 nt, Neisseria meningitidis Z2491
ugccagucuuuaaauucaacuu

SEQ ID NO: 3356543 - RNA, 19 nt, Neisseria meningitidis Z2491
ugccaguucggcaaacggc

SEQ ID NO: 3356544 - RNA, 21 nt, Neisseria meningitidis Z2491
ugccauacaaacaggcuucag

SEQ ID NO: 3356545 - RNA, 12 nt, Neisseria meningitidis Z2491
ugccaucaggac

SEQ ID NO: 3356546 - RNA, 16 nt, Neisseria meningitidis Z2491
ugccaucaggacucga

SEQ ID NO: 3356547 - RNA, 16 nt, Neisseria meningitidis Z2491
ugcccaacagcagcau

SEQ ID NO: 3356548 - RNA, 19 nt, Neisseria meningitidis Z2491
ugcccaacagcagcauaac

SEQ ID NO: 3356549 - RNA, 12 nt, Neisseria meningitidis Z2491
ugcccacacguu

SEQ ID NO: 3356550 - RNA, 17 nt, Neisseria meningitidis Z2491
ugcccauagaaagggaa

SEQ ID NO: 3356551 - RNA, 15 nt, Neisseria meningitidis Z2491
ugcccauccgccuuc

SEQ ID NO: 3356552 - RNA, 15 nt, Neisseria meningitidis Z2491
ugccccaauaccaac

SEQ ID NO: 3356553 - RNA, 20 nt, Neisseria meningitidis Z2491
ugccccacauaaacagcacg

SEQ ID NO: 3356554 - RNA, 13 nt, Neisseria meningitidis Z2491
ugccccaguucuu

SEQ ID NO: 3356555 - RNA, 12 nt, Neisseria meningitidis Z2491
ugcccgaaccgu

SEQ ID NO: 3356556 - RNA, 20 nt, Neisseria meningitidis Z2491
ugcccgaaccgucauucccg

SEQ ID NO: 3356557 - RNA, 22 nt, Neisseria meningitidis Z2491
ugcccgaaccgucauucccgcc

SEQ ID NO: 3356558 - RNA, 19 nt, Neisseria meningitidis Z2491
ugcccgacggggugaaaaa

SEQ ID NO: 3356559 - RNA, 17 nt, Neisseria meningitidis Z2491
ugcccgcaaucugaaau

SEQ ID NO: 3356560 - RNA, 17 nt, Neisseria meningitidis Z2491
ugcccgccuucaguacg

SEQ ID NO: 3356561 - RNA, 17 nt, Neisseria meningitidis Z2491
ugcccgguuggaaggcg

SEQ ID NO: 3356562 - RNA, 22 nt, Neisseria meningitidis Z2491
ugcccucggauggggugcggca

SEQ ID NO: 3356563 - RNA, 23 nt, Neisseria meningitidis Z2491
ugcccugccaaaacucaaucaaa

SEQ ID NO: 3356564 - RNA, 15 nt, Neisseria meningitidis Z2491
ugcccuuucgcagau

SEQ ID NO: 3356565 - RNA, 13 nt, Neisseria meningitidis Z2491
ugccgaaaccaaa

SEQ ID NO: 3356566 - RNA, 18 nt, Neisseria meningitidis Z2491
ugccgaagguaaggagca

SEQ ID NO: 3356567 - RNA, 20 nt, Neisseria meningitidis Z2491
ugccgacccgaaucacaaac

SEQ ID NO: 3356568 - RNA, 21 nt, Neisseria meningitidis Z2491
ugccgacccgaaucacaaaca

SEQ ID NO: 3356569 - RNA, 16 nt, Neisseria meningitidis Z2491
ugccgaguuuuuggua

SEQ ID NO: 3356570 - RNA, 16 nt, Neisseria meningitidis Z2491
ugccgauauagagucc

SEQ ID NO: 3356571 - RNA, 13 nt, Neisseria meningitidis Z2491
ugccgaugagucc

SEQ ID NO: 3356572 - RNA, 16 nt, Neisseria meningitidis Z2491
ugccgaugucggccaa

SEQ ID NO: 3356573 - RNA, 15 nt, Neisseria meningitidis Z2491
ugccgcaaaugccgu

SEQ ID NO: 3356574 - RNA, 20 nt, Neisseria meningitidis Z2491
ugccgcaccaccagccacaa

SEQ ID NO: 3356575 - RNA, 23 nt, Neisseria meningitidis Z2491
ugccgcauaaaucaacagcagaa

SEQ ID NO: 3356576 - RNA, 12 nt, Neisseria meningitidis Z2491
ugccgccaaagu

SEQ ID NO: 3356577 - RNA, 22 nt, Neisseria meningitidis Z2491
ugccgccaaagugccaaaugua

SEQ ID NO: 3356578 - RNA, 20 nt, Neisseria meningitidis Z2491
ugccgccaauccugccuuca

SEQ ID NO: 3356579 - RNA, 14 nt, Neisseria meningitidis Z2491
ugccgccgccaugu

SEQ ID NO: 3356580 - RNA, 23 nt, Neisseria meningitidis Z2491
ugccgccgucuugggaaaugccg

SEQ ID NO: 3356581 - RNA, 15 nt, Neisseria meningitidis Z2491
ugccgccugaacauu

SEQ ID NO: 3356582 - RNA, 15 nt, Neisseria meningitidis Z2491
ugccgccugccuguu

SEQ ID NO: 3356583 - RNA, 19 nt, Neisseria meningitidis Z2491
ugccgcgaccgaaaugccg

SEQ ID NO: 3356584 - RNA, 16 nt, Neisseria meningitidis Z2491
ugccgcguaugcguuc

SEQ ID NO: 3356585 - RNA, 20 nt, Neisseria meningitidis Z2491
ugccgcugacgaaaccagau

SEQ ID NO: 3356586 - RNA, 18 nt, Neisseria meningitidis Z2491
ugccgcuugaccgcagcc

SEQ ID NO: 3356587 - RNA, 14 nt, Neisseria meningitidis Z2491
ugccggaaauaccg

SEQ ID NO: 3356588 - RNA, 21 nt, Neisseria meningitidis Z2491
ugccguauuucagacaggauu

SEQ ID NO: 3356589 - RNA, 18 nt, Neisseria meningitidis Z2491
ugccguccgaaagguuuu

SEQ ID NO: 3356590 - RNA, 14 nt, Neisseria meningitidis Z2491
ugccguccgaacag

SEQ ID NO: 3356591 - RNA, 13 nt, Neisseria meningitidis Z2491
ugccgucugaaaa

SEQ ID NO: 3356592 - RNA, 22 nt, Neisseria meningitidis Z2491
ugccgucugaaaaaccuuuccc

SEQ ID NO: 3356593 - RNA, 17 nt, Neisseria meningitidis Z2491
ugccgucugaaaacagg

SEQ ID NO: 3356594 - RNA, 21 nt, Neisseria meningitidis Z2491
ugccgucugaaaacaguuuuu

SEQ ID NO: 3356595 - RNA, 13 nt, Neisseria meningitidis Z2491
ugccgucugaaac

SEQ ID NO: 3356596 - RNA, 18 nt, Neisseria meningitidis Z2491
ugccgucugaaacagguu

SEQ ID NO: 3356597 - RNA, 14 nt, Neisseria meningitidis Z2491
ugccgucugaaacc

SEQ ID NO: 3356598 - RNA, 15 nt, Neisseria meningitidis Z2491
ugccgucugaaaccu

SEQ ID NO: 3356599 - RNA, 18 nt, Neisseria meningitidis Z2491
ugccgucugaaacggcau

SEQ ID NO: 3356600 - RNA, 20 nt, Neisseria meningitidis Z2491
ugccgucugaaacguugugc

SEQ ID NO: 3356601 - RNA, 13 nt, Neisseria meningitidis Z2491
ugccgucugaaag

SEQ ID NO: 3356602 - RNA, 13 nt, Neisseria meningitidis Z2491
ugccgucugaaau

SEQ ID NO: 3356603 - RNA, 17 nt, Neisseria meningitidis Z2491
ugccgucugaaauguuc

SEQ ID NO: 3356604 - RNA, 22 nt, Neisseria meningitidis Z2491
ugccgucugaacaucuuucaga

SEQ ID NO: 3356605 - RNA, 15 nt, Neisseria meningitidis Z2491
ugccgucugaagccc

SEQ ID NO: 3356606 - RNA, 22 nt, Neisseria meningitidis Z2491
ugccgucugaagcccugccugc

SEQ ID NO: 3356607 - RNA, 20 nt, Neisseria meningitidis Z2491
ugccgucugaagccuucaga

SEQ ID NO: 3356608 - RNA, 22 nt, Neisseria meningitidis Z2491
ugccgucugaagcguauuucua

SEQ ID NO: 3356609 - RNA, 18 nt, Neisseria meningitidis Z2491
ugccgucugaaggcuuca

SEQ ID NO: 3356610 - RNA, 13 nt, Neisseria meningitidis Z2491
ugccgucugagaa

SEQ ID NO: 3356611 - RNA, 22 nt, Neisseria meningitidis Z2491
ugccgugugcgcggacacgguu

SEQ ID NO: 3356612 - RNA, 20 nt, Neisseria meningitidis Z2491
ugccguguuggguucuagau

SEQ ID NO: 3356613 - RNA, 14 nt, Neisseria meningitidis Z2491
ugccguuucagacg

SEQ ID NO: 3356614 - RNA, 18 nt, Neisseria meningitidis Z2491
ugccguuucagacggcau

SEQ ID NO: 3356615 - RNA, 15 nt, Neisseria meningitidis Z2491
ugccuacgccgaugg

SEQ ID NO: 3356616 - RNA, 16 nt, Neisseria meningitidis Z2491
ugccuaggggcgguuu

SEQ ID NO: 3356617 - RNA, 15 nt, Neisseria meningitidis Z2491
ugccuauuuuuuaau

SEQ ID NO: 3356618 - RNA, 16 nt, Neisseria meningitidis Z2491
ugccuauuuuuuaauc

SEQ ID NO: 3356619 - RNA, 15 nt, Neisseria meningitidis Z2491
ugccucgccuuagcu

SEQ ID NO: 3356620 - RNA, 16 nt, Neisseria meningitidis Z2491
ugccucuauuuaaaaa

SEQ ID NO: 3356621 - RNA, 16 nt, Neisseria meningitidis Z2491
ugccugauccaaaccg

SEQ ID NO: 3356622 - RNA, 21 nt, Neisseria meningitidis Z2491
ugccuuauguauaguaauaaa

SEQ ID NO: 3356623 - RNA, 14 nt, Neisseria meningitidis Z2491
ugccuuguaaaaau

SEQ ID NO: 3356624 - RNA, 23 nt, Neisseria meningitidis Z2491
ugccuuguaaaaaugccgucuga

SEQ ID NO: 3356625 - RNA, 22 nt, Neisseria meningitidis Z2491
ugccuuguccugauuuaaauuu

SEQ ID NO: 3356626 - RNA, 14 nt, Neisseria meningitidis Z2491
ugccuuuauugugc

SEQ ID NO: 3356627 - RNA, 18 nt, Neisseria meningitidis Z2491
ugccuuuucccugacaaa

SEQ ID NO: 3356628 - RNA, 20 nt, Neisseria meningitidis Z2491
ugcgaaagcgggaaugccga

SEQ ID NO: 3356629 - RNA, 15 nt, Neisseria meningitidis Z2491
ugcgaauaagugcgg

SEQ ID NO: 3356630 - RNA, 17 nt, Neisseria meningitidis Z2491
ugcgaugacgaagccga

SEQ ID NO: 3356631 - RNA, 23 nt, Neisseria meningitidis Z2491
ugcgcaggcgggaauacaaacau

SEQ ID NO: 3356632 - RNA, 19 nt, Neisseria meningitidis Z2491
ugcgcagguuguuggaaaa

SEQ ID NO: 3356633 - RNA, 15 nt, Neisseria meningitidis Z2491
ugcgccacggcauaa

SEQ ID NO: 3356634 - RNA, 21 nt, Neisseria meningitidis Z2491
ugcgccacggcuuucgcgccg

SEQ ID NO: 3356635 - RNA, 19 nt, Neisseria meningitidis Z2491
ugcgcccgauguagucguu

SEQ ID NO: 3356636 - RNA, 15 nt, Neisseria meningitidis Z2491
ugcgccgacagcagc

SEQ ID NO: 3356637 - RNA, 16 nt, Neisseria meningitidis Z2491
ugcgccgacagcagcu

SEQ ID NO: 3356638 - RNA, 19 nt, Neisseria meningitidis Z2491
ugcgccgguacccaaacuu

SEQ ID NO: 3356639 - RNA, 12 nt, Neisseria meningitidis Z2491
ugcgccuugccc

SEQ ID NO: 3356640 - RNA, 19 nt, Neisseria meningitidis Z2491
ugcgcgccuuuuuguuuuc

SEQ ID NO: 3356641 - RNA, 15 nt, Neisseria meningitidis Z2491
ugcgcgcggacggau

SEQ ID NO: 3356642 - RNA, 17 nt, Neisseria meningitidis Z2491
ugcgcgggaaugacaaa

SEQ ID NO: 3356643 - RNA, 16 nt, Neisseria meningitidis Z2491
ugcgcgggaaugacgg

SEQ ID NO: 3356644 - RNA, 19 nt, Neisseria meningitidis Z2491
ugcgcgggaaugacggcag

SEQ ID NO: 3356645 - RNA, 23 nt, Neisseria meningitidis Z2491
ugcggaaacuuaucggguaaaac

SEQ ID NO: 3356646 - RNA, 16 nt, Neisseria meningitidis Z2491
ugcggcaacgggagga

SEQ ID NO: 3356647 - RNA, 15 nt, Neisseria meningitidis Z2491
ugcggcacgccgccg

SEQ ID NO: 3356648 - RNA, 14 nt, Neisseria meningitidis Z2491
ugcggcaucaggaa

SEQ ID NO: 3356649 - RNA, 20 nt, Neisseria meningitidis Z2491
ugcggcucgccgccuugucc

SEQ ID NO: 3356650 - RNA, 18 nt, Neisseria meningitidis Z2491
ugcgggaauagcucaguu

SEQ ID NO: 3356651 - RNA, 16 nt, Neisseria meningitidis Z2491
ugcgguaagcggcuug

SEQ ID NO: 3356652 - RNA, 16 nt, Neisseria meningitidis Z2491
ugcggucaaaauuuac

SEQ ID NO: 3356653 - RNA, 16 nt, Neisseria meningitidis Z2491
ugcgguucggacggca

SEQ ID NO: 3356654 - RNA, 14 nt, Neisseria meningitidis Z2491
ugcgguucggcuug

SEQ ID NO: 3356655 - RNA, 17 nt, Neisseria meningitidis Z2491
ugcguacuccuguuuuu

SEQ ID NO: 3356656 - RNA, 23 nt, Neisseria meningitidis Z2491
ugcguaucaaaaaauaaaguaau

SEQ ID NO: 3356657 - RNA, 14 nt, Neisseria meningitidis Z2491
ugcgucaaaccagc

SEQ ID NO: 3356658 - RNA, 15 nt, Neisseria meningitidis Z2491
ugcgucugccuucuu

SEQ ID NO: 3356659 - RNA, 17 nt, Neisseria meningitidis Z2491
ugcgucugccuucuucu

SEQ ID NO: 3356660 - RNA, 16 nt, Neisseria meningitidis Z2491
ugcguguuggagauaa

SEQ ID NO: 3356661 - RNA, 20 nt, Neisseria meningitidis Z2491
ugcguguuggagauaauagu

SEQ ID NO: 3356662 - RNA, 17 nt, Neisseria meningitidis Z2491
ugcguucagacggcauc

SEQ ID NO: 3356663 - RNA, 16 nt, Neisseria meningitidis Z2491
ugcguucgagcaggaa

SEQ ID NO: 3356664 - RNA, 14 nt, Neisseria meningitidis Z2491
ugcguugaguuuca

SEQ ID NO: 3356665 - RNA, 19 nt, Neisseria meningitidis Z2491
ugcguuucagagcauugcg

SEQ ID NO: 3356666 - RNA, 18 nt, Neisseria meningitidis Z2491
ugcguuucuagauuccca

SEQ ID NO: 3356667 - RNA, 12 nt, Neisseria meningitidis Z2491
ugcguuuuucgg

SEQ ID NO: 3356668 - RNA, 14 nt, Neisseria meningitidis Z2491
ugcuaaauuucuag

SEQ ID NO: 3356669 - RNA, 15 nt, Neisseria meningitidis Z2491
ugcuaaauuucuaga

SEQ ID NO: 3356670 - RNA, 13 nt, Neisseria meningitidis Z2491
ugcuaaggcaauu

SEQ ID NO: 3356671 - RNA, 21 nt, Neisseria meningitidis Z2491
ugcuauuuuuuguugcauaau

SEQ ID NO: 3356672 - RNA, 13 nt, Neisseria meningitidis Z2491
ugcucaauauuag

SEQ ID NO: 3356673 - RNA, 18 nt, Neisseria meningitidis Z2491
ugcucaauauuaggaagg

SEQ ID NO: 3356674 - RNA, 21 nt, Neisseria meningitidis Z2491
ugcucaaucuuauuuucaaaa

SEQ ID NO: 3356675 - RNA, 18 nt, Neisseria meningitidis Z2491
ugcucccgauaaaugccg

SEQ ID NO: 3356676 - RNA, 15 nt, Neisseria meningitidis Z2491
ugcuccugacggcaa

SEQ ID NO: 3356677 - RNA, 17 nt, Neisseria meningitidis Z2491
ugcucgaucggcugcca

SEQ ID NO: 3356678 - RNA, 21 nt, Neisseria meningitidis Z2491
ugcucuacgauaacgccgccg

SEQ ID NO: 3356679 - RNA, 13 nt, Neisseria meningitidis Z2491
ugcugccgcccca

SEQ ID NO: 3356680 - RNA, 17 nt, Neisseria meningitidis Z2491
ugcugccggcaggauaa

SEQ ID NO: 3356681 - RNA, 14 nt, Neisseria meningitidis Z2491
ugcugccgugaugc

SEQ ID NO: 3356682 - RNA, 19 nt, Neisseria meningitidis Z2491
ugcugccgugaugccccaa

SEQ ID NO: 3356683 - RNA, 21 nt, Neisseria meningitidis Z2491
ugcugcguuuggagaaaauau

SEQ ID NO: 3356684 - RNA, 18 nt, Neisseria meningitidis Z2491
ugcugcuguauuuuucga

SEQ ID NO: 3356685 - RNA, 19 nt, Neisseria meningitidis Z2491
ugcugcuuuucauuucuag

SEQ ID NO: 3356686 - RNA, 12 nt, Neisseria meningitidis Z2491
ugcuggcugccg

SEQ ID NO: 3356687 - RNA, 15 nt, Neisseria meningitidis Z2491
ugcugguaacauuaa

SEQ ID NO: 3356688 - RNA, 14 nt, Neisseria meningitidis Z2491
ugcuguauuuuucc

SEQ ID NO: 3356689 - RNA, 21 nt, Neisseria meningitidis Z2491
ugcuguauuuuucgaggcgca

SEQ ID NO: 3356690 - RNA, 17 nt, Neisseria meningitidis Z2491
ugcugucugaaaccuga

SEQ ID NO: 3356691 - RNA, 15 nt, Neisseria meningitidis Z2491
ugcuguugcaaagcc

SEQ ID NO: 3356692 - RNA, 13 nt, Neisseria meningitidis Z2491
ugcuguuggaaaa

SEQ ID NO: 3356693 - RNA, 20 nt, Neisseria meningitidis Z2491
ugcuuaaacagcacugccuc

SEQ ID NO: 3356694 - RNA, 21 nt, Neisseria meningitidis Z2491
ugcuuaaacagcacugccucu

SEQ ID NO: 3356695 - RNA, 22 nt, Neisseria meningitidis Z2491
ugcuuacaauccgcuuuuuaaa

SEQ ID NO: 3356696 - RNA, 15 nt, Neisseria meningitidis Z2491
ugcuuauuugagcgg

SEQ ID NO: 3356697 - RNA, 14 nt, Neisseria meningitidis Z2491
ugcuuauuuguuca

SEQ ID NO: 3356698 - RNA, 19 nt, Neisseria meningitidis Z2491
ugcuucaaggcgcggcaca

SEQ ID NO: 3356699 - RNA, 20 nt, Neisseria meningitidis Z2491
ugcuucagcaccuuagagaa

SEQ ID NO: 3356700 - RNA, 14 nt, Neisseria meningitidis Z2491
ugcuucaucggcaa

SEQ ID NO: 3356701 - RNA, 20 nt, Neisseria meningitidis Z2491
ugcuuccgaggcggcuuuca

SEQ ID NO: 3356702 - RNA, 17 nt, Neisseria meningitidis Z2491
ugcuucuucgagggcau

SEQ ID NO: 3356703 - RNA, 21 nt, Neisseria meningitidis Z2491
ugguuugccgaguuuuuggua

SEQ ID NO: 3356704 - RNA, 14 nt, Neisseria meningitidis Z2491
ugguuuucaaaaca

SEQ ID NO: 3356705 - RNA, 21 nt, Neisseria meningitidis Z2491
ugguuuucaaaacauccgcaa

SEQ ID NO: 3356706 - RNA, 22 nt, Neisseria meningitidis Z2491
ugguuuucaaaacauccgcaac

SEQ ID NO: 3356707 - RNA, 12 nt, Neisseria meningitidis Z2491
ugguuuugaggc

SEQ ID NO: 3356708 - RNA, 14 nt, Neisseria meningitidis Z2491
uguaaaaacaaaaa

SEQ ID NO: 3356709 - RNA, 15 nt, Neisseria meningitidis Z2491
uguaaaaacaaaaaa

SEQ ID NO: 3356710 - RNA, 18 nt, Neisseria meningitidis Z2491
uguaaacagauaaaacca

SEQ ID NO: 3356711 - RNA, 19 nt, Neisseria meningitidis Z2491
uguaaacagauaaaaccaa

SEQ ID NO: 3356712 - RNA, 18 nt, Neisseria meningitidis Z2491
uguaaacgaauugaauca

SEQ ID NO: 3356713 - RNA, 15 nt, Neisseria meningitidis Z2491
uguaaagauaaaucu

SEQ ID NO: 3356714 - RNA, 17 nt, Neisseria meningitidis Z2491
uguaaagauaaaucuau

SEQ ID NO: 3356715 - RNA, 17 nt, Neisseria meningitidis Z2491
uguaaauuuuuaaauuu

SEQ ID NO: 3356716 - RNA, 20 nt, Neisseria meningitidis Z2491
uguaaucagggaugcucagu

SEQ ID NO: 3356717 - RNA, 21 nt, Neisseria meningitidis Z2491
uguaauuaggcuccuuaugca

SEQ ID NO: 3356718 - RNA, 17 nt, Neisseria meningitidis Z2491
uguacagguuugagccg

SEQ ID NO: 3356719 - RNA, 22 nt, Neisseria meningitidis Z2491
uguacauugugguagcguugca

SEQ ID NO: 3356720 - RNA, 14 nt, Neisseria meningitidis Z2491
uguaccgguuuaaa

SEQ ID NO: 3356721 - RNA, 17 nt, Neisseria meningitidis Z2491
uguacugguuuaaauuu

SEQ ID NO: 3356722 - RNA, 17 nt, Neisseria meningitidis Z2491
uguacugguuuuuguua

SEQ ID NO: 3356723 - RNA, 20 nt, Neisseria meningitidis Z2491
uguagcggcuaccgaaaugg

SEQ ID NO: 3356724 - RNA, 19 nt, Neisseria meningitidis Z2491
uguauaguaauaaauuaau

SEQ ID NO: 3356725 - RNA, 17 nt, Neisseria meningitidis Z2491
uguaucgguauagugaa

SEQ ID NO: 3356726 - RNA, 19 nt, Neisseria meningitidis Z2491
uguaucggugucaaaacaa

SEQ ID NO: 3356727 - RNA, 19 nt, Neisseria meningitidis Z2491
uguaugccgucugaaaccu

SEQ ID NO: 3356728 - RNA, 20 nt, Neisseria meningitidis Z2491
uguaugccgucugaaaccug

SEQ ID NO: 3356729 - RNA, 19 nt, Neisseria meningitidis Z2491
uguauucggauucccuccu

SEQ ID NO: 3356730 - RNA, 20 nt, Neisseria meningitidis Z2491
ugucaaaauacauccuaaaa

SEQ ID NO: 3356731 - RNA, 14 nt, Neisseria meningitidis Z2491
ugucagacggcauu

SEQ ID NO: 3356732 - RNA, 14 nt, Neisseria meningitidis Z2491
uguccagugcggca

SEQ ID NO: 3356733 - RNA, 20 nt, Neisseria meningitidis Z2491
uguccauucggcuuaaaccu

SEQ ID NO: 3356734 - RNA, 13 nt, Neisseria meningitidis Z2491
uguccauuuuucu

SEQ ID NO: 3356735 - RNA, 22 nt, Neisseria meningitidis Z2491
ugucccacagagcgaacaaguu

SEQ ID NO: 3356736 - RNA, 23 nt, Neisseria meningitidis Z2491
uguccgaccguuccgaaaccaag

SEQ ID NO: 3356737 - RNA, 20 nt, Neisseria meningitidis Z2491
uguccggcaugauuuucuuu

SEQ ID NO: 3356738 - RNA, 20 nt, Neisseria meningitidis Z2491
uguccggcugaacauuccgu

SEQ ID NO: 3356739 - RNA, 15 nt, Neisseria meningitidis Z2491
uguccguuuucuucu

SEQ ID NO: 3356740 - RNA, 15 nt, Neisseria meningitidis Z2491
uguccugauuuuugu

SEQ ID NO: 3356741 - RNA, 21 nt, Neisseria meningitidis Z2491
uguccugauuuuuguuaaucc

SEQ ID NO: 3356742 - RNA, 22 nt, Neisseria meningitidis Z2491
uguccugcuggcagucuaucag

SEQ ID NO: 3356743 - RNA, 14 nt, Neisseria meningitidis Z2491
ugucgaguucuuuu

SEQ ID NO: 3356744 - RNA, 18 nt, Neisseria meningitidis Z2491
ugucgaguucuuuuaaag

SEQ ID NO: 3356745 - RNA, 16 nt, Neisseria meningitidis Z2491
ugucgcagcugcucag

SEQ ID NO: 3356746 - RNA, 17 nt, Neisseria meningitidis Z2491
ugucgcgggcggugcgc

SEQ ID NO: 3356747 - RNA, 22 nt, Neisseria meningitidis Z2491
ugucggaauaagguuugagcag

SEQ ID NO: 3356748 - RNA, 15 nt, Neisseria meningitidis Z2491
ugucggcuuuugaca

SEQ ID NO: 3356749 - RNA, 15 nt, Neisseria meningitidis Z2491
ugucguugucaacca

SEQ ID NO: 3356750 - RNA, 22 nt, Neisseria meningitidis Z2491
ugucugaaaacuuggagauucu

SEQ ID NO: 3356751 - RNA, 12 nt, Neisseria meningitidis Z2491
ugucugaaaccu

SEQ ID NO: 3356752 - RNA, 17 nt, Neisseria meningitidis Z2491
ugucuucaaaaaacaau

SEQ ID NO: 3356753 - RNA, 18 nt, Neisseria meningitidis Z2491
ugucuuguacguggccuu

SEQ ID NO: 3356754 - RNA, 22 nt, Neisseria meningitidis Z2491
ugucuuguacguggccuuuucu

SEQ ID NO: 3356755 - RNA, 23 nt, Neisseria meningitidis Z2491
ugucuuuucccuugcaaauaauu

SEQ ID NO: 3356756 - RNA, 19 nt, Neisseria meningitidis Z2491
ugugaucgcgcugaauguc

SEQ ID NO: 3356757 - RNA, 13 nt, Neisseria meningitidis Z2491
ugugcaggcugcc

SEQ ID NO: 3356758 - RNA, 16 nt, Neisseria meningitidis Z2491
ugugcauaaggcacaa

SEQ ID NO: 3356759 - RNA, 18 nt, Neisseria meningitidis Z2491
ugugcauccgacaggcaa

SEQ ID NO: 3356760 - RNA, 13 nt, Neisseria meningitidis Z2491
ugugcauuucuaa

SEQ ID NO: 3356761 - RNA, 21 nt, Neisseria meningitidis Z2491
ugugcauuucuaauuuuuaua

SEQ ID NO: 3356762 - RNA, 13 nt, Neisseria meningitidis Z2491
ugugccaaugccg

SEQ ID NO: 3356763 - RNA, 21 nt, Neisseria meningitidis Z2491
ugugcgccacgccauuuguuc

SEQ ID NO: 3356764 - RNA, 13 nt, Neisseria meningitidis Z2491
ugugcgccgccgg

SEQ ID NO: 3356765 - RNA, 23 nt, Neisseria meningitidis Z2491
ugugcggcaaaacgccuucuucg

SEQ ID NO: 3356766 - RNA, 13 nt, Neisseria meningitidis Z2491
uguggauaaacau

SEQ ID NO: 3356767 - RNA, 20 nt, Neisseria meningitidis Z2491
uguggaucauaauagaguga

SEQ ID NO: 3356768 - RNA, 22 nt, Neisseria meningitidis Z2491
uguggcugaugcggacggcuug

SEQ ID NO: 3356769 - RNA, 14 nt, Neisseria meningitidis Z2491
ugugggaaugacgg

SEQ ID NO: 3356770 - RNA, 19 nt, Neisseria meningitidis Z2491
ugugggcgauuaucgggaa

SEQ ID NO: 3356771 - RNA, 17 nt, Neisseria meningitidis Z2491
uguguggcgguuauugu

SEQ ID NO: 3356772 - RNA, 13 nt, Neisseria meningitidis Z2491
uguguucgcgcgu

SEQ ID NO: 3356773 - RNA, 21 nt, Neisseria meningitidis Z2491
uguuaauccacuauaauuuuu

SEQ ID NO: 3356774 - RNA, 19 nt, Neisseria meningitidis Z2491
uguuaauccacuauauuaa

SEQ ID NO: 3356775 - RNA, 14 nt, Neisseria meningitidis Z2491
uguuauuauuuucc

SEQ ID NO: 3356776 - RNA, 14 nt, Neisseria meningitidis Z2491
uguuauuuucacaa

SEQ ID NO: 3356777 - RNA, 14 nt, Neisseria meningitidis Z2491
uguuauuuuuauuu

SEQ ID NO: 3356778 - RNA, 15 nt, Neisseria meningitidis Z2491
uguucagaaaauccg

SEQ ID NO: 3356779 - RNA, 16 nt, Neisseria meningitidis Z2491
uguucagacggcauuu

SEQ ID NO: 3356780 - RNA, 20 nt, Neisseria meningitidis Z2491
uguucagacggcauuuugcc

SEQ ID NO: 3356781 - RNA, 21 nt, Neisseria meningitidis Z2491
uguucauccacuauaacagca

SEQ ID NO: 3356782 - RNA, 17 nt, Neisseria meningitidis Z2491
uguuccaaaagccgccc

SEQ ID NO: 3356783 - RNA, 15 nt, Neisseria meningitidis Z2491
uguuccaauuccugu

SEQ ID NO: 3356784 - RNA, 22 nt, Neisseria meningitidis Z2491
uguuccgcaucgucgggaaaaa

SEQ ID NO: 3356785 - RNA, 19 nt, Neisseria meningitidis Z2491
uguucgauauuuuugaaga

SEQ ID NO: 3356786 - RNA, 14 nt, Neisseria meningitidis Z2491
uguucgccaacaau

SEQ ID NO: 3356787 - RNA, 22 nt, Neisseria meningitidis Z2491
uguucggguacaaccaaugcgg

SEQ ID NO: 3356788 - RNA, 23 nt, Neisseria meningitidis Z2491
uguucuucauguucgugcaucau

SEQ ID NO: 3356789 - RNA, 15 nt, Neisseria meningitidis Z2491
uguugaaaaugccgu

SEQ ID NO: 3356790 - RNA, 16 nt, Neisseria meningitidis Z2491
uguugaguucgggcgg

SEQ ID NO: 3356791 - RNA, 14 nt, Neisseria meningitidis Z2491
uguugcacaaacag

SEQ ID NO: 3356792 - RNA, 21 nt, Neisseria meningitidis Z2491
uguugcucccgauaaaugccg

SEQ ID NO: 3356793 - RNA, 22 nt, Neisseria meningitidis Z2491
uguugcucccgauaaaugccgc

SEQ ID NO: 3356794 - RNA, 14 nt, Neisseria meningitidis Z2491
uguugcuuuucauu

SEQ ID NO: 3356795 - RNA, 20 nt, Neisseria meningitidis Z2491
uguugcuuuucauuucuaga

SEQ ID NO: 3356796 - RNA, 12 nt, Neisseria meningitidis Z2491
uguuggaaaaac

SEQ ID NO: 3356797 - RNA, 21 nt, Neisseria meningitidis Z2491
uguugucgcuucggauaaauu

SEQ ID NO: 3356798 - RNA, 13 nt, Neisseria meningitidis Z2491
uguuguuuuaaag

SEQ ID NO: 3356799 - RNA, 17 nt, Neisseria meningitidis Z2491
uguuguuuuuugguuuc

SEQ ID NO: 3356800 - RNA, 15 nt, Neisseria meningitidis Z2491
uguuuaucuuuucuu

SEQ ID NO: 3356801 - RNA, 16 nt, Neisseria meningitidis Z2491
uguuuaucuuuucuua

SEQ ID NO: 3356802 - RNA, 14 nt, Neisseria meningitidis Z2491
uguuuauugagaau

SEQ ID NO: 3356803 - RNA, 14 nt, Neisseria meningitidis Z2491
uguuucaaaauguu

SEQ ID NO: 3356804 - RNA, 15 nt, Neisseria meningitidis Z2491
uuaucccauaaaaac

SEQ ID NO: 3356805 - RNA, 19 nt, Neisseria meningitidis Z2491
uuaucccauaaaaacggga

SEQ ID NO: 3356806 - RNA, 17 nt, Neisseria meningitidis Z2491
uuauccgauaaguuucc

SEQ ID NO: 3356807 - RNA, 23 nt, Neisseria meningitidis Z2491
uuauccgcacacgaacugccucc

SEQ ID NO: 3356808 - RNA, 17 nt, Neisseria meningitidis Z2491
uuaucgggaaaaacggu

SEQ ID NO: 3356809 - RNA, 15 nt, Neisseria meningitidis Z2491
uuaucgggaaaaaua

SEQ ID NO: 3356810 - RNA, 14 nt, Neisseria meningitidis Z2491
uuaucggguaaaac

SEQ ID NO: 3356811 - RNA, 19 nt, Neisseria meningitidis Z2491
uuaucuaaaggaaugguug

SEQ ID NO: 3356812 - RNA, 15 nt, Neisseria meningitidis Z2491
uuaucugacaggaaa

SEQ ID NO: 3356813 - RNA, 19 nt, Neisseria meningitidis Z2491
uuaucugacgcguuuuacc

SEQ ID NO: 3356814 - RNA, 15 nt, Neisseria meningitidis Z2491
uuaugaugcguucaa

SEQ ID NO: 3356815 - RNA, 10 nt, Neisseria meningitidis Z2491
uuaugccuuu

SEQ ID NO: 3356816 - RNA, 18 nt, Neisseria meningitidis Z2491
uuaugcucaaucucauuu

SEQ ID NO: 3356817 - RNA, 15 nt, Neisseria meningitidis Z2491
uuauggggauuuauu

SEQ ID NO: 3356818 - RNA, 12 nt, Neisseria meningitidis Z2491
uuauuauguaua

SEQ ID NO: 3356819 - RNA, 17 nt, Neisseria meningitidis Z2491
uuauucccccgaagaug

SEQ ID NO: 3356820 - RNA, 15 nt, Neisseria meningitidis Z2491
uuauugugcuaugca

SEQ ID NO: 3356821 - RNA, 16 nt, Neisseria meningitidis Z2491
uuauuuaaauaaaauu

SEQ ID NO: 3356822 - RNA, 16 nt, Neisseria meningitidis Z2491
uuauuuucaaaaugca

SEQ ID NO: 3356823 - RNA, 19 nt, Neisseria meningitidis Z2491
uuauuuuccauaaaauaca

SEQ ID NO: 3356824 - RNA, 11 nt, Neisseria meningitidis Z2491
uucaaaaaacc

SEQ ID NO: 3356825 - RNA, 12 nt, Neisseria meningitidis Z2491
uucaaaaaaccg

SEQ ID NO: 3356826 - RNA, 11 nt, Neisseria meningitidis Z2491
uucaaaaacag

SEQ ID NO: 3356827 - RNA, 17 nt, Neisseria meningitidis Z2491
uucaaaagguucaaaca

SEQ ID NO: 3356828 - RNA, 14 nt, Neisseria meningitidis Z2491
uucaaaaugcaaaa

SEQ ID NO: 3356829 - RNA, 15 nt, Neisseria meningitidis Z2491
uucaaaaugcaaaac

SEQ ID NO: 3356830 - RNA, 18 nt, Neisseria meningitidis Z2491
uucaaaaugcaaaacuuu

SEQ ID NO: 3356831 - RNA, 17 nt, Neisseria meningitidis Z2491
uucaaacacaucgccuu

SEQ ID NO: 3356832 - RNA, 16 nt, Neisseria meningitidis Z2491
uucaaaccccuucaaa

SEQ ID NO: 3356833 - RNA, 14 nt, Neisseria meningitidis Z2491
uucaaacgguuuuu

SEQ ID NO: 3356834 - RNA, 22 nt, Neisseria meningitidis Z2491
uucaaaguauguaccaagcggu

SEQ ID NO: 3356835 - RNA, 11 nt, Neisseria meningitidis Z2491
uucaaaugccg

SEQ ID NO: 3356836 - RNA, 20 nt, Neisseria meningitidis Z2491
uucaaaugccgucugaagcc

SEQ ID NO: 3356837 - RNA, 16 nt, Neisseria meningitidis Z2491
uucaacagacggcguu

SEQ ID NO: 3356838 - RNA, 22 nt, Neisseria meningitidis Z2491
uucaacgccgauuaauccgcuu

SEQ ID NO: 3356839 - RNA, 14 nt, Neisseria meningitidis Z2491
uucaacggcacggc

SEQ ID NO: 3356840 - RNA, 12 nt, Neisseria meningitidis Z2491
uucaagcagcaa

SEQ ID NO: 3356841 - RNA, 17 nt, Neisseria meningitidis Z2491
uucaagccuucccguuc

SEQ ID NO: 3356842 - RNA, 21 nt, Neisseria meningitidis Z2491
uucaagccuucccguuccaca

SEQ ID NO: 3356843 - RNA, 14 nt, Neisseria meningitidis Z2491
uucaauauacucaa

SEQ ID NO: 3356844 - RNA, 17 nt, Neisseria meningitidis Z2491
uucaauauacugcucgc

SEQ ID NO: 3356845 - RNA, 21 nt, Neisseria meningitidis Z2491
uucaauauacugcucgccaca

SEQ ID NO: 3356846 - RNA, 15 nt, Neisseria meningitidis Z2491
uucaauccucaacuu

SEQ ID NO: 3356847 - RNA, 22 nt, Neisseria meningitidis Z2491
uucaaugcuaaggcaauuuauc

SEQ ID NO: 3356848 - RNA, 13 nt, Neisseria meningitidis Z2491
uucaauucaaaau

SEQ ID NO: 3356849 - RNA, 16 nt, Neisseria meningitidis Z2491
uucacaaaaacagaaa

SEQ ID NO: 3356850 - RNA, 18 nt, Neisseria meningitidis Z2491
uucacaucuuuagacugc

SEQ ID NO: 3356851 - RNA, 23 nt, Neisseria meningitidis Z2491
uucacgggaaugacgaaaaguug

SEQ ID NO: 3356852 - RNA, 18 nt, Neisseria meningitidis Z2491
uucacuauauuuucccga

SEQ ID NO: 3356853 - RNA, 12 nt, Neisseria meningitidis Z2491
uucacuuccaac

SEQ ID NO: 3356854 - RNA, 18 nt, Neisseria meningitidis Z2491
uucacuuggugcuucagc

SEQ ID NO: 3356855 - RNA, 12 nt, Neisseria meningitidis Z2491
uucagacaggau

SEQ ID NO: 3356856 - RNA, 21 nt, Neisseria meningitidis Z2491
uucagacggcacuuucauuca

SEQ ID NO: 3356857 - RNA, 12 nt, Neisseria meningitidis Z2491
uucagacggcau

SEQ ID NO: 3356858 - RNA, 18 nt, Neisseria meningitidis Z2491
uucagacggcauccgcuu

SEQ ID NO: 3356859 - RNA, 13 nt, Neisseria meningitidis Z2491
uucagacggcauu

SEQ ID NO: 3356860 - RNA, 21 nt, Neisseria meningitidis Z2491
uucagacggcauuucgaggau

SEQ ID NO: 3356861 - RNA, 17 nt, Neisseria meningitidis Z2491
uucagacggcauuugac

SEQ ID NO: 3356862 - RNA, 17 nt, Neisseria meningitidis Z2491
uucagacggcauuuguc

SEQ ID NO: 3356863 - RNA, 16 nt, Neisseria meningitidis Z2491
uucagacggcauuuuc

SEQ ID NO: 3356864 - RNA, 17 nt, Neisseria meningitidis Z2491
uucagacggcauuuugc

SEQ ID NO: 3356865 - RNA, 22 nt, Neisseria meningitidis Z2491
uucagacggcauuuuguuuuua

SEQ ID NO: 3356866 - RNA, 17 nt, Neisseria meningitidis Z2491
uucagacggcauuuuug

SEQ ID NO: 3356867 - RNA, 21 nt, Neisseria meningitidis Z2491
uucagacggccuuuggaaugg

SEQ ID NO: 3356868 - RNA, 21 nt, Neisseria meningitidis Z2491
uucagacggccuuuuugcuuu

SEQ ID NO: 3356869 - RNA, 13 nt, Neisseria meningitidis Z2491
uucagagaaaugg

SEQ ID NO: 3356870 - RNA, 20 nt, Neisseria meningitidis Z2491
uucagagaaauggcaguauc

SEQ ID NO: 3356871 - RNA, 21 nt, Neisseria meningitidis Z2491
uucagagaaauggcaguauca

SEQ ID NO: 3356872 - RNA, 23 nt, Neisseria meningitidis Z2491
uucagauugugggcauuaucagu

SEQ ID NO: 3356873 - RNA, 24 nt, Neisseria meningitidis Z2491
uucagcgacacgaccgaccggcau

SEQ ID NO: 3356874 - RNA, 21 nt, Neisseria meningitidis Z2491
uucagcggcgggaaguuguug

SEQ ID NO: 3356875 - RNA, 21 nt, Neisseria meningitidis Z2491
uucagcuaaccuuugaauauu

SEQ ID NO: 3356876 - RNA, 22 nt, Neisseria meningitidis Z2491
uucagugcugcgcccaaagcgg

SEQ ID NO: 3356877 - RNA, 23 nt, Neisseria meningitidis Z2491
uucagugcugcgcccaaagcggu

SEQ ID NO: 3356878 - RNA, 18 nt, Neisseria meningitidis Z2491
uucaguuguuuuacugau

SEQ ID NO: 3356879 - RNA, 16 nt, Neisseria meningitidis Z2491
uucauaaguuucccga

SEQ ID NO: 3356880 - RNA, 22 nt, Neisseria meningitidis Z2491
uucauaaguuucccgaaauucc

SEQ ID NO: 3356881 - RNA, 19 nt, Neisseria meningitidis Z2491
uucauacacagccaaaaaa

SEQ ID NO: 3356882 - RNA, 18 nt, Neisseria meningitidis Z2491
uucauagcaaaauaaaau

SEQ ID NO: 3356883 - RNA, 16 nt, Neisseria meningitidis Z2491
uucaucauaugcauca

SEQ ID NO: 3356884 - RNA, 19 nt, Neisseria meningitidis Z2491
uucauccacuauaacagca

SEQ ID NO: 3356885 - RNA, 18 nt, Neisseria meningitidis Z2491
uucaucgcuugauuuucg

SEQ ID NO: 3356886 - RNA, 16 nt, Neisseria meningitidis Z2491
uucaugguguuuccua

SEQ ID NO: 3356887 - RNA, 18 nt, Neisseria meningitidis Z2491
uucaugguguuuccuaau

SEQ ID NO: 3356888 - RNA, 20 nt, Neisseria meningitidis Z2491
uucauguucgugcaucauca

SEQ ID NO: 3356889 - RNA, 17 nt, Neisseria meningitidis Z2491
uucauuauccgcccguu

SEQ ID NO: 3356890 - RNA, 18 nt, Neisseria meningitidis Z2491
uucauuucuagauuccca

SEQ ID NO: 3356891 - RNA, 14 nt, Neisseria meningitidis Z2491
uuccaaaagcguca

SEQ ID NO: 3356892 - RNA, 15 nt, Neisseria meningitidis Z2491
uuccaaagccuucag

SEQ ID NO: 3356893 - RNA, 18 nt, Neisseria meningitidis Z2491
uuccaacucgacauuuuc

SEQ ID NO: 3356894 - RNA, 20 nt, Neisseria meningitidis Z2491
uuccaagauggcgagcgauu

SEQ ID NO: 3356895 - RNA, 16 nt, Neisseria meningitidis Z2491
uuccaauacauuuuug

SEQ ID NO: 3356896 - RNA, 22 nt, Neisseria meningitidis Z2491
uuccaauucgcugaauuugaaa

SEQ ID NO: 3356897 - RNA, 20 nt, Neisseria meningitidis Z2491
uuccacaaaagauacacaca

SEQ ID NO: 3356898 - RNA, 15 nt, Neisseria meningitidis Z2491
uuccaccgcagcuuu

SEQ ID NO: 3356899 - RNA, 17 nt, Neisseria meningitidis Z2491
uuccacuaaaugcucac

SEQ ID NO: 3356900 - RNA, 21 nt, Neisseria meningitidis Z2491
uuccagcgcaccuccauaauc

SEQ ID NO: 3356901 - RNA, 22 nt, Neisseria meningitidis Z2491
uuccaguugcgggccuuuggcg

SEQ ID NO: 3356902 - RNA, 13 nt, Neisseria meningitidis Z2491
uuccaguuugaaa

SEQ ID NO: 3356903 - RNA, 14 nt, Neisseria meningitidis Z2491
uuccauaaaauaca

SEQ ID NO: 3356904 - RNA, 20 nt, Neisseria meningitidis Z2491
uuccauaccguuuggcggca

SEQ ID NO: 3356905 - RNA, 18 nt, Neisseria meningitidis Z2491
uucugacagcauuuccac

SEQ ID NO: 3356906 - RNA, 18 nt, Neisseria meningitidis Z2491
uucugauuuaaaaccaua

SEQ ID NO: 3356907 - RNA, 13 nt, Neisseria meningitidis Z2491
uucugcaaaaauc

SEQ ID NO: 3356908 - RNA, 13 nt, Neisseria meningitidis Z2491
uucugcaccgcuu

SEQ ID NO: 3356909 - RNA, 16 nt, Neisseria meningitidis Z2491
uucugccaaacggcga

SEQ ID NO: 3356910 - RNA, 15 nt, Neisseria meningitidis Z2491
uucuggauucccacu

SEQ ID NO: 3356911 - RNA, 16 nt, Neisseria meningitidis Z2491
uucuguucuaaaagca

SEQ ID NO: 3356912 - RNA, 15 nt, Neisseria meningitidis Z2491
uucuguuuggcuuuu

SEQ ID NO: 3356913 - RNA, 18 nt, Neisseria meningitidis Z2491
uucuguuuggcuuuuuuc

SEQ ID NO: 3356914 - RNA, 19 nt, Neisseria meningitidis Z2491
uucuguuuggcuuuuuucu

SEQ ID NO: 3356915 - RNA, 15 nt, Neisseria meningitidis Z2491
uucuguuuuugguuu

SEQ ID NO: 3356916 - RNA, 22 nt, Neisseria meningitidis Z2491
uucuguuuuugguuuucuguuu

SEQ ID NO: 3356917 - RNA, 19 nt, Neisseria meningitidis Z2491
uucuguuuuugugggaaug

SEQ ID NO: 3356918 - RNA, 13 nt, Neisseria meningitidis Z2491
uucuucuaaaaau

SEQ ID NO: 3356919 - RNA, 17 nt, Neisseria meningitidis Z2491
uucuucuuuccauccau

SEQ ID NO: 3356920 - RNA, 17 nt, Neisseria meningitidis Z2491
uucuucuuugcugacaa

SEQ ID NO: 3356921 - RNA, 21 nt, Neisseria meningitidis Z2491
uucuugaggcauugaaauucc

SEQ ID NO: 3356922 - RNA, 20 nt, Neisseria meningitidis Z2491
uucuugauggcgaaagcaau

SEQ ID NO: 3356923 - RNA, 14 nt, Neisseria meningitidis Z2491
uucuugauuuuucu

SEQ ID NO: 3356924 - RNA, 19 nt, Neisseria meningitidis Z2491
uucuugcaaaauagaaaac

SEQ ID NO: 3356925 - RNA, 16 nt, Neisseria meningitidis Z2491
uucuugucaaaccaac

SEQ ID NO: 3356926 - RNA, 13 nt, Neisseria meningitidis Z2491
uucuuuccaucca

SEQ ID NO: 3356927 - RNA, 21 nt, Neisseria meningitidis Z2491
uucuuugaaaacagguuuaag

SEQ ID NO: 3356928 - RNA, 18 nt, Neisseria meningitidis Z2491
uucuuugacggcgggcag

SEQ ID NO: 3356929 - RNA, 18 nt, Neisseria meningitidis Z2491
uugaaaaauaauccuuau

SEQ ID NO: 3356930 - RNA, 19 nt, Neisseria meningitidis Z2491
uugaaacggacaacggcac

SEQ ID NO: 3356931 - RNA, 16 nt, Neisseria meningitidis Z2491
uugaaagagaaaaggu

SEQ ID NO: 3356932 - RNA, 24 nt, Neisseria meningitidis Z2491
uugaaaucaacagauugucaaaau

SEQ ID NO: 3356933 - RNA, 12 nt, Neisseria meningitidis Z2491
uugaaaugccgu

SEQ ID NO: 3356934 - RNA, 15 nt, Neisseria meningitidis Z2491
uugaaauucuagauu

SEQ ID NO: 3356935 - RNA, 17 nt, Neisseria meningitidis Z2491
uugaaauucuagauucc

SEQ ID NO: 3356936 - RNA, 21 nt, Neisseria meningitidis Z2491
uugaaccagggauuuuucaaa

SEQ ID NO: 3356937 - RNA, 14 nt, Neisseria meningitidis Z2491
uugaaccauuucca

SEQ ID NO: 3356938 - RNA, 17 nt, Neisseria meningitidis Z2491
uugaauagcaugguuaa

SEQ ID NO: 3356939 - RNA, 22 nt, Neisseria meningitidis Z2491
uugaaugccuuucucuguuuuu

SEQ ID NO: 3356940 - RNA, 16 nt, Neisseria meningitidis Z2491
uugaauggaaaugccg

SEQ ID NO: 3356941 - RNA, 13 nt, Neisseria meningitidis Z2491
uugaauuuaauuu

SEQ ID NO: 3356942 - RNA, 16 nt, Neisseria meningitidis Z2491
uugaauuucauuuuuc

SEQ ID NO: 3356943 - RNA, 18 nt, Neisseria meningitidis Z2491
uugaauuucauuuuucau

SEQ ID NO: 3356944 - RNA, 13 nt, Neisseria meningitidis Z2491
uugaauuuuauug

SEQ ID NO: 3356945 - RNA, 19 nt, Neisseria meningitidis Z2491
uugacaaacauccauaucu

SEQ ID NO: 3356946 - RNA, 17 nt, Neisseria meningitidis Z2491
uugacaggcauuugcac

SEQ ID NO: 3356947 - RNA, 17 nt, Neisseria meningitidis Z2491
uugaccaaagcauuuuu

SEQ ID NO: 3356948 - RNA, 19 nt, Neisseria meningitidis Z2491
uugaccaaagcauuuuucg

SEQ ID NO: 3356949 - RNA, 13 nt, Neisseria meningitidis Z2491
uugacccauuacu

SEQ ID NO: 3356950 - RNA, 17 nt, Neisseria meningitidis Z2491
uugacguaguuuacugu

SEQ ID NO: 3356951 - RNA, 17 nt, Neisseria meningitidis Z2491
uugacguuacccucuug

SEQ ID NO: 3356952 - RNA, 14 nt, Neisseria meningitidis Z2491
uugacuauuuuuua

SEQ ID NO: 3356953 - RNA, 17 nt, Neisseria meningitidis Z2491
uugacuauuuuuuaauc

SEQ ID NO: 3356954 - RNA, 15 nt, Neisseria meningitidis Z2491
uugagaccuuugcaa

SEQ ID NO: 3356955 - RNA, 16 nt, Neisseria meningitidis Z2491
uugagauuuugaauca

SEQ ID NO: 3356956 - RNA, 14 nt, Neisseria meningitidis Z2491
uugagcaaaaagua

SEQ ID NO: 3356957 - RNA, 15 nt, Neisseria meningitidis Z2491
uugagcaaaaaguag

SEQ ID NO: 3356958 - RNA, 12 nt, Neisseria meningitidis Z2491
uugagccuucac

SEQ ID NO: 3356959 - RNA, 22 nt, Neisseria meningitidis Z2491
uugagcgcgucaaacagacgga

SEQ ID NO: 3356960 - RNA, 19 nt, Neisseria meningitidis Z2491
uugagcguucagacggcau

SEQ ID NO: 3356961 - RNA, 14 nt, Neisseria meningitidis Z2491
uugagcuaaggcga

SEQ ID NO: 3356962 - RNA, 13 nt, Neisseria meningitidis Z2491
uugagcuucgcga

SEQ ID NO: 3356963 - RNA, 22 nt, Neisseria meningitidis Z2491
uugagguagauggggaggcgcg

SEQ ID NO: 3356964 - RNA, 15 nt, Neisseria meningitidis Z2491
uugaggucuuugaug

SEQ ID NO: 3356965 - RNA, 19 nt, Neisseria meningitidis Z2491
uugaguuucagucauuccc

SEQ ID NO: 3356966 - RNA, 21 nt, Neisseria meningitidis Z2491
uugaguuuccgucauuucuga

SEQ ID NO: 3356967 - RNA, 18 nt, Neisseria meningitidis Z2491
uugauacugcuugaccaa

SEQ ID NO: 3356968 - RNA, 18 nt, Neisseria meningitidis Z2491
uugauauggcguugacaa

SEQ ID NO: 3356969 - RNA, 21 nt, Neisseria meningitidis Z2491
uugauauggcguugacaaaca

SEQ ID NO: 3356970 - RNA, 22 nt, Neisseria meningitidis Z2491
uugauauggcguugacaaacau

SEQ ID NO: 3356971 - RNA, 23 nt, Neisseria meningitidis Z2491
uugaucaccaucgagcugccuuu

SEQ ID NO: 3356972 - RNA, 19 nt, Neisseria meningitidis Z2491
uugaugaugucgaaggcgc

SEQ ID NO: 3356973 - RNA, 17 nt, Neisseria meningitidis Z2491
uugaugucgugcagaug

SEQ ID NO: 3356974 - RNA, 16 nt, Neisseria meningitidis Z2491
uugauuaaaacaaaaa

SEQ ID NO: 3356975 - RNA, 17 nt, Neisseria meningitidis Z2491
uugauuaaaacaaaaau

SEQ ID NO: 3356976 - RNA, 12 nt, Neisseria meningitidis Z2491
uugcaaaaccgg

SEQ ID NO: 3356977 - RNA, 13 nt, Neisseria meningitidis Z2491
uugcaaaauagaa

SEQ ID NO: 3356978 - RNA, 14 nt, Neisseria meningitidis Z2491
uugcaaaauagaaa

SEQ ID NO: 3356979 - RNA, 22 nt, Neisseria meningitidis Z2491
uugcaaaccccucaacacacca

SEQ ID NO: 3356980 - RNA, 22 nt, Neisseria meningitidis Z2491
uugcaaauaauugaaaucaaca

SEQ ID NO: 3356981 - RNA, 14 nt, Neisseria meningitidis Z2491
uugcaagaaugacg

SEQ ID NO: 3356982 - RNA, 18 nt, Neisseria meningitidis Z2491
uugcaagaauggcaaaau

SEQ ID NO: 3356983 - RNA, 20 nt, Neisseria meningitidis Z2491
uugcaagcaguugaaaucaa

SEQ ID NO: 3356984 - RNA, 15 nt, Neisseria meningitidis Z2491
uugcaaggcaggcag

SEQ ID NO: 3356985 - RNA, 17 nt, Neisseria meningitidis Z2491
uugcaauauucgugaaa

SEQ ID NO: 3356986 - RNA, 21 nt, Neisseria meningitidis Z2491
uugcaccgucuccagcgguuu

SEQ ID NO: 3356987 - RNA, 16 nt, Neisseria meningitidis Z2491
uugcacgguuuuccuc

SEQ ID NO: 3356988 - RNA, 14 nt, Neisseria meningitidis Z2491
uugcagauaaauuu

SEQ ID NO: 3356989 - RNA, 11 nt, Neisseria meningitidis Z2491
uugcaggaauc

SEQ ID NO: 3356990 - RNA, 16 nt, Neisseria meningitidis Z2491
uugcaggcguagucuu

SEQ ID NO: 3356991 - RNA, 22 nt, Neisseria meningitidis Z2491
uugcauaaucaauuaaaaacaa

SEQ ID NO: 3356992 - RNA, 18 nt, Neisseria meningitidis Z2491
uugcauuuugaaaaugag

SEQ ID NO: 3356993 - RNA, 12 nt, Neisseria meningitidis Z2491
uugccaaggcgg

SEQ ID NO: 3356994 - RNA, 20 nt, Neisseria meningitidis Z2491
uugccaccaauaccgccuug

SEQ ID NO: 3356995 - RNA, 17 nt, Neisseria meningitidis Z2491
uugccagcccccuucca

SEQ ID NO: 3356996 - RNA, 16 nt, Neisseria meningitidis Z2491
uugccagccugcccau

SEQ ID NO: 3356997 - RNA, 21 nt, Neisseria meningitidis Z2491
uugcccaacagcagcauaaca

SEQ ID NO: 3356998 - RNA, 13 nt, Neisseria meningitidis Z2491
uugcccauagaaa

SEQ ID NO: 3356999 - RNA, 20 nt, Neisseria meningitidis Z2491
uugccgaaagcgcggccuuu

SEQ ID NO: 3357000 - RNA, 10 nt, Neisseria meningitidis Z2491
uugccgaccc

SEQ ID NO: 3357001 - RNA, 13 nt, Neisseria meningitidis Z2491
uugccgcauaaau

SEQ ID NO: 3357002 - RNA, 24 nt, Neisseria meningitidis Z2491
uugccgcccgucccgaugccgcaa

SEQ ID NO: 3357003 - RNA, 21 nt, Neisseria meningitidis Z2491
uugccguauccauaccaaaca

SEQ ID NO: 3357004 - RNA, 15 nt, Neisseria meningitidis Z2491
uugccguugaugacg

SEQ ID NO: 3357005 - RNA, 17 nt, Neisseria meningitidis Z2491
uugccucuauuuaaaaa

SEQ ID NO: 3357006 - RNA, 14 nt, Neisseria meningitidis Z2491
uugccugauccaaa

SEQ ID NO: 3357007 - RNA, 14 nt, Neisseria meningitidis Z2491
uuucugauuuugag

SEQ ID NO: 3357008 - RNA, 14 nt, Neisseria meningitidis Z2491
uuucugauuuuucc

SEQ ID NO: 3357009 - RNA, 18 nt, Neisseria meningitidis Z2491
uuucugcaacccuagaau

SEQ ID NO: 3357010 - RNA, 15 nt, Neisseria meningitidis Z2491
uuucuggauucccac

SEQ ID NO: 3357011 - RNA, 16 nt, Neisseria meningitidis Z2491
uuucugucgccagcau

SEQ ID NO: 3357012 - RNA, 21 nt, Neisseria meningitidis Z2491
uuucuguuucgguuuucuauu

SEQ ID NO: 3357013 - RNA, 17 nt, Neisseria meningitidis Z2491
uuucuguuuggcuguuu

SEQ ID NO: 3357014 - RNA, 14 nt, Neisseria meningitidis Z2491
uuucuucaaaauac

SEQ ID NO: 3357015 - RNA, 15 nt, Neisseria meningitidis Z2491
uuucuucaguuguuu

SEQ ID NO: 3357016 - RNA, 16 nt, Neisseria meningitidis Z2491
uuucuucugaauaaac

SEQ ID NO: 3357017 - RNA, 11 nt, Neisseria meningitidis Z2491
uuucuucuucg

SEQ ID NO: 3357018 - RNA, 16 nt, Neisseria meningitidis Z2491
uuugaaaacagguuua

SEQ ID NO: 3357019 - RNA, 18 nt, Neisseria meningitidis Z2491
uuugaaacgguuguucaa

SEQ ID NO: 3357020 - RNA, 23 nt, Neisseria meningitidis Z2491
uuugaaacgguuguucaaaucga

SEQ ID NO: 3357021 - RNA, 19 nt, Neisseria meningitidis Z2491
uuugaaacucuaaucccgu

SEQ ID NO: 3357022 - RNA, 17 nt, Neisseria meningitidis Z2491
uuugaaagagaaaaggu

SEQ ID NO: 3357023 - RNA, 23 nt, Neisseria meningitidis Z2491
uuugaaccagggauuuuucaaau

SEQ ID NO: 3357024 - RNA, 23 nt, Neisseria meningitidis Z2491
uuugaacgcgcgggaauagcuca

SEQ ID NO: 3357025 - RNA, 16 nt, Neisseria meningitidis Z2491
uuugaauauuacuguu

SEQ ID NO: 3357026 - RNA, 20 nt, Neisseria meningitidis Z2491
uuugaauggaaaugccgucu

SEQ ID NO: 3357027 - RNA, 14 nt, Neisseria meningitidis Z2491
uuugacgcauaaaa

SEQ ID NO: 3357028 - RNA, 15 nt, Neisseria meningitidis Z2491
uuugacgcauaaaaa

SEQ ID NO: 3357029 - RNA, 14 nt, Neisseria meningitidis Z2491
uuugacuuucaggg

SEQ ID NO: 3357030 - RNA, 16 nt, Neisseria meningitidis Z2491
uuugagggaaugacgg

SEQ ID NO: 3357031 - RNA, 20 nt, Neisseria meningitidis Z2491
uuugaugaaacucaauauaa

SEQ ID NO: 3357032 - RNA, 17 nt, Neisseria meningitidis Z2491
uuugaugguuuuccaau

SEQ ID NO: 3357033 - RNA, 18 nt, Neisseria meningitidis Z2491
uuugaugguuuugccgcu

SEQ ID NO: 3357034 - RNA, 18 nt, Neisseria meningitidis Z2491
uuugauucaauauaaaca

SEQ ID NO: 3357035 - RNA, 12 nt, Neisseria meningitidis Z2491
uuugauuucuau

SEQ ID NO: 3357036 - RNA, 19 nt, Neisseria meningitidis Z2491
uuugcacacguuugccguu

SEQ ID NO: 3357037 - RNA, 18 nt, Neisseria meningitidis Z2491
uuugcagcccugauaaaa

SEQ ID NO: 3357038 - RNA, 22 nt, Neisseria meningitidis Z2491
uuugccgacccgaaucacaaac

SEQ ID NO: 3357039 - RNA, 18 nt, Neisseria meningitidis Z2491
uuugccgaguuuuuggua

SEQ ID NO: 3357040 - RNA, 22 nt, Neisseria meningitidis Z2491
uuugccgccugaugauuuuuuc

SEQ ID NO: 3357041 - RNA, 23 nt, Neisseria meningitidis Z2491
uuugccgcgauuccggcgcggcg

SEQ ID NO: 3357042 - RNA, 23 nt, Neisseria meningitidis Z2491
uuugccguguuggguucuagauu

SEQ ID NO: 3357043 - RNA, 16 nt, Neisseria meningitidis Z2491
uuugcgcagccugcag

SEQ ID NO: 3357044 - RNA, 22 nt, Neisseria meningitidis Z2491
uuugcuggaagcauugaccacu

SEQ ID NO: 3357045 - RNA, 20 nt, Neisseria meningitidis Z2491
uuuggaugccgucugaaacg

SEQ ID NO: 3357046 - RNA, 15 nt, Neisseria meningitidis Z2491
uuuggcaaaauccgg

SEQ ID NO: 3357047 - RNA, 16 nt, Neisseria meningitidis Z2491
uuuggcaaaauccggu

SEQ ID NO: 3357048 - RNA, 18 nt, Neisseria meningitidis Z2491
uuuggcgcauuuuuaugc

SEQ ID NO: 3357049 - RNA, 22 nt, Neisseria meningitidis Z2491
uuuggcgcauuuuuucugccau

SEQ ID NO: 3357050 - RNA, 14 nt, Neisseria meningitidis Z2491
uuuggcggcggcag

SEQ ID NO: 3357051 - RNA, 17 nt, Neisseria meningitidis Z2491
uuuggcuuuuuucuguu

SEQ ID NO: 3357052 - RNA, 15 nt, Neisseria meningitidis Z2491
uuugggauuucuguu

SEQ ID NO: 3357053 - RNA, 14 nt, Neisseria meningitidis Z2491
uuuggguuucuguu

SEQ ID NO: 3357054 - RNA, 20 nt, Neisseria meningitidis Z2491
uuugguaaaacgccaauuug

SEQ ID NO: 3357055 - RNA, 22 nt, Neisseria meningitidis Z2491
uuugguaaaacgccaauuugua

SEQ ID NO: 3357056 - RNA, 23 nt, Neisseria meningitidis Z2491
uuugguaaaacgccaauuuguau

SEQ ID NO: 3357057 - RNA, 20 nt, Neisseria meningitidis Z2491
uuugguaaugcaaaaagucc

SEQ ID NO: 3357058 - RNA, 16 nt, Neisseria meningitidis Z2491
uuugguauauuuuuuc

SEQ ID NO: 3357059 - RNA, 13 nt, Neisseria meningitidis Z2491
uuuggucaguguu

SEQ ID NO: 3357060 - RNA, 14 nt, Neisseria meningitidis Z2491
uuugguuuauuuuu

SEQ ID NO: 3357061 - RNA, 22 nt, Neisseria meningitidis Z2491
uuugguuuccagauucccaccu

SEQ ID NO: 3357062 - RNA, 14 nt, Neisseria meningitidis Z2491
uuugguuuucuauu

SEQ ID NO: 3357063 - RNA, 19 nt, Neisseria meningitidis Z2491
uuuguaagaguucguccca

SEQ ID NO: 3357064 - RNA, 17 nt, Neisseria meningitidis Z2491
uuuguacugucugcagc

SEQ ID NO: 3357065 - RNA, 19 nt, Neisseria meningitidis Z2491
uuuguagggcgugccgaug

SEQ ID NO: 3357066 - RNA, 17 nt, Neisseria meningitidis Z2491
uuuguauuugaucaccg

SEQ ID NO: 3357067 - RNA, 20 nt, Neisseria meningitidis Z2491
uuuguccauucggcuuaaac

SEQ ID NO: 3357068 - RNA, 15 nt, Neisseria meningitidis Z2491
uuugucgguaaaaau

SEQ ID NO: 3357069 - RNA, 20 nt, Neisseria meningitidis Z2491
uuugucgguaaaaauggaaa

SEQ ID NO: 3357070 - RNA, 23 nt, Neisseria meningitidis Z2491
uuugugaucgcgcugaaugucga

SEQ ID NO: 3357071 - RNA, 22 nt, Neisseria meningitidis Z2491
uuuguuaauccacuauaaaaaa

SEQ ID NO: 3357072 - RNA, 23 nt, Neisseria meningitidis Z2491
uuuguuaauccacuauacauccc

SEQ ID NO: 3357073 - RNA, 18 nt, Neisseria meningitidis Z2491
uuuguuaauccgcuauau

SEQ ID NO: 3357074 - RNA, 14 nt, Neisseria meningitidis Z2491
uuuguuuacaugga

SEQ ID NO: 3357075 - RNA, 19 nt, Neisseria meningitidis Z2491
uuuguuugccaucaggacu

SEQ ID NO: 3357076 - RNA, 15 nt, Neisseria meningitidis Z2491
uuuguuuuauuuccc

SEQ ID NO: 3357077 - RNA, 15 nt, Neisseria meningitidis Z2491
uuuuaauuucuucua

SEQ ID NO: 3357078 - RNA, 22 nt, Neisseria meningitidis Z2491
uuuuacaaucagaauacugccu

SEQ ID NO: 3357079 - RNA, 19 nt, Neisseria meningitidis Z2491
uuuuacccucuccccgacc

SEQ ID NO: 3357080 - RNA, 13 nt, Neisseria meningitidis Z2491
uuuuagaacagaa

SEQ ID NO: 3357081 - RNA, 16 nt, Neisseria meningitidis Z2491
uuuuagccuuuuguuu

SEQ ID NO: 3357082 - RNA, 22 nt, Neisseria meningitidis Z2491
uuuuaggcaauugaaaaauuuu

SEQ ID NO: 3357083 - RNA, 21 nt, Neisseria meningitidis Z2491
uuuuaggcaauugaaaauuuu

SEQ ID NO: 3357084 - RNA, 11 nt, Neisseria meningitidis Z2491
uuuuagguuuc

SEQ ID NO: 3357085 - RNA, 16 nt, Neisseria meningitidis Z2491
uuuuagguuucugauu

SEQ ID NO: 3357086 - RNA, 21 nt, Neisseria meningitidis Z2491
uuuuauaguggauuaacaaaa

SEQ ID NO: 3357087 - RNA, 22 nt, Neisseria meningitidis Z2491
uuuuaucagggcugcaaaauuu

SEQ ID NO: 3357088 - RNA, 20 nt, Neisseria meningitidis Z2491
uuuuauccucggcagacaaa

SEQ ID NO: 3357089 - RNA, 14 nt, Neisseria meningitidis Z2491
uuuuaugcgucaaa

SEQ ID NO: 3357090 - RNA, 19 nt, Neisseria meningitidis Z2491
uuuuaugcgucaaauuucg

SEQ ID NO: 3357091 - RNA, 13 nt, Neisseria meningitidis Z2491
uuuuauuuacguu

SEQ ID NO: 3357092 - RNA, 12 nt, Neisseria meningitidis Z2491
uuuuauuuuuug

SEQ ID NO: 3357093 - RNA, 17 nt, Neisseria meningitidis Z2491
uuuucaaaaugcaaaac

SEQ ID NO: 3357094 - RNA, 20 nt, Neisseria meningitidis Z2491
uuuucaaaaugcaaaacuuu

SEQ ID NO: 3357095 - RNA, 15 nt, Neisseria meningitidis Z2491
uuuucaagccuuccc

SEQ ID NO: 3357096 - RNA, 12 nt, Neisseria meningitidis Z2491
uuuucacaaaaa

SEQ ID NO: 3357097 - RNA, 14 nt, Neisseria meningitidis Z2491
uuuucacaaaaaca

SEQ ID NO: 3357098 - RNA, 19 nt, Neisseria meningitidis Z2491
uuuucacaaaaacagaaaa

SEQ ID NO: 3357099 - RNA, 12 nt, Neisseria meningitidis Z2491
uuuucacgggga

SEQ ID NO: 3357100 - RNA, 13 nt, Neisseria meningitidis Z2491
uuuucacggggaa

SEQ ID NO: 3357101 - RNA, 13 nt, Neisseria meningitidis Z2491
uuuucauccacca

SEQ ID NO: 3357102 - RNA, 17 nt, Neisseria meningitidis Z2491
uuuuccacaaaagauac

SEQ ID NO: 3357103 - RNA, 18 nt, Neisseria meningitidis Z2491
uuuuccacaaaagauaca

SEQ ID NO: 3357104 - RNA, 13 nt, Neisseria meningitidis Z2491
uuuuccaguuuga

SEQ ID NO: 3357105 - RNA, 18 nt, Neisseria meningitidis Z2491
uuuuccccgugaaaaaau

SEQ ID NO: 3357106 - RNA, 17 nt, Neisseria meningitidis Z2491
uuuucccugacaaacag

SEQ ID NO: 3357107 - RNA, 15 nt, Neisseria meningitidis Z2491
uuuuccgauaaauuc

SEQ ID NO: 3357108 - RNA, 13 nt, Neisseria meningitidis Z2491
aaaaaaaccgaaa

SEQ ID NO: 3357109 - RNA, 11 nt, Neisseria meningitidis Z2491
aaaaaacaaac

SEQ ID NO: 3357110 - RNA, 12 nt, Neisseria meningitidis Z2491
aaaaaacaaaca

SEQ ID NO: 3357111 - RNA, 16 nt, Neisseria meningitidis Z2491
aaaaaaccaaaacaga

SEQ ID NO: 3357112 - RNA, 19 nt, Neisseria meningitidis Z2491
aaaaaaccgaaguuuaaag

SEQ ID NO: 3357113 - RNA, 19 nt, Neisseria meningitidis Z2491
aaaaaagccagcagcagcc

SEQ ID NO: 3357114 - RNA, 16 nt, Neisseria meningitidis Z2491
aaaaaauaaaguaauu

SEQ ID NO: 3357115 - RNA, 16 nt, Neisseria meningitidis Z2491
aaaaaauauaccaaaa

SEQ ID NO: 3357116 - RNA, 11 nt, Neisseria meningitidis Z2491
aaaaacaaaaa

SEQ ID NO: 3357117 - RNA, 12 nt, Neisseria meningitidis Z2491
aaaaacaaaaaa

SEQ ID NO: 3357118 - RNA, 20 nt, Neisseria meningitidis Z2491
aaaaacaacaaugcaaagaa

SEQ ID NO: 3357119 - RNA, 13 nt, Neisseria meningitidis Z2491
aaaaacaacugaa

SEQ ID NO: 3357120 - RNA, 20 nt, Neisseria meningitidis Z2491
aaaaacaacugaaaccgaac

SEQ ID NO: 3357121 - RNA, 14 nt, Neisseria meningitidis Z2491
aaaaacaacugauu

SEQ ID NO: 3357122 - RNA, 15 nt, Neisseria meningitidis Z2491
aaaaacaagaaacgc

SEQ ID NO: 3357123 - RNA, 13 nt, Neisseria meningitidis Z2491
aaaaacagaaaac

SEQ ID NO: 3357124 - RNA, 14 nt, Neisseria meningitidis Z2491
aaaaacagaaaacc

SEQ ID NO: 3357125 - RNA, 18 nt, Neisseria meningitidis Z2491
aaaaacagaaaaccaaaa

SEQ ID NO: 3357126 - RNA, 13 nt, Neisseria meningitidis Z2491
aaaaacagaaacc

SEQ ID NO: 3357127 - RNA, 23 nt, Neisseria meningitidis Z2491
aaaaacagaaaccuaaaauucgu

SEQ ID NO: 3357128 - RNA, 18 nt, Neisseria meningitidis Z2491
aaaaacagcaaucaaaau

SEQ ID NO: 3357129 - RNA, 21 nt, Neisseria meningitidis Z2491
aaaaacagcguuuucauuucu

SEQ ID NO: 3357130 - RNA, 17 nt, Neisseria meningitidis Z2491
aaaaacaucagccaaac

SEQ ID NO: 3357131 - RNA, 17 nt, Neisseria meningitidis Z2491
aaaaaccgaaguuuaaa

SEQ ID NO: 3357132 - RNA, 22 nt, Neisseria meningitidis Z2491
aaaaaccggauuuauuuuagaa

SEQ ID NO: 3357133 - RNA, 22 nt, Neisseria meningitidis Z2491
aaaaaccggccggaaaaccuug

SEQ ID NO: 3357134 - RNA, 14 nt, Neisseria meningitidis Z2491
aaaaaccuaaaauc

SEQ ID NO: 3357135 - RNA, 15 nt, Neisseria meningitidis Z2491
aaaaacgccguccga

SEQ ID NO: 3357136 - RNA, 15 nt, Neisseria meningitidis Z2491
aaaaacuggauuccc

SEQ ID NO: 3357137 - RNA, 17 nt, Neisseria meningitidis Z2491
aaaaacuuuucugauuu

SEQ ID NO: 3357138 - RNA, 14 nt, Neisseria meningitidis Z2491
aaaaagccguccga

SEQ ID NO: 3357139 - RNA, 20 nt, Neisseria meningitidis Z2491
aaaaaguaggagaaaucaga

SEQ ID NO: 3357140 - RNA, 21 nt, Neisseria meningitidis Z2491
aaaaaguaggagaaaucagaa

SEQ ID NO: 3357141 - RNA, 14 nt, Neisseria meningitidis Z2491
aaaaaguccagcau

SEQ ID NO: 3357142 - RNA, 16 nt, Neisseria meningitidis Z2491
aaaaauaauugucuuu

SEQ ID NO: 3357143 - RNA, 15 nt, Neisseria meningitidis Z2491
aaaaauaccgucuga

SEQ ID NO: 3357144 - RNA, 15 nt, Neisseria meningitidis Z2491
aaaaaugccgucuga

SEQ ID NO: 3357145 - RNA, 17 nt, Neisseria meningitidis Z2491
aaaaaugccgucugaaa

SEQ ID NO: 3357146 - RNA, 18 nt, Neisseria meningitidis Z2491
aaaaaugcgccaaaaaau

SEQ ID NO: 3357147 - RNA, 19 nt, Neisseria meningitidis Z2491
aaaaaugcgccaaaaaauu

SEQ ID NO: 3357148 - RNA, 20 nt, Neisseria meningitidis Z2491
aaaaaugcgccaaaaaauuu

SEQ ID NO: 3357149 - RNA, 21 nt, Neisseria meningitidis Z2491
aaaaauuaaauuuuauuuaaa

SEQ ID NO: 3357150 - RNA, 15 nt, Neisseria meningitidis Z2491
aaaaauucuucuuuc

SEQ ID NO: 3357151 - RNA, 16 nt, Neisseria meningitidis Z2491
aaaaauuuauuuagaa

SEQ ID NO: 3357152 - RNA, 24 nt, Neisseria meningitidis Z2491
aaaaauuuauuuagaaacaacuga

SEQ ID NO: 3357153 - RNA, 18 nt, Neisseria meningitidis Z2491
aaaaauuucauuuuccca

SEQ ID NO: 3357154 - RNA, 12 nt, Neisseria meningitidis Z2491
aaaaauuuuugg

SEQ ID NO: 3357155 - RNA, 14 nt, Neisseria meningitidis Z2491
aaaacaaaaaaaau

SEQ ID NO: 3357156 - RNA, 20 nt, Neisseria meningitidis Z2491
aaaacaaaaaaaaucaaaaa

SEQ ID NO: 3357157 - RNA, 18 nt, Neisseria meningitidis Z2491
aaaacaaaaaaucaaaaa

SEQ ID NO: 3357158 - RNA, 22 nt, Neisseria meningitidis Z2491
aaaacaaaauaguacaauauuc

SEQ ID NO: 3357159 - RNA, 17 nt, Neisseria meningitidis Z2491
aaaacaacaggaauuua

SEQ ID NO: 3357160 - RNA, 19 nt, Neisseria meningitidis Z2491
aaaacaacaggaauuuauc

SEQ ID NO: 3357161 - RNA, 19 nt, Neisseria meningitidis Z2491
aaaacacagccaaaauauu

SEQ ID NO: 3357162 - RNA, 18 nt, Neisseria meningitidis Z2491
aaaacacgucaaccgucg

SEQ ID NO: 3357163 - RNA, 11 nt, Neisseria meningitidis Z2491
aaaacagaaaa

SEQ ID NO: 3357164 - RNA, 16 nt, Neisseria meningitidis Z2491
aaaacagaaaaccaaa

SEQ ID NO: 3357165 - RNA, 17 nt, Neisseria meningitidis Z2491
aaaacagaaaaccaaaa

SEQ ID NO: 3357166 - RNA, 18 nt, Neisseria meningitidis Z2491
aaaacagaaaaccaaaaa

SEQ ID NO: 3357167 - RNA, 22 nt, Neisseria meningitidis Z2491
aaaacagaaaaucaaaaacaga

SEQ ID NO: 3357168 - RNA, 14 nt, Neisseria meningitidis Z2491
aaaacagaaaccua

SEQ ID NO: 3357169 - RNA, 11 nt, Neisseria meningitidis Z2491
aaaacagaaag

SEQ ID NO: 3357170 - RNA, 17 nt, Neisseria meningitidis Z2491
aaaacagaaagccaaaa

SEQ ID NO: 3357171 - RNA, 22 nt, Neisseria meningitidis Z2491
aaaacagaaagccaaaaacaga

SEQ ID NO: 3357172 - RNA, 22 nt, Neisseria meningitidis Z2491
aaaacagaaauucaaaaacaga

SEQ ID NO: 3357173 - RNA, 13 nt, Neisseria meningitidis Z2491
aaaacagcugaaa

SEQ ID NO: 3357174 - RNA, 20 nt, Neisseria meningitidis Z2491
aaaacaguccacauuuggaa

SEQ ID NO: 3357175 - RNA, 18 nt, Neisseria meningitidis Z2491
aaaaccaaaaacagcaac

SEQ ID NO: 3357176 - RNA, 13 nt, Neisseria meningitidis Z2491
aaaaccaguacag

SEQ ID NO: 3357177 - RNA, 17 nt, Neisseria meningitidis Z2491
aaaaccucgggaauaaa

SEQ ID NO: 3357178 - RNA, 18 nt, Neisseria meningitidis Z2491
aaaaccugcaucccguca

SEQ ID NO: 3357179 - RNA, 18 nt, Neisseria meningitidis Z2491
aaaacgccgcuguuacgc

SEQ ID NO: 3357180 - RNA, 13 nt, Neisseria meningitidis Z2491
aaaacgccgucug

SEQ ID NO: 3357181 - RNA, 16 nt, Neisseria meningitidis Z2491
aaaacgccgucugaaa

SEQ ID NO: 3357182 - RNA, 17 nt, Neisseria meningitidis Z2491
aaaacgccgucugaaau

SEQ ID NO: 3357183 - RNA, 16 nt, Neisseria meningitidis Z2491
aaaacgccuucuucgc

SEQ ID NO: 3357184 - RNA, 22 nt, Neisseria meningitidis Z2491
aaaacggcaguuuccaauacaa

SEQ ID NO: 3357185 - RNA, 13 nt, Neisseria meningitidis Z2491
aaaacgguuuuuc

SEQ ID NO: 3357186 - RNA, 19 nt, Neisseria meningitidis Z2491
aaaacucuccugaucuaaa

SEQ ID NO: 3357187 - RNA, 11 nt, Neisseria meningitidis Z2491
aaaacuuaaaa

SEQ ID NO: 3357188 - RNA, 14 nt, Neisseria meningitidis Z2491
aaaacuuuucugau

SEQ ID NO: 3357189 - RNA, 17 nt, Neisseria meningitidis Z2491
aaaacuuuucugauuuu

SEQ ID NO: 3357190 - RNA, 13 nt, Neisseria meningitidis Z2491
aaaagauacacac

SEQ ID NO: 3357191 - RNA, 16 nt, Neisseria meningitidis Z2491
aaaagaugccgucuga

SEQ ID NO: 3357192 - RNA, 21 nt, Neisseria meningitidis Z2491
aaaagcaagacguagcguggg

SEQ ID NO: 3357193 - RNA, 14 nt, Neisseria meningitidis Z2491
aaaagcaucuuguu

SEQ ID NO: 3357194 - RNA, 14 nt, Neisseria meningitidis Z2491
aaaagccagcagca

SEQ ID NO: 3357195 - RNA, 18 nt, Neisseria meningitidis Z2491
aaaaggaaauacgauaaa

SEQ ID NO: 3357196 - RNA, 21 nt, Neisseria meningitidis Z2491
aaaaggacguagucggugcuu

SEQ ID NO: 3357197 - RNA, 15 nt, Neisseria meningitidis Z2491
aaaaguaccgcagcc

SEQ ID NO: 3357198 - RNA, 14 nt, Neisseria meningitidis Z2491
aaaauaaaguaauu

SEQ ID NO: 3357199 - RNA, 20 nt, Neisseria meningitidis Z2491
aaaauaauggccuuuucccu

SEQ ID NO: 3357200 - RNA, 20 nt, Neisseria meningitidis Z2491
aaaauaauugccuuuucccu

SEQ ID NO: 3357201 - RNA, 20 nt, Neisseria meningitidis Z2491
aaaauaauugucuuuucccu

SEQ ID NO: 3357202 - RNA, 12 nt, Neisseria meningitidis Z2491
aaaauaccguug

SEQ ID NO: 3357203 - RNA, 13 nt, Neisseria meningitidis Z2491
aaaauagaaaacc

SEQ ID NO: 3357204 - RNA, 17 nt, Neisseria meningitidis Z2491
aaaauagaaaaucaaaa

SEQ ID NO: 3357205 - RNA, 18 nt, Neisseria meningitidis Z2491
aaaauagaaaaucaaaaa

SEQ ID NO: 3357206 - RNA, 13 nt, Neisseria meningitidis Z2491
aaaauagaaauac

SEQ ID NO: 3357207 - RNA, 20 nt, Neisseria meningitidis Z2491
aaaauagaaauacuuaacaa

SEQ ID NO: 3357208 - RNA, 13 nt, Neisseria meningitidis Z2491
aaaauaguacaau

SEQ ID NO: 3357209 - RNA, 22 nt, Neisseria meningitidis Z2491
aaaauauaguggauuaacaaaa

SEQ ID NO: 3357210 - RNA, 21 nt, Neisseria meningitidis Z2491
aaaauauucaauugacaaaaa

SEQ ID NO: 3357211 - RNA, 11 nt, Neisseria meningitidis Z2491
aaaaucaaaaa

SEQ ID NO: 3357212 - RNA, 14 nt, Neisseria meningitidis Z2491
aaaaucaaaaacac

SEQ ID NO: 3357213 - RNA, 22 nt, Neisseria meningitidis Z2491
aaaaucacggugaaaaaugaaa

SEQ ID NO: 3357214 - RNA, 14 nt, Neisseria meningitidis Z2491
aaaaucagaaaccu

SEQ ID NO: 3357215 - RNA, 18 nt, Neisseria meningitidis Z2491
aaaaucagaaaccuaaaa

SEQ ID NO: 3357216 - RNA, 13 nt, Neisseria meningitidis Z2491
aaaaucagcacaa

SEQ ID NO: 3357217 - RNA, 22 nt, Neisseria meningitidis Z2491
aaaaucaggggauuauuuauuu

SEQ ID NO: 3357218 - RNA, 13 nt, Neisseria meningitidis Z2491
aaaaucaguauag

SEQ ID NO: 3357219 - RNA, 16 nt, Neisseria meningitidis Z2491
aaaauccaaaaauacg

SEQ ID NO: 3357220 - RNA, 20 nt, Neisseria meningitidis Z2491
aaaauccaacgcugcaaaaa

SEQ ID NO: 3357221 - RNA, 14 nt, Neisseria meningitidis Z2491
aaaauccgucauuc

SEQ ID NO: 3357222 - RNA, 22 nt, Neisseria meningitidis Z2491
aaaauccugcuuauugcacuaa

SEQ ID NO: 3357223 - RNA, 15 nt, Neisseria meningitidis Z2491
aaaaucuauagugga

SEQ ID NO: 3357224 - RNA, 23 nt, Neisseria meningitidis Z2491
aaaaucuauaguggauuaacaaa

SEQ ID NO: 3357225 - RNA, 16 nt, Neisseria meningitidis Z2491
aaaaucucaagaaacc

SEQ ID NO: 3357226 - RNA, 19 nt, Neisseria meningitidis Z2491
aaaaucucgucauucucgc

SEQ ID NO: 3357227 - RNA, 21 nt, Neisseria meningitidis Z2491
aaaaugacugaagcucaaaaa

SEQ ID NO: 3357228 - RNA, 14 nt, Neisseria meningitidis Z2491
aaaaugcaaaacuu

SEQ ID NO: 3357229 - RNA, 23 nt, Neisseria meningitidis Z2491
aaaaugcaaaacuuuucugauuu

SEQ ID NO: 3357230 - RNA, 16 nt, Neisseria meningitidis Z2491
aaaaugccgccugaac

SEQ ID NO: 3357231 - RNA, 12 nt, Neisseria meningitidis Z2491
aaaaugccgucc

SEQ ID NO: 3357232 - RNA, 20 nt, Neisseria meningitidis Z2491
aaaaugccguccgaaagguu

SEQ ID NO: 3357233 - RNA, 13 nt, Neisseria meningitidis Z2491
aaaaugccgucug

SEQ ID NO: 3357234 - RNA, 15 nt, Neisseria meningitidis Z2491
aaaaugccgucugaa

SEQ ID NO: 3357235 - RNA, 16 nt, Neisseria meningitidis Z2491
aaaaugccgucugaaa

SEQ ID NO: 3357236 - RNA, 21 nt, Neisseria meningitidis Z2491
aaaaugccgucugaaaaaccu

SEQ ID NO: 3357237 - RNA, 18 nt, Neisseria meningitidis Z2491
aaaaugccgucugaaaag

SEQ ID NO: 3357238 - RNA, 22 nt, Neisseria meningitidis Z2491
aaaaugccgucugaaaagauau

SEQ ID NO: 3357239 - RNA, 18 nt, Neisseria meningitidis Z2491
aaaaugccgucuggaacu

SEQ ID NO: 3357240 - RNA, 21 nt, Neisseria meningitidis Z2491
aaaaugguaucgggcauaaaa

SEQ ID NO: 3357241 - RNA, 15 nt, Neisseria meningitidis Z2491
aaaaugugcauuucu

SEQ ID NO: 3357242 - RNA, 13 nt, Neisseria meningitidis Z2491
aaaauuccguuau

SEQ ID NO: 3357243 - RNA, 14 nt, Neisseria meningitidis Z2491
aaaauucuucuuuc

SEQ ID NO: 3357244 - RNA, 12 nt, Neisseria meningitidis Z2491
aaaauuuaaaag

SEQ ID NO: 3357245 - RNA, 16 nt, Neisseria meningitidis Z2491
aaaauuuaauuuuugg

SEQ ID NO: 3357246 - RNA, 19 nt, Neisseria meningitidis Z2491
aaaauuuauccgaaacaac

SEQ ID NO: 3357247 - RNA, 17 nt, Neisseria meningitidis Z2491
aaaauuuaugaaauaca

SEQ ID NO: 3357248 - RNA, 16 nt, Neisseria meningitidis Z2491
aaaauuuauuuagaaa

SEQ ID NO: 3357249 - RNA, 21 nt, Neisseria meningitidis Z2491
aaaauuucaucauuccuacaa

SEQ ID NO: 3357250 - RNA, 15 nt, Neisseria meningitidis Z2491
aaaauuucuugauuu

SEQ ID NO: 3357251 - RNA, 22 nt, Neisseria meningitidis Z2491
aaaauuucuugauuuuucugaa

SEQ ID NO: 3357252 - RNA, 21 nt, Neisseria meningitidis Z2491
aaacaaaaaaaaucaaaaaca

SEQ ID NO: 3357253 - RNA, 12 nt, Neisseria meningitidis Z2491
aaacaaaaaaca

SEQ ID NO: 3357254 - RNA, 19 nt, Neisseria meningitidis Z2491
aaacaaaaaaucaaaaaca

SEQ ID NO: 3357255 - RNA, 10 nt, Neisseria meningitidis Z2491
aaacaaaaau

SEQ ID NO: 3357256 - RNA, 19 nt, Neisseria meningitidis Z2491
aaacaaaaaugccgucuga

SEQ ID NO: 3357257 - RNA, 12 nt, Neisseria meningitidis Z2491
aaacaaaauaaa

SEQ ID NO: 3357258 - RNA, 23 nt, Neisseria meningitidis Z2491
aaacaaagccggcggcaacaaug

SEQ ID NO: 3357259 - RNA, 22 nt, Neisseria meningitidis Z2491
aaacaaagcuuuaaacuauagu

SEQ ID NO: 3357260 - RNA, 19 nt, Neisseria meningitidis Z2491
aaacaaauacccaaaugca

SEQ ID NO: 3357261 - RNA, 13 nt, Neisseria meningitidis Z2491
aaacaacaaaacc

SEQ ID NO: 3357262 - RNA, 17 nt, Neisseria meningitidis Z2491
aaacaacaaauuuuuga

SEQ ID NO: 3357263 - RNA, 15 nt, Neisseria meningitidis Z2491
aaacaacaaugcaaa

SEQ ID NO: 3357264 - RNA, 16 nt, Neisseria meningitidis Z2491
aaacaacugauucaac

SEQ ID NO: 3357265 - RNA, 18 nt, Neisseria meningitidis Z2491
aaacaacugcaauuauaa

SEQ ID NO: 3357266 - RNA, 19 nt, Neisseria meningitidis Z2491
aaacaagcgauuauuuuuu

SEQ ID NO: 3357267 - RNA, 16 nt, Neisseria meningitidis Z2491
aaacaaugccgucuga

SEQ ID NO: 3357268 - RNA, 13 nt, Neisseria meningitidis Z2491
aaacacaaaacug

SEQ ID NO: 3357269 - RNA, 16 nt, Neisseria meningitidis Z2491
aaacacaaaacugaaa

SEQ ID NO: 3357270 - RNA, 19 nt, Neisseria meningitidis Z2491
aaacaccggcuguguuuau

SEQ ID NO: 3357271 - RNA, 16 nt, Neisseria meningitidis Z2491
aaacacgggguuuauc

SEQ ID NO: 3357272 - RNA, 14 nt, Neisseria meningitidis Z2491
aaacacuguucaga

SEQ ID NO: 3357273 - RNA, 18 nt, Neisseria meningitidis Z2491
aaacagaaaaccaaaaac

SEQ ID NO: 3357274 - RNA, 15 nt, Neisseria meningitidis Z2491
aaacagauaaaacca

SEQ ID NO: 3357275 - RNA, 14 nt, Neisseria meningitidis Z2491
aaacagcaaccuuu

SEQ ID NO: 3357276 - RNA, 14 nt, Neisseria meningitidis Z2491
aaacagcaauccau

SEQ ID NO: 3357277 - RNA, 22 nt, Neisseria meningitidis Z2491
aaacagcaauccauucccucuc

SEQ ID NO: 3357278 - RNA, 14 nt, Neisseria meningitidis Z2491
aaacagcaaucuga

SEQ ID NO: 3357279 - RNA, 21 nt, Neisseria meningitidis Z2491
aaacagcacgauacacaaaaa

SEQ ID NO: 3357280 - RNA, 22 nt, Neisseria meningitidis Z2491
aaacagcacgauacacaaaaaa

SEQ ID NO: 3357281 - RNA, 14 nt, Neisseria meningitidis Z2491
aaacagcacugccu

SEQ ID NO: 3357282 - RNA, 16 nt, Neisseria meningitidis Z2491
aaacagcacugccucu

SEQ ID NO: 3357283 - RNA, 19 nt, Neisseria meningitidis Z2491
aaacagcauauagccgagc

SEQ ID NO: 3357284 - RNA, 12 nt, Neisseria meningitidis Z2491
aaacagccaggc

SEQ ID NO: 3357285 - RNA, 18 nt, Neisseria meningitidis Z2491
aaacagccgaaaacagcu

SEQ ID NO: 3357286 - RNA, 20 nt, Neisseria meningitidis Z2491
aaacaggcagccuaaaacau

SEQ ID NO: 3357287 - RNA, 20 nt, Neisseria meningitidis Z2491
aaacaggcuucagacggcau

SEQ ID NO: 3357288 - RNA, 21 nt, Neisseria meningitidis Z2491
aaacagguugaagucgaugcg

SEQ ID NO: 3357289 - RNA, 15 nt, Neisseria meningitidis Z2491
aaacagguuuaaguc

SEQ ID NO: 3357290 - RNA, 22 nt, Neisseria meningitidis Z2491
aaacagguuuaagucaauguuu

SEQ ID NO: 3357291 - RNA, 17 nt, Neisseria meningitidis Z2491
aaacagguuucagacgg

SEQ ID NO: 3357292 - RNA, 22 nt, Neisseria meningitidis Z2491
aaacagguuucagacggcauuu

SEQ ID NO: 3357293 - RNA, 14 nt, Neisseria meningitidis Z2491
aaacaguuucagca

SEQ ID NO: 3357294 - RNA, 22 nt, Neisseria meningitidis Z2491
aaacauaaaaugccgucugaaa

SEQ ID NO: 3357295 - RNA, 18 nt, Neisseria meningitidis Z2491
aaacaucgcucaaauucu

SEQ ID NO: 3357296 - RNA, 21 nt, Neisseria meningitidis Z2491
aaacaucgcucaaauucuguu

SEQ ID NO: 3357297 - RNA, 23 nt, Neisseria meningitidis Z2491
aaacaucgcucaaauucuguuug

SEQ ID NO: 3357298 - RNA, 15 nt, Neisseria meningitidis Z2491
aaacaucguuugcau

SEQ ID NO: 3357299 - RNA, 17 nt, Neisseria meningitidis Z2491
aaacaucugauuuuucu

SEQ ID NO: 3357300 - RNA, 15 nt, Neisseria meningitidis Z2491
aaacauuacugaaau

SEQ ID NO: 3357301 - RNA, 12 nt, Neisseria meningitidis Z2491
aaacauuuuugc

SEQ ID NO: 3357302 - RNA, 13 nt, Neisseria meningitidis Z2491
aaaccaaaaaaca

SEQ ID NO: 3357303 - RNA, 20 nt, Neisseria meningitidis Z2491
aaaccaaaaaacaacaggaa

SEQ ID NO: 3357304 - RNA, 18 nt, Neisseria meningitidis Z2491
aaaccaaaaacagcaacc

SEQ ID NO: 3357305 - RNA, 20 nt, Neisseria meningitidis Z2491
aaaccaaaaucagaaaccua

SEQ ID NO: 3357306 - RNA, 22 nt, Neisseria meningitidis Z2491
aaaccaaauuacgggacgacau

SEQ ID NO: 3357307 - RNA, 18 nt, Neisseria meningitidis Z2491
aaaccaccgccaucagga

SEQ ID NO: 3357308 - RNA, 22 nt, Neisseria meningitidis Z2491
aaaccagcccgauaagcuguuu

SEQ ID NO: 3357309 - RNA, 13 nt, Neisseria meningitidis Z2491
aaacccaaacaca

SEQ ID NO: 3357310 - RNA, 17 nt, Neisseria meningitidis Z2491
aaacccccgucauuccc

SEQ ID NO: 3357311 - RNA, 23 nt, Neisseria meningitidis Z2491
aaacccgccugagcaaaugccuu

SEQ ID NO: 3357312 - RNA, 14 nt, Neisseria meningitidis Z2491
aaacccggaaaaaa

SEQ ID NO: 3357313 - RNA, 20 nt, Neisseria meningitidis Z2491
aaaccgaacagaccggauuc

SEQ ID NO: 3357314 - RNA, 22 nt, Neisseria meningitidis Z2491
aaaccgaaugccacacgcaggc

SEQ ID NO: 3357315 - RNA, 19 nt, Neisseria meningitidis Z2491
aaaccgacccugccgucug

SEQ ID NO: 3357316 - RNA, 20 nt, Neisseria meningitidis Z2491
aaaccgacccugccgucuga

SEQ ID NO: 3357317 - RNA, 23 nt, Neisseria meningitidis Z2491
aaaccgccauucccgcaaaagcg

SEQ ID NO: 3357318 - RNA, 23 nt, Neisseria meningitidis Z2491
aaaccgccgugcagauucuuguc

SEQ ID NO: 3357319 - RNA, 16 nt, Neisseria meningitidis Z2491
aaaccgcgcaucgcca

SEQ ID NO: 3357320 - RNA, 15 nt, Neisseria meningitidis Z2491
aaaccgcucccccuc

SEQ ID NO: 3357321 - RNA, 23 nt, Neisseria meningitidis Z2491
aaaccgcuccgccgucauucccg

SEQ ID NO: 3357322 - RNA, 17 nt, Neisseria meningitidis Z2491
aaaccgcucugccguca

SEQ ID NO: 3357323 - RNA, 23 nt, Neisseria meningitidis Z2491
aaaccgcucugccgucauucccg

SEQ ID NO: 3357324 - RNA, 20 nt, Neisseria meningitidis Z2491
aaaccggauuccuacgaaaa

SEQ ID NO: 3357325 - RNA, 20 nt, Neisseria meningitidis Z2491
aaaccggccggaaaaccuug

SEQ ID NO: 3357326 - RNA, 20 nt, Neisseria meningitidis Z2491
aaaccggcuucagacggcau

SEQ ID NO: 3357327 - RNA, 13 nt, Neisseria meningitidis Z2491
aaaccggcuugaa

SEQ ID NO: 3357328 - RNA, 17 nt, Neisseria meningitidis Z2491
aaaccguauucccgccu

SEQ ID NO: 3357329 - RNA, 18 nt, Neisseria meningitidis Z2491
aaaccguauucccgccug

SEQ ID NO: 3357330 - RNA, 16 nt, Neisseria meningitidis Z2491
aaaccgucaaacaaaa

SEQ ID NO: 3357331 - RNA, 14 nt, Neisseria meningitidis Z2491
aaaccgucauuccc

SEQ ID NO: 3357332 - RNA, 21 nt, Neisseria meningitidis Z2491
aaaccgucugccaaggauaga

SEQ ID NO: 3357333 - RNA, 22 nt, Neisseria meningitidis Z2491
aaaccgugcugucgguuucauc

SEQ ID NO: 3357334 - RNA, 15 nt, Neisseria meningitidis Z2491
aaaccucaaaucccg

SEQ ID NO: 3357335 - RNA, 21 nt, Neisseria meningitidis Z2491
aaaccucguucggacggcauu

SEQ ID NO: 3357336 - RNA, 17 nt, Neisseria meningitidis Z2491
aaaccugaaaacagaaa

SEQ ID NO: 3357337 - RNA, 14 nt, Neisseria meningitidis Z2491
aaaccugacaguaa

SEQ ID NO: 3357338 - RNA, 22 nt, Neisseria meningitidis Z2491
aaaccugcaccacgucauuccc

SEQ ID NO: 3357339 - RNA, 22 nt, Neisseria meningitidis Z2491
aaaccugcaccgcgucauuccc

SEQ ID NO: 3357340 - RNA, 22 nt, Neisseria meningitidis Z2491
aaaccugcaucccgucauuccu

SEQ ID NO: 3357341 - RNA, 24 nt, Neisseria meningitidis Z2491
aaaccuguaccguuucagacggca

SEQ ID NO: 3357342 - RNA, 20 nt, Neisseria meningitidis Z2491
aaaccuguuucagacggcau

SEQ ID NO: 3357343 - RNA, 13 nt, Neisseria meningitidis Z2491
aaaccuuauccau

SEQ ID NO: 3357344 - RNA, 18 nt, Neisseria meningitidis Z2491
aaaccuuauccauaucca

SEQ ID NO: 3357345 - RNA, 21 nt, Neisseria meningitidis Z2491
aaaccuuauccauauccaaac

SEQ ID NO: 3357346 - RNA, 17 nt, Neisseria meningitidis Z2491
aaaccuuucagacggca

SEQ ID NO: 3357347 - RNA, 15 nt, Neisseria meningitidis Z2491
aaacgaacaaacccu

SEQ ID NO: 3357348 - RNA, 16 nt, Neisseria meningitidis Z2491
aaacgaacaaacccuu

SEQ ID NO: 3357349 - RNA, 17 nt, Neisseria meningitidis Z2491
aaacgaacaaacccuuu

SEQ ID NO: 3357350 - RNA, 18 nt, Neisseria meningitidis Z2491
aaacgacgagaauuuauc

SEQ ID NO: 3357351 - RNA, 13 nt, Neisseria meningitidis Z2491
aaacgagcaauau

SEQ ID NO: 3357352 - RNA, 17 nt, Neisseria meningitidis Z2491
aaacgaugacggcgaaa

SEQ ID NO: 3357353 - RNA, 19 nt, Neisseria meningitidis Z2491
aaacgccgcagcaaaauau

SEQ ID NO: 3357354 - RNA, 13 nt, Neisseria meningitidis Z2491
aaacgccguccga

SEQ ID NO: 3357355 - RNA, 12 nt, Neisseria meningitidis Z2491
aaacgccgucug

SEQ ID NO: 3357356 - RNA, 16 nt, Neisseria meningitidis Z2491
aaacgccgucugaaau

SEQ ID NO: 3357357 - RNA, 22 nt, Neisseria meningitidis Z2491
aaacgccgucugaaauuucaga

SEQ ID NO: 3357358 - RNA, 23 nt, Neisseria meningitidis Z2491
aaacgccgucugaaauuucagac

SEQ ID NO: 3357359 - RNA, 20 nt, Neisseria meningitidis Z2491
aaacgcgauuuucgacgcau

SEQ ID NO: 3357360 - RNA, 14 nt, Neisseria meningitidis Z2491
aaacgcgugcaggc

SEQ ID NO: 3357361 - RNA, 12 nt, Neisseria meningitidis Z2491
aaacggaaaauc

SEQ ID NO: 3357362 - RNA, 22 nt, Neisseria meningitidis Z2491
aaacggcaggaacacggcggca

SEQ ID NO: 3357363 - RNA, 23 nt, Neisseria meningitidis Z2491
aaacggcaggaacacggcggcac

SEQ ID NO: 3357364 - RNA, 12 nt, Neisseria meningitidis Z2491
aaacggcaguuu

SEQ ID NO: 3357365 - RNA, 17 nt, Neisseria meningitidis Z2491
aaacggcggcagccuga

SEQ ID NO: 3357366 - RNA, 17 nt, Neisseria meningitidis Z2491
aaacgggaaucuagagc

SEQ ID NO: 3357367 - RNA, 13 nt, Neisseria meningitidis Z2491
aaacgggaaucuc

SEQ ID NO: 3357368 - RNA, 20 nt, Neisseria meningitidis Z2491
aaacggguucggacggcguu

SEQ ID NO: 3357369 - RNA, 20 nt, Neisseria meningitidis Z2491
aaacggguuucagacggcau

SEQ ID NO: 3357370 - RNA, 12 nt, Neisseria meningitidis Z2491
aaacgguuucuc

SEQ ID NO: 3357371 - RNA, 12 nt, Neisseria meningitidis Z2491
aaacgguuucuu

SEQ ID NO: 3357372 - RNA, 20 nt, Neisseria meningitidis Z2491
aaacgguuucuugagauuuu

SEQ ID NO: 3357373 - RNA, 12 nt, Neisseria meningitidis Z2491
aaacguuucaga

SEQ ID NO: 3357374 - RNA, 13 nt, Neisseria meningitidis Z2491
aaacguuucagac

SEQ ID NO: 3357375 - RNA, 17 nt, Neisseria meningitidis Z2491
aaacguuucagacggca

SEQ ID NO: 3357376 - RNA, 13 nt, Neisseria meningitidis Z2491
aaacguuuguuua

SEQ ID NO: 3357377 - RNA, 20 nt, Neisseria meningitidis Z2491
aaacuaaaugccaaucucuu

SEQ ID NO: 3357378 - RNA, 21 nt, Neisseria meningitidis Z2491
aaacucaaaaaaacuagauuc

SEQ ID NO: 3357379 - RNA, 13 nt, Neisseria meningitidis Z2491
aaacucaaaaaac

SEQ ID NO: 3357380 - RNA, 20 nt, Neisseria meningitidis Z2491
aaacucaaaaaaccggauuc

SEQ ID NO: 3357381 - RNA, 14 nt, Neisseria meningitidis Z2491
aaacucaaaaaacu

SEQ ID NO: 3357382 - RNA, 20 nt, Neisseria meningitidis Z2491
aaacucaaaaagcuggauuc

SEQ ID NO: 3357383 - RNA, 21 nt, Neisseria meningitidis Z2491
aaacucaacgaaccuggauuc

SEQ ID NO: 3357384 - RNA, 22 nt, Neisseria meningitidis Z2491
aaacucucuauaaaaucccccg

SEQ ID NO: 3357385 - RNA, 17 nt, Neisseria meningitidis Z2491
aaacucuggucgaacca

SEQ ID NO: 3357386 - RNA, 24 nt, Neisseria meningitidis Z2491
aaacugcccgaccuguaaaauauc

SEQ ID NO: 3357387 - RNA, 17 nt, Neisseria meningitidis Z2491
aaacugcguuacauaau

SEQ ID NO: 3357388 - RNA, 13 nt, Neisseria meningitidis Z2491
aaacugggcggau

SEQ ID NO: 3357389 - RNA, 14 nt, Neisseria meningitidis Z2491
aaacuuaaaauucc

SEQ ID NO: 3357390 - RNA, 20 nt, Neisseria meningitidis Z2491
aaacuugauugcuguuuuuc

SEQ ID NO: 3357391 - RNA, 22 nt, Neisseria meningitidis Z2491
aaacuuucggauaaucuuugaa

SEQ ID NO: 3357392 - RNA, 15 nt, Neisseria meningitidis Z2491
aaacuuuucugauuu

SEQ ID NO: 3357393 - RNA, 19 nt, Neisseria meningitidis Z2491
aaacuuuucugauuuuucc

SEQ ID NO: 3357394 - RNA, 13 nt, Neisseria meningitidis Z2491
aaagaaauguaaa

SEQ ID NO: 3357395 - RNA, 14 nt, Neisseria meningitidis Z2491
aaagaaauguaaau

SEQ ID NO: 3357396 - RNA, 22 nt, Neisseria meningitidis Z2491
aaagaacccaaaccgucauucc

SEQ ID NO: 3357397 - RNA, 14 nt, Neisseria meningitidis Z2491
aaagacauccccca

SEQ ID NO: 3357398 - RNA, 19 nt, Neisseria meningitidis Z2491
aaagagaacaauucucuaa

SEQ ID NO: 3357399 - RNA, 19 nt, Neisseria meningitidis Z2491
aaagagaacgauucucuaa

SEQ ID NO: 3357400 - RNA, 16 nt, Neisseria meningitidis Z2491
aaagaggcauaccguu

SEQ ID NO: 3357401 - RNA, 14 nt, Neisseria meningitidis Z2491
aaagauacaagaac

SEQ ID NO: 3357402 - RNA, 14 nt, Neisseria meningitidis Z2491
aaagaugccgucug

SEQ ID NO: 3357403 - RNA, 15 nt, Neisseria meningitidis Z2491
aaagaugccgucuga

SEQ ID NO: 3357404 - RNA, 17 nt, Neisseria meningitidis Z2491
aaagaugccgucugaaa

SEQ ID NO: 3357405 - RNA, 16 nt, Neisseria meningitidis Z2491
aaagauuaucugaaag

SEQ ID NO: 3357406 - RNA, 18 nt, Neisseria meningitidis Z2491
aaagauuugcaaucgauu

SEQ ID NO: 3357407 - RNA, 21 nt, Neisseria meningitidis Z2491
aaagcaauuuaucggaaaaaa

SEQ ID NO: 3357408 - RNA, 13 nt, Neisseria meningitidis Z2491
aaagcacaaauua

SEQ ID NO: 3357409 - RNA, 14 nt, Neisseria meningitidis Z2491
aaagcacaaauuaa

SEQ ID NO: 3357410 - RNA, 15 nt, Neisseria meningitidis Z2491
aaagcauacggcuga

SEQ ID NO: 3357411 - RNA, 24 nt, Neisseria meningitidis Z2491
aaagcaucuuguuuuucaaucaaa

SEQ ID NO: 3357412 - RNA, 11 nt, Neisseria meningitidis Z2491
aaagcauuuuu

SEQ ID NO: 3357413 - RNA, 14 nt, Neisseria meningitidis Z2491
aaagccagcagcag

SEQ ID NO: 3357414 - RNA, 22 nt, Neisseria meningitidis Z2491
aaagccagcagcagcccgucua

SEQ ID NO: 3357415 - RNA, 16 nt, Neisseria meningitidis Z2491
aaagcccaaacgagca

SEQ ID NO: 3357416 - RNA, 21 nt, Neisseria meningitidis Z2491
aaagccggcauuucugcgaaa

SEQ ID NO: 3357417 - RNA, 14 nt, Neisseria meningitidis Z2491
aaagccggcggcaa

SEQ ID NO: 3357418 - RNA, 22 nt, Neisseria meningitidis Z2491
aaagccgugugaaaauuuaaaa

SEQ ID NO: 3357419 - RNA, 13 nt, Neisseria meningitidis Z2491
aaagccugcugca

SEQ ID NO: 3357420 - RNA, 17 nt, Neisseria meningitidis Z2491
aaagcggaauacggcaa

SEQ ID NO: 3357421 - RNA, 23 nt, Neisseria meningitidis Z2491
aaagcggaauacggcaacaucau

SEQ ID NO: 3357422 - RNA, 20 nt, Neisseria meningitidis Z2491
aaagcggcaaugccgucuga

SEQ ID NO: 3357423 - RNA, 18 nt, Neisseria meningitidis Z2491
aaagcgggaaucuagaau

SEQ ID NO: 3357424 - RNA, 18 nt, Neisseria meningitidis Z2491
aaagcgggguuggggaaa

SEQ ID NO: 3357425 - RNA, 14 nt, Neisseria meningitidis Z2491
aaagcgucgcccua

SEQ ID NO: 3357426 - RNA, 19 nt, Neisseria meningitidis Z2491
aaagcuaacgggcaauuuu

SEQ ID NO: 3357427 - RNA, 24 nt, Neisseria meningitidis Z2491
aaagcugcaagaauuuaucaaaaa

SEQ ID NO: 3357428 - RNA, 12 nt, Neisseria meningitidis Z2491
aaagcuggauuc

SEQ ID NO: 3357429 - RNA, 17 nt, Neisseria meningitidis Z2491
aaagcuggauucccacu

SEQ ID NO: 3357430 - RNA, 18 nt, Neisseria meningitidis Z2491
aaagcuuccaacucggca

SEQ ID NO: 3357431 - RNA, 20 nt, Neisseria meningitidis Z2491
aaaggaauuuugcaaagguc

SEQ ID NO: 3357432 - RNA, 15 nt, Neisseria meningitidis Z2491
aaaggagcaauuaaa

SEQ ID NO: 3357433 - RNA, 16 nt, Neisseria meningitidis Z2491
aaaggauguuugaguc

SEQ ID NO: 3357434 - RNA, 23 nt, Neisseria meningitidis Z2491
aaaggcagcaaaaaugccgucug

SEQ ID NO: 3357435 - RNA, 13 nt, Neisseria meningitidis Z2491
aaaggccgucuga

SEQ ID NO: 3357436 - RNA, 14 nt, Neisseria meningitidis Z2491
aaaggccgucugaa

SEQ ID NO: 3357437 - RNA, 15 nt, Neisseria meningitidis Z2491
aaaggccgucugaaa

SEQ ID NO: 3357438 - RNA, 16 nt, Neisseria meningitidis Z2491
aaaggccgucugaaau

SEQ ID NO: 3357439 - RNA, 23 nt, Neisseria meningitidis Z2491
aaaggcuuacucguucggcagcc

SEQ ID NO: 3357440 - RNA, 18 nt, Neisseria meningitidis Z2491
aaaggcuucagacggcau

SEQ ID NO: 3357441 - RNA, 19 nt, Neisseria meningitidis Z2491
aaaggcuucagacggcauu

SEQ ID NO: 3357442 - RNA, 18 nt, Neisseria meningitidis Z2491
aaaggcuuucagacggca

SEQ ID NO: 3357443 - RNA, 21 nt, Neisseria meningitidis Z2491
aaaggcuuugcuguucgcggc

SEQ ID NO: 3357444 - RNA, 15 nt, Neisseria meningitidis Z2491
aaagggaacggcauc

SEQ ID NO: 3357445 - RNA, 19 nt, Neisseria meningitidis Z2491
aaagggcaguugggaauca

SEQ ID NO: 3357446 - RNA, 18 nt, Neisseria meningitidis Z2491
aaagggcuucagacggca

SEQ ID NO: 3357447 - RNA, 18 nt, Neisseria meningitidis Z2491
aaaggucuagauucccgc

SEQ ID NO: 3357448 - RNA, 18 nt, Neisseria meningitidis Z2491
aaaggucucuauuuguuc

SEQ ID NO: 3357449 - RNA, 18 nt, Neisseria meningitidis Z2491
aaaggucuggauucccac

SEQ ID NO: 3357450 - RNA, 14 nt, Neisseria meningitidis Z2491
aaaggucuuuucua

SEQ ID NO: 3357451 - RNA, 13 nt, Neisseria meningitidis Z2491
aaaguaccgcagc

SEQ ID NO: 3357452 - RNA, 13 nt, Neisseria meningitidis Z2491
aaaguaguuuccc

SEQ ID NO: 3357453 - RNA, 23 nt, Neisseria meningitidis Z2491
aaagucugauucuaccgccccga

SEQ ID NO: 3357454 - RNA, 19 nt, Neisseria meningitidis Z2491
aaagucuuucagacggcau

SEQ ID NO: 3357455 - RNA, 20 nt, Neisseria meningitidis Z2491
aaagucuuucagacggcauu

SEQ ID NO: 3357456 - RNA, 14 nt, Neisseria meningitidis Z2491
aaagugccaaaugu

SEQ ID NO: 3357457 - RNA, 16 nt, Neisseria meningitidis Z2491
aaagugcgguaaauuu

SEQ ID NO: 3357458 - RNA, 15 nt, Neisseria meningitidis Z2491
aaaguggaacagaaa

SEQ ID NO: 3357459 - RNA, 19 nt, Neisseria meningitidis Z2491
aaaguggaacagaaagcaa

SEQ ID NO: 3357460 - RNA, 18 nt, Neisseria meningitidis Z2491
aaagugggaaucuagaau

SEQ ID NO: 3357461 - RNA, 17 nt, Neisseria meningitidis Z2491
aaagugggaaucuaguu

SEQ ID NO: 3357462 - RNA, 20 nt, Neisseria meningitidis Z2491
aaaguuauucaauuuaaaca

SEQ ID NO: 3357463 - RNA, 23 nt, Neisseria meningitidis Z2491
aaaguuauucaauuuaaacacuu

SEQ ID NO: 3357464 - RNA, 21 nt, Neisseria meningitidis Z2491
aaaguuuagagguucuagauu

SEQ ID NO: 3357465 - RNA, 12 nt, Neisseria meningitidis Z2491
aaauaaaacaaa

SEQ ID NO: 3357466 - RNA, 15 nt, Neisseria meningitidis Z2491
aaauaaacucauuga

SEQ ID NO: 3357467 - RNA, 22 nt, Neisseria meningitidis Z2491
aaauaaucuguuaacgaaauuu

SEQ ID NO: 3357468 - RNA, 21 nt, Neisseria meningitidis Z2491
aaauaauggccuuuucccuug

SEQ ID NO: 3357469 - RNA, 15 nt, Neisseria meningitidis Z2491
aaauaauugaaauca

SEQ ID NO: 3357470 - RNA, 19 nt, Neisseria meningitidis Z2491
aaauaauugccuuuucccu

SEQ ID NO: 3357471 - RNA, 19 nt, Neisseria meningitidis Z2491
aaauaauugucuuuucccu

SEQ ID NO: 3357472 - RNA, 19 nt, Neisseria meningitidis Z2491
aaauacaaaaggccgucug

SEQ ID NO: 3357473 - RNA, 14 nt, Neisseria meningitidis Z2491
aaauacauccuaaa

SEQ ID NO: 3357474 - RNA, 22 nt, Neisseria meningitidis Z2491
aaauacccaaaugcagaauaag

SEQ ID NO: 3357475 - RNA, 17 nt, Neisseria meningitidis Z2491
aaauacugaggaaacca

SEQ ID NO: 3357476 - RNA, 22 nt, Neisseria meningitidis Z2491
aaauacuuauaucgucauuuau

SEQ ID NO: 3357477 - RNA, 14 nt, Neisseria meningitidis Z2491
aaauagaaaaccga

SEQ ID NO: 3357478 - RNA, 19 nt, Neisseria meningitidis Z2491
aaauagaaaauacugauaa

SEQ ID NO: 3357479 - RNA, 13 nt, Neisseria meningitidis Z2491
aaauagaaaauau

SEQ ID NO: 3357480 - RNA, 14 nt, Neisseria meningitidis Z2491
aaauagcugaaacu

SEQ ID NO: 3357481 - RNA, 16 nt, Neisseria meningitidis Z2491
aaauaggcauugguaa

SEQ ID NO: 3357482 - RNA, 13 nt, Neisseria meningitidis Z2491
aaauauaaaaaau

SEQ ID NO: 3357483 - RNA, 15 nt, Neisseria meningitidis Z2491
aaauaucuagcaaaa

SEQ ID NO: 3357484 - RNA, 13 nt, Neisseria meningitidis Z2491
aaauaugccgucu

SEQ ID NO: 3357485 - RNA, 22 nt, Neisseria meningitidis Z2491
aaauaugccgucugaagccuuc

SEQ ID NO: 3357486 - RNA, 12 nt, Neisseria meningitidis Z2491
aaauauggcuga

SEQ ID NO: 3357487 - RNA, 19 nt, Neisseria meningitidis Z2491
aaauaugguucagacggca

SEQ ID NO: 3357488 - RNA, 19 nt, Neisseria meningitidis Z2491
aaauauuguuauucccccg

SEQ ID NO: 3357489 - RNA, 12 nt, Neisseria meningitidis Z2491
aaaucaaaaaaa

SEQ ID NO: 3357490 - RNA, 14 nt, Neisseria meningitidis Z2491
aaaucaaaaacaca

SEQ ID NO: 3357491 - RNA, 21 nt, Neisseria meningitidis Z2491
aaaucaaaaacacaaaacuga

SEQ ID NO: 3357492 - RNA, 19 nt, Neisseria meningitidis Z2491
aaaucaacagauuacuaaa

SEQ ID NO: 3357493 - RNA, 23 nt, Neisseria meningitidis Z2491
aaaucaacagauuacuaaaacac

SEQ ID NO: 3357494 - RNA, 23 nt, Neisseria meningitidis Z2491
aaaucaacagauugucaaaauac

SEQ ID NO: 3357495 - RNA, 20 nt, Neisseria meningitidis Z2491
aaaucaaguuuauccuaguu

SEQ ID NO: 3357496 - RNA, 16 nt, Neisseria meningitidis Z2491
aaaucagaaaccuaaa

SEQ ID NO: 3357497 - RNA, 12 nt, Neisseria meningitidis Z2491
aaaucagcacaa

SEQ ID NO: 3357498 - RNA, 12 nt, Neisseria meningitidis Z2491
aaaucaggacaa

SEQ ID NO: 3357499 - RNA, 19 nt, Neisseria meningitidis Z2491
aaaucaggggauuauuuau

SEQ ID NO: 3357500 - RNA, 14 nt, Neisseria meningitidis Z2491
aaauccaaaaauac

SEQ ID NO: 3357501 - RNA, 15 nt, Neisseria meningitidis Z2491
aaaucccaaacccuc

SEQ ID NO: 3357502 - RNA, 23 nt, Neisseria meningitidis Z2491
aaauccgccaaaaacggcacggc

SEQ ID NO: 3357503 - RNA, 21 nt, Neisseria meningitidis Z2491
aaauccgccguauccauugcc

SEQ ID NO: 3357504 - RNA, 14 nt, Neisseria meningitidis Z2491
aaauccgccugucu

SEQ ID NO: 3357505 - RNA, 18 nt, Neisseria meningitidis Z2491
aaauccgugcgccguccg

SEQ ID NO: 3357506 - RNA, 15 nt, Neisseria meningitidis Z2491
aaauccugcugcugg

SEQ ID NO: 3357507 - RNA, 16 nt, Neisseria meningitidis Z2491
aaaucggcuuucagac

SEQ ID NO: 3357508 - RNA, 14 nt, Neisseria meningitidis Z2491
aaaucgucauuccc

SEQ ID NO: 3357509 - RNA, 21 nt, Neisseria meningitidis Z2491
aaaucuaaauagcguuuuaau

SEQ ID NO: 3357510 - RNA, 21 nt, Neisseria meningitidis Z2491
aaaucuauaguggauuaacaa

SEQ ID NO: 3357511 - RNA, 23 nt, Neisseria meningitidis Z2491
aaaucuauaguggauuaacaaaa

SEQ ID NO: 3357512 - RNA, 14 nt, Neisseria meningitidis Z2491
aaaucuauguuaug

SEQ ID NO: 3357513 - RNA, 15 nt, Neisseria meningitidis Z2491
aaaucugauaagcaa

SEQ ID NO: 3357514 - RNA, 17 nt, Neisseria meningitidis Z2491
aaaucugauaagcaagc

SEQ ID NO: 3357515 - RNA, 16 nt, Neisseria meningitidis Z2491
aaaucugugaaaauca

SEQ ID NO: 3357516 - RNA, 17 nt, Neisseria meningitidis Z2491
aaaucugugaaaaucag

SEQ ID NO: 3357517 - RNA, 16 nt, Neisseria meningitidis Z2491
aaaucuuccugcggca

SEQ ID NO: 3357518 - RNA, 16 nt, Neisseria meningitidis Z2491
aaaugacacaaagccu

SEQ ID NO: 3357519 - RNA, 21 nt, Neisseria meningitidis Z2491
aaaugacggaaacucaaaaaa

SEQ ID NO: 3357520 - RNA, 14 nt, Neisseria meningitidis Z2491
aaaugacugaaacu

SEQ ID NO: 3357521 - RNA, 15 nt, Neisseria meningitidis Z2491
aaaugacugaaacuc

SEQ ID NO: 3357522 - RNA, 16 nt, Neisseria meningitidis Z2491
aaaugacugaaacuca

SEQ ID NO: 3357523 - RNA, 18 nt, Neisseria meningitidis Z2491
aaaugacugaaacucaaa

SEQ ID NO: 3357524 - RNA, 20 nt, Neisseria meningitidis Z2491
aaaugacugaaacucaaaaa

SEQ ID NO: 3357525 - RNA, 20 nt, Neisseria meningitidis Z2491
aaaugauacgcgacaauaaa

SEQ ID NO: 3357526 - RNA, 20 nt, Neisseria meningitidis Z2491
aaaugaugggcugaaauaga

SEQ ID NO: 3357527 - RNA, 24 nt, Neisseria meningitidis Z2491
aaaugaugggcugaaauagaaaau

SEQ ID NO: 3357528 - RNA, 20 nt, Neisseria meningitidis Z2491
aaaugcacgguuacacaaau

SEQ ID NO: 3357529 - RNA, 20 nt, Neisseria meningitidis Z2491
aaaugccgcaaaugccgucu

SEQ ID NO: 3357530 - RNA, 18 nt, Neisseria meningitidis Z2491
aaaugccgcaaucucaaa

SEQ ID NO: 3357531 - RNA, 15 nt, Neisseria meningitidis Z2491
aaaugccgccagcca

SEQ ID NO: 3357532 - RNA, 15 nt, Neisseria meningitidis Z2491
aaaugccgccgucga

SEQ ID NO: 3357533 - RNA, 12 nt, Neisseria meningitidis Z2491
aaaugccgucug

SEQ ID NO: 3357534 - RNA, 13 nt, Neisseria meningitidis Z2491
aaaugccgucuga

SEQ ID NO: 3357535 - RNA, 16 nt, Neisseria meningitidis Z2491
aaaugccgucugaaaa

SEQ ID NO: 3357536 - RNA, 22 nt, Neisseria meningitidis Z2491
aaaugccgucugaaaacagcaa

SEQ ID NO: 3357537 - RNA, 21 nt, Neisseria meningitidis Z2491
aaaugccgucugaacagcauu

SEQ ID NO: 3357538 - RNA, 22 nt, Neisseria meningitidis Z2491
aaaugccgucugaagccugaaa

SEQ ID NO: 3357539 - RNA, 22 nt, Neisseria meningitidis Z2491
aaaugccgucugaagccuucag

SEQ ID NO: 3357540 - RNA, 19 nt, Neisseria meningitidis Z2491
aaaugcgccaaaaaauuuu

SEQ ID NO: 3357541 - RNA, 18 nt, Neisseria meningitidis Z2491
aaaugcguaugccccaca

SEQ ID NO: 3357542 - RNA, 22 nt, Neisseria meningitidis Z2491
aaaugcguuuugacaaaaucag

SEQ ID NO: 3357543 - RNA, 16 nt, Neisseria meningitidis Z2491
aaauggcaguaucaau

SEQ ID NO: 3357544 - RNA, 15 nt, Neisseria meningitidis Z2491
aaaugguaucgggca

SEQ ID NO: 3357545 - RNA, 15 nt, Neisseria meningitidis Z2491
aaauuaaaauaaaac

SEQ ID NO: 3357546 - RNA, 17 nt, Neisseria meningitidis Z2491
aaauuaaaguuucagaa

SEQ ID NO: 3357547 - RNA, 19 nt, Neisseria meningitidis Z2491
aaauuaucgaugugcucgg

SEQ ID NO: 3357548 - RNA, 22 nt, Neisseria meningitidis Z2491
aaauucaaaaacagaaauccca

SEQ ID NO: 3357549 - RNA, 14 nt, Neisseria meningitidis Z2491
aaauucaaauuaag

SEQ ID NO: 3357550 - RNA, 21 nt, Neisseria meningitidis Z2491
aaauucaucgcgcugccgucg

SEQ ID NO: 3357551 - RNA, 12 nt, Neisseria meningitidis Z2491
aaauuccagcaa

SEQ ID NO: 3357552 - RNA, 13 nt, Neisseria meningitidis Z2491
aaauuccuaaaac

SEQ ID NO: 3357553 - RNA, 14 nt, Neisseria meningitidis Z2491
aaauuccuaaaacu

SEQ ID NO: 3357554 - RNA, 15 nt, Neisseria meningitidis Z2491
aaauuccuaaaacuu

SEQ ID NO: 3357555 - RNA, 21 nt, Neisseria meningitidis Z2491
aaauuccuaaaacuuaaaauu

SEQ ID NO: 3357556 - RNA, 21 nt, Neisseria meningitidis Z2491
aaauuccugcugcuuuucauu

SEQ ID NO: 3357557 - RNA, 17 nt, Neisseria meningitidis Z2491
aaauuccuuucccuccc

SEQ ID NO: 3357558 - RNA, 12 nt, Neisseria meningitidis Z2491
aaauucuaacuc

SEQ ID NO: 3357559 - RNA, 12 nt, Neisseria meningitidis Z2491
aaauucuagauu

SEQ ID NO: 3357560 - RNA, 21 nt, Neisseria meningitidis Z2491
aaauucuugcagcuuugaguu

SEQ ID NO: 3357561 - RNA, 21 nt, Neisseria meningitidis Z2491
aaauucuugccgcauuaaaau

SEQ ID NO: 3357562 - RNA, 22 nt, Neisseria meningitidis Z2491
aaauucuugccgcauuaaaauu

SEQ ID NO: 3357563 - RNA, 15 nt, Neisseria meningitidis Z2491
aaauugaaaguuaca

SEQ ID NO: 3357564 - RNA, 13 nt, Neisseria meningitidis Z2491
aaauugcauuuuu

SEQ ID NO: 3357565 - RNA, 16 nt, Neisseria meningitidis Z2491
aaauuuaaaagggaac

SEQ ID NO: 3357566 - RNA, 14 nt, Neisseria meningitidis Z2491
aaauuuaaaccagu

SEQ ID NO: 3357567 - RNA, 15 nt, Neisseria meningitidis Z2491
aaauuuauaaacaaa

SEQ ID NO: 3357568 - RNA, 22 nt, Neisseria meningitidis Z2491
aaauuuauaguggauuaacaaa

SEQ ID NO: 3357569 - RNA, 23 nt, Neisseria meningitidis Z2491
aaauuuauaguggauuaacaaaa

SEQ ID NO: 3357570 - RNA, 14 nt, Neisseria meningitidis Z2491
aaauuuauuaugua

SEQ ID NO: 3357571 - RNA, 18 nt, Neisseria meningitidis Z2491
aaauuucagauagcugaa

SEQ ID NO: 3357572 - RNA, 22 nt, Neisseria meningitidis Z2491
aaauuuccaaauauaaaaaaug

SEQ ID NO: 3357573 - RNA, 21 nt, Neisseria meningitidis Z2491
aaauuuggcuguauuuuaaua

SEQ ID NO: 3357574 - RNA, 17 nt, Neisseria meningitidis Z2491
aaauuugguaaugcaaa

SEQ ID NO: 3357575 - RNA, 18 nt, Neisseria meningitidis Z2491
aaauuuuagguuucugau

SEQ ID NO: 3357576 - RNA, 11 nt, Neisseria meningitidis Z2491
aaauuuuaugc

SEQ ID NO: 3357577 - RNA, 22 nt, Neisseria meningitidis Z2491
aaauuuuaugcucaaucucauu

SEQ ID NO: 3357578 - RNA, 13 nt, Neisseria meningitidis Z2491
aaauuuuuaaauu

SEQ ID NO: 3357579 - RNA, 21 nt, Neisseria meningitidis Z2491
aaauuuuuggcgcauuuuuau

SEQ ID NO: 3357580 - RNA, 21 nt, Neisseria meningitidis Z2491
aaauuuuuuggcgcauuuuua

SEQ ID NO: 3357581 - RNA, 12 nt, Neisseria meningitidis Z2491
aacaaaaaauau

SEQ ID NO: 3357582 - RNA, 16 nt, Neisseria meningitidis Z2491
aacaaaaaccaguaca

SEQ ID NO: 3357583 - RNA, 21 nt, Neisseria meningitidis Z2491
aacaaaaaucaggacaaggca

SEQ ID NO: 3357584 - RNA, 19 nt, Neisseria meningitidis Z2491
aacaaaaugccgccgucga

SEQ ID NO: 3357585 - RNA, 17 nt, Neisseria meningitidis Z2491
aacaaaaugccgucuga

SEQ ID NO: 3357586 - RNA, 20 nt, Neisseria meningitidis Z2491
aacaaaauguucagacggca

SEQ ID NO: 3357587 - RNA, 17 nt, Neisseria meningitidis Z2491
aacaaacaggcagccua

SEQ ID NO: 3357588 - RNA, 11 nt, Neisseria meningitidis Z2491
aacaaauaccc

SEQ ID NO: 3357589 - RNA, 13 nt, Neisseria meningitidis Z2491
aacaacaaauuuu

SEQ ID NO: 3357590 - RNA, 20 nt, Neisseria meningitidis Z2491
aacaacaaauuuuugauuuc

SEQ ID NO: 3357591 - RNA, 20 nt, Neisseria meningitidis Z2491
aacaacaggaauuuauccga

SEQ ID NO: 3357592 - RNA, 18 nt, Neisseria meningitidis Z2491
aacaacucuuucgggcug

SEQ ID NO: 3357593 - RNA, 14 nt, Neisseria meningitidis Z2491
aacaagaaaugaua

SEQ ID NO: 3357594 - RNA, 11 nt, Neisseria meningitidis Z2491
aacaaggaagc

SEQ ID NO: 3357595 - RNA, 15 nt, Neisseria meningitidis Z2491
aacaaugcaaaaaca

SEQ ID NO: 3357596 - RNA, 16 nt, Neisseria meningitidis Z2491
aacaaugcaaaaacau

SEQ ID NO: 3357597 - RNA, 13 nt, Neisseria meningitidis Z2491
aacacaaaaaacu

SEQ ID NO: 3357598 - RNA, 13 nt, Neisseria meningitidis Z2491
aacacaaaauaaa

SEQ ID NO: 3357599 - RNA, 13 nt, Neisseria meningitidis Z2491
aacacaaaugccg

SEQ ID NO: 3357600 - RNA, 16 nt, Neisseria meningitidis Z2491
aacacagguuuucguc

SEQ ID NO: 3357601 - RNA, 21 nt, Neisseria meningitidis Z2491
aacacagguuuucgucuauuu

SEQ ID NO: 3357602 - RNA, 12 nt, Neisseria meningitidis Z2491
aacaccaaaucg

SEQ ID NO: 3357603 - RNA, 16 nt, Neisseria meningitidis Z2491
aacaccaugaugccua

SEQ ID NO: 3357604 - RNA, 16 nt, Neisseria meningitidis Z2491
aacacgcaaaacacaa

SEQ ID NO: 3357605 - RNA, 22 nt, Neisseria meningitidis Z2491
aacacgucggcgcggacgauuu

SEQ ID NO: 3357606 - RNA, 21 nt, Neisseria meningitidis Z2491
aacacgucguaggcuuuuucc

SEQ ID NO: 3357607 - RNA, 22 nt, Neisseria meningitidis Z2491
aacacgucguaggcuuuuucca

SEQ ID NO: 3357608 - RNA, 18 nt, Neisseria meningitidis Z2491
aacagaaaaccaaaauca

SEQ ID NO: 3357609 - RNA, 22 nt, Neisseria meningitidis Z2491
aacagaaacccaaaaucggcca

SEQ ID NO: 3357610 - RNA, 18 nt, Neisseria meningitidis Z2491
aacagaaaccgcucugcc

SEQ ID NO: 3357611 - RNA, 19 nt, Neisseria meningitidis Z2491
aacagaaaccugaaaacag

SEQ ID NO: 3357612 - RNA, 23 nt, Neisseria meningitidis Z2491
aacagaaagccaaaaacagaaac

SEQ ID NO: 3357613 - RNA, 15 nt, Neisseria meningitidis Z2491
aacagacuauuuuug

SEQ ID NO: 3357614 - RNA, 21 nt, Neisseria meningitidis Z2491
aacagacuauuuuugcaaagg

SEQ ID NO: 3357615 - RNA, 22 nt, Neisseria meningitidis Z2491
aacagacuauuuuugcaaaggu

SEQ ID NO: 3357616 - RNA, 16 nt, Neisseria meningitidis Z2491
aacagauaaaaccaac

SEQ ID NO: 3357617 - RNA, 17 nt, Neisseria meningitidis Z2491
aacagauuacuaaaaca

SEQ ID NO: 3357618 - RNA, 17 nt, Neisseria meningitidis Z2491
aacagauugucaaaaua

SEQ ID NO: 3357619 - RNA, 16 nt, Neisseria meningitidis Z2491
aacagauugugcauaa

SEQ ID NO: 3357620 - RNA, 13 nt, Neisseria meningitidis Z2491
aacagauuuuuug

SEQ ID NO: 3357621 - RNA, 17 nt, Neisseria meningitidis Z2491
aacagcaaucaaaauaa

SEQ ID NO: 3357622 - RNA, 19 nt, Neisseria meningitidis Z2491
aacagcaauccauucccuc

SEQ ID NO: 3357623 - RNA, 20 nt, Neisseria meningitidis Z2491
aacagcacugccucuuuuca

SEQ ID NO: 3357624 - RNA, 23 nt, Neisseria meningitidis Z2491
aacagcauauagccgagcaucac

SEQ ID NO: 3357625 - RNA, 17 nt, Neisseria meningitidis Z2491
aacagcaucaaaccaua

SEQ ID NO: 3357626 - RNA, 22 nt, Neisseria meningitidis Z2491
aacagcaucaaaccauauggaa

SEQ ID NO: 3357627 - RNA, 14 nt, Neisseria meningitidis Z2491
aacagccgaaaaca

SEQ ID NO: 3357628 - RNA, 15 nt, Neisseria meningitidis Z2491
aacagcgaguuuuuc

SEQ ID NO: 3357629 - RNA, 18 nt, Neisseria meningitidis Z2491
aacagcggguaggcggga

SEQ ID NO: 3357630 - RNA, 15 nt, Neisseria meningitidis Z2491
aacagcuguacgcug

SEQ ID NO: 3357631 - RNA, 13 nt, Neisseria meningitidis Z2491
aacagcuuaaaau

SEQ ID NO: 3357632 - RNA, 21 nt, Neisseria meningitidis Z2491
aacaggacaaaaauccugcuu

SEQ ID NO: 3357633 - RNA, 23 nt, Neisseria meningitidis Z2491
aacaggacaaaaauccugcuuau

SEQ ID NO: 3357634 - RNA, 19 nt, Neisseria meningitidis Z2491
aacaggcagccuaaaacau

SEQ ID NO: 3357635 - RNA, 17 nt, Neisseria meningitidis Z2491
aacaggcggcggcauau

SEQ ID NO: 3357636 - RNA, 20 nt, Neisseria meningitidis Z2491
aacaggcggcggcauaucau

SEQ ID NO: 3357637 - RNA, 17 nt, Neisseria meningitidis Z2491
aacagggaaagcagcag

SEQ ID NO: 3357638 - RNA, 18 nt, Neisseria meningitidis Z2491
aacagggaaagcagcagc

SEQ ID NO: 3357639 - RNA, 15 nt, Neisseria meningitidis Z2491
aacaguguuucagac

SEQ ID NO: 3357640 - RNA, 13 nt, Neisseria meningitidis Z2491
aacaguucagacg

SEQ ID NO: 3357641 - RNA, 13 nt, Neisseria meningitidis Z2491
aacaguucuuuga

SEQ ID NO: 3357642 - RNA, 13 nt, Neisseria meningitidis Z2491
aacaguuucagca

SEQ ID NO: 3357643 - RNA, 14 nt, Neisseria meningitidis Z2491
aacauaaaaugccg

SEQ ID NO: 3357644 - RNA, 14 nt, Neisseria meningitidis Z2491
aacauacuuuguuu

SEQ ID NO: 3357645 - RNA, 18 nt, Neisseria meningitidis Z2491
aacaucaaguuaccgguc

SEQ ID NO: 3357646 - RNA, 22 nt, Neisseria meningitidis Z2491
aacauccgcaacgcgcaaaccc

SEQ ID NO: 3357647 - RNA, 20 nt, Neisseria meningitidis Z2491
aacaucgcucaaauucuguu

SEQ ID NO: 3357648 - RNA, 20 nt, Neisseria meningitidis Z2491
aacaucggguuucagacggc

SEQ ID NO: 3357649 - RNA, 14 nt, Neisseria meningitidis Z2491
aacaucugauuuuu

SEQ ID NO: 3357650 - RNA, 22 nt, Neisseria meningitidis Z2491
aacaucuugugccagcucuuga

SEQ ID NO: 3357651 - RNA, 16 nt, Neisseria meningitidis Z2491
aacaugccaccgucau

SEQ ID NO: 3357652 - RNA, 20 nt, Neisseria meningitidis Z2491
aacauuaaauuuccagauuc

SEQ ID NO: 3357653 - RNA, 21 nt, Neisseria meningitidis Z2491
aacauuaacgggguuaaauaa

SEQ ID NO: 3357654 - RNA, 14 nt, Neisseria meningitidis Z2491
aacauuugcgcagc

SEQ ID NO: 3357655 - RNA, 16 nt, Neisseria meningitidis Z2491
aaccaaaaaacaacag

SEQ ID NO: 3357656 - RNA, 13 nt, Neisseria meningitidis Z2491
aaccaaaaaaucu

SEQ ID NO: 3357657 - RNA, 15 nt, Neisseria meningitidis Z2491
aaccaaaaaaucuga

SEQ ID NO: 3357658 - RNA, 21 nt, Neisseria meningitidis Z2491
aaccaaaaacagcaaccugaa

SEQ ID NO: 3357659 - RNA, 13 nt, Neisseria meningitidis Z2491
aaccaaaagccaa

SEQ ID NO: 3357660 - RNA, 19 nt, Neisseria meningitidis Z2491
aaccaaaagccaaaaaaca

SEQ ID NO: 3357661 - RNA, 14 nt, Neisseria meningitidis Z2491
aaccaaaaucagaa

SEQ ID NO: 3357662 - RNA, 13 nt, Neisseria meningitidis Z2491
aaccaaaaugccc

SEQ ID NO: 3357663 - RNA, 17 nt, Neisseria meningitidis Z2491
aaccaacgaaacacucg

SEQ ID NO: 3357664 - RNA, 17 nt, Neisseria meningitidis Z2491
aaccaagauauagugga

SEQ ID NO: 3357665 - RNA, 23 nt, Neisseria meningitidis Z2491
aaccacgcuucugaugccgucug

SEQ ID NO: 3357666 - RNA, 23 nt, Neisseria meningitidis Z2491
aaccagccccaagccuauccauu

SEQ ID NO: 3357667 - RNA, 15 nt, Neisseria meningitidis Z2491
aaccagggauuuuuc

SEQ ID NO: 3357668 - RNA, 18 nt, Neisseria meningitidis Z2491
aaccagggauuuuucaaa

SEQ ID NO: 3357669 - RNA, 13 nt, Neisseria meningitidis Z2491
aaccaguacagcg

SEQ ID NO: 3357670 - RNA, 15 nt, Neisseria meningitidis Z2491
aaccaguacagcguu

SEQ ID NO: 3357671 - RNA, 23 nt, Neisseria meningitidis Z2491
aaccauauggaaaaaucugugga

SEQ ID NO: 3357672 - RNA, 21 nt, Neisseria meningitidis Z2491
aacccaaaccgucauucccgc

SEQ ID NO: 3357673 - RNA, 12 nt, Neisseria meningitidis Z2491
aacccaaagccu

SEQ ID NO: 3357674 - RNA, 21 nt, Neisseria meningitidis Z2491
aacccauucaccguuauggaa

SEQ ID NO: 3357675 - RNA, 17 nt, Neisseria meningitidis Z2491
aaccccauucggagcaa

SEQ ID NO: 3357676 - RNA, 19 nt, Neisseria meningitidis Z2491
aaccccauucggagcaaga

SEQ ID NO: 3357677 - RNA, 18 nt, Neisseria meningitidis Z2491
aacccccgucauucccgc

SEQ ID NO: 3357678 - RNA, 17 nt, Neisseria meningitidis Z2491
aacccgaaccaaaccgu

SEQ ID NO: 3357679 - RNA, 14 nt, Neisseria meningitidis Z2491
aacccguuuggcaa

SEQ ID NO: 3357680 - RNA, 15 nt, Neisseria meningitidis Z2491
aacccguuuucaggu

SEQ ID NO: 3357681 - RNA, 19 nt, Neisseria meningitidis Z2491
aacccuccgccucugccag

SEQ ID NO: 3357682 - RNA, 18 nt, Neisseria meningitidis Z2491
aacccucggcauucccgc

SEQ ID NO: 3357683 - RNA, 20 nt, Neisseria meningitidis Z2491
aacccugaacauaaaugccg

SEQ ID NO: 3357684 - RNA, 22 nt, Neisseria meningitidis Z2491
aacccugaacauaaaugccguc

SEQ ID NO: 3357685 - RNA, 17 nt, Neisseria meningitidis Z2491
aacccugucgccgucau

SEQ ID NO: 3357686 - RNA, 15 nt, Neisseria meningitidis Z2491
aacccuuuuucugcc

SEQ ID NO: 3357687 - RNA, 12 nt, Neisseria meningitidis Z2491
aaccgaaaauaa

SEQ ID NO: 3357688 - RNA, 15 nt, Neisseria meningitidis Z2491
aaccgaaacagaaac

SEQ ID NO: 3357689 - RNA, 12 nt, Neisseria meningitidis Z2491
aaccgaacacag

SEQ ID NO: 3357690 - RNA, 16 nt, Neisseria meningitidis Z2491
aaccgaacacagacau

SEQ ID NO: 3357691 - RNA, 20 nt, Neisseria meningitidis Z2491
aaccgaaguuuaaagaaccg

SEQ ID NO: 3357692 - RNA, 13 nt, Neisseria meningitidis Z2491
aaccgacgaaggc

SEQ ID NO: 3357693 - RNA, 14 nt, Neisseria meningitidis Z2491
aaccgaugccguca

SEQ ID NO: 3357694 - RNA, 15 nt, Neisseria meningitidis Z2491
aaccgccauucccgc

SEQ ID NO: 3357695 - RNA, 14 nt, Neisseria meningitidis Z2491
aaccgccggcagug

SEQ ID NO: 3357696 - RNA, 19 nt, Neisseria meningitidis Z2491
aaccgcgcagcaguuuugc

SEQ ID NO: 3357697 - RNA, 15 nt, Neisseria meningitidis Z2491
aaccgcgcucauuuu

SEQ ID NO: 3357698 - RNA, 17 nt, Neisseria meningitidis Z2491
aaccgcucugccgucau

SEQ ID NO: 3357699 - RNA, 19 nt, Neisseria meningitidis Z2491
aaccgggguucgaaucccc

SEQ ID NO: 3357700 - RNA, 14 nt, Neisseria meningitidis Z2491
aaccgguccuucca

SEQ ID NO: 3357701 - RNA, 17 nt, Neisseria meningitidis Z2491
aaccguagcaacugaac

SEQ ID NO: 3357702 - RNA, 18 nt, Neisseria meningitidis Z2491
aaccguauauuucccguc

SEQ ID NO: 3357703 - RNA, 14 nt, Neisseria meningitidis Z2491
aaccguaucaaaca

SEQ ID NO: 3357704 - RNA, 20 nt, Neisseria meningitidis Z2491
aaccgucguuuuuuuccugc

SEQ ID NO: 3357705 - RNA, 19 nt, Neisseria meningitidis Z2491
aaccgugccgacaaaaccc

SEQ ID NO: 3357706 - RNA, 20 nt, Neisseria meningitidis Z2491
aaccguugcagccaugcggc

SEQ ID NO: 3357707 - RNA, 16 nt, Neisseria meningitidis Z2491
aaccuaaaaucccguc

SEQ ID NO: 3357708 - RNA, 15 nt, Neisseria meningitidis Z2491
aaccuaaaauccguc

SEQ ID NO: 3357709 - RNA, 20 nt, Neisseria meningitidis Z2491
aaccuaaaauucgucauucc

SEQ ID NO: 3357710 - RNA, 15 nt, Neisseria meningitidis Z2491
aaccuacauuccguc

SEQ ID NO: 3357711 - RNA, 23 nt, Neisseria meningitidis Z2491
aaccuauccgccggcauccccgc

SEQ ID NO: 3357712 - RNA, 15 nt, Neisseria meningitidis Z2491
aaccucaaaucccgu

SEQ ID NO: 3357713 - RNA, 18 nt, Neisseria meningitidis Z2491
aaccucaaaucccgucau

SEQ ID NO: 3357714 - RNA, 16 nt, Neisseria meningitidis Z2491
aaccucagccaccagc

SEQ ID NO: 3357715 - RNA, 20 nt, Neisseria meningitidis Z2491
aaccucguucggacggcauu

SEQ ID NO: 3357716 - RNA, 18 nt, Neisseria meningitidis Z2491
aaccugcaccacgucauu

SEQ ID NO: 3357717 - RNA, 17 nt, Neisseria meningitidis Z2491
aaccugcaccgcgucau

SEQ ID NO: 3357718 - RNA, 14 nt, Neisseria meningitidis Z2491
aaccugcaucccgu

SEQ ID NO: 3357719 - RNA, 15 nt, Neisseria meningitidis Z2491
aaccugcaucccguc

SEQ ID NO: 3357720 - RNA, 14 nt, Neisseria meningitidis Z2491
aaccugcugccguc

SEQ ID NO: 3357721 - RNA, 21 nt, Neisseria meningitidis Z2491
aaccuguguucagacggcaua

SEQ ID NO: 3357722 - RNA, 20 nt, Neisseria meningitidis Z2491
aaccuguuuuucaaagccca

SEQ ID NO: 3357723 - RNA, 17 nt, Neisseria meningitidis Z2491
aaccuuaacaaucacua

SEQ ID NO: 3357724 - RNA, 17 nt, Neisseria meningitidis Z2491
aaccuuauccauaucca

SEQ ID NO: 3357725 - RNA, 19 nt, Neisseria meningitidis Z2491
aaccuugccaagguugagg

SEQ ID NO: 3357726 - RNA, 15 nt, Neisseria meningitidis Z2491
aacgaaugccgucug

SEQ ID NO: 3357727 - RNA, 14 nt, Neisseria meningitidis Z2491
aacgaauuucaugu

SEQ ID NO: 3357728 - RNA, 13 nt, Neisseria meningitidis Z2491
aacgacagcagca

SEQ ID NO: 3357729 - RNA, 20 nt, Neisseria meningitidis Z2491
aacgacgguauaaaccaaaa

SEQ ID NO: 3357730 - RNA, 22 nt, Neisseria meningitidis Z2491
aacgacgguauaaaccaaaaug

SEQ ID NO: 3357731 - RNA, 20 nt, Neisseria meningitidis Z2491
aacgacuuccaacucuacgg

SEQ ID NO: 3357732 - RNA, 15 nt, Neisseria meningitidis Z2491
aacgacuuccagcac

SEQ ID NO: 3357733 - RNA, 20 nt, Neisseria meningitidis Z2491
aacgacuuuggucaguguug

SEQ ID NO: 3357734 - RNA, 22 nt, Neisseria meningitidis Z2491
aacgauuuuuuuucuaaccagc

SEQ ID NO: 3357735 - RNA, 17 nt, Neisseria meningitidis Z2491
aacgcaaagcugcaaga

SEQ ID NO: 3357736 - RNA, 13 nt, Neisseria meningitidis Z2491
aacgcagccagca

SEQ ID NO: 3357737 - RNA, 16 nt, Neisseria meningitidis Z2491
aacgcauucagacggc

SEQ ID NO: 3357738 - RNA, 21 nt, Neisseria meningitidis Z2491
aacgccacccauauaaggcug

SEQ ID NO: 3357739 - RNA, 19 nt, Neisseria meningitidis Z2491
aacgccagcacaaacagca

SEQ ID NO: 3357740 - RNA, 22 nt, Neisseria meningitidis Z2491
aacgcccuuuuguaaaggaagu

SEQ ID NO: 3357741 - RNA, 21 nt, Neisseria meningitidis Z2491
aacgccgccgacaucccccag

SEQ ID NO: 3357742 - RNA, 15 nt, Neisseria meningitidis Z2491
aacgccguacugguu

SEQ ID NO: 3357743 - RNA, 16 nt, Neisseria meningitidis Z2491
aacgccguacugguuu

SEQ ID NO: 3357744 - RNA, 23 nt, Neisseria meningitidis Z2491
aacgccucuuccgucaaaaaugc

SEQ ID NO: 3357745 - RNA, 15 nt, Neisseria meningitidis Z2491
aacgcgaaaaugccg

SEQ ID NO: 3357746 - RNA, 16 nt, Neisseria meningitidis Z2491
aacgcgacggaaagug

SEQ ID NO: 3357747 - RNA, 14 nt, Neisseria meningitidis Z2491
aacgcgcaaacccg

SEQ ID NO: 3357748 - RNA, 15 nt, Neisseria meningitidis Z2491
aacgcgcaaacgcug

SEQ ID NO: 3357749 - RNA, 18 nt, Neisseria meningitidis Z2491
aacgcgucuuccgucugc

SEQ ID NO: 3357750 - RNA, 22 nt, Neisseria meningitidis Z2491
aacgcuugugaaugcggcggca

SEQ ID NO: 3357751 - RNA, 14 nt, Neisseria meningitidis Z2491
aacggaaaaucaaa

SEQ ID NO: 3357752 - RNA, 14 nt, Neisseria meningitidis Z2491
aacggacaaaccgc

SEQ ID NO: 3357753 - RNA, 14 nt, Neisseria meningitidis Z2491
aacggagauucccg

SEQ ID NO: 3357754 - RNA, 17 nt, Neisseria meningitidis Z2491
aacggcacggcgcaggc

SEQ ID NO: 3357755 - RNA, 18 nt, Neisseria meningitidis Z2491
aacggcacggcgcaggca

SEQ ID NO: 3357756 - RNA, 21 nt, Neisseria meningitidis Z2491
aacggcaggcaaaaaaaauaa

SEQ ID NO: 3357757 - RNA, 22 nt, Neisseria meningitidis Z2491
aacggcauaucccgacagaaca

SEQ ID NO: 3357758 - RNA, 14 nt, Neisseria meningitidis Z2491
aacggcggaaaaau

SEQ ID NO: 3357759 - RNA, 19 nt, Neisseria meningitidis Z2491
aacgguauuggaugcgguc

SEQ ID NO: 3357760 - RNA, 15 nt, Neisseria meningitidis Z2491
aacggucgaaacuuu

SEQ ID NO: 3357761 - RNA, 20 nt, Neisseria meningitidis Z2491
aacgguguggagaguuuuuc

SEQ ID NO: 3357762 - RNA, 20 nt, Neisseria meningitidis Z2491
aacgguuuuuccaaaccuga

SEQ ID NO: 3357763 - RNA, 11 nt, Neisseria meningitidis Z2491
aacgguuuuuu

SEQ ID NO: 3357764 - RNA, 15 nt, Neisseria meningitidis Z2491
aacguacaaaugccg

SEQ ID NO: 3357765 - RNA, 19 nt, Neisseria meningitidis Z2491
aacguacaaaugccgucug

SEQ ID NO: 3357766 - RNA, 17 nt, Neisseria meningitidis Z2491
aacguauucaagcagca

SEQ ID NO: 3357767 - RNA, 18 nt, Neisseria meningitidis Z2491
aacguauucaagcagcaa

SEQ ID NO: 3357768 - RNA, 22 nt, Neisseria meningitidis Z2491
aacguucaguucauucgacagc

SEQ ID NO: 3357769 - RNA, 20 nt, Neisseria meningitidis Z2491
aacuauaguggauuaacaaa

SEQ ID NO: 3357770 - RNA, 22 nt, Neisseria meningitidis Z2491
aacuauaguggauuaacaaaaa

SEQ ID NO: 3357771 - RNA, 21 nt, Neisseria meningitidis Z2491
aacucaaaaaaacuagauucc

SEQ ID NO: 3357772 - RNA, 12 nt, Neisseria meningitidis Z2491
aacucaaaaaac

SEQ ID NO: 3357773 - RNA, 20 nt, Neisseria meningitidis Z2491
aacucaaaaaaccggauucc

SEQ ID NO: 3357774 - RNA, 20 nt, Neisseria meningitidis Z2491
aacucaacgaaccuggauuc

SEQ ID NO: 3357775 - RNA, 19 nt, Neisseria meningitidis Z2491
aacucaacgcacuggauuc

SEQ ID NO: 3357776 - RNA, 15 nt, Neisseria meningitidis Z2491
aacucaggcuucaga

SEQ ID NO: 3357777 - RNA, 19 nt, Neisseria meningitidis Z2491
aacucaggcuucagacggc

SEQ ID NO: 3357778 - RNA, 20 nt, Neisseria meningitidis Z2491
aacucaggcuucagacggca

SEQ ID NO: 3357779 - RNA, 13 nt, Neisseria meningitidis Z2491
aacucaucaucgg

SEQ ID NO: 3357780 - RNA, 13 nt, Neisseria meningitidis Z2491
aacucgauuuccg

SEQ ID NO: 3357781 - RNA, 18 nt, Neisseria meningitidis Z2491
aacucuccgucauucccg

SEQ ID NO: 3357782 - RNA, 20 nt, Neisseria meningitidis Z2491
aacucuggucgaaccauugc

SEQ ID NO: 3357783 - RNA, 18 nt, Neisseria meningitidis Z2491
aacucuuaaaacacguca

SEQ ID NO: 3357784 - RNA, 14 nt, Neisseria meningitidis Z2491
aacugauucaacgc

SEQ ID NO: 3357785 - RNA, 19 nt, Neisseria meningitidis Z2491
aacugauuguuuuucagag

SEQ ID NO: 3357786 - RNA, 20 nt, Neisseria meningitidis Z2491
aacugauuguuuuucagaga

SEQ ID NO: 3357787 - RNA, 23 nt, Neisseria meningitidis Z2491
aacugauuguuuuucagagaaau

SEQ ID NO: 3357788 - RNA, 18 nt, Neisseria meningitidis Z2491
aacugcaagaacagcagc

SEQ ID NO: 3357789 - RNA, 21 nt, Neisseria meningitidis Z2491
aacugcgguucggacggcaua

SEQ ID NO: 3357790 - RNA, 15 nt, Neisseria meningitidis Z2491
aacugcuaugcggca

SEQ ID NO: 3357791 - RNA, 14 nt, Neisseria meningitidis Z2491
aacuuauacacacg

SEQ ID NO: 3357792 - RNA, 13 nt, Neisseria meningitidis Z2491
aacuucaaacccc

SEQ ID NO: 3357793 - RNA, 15 nt, Neisseria meningitidis Z2491
aacuucaauaguggg

SEQ ID NO: 3357794 - RNA, 14 nt, Neisseria meningitidis Z2491
aacuuccaaaccgc

SEQ ID NO: 3357795 - RNA, 11 nt, Neisseria meningitidis Z2491
aacuuccagcg

SEQ ID NO: 3357796 - RNA, 13 nt, Neisseria meningitidis Z2491
aacuuccgcccgg

SEQ ID NO: 3357797 - RNA, 14 nt, Neisseria meningitidis Z2491
aacuucuaacaaau

SEQ ID NO: 3357798 - RNA, 21 nt, Neisseria meningitidis Z2491
aacuugguggucggcauucaa

SEQ ID NO: 3357799 - RNA, 15 nt, Neisseria meningitidis Z2491
aacuuuaauuuuguc

SEQ ID NO: 3357800 - RNA, 18 nt, Neisseria meningitidis Z2491
aacuuuauccguuacacc

SEQ ID NO: 3357801 - RNA, 19 nt, Neisseria meningitidis Z2491
aacuuuucugauuuuuccu

SEQ ID NO: 3357802 - RNA, 23 nt, Neisseria meningitidis Z2491
aacuuuucugauuuuuccuacuu

SEQ ID NO: 3357803 - RNA, 16 nt, Neisseria meningitidis Z2491
aacuuuuuaugccugu

SEQ ID NO: 3357804 - RNA, 20 nt, Neisseria meningitidis Z2491
aagaaaaacagcaaucaaaa

SEQ ID NO: 3357805 - RNA, 22 nt, Neisseria meningitidis Z2491
aagaaaccguuuuauccgauaa

SEQ ID NO: 3357806 - RNA, 13 nt, Neisseria meningitidis Z2491
aagaacagcagca

SEQ ID NO: 3357807 - RNA, 22 nt, Neisseria meningitidis Z2491
aagaacccaaaccgucauuccc

SEQ ID NO: 3357808 - RNA, 16 nt, Neisseria meningitidis Z2491
aagaacgccaaaccca

SEQ ID NO: 3357809 - RNA, 16 nt, Neisseria meningitidis Z2491
aagaacuuuaucccca

SEQ ID NO: 3357810 - RNA, 14 nt, Neisseria meningitidis Z2491
aagaagugggucag

SEQ ID NO: 3357811 - RNA, 16 nt, Neisseria meningitidis Z2491
aagaauuuaucaaaaa

SEQ ID NO: 3357812 - RNA, 21 nt, Neisseria meningitidis Z2491
aagacaucccccaaccaauau

SEQ ID NO: 3357813 - RNA, 18 nt, Neisseria meningitidis Z2491
aagacaucguuuuuuuag

SEQ ID NO: 3357814 - RNA, 20 nt, Neisseria meningitidis Z2491
aagacauugccaaauagaaa

SEQ ID NO: 3357815 - RNA, 16 nt, Neisseria meningitidis Z2491
aagacgaagaaauagc

SEQ ID NO: 3357816 - RNA, 16 nt, Neisseria meningitidis Z2491
aagagcaggacaaagu

SEQ ID NO: 3357817 - RNA, 12 nt, Neisseria meningitidis Z2491
aagauacacaca

SEQ ID NO: 3357818 - RNA, 12 nt, Neisseria meningitidis Z2491
aagaucauaccu

SEQ ID NO: 3357819 - RNA, 11 nt, Neisseria meningitidis Z2491
aagaugccguc

SEQ ID NO: 3357820 - RNA, 18 nt, Neisseria meningitidis Z2491
aagauuauccgaaaguuu

SEQ ID NO: 3357821 - RNA, 18 nt, Neisseria meningitidis Z2491
aagauuaucugaaaguuu

SEQ ID NO: 3357822 - RNA, 20 nt, Neisseria meningitidis Z2491
aagauuucaucauccugcuu

SEQ ID NO: 3357823 - RNA, 22 nt, Neisseria meningitidis Z2491
aagauuuguggcggauuuccca

SEQ ID NO: 3357824 - RNA, 19 nt, Neisseria meningitidis Z2491
aagcaaucaucucuucuau

SEQ ID NO: 3357825 - RNA, 18 nt, Neisseria meningitidis Z2491
aagcaauccugccgaggc

SEQ ID NO: 3357826 - RNA, 15 nt, Neisseria meningitidis Z2491
aagcacaaauuaaaa

SEQ ID NO: 3357827 - RNA, 20 nt, Neisseria meningitidis Z2491
aagcacaaauuaaaauaaaa

SEQ ID NO: 3357828 - RNA, 21 nt, Neisseria meningitidis Z2491
aagcacagccuauuuuucuga

SEQ ID NO: 3357829 - RNA, 18 nt, Neisseria meningitidis Z2491
aagcaccaaguaaaucgg

SEQ ID NO: 3357830 - RNA, 15 nt, Neisseria meningitidis Z2491
aagcaccaagugaau

SEQ ID NO: 3357831 - RNA, 18 nt, Neisseria meningitidis Z2491
aagcaccaagugaaucgg

SEQ ID NO: 3357832 - RNA, 19 nt, Neisseria meningitidis Z2491
aagcagaaaccgcuccgcc

SEQ ID NO: 3357833 - RNA, 13 nt, Neisseria meningitidis Z2491
aagcagaaauaag

SEQ ID NO: 3357834 - RNA, 11 nt, Neisseria meningitidis Z2491
aagcagcagcc

SEQ ID NO: 3357835 - RNA, 18 nt, Neisseria meningitidis Z2491
aagcaggcguuuuucaga

SEQ ID NO: 3357836 - RNA, 14 nt, Neisseria meningitidis Z2491
aagcauacggcuga

SEQ ID NO: 3357837 - RNA, 15 nt, Neisseria meningitidis Z2491
aagccagcagcagcc

SEQ ID NO: 3357838 - RNA, 19 nt, Neisseria meningitidis Z2491
aagcccuaaauacggcaau

SEQ ID NO: 3357839 - RNA, 20 nt, Neisseria meningitidis Z2491
aagcccugccugccauuccc

SEQ ID NO: 3357840 - RNA, 15 nt, Neisseria meningitidis Z2491
aagcccuuucagacg

SEQ ID NO: 3357841 - RNA, 17 nt, Neisseria meningitidis Z2491
aagccgcagacaguaca

SEQ ID NO: 3357842 - RNA, 18 nt, Neisseria meningitidis Z2491
aagccgcagacaguacaa

SEQ ID NO: 3357843 - RNA, 15 nt, Neisseria meningitidis Z2491
aagccgcccggcauu

SEQ ID NO: 3357844 - RNA, 15 nt, Neisseria meningitidis Z2491
aagccgccgccgaca

SEQ ID NO: 3357845 - RNA, 20 nt, Neisseria meningitidis Z2491
aagccgcuucagacggcauu

SEQ ID NO: 3357846 - RNA, 13 nt, Neisseria meningitidis Z2491
aagccggcggcaa

SEQ ID NO: 3357847 - RNA, 21 nt, Neisseria meningitidis Z2491
aagccgguugcggugcugcug

SEQ ID NO: 3357848 - RNA, 17 nt, Neisseria meningitidis Z2491
aagccguacauaaggaa

SEQ ID NO: 3357849 - RNA, 23 nt, Neisseria meningitidis Z2491
aagccugcggaaacagagugcgu

SEQ ID NO: 3357850 - RNA, 13 nt, Neisseria meningitidis Z2491
aagccuucagacg

SEQ ID NO: 3357851 - RNA, 15 nt, Neisseria meningitidis Z2491
aagccuucagacggc

SEQ ID NO: 3357852 - RNA, 16 nt, Neisseria meningitidis Z2491
aagccuucagacggca

SEQ ID NO: 3357853 - RNA, 18 nt, Neisseria meningitidis Z2491
aagccuucagacggcauu

SEQ ID NO: 3357854 - RNA, 17 nt, Neisseria meningitidis Z2491
aagccuugcaaaucagg

SEQ ID NO: 3357855 - RNA, 20 nt, Neisseria meningitidis Z2491
aagccuugcaaaucaggcag

SEQ ID NO: 3357856 - RNA, 11 nt, Neisseria meningitidis Z2491
aagcgaugccg

SEQ ID NO: 3357857 - RNA, 21 nt, Neisseria meningitidis Z2491
aagcgcggccuuugcaaaacc

SEQ ID NO: 3357858 - RNA, 15 nt, Neisseria meningitidis Z2491
aagcggaauacggca

SEQ ID NO: 3357859 - RNA, 18 nt, Neisseria meningitidis Z2491
aagcggacgauuucccug

SEQ ID NO: 3357860 - RNA, 19 nt, Neisseria meningitidis Z2491
aagcggcaaucaaauccug

SEQ ID NO: 3357861 - RNA, 18 nt, Neisseria meningitidis Z2491
aagcggcaaugccgucug

SEQ ID NO: 3357862 - RNA, 22 nt, Neisseria meningitidis Z2491
aagcggcggcaucccaguuuug

SEQ ID NO: 3357863 - RNA, 17 nt, Neisseria meningitidis Z2491
aagcggcggcaucugcu

SEQ ID NO: 3357864 - RNA, 20 nt, Neisseria meningitidis Z2491
aagcgggaauccggaagcga

SEQ ID NO: 3357865 - RNA, 20 nt, Neisseria meningitidis Z2491
aagcgggaguccggaagcgg

SEQ ID NO: 3357866 - RNA, 19 nt, Neisseria meningitidis Z2491
aagcggugggcugaagccc

SEQ ID NO: 3357867 - RNA, 13 nt, Neisseria meningitidis Z2491
aagcgguuuuugc

SEQ ID NO: 3357868 - RNA, 23 nt, Neisseria meningitidis Z2491
aagcguaaagccgcguccagcuu

SEQ ID NO: 3357869 - RNA, 20 nt, Neisseria meningitidis Z2491
aagcguucacgccagcaaca

SEQ ID NO: 3357870 - RNA, 14 nt, Neisseria meningitidis Z2491
aagcuaacgggcaa

SEQ ID NO: 3357871 - RNA, 19 nt, Neisseria meningitidis Z2491
aagcuaacgggcaauuuuc

SEQ ID NO: 3357872 - RNA, 20 nt, Neisseria meningitidis Z2491
aagcugcaacugaaaccaca

SEQ ID NO: 3357873 - RNA, 20 nt, Neisseria meningitidis Z2491
aagcugcagacaguacaaau

SEQ ID NO: 3357874 - RNA, 16 nt, Neisseria meningitidis Z2491
aagcuggauucccacu

SEQ ID NO: 3357875 - RNA, 14 nt, Neisseria meningitidis Z2491
aaggaauuugagau

SEQ ID NO: 3357876 - RNA, 22 nt, Neisseria meningitidis Z2491
aaggacgggcagggcaaguuug

SEQ ID NO: 3357877 - RNA, 21 nt, Neisseria meningitidis Z2491
aaggaugccguuucagacggc

SEQ ID NO: 3357878 - RNA, 23 nt, Neisseria meningitidis Z2491
aaggcaaacccgaaccaaaccgu

SEQ ID NO: 3357879 - RNA, 16 nt, Neisseria meningitidis Z2491
aaggcaauuucucgga

SEQ ID NO: 3357880 - RNA, 21 nt, Neisseria meningitidis Z2491
aaggcauacggggaggaaagu

SEQ ID NO: 3357881 - RNA, 18 nt, Neisseria meningitidis Z2491
aaggcgacaaagccgcag

SEQ ID NO: 3357882 - RNA, 19 nt, Neisseria meningitidis Z2491
aaggcgacaaagccgcaga

SEQ ID NO: 3357883 - RNA, 18 nt, Neisseria meningitidis Z2491
aaggcgagccaacgcugu

SEQ ID NO: 3357884 - RNA, 18 nt, Neisseria meningitidis Z2491
aaggcgaggcaacgccgu

SEQ ID NO: 3357885 - RNA, 12 nt, Neisseria meningitidis Z2491
aaggcgccggcg

SEQ ID NO: 3357886 - RNA, 19 nt, Neisseria meningitidis Z2491
aaggcgcggcacacgcauu

SEQ ID NO: 3357887 - RNA, 16 nt, Neisseria meningitidis Z2491
aaggcggcgagccgca

SEQ ID NO: 3357888 - RNA, 21 nt, Neisseria meningitidis Z2491
aaggcggcggcguucaaauca

SEQ ID NO: 3357889 - RNA, 17 nt, Neisseria meningitidis Z2491
aaggcgggcaggcagug

SEQ ID NO: 3357890 - RNA, 18 nt, Neisseria meningitidis Z2491
aaggcggggcaacgccgu

SEQ ID NO: 3357891 - RNA, 17 nt, Neisseria meningitidis Z2491
aaggcuguguuugaaua

SEQ ID NO: 3357892 - RNA, 13 nt, Neisseria meningitidis Z2491
aaggcuucagacg

SEQ ID NO: 3357893 - RNA, 18 nt, Neisseria meningitidis Z2491
aaggcuucagacggcauc

SEQ ID NO: 3357894 - RNA, 17 nt, Neisseria meningitidis Z2491
aaggcuucgagugcuuc

SEQ ID NO: 3357895 - RNA, 21 nt, Neisseria meningitidis Z2491
aaggcuuuuucagacggcauu

SEQ ID NO: 3357896 - RNA, 12 nt, Neisseria meningitidis Z2491
aagggcuucaga

SEQ ID NO: 3357897 - RNA, 17 nt, Neisseria meningitidis Z2491
aaggucgaggaaauucu

SEQ ID NO: 3357898 - RNA, 16 nt, Neisseria meningitidis Z2491
aaggucggcggcggau

SEQ ID NO: 3357899 - RNA, 13 nt, Neisseria meningitidis Z2491
aaggucgucugaa

SEQ ID NO: 3357900 - RNA, 12 nt, Neisseria meningitidis Z2491
aaggucuagauu

SEQ ID NO: 3357901 - RNA, 16 nt, Neisseria meningitidis Z2491
aaggucuagauucccg

SEQ ID NO: 3357902 - RNA, 12 nt, Neisseria meningitidis Z2491
aaggucuggauu

SEQ ID NO: 3357903 - RNA, 20 nt, Neisseria meningitidis Z2491
aaggucuuuucuaaaauaug

SEQ ID NO: 3357904 - RNA, 17 nt, Neisseria meningitidis Z2491
aaggugcugaagcacca

SEQ ID NO: 3357905 - RNA, 21 nt, Neisseria meningitidis Z2491
aaggugggaaucuggaaacca

SEQ ID NO: 3357906 - RNA, 21 nt, Neisseria meningitidis Z2491
aagguuauuuucuugaguuuc

SEQ ID NO: 3357907 - RNA, 14 nt, Neisseria meningitidis Z2491
aagguucaaacaca

SEQ ID NO: 3357908 - RNA, 21 nt, Neisseria meningitidis Z2491
aagguugcgucugccuucuuc

SEQ ID NO: 3357909 - RNA, 17 nt, Neisseria meningitidis Z2491
aagguugucugaaaacu

SEQ ID NO: 3357910 - RNA, 19 nt, Neisseria meningitidis Z2491
aagguugucugaaaacuug

SEQ ID NO: 3357911 - RNA, 16 nt, Neisseria meningitidis Z2491
aagguuugagcaguuu

SEQ ID NO: 3357912 - RNA, 15 nt, Neisseria meningitidis Z2491
aagguuuuaggcaau

SEQ ID NO: 3357913 - RNA, 18 nt, Neisseria meningitidis Z2491
aagguuuucagacggcau

SEQ ID NO: 3357914 - RNA, 13 nt, Neisseria meningitidis Z2491
aaguaaaucgguu

SEQ ID NO: 3357915 - RNA, 16 nt, Neisseria meningitidis Z2491
aaguaaucacaacggc

SEQ ID NO: 3357916 - RNA, 23 nt, Neisseria meningitidis Z2491
aaguacaaaaugccgucugaagc

SEQ ID NO: 3357917 - RNA, 20 nt, Neisseria meningitidis Z2491
aaguaggagaaaucagaaaa

SEQ ID NO: 3357918 - RNA, 13 nt, Neisseria meningitidis Z2491
aaguaguuucccu

SEQ ID NO: 3357919 - RNA, 15 nt, Neisseria meningitidis Z2491
aaguauuucuauuuu

SEQ ID NO: 3357920 - RNA, 13 nt, Neisseria meningitidis Z2491
aagucauauuaau

SEQ ID NO: 3357921 - RNA, 19 nt, Neisseria meningitidis Z2491
aaguccgaacauacggcgu

SEQ ID NO: 3357922 - RNA, 13 nt, Neisseria meningitidis Z2491
aaguccuucacgc

SEQ ID NO: 3357923 - RNA, 14 nt, Neisseria meningitidis Z2491
aagucgggcaaagc

SEQ ID NO: 3357924 - RNA, 16 nt, Neisseria meningitidis Z2491
aagucugauucuaccg

SEQ ID NO: 3357925 - RNA, 17 nt, Neisseria meningitidis Z2491
aagucugauucuaccgc

SEQ ID NO: 3357926 - RNA, 14 nt, Neisseria meningitidis Z2491
aagugaguaaaaac

SEQ ID NO: 3357927 - RNA, 20 nt, Neisseria meningitidis Z2491
aagugauucaauaggauagg

SEQ ID NO: 3357928 - RNA, 16 nt, Neisseria meningitidis Z2491
aagugcggucaaaauu

SEQ ID NO: 3357929 - RNA, 15 nt, Neisseria meningitidis Z2491
aagugcggugaaauc

SEQ ID NO: 3357930 - RNA, 22 nt, Neisseria meningitidis Z2491
aagugggaaucuagaaauuuaa

SEQ ID NO: 3357931 - RNA, 17 nt, Neisseria meningitidis Z2491
aaguggguucgucaaac

SEQ ID NO: 3357932 - RNA, 12 nt, Neisseria meningitidis Z2491
aaguuaaaucga

SEQ ID NO: 3357933 - RNA, 20 nt, Neisseria meningitidis Z2491
aaguuacucgaaacuuaaaa

SEQ ID NO: 3357934 - RNA, 16 nt, Neisseria meningitidis Z2491
aaguucuagauucccg

SEQ ID NO: 3357935 - RNA, 17 nt, Neisseria meningitidis Z2491
aaguuucagacggcauc

SEQ ID NO: 3357936 - RNA, 17 nt, Neisseria meningitidis Z2491
aaguuucccgaaauucc

SEQ ID NO: 3357937 - RNA, 18 nt, Neisseria meningitidis Z2491
aaguuucccgaaauucca

SEQ ID NO: 3357938 - RNA, 16 nt, Neisseria meningitidis Z2491
aauaaaaaacaaaguu

SEQ ID NO: 3357939 - RNA, 19 nt, Neisseria meningitidis Z2491
aauaaaaaaugccgucuga

SEQ ID NO: 3357940 - RNA, 15 nt, Neisseria meningitidis Z2491
aauaaaaccgauaaa

SEQ ID NO: 3357941 - RNA, 17 nt, Neisseria meningitidis Z2491
aauaaaacgcgugcagg

SEQ ID NO: 3357942 - RNA, 16 nt, Neisseria meningitidis Z2491
aauaaaagcaucuugu

SEQ ID NO: 3357943 - RNA, 17 nt, Neisseria meningitidis Z2491
aauaaaaguaccgcagc

SEQ ID NO: 3357944 - RNA, 17 nt, Neisseria meningitidis Z2491
aauaaaaugccgucuga

SEQ ID NO: 3357945 - RNA, 21 nt, Neisseria meningitidis Z2491
aauaaacagccgauaagguuu

SEQ ID NO: 3357946 - RNA, 23 nt, Neisseria meningitidis Z2491
aauaaacuugauugcuguuuuuc

SEQ ID NO: 3357947 - RNA, 22 nt, Neisseria meningitidis Z2491
aauaaaguccggcauaaauccu

SEQ ID NO: 3357948 - RNA, 23 nt, Neisseria meningitidis Z2491
aauaaauucugaaacuuuaauuu

SEQ ID NO: 3357949 - RNA, 21 nt, Neisseria meningitidis Z2491
aauaacuauaguggauuaaca

SEQ ID NO: 3357950 - RNA, 14 nt, Neisseria meningitidis Z2491
aauaauaaacgcca

SEQ ID NO: 3357951 - RNA, 19 nt, Neisseria meningitidis Z2491
aauaaucgaaccaaauaaa

SEQ ID NO: 3357952 - RNA, 11 nt, Neisseria meningitidis Z2491
aauaaugaaaa

SEQ ID NO: 3357953 - RNA, 14 nt, Neisseria meningitidis Z2491
aauaauggaacaaa

SEQ ID NO: 3357954 - RNA, 17 nt, Neisseria meningitidis Z2491
aauaauggcaaccaaaa

SEQ ID NO: 3357955 - RNA, 20 nt, Neisseria meningitidis Z2491
aauaauguguugauuaaaua

SEQ ID NO: 3357956 - RNA, 16 nt, Neisseria meningitidis Z2491
aauaauugucuuuucc

SEQ ID NO: 3357957 - RNA, 20 nt, Neisseria meningitidis Z2491
aauacaaaaaugccgucuga

SEQ ID NO: 3357958 - RNA, 19 nt, Neisseria meningitidis Z2491
aauacaaaaggccgucuga

SEQ ID NO: 3357959 - RNA, 21 nt, Neisseria meningitidis Z2491
aauacaaaaggccgucugaaa

SEQ ID NO: 3357960 - RNA, 12 nt, Neisseria meningitidis Z2491
aauacaaacauc

SEQ ID NO: 3357961 - RNA, 18 nt, Neisseria meningitidis Z2491
aauacaaacaucugauuu

SEQ ID NO: 3357962 - RNA, 21 nt, Neisseria meningitidis Z2491
aauacaaacaucugauuuuuc

SEQ ID NO: 3357963 - RNA, 13 nt, Neisseria meningitidis Z2491
aauacaacaaaau

SEQ ID NO: 3357964 - RNA, 17 nt, Neisseria meningitidis Z2491
aauacaacaaaaugccg

SEQ ID NO: 3357965 - RNA, 19 nt, Neisseria meningitidis Z2491
aauacacaagguuauuuuc

SEQ ID NO: 3357966 - RNA, 23 nt, Neisseria meningitidis Z2491
aauacacaagguuauuuucuuga

SEQ ID NO: 3357967 - RNA, 16 nt, Neisseria meningitidis Z2491
aauacauccuaaaaau

SEQ ID NO: 3357968 - RNA, 14 nt, Neisseria meningitidis Z2491
aauacauugauuuu

SEQ ID NO: 3357969 - RNA, 16 nt, Neisseria meningitidis Z2491
aauacauuuuugauau

SEQ ID NO: 3357970 - RNA, 16 nt, Neisseria meningitidis Z2491
aauaccaaaccgcgca

SEQ ID NO: 3357971 - RNA, 16 nt, Neisseria meningitidis Z2491
aauacccaaaugcaga

SEQ ID NO: 3357972 - RNA, 11 nt, Neisseria meningitidis Z2491
aauaccgcgcc

SEQ ID NO: 3357973 - RNA, 20 nt, Neisseria meningitidis Z2491
aauaccuuguuuuuucaggc

SEQ ID NO: 3357974 - RNA, 13 nt, Neisseria meningitidis Z2491
aauacgcaaaaca

SEQ ID NO: 3357975 - RNA, 22 nt, Neisseria meningitidis Z2491
aauacgcaaaacaaacccacgc

SEQ ID NO: 3357976 - RNA, 23 nt, Neisseria meningitidis Z2491
aauacggcaacaucauagaaauc

SEQ ID NO: 3357977 - RNA, 20 nt, Neisseria meningitidis Z2491
aauacugccuguaaaaccaa

SEQ ID NO: 3357978 - RNA, 18 nt, Neisseria meningitidis Z2491
aauacuguccggcaugau

SEQ ID NO: 3357979 - RNA, 22 nt, Neisseria meningitidis Z2491
aauacuguccggcaugauuuuc

SEQ ID NO: 3357980 - RNA, 19 nt, Neisseria meningitidis Z2491
aauagaaaauacugauaau

SEQ ID NO: 3357981 - RNA, 17 nt, Neisseria meningitidis Z2491
aauagaagccaaaauau

SEQ ID NO: 3357982 - RNA, 16 nt, Neisseria meningitidis Z2491
aauagcaugguuaaga

SEQ ID NO: 3357983 - RNA, 18 nt, Neisseria meningitidis Z2491
aauagcguuuuaauucgg

SEQ ID NO: 3357984 - RNA, 15 nt, Neisseria meningitidis Z2491
aauagcugaaacuca

SEQ ID NO: 3357985 - RNA, 22 nt, Neisseria meningitidis Z2491
aauagcugaaacucaacgcacu

SEQ ID NO: 3357986 - RNA, 16 nt, Neisseria meningitidis Z2491
aauaggacaaaugccg

SEQ ID NO: 3357987 - RNA, 15 nt, Neisseria meningitidis Z2491
aauaggauaggcugc

SEQ ID NO: 3357988 - RNA, 19 nt, Neisseria meningitidis Z2491
aauaggauaggucucuucc

SEQ ID NO: 3357989 - RNA, 14 nt, Neisseria meningitidis Z2491
aauagucaggcugc

SEQ ID NO: 3357990 - RNA, 12 nt, Neisseria meningitidis Z2491
aauauaaaaaau

SEQ ID NO: 3357991 - RNA, 13 nt, Neisseria meningitidis Z2491
aauauaaucaaac

SEQ ID NO: 3357992 - RNA, 20 nt, Neisseria meningitidis Z2491
aauauacugauuuauauugu

SEQ ID NO: 3357993 - RNA, 16 nt, Neisseria meningitidis Z2491
aauaucagauuuugga

SEQ ID NO: 3357994 - RNA, 12 nt, Neisseria meningitidis Z2491
aauauccgacca

SEQ ID NO: 3357995 - RNA, 11 nt, Neisseria meningitidis Z2491
aauaugccguc

SEQ ID NO: 3357996 - RNA, 17 nt, Neisseria meningitidis Z2491
aauaugccgucauuccc

SEQ ID NO: 3357997 - RNA, 12 nt, Neisseria meningitidis Z2491
aauaugccgucu

SEQ ID NO: 3357998 - RNA, 23 nt, Neisseria meningitidis Z2491
aauauggcggauuaaaauaaaaa

SEQ ID NO: 3357999 - RNA, 22 nt, Neisseria meningitidis Z2491
aauauggcugcuuugguaaaaa

SEQ ID NO: 3358000 - RNA, 17 nt, Neisseria meningitidis Z2491
aauauuaagaaaaacag

SEQ ID NO: 3358001 - RNA, 13 nt, Neisseria meningitidis Z2491
aauauucaaagau

SEQ ID NO: 3358002 - RNA, 17 nt, Neisseria meningitidis Z2491
aauauugagcaaaaagu

SEQ ID NO: 3358003 - RNA, 18 nt, Neisseria meningitidis Z2491
aauauugagcaaaaagua

SEQ ID NO: 3358004 - RNA, 14 nt, Neisseria meningitidis Z2491
aauauuuccucacu

SEQ ID NO: 3358005 - RNA, 14 nt, Neisseria meningitidis Z2491
aaucaaaaccagcc

SEQ ID NO: 3358006 - RNA, 12 nt, Neisseria meningitidis Z2491
aaucaaaauaaa

SEQ ID NO: 3358007 - RNA, 14 nt, Neisseria meningitidis Z2491
aaucaaaaucagaa

SEQ ID NO: 3358008 - RNA, 14 nt, Neisseria meningitidis Z2491
aaucaaauauuaaa

SEQ ID NO: 3358009 - RNA, 16 nt, Neisseria meningitidis Z2491
aaucaaguuuauccua

SEQ ID NO: 3358010 - RNA, 15 nt, Neisseria meningitidis Z2491
aaucaauuaaaaaca

SEQ ID NO: 3358011 - RNA, 16 nt, Neisseria meningitidis Z2491
aaucaauuaaaaacaa

SEQ ID NO: 3358012 - RNA, 18 nt, Neisseria meningitidis Z2491
aaucaauuaaaaacaaaa

SEQ ID NO: 3358013 - RNA, 22 nt, Neisseria meningitidis Z2491
aaucacagucggugugccgcug

SEQ ID NO: 3358014 - RNA, 19 nt, Neisseria meningitidis Z2491
aaucacuauaccaaacggc

SEQ ID NO: 3358015 - RNA, 17 nt, Neisseria meningitidis Z2491
aaucacuauuaaaaugc

SEQ ID NO: 3358016 - RNA, 22 nt, Neisseria meningitidis Z2491
aaucagaaaccuaaaaucccgu

SEQ ID NO: 3358017 - RNA, 20 nt, Neisseria meningitidis Z2491
aaucagaccgaauuuaauca

SEQ ID NO: 3358018 - RNA, 18 nt, Neisseria meningitidis Z2491
aaucagcacaaaugccaa

SEQ ID NO: 3358019 - RNA, 16 nt, Neisseria meningitidis Z2491
aaucagcccgaaauaa

SEQ ID NO: 3358020 - RNA, 16 nt, Neisseria meningitidis Z2491
aaucaggccggcggag

SEQ ID NO: 3358021 - RNA, 23 nt, Neisseria meningitidis Z2491
aaucauccacagccgcaaaagcc

SEQ ID NO: 3358022 - RNA, 17 nt, Neisseria meningitidis Z2491
aaucaucccaaacaucg

SEQ ID NO: 3358023 - RNA, 19 nt, Neisseria meningitidis Z2491
aaucauguuauuauuuucc

SEQ ID NO: 3358024 - RNA, 23 nt, Neisseria meningitidis Z2491
aauccaccauauuugaaccugac

SEQ ID NO: 3358025 - RNA, 17 nt, Neisseria meningitidis Z2491
aauccacuauaauacaa

SEQ ID NO: 3358026 - RNA, 17 nt, Neisseria meningitidis Z2491
aauccacuauaauacau

SEQ ID NO: 3358027 - RNA, 19 nt, Neisseria meningitidis Z2491
aauccacuauaauacauug

SEQ ID NO: 3358028 - RNA, 21 nt, Neisseria meningitidis Z2491
aauccagaacguaaaaucuca

SEQ ID NO: 3358029 - RNA, 20 nt, Neisseria meningitidis Z2491
aauccagguucguugaguuu

SEQ ID NO: 3358030 - RNA, 23 nt, Neisseria meningitidis Z2491
aauccagguucguugaguuucgg

SEQ ID NO: 3358031 - RNA, 19 nt, Neisseria meningitidis Z2491
aauccagugcguugaguuu

SEQ ID NO: 3358032 - RNA, 17 nt, Neisseria meningitidis Z2491
aauccaguucgguuuca

SEQ ID NO: 3358033 - RNA, 15 nt, Neisseria meningitidis Z2491
aauccaguuucuuga

SEQ ID NO: 3358034 - RNA, 19 nt, Neisseria meningitidis Z2491
aauccaguuucuugaguuu

SEQ ID NO: 3358035 - RNA, 13 nt, Neisseria meningitidis Z2491
aauccauccauac

SEQ ID NO: 3358036 - RNA, 21 nt, Neisseria meningitidis Z2491
aauccauccauacggaaaccu

SEQ ID NO: 3358037 - RNA, 17 nt, Neisseria meningitidis Z2491
aauccauucgccgacuu

SEQ ID NO: 3358038 - RNA, 23 nt, Neisseria meningitidis Z2491
aaucccauuauuuucacaaaaac

SEQ ID NO: 3358039 - RNA, 13 nt, Neisseria meningitidis Z2491
aaucccgcaggau

SEQ ID NO: 3358040 - RNA, 23 nt, Neisseria meningitidis Z2491
aaucccguugccaaaccggcauu

SEQ ID NO: 3358041 - RNA, 20 nt, Neisseria meningitidis Z2491
aaucccuuugagcuucgcga

SEQ ID NO: 3358042 - RNA, 14 nt, Neisseria meningitidis Z2491
aauccgcaaacggc

SEQ ID NO: 3358043 - RNA, 12 nt, Neisseria meningitidis Z2491
aauccgcaauau

SEQ ID NO: 3358044 - RNA, 19 nt, Neisseria meningitidis Z2491
aauccgccaaaaacggcac

SEQ ID NO: 3358045 - RNA, 19 nt, Neisseria meningitidis Z2491
aauccgcccgaauaaaaaa

SEQ ID NO: 3358046 - RNA, 18 nt, Neisseria meningitidis Z2491
aauccgccggcaauauug

SEQ ID NO: 3358047 - RNA, 15 nt, Neisseria meningitidis Z2491
aauccgccugcgcca

SEQ ID NO: 3358048 - RNA, 21 nt, Neisseria meningitidis Z2491
aauccgccugcgccacggcuu

SEQ ID NO: 3358049 - RNA, 19 nt, Neisseria meningitidis Z2491
aauccgcuauaacagcaac

SEQ ID NO: 3358050 - RNA, 15 nt, Neisseria meningitidis Z2491
aauccgcuauauauu

SEQ ID NO: 3358051 - RNA, 17 nt, Neisseria meningitidis Z2491
aauccgcuauauauucu

SEQ ID NO: 3358052 - RNA, 15 nt, Neisseria meningitidis Z2491
aauccgcuauauucc

SEQ ID NO: 3358053 - RNA, 21 nt, Neisseria meningitidis Z2491
aauccgcucuucggcgcgcau

SEQ ID NO: 3358054 - RNA, 19 nt, Neisseria meningitidis Z2491
aauccgcuuccaaaaccac

SEQ ID NO: 3358055 - RNA, 16 nt, Neisseria meningitidis Z2491
aauccgggauuuuaaa

SEQ ID NO: 3358056 - RNA, 13 nt, Neisseria meningitidis Z2491
aauccgguuuuuu

SEQ ID NO: 3358057 - RNA, 14 nt, Neisseria meningitidis Z2491
aauccgucauuccc

SEQ ID NO: 3358058 - RNA, 15 nt, Neisseria meningitidis Z2491
aauccuauuuucaga

SEQ ID NO: 3358059 - RNA, 19 nt, Neisseria meningitidis Z2491
aauccuucagcucucccuc

SEQ ID NO: 3358060 - RNA, 19 nt, Neisseria meningitidis Z2491
aaucgccaaacauuuugau

SEQ ID NO: 3358061 - RNA, 16 nt, Neisseria meningitidis Z2491
aaucggccauucccuc

SEQ ID NO: 3358062 - RNA, 19 nt, Neisseria meningitidis Z2491
aaucgggcgggaauagcuc

SEQ ID NO: 3358063 - RNA, 18 nt, Neisseria meningitidis Z2491
aaucggguuucagacggc

SEQ ID NO: 3358064 - RNA, 23 nt, Neisseria meningitidis Z2491
aaucggguuucagacggcacuuu

SEQ ID NO: 3358065 - RNA, 19 nt, Neisseria meningitidis Z2491
aaucgguuccguacuauuu

SEQ ID NO: 3358066 - RNA, 14 nt, Neisseria meningitidis Z2491
aaucguucucuuug

SEQ ID NO: 3358067 - RNA, 17 nt, Neisseria meningitidis Z2491
aaucguucucuuugagc

SEQ ID NO: 3358068 - RNA, 16 nt, Neisseria meningitidis Z2491
aaucuaaaaauccaac

SEQ ID NO: 3358069 - RNA, 22 nt, Neisseria meningitidis Z2491
aaucuaaauagcguuuuaauuc

SEQ ID NO: 3358070 - RNA, 22 nt, Neisseria meningitidis Z2491
aaucuagaaacgcaaagcugca

SEQ ID NO: 3358071 - RNA, 13 nt, Neisseria meningitidis Z2491
aaucuagaaacuc

SEQ ID NO: 3358072 - RNA, 14 nt, Neisseria meningitidis Z2491
aaucuagaaacuca

SEQ ID NO: 3358073 - RNA, 14 nt, Neisseria meningitidis Z2491
aaucuagaaauuua

SEQ ID NO: 3358074 - RNA, 21 nt, Neisseria meningitidis Z2491
aaucuagaacccaacacggca

SEQ ID NO: 3358075 - RNA, 22 nt, Neisseria meningitidis Z2491
aaucuagaaccucuaaacuuuc

SEQ ID NO: 3358076 - RNA, 21 nt, Neisseria meningitidis Z2491
aaucuagaacguaaaaucuca

SEQ ID NO: 3358077 - RNA, 14 nt, Neisseria meningitidis Z2491
aaucuagacauuca

SEQ ID NO: 3358078 - RNA, 22 nt, Neisseria meningitidis Z2491
aaucuagacauucaaugcuaag

SEQ ID NO: 3358079 - RNA, 21 nt, Neisseria meningitidis Z2491
aaucuauaguggauuaacaaa

SEQ ID NO: 3358080 - RNA, 22 nt, Neisseria meningitidis Z2491
aaucuauaguggauuaacaaaa

SEQ ID NO: 3358081 - RNA, 19 nt, Neisseria meningitidis Z2491
aaucuccuuuuuuuucuau

SEQ ID NO: 3358082 - RNA, 17 nt, Neisseria meningitidis Z2491
aaucucggacuuucaga

SEQ ID NO: 3358083 - RNA, 18 nt, Neisseria meningitidis Z2491
aaucucgucccaaacaau

SEQ ID NO: 3358084 - RNA, 22 nt, Neisseria meningitidis Z2491
aaucucguuauccauacaagaa

SEQ ID NO: 3358085 - RNA, 20 nt, Neisseria meningitidis Z2491
aaucucuaaagcuucagcua

SEQ ID NO: 3358086 - RNA, 20 nt, Neisseria meningitidis Z2491
aaucugaaaccccauccuuc

SEQ ID NO: 3358087 - RNA, 22 nt, Neisseria meningitidis Z2491
aaucugagaccuuugcaaaaau

SEQ ID NO: 3358088 - RNA, 11 nt, Neisseria meningitidis Z2491
aaucugcugca

SEQ ID NO: 3358089 - RNA, 21 nt, Neisseria meningitidis Z2491
aaucugcugcaaaccgucugc

SEQ ID NO: 3358090 - RNA, 16 nt, Neisseria meningitidis Z2491
aaucuggaaaccaaaa

SEQ ID NO: 3358091 - RNA, 21 nt, Neisseria meningitidis Z2491
aaucuggaaaccaaaaaacaa

SEQ ID NO: 3358092 - RNA, 22 nt, Neisseria meningitidis Z2491
aaucuggaaaccaaaaaacaac

SEQ ID NO: 3358093 - RNA, 23 nt, Neisseria meningitidis Z2491
aaucuggaaaccaaaaaacaaca

SEQ ID NO: 3358094 - RNA, 16 nt, Neisseria meningitidis Z2491
aaucuuauuuucaaaa

SEQ ID NO: 3358095 - RNA, 18 nt, Neisseria meningitidis Z2491
aaucuuauuuucaaaaug

SEQ ID NO: 3358096 - RNA, 19 nt, Neisseria meningitidis Z2491
aaucuuauuuucaaaaugc

SEQ ID NO: 3358097 - RNA, 13 nt, Neisseria meningitidis Z2491
aaucuucauuccg

SEQ ID NO: 3358098 - RNA, 22 nt, Neisseria meningitidis Z2491
aaucuucgcaguuggaacagcu

SEQ ID NO: 3358099 - RNA, 18 nt, Neisseria meningitidis Z2491
aaucuugaaacccgucau

SEQ ID NO: 3358100 - RNA, 22 nt, Neisseria meningitidis Z2491
aaucuugaaacccgucauuccc

SEQ ID NO: 3358101 - RNA, 17 nt, Neisseria meningitidis Z2491
aaucuuugaauauugcu

SEQ ID NO: 3358102 - RNA, 11 nt, Neisseria meningitidis Z2491
aaucuuuggca

SEQ ID NO: 3358103 - RNA, 19 nt, Neisseria meningitidis Z2491
aaugaaaaugugcauuucu

SEQ ID NO: 3358104 - RNA, 22 nt, Neisseria meningitidis Z2491
aaugaaaauuugguaaugcaaa

SEQ ID NO: 3358105 - RNA, 17 nt, Neisseria meningitidis Z2491
aaugaaggaauuugaga

SEQ ID NO: 3358106 - RNA, 17 nt, Neisseria meningitidis Z2491
aaugacgaaaaguugca

SEQ ID NO: 3358107 - RNA, 14 nt, Neisseria meningitidis Z2491
aaugacgaaauuuu

SEQ ID NO: 3358108 - RNA, 17 nt, Neisseria meningitidis Z2491
aaugacgaaguuucaga

SEQ ID NO: 3358109 - RNA, 23 nt, Neisseria meningitidis Z2491
aaugacgaugaaaagauuguugu

SEQ ID NO: 3358110 - RNA, 20 nt, Neisseria meningitidis Z2491
aaugacgauucauaaguuuc

SEQ ID NO: 3358111 - RNA, 23 nt, Neisseria meningitidis Z2491
aaugacgcgaacagaaaccucaa

SEQ ID NO: 3358112 - RNA, 15 nt, Neisseria meningitidis Z2491
aaugacggaaacuca

SEQ ID NO: 3358113 - RNA, 21 nt, Neisseria meningitidis Z2491
aaugacggaguuucaggcggc

SEQ ID NO: 3358114 - RNA, 23 nt, Neisseria meningitidis Z2491
aaugacggauuuuagguuucuga

SEQ ID NO: 3358115 - RNA, 15 nt, Neisseria meningitidis Z2491
aaugacggcagagcg

SEQ ID NO: 3358116 - RNA, 23 nt, Neisseria meningitidis Z2491
aaugacggcagagcgguuucugu

SEQ ID NO: 3358117 - RNA, 13 nt, Neisseria meningitidis Z2491
aaugacggcggaa

SEQ ID NO: 3358118 - RNA, 23 nt, Neisseria meningitidis Z2491
aaugacggcggagcgguuucugu

SEQ ID NO: 3358119 - RNA, 24 nt, Neisseria meningitidis Z2491
aaugacggcggaggguugcuguuu

SEQ ID NO: 3358120 - RNA, 19 nt, Neisseria meningitidis Z2491
aaugacgggauauagguuu

SEQ ID NO: 3358121 - RNA, 17 nt, Neisseria meningitidis Z2491
aaugacgggauuugaga

SEQ ID NO: 3358122 - RNA, 17 nt, Neisseria meningitidis Z2491
aaugacgguaaagauug

SEQ ID NO: 3358123 - RNA, 22 nt, Neisseria meningitidis Z2491
aaugacggucggggguuucugu

SEQ ID NO: 3358124 - RNA, 14 nt, Neisseria meningitidis Z2491
aaugacuccguaaa

SEQ ID NO: 3358125 - RNA, 16 nt, Neisseria meningitidis Z2491
aaugacugaaacucaa

SEQ ID NO: 3358126 - RNA, 21 nt, Neisseria meningitidis Z2491
aaugacugaaacucaaaaaaa

SEQ ID NO: 3358127 - RNA, 21 nt, Neisseria meningitidis Z2491
aaugacugaaacucaaaaaac

SEQ ID NO: 3358128 - RNA, 21 nt, Neisseria meningitidis Z2491
aaugacugaaauucaaaaaac

SEQ ID NO: 3358129 - RNA, 15 nt, Neisseria meningitidis Z2491
aaugacugaagcuca

SEQ ID NO: 3358130 - RNA, 21 nt, Neisseria meningitidis Z2491
aaugacuguccgagacagaac

SEQ ID NO: 3358131 - RNA, 21 nt, Neisseria meningitidis Z2491
aaugagauugagcauaaaauu

SEQ ID NO: 3358132 - RNA, 15 nt, Neisseria meningitidis Z2491
aaugaucaggcggau

SEQ ID NO: 3358133 - RNA, 15 nt, Neisseria meningitidis Z2491
aaugauucauaaaau

SEQ ID NO: 3358134 - RNA, 20 nt, Neisseria meningitidis Z2491
aaugauucauaaaauauuug

SEQ ID NO: 3358135 - RNA, 14 nt, Neisseria meningitidis Z2491
aaugcaaaaacauc

SEQ ID NO: 3358136 - RNA, 18 nt, Neisseria meningitidis Z2491
aaugcaaaacuuuucuga

SEQ ID NO: 3358137 - RNA, 14 nt, Neisseria meningitidis Z2491
aaugcacuacuuca

SEQ ID NO: 3358138 - RNA, 23 nt, Neisseria meningitidis Z2491
aaugcccauccgccuuccgcaua

SEQ ID NO: 3358139 - RNA, 21 nt, Neisseria meningitidis Z2491
aaugcccgaaccgucauuccc

SEQ ID NO: 3358140 - RNA, 16 nt, Neisseria meningitidis Z2491
aaugccgcaaaugccg

SEQ ID NO: 3358141 - RNA, 19 nt, Neisseria meningitidis Z2491
aaugccgcaaaugccgucu

SEQ ID NO: 3358142 - RNA, 21 nt, Neisseria meningitidis Z2491
aaugccgcaaaugccgucuga

SEQ ID NO: 3358143 - RNA, 16 nt, Neisseria meningitidis Z2491
aaugccgcaaucucaa

SEQ ID NO: 3358144 - RNA, 23 nt, Neisseria meningitidis Z2491
aaugccgccugaacauuucagac

SEQ ID NO: 3358145 - RNA, 15 nt, Neisseria meningitidis Z2491
aaugccguccgaacc

SEQ ID NO: 3358146 - RNA, 10 nt, Neisseria meningitidis Z2491
aaugccgucu

SEQ ID NO: 3358147 - RNA, 12 nt, Neisseria meningitidis Z2491
aaugccgucuga

SEQ ID NO: 3358148 - RNA, 19 nt, Neisseria meningitidis Z2491
aaugccgucugaaaacagc

SEQ ID NO: 3358149 - RNA, 21 nt, Neisseria meningitidis Z2491
aaugccgucugaaaaccuuuc

SEQ ID NO: 3358150 - RNA, 20 nt, Neisseria meningitidis Z2491
aaugccgucugaaacagguu

SEQ ID NO: 3358151 - RNA, 18 nt, Neisseria meningitidis Z2491
aaugccgucugaaacccg

SEQ ID NO: 3358152 - RNA, 21 nt, Neisseria meningitidis Z2491
aaugccgucugaaagccguau

SEQ ID NO: 3358153 - RNA, 16 nt, Neisseria meningitidis Z2491
aaugccgucugaaagg

SEQ ID NO: 3358154 - RNA, 20 nt, Neisseria meningitidis Z2491
aaugccgucugaacaucuuu

SEQ ID NO: 3358155 - RNA, 19 nt, Neisseria meningitidis Z2491
aaugccgucugaagccuuc

SEQ ID NO: 3358156 - RNA, 19 nt, Neisseria meningitidis Z2491
aaugccgucugaagccuuu

SEQ ID NO: 3358157 - RNA, 18 nt, Neisseria meningitidis Z2491
aaugccgucugaaggcuu

SEQ ID NO: 3358158 - RNA, 21 nt, Neisseria meningitidis Z2491
aaugccgucugaaguuucugc

SEQ ID NO: 3358159 - RNA, 14 nt, Neisseria meningitidis Z2491
aaugccgucugaua

SEQ ID NO: 3358160 - RNA, 18 nt, Neisseria meningitidis Z2491
aaugccuuucucuguuuu

SEQ ID NO: 3358161 - RNA, 20 nt, Neisseria meningitidis Z2491
aaugcggcacggcagggaca

SEQ ID NO: 3358162 - RNA, 19 nt, Neisseria meningitidis Z2491
aaugcgucggagaaaaaca

SEQ ID NO: 3358163 - RNA, 14 nt, Neisseria meningitidis Z2491
aaugcuaaggcaau

SEQ ID NO: 3358164 - RNA, 17 nt, Neisseria meningitidis Z2491
aaugcuguucagacggc

SEQ ID NO: 3358165 - RNA, 17 nt, Neisseria meningitidis Z2491
aaugcuuaaucaaaucu

SEQ ID NO: 3358166 - RNA, 13 nt, Neisseria meningitidis Z2491
aauggaaaugccg

SEQ ID NO: 3358167 - RNA, 14 nt, Neisseria meningitidis Z2491
aauggcaaaauuuc

SEQ ID NO: 3358168 - RNA, 22 nt, Neisseria meningitidis Z2491
aauggcaaaauuucagauugcg

SEQ ID NO: 3358169 - RNA, 23 nt, Neisseria meningitidis Z2491
aauggccgauuuuggguuucugu

SEQ ID NO: 3358170 - RNA, 17 nt, Neisseria meningitidis Z2491
aaugggcuucagacggc

SEQ ID NO: 3358171 - RNA, 15 nt, Neisseria meningitidis Z2491
aauguacuucuggaa

SEQ ID NO: 3358172 - RNA, 20 nt, Neisseria meningitidis Z2491
aauguauuagaaaugacuga

SEQ ID NO: 3358173 - RNA, 22 nt, Neisseria meningitidis Z2491
aauguccguuuucuucugaaua

SEQ ID NO: 3358174 - RNA, 15 nt, Neisseria meningitidis Z2491
aaugucggcauuuuc

SEQ ID NO: 3358175 - RNA, 16 nt, Neisseria meningitidis Z2491
aaugucggcauuuucg

SEQ ID NO: 3358176 - RNA, 16 nt, Neisseria meningitidis Z2491
aaugucuagauucccg

SEQ ID NO: 3358177 - RNA, 15 nt, Neisseria meningitidis Z2491
aaugucuucauacga

SEQ ID NO: 3358178 - RNA, 17 nt, Neisseria meningitidis Z2491
aauguguugauuaaaua

SEQ ID NO: 3358179 - RNA, 16 nt, Neisseria meningitidis Z2491
aauguguuuugaaggu

SEQ ID NO: 3358180 - RNA, 23 nt, Neisseria meningitidis Z2491
aauguucguacggguuaaucaaa

SEQ ID NO: 3358181 - RNA, 13 nt, Neisseria meningitidis Z2491
aauuaaaaacaaa

SEQ ID NO: 3358182 - RNA, 18 nt, Neisseria meningitidis Z2491
aauuaaaguuucagaauu

SEQ ID NO: 3358183 - RNA, 14 nt, Neisseria meningitidis Z2491
aauuaaauuuaaac

SEQ ID NO: 3358184 - RNA, 13 nt, Neisseria meningitidis Z2491
aauuaacaaaaau

SEQ ID NO: 3358185 - RNA, 15 nt, Neisseria meningitidis Z2491
aauuaggagguauuu

SEQ ID NO: 3358186 - RNA, 21 nt, Neisseria meningitidis Z2491
aauuauaguggauuaacaaaa

SEQ ID NO: 3358187 - RNA, 16 nt, Neisseria meningitidis Z2491
aauuauccacagagau

SEQ ID NO: 3358188 - RNA, 22 nt, Neisseria meningitidis Z2491
aauuauugccagcauuaauaua

SEQ ID NO: 3358189 - RNA, 13 nt, Neisseria meningitidis Z2491
aauucaaaaaacc

SEQ ID NO: 3358190 - RNA, 14 nt, Neisseria meningitidis Z2491
aauucaaaaaccug

SEQ ID NO: 3358191 - RNA, 13 nt, Neisseria meningitidis Z2491
aauucaacuuggu

SEQ ID NO: 3358192 - RNA, 15 nt, Neisseria meningitidis Z2491
aauucagguucguuu

SEQ ID NO: 3358193 - RNA, 23 nt, Neisseria meningitidis Z2491
aauucagguucguuuaguuucgg

SEQ ID NO: 3358194 - RNA, 14 nt, Neisseria meningitidis Z2491
aauucauagcaaaa

SEQ ID NO: 3358195 - RNA, 20 nt, Neisseria meningitidis Z2491
aauucaucgcgcugccgucg

SEQ ID NO: 3358196 - RNA, 19 nt, Neisseria meningitidis Z2491
aauuccaacauaaccgaaa

SEQ ID NO: 3358197 - RNA, 11 nt, Neisseria meningitidis Z2491
aauuccagcaa

SEQ ID NO: 3358198 - RNA, 20 nt, Neisseria meningitidis Z2491
aauucccaccguuucccauc

SEQ ID NO: 3358199 - RNA, 15 nt, Neisseria meningitidis Z2491
aauucccgccaucua

SEQ ID NO: 3358200 - RNA, 16 nt, Neisseria meningitidis Z2491
aauuccggaaucagac

SEQ ID NO: 3358201 - RNA, 18 nt, Neisseria meningitidis Z2491
aauuccuaaaacuuaaaa

SEQ ID NO: 3358202 - RNA, 15 nt, Neisseria meningitidis Z2491
aauucggcaauuuga

SEQ ID NO: 3358203 - RNA, 17 nt, Neisseria meningitidis Z2491
aauucugaaacuuuaau

SEQ ID NO: 3358204 - RNA, 18 nt, Neisseria meningitidis Z2491
aauucuucuuuccaucca

SEQ ID NO: 3358205 - RNA, 19 nt, Neisseria meningitidis Z2491
aauucuugccgcauuaaaa

SEQ ID NO: 3358206 - RNA, 21 nt, Neisseria meningitidis Z2491
aauucuugccgcauuaaaauu

SEQ ID NO: 3358207 - RNA, 16 nt, Neisseria meningitidis Z2491
aauugaaaaauuuuug

SEQ ID NO: 3358208 - RNA, 16 nt, Neisseria meningitidis Z2491
aauugaaaucaacaga

SEQ ID NO: 3358209 - RNA, 13 nt, Neisseria meningitidis Z2491
aauugaaaugccg

SEQ ID NO: 3358210 - RNA, 18 nt, Neisseria meningitidis Z2491
aauugaaaugccgucuga

SEQ ID NO: 3358211 - RNA, 21 nt, Neisseria meningitidis Z2491
aauugaagcgucccaaauauu

SEQ ID NO: 3358212 - RNA, 14 nt, Neisseria meningitidis Z2491
aauugccuucauca

SEQ ID NO: 3358213 - RNA, 21 nt, Neisseria meningitidis Z2491
aauugccuuuucccugacaaa

SEQ ID NO: 3358214 - RNA, 19 nt, Neisseria meningitidis Z2491
aauugcgccgacagcagcu

SEQ ID NO: 3358215 - RNA, 16 nt, Neisseria meningitidis Z2491
aauugcuugagauggu

SEQ ID NO: 3358216 - RNA, 16 nt, Neisseria meningitidis Z2491
aauuguccauuuuucu

SEQ ID NO: 3358217 - RNA, 15 nt, Neisseria meningitidis Z2491
aauuuaaaagggaac

SEQ ID NO: 3358218 - RNA, 19 nt, Neisseria meningitidis Z2491
aauuuaaacacuucuucau

SEQ ID NO: 3358219 - RNA, 17 nt, Neisseria meningitidis Z2491
aauuuaauccacuauaa

SEQ ID NO: 3358220 - RNA, 18 nt, Neisseria meningitidis Z2491
aauuuaauccacuauaaa

SEQ ID NO: 3358221 - RNA, 19 nt, Neisseria meningitidis Z2491
aauuuaauccacuauaaaa

SEQ ID NO: 3358222 - RNA, 21 nt, Neisseria meningitidis Z2491
aauuuaauccacuauaaaauu

SEQ ID NO: 3358223 - RNA, 17 nt, Neisseria meningitidis Z2491
aauuuaauccauuauaa

SEQ ID NO: 3358224 - RNA, 15 nt, Neisseria meningitidis Z2491
aauuuacagcuuuua

SEQ ID NO: 3358225 - RNA, 14 nt, Neisseria meningitidis Z2491
aauuuauaaacaaa

SEQ ID NO: 3358226 - RNA, 22 nt, Neisseria meningitidis Z2491
aauuuauaguggauuaacaaaa

SEQ ID NO: 3358227 - RNA, 23 nt, Neisseria meningitidis Z2491
aauuuauaguggauuaacaaaaa

SEQ ID NO: 3358228 - RNA, 13 nt, Neisseria meningitidis Z2491
aauuuauccgaaa

SEQ ID NO: 3358229 - RNA, 16 nt, Neisseria meningitidis Z2491
aauuuauccgaaacaa

SEQ ID NO: 3358230 - RNA, 22 nt, Neisseria meningitidis Z2491
aauuuauccgaagcgacaacaa

SEQ ID NO: 3358231 - RNA, 18 nt, Neisseria meningitidis Z2491
aauuuaucggaaaugacu

SEQ ID NO: 3358232 - RNA, 21 nt, Neisseria meningitidis Z2491
aauuuaucggaaaugacugaa

SEQ ID NO: 3358233 - RNA, 21 nt, Neisseria meningitidis Z2491
aauuuaucgggaaugacugaa

SEQ ID NO: 3358234 - RNA, 13 nt, Neisseria meningitidis Z2491
aauuuauuaugua

SEQ ID NO: 3358235 - RNA, 12 nt, Neisseria meningitidis Z2491
aauuuauuuaga

SEQ ID NO: 3358236 - RNA, 17 nt, Neisseria meningitidis Z2491
aauuucaauacgcaaac

SEQ ID NO: 3358237 - RNA, 20 nt, Neisseria meningitidis Z2491
aauuucaugucaucgcggau

SEQ ID NO: 3358238 - RNA, 16 nt, Neisseria meningitidis Z2491
aauuuccacaauucaa

SEQ ID NO: 3358239 - RNA, 17 nt, Neisseria meningitidis Z2491
aauuuccgaccaacucc

SEQ ID NO: 3358240 - RNA, 16 nt, Neisseria meningitidis Z2491
aauuucggaaaugcgu

SEQ ID NO: 3358241 - RNA, 15 nt, Neisseria meningitidis Z2491
aauuucgggcaacgc

SEQ ID NO: 3358242 - RNA, 13 nt, Neisseria meningitidis Z2491
aauuucuugauuu

SEQ ID NO: 3358243 - RNA, 23 nt, Neisseria meningitidis Z2491
aauuuggcuguguuucaauaugg

SEQ ID NO: 3358244 - RNA, 23 nt, Neisseria meningitidis Z2491
aauuuuagguuucugauuuugau

SEQ ID NO: 3358245 - RNA, 16 nt, Neisseria meningitidis Z2491
aauuuuauugauucaa

SEQ ID NO: 3358246 - RNA, 12 nt, Neisseria meningitidis Z2491
aauuuugcaaag

SEQ ID NO: 3358247 - RNA, 17 nt, Neisseria meningitidis Z2491
aauuuuuaaaaccguuc

SEQ ID NO: 3358248 - RNA, 20 nt, Neisseria meningitidis Z2491
aauuuuuggcgcauuuuuau

SEQ ID NO: 3358249 - RNA, 21 nt, Neisseria meningitidis Z2491
aauuuuuuggcgcauuuuuau

SEQ ID NO: 3358250 - RNA, 18 nt, Neisseria meningitidis Z2491
acaaaaaaccgcuucgga

SEQ ID NO: 3358251 - RNA, 13 nt, Neisseria meningitidis Z2491
acaaaaaagccag

SEQ ID NO: 3358252 - RNA, 13 nt, Neisseria meningitidis Z2491
acaaaaacagaaa

SEQ ID NO: 3358253 - RNA, 14 nt, Neisseria meningitidis Z2491
acaaaaacagaaaa

SEQ ID NO: 3358254 - RNA, 18 nt, Neisseria meningitidis Z2491
acaaaaacagaaaaccaa

SEQ ID NO: 3358255 - RNA, 11 nt, Neisseria meningitidis Z2491
acaaaaaccag

SEQ ID NO: 3358256 - RNA, 13 nt, Neisseria meningitidis Z2491
acaaaaaccagua

SEQ ID NO: 3358257 - RNA, 14 nt, Neisseria meningitidis Z2491
acaaaaacuuuucu

SEQ ID NO: 3358258 - RNA, 17 nt, Neisseria meningitidis Z2491
acaaaaauaccgucuga

SEQ ID NO: 3358259 - RNA, 15 nt, Neisseria meningitidis Z2491
acaaaaaugccgucu

SEQ ID NO: 3358260 - RNA, 15 nt, Neisseria meningitidis Z2491
acaaaacgcccuuuu

SEQ ID NO: 3358261 - RNA, 13 nt, Neisseria meningitidis Z2491
acaaaaucaguau

SEQ ID NO: 3358262 - RNA, 12 nt, Neisseria meningitidis Z2491
acaaaaugccgc

SEQ ID NO: 3358263 - RNA, 18 nt, Neisseria meningitidis Z2491
acaaaaugccgccgucga

SEQ ID NO: 3358264 - RNA, 13 nt, Neisseria meningitidis Z2491
acaaaaugccguc

SEQ ID NO: 3358265 - RNA, 18 nt, Neisseria meningitidis Z2491
acaaaaugccgucugaaa

SEQ ID NO: 3358266 - RNA, 19 nt, Neisseria meningitidis Z2491
acaaaaugccgucugaaaa

SEQ ID NO: 3358267 - RNA, 18 nt, Neisseria meningitidis Z2491
acaaaaugccgucugaac

SEQ ID NO: 3358268 - RNA, 21 nt, Neisseria meningitidis Z2491
acaaaauuaaaguuucagaau

SEQ ID NO: 3358269 - RNA, 21 nt, Neisseria meningitidis Z2491
acaaacaggcagccuaaaaca

SEQ ID NO: 3358270 - RNA, 19 nt, Neisseria meningitidis Z2491
acaaacaggcuucagacgg

SEQ ID NO: 3358271 - RNA, 19 nt, Neisseria meningitidis Z2491
acaaacaucugauuuuucu

SEQ ID NO: 3358272 - RNA, 15 nt, Neisseria meningitidis Z2491
acaaaccgccauucc

SEQ ID NO: 3358273 - RNA, 21 nt, Neisseria meningitidis Z2491
acaaacgccagcacaaacagc

SEQ ID NO: 3358274 - RNA, 18 nt, Neisseria meningitidis Z2491
acaaagacagaaaaccaa

SEQ ID NO: 3358275 - RNA, 18 nt, Neisseria meningitidis Z2491
acaaagccuucuucuaaa

SEQ ID NO: 3358276 - RNA, 16 nt, Neisseria meningitidis Z2491
acaaagcuuuaaacua

SEQ ID NO: 3358277 - RNA, 22 nt, Neisseria meningitidis Z2491
acaaaguuggcaaggaaugcca

SEQ ID NO: 3358278 - RNA, 15 nt, Neisseria meningitidis Z2491
acaaauaguacggaa

SEQ ID NO: 3358279 - RNA, 17 nt, Neisseria meningitidis Z2491
acaaauccacuuugucg

SEQ ID NO: 3358280 - RNA, 14 nt, Neisseria meningitidis Z2491
acaaaugccaaagg

SEQ ID NO: 3358281 - RNA, 13 nt, Neisseria meningitidis Z2491
acaaaugccgucu

SEQ ID NO: 3358282 - RNA, 14 nt, Neisseria meningitidis Z2491
acaaauuaaaauaa

SEQ ID NO: 3358283 - RNA, 20 nt, Neisseria meningitidis Z2491
acaaauuaaaauaaaaccga

SEQ ID NO: 3358284 - RNA, 12 nt, Neisseria meningitidis Z2491
acaaauucccgc

SEQ ID NO: 3358285 - RNA, 10 nt, Neisseria meningitidis Z2491
acaaauuccu

SEQ ID NO: 3358286 - RNA, 12 nt, Neisseria meningitidis Z2491
acaaauuccuaa

SEQ ID NO: 3358287 - RNA, 16 nt, Neisseria meningitidis Z2491
acaacaaauuuuugau

SEQ ID NO: 3358288 - RNA, 16 nt, Neisseria meningitidis Z2491
acaacaaugcaaagaa

SEQ ID NO: 3358289 - RNA, 12 nt, Neisseria meningitidis Z2491
acaacaggaauu

SEQ ID NO: 3358290 - RNA, 20 nt, Neisseria meningitidis Z2491
acaacccugaugaugaagua

SEQ ID NO: 3358291 - RNA, 20 nt, Neisseria meningitidis Z2491
acaagcccgcacauuccauc

SEQ ID NO: 3358292 - RNA, 21 nt, Neisseria meningitidis Z2491
acaagccguacauaaggaaca

SEQ ID NO: 3358293 - RNA, 22 nt, Neisseria meningitidis Z2491
acaagccuguuuuccugcccaa

SEQ ID NO: 3358294 - RNA, 19 nt, Neisseria meningitidis Z2491
acaagcgauuauuuuuuag

SEQ ID NO: 3358295 - RNA, 18 nt, Neisseria meningitidis Z2491
acaaggacagaaaaccaa

SEQ ID NO: 3358296 - RNA, 14 nt, Neisseria meningitidis Z2491
acaaggcuggauuc

SEQ ID NO: 3358297 - RNA, 16 nt, Neisseria meningitidis Z2491
acaagguuauuuucuu

SEQ ID NO: 3358298 - RNA, 12 nt, Neisseria meningitidis Z2491
acaaucaggaaa

SEQ ID NO: 3358299 - RNA, 15 nt, Neisseria meningitidis Z2491
acaaucaggaaaaca

SEQ ID NO: 3358300 - RNA, 22 nt, Neisseria meningitidis Z2491
acaaucaggccggcggagaaca

SEQ ID NO: 3358301 - RNA, 21 nt, Neisseria meningitidis Z2491
acaauccgcccgaauaaaaaa

SEQ ID NO: 3358302 - RNA, 22 nt, Neisseria meningitidis Z2491
acaauccgcccgaauaaaaaau

SEQ ID NO: 3358303 - RNA, 24 nt, Neisseria meningitidis Z2491
acaaucggcucgccgccuuugcga

SEQ ID NO: 3358304 - RNA, 11 nt, Neisseria meningitidis Z2491
acaaucuucca

SEQ ID NO: 3358305 - RNA, 21 nt, Neisseria meningitidis Z2491
acaaucuuuucaucgucauuc

SEQ ID NO: 3358306 - RNA, 23 nt, Neisseria meningitidis Z2491
acaaucuuuucaucgucauuccc

SEQ ID NO: 3358307 - RNA, 15 nt, Neisseria meningitidis Z2491
acaaugcaaaaacau

SEQ ID NO: 3358308 - RNA, 18 nt, Neisseria meningitidis Z2491
acaaugcaaaaacaucag

SEQ ID NO: 3358309 - RNA, 22 nt, Neisseria meningitidis Z2491
acaaugccgucugaaacgaaca

SEQ ID NO: 3358310 - RNA, 23 nt, Neisseria meningitidis Z2491
acaauuaguaaaaucaaguuuau

SEQ ID NO: 3358311 - RNA, 18 nt, Neisseria meningitidis Z2491
acaauucccaccguuucc

SEQ ID NO: 3358312 - RNA, 14 nt, Neisseria meningitidis Z2491
acacaaaaaagcca

SEQ ID NO: 3358313 - RNA, 17 nt, Neisseria meningitidis Z2491
acacaaaaaagccagca

SEQ ID NO: 3358314 - RNA, 19 nt, Neisseria meningitidis Z2491
acacaaaaaagccagcagc

SEQ ID NO: 3358315 - RNA, 18 nt, Neisseria meningitidis Z2491
acacaagguuauuuucuu

SEQ ID NO: 3358316 - RNA, 20 nt, Neisseria meningitidis Z2491
acacaauucccaccguuucc

SEQ ID NO: 3358317 - RNA, 18 nt, Neisseria meningitidis Z2491
acacacaagccguacaua

SEQ ID NO: 3358318 - RNA, 23 nt, Neisseria meningitidis Z2491
acacacaagccguacauaaggaa

SEQ ID NO: 3358319 - RNA, 15 nt, Neisseria meningitidis Z2491
acacacacguuuuau

SEQ ID NO: 3358320 - RNA, 20 nt, Neisseria meningitidis Z2491
acacacaggacgacacauaa

SEQ ID NO: 3358321 - RNA, 21 nt, Neisseria meningitidis Z2491
acacacaggacgacacauaaa

SEQ ID NO: 3358322 - RNA, 15 nt, Neisseria meningitidis Z2491
acacacgguuuucac

SEQ ID NO: 3358323 - RNA, 23 nt, Neisseria meningitidis Z2491
acacagauaccgucugaacacga

SEQ ID NO: 3358324 - RNA, 15 nt, Neisseria meningitidis Z2491
acacagccaaaaaaa

SEQ ID NO: 3358325 - RNA, 14 nt, Neisseria meningitidis Z2491
acacagccaaaaua

SEQ ID NO: 3358326 - RNA, 21 nt, Neisseria meningitidis Z2491
acacaggguucggacggcauu

SEQ ID NO: 3358327 - RNA, 18 nt, Neisseria meningitidis Z2491
acacagguauuguucagc

SEQ ID NO: 3358328 - RNA, 22 nt, Neisseria meningitidis Z2491
acacagguuuucgucuauuuuc

SEQ ID NO: 3358329 - RNA, 17 nt, Neisseria meningitidis Z2491
acacccaugccauacug

SEQ ID NO: 3358330 - RNA, 22 nt, Neisseria meningitidis Z2491
acacccauuuggagucgccuuc

SEQ ID NO: 3358331 - RNA, 19 nt, Neisseria meningitidis Z2491
acacccccgaaugacaacc

SEQ ID NO: 3358332 - RNA, 17 nt, Neisseria meningitidis Z2491
acacccccgucauuccc

SEQ ID NO: 3358333 - RNA, 14 nt, Neisseria meningitidis Z2491
acacccgccccgcc

SEQ ID NO: 3358334 - RNA, 20 nt, Neisseria meningitidis Z2491
acacccgccccgccgaucug

SEQ ID NO: 3358335 - RNA, 20 nt, Neisseria meningitidis Z2491
acacccguuaaggcagagau

SEQ ID NO: 3358336 - RNA, 14 nt, Neisseria meningitidis Z2491
acacgaacugccuc

SEQ ID NO: 3358337 - RNA, 15 nt, Neisseria meningitidis Z2491
acacgaacugccucc

SEQ ID NO: 3358338 - RNA, 14 nt, Neisseria meningitidis Z2491
acacgcaaaacaca

SEQ ID NO: 3358339 - RNA, 17 nt, Neisseria meningitidis Z2491
acacggcaaaaauuuau

SEQ ID NO: 3358340 - RNA, 20 nt, Neisseria meningitidis Z2491
acacggguucagacggcauc

SEQ ID NO: 3358341 - RNA, 18 nt, Neisseria meningitidis Z2491
acacgguucugcaccgcu

SEQ ID NO: 3358342 - RNA, 17 nt, Neisseria meningitidis Z2491
acacguuuugcagguag

SEQ ID NO: 3358343 - RNA, 23 nt, Neisseria meningitidis Z2491
acacugcccuuucacggcggcaa

SEQ ID NO: 3358344 - RNA, 18 nt, Neisseria meningitidis Z2491
acacuucacauuuucuau

SEQ ID NO: 3358345 - RNA, 19 nt, Neisseria meningitidis Z2491
acagaaaaccaaaaacaga

SEQ ID NO: 3358346 - RNA, 23 nt, Neisseria meningitidis Z2491
acagaaaaccaaaaacagaaacc

SEQ ID NO: 3358347 - RNA, 20 nt, Neisseria meningitidis Z2491
acagaaaaccaaaaucagaa

SEQ ID NO: 3358348 - RNA, 19 nt, Neisseria meningitidis Z2491
acagaaaaucaaaaacaga

SEQ ID NO: 3358349 - RNA, 17 nt, Neisseria meningitidis Z2491
acagaaaauugaaauuc

SEQ ID NO: 3358350 - RNA, 16 nt, Neisseria meningitidis Z2491
acagaaacccaaaauc

SEQ ID NO: 3358351 - RNA, 15 nt, Neisseria meningitidis Z2491
acagaaaccugaaaa

SEQ ID NO: 3358352 - RNA, 15 nt, Neisseria meningitidis Z2491
acagaaagccaaaaa

SEQ ID NO: 3358353 - RNA, 19 nt, Neisseria meningitidis Z2491
acagaaagccaaaaacaga

SEQ ID NO: 3358354 - RNA, 22 nt, Neisseria meningitidis Z2491
acagaaauaaaagcaucuuguu

SEQ ID NO: 3358355 - RNA, 17 nt, Neisseria meningitidis Z2491
acagaaugauaacccaa

SEQ ID NO: 3358356 - RNA, 19 nt, Neisseria meningitidis Z2491
acagacauugcuaaaacaa

SEQ ID NO: 3358357 - RNA, 16 nt, Neisseria meningitidis Z2491
acagacggccaaacac

SEQ ID NO: 3358358 - RNA, 15 nt, Neisseria meningitidis Z2491
acagacuauuuuugc

SEQ ID NO: 3358359 - RNA, 19 nt, Neisseria meningitidis Z2491
acagagcgccgucuccauu

SEQ ID NO: 3358360 - RNA, 13 nt, Neisseria meningitidis Z2491
acagauuuuuugc

SEQ ID NO: 3358361 - RNA, 16 nt, Neisseria meningitidis Z2491
acagcaaccugaaauu

SEQ ID NO: 3358362 - RNA, 23 nt, Neisseria meningitidis Z2491
acagcaacuuuuccgcgucauuc

SEQ ID NO: 3358363 - RNA, 12 nt, Neisseria meningitidis Z2491
acagcacugccu

SEQ ID NO: 3358364 - RNA, 13 nt, Neisseria meningitidis Z2491
acagcacugccuc

SEQ ID NO: 3358365 - RNA, 14 nt, Neisseria meningitidis Z2491
acagcacugccucu

SEQ ID NO: 3358366 - RNA, 20 nt, Neisseria meningitidis Z2491
acagcacugccucuuuucag

SEQ ID NO: 3358367 - RNA, 13 nt, Neisseria meningitidis Z2491
acagcagcagccc

SEQ ID NO: 3358368 - RNA, 18 nt, Neisseria meningitidis Z2491
acagcagcgaaggcgcga

SEQ ID NO: 3358369 - RNA, 20 nt, Neisseria meningitidis Z2491
acagcauauagccgagcauc

SEQ ID NO: 3358370 - RNA, 14 nt, Neisseria meningitidis Z2491
acagcauccuuucc

SEQ ID NO: 3358371 - RNA, 21 nt, Neisseria meningitidis Z2491
acagcauccuuuccucuuuca

SEQ ID NO: 3358372 - RNA, 15 nt, Neisseria meningitidis Z2491
acagcauuugcgguu

SEQ ID NO: 3358373 - RNA, 22 nt, Neisseria meningitidis Z2491
acagccaaaaaaaagccguccg

SEQ ID NO: 3358374 - RNA, 23 nt, Neisseria meningitidis Z2491
acagccccuaaauuuaaaccagu

SEQ ID NO: 3358375 - RNA, 20 nt, Neisseria meningitidis Z2491
acagccgaaacccaaacaca

SEQ ID NO: 3358376 - RNA, 19 nt, Neisseria meningitidis Z2491
acagccuacuugcccgccu

SEQ ID NO: 3358377 - RNA, 23 nt, Neisseria meningitidis Z2491
acagccuacuugcccgccuucag

SEQ ID NO: 3358378 - RNA, 20 nt, Neisseria meningitidis Z2491
acagcggccgccaucaaaaa

SEQ ID NO: 3358379 - RNA, 15 nt, Neisseria meningitidis Z2491
acagcuuaaaauccu

SEQ ID NO: 3358380 - RNA, 18 nt, Neisseria meningitidis Z2491
acagcuugagauuucgcg

SEQ ID NO: 3358381 - RNA, 16 nt, Neisseria meningitidis Z2491
acaggacaaaaauccu

SEQ ID NO: 3358382 - RNA, 18 nt, Neisseria meningitidis Z2491
acaggacgacacauaaag

SEQ ID NO: 3358383 - RNA, 23 nt, Neisseria meningitidis Z2491
acaggauucguggaugcuuugca

SEQ ID NO: 3358384 - RNA, 19 nt, Neisseria meningitidis Z2491
acaggcagccuaaaacauc

SEQ ID NO: 3358385 - RNA, 20 nt, Neisseria meningitidis Z2491
acaggcggauuugaaguuuc

SEQ ID NO: 3358386 - RNA, 14 nt, Neisseria meningitidis Z2491
acaggcggcggcau

SEQ ID NO: 3358387 - RNA, 19 nt, Neisseria meningitidis Z2491
acaggcguuguucggauuu

SEQ ID NO: 3358388 - RNA, 12 nt, Neisseria meningitidis Z2491
acaggcuucaga

SEQ ID NO: 3358389 - RNA, 19 nt, Neisseria meningitidis Z2491
acaggcuucagacggcauu

SEQ ID NO: 3358390 - RNA, 18 nt, Neisseria meningitidis Z2491
acagggaaagcagcagcc

SEQ ID NO: 3358391 - RNA, 20 nt, Neisseria meningitidis Z2491
acaggucggacauuugacuu

SEQ ID NO: 3358392 - RNA, 16 nt, Neisseria meningitidis Z2491
acagguucaaacacau

SEQ ID NO: 3358393 - RNA, 23 nt, Neisseria meningitidis Z2491
acagguucaaacacaucgcuuuc

SEQ ID NO: 3358394 - RNA, 21 nt, Neisseria meningitidis Z2491
acaguacaaauaguacggaac

SEQ ID NO: 3358395 - RNA, 21 nt, Neisseria meningitidis Z2491
acaguacaaauaguacggcaa

SEQ ID NO: 3358396 - RNA, 14 nt, Neisseria meningitidis Z2491
acaguacagauagu

SEQ ID NO: 3358397 - RNA, 14 nt, Neisseria meningitidis Z2491
acaguguuucagac

SEQ ID NO: 3358398 - RNA, 16 nt, Neisseria meningitidis Z2491
acaguucuuugauguu

SEQ ID NO: 3358399 - RNA, 15 nt, Neisseria meningitidis Z2491
acaguuuaaucccuu

SEQ ID NO: 3358400 - RNA, 12 nt, Neisseria meningitidis Z2491
acauaaaugccg

SEQ ID NO: 3358401 - RNA, 15 nt, Neisseria meningitidis Z2491
acauaaaugccgucu

SEQ ID NO: 3358402 - RNA, 14 nt, Neisseria meningitidis Z2491
acauagauggggau

SEQ ID NO: 3358403 - RNA, 14 nt, Neisseria meningitidis Z2491
accgccaucaggaa

SEQ ID NO: 3358404 - RNA, 18 nt, Neisseria meningitidis Z2491
accgccaucaggaaugca

SEQ ID NO: 3358405 - RNA, 19 nt, Neisseria meningitidis Z2491
accgccauuccccggcauc

SEQ ID NO: 3358406 - RNA, 19 nt, Neisseria meningitidis Z2491
accgccccgucauucccgc

SEQ ID NO: 3358407 - RNA, 18 nt, Neisseria meningitidis Z2491
accgccccuaaaaugccc

SEQ ID NO: 3358408 - RNA, 22 nt, Neisseria meningitidis Z2491
accgccugcgcgcggacggauu

SEQ ID NO: 3358409 - RNA, 14 nt, Neisseria meningitidis Z2491
accgcgcugcucgg

SEQ ID NO: 3358410 - RNA, 18 nt, Neisseria meningitidis Z2491
accgcuucggaacguuga

SEQ ID NO: 3358411 - RNA, 19 nt, Neisseria meningitidis Z2491
accgcuugacgcuaccgca

SEQ ID NO: 3358412 - RNA, 19 nt, Neisseria meningitidis Z2491
accgcuuucgcauccccga

SEQ ID NO: 3358413 - RNA, 21 nt, Neisseria meningitidis Z2491
accggcacaggcucaaacagc

SEQ ID NO: 3358414 - RNA, 22 nt, Neisseria meningitidis Z2491
accggcuguguuuaucuuuucu

SEQ ID NO: 3358415 - RNA, 16 nt, Neisseria meningitidis Z2491
accgguccuuccauca

SEQ ID NO: 3358416 - RNA, 20 nt, Neisseria meningitidis Z2491
accggucuaaaugccgucaa

SEQ ID NO: 3358417 - RNA, 19 nt, Neisseria meningitidis Z2491
accgguuugguuuucaaaa

SEQ ID NO: 3358418 - RNA, 24 nt, Neisseria meningitidis Z2491
accgguuuguauuugaugcguuuc

SEQ ID NO: 3358419 - RNA, 18 nt, Neisseria meningitidis Z2491
accguaucaaacaagaaa

SEQ ID NO: 3358420 - RNA, 17 nt, Neisseria meningitidis Z2491
accgucaaacaaaaugc

SEQ ID NO: 3358421 - RNA, 21 nt, Neisseria meningitidis Z2491
accgucaaaccgaugccguca

SEQ ID NO: 3358422 - RNA, 18 nt, Neisseria meningitidis Z2491
accgucauucccacgaaa

SEQ ID NO: 3358423 - RNA, 14 nt, Neisseria meningitidis Z2491
accgucauucccgc

SEQ ID NO: 3358424 - RNA, 19 nt, Neisseria meningitidis Z2491
accguccacaagccgccga

SEQ ID NO: 3358425 - RNA, 20 nt, Neisseria meningitidis Z2491
accgucggcagugauuuccc

SEQ ID NO: 3358426 - RNA, 20 nt, Neisseria meningitidis Z2491
accgucguuuuuuuccugcc

SEQ ID NO: 3358427 - RNA, 16 nt, Neisseria meningitidis Z2491
accgucugaaaccugc

SEQ ID NO: 3358428 - RNA, 20 nt, Neisseria meningitidis Z2491
accgugcgcugucaaacccu

SEQ ID NO: 3358429 - RNA, 12 nt, Neisseria meningitidis Z2491
accgugucggcg

SEQ ID NO: 3358430 - RNA, 14 nt, Neisseria meningitidis Z2491
accguuauggaaau

SEQ ID NO: 3358431 - RNA, 16 nt, Neisseria meningitidis Z2491
accguuauggaaaugu

SEQ ID NO: 3358432 - RNA, 17 nt, Neisseria meningitidis Z2491
accguuauggaaauguc

SEQ ID NO: 3358433 - RNA, 17 nt, Neisseria meningitidis Z2491
accguuccgaaaccaag

SEQ ID NO: 3358434 - RNA, 23 nt, Neisseria meningitidis Z2491
accguugcgugucuucgccgacc

SEQ ID NO: 3358435 - RNA, 16 nt, Neisseria meningitidis Z2491
accguuucagacggca

SEQ ID NO: 3358436 - RNA, 13 nt, Neisseria meningitidis Z2491
accguuucccauc

SEQ ID NO: 3358437 - RNA, 15 nt, Neisseria meningitidis Z2491
accuaaaauccguca

SEQ ID NO: 3358438 - RNA, 12 nt, Neisseria meningitidis Z2491
accuaccgccua

SEQ ID NO: 3358439 - RNA, 14 nt, Neisseria meningitidis Z2491
accuagauucccgc

SEQ ID NO: 3358440 - RNA, 17 nt, Neisseria meningitidis Z2491
accucauugccgcccgu

SEQ ID NO: 3358441 - RNA, 18 nt, Neisseria meningitidis Z2491
accucgccgcgcgucagc

SEQ ID NO: 3358442 - RNA, 20 nt, Neisseria meningitidis Z2491
accucgucauucccgcaaaa

SEQ ID NO: 3358443 - RNA, 19 nt, Neisseria meningitidis Z2491
accucguucggacggcauu

SEQ ID NO: 3358444 - RNA, 14 nt, Neisseria meningitidis Z2491
accugaaaacagaa

SEQ ID NO: 3358445 - RNA, 20 nt, Neisseria meningitidis Z2491
accugaaaggcacaacgagc

SEQ ID NO: 3358446 - RNA, 22 nt, Neisseria meningitidis Z2491
accugaaauaugguucagacgg

SEQ ID NO: 3358447 - RNA, 14 nt, Neisseria meningitidis Z2491
accugacaguaacc

SEQ ID NO: 3358448 - RNA, 14 nt, Neisseria meningitidis Z2491
accugcaaaacauc

SEQ ID NO: 3358449 - RNA, 21 nt, Neisseria meningitidis Z2491
accugcugcccaugaagagga

SEQ ID NO: 3358450 - RNA, 13 nt, Neisseria meningitidis Z2491
accuguaaaauau

SEQ ID NO: 3358451 - RNA, 20 nt, Neisseria meningitidis Z2491
accuguaccguuucagacgg

SEQ ID NO: 3358452 - RNA, 21 nt, Neisseria meningitidis Z2491
accuguaccguuucagacggc

SEQ ID NO: 3358453 - RNA, 18 nt, Neisseria meningitidis Z2491
accuguuuuucaaagccc

SEQ ID NO: 3358454 - RNA, 16 nt, Neisseria meningitidis Z2491
accuuaacaaucacua

SEQ ID NO: 3358455 - RNA, 18 nt, Neisseria meningitidis Z2491
accuuagagaaucguucu

SEQ ID NO: 3358456 - RNA, 21 nt, Neisseria meningitidis Z2491
accuuagagaaucguucucuu

SEQ ID NO: 3358457 - RNA, 21 nt, Neisseria meningitidis Z2491
accuucguaauuuuucuccau

SEQ ID NO: 3358458 - RNA, 12 nt, Neisseria meningitidis Z2491
accuuguuugau

SEQ ID NO: 3358459 - RNA, 22 nt, Neisseria meningitidis Z2491
accuuucagacggcauuuuuau

SEQ ID NO: 3358460 - RNA, 22 nt, Neisseria meningitidis Z2491
accuuucccguuucagacggca

SEQ ID NO: 3358461 - RNA, 23 nt, Neisseria meningitidis Z2491
accuuucccguuucagacggcau

SEQ ID NO: 3358462 - RNA, 14 nt, Neisseria meningitidis Z2491
accuuugcaaaaau

SEQ ID NO: 3358463 - RNA, 17 nt, Neisseria meningitidis Z2491
acgaaaaguugcaagaa

SEQ ID NO: 3358464 - RNA, 20 nt, Neisseria meningitidis Z2491
acgaaaaguugcaagaauga

SEQ ID NO: 3358465 - RNA, 22 nt, Neisseria meningitidis Z2491
acgaaagugggaaucuagaaau

SEQ ID NO: 3358466 - RNA, 16 nt, Neisseria meningitidis Z2491
acgaaccuacauuccg

SEQ ID NO: 3358467 - RNA, 22 nt, Neisseria meningitidis Z2491
acgaaccuacauuccgucauuc

SEQ ID NO: 3358468 - RNA, 21 nt, Neisseria meningitidis Z2491
acgaagcccucagcuaugccu

SEQ ID NO: 3358469 - RNA, 13 nt, Neisseria meningitidis Z2491
acgaagccgcaga

SEQ ID NO: 3358470 - RNA, 14 nt, Neisseria meningitidis Z2491
acgaagccgcagac

SEQ ID NO: 3358471 - RNA, 18 nt, Neisseria meningitidis Z2491
acgaagccgcagacagua

SEQ ID NO: 3358472 - RNA, 21 nt, Neisseria meningitidis Z2491
acgaagccgcagacaguacaa

SEQ ID NO: 3358473 - RNA, 18 nt, Neisseria meningitidis Z2491
acgaaucuuauccacaga

SEQ ID NO: 3358474 - RNA, 22 nt, Neisseria meningitidis Z2491
acgaauuucaugucaucgcgga

SEQ ID NO: 3358475 - RNA, 17 nt, Neisseria meningitidis Z2491
acgaccaacgccgccga

SEQ ID NO: 3358476 - RNA, 21 nt, Neisseria meningitidis Z2491
acgaccaacgccgccgacauc

SEQ ID NO: 3358477 - RNA, 20 nt, Neisseria meningitidis Z2491
acgaccagugcgccggcaua

SEQ ID NO: 3358478 - RNA, 22 nt, Neisseria meningitidis Z2491
acgaccauuuccaaugacugcg

SEQ ID NO: 3358479 - RNA, 16 nt, Neisseria meningitidis Z2491
acgaccuuugcuuuuc

SEQ ID NO: 3358480 - RNA, 19 nt, Neisseria meningitidis Z2491
acgacgaccaucguccaac

SEQ ID NO: 3358481 - RNA, 15 nt, Neisseria meningitidis Z2491
acgacgagaauuuau

SEQ ID NO: 3358482 - RNA, 22 nt, Neisseria meningitidis Z2491
acgacgagaauuuaucagaaau

SEQ ID NO: 3358483 - RNA, 17 nt, Neisseria meningitidis Z2491
acgacgcggcugcugcc

SEQ ID NO: 3358484 - RNA, 12 nt, Neisseria meningitidis Z2491
acgagauuuuag

SEQ ID NO: 3358485 - RNA, 14 nt, Neisseria meningitidis Z2491
acgagccguaaccg

SEQ ID NO: 3358486 - RNA, 17 nt, Neisseria meningitidis Z2491
acgagucagaaguuacu

SEQ ID NO: 3358487 - RNA, 22 nt, Neisseria meningitidis Z2491
acgagucagaaguuacucgaaa

SEQ ID NO: 3358488 - RNA, 16 nt, Neisseria meningitidis Z2491
acgaugaguuuuuugc

SEQ ID NO: 3358489 - RNA, 22 nt, Neisseria meningitidis Z2491
acgaugcuggcggggcuuucga

SEQ ID NO: 3358490 - RNA, 22 nt, Neisseria meningitidis Z2491
acgauuuggaaauuacccgaaa

SEQ ID NO: 3358491 - RNA, 12 nt, Neisseria meningitidis Z2491
acgauuuugugc

SEQ ID NO: 3358492 - RNA, 23 nt, Neisseria meningitidis Z2491
acgcaaacuaacuuauacacacg

SEQ ID NO: 3358493 - RNA, 16 nt, Neisseria meningitidis Z2491
acgcaaagcugcaaga

SEQ ID NO: 3358494 - RNA, 13 nt, Neisseria meningitidis Z2491
acgcacuggauuc

SEQ ID NO: 3358495 - RNA, 13 nt, Neisseria meningitidis Z2491
acgcauaaaaaug

SEQ ID NO: 3358496 - RNA, 14 nt, Neisseria meningitidis Z2491
acgccaauuuguau

SEQ ID NO: 3358497 - RNA, 17 nt, Neisseria meningitidis Z2491
acgccagcaacauuucc

SEQ ID NO: 3358498 - RNA, 15 nt, Neisseria meningitidis Z2491
acgccauuuguucgc

SEQ ID NO: 3358499 - RNA, 18 nt, Neisseria meningitidis Z2491
acgcccuuuuguaaagga

SEQ ID NO: 3358500 - RNA, 18 nt, Neisseria meningitidis Z2491
acgccgggcaagacgaag

SEQ ID NO: 3358501 - RNA, 14 nt, Neisseria meningitidis Z2491
acgccgucugaaau

SEQ ID NO: 3358502 - RNA, 15 nt, Neisseria meningitidis Z2491
acgccgucugaaauu

SEQ ID NO: 3358503 - RNA, 20 nt, Neisseria meningitidis Z2491
acgccguguuucaaggcggc

SEQ ID NO: 3358504 - RNA, 16 nt, Neisseria meningitidis Z2491
acuaaaugccaaucuc

SEQ ID NO: 3358505 - RNA, 16 nt, Neisseria meningitidis Z2491
acuaacuuauacacac

SEQ ID NO: 3358506 - RNA, 14 nt, Neisseria meningitidis Z2491
acuacgcggcugaa

SEQ ID NO: 3358507 - RNA, 13 nt, Neisseria meningitidis Z2491
acuagauucccgc

SEQ ID NO: 3358508 - RNA, 13 nt, Neisseria meningitidis Z2491
acuaguguauuag

SEQ ID NO: 3358509 - RNA, 12 nt, Neisseria meningitidis Z2491
acuauaaaaaau

SEQ ID NO: 3358510 - RNA, 18 nt, Neisseria meningitidis Z2491
acuauaaaaaaucccugu

SEQ ID NO: 3358511 - RNA, 19 nt, Neisseria meningitidis Z2491
acuauaaaaggucuuuucu

SEQ ID NO: 3358512 - RNA, 11 nt, Neisseria meningitidis Z2491
acuauaaaauu

SEQ ID NO: 3358513 - RNA, 14 nt, Neisseria meningitidis Z2491
acuauaucagacgg

SEQ ID NO: 3358514 - RNA, 15 nt, Neisseria meningitidis Z2491
acuauaucauugcuu

SEQ ID NO: 3358515 - RNA, 22 nt, Neisseria meningitidis Z2491
acuaucuguacugucugcggcu

SEQ ID NO: 3358516 - RNA, 19 nt, Neisseria meningitidis Z2491
acuauuaccgguauuuuuu

SEQ ID NO: 3358517 - RNA, 22 nt, Neisseria meningitidis Z2491
acuauuuguacugucugcagcu

SEQ ID NO: 3358518 - RNA, 14 nt, Neisseria meningitidis Z2491
acuauuuuugcaaa

SEQ ID NO: 3358519 - RNA, 13 nt, Neisseria meningitidis Z2491
acuauuuuuuaau

SEQ ID NO: 3358520 - RNA, 14 nt, Neisseria meningitidis Z2491
acucaaaaaaccgg

SEQ ID NO: 3358521 - RNA, 17 nt, Neisseria meningitidis Z2491
acucaaagcugcaagaa

SEQ ID NO: 3358522 - RNA, 17 nt, Neisseria meningitidis Z2491
acucacuuugcucagcc

SEQ ID NO: 3358523 - RNA, 15 nt, Neisseria meningitidis Z2491
acucauucaauccuc

SEQ ID NO: 3358524 - RNA, 16 nt, Neisseria meningitidis Z2491
acuccaaaccuuuggc

SEQ ID NO: 3358525 - RNA, 20 nt, Neisseria meningitidis Z2491
acuccgccucgccuuucgua

SEQ ID NO: 3358526 - RNA, 15 nt, Neisseria meningitidis Z2491
acuccugcugcggcg

SEQ ID NO: 3358527 - RNA, 15 nt, Neisseria meningitidis Z2491
acuccuguuuuuaac

SEQ ID NO: 3358528 - RNA, 20 nt, Neisseria meningitidis Z2491
acucuaaucccgucauuccc

SEQ ID NO: 3358529 - RNA, 16 nt, Neisseria meningitidis Z2491
acucuccgucauuccc

SEQ ID NO: 3358530 - RNA, 19 nt, Neisseria meningitidis Z2491
acucuccgucauucccacg

SEQ ID NO: 3358531 - RNA, 12 nt, Neisseria meningitidis Z2491
acucuuucgggc

SEQ ID NO: 3358532 - RNA, 15 nt, Neisseria meningitidis Z2491
acugaaacucaaaaa

SEQ ID NO: 3358533 - RNA, 15 nt, Neisseria meningitidis Z2491
acugaaacucaacga

SEQ ID NO: 3358534 - RNA, 15 nt, Neisseria meningitidis Z2491
acugaaauaucguca

SEQ ID NO: 3358535 - RNA, 18 nt, Neisseria meningitidis Z2491
acugaaauaucgucauuc

SEQ ID NO: 3358536 - RNA, 19 nt, Neisseria meningitidis Z2491
acugaaauaucgucauucc

SEQ ID NO: 3358537 - RNA, 13 nt, Neisseria meningitidis Z2491
acugaagcucaaa

SEQ ID NO: 3358538 - RNA, 21 nt, Neisseria meningitidis Z2491
acugagaccuuugcaauaaca

SEQ ID NO: 3358539 - RNA, 19 nt, Neisseria meningitidis Z2491
acugauuguuuuucagaga

SEQ ID NO: 3358540 - RNA, 23 nt, Neisseria meningitidis Z2491
acugcaagaacagcagcagaguu

SEQ ID NO: 3358541 - RNA, 15 nt, Neisseria meningitidis Z2491
acugccagccgccga

SEQ ID NO: 3358542 - RNA, 19 nt, Neisseria meningitidis Z2491
acugccgcaaacggcaggc

SEQ ID NO: 3358543 - RNA, 21 nt, Neisseria meningitidis Z2491
acugccgcaaacggcaggcaa

SEQ ID NO: 3358544 - RNA, 16 nt, Neisseria meningitidis Z2491
acugccgccgcgccug

SEQ ID NO: 3358545 - RNA, 18 nt, Neisseria meningitidis Z2491
acugccucuuuucagaca

SEQ ID NO: 3358546 - RNA, 22 nt, Neisseria meningitidis Z2491
acugcucgaucggcugccaauc

SEQ ID NO: 3358547 - RNA, 22 nt, Neisseria meningitidis Z2491
acugcucgccacauaauucaaa

SEQ ID NO: 3358548 - RNA, 19 nt, Neisseria meningitidis Z2491
acugcuguugcaaagccug

SEQ ID NO: 3358549 - RNA, 23 nt, Neisseria meningitidis Z2491
acugcuuccguguguauagugga

SEQ ID NO: 3358550 - RNA, 11 nt, Neisseria meningitidis Z2491
acugguuuaaa

SEQ ID NO: 3358551 - RNA, 16 nt, Neisseria meningitidis Z2491
acugguuuaaauuuaa

SEQ ID NO: 3358552 - RNA, 16 nt, Neisseria meningitidis Z2491
acugguuuuuguuaau

SEQ ID NO: 3358553 - RNA, 21 nt, Neisseria meningitidis Z2491
acuguauugggaugauuuugu

SEQ ID NO: 3358554 - RNA, 16 nt, Neisseria meningitidis Z2491
acuguccgagacagaa

SEQ ID NO: 3358555 - RNA, 14 nt, Neisseria meningitidis Z2491
acugucugcagcuu

SEQ ID NO: 3358556 - RNA, 13 nt, Neisseria meningitidis Z2491
acugucugcggcu

SEQ ID NO: 3358557 - RNA, 14 nt, Neisseria meningitidis Z2491
acugucugcggcuc

SEQ ID NO: 3358558 - RNA, 19 nt, Neisseria meningitidis Z2491
acugugucgccgacuuugc

SEQ ID NO: 3358559 - RNA, 21 nt, Neisseria meningitidis Z2491
acuuaaaauuccguuauuccc

SEQ ID NO: 3358560 - RNA, 14 nt, Neisseria meningitidis Z2491
acuuaagaaacaaa

SEQ ID NO: 3358561 - RNA, 15 nt, Neisseria meningitidis Z2491
acuuaagaaacaaag

SEQ ID NO: 3358562 - RNA, 23 nt, Neisseria meningitidis Z2491
acuuaagaaacaaagcuuuaaac

SEQ ID NO: 3358563 - RNA, 22 nt, Neisseria meningitidis Z2491
acuuauuuaucaaaacagucca

SEQ ID NO: 3358564 - RNA, 16 nt, Neisseria meningitidis Z2491
acuucaaaccccuuca

SEQ ID NO: 3358565 - RNA, 14 nt, Neisseria meningitidis Z2491
acuucaauaguggg

SEQ ID NO: 3358566 - RNA, 15 nt, Neisseria meningitidis Z2491
acuucagacggcauu

SEQ ID NO: 3358567 - RNA, 20 nt, Neisseria meningitidis Z2491
acuuccaaaccgccauuccc

SEQ ID NO: 3358568 - RNA, 18 nt, Neisseria meningitidis Z2491
acuuccagcgcaccucca

SEQ ID NO: 3358569 - RNA, 22 nt, Neisseria meningitidis Z2491
acuuccugauugaccgaaaaau

SEQ ID NO: 3358570 - RNA, 22 nt, Neisseria meningitidis Z2491
acuucuucacgaguccaagaca

SEQ ID NO: 3358571 - RNA, 15 nt, Neisseria meningitidis Z2491
acuugaaggcguguu

SEQ ID NO: 3358572 - RNA, 19 nt, Neisseria meningitidis Z2491
acuuggcaaaaucuggauu

SEQ ID NO: 3358573 - RNA, 15 nt, Neisseria meningitidis Z2491
acuuggugcuucagc

SEQ ID NO: 3358574 - RNA, 17 nt, Neisseria meningitidis Z2491
acuuggugcuucagcac

SEQ ID NO: 3358575 - RNA, 16 nt, Neisseria meningitidis Z2491
acuugucgcagcugcu

SEQ ID NO: 3358576 - RNA, 17 nt, Neisseria meningitidis Z2491
acuugucgcagcugcuc

SEQ ID NO: 3358577 - RNA, 21 nt, Neisseria meningitidis Z2491
acuugucgcagcugcucagac

SEQ ID NO: 3358578 - RNA, 21 nt, Neisseria meningitidis Z2491
acuuuaaucauguugccguca

SEQ ID NO: 3358579 - RNA, 20 nt, Neisseria meningitidis Z2491
acuuuaaucccgucauuccc

SEQ ID NO: 3358580 - RNA, 13 nt, Neisseria meningitidis Z2491
acuuuaauuuugu

SEQ ID NO: 3358581 - RNA, 12 nt, Neisseria meningitidis Z2491
acuuuaucccca

SEQ ID NO: 3358582 - RNA, 20 nt, Neisseria meningitidis Z2491
acuuuaucugacgcguuuua

SEQ ID NO: 3358583 - RNA, 15 nt, Neisseria meningitidis Z2491
acuuucaucgcuuga

SEQ ID NO: 3358584 - RNA, 21 nt, Neisseria meningitidis Z2491
acuuugcacuugcugaacaaa

SEQ ID NO: 3358585 - RNA, 17 nt, Neisseria meningitidis Z2491
acuuugcggcagauaca

SEQ ID NO: 3358586 - RNA, 13 nt, Neisseria meningitidis Z2491
acuuugcguucac

SEQ ID NO: 3358587 - RNA, 17 nt, Neisseria meningitidis Z2491
acuuugcucagcccgaa

SEQ ID NO: 3358588 - RNA, 15 nt, Neisseria meningitidis Z2491
acuuuggaacaaaaa

SEQ ID NO: 3358589 - RNA, 16 nt, Neisseria meningitidis Z2491
acuuuggaacaaaaaa

SEQ ID NO: 3358590 - RNA, 14 nt, Neisseria meningitidis Z2491
acuuugucgcccaa

SEQ ID NO: 3358591 - RNA, 14 nt, Neisseria meningitidis Z2491
acuuuguuucaaaa

SEQ ID NO: 3358592 - RNA, 19 nt, Neisseria meningitidis Z2491
acuuuuccgcgucauuccc

SEQ ID NO: 3358593 - RNA, 18 nt, Neisseria meningitidis Z2491
acuuuucugauuuuuccu

SEQ ID NO: 3358594 - RNA, 20 nt, Neisseria meningitidis Z2491
acuuuugagccgucauuccc

SEQ ID NO: 3358595 - RNA, 15 nt, Neisseria meningitidis Z2491
agaaaaacaaguuuu

SEQ ID NO: 3358596 - RNA, 13 nt, Neisseria meningitidis Z2491
agaaaaacagcaa

SEQ ID NO: 3358597 - RNA, 14 nt, Neisseria meningitidis Z2491
agaaaaacaucccg

SEQ ID NO: 3358598 - RNA, 22 nt, Neisseria meningitidis Z2491
agaaaaaggguuugacagcgca

SEQ ID NO: 3358599 - RNA, 10 nt, Neisseria meningitidis Z2491
agaaaacaga

SEQ ID NO: 3358600 - RNA, 11 nt, Neisseria meningitidis Z2491
agaaaacagaa

SEQ ID NO: 3358601 - RNA, 12 nt, Neisseria meningitidis Z2491
agaaaacagaaa

SEQ ID NO: 3358602 - RNA, 13 nt, Neisseria meningitidis Z2491
agaaaaccaaaaa

SEQ ID NO: 3358603 - RNA, 17 nt, Neisseria meningitidis Z2491
agaaaaccaaaaucaga

SEQ ID NO: 3358604 - RNA, 20 nt, Neisseria meningitidis Z2491
agaaaaccaaaaucagaaac

SEQ ID NO: 3358605 - RNA, 13 nt, Neisseria meningitidis Z2491
agaaaacgccguc

SEQ ID NO: 3358606 - RNA, 23 nt, Neisseria meningitidis Z2491
agauucccgccuucgcgggaaug

SEQ ID NO: 3358607 - RNA, 16 nt, Neisseria meningitidis Z2491
agauucccgcuuucac

SEQ ID NO: 3358608 - RNA, 15 nt, Neisseria meningitidis Z2491
agauucccgcuuucg

SEQ ID NO: 3358609 - RNA, 23 nt, Neisseria meningitidis Z2491
agauucccgcuuuugcgggaaug

SEQ ID NO: 3358610 - RNA, 14 nt, Neisseria meningitidis Z2491
agauuccggcggcu

SEQ ID NO: 3358611 - RNA, 23 nt, Neisseria meningitidis Z2491
agauuggauuuggcuuaaaaauc

SEQ ID NO: 3358612 - RNA, 15 nt, Neisseria meningitidis Z2491
agauugucaaaauac

SEQ ID NO: 3358613 - RNA, 23 nt, Neisseria meningitidis Z2491
agauuguuucccaguuccuccac

SEQ ID NO: 3358614 - RNA, 20 nt, Neisseria meningitidis Z2491
agauuuccgccgucauuccc

SEQ ID NO: 3358615 - RNA, 15 nt, Neisseria meningitidis Z2491
agauuugcaaucgau

SEQ ID NO: 3358616 - RNA, 15 nt, Neisseria meningitidis Z2491
agauuuuggagcagu

SEQ ID NO: 3358617 - RNA, 23 nt, Neisseria meningitidis Z2491
agauuuuggagcaguaaaauuua

SEQ ID NO: 3358618 - RNA, 21 nt, Neisseria meningitidis Z2491
agauuuuuuuauuuaaacagc

SEQ ID NO: 3358619 - RNA, 14 nt, Neisseria meningitidis Z2491
agcaaaaaaugccg

SEQ ID NO: 3358620 - RNA, 18 nt, Neisseria meningitidis Z2491
agcaaaaccgccgauggc

SEQ ID NO: 3358621 - RNA, 19 nt, Neisseria meningitidis Z2491
agcaaaauaaaaugccguc

SEQ ID NO: 3358622 - RNA, 13 nt, Neisseria meningitidis Z2491
agcaaaauauggc

SEQ ID NO: 3358623 - RNA, 19 nt, Neisseria meningitidis Z2491
agcaaaauauggcugacua

SEQ ID NO: 3358624 - RNA, 16 nt, Neisseria meningitidis Z2491
agcaaaaucagcacaa

SEQ ID NO: 3358625 - RNA, 23 nt, Neisseria meningitidis Z2491
agcaaacgguauuggaugcgguc

SEQ ID NO: 3358626 - RNA, 15 nt, Neisseria meningitidis Z2491
agcaaaucgaugcgu

SEQ ID NO: 3358627 - RNA, 16 nt, Neisseria meningitidis Z2491
agcaaaugccgucuga

SEQ ID NO: 3358628 - RNA, 11 nt, Neisseria meningitidis Z2491
agcaacagaaa

SEQ ID NO: 3358629 - RNA, 15 nt, Neisseria meningitidis Z2491
agcaacauuuccugc

SEQ ID NO: 3358630 - RNA, 22 nt, Neisseria meningitidis Z2491
agcaacccugucgccgucauuc

SEQ ID NO: 3358631 - RNA, 22 nt, Neisseria meningitidis Z2491
agcaaccugaaauucgucauuc

SEQ ID NO: 3358632 - RNA, 15 nt, Neisseria meningitidis Z2491
agcaacgacagcagc

SEQ ID NO: 3358633 - RNA, 19 nt, Neisseria meningitidis Z2491
agcaacgacagcagcagcc

SEQ ID NO: 3358634 - RNA, 23 nt, Neisseria meningitidis Z2491
agcaacuuuuccgcgucauuccc

SEQ ID NO: 3358635 - RNA, 16 nt, Neisseria meningitidis Z2491
agcaagaccaaacaga

SEQ ID NO: 3358636 - RNA, 12 nt, Neisseria meningitidis Z2491
agcaauaaaaua

SEQ ID NO: 3358637 - RNA, 15 nt, Neisseria meningitidis Z2491
agcaauaaaauaaag

SEQ ID NO: 3358638 - RNA, 15 nt, Neisseria meningitidis Z2491
agcaaucaucucuuc

SEQ ID NO: 3358639 - RNA, 20 nt, Neisseria meningitidis Z2491
agcacagccuauuuuucuga

SEQ ID NO: 3358640 - RNA, 18 nt, Neisseria meningitidis Z2491
agcaccaaguaaaucggu

SEQ ID NO: 3358641 - RNA, 12 nt, Neisseria meningitidis Z2491
agcaccaguucg

SEQ ID NO: 3358642 - RNA, 20 nt, Neisseria meningitidis Z2491
agcaccguuuaaaacagcau

SEQ ID NO: 3358643 - RNA, 17 nt, Neisseria meningitidis Z2491
agcaccuuagagaaucg

SEQ ID NO: 3358644 - RNA, 18 nt, Neisseria meningitidis Z2491
agcaccuuagagaaucgu

SEQ ID NO: 3358645 - RNA, 15 nt, Neisseria meningitidis Z2491
agcacgcggugcugc

SEQ ID NO: 3358646 - RNA, 14 nt, Neisseria meningitidis Z2491
agcagaaucaaaua

SEQ ID NO: 3358647 - RNA, 23 nt, Neisseria meningitidis Z2491
agcagaugaagcugcaacugaaa

SEQ ID NO: 3358648 - RNA, 22 nt, Neisseria meningitidis Z2491
agcagcuuuugcgccacggcau

SEQ ID NO: 3358649 - RNA, 14 nt, Neisseria meningitidis Z2491
agcaggaaggcggc

SEQ ID NO: 3358650 - RNA, 14 nt, Neisseria meningitidis Z2491
agcaggcacaaggc

SEQ ID NO: 3358651 - RNA, 18 nt, Neisseria meningitidis Z2491
agcaggcguuuuucagac

SEQ ID NO: 3358652 - RNA, 22 nt, Neisseria meningitidis Z2491
agcaggggaauuaacuuuccuu

SEQ ID NO: 3358653 - RNA, 12 nt, Neisseria meningitidis Z2491
agcaguaaaauu

SEQ ID NO: 3358654 - RNA, 20 nt, Neisseria meningitidis Z2491
agcaguaaaauuuauuaugu

SEQ ID NO: 3358655 - RNA, 22 nt, Neisseria meningitidis Z2491
agcaguauagugaauuaaauuu

SEQ ID NO: 3358656 - RNA, 20 nt, Neisseria meningitidis Z2491
agcagugcgcguuaaagguc

SEQ ID NO: 3358657 - RNA, 17 nt, Neisseria meningitidis Z2491
agcaguuugaugccgug

SEQ ID NO: 3358658 - RNA, 18 nt, Neisseria meningitidis Z2491
agcaguuugaugccgugu

SEQ ID NO: 3358659 - RNA, 11 nt, Neisseria meningitidis Z2491
agcaguuuuuc

SEQ ID NO: 3358660 - RNA, 15 nt, Neisseria meningitidis Z2491
agcaguuuuucaaau

SEQ ID NO: 3358661 - RNA, 19 nt, Neisseria meningitidis Z2491
agcauaagccgccaucaaa

SEQ ID NO: 3358662 - RNA, 20 nt, Neisseria meningitidis Z2491
agcaucuuguuuuucaauca

SEQ ID NO: 3358663 - RNA, 23 nt, Neisseria meningitidis Z2491
agcaugguuaagagauuggcauu

SEQ ID NO: 3358664 - RNA, 16 nt, Neisseria meningitidis Z2491
agcauugcaauccuca

SEQ ID NO: 3358665 - RNA, 18 nt, Neisseria meningitidis Z2491
agccaaaaaaaagccguc

SEQ ID NO: 3358666 - RNA, 16 nt, Neisseria meningitidis Z2491
agccaaaauauucaau

SEQ ID NO: 3358667 - RNA, 16 nt, Neisseria meningitidis Z2491
agccaagcaagcaacg

SEQ ID NO: 3358668 - RNA, 17 nt, Neisseria meningitidis Z2491
agccacgccaaaaaugc

SEQ ID NO: 3358669 - RNA, 21 nt, Neisseria meningitidis Z2491
agccacgccaaaaaugcggcc

SEQ ID NO: 3358670 - RNA, 22 nt, Neisseria meningitidis Z2491
agccacgccaaaaaugcggccg

SEQ ID NO: 3358671 - RNA, 15 nt, Neisseria meningitidis Z2491
agcccaaucccgcaa

SEQ ID NO: 3358672 - RNA, 16 nt, Neisseria meningitidis Z2491
agcccaaucccgcaac

SEQ ID NO: 3358673 - RNA, 14 nt, Neisseria meningitidis Z2491
agccccaccauugu

SEQ ID NO: 3358674 - RNA, 21 nt, Neisseria meningitidis Z2491
agcccgccccggcugguguug

SEQ ID NO: 3358675 - RNA, 20 nt, Neisseria meningitidis Z2491
agcccgcugccgaaaccaaa

SEQ ID NO: 3358676 - RNA, 17 nt, Neisseria meningitidis Z2491
agcccgucuaugccgag

SEQ ID NO: 3358677 - RNA, 14 nt, Neisseria meningitidis Z2491
agcccgugccgccg

SEQ ID NO: 3358678 - RNA, 15 nt, Neisseria meningitidis Z2491
agcccuaucacgcuc

SEQ ID NO: 3358679 - RNA, 21 nt, Neisseria meningitidis Z2491
agcccugauaaaaaauauggc

SEQ ID NO: 3358680 - RNA, 12 nt, Neisseria meningitidis Z2491
agcccuuucaga

SEQ ID NO: 3358681 - RNA, 17 nt, Neisseria meningitidis Z2491
agcccuuucagacggca

SEQ ID NO: 3358682 - RNA, 18 nt, Neisseria meningitidis Z2491
agcccuuucagacggcau

SEQ ID NO: 3358683 - RNA, 19 nt, Neisseria meningitidis Z2491
agcccuuucagacggcauu

SEQ ID NO: 3358684 - RNA, 19 nt, Neisseria meningitidis Z2491
agccgaaacccaaacacag

SEQ ID NO: 3358685 - RNA, 18 nt, Neisseria meningitidis Z2491
agccgaaugauucauaaa

SEQ ID NO: 3358686 - RNA, 22 nt, Neisseria meningitidis Z2491
agccgaaugauucauaaaauau

SEQ ID NO: 3358687 - RNA, 15 nt, Neisseria meningitidis Z2491
agccgacuuuuucca

SEQ ID NO: 3358688 - RNA, 12 nt, Neisseria meningitidis Z2491
agccgcaaagac

SEQ ID NO: 3358689 - RNA, 18 nt, Neisseria meningitidis Z2491
agccgcaaugccgucuga

SEQ ID NO: 3358690 - RNA, 17 nt, Neisseria meningitidis Z2491
agccgcccaaugccguc

SEQ ID NO: 3358691 - RNA, 18 nt, Neisseria meningitidis Z2491
agccgccuccaucagcac

SEQ ID NO: 3358692 - RNA, 16 nt, Neisseria meningitidis Z2491
agccgccuccgaacgg

SEQ ID NO: 3358693 - RNA, 21 nt, Neisseria meningitidis Z2491
agccgcucgcguauccagccg

SEQ ID NO: 3358694 - RNA, 19 nt, Neisseria meningitidis Z2491
agccggcggcaacaaugcc

SEQ ID NO: 3358695 - RNA, 16 nt, Neisseria meningitidis Z2491
agccguagacaguaca

SEQ ID NO: 3358696 - RNA, 17 nt, Neisseria meningitidis Z2491
agccguccgaacccaaa

SEQ ID NO: 3358697 - RNA, 17 nt, Neisseria meningitidis Z2491
agccguccguaagccuu

SEQ ID NO: 3358698 - RNA, 14 nt, Neisseria meningitidis Z2491
agccuaaaacauca

SEQ ID NO: 3358699 - RNA, 15 nt, Neisseria meningitidis Z2491
agccuaaaacaucaa

SEQ ID NO: 3358700 - RNA, 19 nt, Neisseria meningitidis Z2491
agccuaaaacgccuuugag

SEQ ID NO: 3358701 - RNA, 18 nt, Neisseria meningitidis Z2491
agccuaauguacuucugg

SEQ ID NO: 3358702 - RNA, 13 nt, Neisseria meningitidis Z2491
agccuaucaucag

SEQ ID NO: 3358703 - RNA, 14 nt, Neisseria meningitidis Z2491
agccuaucaucaga

SEQ ID NO: 3358704 - RNA, 17 nt, Neisseria meningitidis Z2491
agccuccgacugcucgg

SEQ ID NO: 3358705 - RNA, 18 nt, Neisseria meningitidis Z2491
agccuccugccaaugccu

SEQ ID NO: 3358706 - RNA, 16 nt, Neisseria meningitidis Z2491
agccucgucauuucca

SEQ ID NO: 3358707 - RNA, 16 nt, Neisseria meningitidis Z2491
aggcgguaggaugugg

SEQ ID NO: 3358708 - RNA, 19 nt, Neisseria meningitidis Z2491
aggcguauaaagauacaag

SEQ ID NO: 3358709 - RNA, 17 nt, Neisseria meningitidis Z2491
aggcguguuugccgcga

SEQ ID NO: 3358710 - RNA, 20 nt, Neisseria meningitidis Z2491
aggcucuuggauucggauuu

SEQ ID NO: 3358711 - RNA, 18 nt, Neisseria meningitidis Z2491
aggcugcauucgagcagg

SEQ ID NO: 3358712 - RNA, 20 nt, Neisseria meningitidis Z2491
aggcugccgcacaagcccua

SEQ ID NO: 3358713 - RNA, 12 nt, Neisseria meningitidis Z2491
aggcugccguca

SEQ ID NO: 3358714 - RNA, 15 nt, Neisseria meningitidis Z2491
aggcuggaaaacagc

SEQ ID NO: 3358715 - RNA, 17 nt, Neisseria meningitidis Z2491
aggcuggaaaacagcug

SEQ ID NO: 3358716 - RNA, 17 nt, Neisseria meningitidis Z2491
aggcuggggauguuuug

SEQ ID NO: 3358717 - RNA, 20 nt, Neisseria meningitidis Z2491
aggcuguaugccgucugaaa

SEQ ID NO: 3358718 - RNA, 20 nt, Neisseria meningitidis Z2491
aggcuguggagcaugaguuc

SEQ ID NO: 3358719 - RNA, 15 nt, Neisseria meningitidis Z2491
aggcuucagacggca

SEQ ID NO: 3358720 - RNA, 19 nt, Neisseria meningitidis Z2491
aggcuucgagugcuucguc

SEQ ID NO: 3358721 - RNA, 12 nt, Neisseria meningitidis Z2491
aggcuuucagac

SEQ ID NO: 3358722 - RNA, 16 nt, Neisseria meningitidis Z2491
aggcuuucagacggcc

SEQ ID NO: 3358723 - RNA, 14 nt, Neisseria meningitidis Z2491
aggcuuucagauag

SEQ ID NO: 3358724 - RNA, 17 nt, Neisseria meningitidis Z2491
aggcuuuguuauuuuua

SEQ ID NO: 3358725 - RNA, 18 nt, Neisseria meningitidis Z2491
aggcuuuuucagacggca

SEQ ID NO: 3358726 - RNA, 20 nt, Neisseria meningitidis Z2491
aggcuuuuucagacggcauu

SEQ ID NO: 3358727 - RNA, 19 nt, Neisseria meningitidis Z2491
aggcuuuuucgccagcauc

SEQ ID NO: 3358728 - RNA, 22 nt, Neisseria meningitidis Z2491
aggcuuuuuucuguuuggcuuu

SEQ ID NO: 3358729 - RNA, 13 nt, Neisseria meningitidis Z2491
agggaaagcagca

SEQ ID NO: 3358730 - RNA, 14 nt, Neisseria meningitidis Z2491
agggaaagcagcag

SEQ ID NO: 3358731 - RNA, 16 nt, Neisseria meningitidis Z2491
agggaaagcagcagcc

SEQ ID NO: 3358732 - RNA, 21 nt, Neisseria meningitidis Z2491
agggaaagcccgucagcacgg

SEQ ID NO: 3358733 - RNA, 19 nt, Neisseria meningitidis Z2491
agggauaauucauacaaau

SEQ ID NO: 3358734 - RNA, 15 nt, Neisseria meningitidis Z2491
agggcacagucggca

SEQ ID NO: 3358735 - RNA, 17 nt, Neisseria meningitidis Z2491
agggcacagucggcaua

SEQ ID NO: 3358736 - RNA, 15 nt, Neisseria meningitidis Z2491
agggcaguuccaaag

SEQ ID NO: 3358737 - RNA, 18 nt, Neisseria meningitidis Z2491
agggcaguugggaaucaa

SEQ ID NO: 3358738 - RNA, 13 nt, Neisseria meningitidis Z2491
agggcgcaccgcg

SEQ ID NO: 3358739 - RNA, 15 nt, Neisseria meningitidis Z2491
agggcgcaccgcgca

SEQ ID NO: 3358740 - RNA, 15 nt, Neisseria meningitidis Z2491
agggcggauugcaga

SEQ ID NO: 3358741 - RNA, 16 nt, Neisseria meningitidis Z2491
agggcuuuugccagcg

SEQ ID NO: 3358742 - RNA, 19 nt, Neisseria meningitidis Z2491
aggggguauuuggguagaa

SEQ ID NO: 3358743 - RNA, 23 nt, Neisseria meningitidis Z2491
aggguaauuuauccgaaauaaca

SEQ ID NO: 3358744 - RNA, 13 nt, Neisseria meningitidis Z2491
agggugguuucug

SEQ ID NO: 3358745 - RNA, 16 nt, Neisseria meningitidis Z2491
aggguguuugccggga

SEQ ID NO: 3358746 - RNA, 16 nt, Neisseria meningitidis Z2491
aggguuuucuucgccg

SEQ ID NO: 3358747 - RNA, 14 nt, Neisseria meningitidis Z2491
agguaaaaaauaga

SEQ ID NO: 3358748 - RNA, 14 nt, Neisseria meningitidis Z2491
agguaacgguuuuu

SEQ ID NO: 3358749 - RNA, 14 nt, Neisseria meningitidis Z2491
agguaaggagcagg

SEQ ID NO: 3358750 - RNA, 13 nt, Neisseria meningitidis Z2491
agguagcggcuga

SEQ ID NO: 3358751 - RNA, 20 nt, Neisseria meningitidis Z2491
agguagcggcugagggcuuc

SEQ ID NO: 3358752 - RNA, 22 nt, Neisseria meningitidis Z2491
agguauuuggggcgaaaacagc

SEQ ID NO: 3358753 - RNA, 15 nt, Neisseria meningitidis Z2491
agguauuuugcgccg

SEQ ID NO: 3358754 - RNA, 21 nt, Neisseria meningitidis Z2491
aggucgaaauauugccagccc

SEQ ID NO: 3358755 - RNA, 17 nt, Neisseria meningitidis Z2491
aggucgaacugccugcc

SEQ ID NO: 3358756 - RNA, 13 nt, Neisseria meningitidis Z2491
aggucgucugaaa

SEQ ID NO: 3358757 - RNA, 22 nt, Neisseria meningitidis Z2491
aggucucagacuauuucggcac

SEQ ID NO: 3358758 - RNA, 22 nt, Neisseria meningitidis Z2491
aggucuugcagguggaauucuu

SEQ ID NO: 3358759 - RNA, 22 nt, Neisseria meningitidis Z2491
aggugcagguuuuuuugauuca

SEQ ID NO: 3358760 - RNA, 17 nt, Neisseria meningitidis Z2491
agguuacuuugacuuuu

SEQ ID NO: 3358761 - RNA, 20 nt, Neisseria meningitidis Z2491
agguuagcugaagcuuuaga

SEQ ID NO: 3358762 - RNA, 16 nt, Neisseria meningitidis Z2491
agguuauggggauuua

SEQ ID NO: 3358763 - RNA, 22 nt, Neisseria meningitidis Z2491
agguucagcaggaaggcggcaa

SEQ ID NO: 3358764 - RNA, 14 nt, Neisseria meningitidis Z2491
agguucagucauuu

SEQ ID NO: 3358765 - RNA, 22 nt, Neisseria meningitidis Z2491
agguugcgucugccuucuucuu

SEQ ID NO: 3358766 - RNA, 16 nt, Neisseria meningitidis Z2491
agguuuccgugcggau

SEQ ID NO: 3358767 - RNA, 17 nt, Neisseria meningitidis Z2491
agguuuucagacggcau

SEQ ID NO: 3358768 - RNA, 18 nt, Neisseria meningitidis Z2491
agguuuuguuuuuccaaa

SEQ ID NO: 3358769 - RNA, 14 nt, Neisseria meningitidis Z2491
aguaaaugccgucu

SEQ ID NO: 3358770 - RNA, 14 nt, Neisseria meningitidis Z2491
aguaauaaauuaau

SEQ ID NO: 3358771 - RNA, 20 nt, Neisseria meningitidis Z2491
aguacaaaaugccgucugaa

SEQ ID NO: 3358772 - RNA, 19 nt, Neisseria meningitidis Z2491
aguacaaauaguacagaac

SEQ ID NO: 3358773 - RNA, 19 nt, Neisseria meningitidis Z2491
aguacagccccuuaaaguu

SEQ ID NO: 3358774 - RNA, 21 nt, Neisseria meningitidis Z2491
aguacgcgcugugcaaagaaa

SEQ ID NO: 3358775 - RNA, 12 nt, Neisseria meningitidis Z2491
aguacgcgggca

SEQ ID NO: 3358776 - RNA, 20 nt, Neisseria meningitidis Z2491
aguacggaaccgauucacuu

SEQ ID NO: 3358777 - RNA, 20 nt, Neisseria meningitidis Z2491
aguacggaaucgauucacuu

SEQ ID NO: 3358778 - RNA, 15 nt, Neisseria meningitidis Z2491
aguacggcaaggcga

SEQ ID NO: 3358779 - RNA, 19 nt, Neisseria meningitidis Z2491
aguacggcaaggcgaggca

SEQ ID NO: 3358780 - RNA, 20 nt, Neisseria meningitidis Z2491
aguacgguaaggcgaggcaa

SEQ ID NO: 3358781 - RNA, 15 nt, Neisseria meningitidis Z2491
aguacucauuuuucg

SEQ ID NO: 3358782 - RNA, 18 nt, Neisseria meningitidis Z2491
aguacugcaaggcgaggc

SEQ ID NO: 3358783 - RNA, 20 nt, Neisseria meningitidis Z2491
aguagaaauggacgacgcgg

SEQ ID NO: 3358784 - RNA, 22 nt, Neisseria meningitidis Z2491
aguauaguggauuaacaaaaau

SEQ ID NO: 3358785 - RNA, 17 nt, Neisseria meningitidis Z2491
aguauguauaaugccca

SEQ ID NO: 3358786 - RNA, 18 nt, Neisseria meningitidis Z2491
agucaugcccaaaagcag

SEQ ID NO: 3358787 - RNA, 18 nt, Neisseria meningitidis Z2491
agucccguuugaaaacaa

SEQ ID NO: 3358788 - RNA, 17 nt, Neisseria meningitidis Z2491
aguccgauaaaauccgg

SEQ ID NO: 3358789 - RNA, 20 nt, Neisseria meningitidis Z2491
aguccugccugcgcgagaau

SEQ ID NO: 3358790 - RNA, 16 nt, Neisseria meningitidis Z2491
aguccuuguuucacca

SEQ ID NO: 3358791 - RNA, 16 nt, Neisseria meningitidis Z2491
agucgaucaguuugca

SEQ ID NO: 3358792 - RNA, 16 nt, Neisseria meningitidis Z2491
agucggugcuuuggca

SEQ ID NO: 3358793 - RNA, 23 nt, Neisseria meningitidis Z2491
agucuaucaguucuacacccaaa

SEQ ID NO: 3358794 - RNA, 11 nt, Neisseria meningitidis Z2491
agucugauucu

SEQ ID NO: 3358795 - RNA, 15 nt, Neisseria meningitidis Z2491
agucugcgaaacaga

SEQ ID NO: 3358796 - RNA, 19 nt, Neisseria meningitidis Z2491
agugaauuaaauuuaaacc

SEQ ID NO: 3358797 - RNA, 17 nt, Neisseria meningitidis Z2491
agugauggcaagcuuuu

SEQ ID NO: 3358798 - RNA, 11 nt, Neisseria meningitidis Z2491
agugauuuccc

SEQ ID NO: 3358799 - RNA, 16 nt, Neisseria meningitidis Z2491
agugccgccaaagugc

SEQ ID NO: 3358800 - RNA, 20 nt, Neisseria meningitidis Z2491
agugcgaugacgaagccgaa

SEQ ID NO: 3358801 - RNA, 19 nt, Neisseria meningitidis Z2491
agugcguacgcaggcuggg

SEQ ID NO: 3358802 - RNA, 13 nt, Neisseria meningitidis Z2491
aguggaacagaaa

SEQ ID NO: 3358803 - RNA, 15 nt, Neisseria meningitidis Z2491
aguggaacagaaagc

SEQ ID NO: 3358804 - RNA, 16 nt, Neisseria meningitidis Z2491
aguggaacagaaagca

SEQ ID NO: 3358805 - RNA, 17 nt, Neisseria meningitidis Z2491
aguggauuaaauuuaaa

SEQ ID NO: 3358806 - RNA, 18 nt, Neisseria meningitidis Z2491
aguggauuaacaaaaacc

SEQ ID NO: 3358807 - RNA, 16 nt, Neisseria meningitidis Z2491
aguggauuaauaaaaa

SEQ ID NO: 3358808 - RNA, 16 nt, Neisseria meningitidis Z2491
auacaaaaaugccguc

SEQ ID NO: 3358809 - RNA, 15 nt, Neisseria meningitidis Z2491
auacaaaaggccguc

SEQ ID NO: 3358810 - RNA, 15 nt, Neisseria meningitidis Z2491
auacaaaaugccguc

SEQ ID NO: 3358811 - RNA, 18 nt, Neisseria meningitidis Z2491
auacaaaaugccgucuga

SEQ ID NO: 3358812 - RNA, 21 nt, Neisseria meningitidis Z2491
auacaaaaugccgucugaaac

SEQ ID NO: 3358813 - RNA, 19 nt, Neisseria meningitidis Z2491
auacaaacaggcuucagac

SEQ ID NO: 3358814 - RNA, 19 nt, Neisseria meningitidis Z2491
auacaacaaaaugccgccu

SEQ ID NO: 3358815 - RNA, 22 nt, Neisseria meningitidis Z2491
auacaagaacuuuauccccagc

SEQ ID NO: 3358816 - RNA, 13 nt, Neisseria meningitidis Z2491
auacacaaaaaag

SEQ ID NO: 3358817 - RNA, 18 nt, Neisseria meningitidis Z2491
auacacaaaaaagccagc

SEQ ID NO: 3358818 - RNA, 20 nt, Neisseria meningitidis Z2491
auacacaagguuauuuucuu

SEQ ID NO: 3358819 - RNA, 23 nt, Neisseria meningitidis Z2491
auacacuguaaucucaaaucccg

SEQ ID NO: 3358820 - RNA, 15 nt, Neisseria meningitidis Z2491
auacacuuaaaaaua

SEQ ID NO: 3358821 - RNA, 15 nt, Neisseria meningitidis Z2491
auacauagcaggcau

SEQ ID NO: 3358822 - RNA, 22 nt, Neisseria meningitidis Z2491
auacauaggguuaauaucagau

SEQ ID NO: 3358823 - RNA, 18 nt, Neisseria meningitidis Z2491
auacauaucgagguuguu

SEQ ID NO: 3358824 - RNA, 16 nt, Neisseria meningitidis Z2491
auacaucaucuuauuu

SEQ ID NO: 3358825 - RNA, 16 nt, Neisseria meningitidis Z2491
auacaucccgucauuc

SEQ ID NO: 3358826 - RNA, 17 nt, Neisseria meningitidis Z2491
auacaucccgucauucc

SEQ ID NO: 3358827 - RNA, 17 nt, Neisseria meningitidis Z2491
auacaucgcgcccaucg

SEQ ID NO: 3358828 - RNA, 20 nt, Neisseria meningitidis Z2491
auacaucuugaguugauaau

SEQ ID NO: 3358829 - RNA, 12 nt, Neisseria meningitidis Z2491
auaccaaaccgc

SEQ ID NO: 3358830 - RNA, 21 nt, Neisseria meningitidis Z2491
auaccauaaauuuuaaauaaa

SEQ ID NO: 3358831 - RNA, 16 nt, Neisseria meningitidis Z2491
auacccaaugcgccga

SEQ ID NO: 3358832 - RNA, 12 nt, Neisseria meningitidis Z2491
auacccucucaa

SEQ ID NO: 3358833 - RNA, 15 nt, Neisseria meningitidis Z2491
auacccucucaaacg

SEQ ID NO: 3358834 - RNA, 23 nt, Neisseria meningitidis Z2491
auaccgcaaccugaaaggcacaa

SEQ ID NO: 3358835 - RNA, 14 nt, Neisseria meningitidis Z2491
auaccgucugaaac

SEQ ID NO: 3358836 - RNA, 18 nt, Neisseria meningitidis Z2491
auaccguuuggcggcauu

SEQ ID NO: 3358837 - RNA, 17 nt, Neisseria meningitidis Z2491
auaccuaaagccguccg

SEQ ID NO: 3358838 - RNA, 13 nt, Neisseria meningitidis Z2491
auaccuccuaauu

SEQ ID NO: 3358839 - RNA, 16 nt, Neisseria meningitidis Z2491
auaccuccuaauucua

SEQ ID NO: 3358840 - RNA, 18 nt, Neisseria meningitidis Z2491
auaccugcaaugccgucu

SEQ ID NO: 3358841 - RNA, 21 nt, Neisseria meningitidis Z2491
auacgaugccgucugaacaca

SEQ ID NO: 3358842 - RNA, 14 nt, Neisseria meningitidis Z2491
auacgcaaaacaaa

SEQ ID NO: 3358843 - RNA, 23 nt, Neisseria meningitidis Z2491
auacgcaaacuaacuuauacaca

SEQ ID NO: 3358844 - RNA, 17 nt, Neisseria meningitidis Z2491
auacggacgggaaguuu

SEQ ID NO: 3358845 - RNA, 20 nt, Neisseria meningitidis Z2491
auacggugucuucaauuccu

SEQ ID NO: 3358846 - RNA, 21 nt, Neisseria meningitidis Z2491
auacuacgcggcugaaaaaau

SEQ ID NO: 3358847 - RNA, 21 nt, Neisseria meningitidis Z2491
auacucugcggacuuaagaaa

SEQ ID NO: 3358848 - RNA, 12 nt, Neisseria meningitidis Z2491
auacugccgucg

SEQ ID NO: 3358849 - RNA, 18 nt, Neisseria meningitidis Z2491
auacugccgucggcguuu

SEQ ID NO: 3358850 - RNA, 20 nt, Neisseria meningitidis Z2491
auacugccuguaaaaccaag

SEQ ID NO: 3358851 - RNA, 13 nt, Neisseria meningitidis Z2491
auacugcugaagu

SEQ ID NO: 3358852 - RNA, 22 nt, Neisseria meningitidis Z2491
auacuguccggcaugauuuucu

SEQ ID NO: 3358853 - RNA, 12 nt, Neisseria meningitidis Z2491
auacuuaacaau

SEQ ID NO: 3358854 - RNA, 22 nt, Neisseria meningitidis Z2491
auagaaagggaauccuuucugu

SEQ ID NO: 3358855 - RNA, 20 nt, Neisseria meningitidis Z2491
auagacaucucgaauuuuuu

SEQ ID NO: 3358856 - RNA, 13 nt, Neisseria meningitidis Z2491
auagacauuuuuu

SEQ ID NO: 3358857 - RNA, 14 nt, Neisseria meningitidis Z2491
auagcaaaauaaaa

SEQ ID NO: 3358858 - RNA, 17 nt, Neisseria meningitidis Z2491
auagcaugguuaagaga

SEQ ID NO: 3358859 - RNA, 19 nt, Neisseria meningitidis Z2491
auagccgaccgccauaccg

SEQ ID NO: 3358860 - RNA, 14 nt, Neisseria meningitidis Z2491
auagccgccccaau

SEQ ID NO: 3358861 - RNA, 21 nt, Neisseria meningitidis Z2491
auagccgccgccgaaggggcu

SEQ ID NO: 3358862 - RNA, 16 nt, Neisseria meningitidis Z2491
auagcgagacggcauc

SEQ ID NO: 3358863 - RNA, 19 nt, Neisseria meningitidis Z2491
auagcgcggacggcggcag

SEQ ID NO: 3358864 - RNA, 16 nt, Neisseria meningitidis Z2491
auagcugaaacucaac

SEQ ID NO: 3358865 - RNA, 20 nt, Neisseria meningitidis Z2491
auagcugaacugcuugaauu

SEQ ID NO: 3358866 - RNA, 13 nt, Neisseria meningitidis Z2491
auaggacaaaugc

SEQ ID NO: 3358867 - RNA, 15 nt, Neisseria meningitidis Z2491
auaggacaaaugccg

SEQ ID NO: 3358868 - RNA, 15 nt, Neisseria meningitidis Z2491
auaggauuugccauc

SEQ ID NO: 3358869 - RNA, 18 nt, Neisseria meningitidis Z2491
auagguuacuaaaauuuu

SEQ ID NO: 3358870 - RNA, 16 nt, Neisseria meningitidis Z2491
auaguaauaaauuaau

SEQ ID NO: 3358871 - RNA, 13 nt, Neisseria meningitidis Z2491
auaguauagugga

SEQ ID NO: 3358872 - RNA, 23 nt, Neisseria meningitidis Z2491
auagucaggcugccuuauguaua

SEQ ID NO: 3358873 - RNA, 17 nt, Neisseria meningitidis Z2491
auagugccgucaaauua

SEQ ID NO: 3358874 - RNA, 17 nt, Neisseria meningitidis Z2491
auaguggauuaaauuua

SEQ ID NO: 3358875 - RNA, 15 nt, Neisseria meningitidis Z2491
auaguggauuaacaa

SEQ ID NO: 3358876 - RNA, 16 nt, Neisseria meningitidis Z2491
auaguggauuaacaaa

SEQ ID NO: 3358877 - RNA, 17 nt, Neisseria meningitidis Z2491
auaguggauuaacaaaa

SEQ ID NO: 3358878 - RNA, 18 nt, Neisseria meningitidis Z2491
auaguggauuaacaaaaa

SEQ ID NO: 3358879 - RNA, 23 nt, Neisseria meningitidis Z2491
auaguggauuaacaaaaaccagu

SEQ ID NO: 3358880 - RNA, 21 nt, Neisseria meningitidis Z2491
auaguggauuaacaaaaauca

SEQ ID NO: 3358881 - RNA, 22 nt, Neisseria meningitidis Z2491
auaguggauuaacaaaaaucag

SEQ ID NO: 3358882 - RNA, 13 nt, Neisseria meningitidis Z2491
auaguugccguca

SEQ ID NO: 3358883 - RNA, 23 nt, Neisseria meningitidis Z2491
auauaaaaaaugccguccgaaca

SEQ ID NO: 3358884 - RNA, 23 nt, Neisseria meningitidis Z2491
auauaacgacuguaaagauaaau

SEQ ID NO: 3358885 - RNA, 20 nt, Neisseria meningitidis Z2491
auauaauccggagcagaauc

SEQ ID NO: 3358886 - RNA, 15 nt, Neisseria meningitidis Z2491
auauacaaaaugccg

SEQ ID NO: 3358887 - RNA, 14 nt, Neisseria meningitidis Z2491
auauacaucgcgcc

SEQ ID NO: 3358888 - RNA, 14 nt, Neisseria meningitidis Z2491
auauagacauuuuu

SEQ ID NO: 3358889 - RNA, 20 nt, Neisseria meningitidis Z2491
auauaguggauuaaauuuaa

SEQ ID NO: 3358890 - RNA, 21 nt, Neisseria meningitidis Z2491
auauaguggauuaaauuuaaa

SEQ ID NO: 3358891 - RNA, 22 nt, Neisseria meningitidis Z2491
auauaguggauuaaauuuaaac

SEQ ID NO: 3358892 - RNA, 20 nt, Neisseria meningitidis Z2491
auauaguggauuaaauuuau

SEQ ID NO: 3358893 - RNA, 21 nt, Neisseria meningitidis Z2491
auauaguggauuaacaaaaau

SEQ ID NO: 3358894 - RNA, 13 nt, Neisseria meningitidis Z2491
auauagugguuuu

SEQ ID NO: 3358895 - RNA, 15 nt, Neisseria meningitidis Z2491
auauaguuacacaca

SEQ ID NO: 3358896 - RNA, 16 nt, Neisseria meningitidis Z2491
auauaguuacacacac

SEQ ID NO: 3358897 - RNA, 19 nt, Neisseria meningitidis Z2491
auauauugggcaacaccau

SEQ ID NO: 3358898 - RNA, 12 nt, Neisseria meningitidis Z2491
auaucagacgga

SEQ ID NO: 3358899 - RNA, 15 nt, Neisseria meningitidis Z2491
auauccggcgcggca

SEQ ID NO: 3358900 - RNA, 17 nt, Neisseria meningitidis Z2491
auauccggcuccuaucc

SEQ ID NO: 3358901 - RNA, 16 nt, Neisseria meningitidis Z2491
auaucgccucauacag

SEQ ID NO: 3358902 - RNA, 23 nt, Neisseria meningitidis Z2491
auaucgggacgcugcgguacaag

SEQ ID NO: 3358903 - RNA, 17 nt, Neisseria meningitidis Z2491
auaucuucuccgaccua

SEQ ID NO: 3358904 - RNA, 19 nt, Neisseria meningitidis Z2491
auaugcagagaccuuugca

SEQ ID NO: 3358905 - RNA, 19 nt, Neisseria meningitidis Z2491
auaugcaggucgugcgccg

SEQ ID NO: 3358906 - RNA, 18 nt, Neisseria meningitidis Z2491
auaugccgucauucccgc

SEQ ID NO: 3358907 - RNA, 11 nt, Neisseria meningitidis Z2491
auaugccgucu

SEQ ID NO: 3358908 - RNA, 13 nt, Neisseria meningitidis Z2491
auaugccgucuga

SEQ ID NO: 3358909 - RNA, 14 nt, Neisseria meningitidis Z2491
aucccaauauuaag

SEQ ID NO: 3358910 - RNA, 18 nt, Neisseria meningitidis Z2491
aucccacgggacuuugcg

SEQ ID NO: 3358911 - RNA, 19 nt, Neisseria meningitidis Z2491
aucccauaaaaacgggaau

SEQ ID NO: 3358912 - RNA, 22 nt, Neisseria meningitidis Z2491
aucccauuauuuucacaaaaac

SEQ ID NO: 3358913 - RNA, 18 nt, Neisseria meningitidis Z2491
aucccggacuuucagaua

SEQ ID NO: 3358914 - RNA, 19 nt, Neisseria meningitidis Z2491
aucccgucauucccgcgca

SEQ ID NO: 3358915 - RNA, 16 nt, Neisseria meningitidis Z2491
aucccguuauuuucac

SEQ ID NO: 3358916 - RNA, 14 nt, Neisseria meningitidis Z2491
auccgaaacaacaa

SEQ ID NO: 3358917 - RNA, 18 nt, Neisseria meningitidis Z2491
auccgaccagagcggcau

SEQ ID NO: 3358918 - RNA, 19 nt, Neisseria meningitidis Z2491
auccgaccagagcggcauu

SEQ ID NO: 3358919 - RNA, 17 nt, Neisseria meningitidis Z2491
auccgcaaacggcagca

SEQ ID NO: 3358920 - RNA, 17 nt, Neisseria meningitidis Z2491
auccgcacagaaaccug

SEQ ID NO: 3358921 - RNA, 22 nt, Neisseria meningitidis Z2491
auccgcagacguucggcaaaau

SEQ ID NO: 3358922 - RNA, 21 nt, Neisseria meningitidis Z2491
auccgcccgaauaaaaaauau

SEQ ID NO: 3358923 - RNA, 23 nt, Neisseria meningitidis Z2491
auccgccggcaauauugcuccug

SEQ ID NO: 3358924 - RNA, 17 nt, Neisseria meningitidis Z2491
auccgccugucuuugcg

SEQ ID NO: 3358925 - RNA, 18 nt, Neisseria meningitidis Z2491
auccgcuuaaaaaacaac

SEQ ID NO: 3358926 - RNA, 18 nt, Neisseria meningitidis Z2491
auccggcaagaauuuuua

SEQ ID NO: 3358927 - RNA, 14 nt, Neisseria meningitidis Z2491
auccgggauuuuaa

SEQ ID NO: 3358928 - RNA, 22 nt, Neisseria meningitidis Z2491
auccgguuggucggcuucuuuu

SEQ ID NO: 3358929 - RNA, 20 nt, Neisseria meningitidis Z2491
auccgguuuuuugaguuuca

SEQ ID NO: 3358930 - RNA, 15 nt, Neisseria meningitidis Z2491
auccgucauucccgc

SEQ ID NO: 3358931 - RNA, 18 nt, Neisseria meningitidis Z2491
auccguuuggaugccguc

SEQ ID NO: 3358932 - RNA, 20 nt, Neisseria meningitidis Z2491
auccguuuggaugccgucug

SEQ ID NO: 3358933 - RNA, 21 nt, Neisseria meningitidis Z2491
auccguuuggaugccgucuga

SEQ ID NO: 3358934 - RNA, 22 nt, Neisseria meningitidis Z2491
auccguuugguuuuauagugga

SEQ ID NO: 3358935 - RNA, 22 nt, Neisseria meningitidis Z2491
auccucaucguucaacagcagc

SEQ ID NO: 3358936 - RNA, 13 nt, Neisseria meningitidis Z2491
auccuccaccauu

SEQ ID NO: 3358937 - RNA, 16 nt, Neisseria meningitidis Z2491
auccuccaccauuucu

SEQ ID NO: 3358938 - RNA, 22 nt, Neisseria meningitidis Z2491
auccucccacucuuucaacagc

SEQ ID NO: 3358939 - RNA, 17 nt, Neisseria meningitidis Z2491
auccucgaaaugccguc

SEQ ID NO: 3358940 - RNA, 21 nt, Neisseria meningitidis Z2491
auccugcacgcgcuucaaauc

SEQ ID NO: 3358941 - RNA, 13 nt, Neisseria meningitidis Z2491
auccugccuucau

SEQ ID NO: 3358942 - RNA, 19 nt, Neisseria meningitidis Z2491
auccugccuucauucuuga

SEQ ID NO: 3358943 - RNA, 15 nt, Neisseria meningitidis Z2491
auccugcuuuaauuc

SEQ ID NO: 3358944 - RNA, 14 nt, Neisseria meningitidis Z2491
aucgaaagccucau

SEQ ID NO: 3358945 - RNA, 14 nt, Neisseria meningitidis Z2491
aucgaaaugccguc

SEQ ID NO: 3358946 - RNA, 15 nt, Neisseria meningitidis Z2491
aucgaaccaaauaaa

SEQ ID NO: 3358947 - RNA, 22 nt, Neisseria meningitidis Z2491
aucgaaccaaauaaacaagguc

SEQ ID NO: 3358948 - RNA, 16 nt, Neisseria meningitidis Z2491
aucgaccgcuuccucg

SEQ ID NO: 3358949 - RNA, 20 nt, Neisseria meningitidis Z2491
aucgacgacgauuaauaccg

SEQ ID NO: 3358950 - RNA, 11 nt, Neisseria meningitidis Z2491
aucgagcugcc

SEQ ID NO: 3358951 - RNA, 19 nt, Neisseria meningitidis Z2491
aucgagguuguucagcggu

SEQ ID NO: 3358952 - RNA, 23 nt, Neisseria meningitidis Z2491
aucgagugugggguagccuucaa

SEQ ID NO: 3358953 - RNA, 20 nt, Neisseria meningitidis Z2491
aucgccgacgaccaaugccu

SEQ ID NO: 3358954 - RNA, 19 nt, Neisseria meningitidis Z2491
aucgccuuacggauggcau

SEQ ID NO: 3358955 - RNA, 16 nt, Neisseria meningitidis Z2491
aucgcgcccaauucuu

SEQ ID NO: 3358956 - RNA, 23 nt, Neisseria meningitidis Z2491
aucgcgcccaauucuucuuuaua

SEQ ID NO: 3358957 - RNA, 21 nt, Neisseria meningitidis Z2491
aucgcuggcgauaugcuucaa

SEQ ID NO: 3358958 - RNA, 15 nt, Neisseria meningitidis Z2491
aucgcuguaauaaac

SEQ ID NO: 3358959 - RNA, 18 nt, Neisseria meningitidis Z2491
aucgcuguaauaaacagc

SEQ ID NO: 3358960 - RNA, 14 nt, Neisseria meningitidis Z2491
aucggaaaaacagc

SEQ ID NO: 3358961 - RNA, 19 nt, Neisseria meningitidis Z2491
aucggacggauguucaaac

SEQ ID NO: 3358962 - RNA, 22 nt, Neisseria meningitidis Z2491
aucggaggaguuugaugccguc

SEQ ID NO: 3358963 - RNA, 15 nt, Neisseria meningitidis Z2491
aucggagugauuauc

SEQ ID NO: 3358964 - RNA, 16 nt, Neisseria meningitidis Z2491
aucggagugauuauca

SEQ ID NO: 3358965 - RNA, 15 nt, Neisseria meningitidis Z2491
aucggauaaaacaga

SEQ ID NO: 3358966 - RNA, 14 nt, Neisseria meningitidis Z2491
aucggcaaacccuu

SEQ ID NO: 3358967 - RNA, 15 nt, Neisseria meningitidis Z2491
aucggcaacuuugac

SEQ ID NO: 3358968 - RNA, 20 nt, Neisseria meningitidis Z2491
aucggcaaucacgucaggca

SEQ ID NO: 3358969 - RNA, 15 nt, Neisseria meningitidis Z2491
aucggccauucccuc

SEQ ID NO: 3358970 - RNA, 15 nt, Neisseria meningitidis Z2491
aucggcucgccgccu

SEQ ID NO: 3358971 - RNA, 11 nt, Neisseria meningitidis Z2491
aucggcuucag

SEQ ID NO: 3358972 - RNA, 12 nt, Neisseria meningitidis Z2491
aucgggaaaaau

SEQ ID NO: 3358973 - RNA, 14 nt, Neisseria meningitidis Z2491
aucgggaaaaauag

SEQ ID NO: 3358974 - RNA, 12 nt, Neisseria meningitidis Z2491
aucgggaaucac

SEQ ID NO: 3358975 - RNA, 13 nt, Neisseria meningitidis Z2491
aucgggcgggaau

SEQ ID NO: 3358976 - RNA, 17 nt, Neisseria meningitidis Z2491
aucgggcgggaauagcu

SEQ ID NO: 3358977 - RNA, 19 nt, Neisseria meningitidis Z2491
aucgggcgggaauagcuca

SEQ ID NO: 3358978 - RNA, 18 nt, Neisseria meningitidis Z2491
aucgguacgcagcaguuu

SEQ ID NO: 3358979 - RNA, 14 nt, Neisseria meningitidis Z2491
aucgguuucgggcg

SEQ ID NO: 3358980 - RNA, 17 nt, Neisseria meningitidis Z2491
aucguaaaaaugccguc

SEQ ID NO: 3358981 - RNA, 18 nt, Neisseria meningitidis Z2491
aucguaaaaaugccgucu

SEQ ID NO: 3358982 - RNA, 21 nt, Neisseria meningitidis Z2491
aucguaaaaaugccgucugaa

SEQ ID NO: 3358983 - RNA, 19 nt, Neisseria meningitidis Z2491
aucguauuggggcaaagcg

SEQ ID NO: 3358984 - RNA, 22 nt, Neisseria meningitidis Z2491
aucguauuggggcaaagcggca

SEQ ID NO: 3358985 - RNA, 21 nt, Neisseria meningitidis Z2491
aucguauuuuuaucuuuuaau

SEQ ID NO: 3358986 - RNA, 16 nt, Neisseria meningitidis Z2491
aucguccaaccuuccc

SEQ ID NO: 3358987 - RNA, 15 nt, Neisseria meningitidis Z2491
aucgucugcaagcag

SEQ ID NO: 3358988 - RNA, 22 nt, Neisseria meningitidis Z2491
aucguggcgguguccggcugaa

SEQ ID NO: 3358989 - RNA, 19 nt, Neisseria meningitidis Z2491
aucgugggacgguucggac

SEQ ID NO: 3358990 - RNA, 15 nt, Neisseria meningitidis Z2491
aucguguaggcaguu

SEQ ID NO: 3358991 - RNA, 18 nt, Neisseria meningitidis Z2491
aucguuacaaauuuaaac

SEQ ID NO: 3358992 - RNA, 21 nt, Neisseria meningitidis Z2491
aucguuuacgauuacuuauuu

SEQ ID NO: 3358993 - RNA, 18 nt, Neisseria meningitidis Z2491
aucuaaaaauucuaacuc

SEQ ID NO: 3358994 - RNA, 13 nt, Neisseria meningitidis Z2491
aucuagaaaugaa

SEQ ID NO: 3358995 - RNA, 20 nt, Neisseria meningitidis Z2491
aucuagaaaugaaaaacgac

SEQ ID NO: 3358996 - RNA, 14 nt, Neisseria meningitidis Z2491
aucuagaaauuuaa

SEQ ID NO: 3358997 - RNA, 12 nt, Neisseria meningitidis Z2491
aucuagaaccca

SEQ ID NO: 3358998 - RNA, 14 nt, Neisseria meningitidis Z2491
aucuagaacgugga

SEQ ID NO: 3358999 - RNA, 11 nt, Neisseria meningitidis Z2491
aucuagacauu

SEQ ID NO: 3359000 - RNA, 18 nt, Neisseria meningitidis Z2491
aucuagacauucaaugcu

SEQ ID NO: 3359001 - RNA, 20 nt, Neisseria meningitidis Z2491
aucuagacauucaaugcuaa

SEQ ID NO: 3359002 - RNA, 20 nt, Neisseria meningitidis Z2491
aucuaguacagccccuuaaa

SEQ ID NO: 3359003 - RNA, 11 nt, Neisseria meningitidis Z2491
aucuauagugg

SEQ ID NO: 3359004 - RNA, 23 nt, Neisseria meningitidis Z2491
aucuauaguggauuaacaaaaac

SEQ ID NO: 3359005 - RNA, 15 nt, Neisseria meningitidis Z2491
aucucauuuucaaaa

SEQ ID NO: 3359006 - RNA, 22 nt, Neisseria meningitidis Z2491
aucucauuuucaaaaugcaaaa

SEQ ID NO: 3359007 - RNA, 23 nt, Neisseria meningitidis Z2491
aucucgaauuuuuuccauacgga

SEQ ID NO: 3359008 - RNA, 17 nt, Neisseria meningitidis Z2491
aucucgucccaaacaau

SEQ ID NO: 3359009 - RNA, 13 nt, Neisseria meningitidis Z2491
aucucguuaucca

SEQ ID NO: 3359010 - RNA, 17 nt, Neisseria meningitidis Z2491
augcggucgugcagccu

SEQ ID NO: 3359011 - RNA, 18 nt, Neisseria meningitidis Z2491
augcguucgagcaggaac

SEQ ID NO: 3359012 - RNA, 13 nt, Neisseria meningitidis Z2491
augcuaaggcaau

SEQ ID NO: 3359013 - RNA, 16 nt, Neisseria meningitidis Z2491
augcuaaggcaauuua

SEQ ID NO: 3359014 - RNA, 21 nt, Neisseria meningitidis Z2491
augcuaaggcaauuucucgga

SEQ ID NO: 3359015 - RNA, 18 nt, Neisseria meningitidis Z2491
augcucaaucuuauuuuc

SEQ ID NO: 3359016 - RNA, 18 nt, Neisseria meningitidis Z2491
augcugucugaaaccuga

SEQ ID NO: 3359017 - RNA, 20 nt, Neisseria meningitidis Z2491
augcuucggucagguucaaa

SEQ ID NO: 3359018 - RNA, 20 nt, Neisseria meningitidis Z2491
auggaaaggcaaaugccguc

SEQ ID NO: 3359019 - RNA, 15 nt, Neisseria meningitidis Z2491
auggaaaugccgucu

SEQ ID NO: 3359020 - RNA, 20 nt, Neisseria meningitidis Z2491
auggacgacgcggcugcugc

SEQ ID NO: 3359021 - RNA, 13 nt, Neisseria meningitidis Z2491
auggaggcaguuu

SEQ ID NO: 3359022 - RNA, 17 nt, Neisseria meningitidis Z2491
auggaggcaguuuuuua

SEQ ID NO: 3359023 - RNA, 21 nt, Neisseria meningitidis Z2491
auggaucagacauuaaaaaau

SEQ ID NO: 3359024 - RNA, 19 nt, Neisseria meningitidis Z2491
auggauucgucauucccgc

SEQ ID NO: 3359025 - RNA, 18 nt, Neisseria meningitidis Z2491
auggcaaaacggccgcaa

SEQ ID NO: 3359026 - RNA, 15 nt, Neisseria meningitidis Z2491
auggcgaacaaacaa

SEQ ID NO: 3359027 - RNA, 20 nt, Neisseria meningitidis Z2491
auggcgggaaauaaaacaaa

SEQ ID NO: 3359028 - RNA, 20 nt, Neisseria meningitidis Z2491
auggcggugcgguagccgcc

SEQ ID NO: 3359029 - RNA, 23 nt, Neisseria meningitidis Z2491
auggcguuaccaauaacggcugc

SEQ ID NO: 3359030 - RNA, 18 nt, Neisseria meningitidis Z2491
auggcguugguugaacgu

SEQ ID NO: 3359031 - RNA, 16 nt, Neisseria meningitidis Z2491
augggcuucaucaguu

SEQ ID NO: 3359032 - RNA, 13 nt, Neisseria meningitidis Z2491
auggggaggcgcg

SEQ ID NO: 3359033 - RNA, 14 nt, Neisseria meningitidis Z2491
auggggaggcgcgg

SEQ ID NO: 3359034 - RNA, 18 nt, Neisseria meningitidis Z2491
auggucaauacacaaggu

SEQ ID NO: 3359035 - RNA, 21 nt, Neisseria meningitidis Z2491
auggugcgccgucuuaucaga

SEQ ID NO: 3359036 - RNA, 20 nt, Neisseria meningitidis Z2491
augguguccgucgccuucua

SEQ ID NO: 3359037 - RNA, 22 nt, Neisseria meningitidis Z2491
augguuaagagauuggcauuua

SEQ ID NO: 3359038 - RNA, 20 nt, Neisseria meningitidis Z2491
augguucagacggcauuuuu

SEQ ID NO: 3359039 - RNA, 20 nt, Neisseria meningitidis Z2491
auguaaaccuaagauauaac

SEQ ID NO: 3359040 - RNA, 12 nt, Neisseria meningitidis Z2491
auguaaauuuuu

SEQ ID NO: 3359041 - RNA, 18 nt, Neisseria meningitidis Z2491
auguaauaggcgagcuuc

SEQ ID NO: 3359042 - RNA, 18 nt, Neisseria meningitidis Z2491
auguaaucguaagauaga

SEQ ID NO: 3359043 - RNA, 21 nt, Neisseria meningitidis Z2491
auguagauuuuuuuauuuaaa

SEQ ID NO: 3359044 - RNA, 19 nt, Neisseria meningitidis Z2491
auguagguucguaggaaug

SEQ ID NO: 3359045 - RNA, 18 nt, Neisseria meningitidis Z2491
auguagguucgugggaau

SEQ ID NO: 3359046 - RNA, 12 nt, Neisseria meningitidis Z2491
auguauaguaau

SEQ ID NO: 3359047 - RNA, 21 nt, Neisseria meningitidis Z2491
auguauauaauccggagcaga

SEQ ID NO: 3359048 - RNA, 14 nt, Neisseria meningitidis Z2491
auguauuagaaaug

SEQ ID NO: 3359049 - RNA, 15 nt, Neisseria meningitidis Z2491
augucgaaggcgcgg

SEQ ID NO: 3359050 - RNA, 18 nt, Neisseria meningitidis Z2491
augucguugucaaccaaa

SEQ ID NO: 3359051 - RNA, 21 nt, Neisseria meningitidis Z2491
augucguugucaaccaaaaaa

SEQ ID NO: 3359052 - RNA, 21 nt, Neisseria meningitidis Z2491
augucugccugauacagccac

SEQ ID NO: 3359053 - RNA, 13 nt, Neisseria meningitidis Z2491
augugcuggcugc

SEQ ID NO: 3359054 - RNA, 15 nt, Neisseria meningitidis Z2491
augugguagagaaaa

SEQ ID NO: 3359055 - RNA, 19 nt, Neisseria meningitidis Z2491
augugugccaguucggcaa

SEQ ID NO: 3359056 - RNA, 18 nt, Neisseria meningitidis Z2491
auguguugcccugauucg

SEQ ID NO: 3359057 - RNA, 23 nt, Neisseria meningitidis Z2491
auguguugcccugauucggaagg

SEQ ID NO: 3359058 - RNA, 22 nt, Neisseria meningitidis Z2491
auguuaugugcugucagaauug

SEQ ID NO: 3359059 - RNA, 16 nt, Neisseria meningitidis Z2491
auguuauuauuuucca

SEQ ID NO: 3359060 - RNA, 14 nt, Neisseria meningitidis Z2491
auguucaauaggau

SEQ ID NO: 3359061 - RNA, 16 nt, Neisseria meningitidis Z2491
auguucagacggcauu

SEQ ID NO: 3359062 - RNA, 13 nt, Neisseria meningitidis Z2491
auguucagacggu

SEQ ID NO: 3359063 - RNA, 17 nt, Neisseria meningitidis Z2491
auguucgugcaucauca

SEQ ID NO: 3359064 - RNA, 19 nt, Neisseria meningitidis Z2491
auguugcccgucaacacaa

SEQ ID NO: 3359065 - RNA, 20 nt, Neisseria meningitidis Z2491
auguugcggcacuagccaaa

SEQ ID NO: 3359066 - RNA, 23 nt, Neisseria meningitidis Z2491
auguugcggcacuagccaaaaaa

SEQ ID NO: 3359067 - RNA, 17 nt, Neisseria meningitidis Z2491
auguuuagcggagcagu

SEQ ID NO: 3359068 - RNA, 20 nt, Neisseria meningitidis Z2491
auguuucaaaccucauucaa

SEQ ID NO: 3359069 - RNA, 19 nt, Neisseria meningitidis Z2491
auguuugcugcuguauuuu

SEQ ID NO: 3359070 - RNA, 23 nt, Neisseria meningitidis Z2491
auguuugcugcuguauuuuucca

SEQ ID NO: 3359071 - RNA, 16 nt, Neisseria meningitidis Z2491
auguuuucgucugccc

SEQ ID NO: 3359072 - RNA, 20 nt, Neisseria meningitidis Z2491
auguuuuugcguucagacgg

SEQ ID NO: 3359073 - RNA, 21 nt, Neisseria meningitidis Z2491
auguuuuugcguucagacggc

SEQ ID NO: 3359074 - RNA, 12 nt, Neisseria meningitidis Z2491
auuaaaaacaaa

SEQ ID NO: 3359075 - RNA, 19 nt, Neisseria meningitidis Z2491
auuaaaaaccggauuuauu

SEQ ID NO: 3359076 - RNA, 13 nt, Neisseria meningitidis Z2491
auuaaaacaaaaa

SEQ ID NO: 3359077 - RNA, 14 nt, Neisseria meningitidis Z2491
auuaaaacaaaaau

SEQ ID NO: 3359078 - RNA, 15 nt, Neisseria meningitidis Z2491
auuaaaauaaaaaua

SEQ ID NO: 3359079 - RNA, 17 nt, Neisseria meningitidis Z2491
auuaaaauaaaaauacu

SEQ ID NO: 3359080 - RNA, 12 nt, Neisseria meningitidis Z2491
auuaaaauuugg

SEQ ID NO: 3359081 - RNA, 22 nt, Neisseria meningitidis Z2491
auuaaaggggugcguuuuauug

SEQ ID NO: 3359082 - RNA, 21 nt, Neisseria meningitidis Z2491
auuaaagugccauuuaaaauc

SEQ ID NO: 3359083 - RNA, 13 nt, Neisseria meningitidis Z2491
auuaaauuuaaac

SEQ ID NO: 3359084 - RNA, 13 nt, Neisseria meningitidis Z2491
auuaaauuuaaau

SEQ ID NO: 3359085 - RNA, 15 nt, Neisseria meningitidis Z2491
auuaaauuuaaauca

SEQ ID NO: 3359086 - RNA, 19 nt, Neisseria meningitidis Z2491
auuaaauuuccagauuccc

SEQ ID NO: 3359087 - RNA, 15 nt, Neisseria meningitidis Z2491
auuaacaaaaaccag

SEQ ID NO: 3359088 - RNA, 12 nt, Neisseria meningitidis Z2491
auuaacaaaaau

SEQ ID NO: 3359089 - RNA, 22 nt, Neisseria meningitidis Z2491
auuaacggcggaaccugcugcc

SEQ ID NO: 3359090 - RNA, 17 nt, Neisseria meningitidis Z2491
auuaacgggguuaaaua

SEQ ID NO: 3359091 - RNA, 14 nt, Neisseria meningitidis Z2491
auuaagaaaaacag

SEQ ID NO: 3359092 - RNA, 15 nt, Neisseria meningitidis Z2491
auuaagaaaaacagc

SEQ ID NO: 3359093 - RNA, 18 nt, Neisseria meningitidis Z2491
auuaagaaaaacagcaau

SEQ ID NO: 3359094 - RNA, 19 nt, Neisseria meningitidis Z2491
auuaaggggggauuugggu

SEQ ID NO: 3359095 - RNA, 18 nt, Neisseria meningitidis Z2491
auuaaggggguauuuggg

SEQ ID NO: 3359096 - RNA, 21 nt, Neisseria meningitidis Z2491
auuaagguuaauuaaaauacg

SEQ ID NO: 3359097 - RNA, 23 nt, Neisseria meningitidis Z2491
auuaauauacuuggcaaaaucug

SEQ ID NO: 3359098 - RNA, 21 nt, Neisseria meningitidis Z2491
auuaaucuccuuuuuuuucua

SEQ ID NO: 3359099 - RNA, 15 nt, Neisseria meningitidis Z2491
auuaaugcgaaaugc

SEQ ID NO: 3359100 - RNA, 18 nt, Neisseria meningitidis Z2491
auuacccaacgccucuuc

SEQ ID NO: 3359101 - RNA, 15 nt, Neisseria meningitidis Z2491
auuaccgccaccuuu

SEQ ID NO: 3359102 - RNA, 22 nt, Neisseria meningitidis Z2491
auuacugcugcggcucugaaac

SEQ ID NO: 3359103 - RNA, 13 nt, Neisseria meningitidis Z2491
auuagaaaugacu

SEQ ID NO: 3359104 - RNA, 17 nt, Neisseria meningitidis Z2491
auuagaaccgaacacag

SEQ ID NO: 3359105 - RNA, 20 nt, Neisseria meningitidis Z2491
auuagaguuucaaaauuuau

SEQ ID NO: 3359106 - RNA, 17 nt, Neisseria meningitidis Z2491
auuaggaagguuuuagg

SEQ ID NO: 3359107 - RNA, 17 nt, Neisseria meningitidis Z2491
auuaggagguauuuggg

SEQ ID NO: 3359108 - RNA, 18 nt, Neisseria meningitidis Z2491
auuaggcgguauuugggg

SEQ ID NO: 3359109 - RNA, 19 nt, Neisseria meningitidis Z2491
auuagugguuggaacagau

SEQ ID NO: 3359110 - RNA, 16 nt, Neisseria meningitidis Z2491
auuauaagguaaguuu

SEQ ID NO: 3359111 - RNA, 22 nt, Neisseria meningitidis Z2491
cguuaccaaguuucagacggca

SEQ ID NO: 3359112 - RNA, 14 nt, Neisseria meningitidis Z2491
cguucaaaucacgc

SEQ ID NO: 3359113 - RNA, 13 nt, Neisseria meningitidis Z2491
cguucaaaugccg

SEQ ID NO: 3359114 - RNA, 14 nt, Neisseria meningitidis Z2491
cguucaacagcagc

SEQ ID NO: 3359115 - RNA, 19 nt, Neisseria meningitidis Z2491
cguucaacauccgcagacg

SEQ ID NO: 3359116 - RNA, 13 nt, Neisseria meningitidis Z2491
cguucagacggca

SEQ ID NO: 3359117 - RNA, 16 nt, Neisseria meningitidis Z2491
cguucagacggcauug

SEQ ID NO: 3359118 - RNA, 22 nt, Neisseria meningitidis Z2491
cguucagauuccugccgccgga

SEQ ID NO: 3359119 - RNA, 20 nt, Neisseria meningitidis Z2491
cguuccacaaauccgccugu

SEQ ID NO: 3359120 - RNA, 18 nt, Neisseria meningitidis Z2491
cguuccgcgccgcaaacc

SEQ ID NO: 3359121 - RNA, 16 nt, Neisseria meningitidis Z2491
cguucgcugacgguau

SEQ ID NO: 3359122 - RNA, 14 nt, Neisseria meningitidis Z2491
cguucggcgcggcu

SEQ ID NO: 3359123 - RNA, 22 nt, Neisseria meningitidis Z2491
cguucuagauucccgccugcgc

SEQ ID NO: 3359124 - RNA, 22 nt, Neisseria meningitidis Z2491
cguuggacgguucguccagcag

SEQ ID NO: 3359125 - RNA, 14 nt, Neisseria meningitidis Z2491
cguuggcucgccuu

SEQ ID NO: 3359126 - RNA, 12 nt, Neisseria meningitidis Z2491
cguuucagacgg

SEQ ID NO: 3359127 - RNA, 16 nt, Neisseria meningitidis Z2491
cguuucagacggcauu

SEQ ID NO: 3359128 - RNA, 15 nt, Neisseria meningitidis Z2491
cguuucagacgguau

SEQ ID NO: 3359129 - RNA, 22 nt, Neisseria meningitidis Z2491
cguuuccaaagugauuuccgcu

SEQ ID NO: 3359130 - RNA, 17 nt, Neisseria meningitidis Z2491
cguuucuagauucccac

SEQ ID NO: 3359131 - RNA, 13 nt, Neisseria meningitidis Z2491
cguuucuauuuuc

SEQ ID NO: 3359132 - RNA, 15 nt, Neisseria meningitidis Z2491
cguuucuuguuuuug

SEQ ID NO: 3359133 - RNA, 14 nt, Neisseria meningitidis Z2491
cguuugccgccaua

SEQ ID NO: 3359134 - RNA, 15 nt, Neisseria meningitidis Z2491
cguuuggcaagguuc

SEQ ID NO: 3359135 - RNA, 21 nt, Neisseria meningitidis Z2491
cguuuucacgggaaugacgaa

SEQ ID NO: 3359136 - RNA, 20 nt, Neisseria meningitidis Z2491
cguuuucgucuuugaaacgc

SEQ ID NO: 3359137 - RNA, 14 nt, Neisseria meningitidis Z2491
cguuuuucagacgg

SEQ ID NO: 3359138 - RNA, 17 nt, Neisseria meningitidis Z2491
cuaaaaacuaaaugcca

SEQ ID NO: 3359139 - RNA, 12 nt, Neisseria meningitidis Z2491
cuaaaaauucua

SEQ ID NO: 3359140 - RNA, 21 nt, Neisseria meningitidis Z2491
cuaaaacacagccaaaauauu

SEQ ID NO: 3359141 - RNA, 16 nt, Neisseria meningitidis Z2491
cuaaaacuuaaaauuc

SEQ ID NO: 3359142 - RNA, 18 nt, Neisseria meningitidis Z2491
cuaaaacuuaaaauuuca

SEQ ID NO: 3359143 - RNA, 21 nt, Neisseria meningitidis Z2491
cuaaaagcaaaaaggccgucu

SEQ ID NO: 3359144 - RNA, 21 nt, Neisseria meningitidis Z2491
cuaaaaucccgucauucccgc

SEQ ID NO: 3359145 - RNA, 20 nt, Neisseria meningitidis Z2491
cuaaaauccgucauucccgc

SEQ ID NO: 3359146 - RNA, 21 nt, Neisseria meningitidis Z2491
cuaaaaucucgucauucucgc

SEQ ID NO: 3359147 - RNA, 20 nt, Neisseria meningitidis Z2491
cuaaaauucgucauucccac

SEQ ID NO: 3359148 - RNA, 13 nt, Neisseria meningitidis Z2491
cuaaaauuuuaug

SEQ ID NO: 3359149 - RNA, 15 nt, Neisseria meningitidis Z2491
cuaaaccgucauucc

SEQ ID NO: 3359150 - RNA, 20 nt, Neisseria meningitidis Z2491
cuaaacgguauucauaccuc

SEQ ID NO: 3359151 - RNA, 23 nt, Neisseria meningitidis Z2491
cuaaacuuucagauaaucuuuga

SEQ ID NO: 3359152 - RNA, 15 nt, Neisseria meningitidis Z2491
cuaaagcaauuuauc

SEQ ID NO: 3359153 - RNA, 16 nt, Neisseria meningitidis Z2491
cuaaagcaauuuaucg

SEQ ID NO: 3359154 - RNA, 23 nt, Neisseria meningitidis Z2491
cuaaagccguccguaagccuuca

SEQ ID NO: 3359155 - RNA, 17 nt, Neisseria meningitidis Z2491
cuaaaggcuucagacgg

SEQ ID NO: 3359156 - RNA, 17 nt, Neisseria meningitidis Z2491
cuaaauagcugaaacuc

SEQ ID NO: 3359157 - RNA, 19 nt, Neisseria meningitidis Z2491
cuaaauagcugaaacucaa

SEQ ID NO: 3359158 - RNA, 23 nt, Neisseria meningitidis Z2491
cuaaaugccaaucucuuaaccau

SEQ ID NO: 3359159 - RNA, 16 nt, Neisseria meningitidis Z2491
cuaaauugcauuuuua

SEQ ID NO: 3359160 - RNA, 17 nt, Neisseria meningitidis Z2491
cuaaauugcauuuuuaa

SEQ ID NO: 3359161 - RNA, 22 nt, Neisseria meningitidis Z2491
cuaaccagccaaccuuaacaau

SEQ ID NO: 3359162 - RNA, 16 nt, Neisseria meningitidis Z2491
cuaaccgaaaaaauaa

SEQ ID NO: 3359163 - RNA, 17 nt, Neisseria meningitidis Z2491
cuaaccgaaaaaauaau

SEQ ID NO: 3359164 - RNA, 18 nt, Neisseria meningitidis Z2491
cuaaccgaaaaaauaauu

SEQ ID NO: 3359165 - RNA, 16 nt, Neisseria meningitidis Z2491
cuaaccgaaaauaauu

SEQ ID NO: 3359166 - RNA, 18 nt, Neisseria meningitidis Z2491
cuaaccgauggaugaaca

SEQ ID NO: 3359167 - RNA, 20 nt, Neisseria meningitidis Z2491
cuaacguacaaaugccgucu

SEQ ID NO: 3359168 - RNA, 16 nt, Neisseria meningitidis Z2491
cuaaggcaauuuaucg

SEQ ID NO: 3359169 - RNA, 17 nt, Neisseria meningitidis Z2491
cuaaggucuagauuccc

SEQ ID NO: 3359170 - RNA, 19 nt, Neisseria meningitidis Z2491
cuaaggucuagauucccgc

SEQ ID NO: 3359171 - RNA, 22 nt, Neisseria meningitidis Z2491
cuaaggucuagauucccgccug

SEQ ID NO: 3359172 - RNA, 18 nt, Neisseria meningitidis Z2491
cuaaggugaggcaacgcu

SEQ ID NO: 3359173 - RNA, 20 nt, Neisseria meningitidis Z2491
cuaaggugcugaagcaccaa

SEQ ID NO: 3359174 - RNA, 19 nt, Neisseria meningitidis Z2491
cuaaucccgucauucccac

SEQ ID NO: 3359175 - RNA, 16 nt, Neisseria meningitidis Z2491
cuaaucgcgucauucc

SEQ ID NO: 3359176 - RNA, 18 nt, Neisseria meningitidis Z2491
cuaaucgcgucauuccca

SEQ ID NO: 3359177 - RNA, 19 nt, Neisseria meningitidis Z2491
cuaaucgcgucauucccac

SEQ ID NO: 3359178 - RNA, 18 nt, Neisseria meningitidis Z2491
cuaauucgugauucccga

SEQ ID NO: 3359179 - RNA, 13 nt, Neisseria meningitidis Z2491
cuaauucuaccca

SEQ ID NO: 3359180 - RNA, 20 nt, Neisseria meningitidis Z2491
cuacauuccgucauucccac

SEQ ID NO: 3359181 - RNA, 18 nt, Neisseria meningitidis Z2491
cuaccauuguuucugaag

SEQ ID NO: 3359182 - RNA, 14 nt, Neisseria meningitidis Z2491
cuacccaaaucccc

SEQ ID NO: 3359183 - RNA, 14 nt, Neisseria meningitidis Z2491
cuaccguuuccucc

SEQ ID NO: 3359184 - RNA, 21 nt, Neisseria meningitidis Z2491
cuacgcggcugaaaaaaugcc

SEQ ID NO: 3359185 - RNA, 14 nt, Neisseria meningitidis Z2491
cuacgcgggaauga

SEQ ID NO: 3359186 - RNA, 19 nt, Neisseria meningitidis Z2491
cuacguucuagauucccgc

SEQ ID NO: 3359187 - RNA, 12 nt, Neisseria meningitidis Z2491
cuagaaauuuaa

SEQ ID NO: 3359188 - RNA, 19 nt, Neisseria meningitidis Z2491
cuagaaucucggacuuuca

SEQ ID NO: 3359189 - RNA, 19 nt, Neisseria meningitidis Z2491
cuagacauucaaugcuaag

SEQ ID NO: 3359190 - RNA, 22 nt, Neisseria meningitidis Z2491
cuagacauucaaugcuaaggca

SEQ ID NO: 3359191 - RNA, 22 nt, Neisseria meningitidis Z2491
cuagauaacuagggaaauucaa

SEQ ID NO: 3359192 - RNA, 22 nt, Neisseria meningitidis Z2491
cuagauggcguugguugaacgu

SEQ ID NO: 3359193 - RNA, 13 nt, Neisseria meningitidis Z2491
cuagauucccacu

SEQ ID NO: 3359194 - RNA, 12 nt, Neisseria meningitidis Z2491
cuagauucccgc

SEQ ID NO: 3359195 - RNA, 15 nt, Neisseria meningitidis Z2491
cuagauucccgcuuu

SEQ ID NO: 3359196 - RNA, 13 nt, Neisseria meningitidis Z2491
cuagccaaaaaaa

SEQ ID NO: 3359197 - RNA, 20 nt, Neisseria meningitidis Z2491
cuaguacagccccuuaaagu

SEQ ID NO: 3359198 - RNA, 12 nt, Neisseria meningitidis Z2491
cuauaaaaaaac

SEQ ID NO: 3359199 - RNA, 10 nt, Neisseria meningitidis Z2491
cuauaaaauu

SEQ ID NO: 3359200 - RNA, 21 nt, Neisseria meningitidis Z2491
cucuauuuguucgauauuuuu

SEQ ID NO: 3359201 - RNA, 16 nt, Neisseria meningitidis Z2491
cucuccgucauuccca

SEQ ID NO: 3359202 - RNA, 13 nt, Neisseria meningitidis Z2491
cucucuauaaaau

SEQ ID NO: 3359203 - RNA, 22 nt, Neisseria meningitidis Z2491
cucugaaaccauaccgccuuca

SEQ ID NO: 3359204 - RNA, 15 nt, Neisseria meningitidis Z2491
cucugauagccgccc

SEQ ID NO: 3359205 - RNA, 13 nt, Neisseria meningitidis Z2491
cucugccagcucc

SEQ ID NO: 3359206 - RNA, 20 nt, Neisseria meningitidis Z2491
cucugccagcuccgccacgu

SEQ ID NO: 3359207 - RNA, 16 nt, Neisseria meningitidis Z2491
cucugccgucauuccc

SEQ ID NO: 3359208 - RNA, 15 nt, Neisseria meningitidis Z2491
cucuguucgaccaca

SEQ ID NO: 3359209 - RNA, 24 nt, Neisseria meningitidis Z2491
cucuucgcguacuuuauccaccaa

SEQ ID NO: 3359210 - RNA, 21 nt, Neisseria meningitidis Z2491
cucuugaagcggcguccuguc

SEQ ID NO: 3359211 - RNA, 20 nt, Neisseria meningitidis Z2491
cucuuggauaaacauuuuug

SEQ ID NO: 3359212 - RNA, 15 nt, Neisseria meningitidis Z2491
cucuuggucaaaaug

SEQ ID NO: 3359213 - RNA, 17 nt, Neisseria meningitidis Z2491
cucuuucaucauaugca

SEQ ID NO: 3359214 - RNA, 17 nt, Neisseria meningitidis Z2491
cugaaaaaaugccgucu

SEQ ID NO: 3359215 - RNA, 23 nt, Neisseria meningitidis Z2491
cugaaaaaaugccgucugaaacg

SEQ ID NO: 3359216 - RNA, 20 nt, Neisseria meningitidis Z2491
cugaaaaauuuucagacgac

SEQ ID NO: 3359217 - RNA, 21 nt, Neisseria meningitidis Z2491
cugaaaaauuuucagacgacc

SEQ ID NO: 3359218 - RNA, 11 nt, Neisseria meningitidis Z2491
cugaaaauaau

SEQ ID NO: 3359219 - RNA, 14 nt, Neisseria meningitidis Z2491
cugaaaaucggguu

SEQ ID NO: 3359220 - RNA, 21 nt, Neisseria meningitidis Z2491
cugaaaccccuaaaggcuuca

SEQ ID NO: 3359221 - RNA, 20 nt, Neisseria meningitidis Z2491
cugaaacccgauguuuucaa

SEQ ID NO: 3359222 - RNA, 17 nt, Neisseria meningitidis Z2491
cugaaacccgauuccug

SEQ ID NO: 3359223 - RNA, 18 nt, Neisseria meningitidis Z2491
cugaaaccggcuucagac

SEQ ID NO: 3359224 - RNA, 19 nt, Neisseria meningitidis Z2491
cugaaaccggcuucagacg

SEQ ID NO: 3359225 - RNA, 23 nt, Neisseria meningitidis Z2491
cugaaaccuguaccguuucagac

SEQ ID NO: 3359226 - RNA, 19 nt, Neisseria meningitidis Z2491
cugaaacgcauucagacgg

SEQ ID NO: 3359227 - RNA, 22 nt, Neisseria meningitidis Z2491
cugaaacgcauucagacggcau

SEQ ID NO: 3359228 - RNA, 19 nt, Neisseria meningitidis Z2491
cugaaacggcggcaggguu

SEQ ID NO: 3359229 - RNA, 12 nt, Neisseria meningitidis Z2491
cugaaacucaaa

SEQ ID NO: 3359230 - RNA, 15 nt, Neisseria meningitidis Z2491
cugaaacucaaaaaa

SEQ ID NO: 3359231 - RNA, 16 nt, Neisseria meningitidis Z2491
cugaaacucaaaaaac

SEQ ID NO: 3359232 - RNA, 17 nt, Neisseria meningitidis Z2491
cugaaacucaaaaaacu

SEQ ID NO: 3359233 - RNA, 22 nt, Neisseria meningitidis Z2491
cugaaacucaaaaagcuggauu

SEQ ID NO: 3359234 - RNA, 22 nt, Neisseria meningitidis Z2491
cugaaacucaacgcacuggauu

SEQ ID NO: 3359235 - RNA, 18 nt, Neisseria meningitidis Z2491
cugaaaggcuucagacgg

SEQ ID NO: 3359236 - RNA, 14 nt, Neisseria meningitidis Z2491
cugaaaggcuuuca

SEQ ID NO: 3359237 - RNA, 20 nt, Neisseria meningitidis Z2491
cugaaaggcuuuuucagacg

SEQ ID NO: 3359238 - RNA, 23 nt, Neisseria meningitidis Z2491
cugaaaggcuuuuucagacggca

SEQ ID NO: 3359239 - RNA, 14 nt, Neisseria meningitidis Z2491
cugaaauagaaaau

SEQ ID NO: 3359240 - RNA, 13 nt, Neisseria meningitidis Z2491
cugaaauaucguc

SEQ ID NO: 3359241 - RNA, 21 nt, Neisseria meningitidis Z2491
cugaaauaucgucauucccgc

SEQ ID NO: 3359242 - RNA, 18 nt, Neisseria meningitidis Z2491
cugaaauaugguucagac

SEQ ID NO: 3359243 - RNA, 19 nt, Neisseria meningitidis Z2491
cugaaauaugguucagacg

SEQ ID NO: 3359244 - RNA, 21 nt, Neisseria meningitidis Z2491
cugaaauaugguucagacggc

SEQ ID NO: 3359245 - RNA, 17 nt, Neisseria meningitidis Z2491
cugaaauguucagacgg

SEQ ID NO: 3359246 - RNA, 14 nt, Neisseria meningitidis Z2491
cugaaauucaaaaa

SEQ ID NO: 3359247 - RNA, 16 nt, Neisseria meningitidis Z2491
cugaaauucaaaaaac

SEQ ID NO: 3359248 - RNA, 18 nt, Neisseria meningitidis Z2491
cugaaauucaaaaaaccg

SEQ ID NO: 3359249 - RNA, 20 nt, Neisseria meningitidis Z2491
cugaaauucgucauucccgc

SEQ ID NO: 3359250 - RNA, 22 nt, Neisseria meningitidis Z2491
cugaaauugaaaguuacagaaa

SEQ ID NO: 3359251 - RNA, 15 nt, Neisseria meningitidis Z2491
cugaaauuucagacg

SEQ ID NO: 3359252 - RNA, 17 nt, Neisseria meningitidis Z2491
cugaaauuucagacggc

SEQ ID NO: 3359253 - RNA, 19 nt, Neisseria meningitidis Z2491
cugaacacggguucagacg

SEQ ID NO: 3359254 - RNA, 20 nt, Neisseria meningitidis Z2491
cugaacacggguucagacgg

SEQ ID NO: 3359255 - RNA, 21 nt, Neisseria meningitidis Z2491
cugaacaggcuucagacggca

SEQ ID NO: 3359256 - RNA, 19 nt, Neisseria meningitidis Z2491
cugaacaguguuucagacg

SEQ ID NO: 3359257 - RNA, 22 nt, Neisseria meningitidis Z2491
cugaacaucguguucagacggu

SEQ ID NO: 3359258 - RNA, 12 nt, Neisseria meningitidis Z2491
cugaacauuuca

SEQ ID NO: 3359259 - RNA, 14 nt, Neisseria meningitidis Z2491
cugaacauuucaga

SEQ ID NO: 3359260 - RNA, 15 nt, Neisseria meningitidis Z2491
cugaacauuucagac

SEQ ID NO: 3359261 - RNA, 17 nt, Neisseria meningitidis Z2491
cugaacauuucagacgg

SEQ ID NO: 3359262 - RNA, 19 nt, Neisseria meningitidis Z2491
cugaacauuucagacggca

SEQ ID NO: 3359263 - RNA, 17 nt, Neisseria meningitidis Z2491
cugaaccgucauuccca

SEQ ID NO: 3359264 - RNA, 23 nt, Neisseria meningitidis Z2491
cugaacgaguuuucagacggcau

SEQ ID NO: 3359265 - RNA, 17 nt, Neisseria meningitidis Z2491
cugaacgcuucagacgg

SEQ ID NO: 3359266 - RNA, 19 nt, Neisseria meningitidis Z2491
cugaacgcuucagacggca

SEQ ID NO: 3359267 - RNA, 20 nt, Neisseria meningitidis Z2491
cugaacgcuucagacggcau

SEQ ID NO: 3359268 - RNA, 16 nt, Neisseria meningitidis Z2491
cugaacucaggcuuca

SEQ ID NO: 3359269 - RNA, 21 nt, Neisseria meningitidis Z2491
cugaacucaggcuucagacgg

SEQ ID NO: 3359270 - RNA, 13 nt, Neisseria meningitidis Z2491
cugaagaaaccgu

SEQ ID NO: 3359271 - RNA, 20 nt, Neisseria meningitidis Z2491
cugaagaaaccguuuuaucc

SEQ ID NO: 3359272 - RNA, 17 nt, Neisseria meningitidis Z2491
cugaagauauuggaaca

SEQ ID NO: 3359273 - RNA, 18 nt, Neisseria meningitidis Z2491
cugaagcccacccuacca

SEQ ID NO: 3359274 - RNA, 15 nt, Neisseria meningitidis Z2491
cugaagcccugccug

SEQ ID NO: 3359275 - RNA, 16 nt, Neisseria meningitidis Z2491
cugaagcccugccugc

SEQ ID NO: 3359276 - RNA, 18 nt, Neisseria meningitidis Z2491
cugaagcccuuucagacg

SEQ ID NO: 3359277 - RNA, 19 nt, Neisseria meningitidis Z2491
cugaagcccuuucagacgg

SEQ ID NO: 3359278 - RNA, 23 nt, Neisseria meningitidis Z2491
cugaagccuucagacaacaagcc

SEQ ID NO: 3359279 - RNA, 17 nt, Neisseria meningitidis Z2491
cugaagccuucagacgg

SEQ ID NO: 3359280 - RNA, 16 nt, Neisseria meningitidis Z2491
cugaagcucaaaaaac

SEQ ID NO: 3359281 - RNA, 13 nt, Neisseria meningitidis Z2491
cugaaggcuucag

SEQ ID NO: 3359282 - RNA, 20 nt, Neisseria meningitidis Z2491
cugaauccaucaauuuccac

SEQ ID NO: 3359283 - RNA, 14 nt, Neisseria meningitidis Z2491
cugaaugucgagga

SEQ ID NO: 3359284 - RNA, 17 nt, Neisseria meningitidis Z2491
cugaauugacaugguau

SEQ ID NO: 3359285 - RNA, 15 nt, Neisseria meningitidis Z2491
cugacaaauucccgc

SEQ ID NO: 3359286 - RNA, 16 nt, Neisseria meningitidis Z2491
cugacaaucaggaaaa

SEQ ID NO: 3359287 - RNA, 18 nt, Neisseria meningitidis Z2491
cugacagcauuuccacau

SEQ ID NO: 3359288 - RNA, 20 nt, Neisseria meningitidis Z2491
cugacgcgcgauggaacgca

SEQ ID NO: 3359289 - RNA, 20 nt, Neisseria meningitidis Z2491
cugacgcuccagcuccggcc

SEQ ID NO: 3359290 - RNA, 15 nt, Neisseria meningitidis Z2491
cugacgguauagccc

SEQ ID NO: 3359291 - RNA, 14 nt, Neisseria meningitidis Z2491
cugacgguuuuuuu

SEQ ID NO: 3359292 - RNA, 16 nt, Neisseria meningitidis Z2491
cugacuagguaauaca

SEQ ID NO: 3359293 - RNA, 19 nt, Neisseria meningitidis Z2491
cugagaccuuugcaaaaau

SEQ ID NO: 3359294 - RNA, 14 nt, Neisseria meningitidis Z2491
cugauaaaaaauau

SEQ ID NO: 3359295 - RNA, 22 nt, Neisseria meningitidis Z2491
cugauaaaugccgcaaucucaa

SEQ ID NO: 3359296 - RNA, 22 nt, Neisseria meningitidis Z2491
cugauacgggcggcucucaaaa

SEQ ID NO: 3359297 - RNA, 20 nt, Neisseria meningitidis Z2491
cugauaguugccgucaaaga

SEQ ID NO: 3359298 - RNA, 22 nt, Neisseria meningitidis Z2491
cugauaucggaggaguuugaug

SEQ ID NO: 3359299 - RNA, 14 nt, Neisseria meningitidis Z2491
cugauccaaaccgu

SEQ ID NO: 3359300 - RNA, 13 nt, Neisseria meningitidis Z2491
cugaugacggcag

SEQ ID NO: 3359301 - RNA, 16 nt, Neisseria meningitidis Z2491
cugaugacggcagcca

SEQ ID NO: 3359302 - RNA, 16 nt, Neisseria meningitidis Z2491
cugauguauucuucca

SEQ ID NO: 3359303 - RNA, 23 nt, Neisseria meningitidis Z2491
cugauucaacgccgauuaauccg

SEQ ID NO: 3359304 - RNA, 23 nt, Neisseria meningitidis Z2491
cugauuuaaaaccauaaggcuuu

SEQ ID NO: 3359305 - RNA, 14 nt, Neisseria meningitidis Z2491
cugauuuaaauuua

SEQ ID NO: 3359306 - RNA, 18 nt, Neisseria meningitidis Z2491
cugauuucguaauccgca

SEQ ID NO: 3359307 - RNA, 14 nt, Neisseria meningitidis Z2491
cugauuuugagaaa

SEQ ID NO: 3359308 - RNA, 16 nt, Neisseria meningitidis Z2491
cugauuuugauuuucc

SEQ ID NO: 3359309 - RNA, 12 nt, Neisseria meningitidis Z2491
cugauuuuuccu

SEQ ID NO: 3359310 - RNA, 19 nt, Neisseria meningitidis Z2491
cugauuuuuccuacuuuuu

SEQ ID NO: 3359311 - RNA, 15 nt, Neisseria meningitidis Z2491
cugauuuuuguuaau

SEQ ID NO: 3359312 - RNA, 19 nt, Neisseria meningitidis Z2491
cugauuuuuguuaauccac

SEQ ID NO: 3359313 - RNA, 13 nt, Neisseria meningitidis Z2491
cugcaaaauuuau

SEQ ID NO: 3359314 - RNA, 14 nt, Neisseria meningitidis Z2491
cugcaaaauuuauc

SEQ ID NO: 3359315 - RNA, 15 nt, Neisseria meningitidis Z2491
cugcaaaauuuaucc

SEQ ID NO: 3359316 - RNA, 19 nt, Neisseria meningitidis Z2491
cugcaacguuucagacggu

SEQ ID NO: 3359317 - RNA, 16 nt, Neisseria meningitidis Z2491
cugcaagaauuuauca

SEQ ID NO: 3359318 - RNA, 23 nt, Neisseria meningitidis Z2491
cugcaaugcacuacuucauuuuu

SEQ ID NO: 3359319 - RNA, 17 nt, Neisseria meningitidis Z2491
cugcaggcguaugccuu

SEQ ID NO: 3359320 - RNA, 22 nt, Neisseria meningitidis Z2491
cugcagguagcggcugagggcu

SEQ ID NO: 3359321 - RNA, 18 nt, Neisseria meningitidis Z2491
cugcaguaacuucaaacc

SEQ ID NO: 3359322 - RNA, 18 nt, Neisseria meningitidis Z2491
cugcaguugggcgauggc

SEQ ID NO: 3359323 - RNA, 16 nt, Neisseria meningitidis Z2491
cugcaucacguucuga

SEQ ID NO: 3359324 - RNA, 22 nt, Neisseria meningitidis Z2491
cugcaucccgucauuccucaaa

SEQ ID NO: 3359325 - RNA, 19 nt, Neisseria meningitidis Z2491
cugcaucgccgcuucaucu

SEQ ID NO: 3359326 - RNA, 23 nt, Neisseria meningitidis Z2491
cugcaugagcgagcgggcgugau

SEQ ID NO: 3359327 - RNA, 13 nt, Neisseria meningitidis Z2491
cugccaaaacuca

SEQ ID NO: 3359328 - RNA, 16 nt, Neisseria meningitidis Z2491
cugccacgaugggcau

SEQ ID NO: 3359329 - RNA, 18 nt, Neisseria meningitidis Z2491
cugccauuccccuaugcu

SEQ ID NO: 3359330 - RNA, 17 nt, Neisseria meningitidis Z2491
cugcccaucgccucuuc

SEQ ID NO: 3359331 - RNA, 23 nt, Neisseria meningitidis Z2491
cugccccguuuuacccucucccc

SEQ ID NO: 3359332 - RNA, 19 nt, Neisseria meningitidis Z2491
cugcccgacugugcccaca

SEQ ID NO: 3359333 - RNA, 20 nt, Neisseria meningitidis Z2491
cugccgaaaccaaaagccaa

SEQ ID NO: 3359334 - RNA, 13 nt, Neisseria meningitidis Z2491
cugccgaccgcgc

SEQ ID NO: 3359335 - RNA, 21 nt, Neisseria meningitidis Z2491
cugccgaggcgcgugaauuug

SEQ ID NO: 3359336 - RNA, 14 nt, Neisseria meningitidis Z2491
cugccgauuucuuc

SEQ ID NO: 3359337 - RNA, 13 nt, Neisseria meningitidis Z2491
cugccgcacaagc

SEQ ID NO: 3359338 - RNA, 17 nt, Neisseria meningitidis Z2491
cugccgcacaagcccua

SEQ ID NO: 3359339 - RNA, 14 nt, Neisseria meningitidis Z2491
cugccgccgcccgg

SEQ ID NO: 3359340 - RNA, 15 nt, Neisseria meningitidis Z2491
cugccgccgccuugu

SEQ ID NO: 3359341 - RNA, 12 nt, Neisseria meningitidis Z2491
cugccgcugaaa

SEQ ID NO: 3359342 - RNA, 17 nt, Neisseria meningitidis Z2491
cugccguauuuauuucc

SEQ ID NO: 3359343 - RNA, 16 nt, Neisseria meningitidis Z2491
cugccgucugaaaccg

SEQ ID NO: 3359344 - RNA, 14 nt, Neisseria meningitidis Z2491
cugccgugaugccc

SEQ ID NO: 3359345 - RNA, 22 nt, Neisseria meningitidis Z2491
cugccgugggugcuuuggcuuc

SEQ ID NO: 3359346 - RNA, 17 nt, Neisseria meningitidis Z2491
cugccucuuuucagaca

SEQ ID NO: 3359347 - RNA, 18 nt, Neisseria meningitidis Z2491
cugccugauacagccacg

SEQ ID NO: 3359348 - RNA, 22 nt, Neisseria meningitidis Z2491
cugccugcgcgagaauaaugaa

SEQ ID NO: 3359349 - RNA, 15 nt, Neisseria meningitidis Z2491
cugccuguuuuucuu

SEQ ID NO: 3359350 - RNA, 22 nt, Neisseria meningitidis Z2491
cugccuucgggauaaucuuuuc

SEQ ID NO: 3359351 - RNA, 22 nt, Neisseria meningitidis Z2491
cugcgcagguuguuggaaaagu

SEQ ID NO: 3359352 - RNA, 13 nt, Neisseria meningitidis Z2491
cugcgcccaaagc

SEQ ID NO: 3359353 - RNA, 14 nt, Neisseria meningitidis Z2491
cugcgcgggaauga

SEQ ID NO: 3359354 - RNA, 19 nt, Neisseria meningitidis Z2491
cugcgcgggaaugacggau

SEQ ID NO: 3359355 - RNA, 20 nt, Neisseria meningitidis Z2491
cugcgcgggaaugacggcaa

SEQ ID NO: 3359356 - RNA, 19 nt, Neisseria meningitidis Z2491
cugcgcgggaaugacggcg

SEQ ID NO: 3359357 - RNA, 13 nt, Neisseria meningitidis Z2491
cugcggaaacaga

SEQ ID NO: 3359358 - RNA, 16 nt, Neisseria meningitidis Z2491
cugcggacuuaagaaa

SEQ ID NO: 3359359 - RNA, 19 nt, Neisseria meningitidis Z2491
cugcggcgggacgcgcgcc

SEQ ID NO: 3359360 - RNA, 20 nt, Neisseria meningitidis Z2491
cugcggcgggacgcgcgcca

SEQ ID NO: 3359361 - RNA, 17 nt, Neisseria meningitidis Z2491
cugcggcuuugccgccu

SEQ ID NO: 3359362 - RNA, 13 nt, Neisseria meningitidis Z2491
cugcgggaaugac

SEQ ID NO: 3359363 - RNA, 14 nt, Neisseria meningitidis Z2491
cugcgucaaaccag

SEQ ID NO: 3359364 - RNA, 19 nt, Neisseria meningitidis Z2491
cugcucgccacauaauuca

SEQ ID NO: 3359365 - RNA, 16 nt, Neisseria meningitidis Z2491
cugcucggccugcccu

SEQ ID NO: 3359366 - RNA, 20 nt, Neisseria meningitidis Z2491
cugcucggccugcccugcca

SEQ ID NO: 3359367 - RNA, 22 nt, Neisseria meningitidis Z2491
cugcucggccugcccugccaaa

SEQ ID NO: 3359368 - RNA, 19 nt, Neisseria meningitidis Z2491
cugcucuacgauaacgccg

SEQ ID NO: 3359369 - RNA, 14 nt, Neisseria meningitidis Z2491
cugcugccaucuca

SEQ ID NO: 3359370 - RNA, 12 nt, Neisseria meningitidis Z2491
cugcugccgccc

SEQ ID NO: 3359371 - RNA, 13 nt, Neisseria meningitidis Z2491
cugcugccgcccc

SEQ ID NO: 3359372 - RNA, 17 nt, Neisseria meningitidis Z2491
cugcugcuuuucauuuc

SEQ ID NO: 3359373 - RNA, 17 nt, Neisseria meningitidis Z2491
cugcuggcagucuauca

SEQ ID NO: 3359374 - RNA, 19 nt, Neisseria meningitidis Z2491
cugcugguuuuucggcaca

SEQ ID NO: 3359375 - RNA, 18 nt, Neisseria meningitidis Z2491
cugcuguauuuuuccaac

SEQ ID NO: 3359376 - RNA, 20 nt, Neisseria meningitidis Z2491
cugcuucggcggagaggcuu

SEQ ID NO: 3359377 - RNA, 18 nt, Neisseria meningitidis Z2491
cugcuugaccaaagcauu

SEQ ID NO: 3359378 - RNA, 20 nt, Neisseria meningitidis Z2491
cugcuugaccaaagcauuuu

SEQ ID NO: 3359379 - RNA, 17 nt, Neisseria meningitidis Z2491
cugcuuuaauucuccaa

SEQ ID NO: 3359380 - RNA, 15 nt, Neisseria meningitidis Z2491
cuggaaaccaaaaaa

SEQ ID NO: 3359381 - RNA, 14 nt, Neisseria meningitidis Z2491
cuggaacuugaaaa

SEQ ID NO: 3359382 - RNA, 16 nt, Neisseria meningitidis Z2491
cuggaacuugaaaaca

SEQ ID NO: 3359383 - RNA, 19 nt, Neisseria meningitidis Z2491
cuggaugccgcgccgccgg

SEQ ID NO: 3359384 - RNA, 18 nt, Neisseria meningitidis Z2491
cuggcaaauugaaaugcc

SEQ ID NO: 3359385 - RNA, 23 nt, Neisseria meningitidis Z2491
cuggcgguaaagugcggugaaau

SEQ ID NO: 3359386 - RNA, 15 nt, Neisseria meningitidis Z2491
cugggugguggcaag

SEQ ID NO: 3359387 - RNA, 14 nt, Neisseria meningitidis Z2491
cuggucgccguuca

SEQ ID NO: 3359388 - RNA, 16 nt, Neisseria meningitidis Z2491
cugguguugauaauca

SEQ ID NO: 3359389 - RNA, 21 nt, Neisseria meningitidis Z2491
cugguguugauaaucaucacu

SEQ ID NO: 3359390 - RNA, 12 nt, Neisseria meningitidis Z2491
cugguugauguc

SEQ ID NO: 3359391 - RNA, 20 nt, Neisseria meningitidis Z2491
cugguuuaaauuuaauccau

SEQ ID NO: 3359392 - RNA, 20 nt, Neisseria meningitidis Z2491
cugguuuuugugaauccacu

SEQ ID NO: 3359393 - RNA, 19 nt, Neisseria meningitidis Z2491
cugguuuuuguuaauccac

SEQ ID NO: 3359394 - RNA, 16 nt, Neisseria meningitidis Z2491
cuguaaaaacaaaaaa

SEQ ID NO: 3359395 - RNA, 12 nt, Neisseria meningitidis Z2491
cuguaaacagau

SEQ ID NO: 3359396 - RNA, 19 nt, Neisseria meningitidis Z2491
cuguaaacagauaaaacca

SEQ ID NO: 3359397 - RNA, 20 nt, Neisseria meningitidis Z2491
cuguaaaucgucauucccgc

SEQ ID NO: 3359398 - RNA, 12 nt, Neisseria meningitidis Z2491
cuguaccagcaa

SEQ ID NO: 3359399 - RNA, 17 nt, Neisseria meningitidis Z2491
cuguaccguuucagacg

SEQ ID NO: 3359400 - RNA, 15 nt, Neisseria meningitidis Z2491
cuguacgaauccgcc

SEQ ID NO: 3359401 - RNA, 14 nt, Neisseria meningitidis Z2491
cuguacgcugaugu

SEQ ID NO: 3359402 - RNA, 22 nt, Neisseria meningitidis Z2491
cuucgucauucccgugaaaacg

SEQ ID NO: 3359403 - RNA, 13 nt, Neisseria meningitidis Z2491
cuucguccgugcc

SEQ ID NO: 3359404 - RNA, 17 nt, Neisseria meningitidis Z2491
cuucgucgccuuguccu

SEQ ID NO: 3359405 - RNA, 22 nt, Neisseria meningitidis Z2491
cuucgucgccuuguccugauuu

SEQ ID NO: 3359406 - RNA, 16 nt, Neisseria meningitidis Z2491
cuucuaaaaauucuuc

SEQ ID NO: 3359407 - RNA, 17 nt, Neisseria meningitidis Z2491
cuucuaaaaauucuucu

SEQ ID NO: 3359408 - RNA, 22 nt, Neisseria meningitidis Z2491
cuucuaaaaauucuucuuucca

SEQ ID NO: 3359409 - RNA, 19 nt, Neisseria meningitidis Z2491
cuucugacagcauuuccac

SEQ ID NO: 3359410 - RNA, 22 nt, Neisseria meningitidis Z2491
cuucuguaacuuccacaccguu

SEQ ID NO: 3359411 - RNA, 19 nt, Neisseria meningitidis Z2491
cuucuucgacguugccuuc

SEQ ID NO: 3359412 - RNA, 21 nt, Neisseria meningitidis Z2491
cuucuucgacguugccuucuu

SEQ ID NO: 3359413 - RNA, 14 nt, Neisseria meningitidis Z2491
cuucuuuccaucca

SEQ ID NO: 3359414 - RNA, 17 nt, Neisseria meningitidis Z2491
cuugaaaacaucggguu

SEQ ID NO: 3359415 - RNA, 18 nt, Neisseria meningitidis Z2491
cuugaaaacaucggguuu

SEQ ID NO: 3359416 - RNA, 21 nt, Neisseria meningitidis Z2491
cuugaagucggcuucuuccuc

SEQ ID NO: 3359417 - RNA, 17 nt, Neisseria meningitidis Z2491
cuugaccgcagccgaac

SEQ ID NO: 3359418 - RNA, 14 nt, Neisseria meningitidis Z2491
cuugagauggucaa

SEQ ID NO: 3359419 - RNA, 16 nt, Neisseria meningitidis Z2491
cuugagcguucagacg

SEQ ID NO: 3359420 - RNA, 17 nt, Neisseria meningitidis Z2491
cuugaggucuuugauga

SEQ ID NO: 3359421 - RNA, 16 nt, Neisseria meningitidis Z2491
cuugaguuucagucau

SEQ ID NO: 3359422 - RNA, 21 nt, Neisseria meningitidis Z2491
cuugaguuucagucauucccg

SEQ ID NO: 3359423 - RNA, 16 nt, Neisseria meningitidis Z2491
cuugauauugcggcuu

SEQ ID NO: 3359424 - RNA, 15 nt, Neisseria meningitidis Z2491
cuugcaaaauagaaa

SEQ ID NO: 3359425 - RNA, 19 nt, Neisseria meningitidis Z2491
cuugcaaauaauugaaauc

SEQ ID NO: 3359426 - RNA, 21 nt, Neisseria meningitidis Z2491
cuugcaaauaauugaaaucaa

SEQ ID NO: 3359427 - RNA, 19 nt, Neisseria meningitidis Z2491
cuugcaagcaguugaaauc

SEQ ID NO: 3359428 - RNA, 16 nt, Neisseria meningitidis Z2491
cuugcagcuuugcguu

SEQ ID NO: 3359429 - RNA, 16 nt, Neisseria meningitidis Z2491
cuugcagguggaauuc

SEQ ID NO: 3359430 - RNA, 14 nt, Neisseria meningitidis Z2491
cuugccauucucac

SEQ ID NO: 3359431 - RNA, 19 nt, Neisseria meningitidis Z2491
cuugcccgacgacgaccuc

SEQ ID NO: 3359432 - RNA, 17 nt, Neisseria meningitidis Z2491
cuugccgcauuaaaauu

SEQ ID NO: 3359433 - RNA, 18 nt, Neisseria meningitidis Z2491
cuugcugguaacauuaac

SEQ ID NO: 3359434 - RNA, 19 nt, Neisseria meningitidis Z2491
cuuggauaaacauuuuugc

SEQ ID NO: 3359435 - RNA, 15 nt, Neisseria meningitidis Z2491
cuuggcaaaaucugg

SEQ ID NO: 3359436 - RNA, 16 nt, Neisseria meningitidis Z2491
cuuggcagcagaugaa

SEQ ID NO: 3359437 - RNA, 19 nt, Neisseria meningitidis Z2491
cuuggcagcagaugaagcu

SEQ ID NO: 3359438 - RNA, 15 nt, Neisseria meningitidis Z2491
cuuggcgggaagcca

SEQ ID NO: 3359439 - RNA, 16 nt, Neisseria meningitidis Z2491
cuuggcgggaagccag

SEQ ID NO: 3359440 - RNA, 19 nt, Neisseria meningitidis Z2491
cuugguagauuggauuugg

SEQ ID NO: 3359441 - RNA, 13 nt, Neisseria meningitidis Z2491
cuugguuuugcuu

SEQ ID NO: 3359442 - RNA, 11 nt, Neisseria meningitidis Z2491
cuuguccugau

SEQ ID NO: 3359443 - RNA, 14 nt, Neisseria meningitidis Z2491
cuuguccugauuuu

SEQ ID NO: 3359444 - RNA, 16 nt, Neisseria meningitidis Z2491
cuuguccugauuuuug

SEQ ID NO: 3359445 - RNA, 20 nt, Neisseria meningitidis Z2491
cuuguccugauuuuuguuaa

SEQ ID NO: 3359446 - RNA, 12 nt, Neisseria meningitidis Z2491
cuugucggcuuc

SEQ ID NO: 3359447 - RNA, 14 nt, Neisseria meningitidis Z2491
cuugucgggauugu

SEQ ID NO: 3359448 - RNA, 17 nt, Neisseria meningitidis Z2491
cuugugaaguagacaaa

SEQ ID NO: 3359449 - RNA, 14 nt, Neisseria meningitidis Z2491
cuugugccugcucc

SEQ ID NO: 3359450 - RNA, 16 nt, Neisseria meningitidis Z2491
cuuguggguauuuacc

SEQ ID NO: 3359451 - RNA, 15 nt, Neisseria meningitidis Z2491
cuuguucggaaucac

SEQ ID NO: 3359452 - RNA, 15 nt, Neisseria meningitidis Z2491
cuuuaaauucaacuu

SEQ ID NO: 3359453 - RNA, 12 nt, Neisseria meningitidis Z2491
cuuuaaauuuaa

SEQ ID NO: 3359454 - RNA, 13 nt, Neisseria meningitidis Z2491
cuuuaaauuuaaa

SEQ ID NO: 3359455 - RNA, 17 nt, Neisseria meningitidis Z2491
cuuuaaucauguugccg

SEQ ID NO: 3359456 - RNA, 20 nt, Neisseria meningitidis Z2491
cuuucaaaagguucaaacac

SEQ ID NO: 3359457 - RNA, 12 nt, Neisseria meningitidis Z2491
cuuucaacggca

SEQ ID NO: 3359458 - RNA, 13 nt, Neisseria meningitidis Z2491
cuuucaacggcac

SEQ ID NO: 3359459 - RNA, 14 nt, Neisseria meningitidis Z2491
cuuucagacggcau

SEQ ID NO: 3359460 - RNA, 18 nt, Neisseria meningitidis Z2491
cuuucagacggcaucaaa

SEQ ID NO: 3359461 - RNA, 16 nt, Neisseria meningitidis Z2491
cuuucagacggcauuu

SEQ ID NO: 3359462 - RNA, 20 nt, Neisseria meningitidis Z2491
cuuucagacggcauuucccg

SEQ ID NO: 3359463 - RNA, 14 nt, Neisseria meningitidis Z2491
cuuucagacggccu

SEQ ID NO: 3359464 - RNA, 22 nt, Neisseria meningitidis Z2491
cuuucaggaagucgggcaaagc

SEQ ID NO: 3359465 - RNA, 23 nt, Neisseria meningitidis Z2491
cuuuccaugcuuaaacagcacug

SEQ ID NO: 3359466 - RNA, 17 nt, Neisseria meningitidis Z2491
cuuucccguuucagacg

SEQ ID NO: 3359467 - RNA, 21 nt, Neisseria meningitidis Z2491
cuuucccguuucagacggcau

SEQ ID NO: 3359468 - RNA, 20 nt, Neisseria meningitidis Z2491
cuuucccucccgacagccga

SEQ ID NO: 3359469 - RNA, 22 nt, Neisseria meningitidis Z2491
cuuuccguucggaacacaaaaa

SEQ ID NO: 3359470 - RNA, 23 nt, Neisseria meningitidis Z2491
cuuuccguucggaacacaaaaaa

SEQ ID NO: 3359471 - RNA, 16 nt, Neisseria meningitidis Z2491
cuuuccucuuucauca

SEQ ID NO: 3359472 - RNA, 12 nt, Neisseria meningitidis Z2491
cuuucgucauuc

SEQ ID NO: 3359473 - RNA, 23 nt, Neisseria meningitidis Z2491
cuuucuguuuuuuccgguaaauu

SEQ ID NO: 3359474 - RNA, 18 nt, Neisseria meningitidis Z2491
cuuucuuacgucauucuu

SEQ ID NO: 3359475 - RNA, 20 nt, Neisseria meningitidis Z2491
cuuugaacauggacaacagc

SEQ ID NO: 3359476 - RNA, 15 nt, Neisseria meningitidis Z2491
cuuugaagacgauuu

SEQ ID NO: 3359477 - RNA, 23 nt, Neisseria meningitidis Z2491
cuuugaauauuacuguuguucua

SEQ ID NO: 3359478 - RNA, 16 nt, Neisseria meningitidis Z2491
cuuugaauauugccgc

SEQ ID NO: 3359479 - RNA, 17 nt, Neisseria meningitidis Z2491
cuuugaauauugccgcc

SEQ ID NO: 3359480 - RNA, 16 nt, Neisseria meningitidis Z2491
cuuugaauauugccgu

SEQ ID NO: 3359481 - RNA, 23 nt, Neisseria meningitidis Z2491
cuuugaauauugcuguuguucua

SEQ ID NO: 3359482 - RNA, 12 nt, Neisseria meningitidis Z2491
cuuugacaaaau

SEQ ID NO: 3359483 - RNA, 17 nt, Neisseria meningitidis Z2491
cuuugacaaaauccagu

SEQ ID NO: 3359484 - RNA, 22 nt, Neisseria meningitidis Z2491
cuuugacggcgggcaggcggcu

SEQ ID NO: 3359485 - RNA, 16 nt, Neisseria meningitidis Z2491
cuuugauuucggcguu

SEQ ID NO: 3359486 - RNA, 15 nt, Neisseria meningitidis Z2491
cuuugcaaaauuccc

SEQ ID NO: 3359487 - RNA, 18 nt, Neisseria meningitidis Z2491
cuuugcagaaagcuucca

SEQ ID NO: 3359488 - RNA, 18 nt, Neisseria meningitidis Z2491
cuuugcgcacucacuuua

SEQ ID NO: 3359489 - RNA, 15 nt, Neisseria meningitidis Z2491
cuuugcucagcccga

SEQ ID NO: 3359490 - RNA, 15 nt, Neisseria meningitidis Z2491
cuuuggaacaaaaaa

SEQ ID NO: 3359491 - RNA, 10 nt, Neisseria meningitidis Z2491
cuuuggcuuc

SEQ ID NO: 3359492 - RNA, 21 nt, Neisseria meningitidis Z2491
cuuugggcgacggcaauauuc

SEQ ID NO: 3359493 - RNA, 17 nt, Neisseria meningitidis Z2491
cuuuguaagaguucguc

SEQ ID NO: 3359494 - RNA, 15 nt, Neisseria meningitidis Z2491
cuuuguugcuguaug

SEQ ID NO: 3359495 - RNA, 11 nt, Neisseria meningitidis Z2491
cuuuguuucaa

SEQ ID NO: 3359496 - RNA, 21 nt, Neisseria meningitidis Z2491
cuuuucacuucgauuucuuug

SEQ ID NO: 3359497 - RNA, 12 nt, Neisseria meningitidis Z2491
cuuuucauauca

SEQ ID NO: 3359498 - RNA, 15 nt, Neisseria meningitidis Z2491
cuuuucccugacaaa

SEQ ID NO: 3359499 - RNA, 21 nt, Neisseria meningitidis Z2491
cuuuucuaaaauaugcagaga

SEQ ID NO: 3359500 - RNA, 22 nt, Neisseria meningitidis Z2491
cuuuucuuaugccuauuuuuua

SEQ ID NO: 3359501 - RNA, 15 nt, Neisseria meningitidis Z2491
cuuuugaggcugccg

SEQ ID NO: 3359502 - RNA, 16 nt, Neisseria meningitidis Z2491
cuuuuuaaacaacaaa

SEQ ID NO: 3359503 - RNA, 22 nt, Neisseria meningitidis Z2491
cuuuuuaaacaacaaauuuuug

SEQ ID NO: 3359504 - RNA, 12 nt, Neisseria meningitidis Z2491
gaaaugacugaa

SEQ ID NO: 3359505 - RNA, 13 nt, Neisseria meningitidis Z2491
gaaaugacugaaa

SEQ ID NO: 3359506 - RNA, 17 nt, Neisseria meningitidis Z2491
gaaaugacugaaacuca

SEQ ID NO: 3359507 - RNA, 22 nt, Neisseria meningitidis Z2491
gaaaugacugaaacucaaaaaa

SEQ ID NO: 3359508 - RNA, 22 nt, Neisseria meningitidis Z2491
gaaaugacugaaauucaaaaaa

SEQ ID NO: 3359509 - RNA, 12 nt, Neisseria meningitidis Z2491
gaaaugccgucu

SEQ ID NO: 3359510 - RNA, 16 nt, Neisseria meningitidis Z2491
gaaaugccgucugaaa

SEQ ID NO: 3359511 - RNA, 16 nt, Neisseria meningitidis Z2491
gaaaugccgucugaac

SEQ ID NO: 3359512 - RNA, 18 nt, Neisseria meningitidis Z2491
gaaaugccgucugaagcc

SEQ ID NO: 3359513 - RNA, 21 nt, Neisseria meningitidis Z2491
gaaaugccgucugaagcccuu

SEQ ID NO: 3359514 - RNA, 18 nt, Neisseria meningitidis Z2491
gaaaugguuuaagagcuc

SEQ ID NO: 3359515 - RNA, 23 nt, Neisseria meningitidis Z2491
gaaaugguuuaagagcucgccgc

SEQ ID NO: 3359516 - RNA, 17 nt, Neisseria meningitidis Z2491
gaaauucaaaaaaccgu

SEQ ID NO: 3359517 - RNA, 17 nt, Neisseria meningitidis Z2491
gaaauucgucauucccg

SEQ ID NO: 3359518 - RNA, 14 nt, Neisseria meningitidis Z2491
gaaauucuagauuc

SEQ ID NO: 3359519 - RNA, 22 nt, Neisseria meningitidis Z2491
gaaauugaagcgucccaaauau

SEQ ID NO: 3359520 - RNA, 13 nt, Neisseria meningitidis Z2491
gaaauugccuuca

SEQ ID NO: 3359521 - RNA, 19 nt, Neisseria meningitidis Z2491
gaaauugccuucaucagca

SEQ ID NO: 3359522 - RNA, 20 nt, Neisseria meningitidis Z2491
gaaauugccuucaucagcau

SEQ ID NO: 3359523 - RNA, 12 nt, Neisseria meningitidis Z2491
gaaauuucagac

SEQ ID NO: 3359524 - RNA, 23 nt, Neisseria meningitidis Z2491
gaaauuucagacggcguuuuugu

SEQ ID NO: 3359525 - RNA, 22 nt, Neisseria meningitidis Z2491
gaaauuuccaaauauaaaaaau

SEQ ID NO: 3359526 - RNA, 14 nt, Neisseria meningitidis Z2491
gaacaaagaaagca

SEQ ID NO: 3359527 - RNA, 12 nt, Neisseria meningitidis Z2491
gaacaaugcaaa

SEQ ID NO: 3359528 - RNA, 15 nt, Neisseria meningitidis Z2491
gaacaaugcaaaaac

SEQ ID NO: 3359529 - RNA, 17 nt, Neisseria meningitidis Z2491
gaacaaugcaaaaacau

SEQ ID NO: 3359530 - RNA, 23 nt, Neisseria meningitidis Z2491
gaacaauucucuaaggugcugaa

SEQ ID NO: 3359531 - RNA, 18 nt, Neisseria meningitidis Z2491
gaacacagacauagacug

SEQ ID NO: 3359532 - RNA, 14 nt, Neisseria meningitidis Z2491
gaacacgaccacuu

SEQ ID NO: 3359533 - RNA, 19 nt, Neisseria meningitidis Z2491
gaacacggguucagacggc

SEQ ID NO: 3359534 - RNA, 21 nt, Neisseria meningitidis Z2491
gaacacggguucagacggcau

SEQ ID NO: 3359535 - RNA, 21 nt, Neisseria meningitidis Z2491
gaacagaaaaccaaaaacaga

SEQ ID NO: 3359536 - RNA, 22 nt, Neisseria meningitidis Z2491
gaacagaaaaccaaaaacagaa

SEQ ID NO: 3359537 - RNA, 18 nt, Neisseria meningitidis Z2491
gaacagcaucaaaccaua

SEQ ID NO: 3359538 - RNA, 15 nt, Neisseria meningitidis Z2491
gaacaggcggcggca

SEQ ID NO: 3359539 - RNA, 19 nt, Neisseria meningitidis Z2491
gaacaggcggcggcauauc

SEQ ID NO: 3359540 - RNA, 22 nt, Neisseria meningitidis Z2491
gaacaggcuucagacggcauuu

SEQ ID NO: 3359541 - RNA, 21 nt, Neisseria meningitidis Z2491
gaacagugggaaagauuugca

SEQ ID NO: 3359542 - RNA, 17 nt, Neisseria meningitidis Z2491
gaacaguguuucagacg

SEQ ID NO: 3359543 - RNA, 22 nt, Neisseria meningitidis Z2491
gaacaguguuucagacggccuu

SEQ ID NO: 3359544 - RNA, 18 nt, Neisseria meningitidis Z2491
gaaccagggauuuuucaa

SEQ ID NO: 3359545 - RNA, 14 nt, Neisseria meningitidis Z2491
gaacccgacuucug

SEQ ID NO: 3359546 - RNA, 16 nt, Neisseria meningitidis Z2491
gaacccgacuucugac

SEQ ID NO: 3359547 - RNA, 21 nt, Neisseria meningitidis Z2491
gaacccgauuggauucagacg

SEQ ID NO: 3359548 - RNA, 14 nt, Neisseria meningitidis Z2491
gaaccgcaaaugcu

SEQ ID NO: 3359549 - RNA, 15 nt, Neisseria meningitidis Z2491
gaaccgucauucccg

SEQ ID NO: 3359550 - RNA, 15 nt, Neisseria meningitidis Z2491
gaaccguuuuccgcc

SEQ ID NO: 3359551 - RNA, 18 nt, Neisseria meningitidis Z2491
gaaccucaaacuuucaga

SEQ ID NO: 3359552 - RNA, 16 nt, Neisseria meningitidis Z2491
gaaccugaccgaagca

SEQ ID NO: 3359553 - RNA, 22 nt, Neisseria meningitidis Z2491
gaaccuggauucccgccugcgc

SEQ ID NO: 3359554 - RNA, 15 nt, Neisseria meningitidis Z2491
gaacgaaugccgucu

SEQ ID NO: 3359555 - RNA, 22 nt, Neisseria meningitidis Z2491
gaacgcgucuuccgucugcggc

SEQ ID NO: 3359556 - RNA, 14 nt, Neisseria meningitidis Z2491
gaacggagccagcc

SEQ ID NO: 3359557 - RNA, 22 nt, Neisseria meningitidis Z2491
gaacguggaaucuaaagaaacc

SEQ ID NO: 3359558 - RNA, 15 nt, Neisseria meningitidis Z2491
gaacugccugcaacg

SEQ ID NO: 3359559 - RNA, 16 nt, Neisseria meningitidis Z2491
gaacugccugccuucc

SEQ ID NO: 3359560 - RNA, 22 nt, Neisseria meningitidis Z2491
gaagaaagcggaauacggcaac

SEQ ID NO: 3359561 - RNA, 17 nt, Neisseria meningitidis Z2491
gaagaaauagccgccgc

SEQ ID NO: 3359562 - RNA, 12 nt, Neisseria meningitidis Z2491
gaagaagugcgu

SEQ ID NO: 3359563 - RNA, 17 nt, Neisseria meningitidis Z2491
gaagaagugggucagcc

SEQ ID NO: 3359564 - RNA, 17 nt, Neisseria meningitidis Z2491
gaagacgauuugguugu

SEQ ID NO: 3359565 - RNA, 21 nt, Neisseria meningitidis Z2491
gaagacgauuugguugucagg

SEQ ID NO: 3359566 - RNA, 13 nt, Neisseria meningitidis Z2491
gaagaucauaccu

SEQ ID NO: 3359567 - RNA, 16 nt, Neisseria meningitidis Z2491
gaagcauaagccgcca

SEQ ID NO: 3359568 - RNA, 14 nt, Neisseria meningitidis Z2491
gaagcaucagcgga

SEQ ID NO: 3359569 - RNA, 20 nt, Neisseria meningitidis Z2491
gaagccagccccaccauugu

SEQ ID NO: 3359570 - RNA, 20 nt, Neisseria meningitidis Z2491
gaagcccacccuaccauugu

SEQ ID NO: 3359571 - RNA, 19 nt, Neisseria meningitidis Z2491
gaagcccuuucagacggca

SEQ ID NO: 3359572 - RNA, 20 nt, Neisseria meningitidis Z2491
gaagcccuuucagacggcau

SEQ ID NO: 3359573 - RNA, 13 nt, Neisseria meningitidis Z2491
gaagccgcagaca

SEQ ID NO: 3359574 - RNA, 20 nt, Neisseria meningitidis Z2491
gaagccgcuucagacggcau

SEQ ID NO: 3359575 - RNA, 13 nt, Neisseria meningitidis Z2491
gaagccuucagac

SEQ ID NO: 3359576 - RNA, 16 nt, Neisseria meningitidis Z2491
gaagccuucagacggc

SEQ ID NO: 3359577 - RNA, 18 nt, Neisseria meningitidis Z2491
gaagccuucagacggcau

SEQ ID NO: 3359578 - RNA, 23 nt, Neisseria meningitidis Z2491
gaagcggaaagccgccgggguuu

SEQ ID NO: 3359579 - RNA, 14 nt, Neisseria meningitidis Z2491
gaagcggaaaucgu

SEQ ID NO: 3359580 - RNA, 22 nt, Neisseria meningitidis Z2491
gaagcggcggcaucugcugcgu

SEQ ID NO: 3359581 - RNA, 17 nt, Neisseria meningitidis Z2491
gaagcgguucagacggc

SEQ ID NO: 3359582 - RNA, 23 nt, Neisseria meningitidis Z2491
gaagcguauguggucaggcccug

SEQ ID NO: 3359583 - RNA, 19 nt, Neisseria meningitidis Z2491
gaagcucaaaaaaccggau

SEQ ID NO: 3359584 - RNA, 12 nt, Neisseria meningitidis Z2491
gaaggcggcggc

SEQ ID NO: 3359585 - RNA, 18 nt, Neisseria meningitidis Z2491
gaaggcgggcaggcagug

SEQ ID NO: 3359586 - RNA, 21 nt, Neisseria meningitidis Z2491
gaaggcggggcggucagcggu

SEQ ID NO: 3359587 - RNA, 17 nt, Neisseria meningitidis Z2491
gaaggcuucagacggca

SEQ ID NO: 3359588 - RNA, 15 nt, Neisseria meningitidis Z2491
gaaggggcggaaugc

SEQ ID NO: 3359589 - RNA, 17 nt, Neisseria meningitidis Z2491
gaaggggcugauguauu

SEQ ID NO: 3359590 - RNA, 18 nt, Neisseria meningitidis Z2491
gaaggguuuuguuuuuuc

SEQ ID NO: 3359591 - RNA, 23 nt, Neisseria meningitidis Z2491
gaagguuuuaggcaauugaaaau

SEQ ID NO: 3359592 - RNA, 22 nt, Neisseria meningitidis Z2491
gaagucgugaauuaaaugcuaa

SEQ ID NO: 3359593 - RNA, 20 nt, Neisseria meningitidis Z2491
gaagugcguacgcaggcugg

SEQ ID NO: 3359594 - RNA, 14 nt, Neisseria meningitidis Z2491
gaauaaaaaauaug

SEQ ID NO: 3359595 - RNA, 15 nt, Neisseria meningitidis Z2491
gaauaaaaaauaugg

SEQ ID NO: 3359596 - RNA, 23 nt, Neisseria meningitidis Z2491
gaauaaaaaauauggaucagaca

SEQ ID NO: 3359597 - RNA, 15 nt, Neisseria meningitidis Z2491
gaauaaacuucuaac

SEQ ID NO: 3359598 - RNA, 17 nt, Neisseria meningitidis Z2491
gaauaaauuuugaaacu

SEQ ID NO: 3359599 - RNA, 16 nt, Neisseria meningitidis Z2491
gaauaagucagcgugc

SEQ ID NO: 3359600 - RNA, 19 nt, Neisseria meningitidis Z2491
gaauaaucuuauaaagaca

SEQ ID NO: 3359601 - RNA, 15 nt, Neisseria meningitidis Z2491
gaauaaugaaaaugu

SEQ ID NO: 3359602 - RNA, 13 nt, Neisseria meningitidis Z2491
gaauacaaacauc

SEQ ID NO: 3359603 - RNA, 19 nt, Neisseria meningitidis Z2491
gaauacaaacaucugauuu

SEQ ID NO: 3359604 - RNA, 21 nt, Neisseria meningitidis Z2491
gaauacggcaacaucauagaa

SEQ ID NO: 3359605 - RNA, 17 nt, Neisseria meningitidis Z2491
gacgaugaguuuuuugc

SEQ ID NO: 3359606 - RNA, 22 nt, Neisseria meningitidis Z2491
gacgaugaguuuuuugccuucg

SEQ ID NO: 3359607 - RNA, 15 nt, Neisseria meningitidis Z2491
gacgcgaacagaaac

SEQ ID NO: 3359608 - RNA, 13 nt, Neisseria meningitidis Z2491
gacgcggcugcug

SEQ ID NO: 3359609 - RNA, 16 nt, Neisseria meningitidis Z2491
gacgcggcugcugccu

SEQ ID NO: 3359610 - RNA, 15 nt, Neisseria meningitidis Z2491
gacgcguuuugccug

SEQ ID NO: 3359611 - RNA, 17 nt, Neisseria meningitidis Z2491
gacggaaacucaaaaaa

SEQ ID NO: 3359612 - RNA, 18 nt, Neisseria meningitidis Z2491
gacggaaacucaaaaaac

SEQ ID NO: 3359613 - RNA, 19 nt, Neisseria meningitidis Z2491
gacggacgcaggugcagau

SEQ ID NO: 3359614 - RNA, 14 nt, Neisseria meningitidis Z2491
gacggacggcggca

SEQ ID NO: 3359615 - RNA, 22 nt, Neisseria meningitidis Z2491
gacggagaguugcgggaaugac

SEQ ID NO: 3359616 - RNA, 17 nt, Neisseria meningitidis Z2491
gacggauguucaaacac

SEQ ID NO: 3359617 - RNA, 19 nt, Neisseria meningitidis Z2491
gacggauucgcgguugccg

SEQ ID NO: 3359618 - RNA, 21 nt, Neisseria meningitidis Z2491
gacggauucgcgguugccguc

SEQ ID NO: 3359619 - RNA, 20 nt, Neisseria meningitidis Z2491
gacggcauauguuuuuuccu

SEQ ID NO: 3359620 - RNA, 14 nt, Neisseria meningitidis Z2491
gacggcaucuuccu

SEQ ID NO: 3359621 - RNA, 17 nt, Neisseria meningitidis Z2491
gacggcauuaaaauuug

SEQ ID NO: 3359622 - RNA, 17 nt, Neisseria meningitidis Z2491
gacggcauuauagugaa

SEQ ID NO: 3359623 - RNA, 14 nt, Neisseria meningitidis Z2491
gacggcauuguuuc

SEQ ID NO: 3359624 - RNA, 21 nt, Neisseria meningitidis Z2491
gacggcauuucguuuggggau

SEQ ID NO: 3359625 - RNA, 15 nt, Neisseria meningitidis Z2491
gacggcauuuuucau

SEQ ID NO: 3359626 - RNA, 16 nt, Neisseria meningitidis Z2491
gacggcauuuuuucac

SEQ ID NO: 3359627 - RNA, 16 nt, Neisseria meningitidis Z2491
gacggcauuuuuuccg

SEQ ID NO: 3359628 - RNA, 13 nt, Neisseria meningitidis Z2491
gacggcgaggcug

SEQ ID NO: 3359629 - RNA, 15 nt, Neisseria meningitidis Z2491
gacggcgaggcugca

SEQ ID NO: 3359630 - RNA, 22 nt, Neisseria meningitidis Z2491
gacggcggaagggguaaauccu

SEQ ID NO: 3359631 - RNA, 15 nt, Neisseria meningitidis Z2491
gacggcggcagauaa

SEQ ID NO: 3359632 - RNA, 18 nt, Neisseria meningitidis Z2491
gacggcggcagauaaaua

SEQ ID NO: 3359633 - RNA, 22 nt, Neisseria meningitidis Z2491
gacggcguuucggcgacagcuu

SEQ ID NO: 3359634 - RNA, 18 nt, Neisseria meningitidis Z2491
gacggcuuggauuugccg

SEQ ID NO: 3359635 - RNA, 19 nt, Neisseria meningitidis Z2491
gacggcuuugccguuuuuc

SEQ ID NO: 3359636 - RNA, 14 nt, Neisseria meningitidis Z2491
gacgggaaguuuuu

SEQ ID NO: 3359637 - RNA, 18 nt, Neisseria meningitidis Z2491
gacgggauuagaguuuca

SEQ ID NO: 3359638 - RNA, 23 nt, Neisseria meningitidis Z2491
gacggggguuuggcgggaaugcc

SEQ ID NO: 3359639 - RNA, 14 nt, Neisseria meningitidis Z2491
gacgguacaaauag

SEQ ID NO: 3359640 - RNA, 13 nt, Neisseria meningitidis Z2491
gacgguaucugug

SEQ ID NO: 3359641 - RNA, 18 nt, Neisseria meningitidis Z2491
gacggugcgcggaugccg

SEQ ID NO: 3359642 - RNA, 12 nt, Neisseria meningitidis Z2491
gacgguggugcg

SEQ ID NO: 3359643 - RNA, 18 nt, Neisseria meningitidis Z2491
gacgguguuuuauuuuuu

SEQ ID NO: 3359644 - RNA, 22 nt, Neisseria meningitidis Z2491
gacgugugaguagcggugugcg

SEQ ID NO: 3359645 - RNA, 14 nt, Neisseria meningitidis Z2491
gacguucaaacccu

SEQ ID NO: 3359646 - RNA, 16 nt, Neisseria meningitidis Z2491
gacguugccuucuucg

SEQ ID NO: 3359647 - RNA, 23 nt, Neisseria meningitidis Z2491
gacuaaaccgccaacugauuaag

SEQ ID NO: 3359648 - RNA, 15 nt, Neisseria meningitidis Z2491
gacuaaccgaaaaua

SEQ ID NO: 3359649 - RNA, 16 nt, Neisseria meningitidis Z2491
gacuaaccgaaaauaa

SEQ ID NO: 3359650 - RNA, 18 nt, Neisseria meningitidis Z2491
gacuagauucccgccugc

SEQ ID NO: 3359651 - RNA, 21 nt, Neisseria meningitidis Z2491
gacuagguaauacauaaccuu

SEQ ID NO: 3359652 - RNA, 12 nt, Neisseria meningitidis Z2491
gacugaaacuca

SEQ ID NO: 3359653 - RNA, 14 nt, Neisseria meningitidis Z2491
gacugaaacucaaa

SEQ ID NO: 3359654 - RNA, 19 nt, Neisseria meningitidis Z2491
gacugcaguaacuucaaac

SEQ ID NO: 3359655 - RNA, 15 nt, Neisseria meningitidis Z2491
gacugggcauacagc

SEQ ID NO: 3359656 - RNA, 16 nt, Neisseria meningitidis Z2491
gacuguaaagauaaau

SEQ ID NO: 3359657 - RNA, 14 nt, Neisseria meningitidis Z2491
gacuuaagaaacaa

SEQ ID NO: 3359658 - RNA, 15 nt, Neisseria meningitidis Z2491
gacuuaagaaacaaa

SEQ ID NO: 3359659 - RNA, 11 nt, Neisseria meningitidis Z2491
gacuucugaca

SEQ ID NO: 3359660 - RNA, 20 nt, Neisseria meningitidis Z2491
gacuucugacagcauuucca

SEQ ID NO: 3359661 - RNA, 20 nt, Neisseria meningitidis Z2491
gacuugccauacaaacaggc

SEQ ID NO: 3359662 - RNA, 20 nt, Neisseria meningitidis Z2491
gacuuuggaacaaaaaauau

SEQ ID NO: 3359663 - RNA, 12 nt, Neisseria meningitidis Z2491
gacuuuuuccag

SEQ ID NO: 3359664 - RNA, 13 nt, Neisseria meningitidis Z2491
gagaaaacagaaa

SEQ ID NO: 3359665 - RNA, 22 nt, Neisseria meningitidis Z2491
gagaacgauucucuaaggugcu

SEQ ID NO: 3359666 - RNA, 13 nt, Neisseria meningitidis Z2491
gagaaguuucugc

SEQ ID NO: 3359667 - RNA, 21 nt, Neisseria meningitidis Z2491
gagacaaucaucaucacaaug

SEQ ID NO: 3359668 - RNA, 16 nt, Neisseria meningitidis Z2491
gagaccuuugcaaaaa

SEQ ID NO: 3359669 - RNA, 19 nt, Neisseria meningitidis Z2491
gagaccuuugcaaaaauaa

SEQ ID NO: 3359670 - RNA, 21 nt, Neisseria meningitidis Z2491
gagacggcaucgguuucuucu

SEQ ID NO: 3359671 - RNA, 17 nt, Neisseria meningitidis Z2491
gagacggcggcaacaga

SEQ ID NO: 3359672 - RNA, 14 nt, Neisseria meningitidis Z2491
gagacggugugccg

SEQ ID NO: 3359673 - RNA, 10 nt, Neisseria meningitidis Z2491
gagagaauga

SEQ ID NO: 3359674 - RNA, 16 nt, Neisseria meningitidis Z2491
gagagcucggucagau

SEQ ID NO: 3359675 - RNA, 12 nt, Neisseria meningitidis Z2491
gagcaaaaagua

SEQ ID NO: 3359676 - RNA, 14 nt, Neisseria meningitidis Z2491
gagcaauuaaauuu

SEQ ID NO: 3359677 - RNA, 21 nt, Neisseria meningitidis Z2491
gagcaccuuagagaaucguuc

SEQ ID NO: 3359678 - RNA, 16 nt, Neisseria meningitidis Z2491
gagcagaaucaaauau

SEQ ID NO: 3359679 - RNA, 13 nt, Neisseria meningitidis Z2491
gagcaggugcugg

SEQ ID NO: 3359680 - RNA, 14 nt, Neisseria meningitidis Z2491
gagcauaaaauuuu

SEQ ID NO: 3359681 - RNA, 20 nt, Neisseria meningitidis Z2491
gagcauaccguucaaacugc

SEQ ID NO: 3359682 - RNA, 15 nt, Neisseria meningitidis Z2491
gagccaagcaagcaa

SEQ ID NO: 3359683 - RNA, 15 nt, Neisseria meningitidis Z2491
gagccaauagccgcc

SEQ ID NO: 3359684 - RNA, 17 nt, Neisseria meningitidis Z2491
gagccgcaaggucggcg

SEQ ID NO: 3359685 - RNA, 19 nt, Neisseria meningitidis Z2491
gagcgacgaccauuuccaa

SEQ ID NO: 3359686 - RNA, 18 nt, Neisseria meningitidis Z2491
gagcgggcgcacuucaag

SEQ ID NO: 3359687 - RNA, 21 nt, Neisseria meningitidis Z2491
gagcuaaggcgaggcaacgcc

SEQ ID NO: 3359688 - RNA, 17 nt, Neisseria meningitidis Z2491
gaggaacaaaaugccgc

SEQ ID NO: 3359689 - RNA, 18 nt, Neisseria meningitidis Z2491
gaggaacaaaaugccgcc

SEQ ID NO: 3359690 - RNA, 21 nt, Neisseria meningitidis Z2491
gaggaacaaaaugccgccguc

SEQ ID NO: 3359691 - RNA, 16 nt, Neisseria meningitidis Z2491
gaggaagcggcggcau

SEQ ID NO: 3359692 - RNA, 17 nt, Neisseria meningitidis Z2491
gaggaguuugaugccgu

SEQ ID NO: 3359693 - RNA, 19 nt, Neisseria meningitidis Z2491
gaggauaaaaaaugccguc

SEQ ID NO: 3359694 - RNA, 21 nt, Neisseria meningitidis Z2491
gaggcaacgacguacugguuu

SEQ ID NO: 3359695 - RNA, 18 nt, Neisseria meningitidis Z2491
gaggcaacgcuguacugg

SEQ ID NO: 3359696 - RNA, 21 nt, Neisseria meningitidis Z2491
gaggcaguuuuuuauccggcu

SEQ ID NO: 3359697 - RNA, 20 nt, Neisseria meningitidis Z2491
gaggcauugaaauucuagau

SEQ ID NO: 3359698 - RNA, 16 nt, Neisseria meningitidis Z2491
gagggaaugacgggau

SEQ ID NO: 3359699 - RNA, 13 nt, Neisseria meningitidis Z2491
gaggguuugggau

SEQ ID NO: 3359700 - RNA, 17 nt, Neisseria meningitidis Z2491
gagguauuuggggcgaa

SEQ ID NO: 3359701 - RNA, 17 nt, Neisseria meningitidis Z2491
gaggucuugcaggugga

SEQ ID NO: 3359702 - RNA, 21 nt, Neisseria meningitidis Z2491
gagguuacaguuuaaucccuu

SEQ ID NO: 3359703 - RNA, 13 nt, Neisseria meningitidis Z2491
gagguucuagauu

SEQ ID NO: 3359704 - RNA, 15 nt, Neisseria meningitidis Z2491
gaguccaagacaggc

SEQ ID NO: 3359705 - RNA, 17 nt, Neisseria meningitidis Z2491
gagucucagggcuggca

SEQ ID NO: 3359706 - RNA, 19 nt, Neisseria meningitidis Z2491
gaguggcgggguuucaacc

SEQ ID NO: 3359707 - RNA, 22 nt, Neisseria meningitidis Z2491
gauuuuacguucuggauuccca

SEQ ID NO: 3359708 - RNA, 14 nt, Neisseria meningitidis Z2491
gauuuucgacgcau

SEQ ID NO: 3359709 - RNA, 10 nt, Neisseria meningitidis Z2491
gauuuugcag

SEQ ID NO: 3359710 - RNA, 12 nt, Neisseria meningitidis Z2491
gauuuugcagcu

SEQ ID NO: 3359711 - RNA, 14 nt, Neisseria meningitidis Z2491
gauuuuguuuuuga

SEQ ID NO: 3359712 - RNA, 15 nt, Neisseria meningitidis Z2491
gauuuuucugaauug

SEQ ID NO: 3359713 - RNA, 20 nt, Neisseria meningitidis Z2491
gauuuuucuuuuauuuucaa

SEQ ID NO: 3359714 - RNA, 15 nt, Neisseria meningitidis Z2491
gauuuuuucaacacc

SEQ ID NO: 3359715 - RNA, 20 nt, Neisseria meningitidis Z2491
gauuuuuuuauuuaaacagc

SEQ ID NO: 3359716 - RNA, 21 nt, Neisseria meningitidis Z2491
gcaaaaaaagaugccgucuga

SEQ ID NO: 3359717 - RNA, 22 nt, Neisseria meningitidis Z2491
gcaaaaaaagaugccgucugaa

SEQ ID NO: 3359718 - RNA, 18 nt, Neisseria meningitidis Z2491
gcaaaaaaugccgucuga

SEQ ID NO: 3359719 - RNA, 22 nt, Neisseria meningitidis Z2491
gcaaaaaaugccgucugaaacc

SEQ ID NO: 3359720 - RNA, 22 nt, Neisseria meningitidis Z2491
gcaaaaacaaaaaaaaucaaaa

SEQ ID NO: 3359721 - RNA, 13 nt, Neisseria meningitidis Z2491
gcaaaaacaucag

SEQ ID NO: 3359722 - RNA, 22 nt, Neisseria meningitidis Z2491
gcaaaaaguaggagaaaucaga

SEQ ID NO: 3359723 - RNA, 12 nt, Neisseria meningitidis Z2491
gcaaaaauaauc

SEQ ID NO: 3359724 - RNA, 17 nt, Neisseria meningitidis Z2491
gcaaaaaugccgucuga

SEQ ID NO: 3359725 - RNA, 18 nt, Neisseria meningitidis Z2491
gcaaaaaugccgucugaa

SEQ ID NO: 3359726 - RNA, 14 nt, Neisseria meningitidis Z2491
gcaaaaauuuaucc

SEQ ID NO: 3359727 - RNA, 15 nt, Neisseria meningitidis Z2491
gcaaaaauuuauccg

SEQ ID NO: 3359728 - RNA, 22 nt, Neisseria meningitidis Z2491
gcaaaaauuuauccgaagcgac

SEQ ID NO: 3359729 - RNA, 15 nt, Neisseria meningitidis Z2491
gcaaaaccggcuuga

SEQ ID NO: 3359730 - RNA, 19 nt, Neisseria meningitidis Z2491
gcaaaacgccuucuucgca

SEQ ID NO: 3359731 - RNA, 20 nt, Neisseria meningitidis Z2491
gcaaaacuuuucugauuuuu

SEQ ID NO: 3359732 - RNA, 20 nt, Neisseria meningitidis Z2491
gcaaaagccagcggauuguu

SEQ ID NO: 3359733 - RNA, 16 nt, Neisseria meningitidis Z2491
gcaaaagcgggaaucu

SEQ ID NO: 3359734 - RNA, 14 nt, Neisseria meningitidis Z2491
gcaaaauagaaaac

SEQ ID NO: 3359735 - RNA, 16 nt, Neisseria meningitidis Z2491
gcaaaaugccgucuga

SEQ ID NO: 3359736 - RNA, 13 nt, Neisseria meningitidis Z2491
gcaaaauuuaucc

SEQ ID NO: 3359737 - RNA, 13 nt, Neisseria meningitidis Z2491
gcaaaccgucugc

SEQ ID NO: 3359738 - RNA, 15 nt, Neisseria meningitidis Z2491
gcaaacggcaggcaa

SEQ ID NO: 3359739 - RNA, 22 nt, Neisseria meningitidis Z2491
gcaaagccuccgacugcucgga

SEQ ID NO: 3359740 - RNA, 14 nt, Neisseria meningitidis Z2491
gcaaaggucucaga

SEQ ID NO: 3359741 - RNA, 20 nt, Neisseria meningitidis Z2491
gcaaauaauugaaaucaaca

SEQ ID NO: 3359742 - RNA, 21 nt, Neisseria meningitidis Z2491
gcaaauaauugaaaucaacag

SEQ ID NO: 3359743 - RNA, 23 nt, Neisseria meningitidis Z2491
gcaaaugaugggcugaaauagaa

SEQ ID NO: 3359744 - RNA, 21 nt, Neisseria meningitidis Z2491
gcaaaugcacgguuacacaaa

SEQ ID NO: 3359745 - RNA, 13 nt, Neisseria meningitidis Z2491
gcaaaugccgucu

SEQ ID NO: 3359746 - RNA, 15 nt, Neisseria meningitidis Z2491
gcaaaugccgucuga

SEQ ID NO: 3359747 - RNA, 16 nt, Neisseria meningitidis Z2491
gcaaaugccgucugaa

SEQ ID NO: 3359748 - RNA, 16 nt, Neisseria meningitidis Z2491
gcaaaugccuuaucca

SEQ ID NO: 3359749 - RNA, 14 nt, Neisseria meningitidis Z2491
gcaaauuccagcaa

SEQ ID NO: 3359750 - RNA, 16 nt, Neisseria meningitidis Z2491
gcaaauuccagcaaug

SEQ ID NO: 3359751 - RNA, 18 nt, Neisseria meningitidis Z2491
gcaaauugaaaugccguc

SEQ ID NO: 3359752 - RNA, 12 nt, Neisseria meningitidis Z2491
gcaaauuuacag

SEQ ID NO: 3359753 - RNA, 23 nt, Neisseria meningitidis Z2491
gcaaauuucagucugucgccguc

SEQ ID NO: 3359754 - RNA, 16 nt, Neisseria meningitidis Z2491
gcaacauaaacaaagc

SEQ ID NO: 3359755 - RNA, 14 nt, Neisseria meningitidis Z2491
gcaacaucauagaa

SEQ ID NO: 3359756 - RNA, 19 nt, Neisseria meningitidis Z2491
gcaaccaaaaccgaccaug

SEQ ID NO: 3359757 - RNA, 22 nt, Neisseria meningitidis Z2491
gcaacccuaaaaacuaaaugcc

SEQ ID NO: 3359758 - RNA, 13 nt, Neisseria meningitidis Z2491
gcaaccgucagua

SEQ ID NO: 3359759 - RNA, 22 nt, Neisseria meningitidis Z2491
gcaaccugaaauucgucauucc

SEQ ID NO: 3359760 - RNA, 23 nt, Neisseria meningitidis Z2491
gcaaccugaaauucgucauuccc

SEQ ID NO: 3359761 - RNA, 15 nt, Neisseria meningitidis Z2491
gcaacgacagcagca

SEQ ID NO: 3359762 - RNA, 16 nt, Neisseria meningitidis Z2491
gcaacgcgcaaacccg

SEQ ID NO: 3359763 - RNA, 14 nt, Neisseria meningitidis Z2491
gcaacgcuguacug

SEQ ID NO: 3359764 - RNA, 22 nt, Neisseria meningitidis Z2491
gcaacgcuugaaucuucauucc

SEQ ID NO: 3359765 - RNA, 20 nt, Neisseria meningitidis Z2491
gcaacggcaauauucaaaga

SEQ ID NO: 3359766 - RNA, 14 nt, Neisseria meningitidis Z2491
gcaacguuucagac

SEQ ID NO: 3359767 - RNA, 19 nt, Neisseria meningitidis Z2491
gcaacguuucagacgguau

SEQ ID NO: 3359768 - RNA, 21 nt, Neisseria meningitidis Z2491
gcaacucuccgucauucccac

SEQ ID NO: 3359769 - RNA, 23 nt, Neisseria meningitidis Z2491
gcaacugaaccgucauucccacg

SEQ ID NO: 3359770 - RNA, 20 nt, Neisseria meningitidis Z2491
gcaacuuugcguuucuagau

SEQ ID NO: 3359771 - RNA, 14 nt, Neisseria meningitidis Z2491
gcaagaauuuauca

SEQ ID NO: 3359772 - RNA, 19 nt, Neisseria meningitidis Z2491
gcaagaauuuuuauagugg

SEQ ID NO: 3359773 - RNA, 20 nt, Neisseria meningitidis Z2491
gcaagaccgauaacggcggc

SEQ ID NO: 3359774 - RNA, 23 nt, Neisseria meningitidis Z2491
gcaagacuuuuucgcgcaccagc

SEQ ID NO: 3359775 - RNA, 19 nt, Neisseria meningitidis Z2491
gcaagcaauaccgcaaccu

SEQ ID NO: 3359776 - RNA, 14 nt, Neisseria meningitidis Z2491
gcaagccaagauau

SEQ ID NO: 3359777 - RNA, 23 nt, Neisseria meningitidis Z2491
gcaagcugugguuugccgaguuu

SEQ ID NO: 3359778 - RNA, 15 nt, Neisseria meningitidis Z2491
gcaaggacgggcagg

SEQ ID NO: 3359779 - RNA, 16 nt, Neisseria meningitidis Z2491
gcaaggcaaggcaaca

SEQ ID NO: 3359780 - RNA, 16 nt, Neisseria meningitidis Z2491
gcaaggcgccggcggc

SEQ ID NO: 3359781 - RNA, 23 nt, Neisseria meningitidis Z2491
gcaaggcggcggcguucaaauca

SEQ ID NO: 3359782 - RNA, 17 nt, Neisseria meningitidis Z2491
gcaagucaaaggcuucg

SEQ ID NO: 3359783 - RNA, 17 nt, Neisseria meningitidis Z2491
gcaaguguccggcagcc

SEQ ID NO: 3359784 - RNA, 16 nt, Neisseria meningitidis Z2491
gcaaguuccaagaugg

SEQ ID NO: 3359785 - RNA, 17 nt, Neisseria meningitidis Z2491
gcaauacgcaaaacaaa

SEQ ID NO: 3359786 - RNA, 17 nt, Neisseria meningitidis Z2491
gcaaucaaaauaaacuu

SEQ ID NO: 3359787 - RNA, 12 nt, Neisseria meningitidis Z2491
gcaaucaaaucc

SEQ ID NO: 3359788 - RNA, 16 nt, Neisseria meningitidis Z2491
gcaauccacgcaauca

SEQ ID NO: 3359789 - RNA, 19 nt, Neisseria meningitidis Z2491
gcaauccacgcaaucaaga

SEQ ID NO: 3359790 - RNA, 20 nt, Neisseria meningitidis Z2491
gcaaucgaaaaagccgccgg

SEQ ID NO: 3359791 - RNA, 16 nt, Neisseria meningitidis Z2491
gcaaucugaaauuuug

SEQ ID NO: 3359792 - RNA, 23 nt, Neisseria meningitidis Z2491
gcaaugccgucugaacccgccug

SEQ ID NO: 3359793 - RNA, 22 nt, Neisseria meningitidis Z2491
gcaaugcgccuucuucaaauuc

SEQ ID NO: 3359794 - RNA, 19 nt, Neisseria meningitidis Z2491
gcaauuaaauuuagcguaa

SEQ ID NO: 3359795 - RNA, 21 nt, Neisseria meningitidis Z2491
gcaauuauaagguaaguuuuu

SEQ ID NO: 3359796 - RNA, 16 nt, Neisseria meningitidis Z2491
gcaauugaaaaauuuu

SEQ ID NO: 3359797 - RNA, 16 nt, Neisseria meningitidis Z2491
gcaauugaaaauuuuu

SEQ ID NO: 3359798 - RNA, 15 nt, Neisseria meningitidis Z2491
gcaauuuaucgggaa

SEQ ID NO: 3359799 - RNA, 19 nt, Neisseria meningitidis Z2491
gcacaaaaaugccgucuga

SEQ ID NO: 3359800 - RNA, 17 nt, Neisseria meningitidis Z2491
gcacaaacgccagcaca

SEQ ID NO: 3359801 - RNA, 15 nt, Neisseria meningitidis Z2491
gcacaaaugccaaag

SEQ ID NO: 3359802 - RNA, 18 nt, Neisseria meningitidis Z2491
gcacaagcccuaaauacg

SEQ ID NO: 3359803 - RNA, 13 nt, Neisseria meningitidis Z2491
gcacacgggacgg

SEQ ID NO: 3359804 - RNA, 17 nt, Neisseria meningitidis Z2491
gcacagaaaccugcacc

SEQ ID NO: 3359805 - RNA, 13 nt, Neisseria meningitidis Z2491
gcacagucggcau

SEQ ID NO: 3359806 - RNA, 14 nt, Neisseria meningitidis Z2491
gcacaguucuguca

SEQ ID NO: 3359807 - RNA, 13 nt, Neisseria meningitidis Z2491
gcacauuuuuuuc

SEQ ID NO: 3359808 - RNA, 16 nt, Neisseria meningitidis Z2491
gcauauagccgagcau

SEQ ID NO: 3359809 - RNA, 18 nt, Neisseria meningitidis Z2491
gcauauguuuuuuccugu

SEQ ID NO: 3359810 - RNA, 16 nt, Neisseria meningitidis Z2491
gcauauuccggugcga

SEQ ID NO: 3359811 - RNA, 22 nt, Neisseria meningitidis Z2491
gcaucaaaaacaaaaaaccgcu

SEQ ID NO: 3359812 - RNA, 22 nt, Neisseria meningitidis Z2491
gcaucaaaaugacacaaagccu

SEQ ID NO: 3359813 - RNA, 16 nt, Neisseria meningitidis Z2491
gcauccgggccgccuu

SEQ ID NO: 3359814 - RNA, 20 nt, Neisseria meningitidis Z2491
gcauccgguuguaaugcgaa

SEQ ID NO: 3359815 - RNA, 23 nt, Neisseria meningitidis Z2491
gcauccguuuggaugccgucuga

SEQ ID NO: 3359816 - RNA, 16 nt, Neisseria meningitidis Z2491
gcaucgaccaguuuga

SEQ ID NO: 3359817 - RNA, 16 nt, Neisseria meningitidis Z2491
gcaucgcagauucggg

SEQ ID NO: 3359818 - RNA, 16 nt, Neisseria meningitidis Z2491
gcaucgcaucggcaac

SEQ ID NO: 3359819 - RNA, 13 nt, Neisseria meningitidis Z2491
gcaucgccgccgu

SEQ ID NO: 3359820 - RNA, 16 nt, Neisseria meningitidis Z2491
gcaucguauuggggca

SEQ ID NO: 3359821 - RNA, 21 nt, Neisseria meningitidis Z2491
gcaugagguuagcggauuuug

SEQ ID NO: 3359822 - RNA, 18 nt, Neisseria meningitidis Z2491
gcaugauggcaacgauga

SEQ ID NO: 3359823 - RNA, 12 nt, Neisseria meningitidis Z2491
gcaugauuaucg

SEQ ID NO: 3359824 - RNA, 16 nt, Neisseria meningitidis Z2491
gcauuaaaauuuggcu

SEQ ID NO: 3359825 - RNA, 22 nt, Neisseria meningitidis Z2491
gcauuaaugcgaaaugccgucu

SEQ ID NO: 3359826 - RNA, 18 nt, Neisseria meningitidis Z2491
gcauuaucaguauuuucu

SEQ ID NO: 3359827 - RNA, 15 nt, Neisseria meningitidis Z2491
gcauuauuuuucauu

SEQ ID NO: 3359828 - RNA, 22 nt, Neisseria meningitidis Z2491
gcauucaaacggcggcgggcag

SEQ ID NO: 3359829 - RNA, 20 nt, Neisseria meningitidis Z2491
gcauucagacggcauccgcu

SEQ ID NO: 3359830 - RNA, 16 nt, Neisseria meningitidis Z2491
gcauucucgucgggca

SEQ ID NO: 3359831 - RNA, 18 nt, Neisseria meningitidis Z2491
gcauugaaauucuagauu

SEQ ID NO: 3359832 - RNA, 19 nt, Neisseria meningitidis Z2491
gcauugaccacuucagggc

SEQ ID NO: 3359833 - RNA, 16 nt, Neisseria meningitidis Z2491
gcauugguaaacauac

SEQ ID NO: 3359834 - RNA, 22 nt, Neisseria meningitidis Z2491
gcauuuaucgggagcaacugaa

SEQ ID NO: 3359835 - RNA, 15 nt, Neisseria meningitidis Z2491
gcauuucuaauuuuu

SEQ ID NO: 3359836 - RNA, 12 nt, Neisseria meningitidis Z2491
gcauuucuuaug

SEQ ID NO: 3359837 - RNA, 22 nt, Neisseria meningitidis Z2491
gcauuugcacacguuugccguu

SEQ ID NO: 3359838 - RNA, 19 nt, Neisseria meningitidis Z2491
gcauuuucguccuugcugu

SEQ ID NO: 3359839 - RNA, 17 nt, Neisseria meningitidis Z2491
gcauuuucuauuuuaca

SEQ ID NO: 3359840 - RNA, 14 nt, Neisseria meningitidis Z2491
gcauuuugccgugu

SEQ ID NO: 3359841 - RNA, 17 nt, Neisseria meningitidis Z2491
gcauuuuguugccgucg

SEQ ID NO: 3359842 - RNA, 14 nt, Neisseria meningitidis Z2491
gcauuuuugacggu

SEQ ID NO: 3359843 - RNA, 15 nt, Neisseria meningitidis Z2491
gcauuuuugccgugu

SEQ ID NO: 3359844 - RNA, 21 nt, Neisseria meningitidis Z2491
gcauuuuuuucggguucagau

SEQ ID NO: 3359845 - RNA, 14 nt, Neisseria meningitidis Z2491
gccaaaaaaaagcc

SEQ ID NO: 3359846 - RNA, 13 nt, Neisseria meningitidis Z2491
gccaaaaaaaccg

SEQ ID NO: 3359847 - RNA, 17 nt, Neisseria meningitidis Z2491
gccaaaaaaaccgaaac

SEQ ID NO: 3359848 - RNA, 14 nt, Neisseria meningitidis Z2491
gccaaaaaauuuuc

SEQ ID NO: 3359849 - RNA, 14 nt, Neisseria meningitidis Z2491
gccaaaaacagaaa

SEQ ID NO: 3359850 - RNA, 15 nt, Neisseria meningitidis Z2491
gccaaaaaugcggcc

SEQ ID NO: 3359851 - RNA, 11 nt, Neisseria meningitidis Z2491
gccaaacccuc

SEQ ID NO: 3359852 - RNA, 22 nt, Neisseria meningitidis Z2491
gccaaaccgaugggcuucauca

SEQ ID NO: 3359853 - RNA, 22 nt, Neisseria meningitidis Z2491
gccaaacggguucggacggcgu

SEQ ID NO: 3359854 - RNA, 23 nt, Neisseria meningitidis Z2491
gccaaacggguuucagacggcau

SEQ ID NO: 3359855 - RNA, 13 nt, Neisseria meningitidis Z2491
gccaacaucagca

SEQ ID NO: 3359856 - RNA, 19 nt, Neisseria meningitidis Z2491
gccaacaucagcauaggga

SEQ ID NO: 3359857 - RNA, 12 nt, Neisseria meningitidis Z2491
gccaagcaagca

SEQ ID NO: 3359858 - RNA, 14 nt, Neisseria meningitidis Z2491
gccaaggcggcggg

SEQ ID NO: 3359859 - RNA, 15 nt, Neisseria meningitidis Z2491
gccaaggcuuucaga

SEQ ID NO: 3359860 - RNA, 21 nt, Neisseria meningitidis Z2491
gccaauagaauuuauacccuc

SEQ ID NO: 3359861 - RNA, 15 nt, Neisseria meningitidis Z2491
gccaauagccgccgg

SEQ ID NO: 3359862 - RNA, 15 nt, Neisseria meningitidis Z2491
gccaauucaaaaacc

SEQ ID NO: 3359863 - RNA, 20 nt, Neisseria meningitidis Z2491
gccaauuuguauucaagcaa

SEQ ID NO: 3359864 - RNA, 17 nt, Neisseria meningitidis Z2491
gccacaagucuucggca

SEQ ID NO: 3359865 - RNA, 19 nt, Neisseria meningitidis Z2491
gccacauaauucaaaugcg

SEQ ID NO: 3359866 - RNA, 13 nt, Neisseria meningitidis Z2491
gccaccacgucca

SEQ ID NO: 3359867 - RNA, 21 nt, Neisseria meningitidis Z2491
gccacgccaaaaaugcggccg

SEQ ID NO: 3359868 - RNA, 22 nt, Neisseria meningitidis Z2491
gccacgccaaaaaugcggccgc

SEQ ID NO: 3359869 - RNA, 20 nt, Neisseria meningitidis Z2491
gccacgccgacugccgccgc

SEQ ID NO: 3359870 - RNA, 18 nt, Neisseria meningitidis Z2491
gccacuuuccgucauucc

SEQ ID NO: 3359871 - RNA, 17 nt, Neisseria meningitidis Z2491
gccagcaacauuuccug

SEQ ID NO: 3359872 - RNA, 18 nt, Neisseria meningitidis Z2491
gccagcacaaacagcaug

SEQ ID NO: 3359873 - RNA, 13 nt, Neisseria meningitidis Z2491
gccagccugccca

SEQ ID NO: 3359874 - RNA, 14 nt, Neisseria meningitidis Z2491
gccagccugcccau

SEQ ID NO: 3359875 - RNA, 14 nt, Neisseria meningitidis Z2491
gccagccuuucaac

SEQ ID NO: 3359876 - RNA, 19 nt, Neisseria meningitidis Z2491
gccagcggauuguucggau

SEQ ID NO: 3359877 - RNA, 14 nt, Neisseria meningitidis Z2491
gccaggcguauaug

SEQ ID NO: 3359878 - RNA, 14 nt, Neisseria meningitidis Z2491
gccagggcggauug

SEQ ID NO: 3359879 - RNA, 17 nt, Neisseria meningitidis Z2491
gccauaaugcccaaacc

SEQ ID NO: 3359880 - RNA, 23 nt, Neisseria meningitidis Z2491
gccauacaaacaggcuucagacg

SEQ ID NO: 3359881 - RNA, 20 nt, Neisseria meningitidis Z2491
gccauaugcaggucgugcgc

SEQ ID NO: 3359882 - RNA, 13 nt, Neisseria meningitidis Z2491
gccaucaaaaagg

SEQ ID NO: 3359883 - RNA, 15 nt, Neisseria meningitidis Z2491
gccaucaaaaaggcu

SEQ ID NO: 3359884 - RNA, 14 nt, Neisseria meningitidis Z2491
gccauccagcaaac

SEQ ID NO: 3359885 - RNA, 19 nt, Neisseria meningitidis Z2491
gccaucggguugccgccga

SEQ ID NO: 3359886 - RNA, 17 nt, Neisseria meningitidis Z2491
gccaugucggguucgga

SEQ ID NO: 3359887 - RNA, 20 nt, Neisseria meningitidis Z2491
gccauucccucaaaaacaga

SEQ ID NO: 3359888 - RNA, 16 nt, Neisseria meningitidis Z2491
gccauuuccaaaccca

SEQ ID NO: 3359889 - RNA, 14 nt, Neisseria meningitidis Z2491
gcccaaaagcagcc

SEQ ID NO: 3359890 - RNA, 18 nt, Neisseria meningitidis Z2491
gcccaaugccgucugaau

SEQ ID NO: 3359891 - RNA, 16 nt, Neisseria meningitidis Z2491
gcccacaaucugaaac

SEQ ID NO: 3359892 - RNA, 23 nt, Neisseria meningitidis Z2491
gcccauacuacgcggcugaaaaa

SEQ ID NO: 3359893 - RNA, 15 nt, Neisseria meningitidis Z2491
gcccauucugccggu

SEQ ID NO: 3359894 - RNA, 17 nt, Neisseria meningitidis Z2491
gccccaaaaagccgccu

SEQ ID NO: 3359895 - RNA, 19 nt, Neisseria meningitidis Z2491
gccccaauaccaacaccug

SEQ ID NO: 3359896 - RNA, 14 nt, Neisseria meningitidis Z2491
gccccuaaaaugcc

SEQ ID NO: 3359897 - RNA, 23 nt, Neisseria meningitidis Z2491
gccccuaaaaugcccauccgccu

SEQ ID NO: 3359898 - RNA, 17 nt, Neisseria meningitidis Z2491
gccccuggcugcggacg

SEQ ID NO: 3359899 - RNA, 14 nt, Neisseria meningitidis Z2491
gccccuuaaaguuu

SEQ ID NO: 3359900 - RNA, 17 nt, Neisseria meningitidis Z2491
gcccgaaauaggcugcc

SEQ ID NO: 3359901 - RNA, 16 nt, Neisseria meningitidis Z2491
gcccgaagggaaagcc

SEQ ID NO: 3359902 - RNA, 19 nt, Neisseria meningitidis Z2491
gcccgacaaccgcccagcc

SEQ ID NO: 3359903 - RNA, 15 nt, Neisseria meningitidis Z2491
gcccgacagccgcaa

SEQ ID NO: 3359904 - RNA, 21 nt, Neisseria meningitidis Z2491
gcccgagauuacagaaaccua

SEQ ID NO: 3359905 - RNA, 10 nt, Neisseria meningitidis Z2491
gcccgccagu

SEQ ID NO: 3359906 - RNA, 22 nt, Neisseria meningitidis Z2491
gcccgguuggaaggcggcggca

SEQ ID NO: 3359907 - RNA, 19 nt, Neisseria meningitidis Z2491
gcccgucccgaugccgcaa

SEQ ID NO: 3359908 - RNA, 17 nt, Neisseria meningitidis Z2491
gcccguggcgacggcaa

SEQ ID NO: 3359909 - RNA, 19 nt, Neisseria meningitidis Z2491
gcccuauguguugcccuga

SEQ ID NO: 3359910 - RNA, 21 nt, Neisseria meningitidis Z2491
gccguguuucaaggcggcggc

SEQ ID NO: 3359911 - RNA, 22 nt, Neisseria meningitidis Z2491
gccguguuucaaggcggcggcg

SEQ ID NO: 3359912 - RNA, 22 nt, Neisseria meningitidis Z2491
gccguugaggagguuuugcacg

SEQ ID NO: 3359913 - RNA, 13 nt, Neisseria meningitidis Z2491
gccguuucagacg

SEQ ID NO: 3359914 - RNA, 17 nt, Neisseria meningitidis Z2491
gccguuucagacggcau

SEQ ID NO: 3359915 - RNA, 12 nt, Neisseria meningitidis Z2491
gccuaacccgac

SEQ ID NO: 3359916 - RNA, 23 nt, Neisseria meningitidis Z2491
gccuaggggcgguuugcggcggc

SEQ ID NO: 3359917 - RNA, 20 nt, Neisseria meningitidis Z2491
gccuauuuuucugaaaaauu

SEQ ID NO: 3359918 - RNA, 13 nt, Neisseria meningitidis Z2491
gccucaaucgcgg

SEQ ID NO: 3359919 - RNA, 17 nt, Neisseria meningitidis Z2491
gccucaaucgcggcggc

SEQ ID NO: 3359920 - RNA, 20 nt, Neisseria meningitidis Z2491
gccuccacggugugcaggcu

SEQ ID NO: 3359921 - RNA, 23 nt, Neisseria meningitidis Z2491
gccuccaucagcacgccgccugc

SEQ ID NO: 3359922 - RNA, 13 nt, Neisseria meningitidis Z2491
gccucuauccugc

SEQ ID NO: 3359923 - RNA, 23 nt, Neisseria meningitidis Z2491
gccucuauuuaaaaauuccuguu

SEQ ID NO: 3359924 - RNA, 23 nt, Neisseria meningitidis Z2491
gccugaacauuucagacggcauu

SEQ ID NO: 3359925 - RNA, 17 nt, Neisseria meningitidis Z2491
gccugacgcgcgaugga

SEQ ID NO: 3359926 - RNA, 18 nt, Neisseria meningitidis Z2491
gccugaugauuuuuucaa

SEQ ID NO: 3359927 - RNA, 23 nt, Neisseria meningitidis Z2491
gccugcccugccaaaacucaauc

SEQ ID NO: 3359928 - RNA, 15 nt, Neisseria meningitidis Z2491
gccugccgcugauga

SEQ ID NO: 3359929 - RNA, 15 nt, Neisseria meningitidis Z2491
gccugcgcgcggacg

SEQ ID NO: 3359930 - RNA, 18 nt, Neisseria meningitidis Z2491
gccugcgcgcggacggau

SEQ ID NO: 3359931 - RNA, 13 nt, Neisseria meningitidis Z2491
gccugcgcgggaa

SEQ ID NO: 3359932 - RNA, 22 nt, Neisseria meningitidis Z2491
gccugcgcgggaaugacgaagc

SEQ ID NO: 3359933 - RNA, 19 nt, Neisseria meningitidis Z2491
gccugguugaugucgugca

SEQ ID NO: 3359934 - RNA, 19 nt, Neisseria meningitidis Z2491
gccuguucggucauagcca

SEQ ID NO: 3359935 - RNA, 14 nt, Neisseria meningitidis Z2491
gccuuaaaaaacaa

SEQ ID NO: 3359936 - RNA, 15 nt, Neisseria meningitidis Z2491
gccuuaaaaaacaaa

SEQ ID NO: 3359937 - RNA, 19 nt, Neisseria meningitidis Z2491
gccuuaacagggaaagcag

SEQ ID NO: 3359938 - RNA, 15 nt, Neisseria meningitidis Z2491
gccuuaccgaccacc

SEQ ID NO: 3359939 - RNA, 16 nt, Neisseria meningitidis Z2491
gccuuacggauggcau

SEQ ID NO: 3359940 - RNA, 13 nt, Neisseria meningitidis Z2491
gccuuagcauuga

SEQ ID NO: 3359941 - RNA, 21 nt, Neisseria meningitidis Z2491
gccuuaucgguguaacggaua

SEQ ID NO: 3359942 - RNA, 14 nt, Neisseria meningitidis Z2491
gccuuauguauagu

SEQ ID NO: 3359943 - RNA, 16 nt, Neisseria meningitidis Z2491
gccuucagacggcaua

SEQ ID NO: 3359944 - RNA, 13 nt, Neisseria meningitidis Z2491
gccuucaucagca

SEQ ID NO: 3359945 - RNA, 15 nt, Neisseria meningitidis Z2491
gccuucaucagcauu

SEQ ID NO: 3359946 - RNA, 15 nt, Neisseria meningitidis Z2491
gccuucauccgcaac

SEQ ID NO: 3359947 - RNA, 21 nt, Neisseria meningitidis Z2491
gccuuccgauuauaucggcaa

SEQ ID NO: 3359948 - RNA, 17 nt, Neisseria meningitidis Z2491
gccuuccgcuucuucca

SEQ ID NO: 3359949 - RNA, 18 nt, Neisseria meningitidis Z2491
gccuuccgcuucuuccag

SEQ ID NO: 3359950 - RNA, 20 nt, Neisseria meningitidis Z2491
gccuuccgcuucuuccagca

SEQ ID NO: 3359951 - RNA, 15 nt, Neisseria meningitidis Z2491
gccuuccugcaggcg

SEQ ID NO: 3359952 - RNA, 17 nt, Neisseria meningitidis Z2491
gccuucuacuucgaugu

SEQ ID NO: 3359953 - RNA, 22 nt, Neisseria meningitidis Z2491
gccuugccguacuaucuguacu

SEQ ID NO: 3359954 - RNA, 22 nt, Neisseria meningitidis Z2491
gccuugcuguacuaucuguacu

SEQ ID NO: 3359955 - RNA, 12 nt, Neisseria meningitidis Z2491
gccuuguccuga

SEQ ID NO: 3359956 - RNA, 13 nt, Neisseria meningitidis Z2491
gccuuguccugau

SEQ ID NO: 3359957 - RNA, 22 nt, Neisseria meningitidis Z2491
gccuuuacucauucaauccuca

SEQ ID NO: 3359958 - RNA, 23 nt, Neisseria meningitidis Z2491
gccuuuacucauucaauccucaa

SEQ ID NO: 3359959 - RNA, 16 nt, Neisseria meningitidis Z2491
gccuuucacaaaggag

SEQ ID NO: 3359960 - RNA, 21 nt, Neisseria meningitidis Z2491
gccuuugccaccaauaccgcc

SEQ ID NO: 3359961 - RNA, 15 nt, Neisseria meningitidis Z2491
gccuuuggcggcggc

SEQ ID NO: 3359962 - RNA, 16 nt, Neisseria meningitidis Z2491
gccuuuggcggcggca

SEQ ID NO: 3359963 - RNA, 18 nt, Neisseria meningitidis Z2491
gccuuugggcgacggcaa

SEQ ID NO: 3359964 - RNA, 24 nt, Neisseria meningitidis Z2491
gccuuuuaccuugaggucuuugau

SEQ ID NO: 3359965 - RNA, 13 nt, Neisseria meningitidis Z2491
gccuuuucuuccu

SEQ ID NO: 3359966 - RNA, 14 nt, Neisseria meningitidis Z2491
gccuuuuucaaacg

SEQ ID NO: 3359967 - RNA, 17 nt, Neisseria meningitidis Z2491
gcgaacagaaggggcgg

SEQ ID NO: 3359968 - RNA, 18 nt, Neisseria meningitidis Z2491
gcgaacugccugcaacgc

SEQ ID NO: 3359969 - RNA, 20 nt, Neisseria meningitidis Z2491
gcgacagcuugggcggacug

SEQ ID NO: 3359970 - RNA, 12 nt, Neisseria meningitidis Z2491
gcgacgacgugg

SEQ ID NO: 3359971 - RNA, 13 nt, Neisseria meningitidis Z2491
gcgagaacagaaa

SEQ ID NO: 3359972 - RNA, 14 nt, Neisseria meningitidis Z2491
gcgagaacagaaaa

SEQ ID NO: 3359973 - RNA, 19 nt, Neisseria meningitidis Z2491
gcgagaacagaaaaccaaa

SEQ ID NO: 3359974 - RNA, 16 nt, Neisseria meningitidis Z2491
gcgagaugcggugcgc

SEQ ID NO: 3359975 - RNA, 12 nt, Neisseria meningitidis Z2491
gcgagccaacgc

SEQ ID NO: 3359976 - RNA, 18 nt, Neisseria meningitidis Z2491
gcgagccaauagccgccg

SEQ ID NO: 3359977 - RNA, 19 nt, Neisseria meningitidis Z2491
gcgagccaauagccgccgg

SEQ ID NO: 3359978 - RNA, 19 nt, Neisseria meningitidis Z2491
gcgaggacgcgugcaauca

SEQ ID NO: 3359979 - RNA, 16 nt, Neisseria meningitidis Z2491
gcgaguucgagacucg

SEQ ID NO: 3359980 - RNA, 17 nt, Neisseria meningitidis Z2491
gcgauaggauuugccau

SEQ ID NO: 3359981 - RNA, 23 nt, Neisseria meningitidis Z2491
gcgauauaugcgccgcguuucau

SEQ ID NO: 3359982 - RNA, 13 nt, Neisseria meningitidis Z2491
gcgaugccgguaa

SEQ ID NO: 3359983 - RNA, 23 nt, Neisseria meningitidis Z2491
gcgcaaccuugccaagguugagg

SEQ ID NO: 3359984 - RNA, 22 nt, Neisseria meningitidis Z2491
gcgcaauccgcccucucauuug

SEQ ID NO: 3359985 - RNA, 22 nt, Neisseria meningitidis Z2491
gcgcaaucgaaaaagccgccgg

SEQ ID NO: 3359986 - RNA, 14 nt, Neisseria meningitidis Z2491
gcgcaauuccugca

SEQ ID NO: 3359987 - RNA, 22 nt, Neisseria meningitidis Z2491
gcgcaccagcaaaucguaaacg

SEQ ID NO: 3359988 - RNA, 22 nt, Neisseria meningitidis Z2491
gcgcaccugacgcuccagcucc

SEQ ID NO: 3359989 - RNA, 14 nt, Neisseria meningitidis Z2491
gcgcacgauuucac

SEQ ID NO: 3359990 - RNA, 16 nt, Neisseria meningitidis Z2491
gcgcacgauuucacgg

SEQ ID NO: 3359991 - RNA, 14 nt, Neisseria meningitidis Z2491
gcgcagccugcagc

SEQ ID NO: 3359992 - RNA, 17 nt, Neisseria meningitidis Z2491
gcgcaggcaaacgcgau

SEQ ID NO: 3359993 - RNA, 16 nt, Neisseria meningitidis Z2491
gcgcaggcgggaaucu

SEQ ID NO: 3359994 - RNA, 21 nt, Neisseria meningitidis Z2491
gcgcaggcgggaaucuagguc

SEQ ID NO: 3359995 - RNA, 19 nt, Neisseria meningitidis Z2491
gcgcauggcuucuuugcug

SEQ ID NO: 3359996 - RNA, 15 nt, Neisseria meningitidis Z2491
gcgccaaaaaauuuu

SEQ ID NO: 3359997 - RNA, 20 nt, Neisseria meningitidis Z2491
gcgccagcggcaccaauucu

SEQ ID NO: 3359998 - RNA, 22 nt, Neisseria meningitidis Z2491
gcgccaucaacauuugcgcagc

SEQ ID NO: 3359999 - RNA, 18 nt, Neisseria meningitidis Z2491
gcgcccaaccgugcggca

SEQ ID NO: 3360000 - RNA, 21 nt, Neisseria meningitidis Z2491
gcgcccacgcccucggcggcg

SEQ ID NO: 3360001 - RNA, 17 nt, Neisseria meningitidis Z2491
gcgcccagagggaaagu

SEQ ID NO: 3360002 - RNA, 15 nt, Neisseria meningitidis Z2491
gcgccgccgguggcg

SEQ ID NO: 3360003 - RNA, 15 nt, Neisseria meningitidis Z2491
gcgccgcuguauuug

SEQ ID NO: 3360004 - RNA, 15 nt, Neisseria meningitidis Z2491
gcgccugcuuccgag

SEQ ID NO: 3360005 - RNA, 14 nt, Neisseria meningitidis Z2491
gcgcgacggcggca

SEQ ID NO: 3360006 - RNA, 18 nt, Neisseria meningitidis Z2491
gcgcgacggcggcagggu

SEQ ID NO: 3360007 - RNA, 22 nt, Neisseria meningitidis Z2491
gcgcggacacgguucugcaccg

SEQ ID NO: 3360008 - RNA, 15 nt, Neisseria meningitidis Z2491
gcgcggaggcggagc

SEQ ID NO: 3360009 - RNA, 18 nt, Neisseria meningitidis Z2491
gcgcggauucgccaggcg

SEQ ID NO: 3360010 - RNA, 13 nt, Neisseria meningitidis Z2491
gcgcggcgcaggc

SEQ ID NO: 3360011 - RNA, 22 nt, Neisseria meningitidis Z2491
ggaaaaaaggcuucagacggua

SEQ ID NO: 3360012 - RNA, 12 nt, Neisseria meningitidis Z2491
ggaaaaacagca

SEQ ID NO: 3360013 - RNA, 15 nt, Neisseria meningitidis Z2491
ggaaaaaccggccgg

SEQ ID NO: 3360014 - RNA, 18 nt, Neisseria meningitidis Z2491
ggaaaaaucauaagacgg

SEQ ID NO: 3360015 - RNA, 22 nt, Neisseria meningitidis Z2491
ggaaaaaucauaagacggauca

SEQ ID NO: 3360016 - RNA, 17 nt, Neisseria meningitidis Z2491
ggaaaacagcuguacgc

SEQ ID NO: 3360017 - RNA, 20 nt, Neisseria meningitidis Z2491
ggaaaaccguguuucagacg

SEQ ID NO: 3360018 - RNA, 17 nt, Neisseria meningitidis Z2491
ggaaaaucaaaaucaga

SEQ ID NO: 3360019 - RNA, 19 nt, Neisseria meningitidis Z2491
ggaaacagcauccuuuccu

SEQ ID NO: 3360020 - RNA, 23 nt, Neisseria meningitidis Z2491
ggaaaccaaaaaacaacaggaau

SEQ ID NO: 3360021 - RNA, 22 nt, Neisseria meningitidis Z2491
ggaaacgaaaagcuaaagcaau

SEQ ID NO: 3360022 - RNA, 16 nt, Neisseria meningitidis Z2491
ggaaacgccuucaguu

SEQ ID NO: 3360023 - RNA, 19 nt, Neisseria meningitidis Z2491
ggaaacucaaaaaaccgga

SEQ ID NO: 3360024 - RNA, 22 nt, Neisseria meningitidis Z2491
ggaaacuuuucauaucaugccg

SEQ ID NO: 3360025 - RNA, 17 nt, Neisseria meningitidis Z2491
ggaaagagcgucauauu

SEQ ID NO: 3360026 - RNA, 16 nt, Neisseria meningitidis Z2491
ggaaagguucagcagg

SEQ ID NO: 3360027 - RNA, 16 nt, Neisseria meningitidis Z2491
ggaaaucguaccaacc

SEQ ID NO: 3360028 - RNA, 15 nt, Neisseria meningitidis Z2491
ggaaaugacugaaac

SEQ ID NO: 3360029 - RNA, 16 nt, Neisseria meningitidis Z2491
ggaaaugacugaaacu

SEQ ID NO: 3360030 - RNA, 17 nt, Neisseria meningitidis Z2491
ggaaaugacugaaacuc

SEQ ID NO: 3360031 - RNA, 16 nt, Neisseria meningitidis Z2491
ggaaaugaucaggcgg

SEQ ID NO: 3360032 - RNA, 15 nt, Neisseria meningitidis Z2491
ggaacaaaaugccgc

SEQ ID NO: 3360033 - RNA, 13 nt, Neisseria meningitidis Z2491
ggaacaaagaaag

SEQ ID NO: 3360034 - RNA, 17 nt, Neisseria meningitidis Z2491
ggaacacaaaaaacuuc

SEQ ID NO: 3360035 - RNA, 18 nt, Neisseria meningitidis Z2491
ggaacacaaaaaacuucc

SEQ ID NO: 3360036 - RNA, 16 nt, Neisseria meningitidis Z2491
ggaacagaaagcaaaa

SEQ ID NO: 3360037 - RNA, 20 nt, Neisseria meningitidis Z2491
ggaacagcaucaaaccauau

SEQ ID NO: 3360038 - RNA, 23 nt, Neisseria meningitidis Z2491
ggaaccgauucacuuggugcuuc

SEQ ID NO: 3360039 - RNA, 19 nt, Neisseria meningitidis Z2491
ggaaccguuuuccgcccga

SEQ ID NO: 3360040 - RNA, 16 nt, Neisseria meningitidis Z2491
ggaagauucggcugcu

SEQ ID NO: 3360041 - RNA, 23 nt, Neisseria meningitidis Z2491
ggaagccgcgccgauguccugac

SEQ ID NO: 3360042 - RNA, 14 nt, Neisseria meningitidis Z2491
ggaaggcggcggca

SEQ ID NO: 3360043 - RNA, 13 nt, Neisseria meningitidis Z2491
ggaaggguuuugu

SEQ ID NO: 3360044 - RNA, 13 nt, Neisseria meningitidis Z2491
ggaagugggaauc

SEQ ID NO: 3360045 - RNA, 16 nt, Neisseria meningitidis Z2491
ggaauacggcaacauc

SEQ ID NO: 3360046 - RNA, 12 nt, Neisseria meningitidis Z2491
ggaauagcucag

SEQ ID NO: 3360047 - RNA, 13 nt, Neisseria meningitidis Z2491
ggaauccagacca

SEQ ID NO: 3360048 - RNA, 23 nt, Neisseria meningitidis Z2491
ggaauccagaccuuugggcggcg

SEQ ID NO: 3360049 - RNA, 19 nt, Neisseria meningitidis Z2491
ggaauccaguccguucagu

SEQ ID NO: 3360050 - RNA, 21 nt, Neisseria meningitidis Z2491
ggaaucgauucacuuggugcu

SEQ ID NO: 3360051 - RNA, 22 nt, Neisseria meningitidis Z2491
ggaaucuagaaacgcaaagcug

SEQ ID NO: 3360052 - RNA, 19 nt, Neisseria meningitidis Z2491
ggaaucuagaaccucaaac

SEQ ID NO: 3360053 - RNA, 21 nt, Neisseria meningitidis Z2491
ggaaucuagacauucaaugcu

SEQ ID NO: 3360054 - RNA, 17 nt, Neisseria meningitidis Z2491
ggaaucuagaccugucg

SEQ ID NO: 3360055 - RNA, 20 nt, Neisseria meningitidis Z2491
ggaaucuggaaaccaaaaaa

SEQ ID NO: 3360056 - RNA, 19 nt, Neisseria meningitidis Z2491
ggaaugacggaauguaggu

SEQ ID NO: 3360057 - RNA, 21 nt, Neisseria meningitidis Z2491
ggaaugacggcaaccggccgg

SEQ ID NO: 3360058 - RNA, 23 nt, Neisseria meningitidis Z2491
ggaaugacggucgaggguuucug

SEQ ID NO: 3360059 - RNA, 23 nt, Neisseria meningitidis Z2491
ggaaugacggucggggguuucug

SEQ ID NO: 3360060 - RNA, 12 nt, Neisseria meningitidis Z2491
ggaauucuucga

SEQ ID NO: 3360061 - RNA, 12 nt, Neisseria meningitidis Z2491
ggaauuuauccg

SEQ ID NO: 3360062 - RNA, 11 nt, Neisseria meningitidis Z2491
ggacaaaugcc

SEQ ID NO: 3360063 - RNA, 12 nt, Neisseria meningitidis Z2491
ggacaagggaaa

SEQ ID NO: 3360064 - RNA, 13 nt, Neisseria meningitidis Z2491
ggacaccagcgcg

SEQ ID NO: 3360065 - RNA, 18 nt, Neisseria meningitidis Z2491
ggacacgcccucaaacgg

SEQ ID NO: 3360066 - RNA, 17 nt, Neisseria meningitidis Z2491
ggacagcggcaauauuc

SEQ ID NO: 3360067 - RNA, 16 nt, Neisseria meningitidis Z2491
ggacgacaugcaagca

SEQ ID NO: 3360068 - RNA, 19 nt, Neisseria meningitidis Z2491
ggacgaugaguuuuuugcc

SEQ ID NO: 3360069 - RNA, 23 nt, Neisseria meningitidis Z2491
ggacgcaggguuaagaaaaccug

SEQ ID NO: 3360070 - RNA, 17 nt, Neisseria meningitidis Z2491
ggacggcggauuucagu

SEQ ID NO: 3360071 - RNA, 21 nt, Neisseria meningitidis Z2491
ggacggcggauuucagugcug

SEQ ID NO: 3360072 - RNA, 12 nt, Neisseria meningitidis Z2491
ggacgggaaguu

SEQ ID NO: 3360073 - RNA, 18 nt, Neisseria meningitidis Z2491
ggagaggcuuucagacgg

SEQ ID NO: 3360074 - RNA, 19 nt, Neisseria meningitidis Z2491
ggagcagaucgagggcgcg

SEQ ID NO: 3360075 - RNA, 20 nt, Neisseria meningitidis Z2491
ggagcaggcacaaggcggcg

SEQ ID NO: 3360076 - RNA, 15 nt, Neisseria meningitidis Z2491
ggagcaugaguuccu

SEQ ID NO: 3360077 - RNA, 19 nt, Neisseria meningitidis Z2491
ggaggaguuugaugccguc

SEQ ID NO: 3360078 - RNA, 19 nt, Neisseria meningitidis Z2491
ggaggcaguuuuuuauccg

SEQ ID NO: 3360079 - RNA, 21 nt, Neisseria meningitidis Z2491
ggagggacagcgugaaaccuu

SEQ ID NO: 3360080 - RNA, 20 nt, Neisseria meningitidis Z2491
ggagggauauucccccgcgc

SEQ ID NO: 3360081 - RNA, 21 nt, Neisseria meningitidis Z2491
ggagggauauucccccgcgca

SEQ ID NO: 3360082 - RNA, 21 nt, Neisseria meningitidis Z2491
ggagucgccuucgcaagccaa

SEQ ID NO: 3360083 - RNA, 20 nt, Neisseria meningitidis Z2491
ggagucuggcggcaucccac

SEQ ID NO: 3360084 - RNA, 12 nt, Neisseria meningitidis Z2491
ggauaaaacaga

SEQ ID NO: 3360085 - RNA, 22 nt, Neisseria meningitidis Z2491
ggauaaacauuaucugacagga

SEQ ID NO: 3360086 - RNA, 19 nt, Neisseria meningitidis Z2491
ggauaaacauuuuugcgua

SEQ ID NO: 3360087 - RNA, 20 nt, Neisseria meningitidis Z2491
ggauaauucauacaaauuca

SEQ ID NO: 3360088 - RNA, 13 nt, Neisseria meningitidis Z2491
ggauaggcugcug

SEQ ID NO: 3360089 - RNA, 18 nt, Neisseria meningitidis Z2491
ggauauugccguuuuccu

SEQ ID NO: 3360090 - RNA, 16 nt, Neisseria meningitidis Z2491
ggaucggagagacugu

SEQ ID NO: 3360091 - RNA, 15 nt, Neisseria meningitidis Z2491
ggaugcagguuucug

SEQ ID NO: 3360092 - RNA, 17 nt, Neisseria meningitidis Z2491
ggaugccgucugaaacg

SEQ ID NO: 3360093 - RNA, 21 nt, Neisseria meningitidis Z2491
ggaugccugcucaaauaggca

SEQ ID NO: 3360094 - RNA, 23 nt, Neisseria meningitidis Z2491
ggauggacagaaacgaaaaugcc

SEQ ID NO: 3360095 - RNA, 19 nt, Neisseria meningitidis Z2491
ggauguccgcgcccacgcc

SEQ ID NO: 3360096 - RNA, 23 nt, Neisseria meningitidis Z2491
ggauguuugccugauccaaaccg

SEQ ID NO: 3360097 - RNA, 14 nt, Neisseria meningitidis Z2491
ggauuaaaauaaaa

SEQ ID NO: 3360098 - RNA, 19 nt, Neisseria meningitidis Z2491
ggauuaaauuuaaaccagu

SEQ ID NO: 3360099 - RNA, 12 nt, Neisseria meningitidis Z2491
ggauuaacaaaa

SEQ ID NO: 3360100 - RNA, 22 nt, Neisseria meningitidis Z2491
ggauuaacaaaaaucaggacaa

SEQ ID NO: 3360101 - RNA, 11 nt, Neisseria meningitidis Z2491
ggauucccaca

SEQ ID NO: 3360102 - RNA, 20 nt, Neisseria meningitidis Z2491
ggauucccacaaccuuucgu

SEQ ID NO: 3360103 - RNA, 11 nt, Neisseria meningitidis Z2491
ggauucccacu

SEQ ID NO: 3360104 - RNA, 14 nt, Neisseria meningitidis Z2491
ggauucccgccugc

SEQ ID NO: 3360105 - RNA, 17 nt, Neisseria meningitidis Z2491
ggauucccgccugcgcg

SEQ ID NO: 3360106 - RNA, 18 nt, Neisseria meningitidis Z2491
ggauuuccuuaaaaaagg

SEQ ID NO: 3360107 - RNA, 23 nt, Neisseria meningitidis Z2491
ggauuuguccaaauugacaggca

SEQ ID NO: 3360108 - RNA, 16 nt, Neisseria meningitidis Z2491
ggauuuuagguuucug

SEQ ID NO: 3360109 - RNA, 19 nt, Neisseria meningitidis Z2491
ggcaaaaaaagaugccguc

SEQ ID NO: 3360110 - RNA, 12 nt, Neisseria meningitidis Z2491
ggcaaaaauuua

SEQ ID NO: 3360111 - RNA, 14 nt, Neisseria meningitidis Z2491
ggcaaaauccgcaa

SEQ ID NO: 3360112 - RNA, 21 nt, Neisseria meningitidis Z2491
ggcucugcgcguaccucauug

SEQ ID NO: 3360113 - RNA, 11 nt, Neisseria meningitidis Z2491
ggcucuuggau

SEQ ID NO: 3360114 - RNA, 15 nt, Neisseria meningitidis Z2491
ggcugaaaaaaugcc

SEQ ID NO: 3360115 - RNA, 13 nt, Neisseria meningitidis Z2491
ggcugaaaauaau

SEQ ID NO: 3360116 - RNA, 13 nt, Neisseria meningitidis Z2491
ggcugaaauagaa

SEQ ID NO: 3360117 - RNA, 18 nt, Neisseria meningitidis Z2491
ggcugaaucgccaaugcu

SEQ ID NO: 3360118 - RNA, 12 nt, Neisseria meningitidis Z2491
ggcugcccugcu

SEQ ID NO: 3360119 - RNA, 16 nt, Neisseria meningitidis Z2491
ggcugcgucgcgggcg

SEQ ID NO: 3360120 - RNA, 20 nt, Neisseria meningitidis Z2491
ggcugcuuugguaaaaaaau

SEQ ID NO: 3360121 - RNA, 19 nt, Neisseria meningitidis Z2491
ggcugcuuuuuaggcggca

SEQ ID NO: 3360122 - RNA, 16 nt, Neisseria meningitidis Z2491
ggcuggggauguuuug

SEQ ID NO: 3360123 - RNA, 23 nt, Neisseria meningitidis Z2491
ggcuguaugccgucugaaaccug

SEQ ID NO: 3360124 - RNA, 17 nt, Neisseria meningitidis Z2491
ggcuguucgccgacauc

SEQ ID NO: 3360125 - RNA, 14 nt, Neisseria meningitidis Z2491
ggcuuaaaccuuau

SEQ ID NO: 3360126 - RNA, 20 nt, Neisseria meningitidis Z2491
ggcuuacucguucggcagcc

SEQ ID NO: 3360127 - RNA, 18 nt, Neisseria meningitidis Z2491
ggcuucaauauacucaau

SEQ ID NO: 3360128 - RNA, 12 nt, Neisseria meningitidis Z2491
ggcuucaucucg

SEQ ID NO: 3360129 - RNA, 23 nt, Neisseria meningitidis Z2491
ggcuugaacaaaccuguggauaa

SEQ ID NO: 3360130 - RNA, 16 nt, Neisseria meningitidis Z2491
ggcuugguuuugcuuc

SEQ ID NO: 3360131 - RNA, 18 nt, Neisseria meningitidis Z2491
ggcuugguuuugcuucca

SEQ ID NO: 3360132 - RNA, 20 nt, Neisseria meningitidis Z2491
ggcuuugcccgcgaaauaaa

SEQ ID NO: 3360133 - RNA, 19 nt, Neisseria meningitidis Z2491
ggcuuugugcacucacuuu

SEQ ID NO: 3360134 - RNA, 12 nt, Neisseria meningitidis Z2491
ggcuuuugacag

SEQ ID NO: 3360135 - RNA, 12 nt, Neisseria meningitidis Z2491
ggcuuuuuccug

SEQ ID NO: 3360136 - RNA, 18 nt, Neisseria meningitidis Z2491
gggaaaauacggacggga

SEQ ID NO: 3360137 - RNA, 16 nt, Neisseria meningitidis Z2491
gggaaagcagacgacu

SEQ ID NO: 3360138 - RNA, 13 nt, Neisseria meningitidis Z2491
gggaaagcagcag

SEQ ID NO: 3360139 - RNA, 14 nt, Neisseria meningitidis Z2491
gggaaagcagcagc

SEQ ID NO: 3360140 - RNA, 18 nt, Neisseria meningitidis Z2491
gggaaagguucagcagga

SEQ ID NO: 3360141 - RNA, 14 nt, Neisseria meningitidis Z2491
gggaaauaaaacaa

SEQ ID NO: 3360142 - RNA, 18 nt, Neisseria meningitidis Z2491
gggaagaugggcaaaucc

SEQ ID NO: 3360143 - RNA, 15 nt, Neisseria meningitidis Z2491
gggaaggcggggcgg

SEQ ID NO: 3360144 - RNA, 12 nt, Neisseria meningitidis Z2491
gggaauccagug

SEQ ID NO: 3360145 - RNA, 17 nt, Neisseria meningitidis Z2491
gggaauccgggauuuua

SEQ ID NO: 3360146 - RNA, 18 nt, Neisseria meningitidis Z2491
gggaaucuagaaacgcaa

SEQ ID NO: 3360147 - RNA, 15 nt, Neisseria meningitidis Z2491
gggaaucuagaaucu

SEQ ID NO: 3360148 - RNA, 21 nt, Neisseria meningitidis Z2491
gggaaucuagacauucaaugc

SEQ ID NO: 3360149 - RNA, 13 nt, Neisseria meningitidis Z2491
gggaaucuaggac

SEQ ID NO: 3360150 - RNA, 17 nt, Neisseria meningitidis Z2491
gggaaucuggaaaccaa

SEQ ID NO: 3360151 - RNA, 22 nt, Neisseria meningitidis Z2491
gggaaucuggaaaccaaaaaac

SEQ ID NO: 3360152 - RNA, 21 nt, Neisseria meningitidis Z2491
gggaaugacgaagagcugcgg

SEQ ID NO: 3360153 - RNA, 18 nt, Neisseria meningitidis Z2491
gggaaugacgaugaaaag

SEQ ID NO: 3360154 - RNA, 21 nt, Neisseria meningitidis Z2491
gggacagacggccaaacacau

SEQ ID NO: 3360155 - RNA, 13 nt, Neisseria meningitidis Z2491
gggacggccgcgg

SEQ ID NO: 3360156 - RNA, 21 nt, Neisseria meningitidis Z2491
gggacugccuacacaucgugu

SEQ ID NO: 3360157 - RNA, 16 nt, Neisseria meningitidis Z2491
gggagcaacugaaacc

SEQ ID NO: 3360158 - RNA, 20 nt, Neisseria meningitidis Z2491
gggauagaaugugggcgcgc

SEQ ID NO: 3360159 - RNA, 16 nt, Neisseria meningitidis Z2491
gggauauuuucuuccg

SEQ ID NO: 3360160 - RNA, 11 nt, Neisseria meningitidis Z2491
gggauggcggg

SEQ ID NO: 3360161 - RNA, 15 nt, Neisseria meningitidis Z2491
gggcaaaagccagcg

SEQ ID NO: 3360162 - RNA, 17 nt, Neisseria meningitidis Z2491
gggcaacacgcccaagc

SEQ ID NO: 3360163 - RNA, 17 nt, Neisseria meningitidis Z2491
gggcaacggcaauauuc

SEQ ID NO: 3360164 - RNA, 17 nt, Neisseria meningitidis Z2491
gggcagcggcaauauuc

SEQ ID NO: 3360165 - RNA, 14 nt, Neisseria meningitidis Z2491
gggcaggcggcugc

SEQ ID NO: 3360166 - RNA, 20 nt, Neisseria meningitidis Z2491
gggcagugggauuuugguuu

SEQ ID NO: 3360167 - RNA, 19 nt, Neisseria meningitidis Z2491
gggcgcacuucaaguccga

SEQ ID NO: 3360168 - RNA, 20 nt, Neisseria meningitidis Z2491
gggcggcucucaaaauauuc

SEQ ID NO: 3360169 - RNA, 13 nt, Neisseria meningitidis Z2491
gggcugcggucgg

SEQ ID NO: 3360170 - RNA, 21 nt, Neisseria meningitidis Z2491
gggcugcgucgcgggcggggu

SEQ ID NO: 3360171 - RNA, 16 nt, Neisseria meningitidis Z2491
gggcuucagacggcau

SEQ ID NO: 3360172 - RNA, 10 nt, Neisseria meningitidis Z2491
gggcuuugag

SEQ ID NO: 3360173 - RNA, 20 nt, Neisseria meningitidis Z2491
ggggaaaccaacaggcgggc

SEQ ID NO: 3360174 - RNA, 21 nt, Neisseria meningitidis Z2491
ggggaauuaugaugcggacgg

SEQ ID NO: 3360175 - RNA, 21 nt, Neisseria meningitidis Z2491
ggggaguccuuauugggaaau

SEQ ID NO: 3360176 - RNA, 16 nt, Neisseria meningitidis Z2491
ggggauuuucgccgug

SEQ ID NO: 3360177 - RNA, 23 nt, Neisseria meningitidis Z2491
ggggcaaguguccggcagccugc

SEQ ID NO: 3360178 - RNA, 15 nt, Neisseria meningitidis Z2491
gggggugaagcaggc

SEQ ID NO: 3360179 - RNA, 20 nt, Neisseria meningitidis Z2491
gggguaauccaagccugcgg

SEQ ID NO: 3360180 - RNA, 16 nt, Neisseria meningitidis Z2491
gggguauuugcugacg

SEQ ID NO: 3360181 - RNA, 14 nt, Neisseria meningitidis Z2491
ggggugcggguggc

SEQ ID NO: 3360182 - RNA, 22 nt, Neisseria meningitidis Z2491
gggguggucuugugccgcgaug

SEQ ID NO: 3360183 - RNA, 11 nt, Neisseria meningitidis Z2491
ggguaaacagg

SEQ ID NO: 3360184 - RNA, 18 nt, Neisseria meningitidis Z2491
ggguaauuuccaaaucgu

SEQ ID NO: 3360185 - RNA, 17 nt, Neisseria meningitidis Z2491
ggguucggacggcauuu

SEQ ID NO: 3360186 - RNA, 14 nt, Neisseria meningitidis Z2491
ggguucggacggcg

SEQ ID NO: 3360187 - RNA, 15 nt, Neisseria meningitidis Z2491
ggguugaagaaaccg

SEQ ID NO: 3360188 - RNA, 21 nt, Neisseria meningitidis Z2491
ggguuucuguuucgguuuucu

SEQ ID NO: 3360189 - RNA, 13 nt, Neisseria meningitidis Z2491
gguaaaaaaaugc

SEQ ID NO: 3360190 - RNA, 14 nt, Neisseria meningitidis Z2491
gguaaaaauggaaa

SEQ ID NO: 3360191 - RNA, 14 nt, Neisseria meningitidis Z2491
gguaaaccgccagc

SEQ ID NO: 3360192 - RNA, 23 nt, Neisseria meningitidis Z2491
gguaaagugcggugaaaucuuau

SEQ ID NO: 3360193 - RNA, 13 nt, Neisseria meningitidis Z2491
gguaacaauaugc

SEQ ID NO: 3360194 - RNA, 19 nt, Neisseria meningitidis Z2491
gguaacuucgccuuugaaa

SEQ ID NO: 3360195 - RNA, 18 nt, Neisseria meningitidis Z2491
gguaauccgaaucaacac

SEQ ID NO: 3360196 - RNA, 16 nt, Neisseria meningitidis Z2491
gguacaaccaaugcgg

SEQ ID NO: 3360197 - RNA, 20 nt, Neisseria meningitidis Z2491
gguacagcguuggcucgccu

SEQ ID NO: 3360198 - RNA, 19 nt, Neisseria meningitidis Z2491
gguacccaaacuuccaaau

SEQ ID NO: 3360199 - RNA, 15 nt, Neisseria meningitidis Z2491
gguacgcccgcagcc

SEQ ID NO: 3360200 - RNA, 13 nt, Neisseria meningitidis Z2491
gguagagaaaauu

SEQ ID NO: 3360201 - RNA, 16 nt, Neisseria meningitidis Z2491
gguagagcgcaaccuu

SEQ ID NO: 3360202 - RNA, 18 nt, Neisseria meningitidis Z2491
gguagauggggaggcgcg

SEQ ID NO: 3360203 - RNA, 18 nt, Neisseria meningitidis Z2491
gguagccgccuuuauccc

SEQ ID NO: 3360204 - RNA, 18 nt, Neisseria meningitidis Z2491
gguaucgggcauaaaauu

SEQ ID NO: 3360205 - RNA, 19 nt, Neisseria meningitidis Z2491
gguaugccaugucggguuc

SEQ ID NO: 3360206 - RNA, 17 nt, Neisseria meningitidis Z2491
gguauuggaugcggucg

SEQ ID NO: 3360207 - RNA, 18 nt, Neisseria meningitidis Z2491
gguauuuuuuauccggcg

SEQ ID NO: 3360208 - RNA, 18 nt, Neisseria meningitidis Z2491
ggucaaaauauuaaucag

SEQ ID NO: 3360209 - RNA, 20 nt, Neisseria meningitidis Z2491
ggucaacucuuccauuugag

SEQ ID NO: 3360210 - RNA, 23 nt, Neisseria meningitidis Z2491
ggucauuucugauaaacccccgu

SEQ ID NO: 3360211 - RNA, 16 nt, Neisseria meningitidis Z2491
ggucgcaucggcggcg

SEQ ID NO: 3360212 - RNA, 20 nt, Neisseria meningitidis Z2491
ggucgcgaguucgagacucg

SEQ ID NO: 3360213 - RNA, 15 nt, Neisseria meningitidis Z2491
ggucguguucuucau

SEQ ID NO: 3360214 - RNA, 14 nt, Neisseria meningitidis Z2491
gucaaaccagcuuc

SEQ ID NO: 3360215 - RNA, 22 nt, Neisseria meningitidis Z2491
gucaaaggcuucgagugcuucg

SEQ ID NO: 3360216 - RNA, 16 nt, Neisseria meningitidis Z2491
gucaaccaaaaaaucu

SEQ ID NO: 3360217 - RNA, 19 nt, Neisseria meningitidis Z2491
gucaagcaaaaaaugccgu

SEQ ID NO: 3360218 - RNA, 17 nt, Neisseria meningitidis Z2491
gucagcccgcugcgggc

SEQ ID NO: 3360219 - RNA, 16 nt, Neisseria meningitidis Z2491
gucagcgugcgcguga

SEQ ID NO: 3360220 - RNA, 17 nt, Neisseria meningitidis Z2491
gucaucaccgcagccgc

SEQ ID NO: 3360221 - RNA, 23 nt, Neisseria meningitidis Z2491
gucaugcaccugcauaaucaguu

SEQ ID NO: 3360222 - RNA, 16 nt, Neisseria meningitidis Z2491
gucaugcccaaaagca

SEQ ID NO: 3360223 - RNA, 13 nt, Neisseria meningitidis Z2491
gucauucccacga

SEQ ID NO: 3360224 - RNA, 21 nt, Neisseria meningitidis Z2491
gucauucccacgaaaguggga

SEQ ID NO: 3360225 - RNA, 16 nt, Neisseria meningitidis Z2491
gucauucccgcaaaag

SEQ ID NO: 3360226 - RNA, 15 nt, Neisseria meningitidis Z2491
gucauucccgcaacu

SEQ ID NO: 3360227 - RNA, 19 nt, Neisseria meningitidis Z2491
guccaaacaaaaaugccgu

SEQ ID NO: 3360228 - RNA, 19 nt, Neisseria meningitidis Z2491
guccacacaucaggggcgg

SEQ ID NO: 3360229 - RNA, 20 nt, Neisseria meningitidis Z2491
guccaucggcgcgccgcugu

SEQ ID NO: 3360230 - RNA, 15 nt, Neisseria meningitidis Z2491
guccccgaaaccgaa

SEQ ID NO: 3360231 - RNA, 17 nt, Neisseria meningitidis Z2491
gucccgacgcuuguccc

SEQ ID NO: 3360232 - RNA, 22 nt, Neisseria meningitidis Z2491
guccgaaugccgcaaaugccgu

SEQ ID NO: 3360233 - RNA, 17 nt, Neisseria meningitidis Z2491
guccgacaauuucuccg

SEQ ID NO: 3360234 - RNA, 17 nt, Neisseria meningitidis Z2491
guccgagacagaacccg

SEQ ID NO: 3360235 - RNA, 23 nt, Neisseria meningitidis Z2491
guccgauuaauuccggaaucaga

SEQ ID NO: 3360236 - RNA, 15 nt, Neisseria meningitidis Z2491
guccgccauuuccaa

SEQ ID NO: 3360237 - RNA, 21 nt, Neisseria meningitidis Z2491
guccggaagcggaaagccgcc

SEQ ID NO: 3360238 - RNA, 14 nt, Neisseria meningitidis Z2491
guccggcaaacauc

SEQ ID NO: 3360239 - RNA, 15 nt, Neisseria meningitidis Z2491
guccguuugcggguu

SEQ ID NO: 3360240 - RNA, 21 nt, Neisseria meningitidis Z2491
guccuccaccgucauucccgc

SEQ ID NO: 3360241 - RNA, 16 nt, Neisseria meningitidis Z2491
guccugauuuaaauuu

SEQ ID NO: 3360242 - RNA, 12 nt, Neisseria meningitidis Z2491
guccugauuuuu

SEQ ID NO: 3360243 - RNA, 13 nt, Neisseria meningitidis Z2491
guccuuauuucug

SEQ ID NO: 3360244 - RNA, 23 nt, Neisseria meningitidis Z2491
gucgaaaccggcuuuggcgauga

SEQ ID NO: 3360245 - RNA, 15 nt, Neisseria meningitidis Z2491
gucgaacaguucuuu

SEQ ID NO: 3360246 - RNA, 16 nt, Neisseria meningitidis Z2491
gucgaacgccgcuucg

SEQ ID NO: 3360247 - RNA, 17 nt, Neisseria meningitidis Z2491
gucgaaggcgcggcugc

SEQ ID NO: 3360248 - RNA, 19 nt, Neisseria meningitidis Z2491
gucgaccugcuguuugagc

SEQ ID NO: 3360249 - RNA, 11 nt, Neisseria meningitidis Z2491
gucgacggcaa

SEQ ID NO: 3360250 - RNA, 16 nt, Neisseria meningitidis Z2491
gucgagcaggaugcug

SEQ ID NO: 3360251 - RNA, 16 nt, Neisseria meningitidis Z2491
gucgaggguuucuguu

SEQ ID NO: 3360252 - RNA, 19 nt, Neisseria meningitidis Z2491
gucgagucccaguucgccg

SEQ ID NO: 3360253 - RNA, 18 nt, Neisseria meningitidis Z2491
gucgcacauuuuuuucau

SEQ ID NO: 3360254 - RNA, 20 nt, Neisseria meningitidis Z2491
gucgccuuccgcuucuucca

SEQ ID NO: 3360255 - RNA, 14 nt, Neisseria meningitidis Z2491
gucggacauuugac

SEQ ID NO: 3360256 - RNA, 15 nt, Neisseria meningitidis Z2491
gucggagaggucuug

SEQ ID NO: 3360257 - RNA, 20 nt, Neisseria meningitidis Z2491
gucggcaaucauuucugucu

SEQ ID NO: 3360258 - RNA, 19 nt, Neisseria meningitidis Z2491
gucggcauacacggcagca

SEQ ID NO: 3360259 - RNA, 17 nt, Neisseria meningitidis Z2491
gucggcggauuguucaa

SEQ ID NO: 3360260 - RNA, 16 nt, Neisseria meningitidis Z2491
gucggcguaggcggcg

SEQ ID NO: 3360261 - RNA, 16 nt, Neisseria meningitidis Z2491
gucgggcugccaagcg

SEQ ID NO: 3360262 - RNA, 23 nt, Neisseria meningitidis Z2491
gucggucggcaucgaugauguga

SEQ ID NO: 3360263 - RNA, 17 nt, Neisseria meningitidis Z2491
gucguauaacgcggauu

SEQ ID NO: 3360264 - RNA, 20 nt, Neisseria meningitidis Z2491
gucgucugaaaaauuuucag

SEQ ID NO: 3360265 - RNA, 16 nt, Neisseria meningitidis Z2491
gucgugcgccguaucg

SEQ ID NO: 3360266 - RNA, 18 nt, Neisseria meningitidis Z2491
gucuagauucccgccugc

SEQ ID NO: 3360267 - RNA, 22 nt, Neisseria meningitidis Z2491
gucuauuuucgccccaaauacc

SEQ ID NO: 3360268 - RNA, 19 nt, Neisseria meningitidis Z2491
gucucaacagcuuaaaauc

SEQ ID NO: 3360269 - RNA, 22 nt, Neisseria meningitidis Z2491
gucucagggcuggcaaaaccgu

SEQ ID NO: 3360270 - RNA, 14 nt, Neisseria meningitidis Z2491
gucucauauucacu

SEQ ID NO: 3360271 - RNA, 13 nt, Neisseria meningitidis Z2491
gucugaaaaaccu

SEQ ID NO: 3360272 - RNA, 14 nt, Neisseria meningitidis Z2491
gucugaaaaauuuu

SEQ ID NO: 3360273 - RNA, 14 nt, Neisseria meningitidis Z2491
gucugaaaacagca

SEQ ID NO: 3360274 - RNA, 18 nt, Neisseria meningitidis Z2491
gucugaaaacaguuuuuu

SEQ ID NO: 3360275 - RNA, 19 nt, Neisseria meningitidis Z2491
gucugaaaccaaaucggcu

SEQ ID NO: 3360276 - RNA, 23 nt, Neisseria meningitidis Z2491
gucugaaaccccuaaaggcuuca

SEQ ID NO: 3360277 - RNA, 13 nt, Neisseria meningitidis Z2491
gucugaaaccugc

SEQ ID NO: 3360278 - RNA, 14 nt, Neisseria meningitidis Z2491
gucugaaaccugua

SEQ ID NO: 3360279 - RNA, 19 nt, Neisseria meningitidis Z2491
gucugaaacgaacaaaccc

SEQ ID NO: 3360280 - RNA, 15 nt, Neisseria meningitidis Z2491
gucugaaacgccaaa

SEQ ID NO: 3360281 - RNA, 14 nt, Neisseria meningitidis Z2491
gucugaaagguuuu

SEQ ID NO: 3360282 - RNA, 18 nt, Neisseria meningitidis Z2491
gucugaaagucuuucaga

SEQ ID NO: 3360283 - RNA, 22 nt, Neisseria meningitidis Z2491
gucugaaauccuauuuucagau

SEQ ID NO: 3360284 - RNA, 11 nt, Neisseria meningitidis Z2491
gucugaaauuu

SEQ ID NO: 3360285 - RNA, 17 nt, Neisseria meningitidis Z2491
gucugaacagcauuugc

SEQ ID NO: 3360286 - RNA, 18 nt, Neisseria meningitidis Z2491
gucugaagauauuggaac

SEQ ID NO: 3360287 - RNA, 21 nt, Neisseria meningitidis Z2491
gucugaaucgcgugcugcauc

SEQ ID NO: 3360288 - RNA, 14 nt, Neisseria meningitidis Z2491
gucugcgaaacaga

SEQ ID NO: 3360289 - RNA, 13 nt, Neisseria meningitidis Z2491
gucugcggcggga

SEQ ID NO: 3360290 - RNA, 21 nt, Neisseria meningitidis Z2491
gucugcuuaccgaccaacugc

SEQ ID NO: 3360291 - RNA, 17 nt, Neisseria meningitidis Z2491
gucuggaacuugaaaac

SEQ ID NO: 3360292 - RNA, 16 nt, Neisseria meningitidis Z2491
gucugucggugcggaa

SEQ ID NO: 3360293 - RNA, 17 nt, Neisseria meningitidis Z2491
gucugucggugcggaaa

SEQ ID NO: 3360294 - RNA, 15 nt, Neisseria meningitidis Z2491
gucuucaaaaaacaa

SEQ ID NO: 3360295 - RNA, 16 nt, Neisseria meningitidis Z2491
gucuucaauuccugcg

SEQ ID NO: 3360296 - RNA, 17 nt, Neisseria meningitidis Z2491
gucuucaauuccugcgc

SEQ ID NO: 3360297 - RNA, 12 nt, Neisseria meningitidis Z2491
gucuucagcuug

SEQ ID NO: 3360298 - RNA, 17 nt, Neisseria meningitidis Z2491
gucuuccaacccuccgc

SEQ ID NO: 3360299 - RNA, 18 nt, Neisseria meningitidis Z2491
gucuucuuuggcuuuguu

SEQ ID NO: 3360300 - RNA, 14 nt, Neisseria meningitidis Z2491
gucuuggucaacca

SEQ ID NO: 3360301 - RNA, 15 nt, Neisseria meningitidis Z2491
gucuuuggcuuccag

SEQ ID NO: 3360302 - RNA, 21 nt, Neisseria meningitidis Z2491
gucuuuucccuugcaaauaau

SEQ ID NO: 3360303 - RNA, 12 nt, Neisseria meningitidis Z2491
gugaaugcggcg

SEQ ID NO: 3360304 - RNA, 13 nt, Neisseria meningitidis Z2491
gugaugccccaau

SEQ ID NO: 3360305 - RNA, 15 nt, Neisseria meningitidis Z2491
gugauggcuucuaaa

SEQ ID NO: 3360306 - RNA, 18 nt, Neisseria meningitidis Z2491
gugauggcuucuaaaaau

SEQ ID NO: 3360307 - RNA, 23 nt, Neisseria meningitidis Z2491
gugauucaauaggauaggcugcu

SEQ ID NO: 3360308 - RNA, 14 nt, Neisseria meningitidis Z2491
gugcaaagaaaaac

SEQ ID NO: 3360309 - RNA, 18 nt, Neisseria meningitidis Z2491
gugcaggcauuauuuuuc

SEQ ID NO: 3360310 - RNA, 22 nt, Neisseria meningitidis Z2491
gugcaggcugccgcacaagccc

SEQ ID NO: 3360311 - RNA, 18 nt, Neisseria meningitidis Z2491
gugcagguuucugugcgg

SEQ ID NO: 3360312 - RNA, 16 nt, Neisseria meningitidis Z2491
gugcauccgacaggca

SEQ ID NO: 3360313 - RNA, 18 nt, Neisseria meningitidis Z2491
gugcauccgacaggcaaa

SEQ ID NO: 3360314 - RNA, 17 nt, Neisseria meningitidis Z2491
gugcauuucuaauuuuu

SEQ ID NO: 3360315 - RNA, 21 nt, Neisseria meningitidis Z2491
gugccaaugccgucugaaacc

SEQ ID NO: 3360316 - RNA, 12 nt, Neisseria meningitidis Z2491
guugaguuucag

SEQ ID NO: 3360317 - RNA, 14 nt, Neisseria meningitidis Z2491
guugaguuucagcu

SEQ ID NO: 3360318 - RNA, 15 nt, Neisseria meningitidis Z2491
guugaucauuucagg

SEQ ID NO: 3360319 - RNA, 15 nt, Neisseria meningitidis Z2491
guugauggcguuuuc

SEQ ID NO: 3360320 - RNA, 20 nt, Neisseria meningitidis Z2491
guugcaaucacgggcaaacg

SEQ ID NO: 3360321 - RNA, 14 nt, Neisseria meningitidis Z2491
guugcccauugcca

SEQ ID NO: 3360322 - RNA, 21 nt, Neisseria meningitidis Z2491
guugcccuguguagcagccca

SEQ ID NO: 3360323 - RNA, 14 nt, Neisseria meningitidis Z2491
guugccgucaaaac

SEQ ID NO: 3360324 - RNA, 18 nt, Neisseria meningitidis Z2491
guugccucgccuugcugu

SEQ ID NO: 3360325 - RNA, 15 nt, Neisseria meningitidis Z2491
guugcggaugaauuu

SEQ ID NO: 3360326 - RNA, 16 nt, Neisseria meningitidis Z2491
guugcgucugccuucu

SEQ ID NO: 3360327 - RNA, 19 nt, Neisseria meningitidis Z2491
guugcgucugccuucuucu

SEQ ID NO: 3360328 - RNA, 20 nt, Neisseria meningitidis Z2491
guugcuguauguuacaaaac

SEQ ID NO: 3360329 - RNA, 23 nt, Neisseria meningitidis Z2491
guuggaaagcguguuccgcaucg

SEQ ID NO: 3360330 - RNA, 14 nt, Neisseria meningitidis Z2491
guuggaauccaguu

SEQ ID NO: 3360331 - RNA, 18 nt, Neisseria meningitidis Z2491
guuggcaauuuucuuccg

SEQ ID NO: 3360332 - RNA, 12 nt, Neisseria meningitidis Z2491
guuggcagcaaa

SEQ ID NO: 3360333 - RNA, 22 nt, Neisseria meningitidis Z2491
guuggcguuuggcgcgggugau

SEQ ID NO: 3360334 - RNA, 21 nt, Neisseria meningitidis Z2491
guugggaaagguucagcagga

SEQ ID NO: 3360335 - RNA, 20 nt, Neisseria meningitidis Z2491
guugguagagcgcaaccuug

SEQ ID NO: 3360336 - RNA, 17 nt, Neisseria meningitidis Z2491
guugucaaccaaaaaau

SEQ ID NO: 3360337 - RNA, 15 nt, Neisseria meningitidis Z2491
guugucgagccuucc

SEQ ID NO: 3360338 - RNA, 21 nt, Neisseria meningitidis Z2491
guugucgcuucggauaaauuu

SEQ ID NO: 3360339 - RNA, 18 nt, Neisseria meningitidis Z2491
guugugccguguuucauc

SEQ ID NO: 3360340 - RNA, 14 nt, Neisseria meningitidis Z2491
guuguucaaauaaa

SEQ ID NO: 3360341 - RNA, 15 nt, Neisseria meningitidis Z2491
guuguucagaaaauc

SEQ ID NO: 3360342 - RNA, 17 nt, Neisseria meningitidis Z2491
guuguuguuugaauaca

SEQ ID NO: 3360343 - RNA, 21 nt, Neisseria meningitidis Z2491
guuuaaacacgggguuuaucu

SEQ ID NO: 3360344 - RNA, 13 nt, Neisseria meningitidis Z2491
guuuaucuuuucu

SEQ ID NO: 3360345 - RNA, 16 nt, Neisseria meningitidis Z2491
guuucaaggcggcggc

SEQ ID NO: 3360346 - RNA, 14 nt, Neisseria meningitidis Z2491
guuucagacggcau

SEQ ID NO: 3360347 - RNA, 20 nt, Neisseria meningitidis Z2491
guuucagacggcaucuuuuu

SEQ ID NO: 3360348 - RNA, 15 nt, Neisseria meningitidis Z2491
guuucagacggcauu

SEQ ID NO: 3360349 - RNA, 18 nt, Neisseria meningitidis Z2491
guuucagacggcauuuug

SEQ ID NO: 3360350 - RNA, 18 nt, Neisseria meningitidis Z2491
guuucagacggcauuuuu

SEQ ID NO: 3360351 - RNA, 16 nt, Neisseria meningitidis Z2491
guuucccgaaauucca

SEQ ID NO: 3360352 - RNA, 15 nt, Neisseria meningitidis Z2491
guuuccgcaccgaca

SEQ ID NO: 3360353 - RNA, 17 nt, Neisseria meningitidis Z2491
guuuccguucauacgga

SEQ ID NO: 3360354 - RNA, 23 nt, Neisseria meningitidis Z2491
guuuccuccucgccgucuuucag

SEQ ID NO: 3360355 - RNA, 20 nt, Neisseria meningitidis Z2491
guuuccugcagguagcggcu

SEQ ID NO: 3360356 - RNA, 18 nt, Neisseria meningitidis Z2491
guuucggagaaguuucug

SEQ ID NO: 3360357 - RNA, 13 nt, Neisseria meningitidis Z2491
guuucggauaaau

SEQ ID NO: 3360358 - RNA, 20 nt, Neisseria meningitidis Z2491
guuucgggcaaaagccagcg

SEQ ID NO: 3360359 - RNA, 13 nt, Neisseria meningitidis Z2491
guuucggguuuca

SEQ ID NO: 3360360 - RNA, 14 nt, Neisseria meningitidis Z2491
guuucguaugauuu

SEQ ID NO: 3360361 - RNA, 19 nt, Neisseria meningitidis Z2491
guuucuagauucccacuuc

SEQ ID NO: 3360362 - RNA, 19 nt, Neisseria meningitidis Z2491
guuucuagauucccacuuu

SEQ ID NO: 3360363 - RNA, 13 nt, Neisseria meningitidis Z2491
guuucugaagcca

SEQ ID NO: 3360364 - RNA, 15 nt, Neisseria meningitidis Z2491
guuucugauuuuggu

SEQ ID NO: 3360365 - RNA, 22 nt, Neisseria meningitidis Z2491
guuucuguuguuucggauaaau

SEQ ID NO: 3360366 - RNA, 20 nt, Neisseria meningitidis Z2491
guuucuguuucgguuuucua

SEQ ID NO: 3360367 - RNA, 15 nt, Neisseria meningitidis Z2491
guuucuucagauuuu

SEQ ID NO: 3360368 - RNA, 17 nt, Neisseria meningitidis Z2491
guuucuucaguuguuuu

SEQ ID NO: 3360369 - RNA, 16 nt, Neisseria meningitidis Z2491
guuucuugaguuucag

SEQ ID NO: 3360370 - RNA, 16 nt, Neisseria meningitidis Z2491
guuugaaagagaaaag

SEQ ID NO: 3360371 - RNA, 19 nt, Neisseria meningitidis Z2491
guuugaaccggcacaggcu

SEQ ID NO: 3360372 - RNA, 21 nt, Neisseria meningitidis Z2491
guuugaaccggcacaggcuca

SEQ ID NO: 3360373 - RNA, 19 nt, Neisseria meningitidis Z2491
guuugaauggaaaugccgu

SEQ ID NO: 3360374 - RNA, 20 nt, Neisseria meningitidis Z2491
guuugagcaguuuuuugacu

SEQ ID NO: 3360375 - RNA, 19 nt, Neisseria meningitidis Z2491
guuugaguccgaccgccgc

SEQ ID NO: 3360376 - RNA, 18 nt, Neisseria meningitidis Z2491
guuugcaggacggggcgg

SEQ ID NO: 3360377 - RNA, 17 nt, Neisseria meningitidis Z2491
guuugccaaggcggcgg

SEQ ID NO: 3360378 - RNA, 18 nt, Neisseria meningitidis Z2491
guuugccaaggcggcggg

SEQ ID NO: 3360379 - RNA, 15 nt, Neisseria meningitidis Z2491
guuugccgaguuugc

SEQ ID NO: 3360380 - RNA, 20 nt, Neisseria meningitidis Z2491
guuugccgcguucgugcaga

SEQ ID NO: 3360381 - RNA, 22 nt, Neisseria meningitidis Z2491
guuugccgcugacgaaaccaga

SEQ ID NO: 3360382 - RNA, 20 nt, Neisseria meningitidis Z2491
guuugccgggaaggcggggc

SEQ ID NO: 3360383 - RNA, 11 nt, Neisseria meningitidis Z2491
guuugccgucu

SEQ ID NO: 3360384 - RNA, 13 nt, Neisseria meningitidis Z2491
guuugccgucuga

SEQ ID NO: 3360385 - RNA, 13 nt, Neisseria meningitidis Z2491
guuuggaugccgu

SEQ ID NO: 3360386 - RNA, 21 nt, Neisseria meningitidis Z2491
guuuggaugcguuucagagca

SEQ ID NO: 3360387 - RNA, 18 nt, Neisseria meningitidis Z2491
guuuggcuguuuucuguu

SEQ ID NO: 3360388 - RNA, 18 nt, Neisseria meningitidis Z2491
guuuggcuuuuuucuguu

SEQ ID NO: 3360389 - RNA, 23 nt, Neisseria meningitidis Z2491
guuugguaaucaguuuuuucagc

SEQ ID NO: 3360390 - RNA, 23 nt, Neisseria meningitidis Z2491
guuuguuguucaaauaaauucug

SEQ ID NO: 3360391 - RNA, 17 nt, Neisseria meningitidis Z2491
guuuuaaccugcaaaac

SEQ ID NO: 3360392 - RNA, 15 nt, Neisseria meningitidis Z2491
guuuuaccugcccga

SEQ ID NO: 3360393 - RNA, 18 nt, Neisseria meningitidis Z2491
guuuuauccgauaaguuu

SEQ ID NO: 3360394 - RNA, 22 nt, Neisseria meningitidis Z2491
guuuuauuuuuuggcuuugaag

SEQ ID NO: 3360395 - RNA, 14 nt, Neisseria meningitidis Z2491
guuuucaaauccgu

SEQ ID NO: 3360396 - RNA, 14 nt, Neisseria meningitidis Z2491
guuuuccugacaaa

SEQ ID NO: 3360397 - RNA, 15 nt, Neisseria meningitidis Z2491
guuuucugguuuuua

SEQ ID NO: 3360398 - RNA, 10 nt, Neisseria meningitidis Z2491
guuuucuguu

SEQ ID NO: 3360399 - RNA, 19 nt, Neisseria meningitidis Z2491
guuuucuucgccgguuuca

SEQ ID NO: 3360400 - RNA, 13 nt, Neisseria meningitidis Z2491
guuuugaugguuu

SEQ ID NO: 3360401 - RNA, 22 nt, Neisseria meningitidis Z2491
guuuugcgcuccauugccugac

SEQ ID NO: 3360402 - RNA, 22 nt, Neisseria meningitidis Z2491
guuuuuaucuguucguuuuugg

SEQ ID NO: 3360403 - RNA, 13 nt, Neisseria meningitidis Z2491
guuuuucagacgg

SEQ ID NO: 3360404 - RNA, 14 nt, Neisseria meningitidis Z2491
guuuuucagagaaa

SEQ ID NO: 3360405 - RNA, 13 nt, Neisseria meningitidis Z2491
guuuuuccacaaa

SEQ ID NO: 3360406 - RNA, 21 nt, Neisseria meningitidis Z2491
guuuuuccgacaaauuccuaa

SEQ ID NO: 3360407 - RNA, 20 nt, Neisseria meningitidis Z2491
guuuuucgcgcucugccagc

SEQ ID NO: 3360408 - RNA, 13 nt, Neisseria meningitidis Z2491
guuuuugccaagu

SEQ ID NO: 3360409 - RNA, 23 nt, Neisseria meningitidis Z2491
guuuuuggcguaaaacggugugg

SEQ ID NO: 3360410 - RNA, 11 nt, Neisseria meningitidis Z2491
guuuuugucuu

SEQ ID NO: 3360411 - RNA, 16 nt, Neisseria meningitidis Z2491
guuuuuguuaauccac

SEQ ID NO: 3360412 - RNA, 24 nt, Neisseria meningitidis Z2491
guuuuuguuaauccacuauacugu

SEQ ID NO: 3360413 - RNA, 20 nt, Neisseria meningitidis Z2491
guuuuuuauccggcuuucca

SEQ ID NO: 3360414 - RNA, 16 nt, Neisseria meningitidis Z2491
guuuuuugaguuucag

SEQ ID NO: 3360415 - RNA, 15 nt, Neisseria meningitidis Z2491
guuuuuugaguuucc

SEQ ID NO: 3360416 - RNA, 14 nt, Neisseria meningitidis Z2491
guuuuuuuugcaaa

SEQ ID NO: 3360417 - RNA, 18 nt, Neisseria meningitidis Z2491
uaaccgcuucaaggcggu

SEQ ID NO: 3360418 - RNA, 14 nt, Neisseria meningitidis Z2491
uaaccguuuaauuu

SEQ ID NO: 3360419 - RNA, 18 nt, Neisseria meningitidis Z2491
uaaccuuguuccuccaaa

SEQ ID NO: 3360420 - RNA, 18 nt, Neisseria meningitidis Z2491
uaacgauacggcggcauu

SEQ ID NO: 3360421 - RNA, 15 nt, Neisseria meningitidis Z2491
uaacgguuuggcauu

SEQ ID NO: 3360422 - RNA, 19 nt, Neisseria meningitidis Z2491
uaacgguuuggcauuuuua

SEQ ID NO: 3360423 - RNA, 16 nt, Neisseria meningitidis Z2491
uaacuagggaaauuca

SEQ ID NO: 3360424 - RNA, 20 nt, Neisseria meningitidis Z2491
uaacuauaguggauuaacaa

SEQ ID NO: 3360425 - RNA, 15 nt, Neisseria meningitidis Z2491
uaacucuaaaccguc

SEQ ID NO: 3360426 - RNA, 22 nt, Neisseria meningitidis Z2491
uaagaaacaaagcuuuaaacua

SEQ ID NO: 3360427 - RNA, 20 nt, Neisseria meningitidis Z2491
uaagaaaccguuuuauccga

SEQ ID NO: 3360428 - RNA, 21 nt, Neisseria meningitidis Z2491
uaagacguggugcuaaaacag

SEQ ID NO: 3360429 - RNA, 14 nt, Neisseria meningitidis Z2491
uaagaguuuaaagg

SEQ ID NO: 3360430 - RNA, 16 nt, Neisseria meningitidis Z2491
uaagauguuuuuccac

SEQ ID NO: 3360431 - RNA, 18 nt, Neisseria meningitidis Z2491
uaagauguuuuuccacaa

SEQ ID NO: 3360432 - RNA, 16 nt, Neisseria meningitidis Z2491
uaagcaaucaucucuu

SEQ ID NO: 3360433 - RNA, 19 nt, Neisseria meningitidis Z2491
uaagcaaucaucucuucua

SEQ ID NO: 3360434 - RNA, 12 nt, Neisseria meningitidis Z2491
uaaggcaauuua

SEQ ID NO: 3360435 - RNA, 13 nt, Neisseria meningitidis Z2491
uaaggcaauuuau

SEQ ID NO: 3360436 - RNA, 15 nt, Neisseria meningitidis Z2491
uaaggcgaggcaacg

SEQ ID NO: 3360437 - RNA, 17 nt, Neisseria meningitidis Z2491
uaaggcugcaaagcggc

SEQ ID NO: 3360438 - RNA, 22 nt, Neisseria meningitidis Z2491
uaaggcuuauuucacuuccaac

SEQ ID NO: 3360439 - RNA, 18 nt, Neisseria meningitidis Z2491
uaaggucuagauucccgc

SEQ ID NO: 3360440 - RNA, 19 nt, Neisseria meningitidis Z2491
uaaggucuagauucccgcc

SEQ ID NO: 3360441 - RNA, 19 nt, Neisseria meningitidis Z2491
uaaggucuagauucccgcu

SEQ ID NO: 3360442 - RNA, 16 nt, Neisseria meningitidis Z2491
uaaguauuucuauuuu

SEQ ID NO: 3360443 - RNA, 17 nt, Neisseria meningitidis Z2491
uaagugaguaaaaacaa

SEQ ID NO: 3360444 - RNA, 16 nt, Neisseria meningitidis Z2491
uaaguguuggacaaau

SEQ ID NO: 3360445 - RNA, 13 nt, Neisseria meningitidis Z2491
uaaguuggguuau

SEQ ID NO: 3360446 - RNA, 18 nt, Neisseria meningitidis Z2491
uaaguuucccgaaauucc

SEQ ID NO: 3360447 - RNA, 14 nt, Neisseria meningitidis Z2491
uaauaaacgccaua

SEQ ID NO: 3360448 - RNA, 16 nt, Neisseria meningitidis Z2491
uaauacguuuuucucg

SEQ ID NO: 3360449 - RNA, 15 nt, Neisseria meningitidis Z2491
uaauauacuuggcaa

SEQ ID NO: 3360450 - RNA, 16 nt, Neisseria meningitidis Z2491
uaauauucaaagguua

SEQ ID NO: 3360451 - RNA, 14 nt, Neisseria meningitidis Z2491
uaaucaaaaccagc

SEQ ID NO: 3360452 - RNA, 15 nt, Neisseria meningitidis Z2491
uaaucaaaaccagcc

SEQ ID NO: 3360453 - RNA, 12 nt, Neisseria meningitidis Z2491
uaaucaaacuca

SEQ ID NO: 3360454 - RNA, 15 nt, Neisseria meningitidis Z2491
uaaucacaacggcgu

SEQ ID NO: 3360455 - RNA, 23 nt, Neisseria meningitidis Z2491
uaaucauaauaggcuguuugcga

SEQ ID NO: 3360456 - RNA, 23 nt, Neisseria meningitidis Z2491
uaaucaucacuccgucuuucauu

SEQ ID NO: 3360457 - RNA, 21 nt, Neisseria meningitidis Z2491
uaaucaucguauuuuuaucuu

SEQ ID NO: 3360458 - RNA, 19 nt, Neisseria meningitidis Z2491
uaaucauguuauuauuuuc

SEQ ID NO: 3360459 - RNA, 13 nt, Neisseria meningitidis Z2491
uaaucauguugcc

SEQ ID NO: 3360460 - RNA, 18 nt, Neisseria meningitidis Z2491
uaauccacaguuuuucca

SEQ ID NO: 3360461 - RNA, 15 nt, Neisseria meningitidis Z2491
uaauccacuauaaaa

SEQ ID NO: 3360462 - RNA, 14 nt, Neisseria meningitidis Z2491
uaauccacuauaau

SEQ ID NO: 3360463 - RNA, 19 nt, Neisseria meningitidis Z2491
uaaucccgucauucccacg

SEQ ID NO: 3360464 - RNA, 17 nt, Neisseria meningitidis Z2491
uaauccgaguggcuucc

SEQ ID NO: 3360465 - RNA, 23 nt, Neisseria meningitidis Z2491
uaauccgccugcgccacggcuuu

SEQ ID NO: 3360466 - RNA, 21 nt, Neisseria meningitidis Z2491
uaauccgcuauauauucugau

SEQ ID NO: 3360467 - RNA, 15 nt, Neisseria meningitidis Z2491
uaauccggagcagaa

SEQ ID NO: 3360468 - RNA, 19 nt, Neisseria meningitidis Z2491
uaaucgcgucauucccacg

SEQ ID NO: 3360469 - RNA, 19 nt, Neisseria meningitidis Z2491
uaaucgugugcauacgguu

SEQ ID NO: 3360470 - RNA, 17 nt, Neisseria meningitidis Z2491
uaaucguuuuuucccuu

SEQ ID NO: 3360471 - RNA, 23 nt, Neisseria meningitidis Z2491
uaaucuaguacagccccuuaaag

SEQ ID NO: 3360472 - RNA, 21 nt, Neisseria meningitidis Z2491
uaaucuuugaauauuacuguu

SEQ ID NO: 3360473 - RNA, 13 nt, Neisseria meningitidis Z2491
uaaugaaaaugug

SEQ ID NO: 3360474 - RNA, 18 nt, Neisseria meningitidis Z2491
uaaugaaaaugugcauuu

SEQ ID NO: 3360475 - RNA, 18 nt, Neisseria meningitidis Z2491
uaaugcgguguaucuuuu

SEQ ID NO: 3360476 - RNA, 17 nt, Neisseria meningitidis Z2491
uaauuaccgaaacauuc

SEQ ID NO: 3360477 - RNA, 17 nt, Neisseria meningitidis Z2491
uaauucaaaugcgccuu

SEQ ID NO: 3360478 - RNA, 15 nt, Neisseria meningitidis Z2491
uaauucuacccaaau

SEQ ID NO: 3360479 - RNA, 22 nt, Neisseria meningitidis Z2491
uaauucuccaaguuccaauaca

SEQ ID NO: 3360480 - RNA, 17 nt, Neisseria meningitidis Z2491
uaauuuauccgaaauaa

SEQ ID NO: 3360481 - RNA, 13 nt, Neisseria meningitidis Z2491
uaauuucggaaau

SEQ ID NO: 3360482 - RNA, 21 nt, Neisseria meningitidis Z2491
uaauuugccguaucacaacac

SEQ ID NO: 3360483 - RNA, 20 nt, Neisseria meningitidis Z2491
uaauuuuuaaaauuuuuaua

SEQ ID NO: 3360484 - RNA, 19 nt, Neisseria meningitidis Z2491
uacaaaaggccgucugaaa

SEQ ID NO: 3360485 - RNA, 19 nt, Neisseria meningitidis Z2491
uacaaaaugccgucugaaa

SEQ ID NO: 3360486 - RNA, 15 nt, Neisseria meningitidis Z2491
uacaaacaggcuuca

SEQ ID NO: 3360487 - RNA, 12 nt, Neisseria meningitidis Z2491
uacaaauucacg

SEQ ID NO: 3360488 - RNA, 15 nt, Neisseria meningitidis Z2491
uacaacaaaaugccg

SEQ ID NO: 3360489 - RNA, 19 nt, Neisseria meningitidis Z2491
uacaagaaccgaaaaucuu

SEQ ID NO: 3360490 - RNA, 21 nt, Neisseria meningitidis Z2491
uacaaucagaauacugccugu

SEQ ID NO: 3360491 - RNA, 17 nt, Neisseria meningitidis Z2491
uacacaaaaaagccagc

SEQ ID NO: 3360492 - RNA, 17 nt, Neisseria meningitidis Z2491
uacacaagguuauuuuc

SEQ ID NO: 3360493 - RNA, 14 nt, Neisseria meningitidis Z2491
uacacaauucccac

SEQ ID NO: 3360494 - RNA, 15 nt, Neisseria meningitidis Z2491
uacacaauucccacc

SEQ ID NO: 3360495 - RNA, 14 nt, Neisseria meningitidis Z2491
uacacggcagcacu

SEQ ID NO: 3360496 - RNA, 23 nt, Neisseria meningitidis Z2491
uacacuuaaaaauaccuaaagcc

SEQ ID NO: 3360497 - RNA, 22 nt, Neisseria meningitidis Z2491
uacagaaauuuauaaacaaaaa

SEQ ID NO: 3360498 - RNA, 17 nt, Neisseria meningitidis Z2491
uacagaaccgauucacu

SEQ ID NO: 3360499 - RNA, 18 nt, Neisseria meningitidis Z2491
uacagauaguacugcaag

SEQ ID NO: 3360500 - RNA, 22 nt, Neisseria meningitidis Z2491
uacagauaguacugcaaggcga

SEQ ID NO: 3360501 - RNA, 18 nt, Neisseria meningitidis Z2491
uacagccacgccaaaaau

SEQ ID NO: 3360502 - RNA, 19 nt, Neisseria meningitidis Z2491
uacagcggauuaaaauauc

SEQ ID NO: 3360503 - RNA, 19 nt, Neisseria meningitidis Z2491
uacagcguugccucgccuu

SEQ ID NO: 3360504 - RNA, 13 nt, Neisseria meningitidis Z2491
uacaguuuaaucc

SEQ ID NO: 3360505 - RNA, 13 nt, Neisseria meningitidis Z2491
uacauaaggaaca

SEQ ID NO: 3360506 - RNA, 14 nt, Neisseria meningitidis Z2491
uacauagcaggcau

SEQ ID NO: 3360507 - RNA, 20 nt, Neisseria meningitidis Z2491
uacauaggguuaauaucaga

SEQ ID NO: 3360508 - RNA, 22 nt, Neisseria meningitidis Z2491
uacaucaggcggcguucuucuu

SEQ ID NO: 3360509 - RNA, 17 nt, Neisseria meningitidis Z2491
uacauccgaauaugcca

SEQ ID NO: 3360510 - RNA, 17 nt, Neisseria meningitidis Z2491
uacauuccgucauuccc

SEQ ID NO: 3360511 - RNA, 16 nt, Neisseria meningitidis Z2491
uaccaaacggcauauc

SEQ ID NO: 3360512 - RNA, 23 nt, Neisseria meningitidis Z2491
uaccaaauuauugccagcauuaa

SEQ ID NO: 3360513 - RNA, 17 nt, Neisseria meningitidis Z2491
uaccauaaauuuuaaau

SEQ ID NO: 3360514 - RNA, 15 nt, Neisseria meningitidis Z2491
uaccaucuucuucaa

SEQ ID NO: 3360515 - RNA, 17 nt, Neisseria meningitidis Z2491
uaccaugcgaagacuuu

SEQ ID NO: 3360516 - RNA, 13 nt, Neisseria meningitidis Z2491
uacccaaauaccc

SEQ ID NO: 3360517 - RNA, 12 nt, Neisseria meningitidis Z2491
uacccaaaugca

SEQ ID NO: 3360518 - RNA, 16 nt, Neisseria meningitidis Z2491
uaguacugcaaggcga

SEQ ID NO: 3360519 - RNA, 21 nt, Neisseria meningitidis Z2491
uaguagauuugaacgacggua

SEQ ID NO: 3360520 - RNA, 22 nt, Neisseria meningitidis Z2491
uaguauaguggauuaacaaaaa

SEQ ID NO: 3360521 - RNA, 19 nt, Neisseria meningitidis Z2491
uagucaggcugccuuaugu

SEQ ID NO: 3360522 - RNA, 20 nt, Neisseria meningitidis Z2491
uagucugagaccuuugcaaa

SEQ ID NO: 3360523 - RNA, 17 nt, Neisseria meningitidis Z2491
uagucuuuuuuauucaa

SEQ ID NO: 3360524 - RNA, 15 nt, Neisseria meningitidis Z2491
uagugaacuaaauuu

SEQ ID NO: 3360525 - RNA, 21 nt, Neisseria meningitidis Z2491
uagugaacuaaauuuaaacca

SEQ ID NO: 3360526 - RNA, 17 nt, Neisseria meningitidis Z2491
uagugaauuaaauuuaa

SEQ ID NO: 3360527 - RNA, 19 nt, Neisseria meningitidis Z2491
uagugaauuaaauuuaaac

SEQ ID NO: 3360528 - RNA, 21 nt, Neisseria meningitidis Z2491
uagugaauuaaauuuaaacca

SEQ ID NO: 3360529 - RNA, 16 nt, Neisseria meningitidis Z2491
uagugauuaacaaaaa

SEQ ID NO: 3360530 - RNA, 23 nt, Neisseria meningitidis Z2491
uagugauuaacaaaaaucaggac

SEQ ID NO: 3360531 - RNA, 21 nt, Neisseria meningitidis Z2491
uaguggauuaaauuuaaacca

SEQ ID NO: 3360532 - RNA, 23 nt, Neisseria meningitidis Z2491
uaguggauuaaauuuaaaccagu

SEQ ID NO: 3360533 - RNA, 21 nt, Neisseria meningitidis Z2491
uaguggauuaaauuuaaauca

SEQ ID NO: 3360534 - RNA, 23 nt, Neisseria meningitidis Z2491
uaguggauuaaauuuaaaucagg

SEQ ID NO: 3360535 - RNA, 17 nt, Neisseria meningitidis Z2491
uaguggauuaaauuuau

SEQ ID NO: 3360536 - RNA, 18 nt, Neisseria meningitidis Z2491
uaguggauuaaauuuaua

SEQ ID NO: 3360537 - RNA, 15 nt, Neisseria meningitidis Z2491
uaguggauuaacaaa

SEQ ID NO: 3360538 - RNA, 17 nt, Neisseria meningitidis Z2491
uaguggauuaacaaaaa

SEQ ID NO: 3360539 - RNA, 21 nt, Neisseria meningitidis Z2491
uaguggauuaacuuuaaacca

SEQ ID NO: 3360540 - RNA, 21 nt, Neisseria meningitidis Z2491
uaguggcuuaaauuuaaacca

SEQ ID NO: 3360541 - RNA, 18 nt, Neisseria meningitidis Z2491
uagugguuuuccggcgug

SEQ ID NO: 3360542 - RNA, 12 nt, Neisseria meningitidis Z2491
uaguguauuagu

SEQ ID NO: 3360543 - RNA, 22 nt, Neisseria meningitidis Z2491
uaguguauuagugguuggaaca

SEQ ID NO: 3360544 - RNA, 21 nt, Neisseria meningitidis Z2491
uaguuuccggcaagcagggcu

SEQ ID NO: 3360545 - RNA, 15 nt, Neisseria meningitidis Z2491
uauaaaauuggaaau

SEQ ID NO: 3360546 - RNA, 23 nt, Neisseria meningitidis Z2491
uauaaacgccgcagcaaaauaug

SEQ ID NO: 3360547 - RNA, 20 nt, Neisseria meningitidis Z2491
uauaacuugauauugcggcu

SEQ ID NO: 3360548 - RNA, 19 nt, Neisseria meningitidis Z2491
uauaauacaaaaaugccgu

SEQ ID NO: 3360549 - RNA, 18 nt, Neisseria meningitidis Z2491
uauaauccggagcagaau

SEQ ID NO: 3360550 - RNA, 14 nt, Neisseria meningitidis Z2491
uauacaaaaugccg

SEQ ID NO: 3360551 - RNA, 20 nt, Neisseria meningitidis Z2491
uauacacacgguuuucacau

SEQ ID NO: 3360552 - RNA, 15 nt, Neisseria meningitidis Z2491
uauaccggggaauua

SEQ ID NO: 3360553 - RNA, 23 nt, Neisseria meningitidis Z2491
uauacuggcaaauugaaaugccg

SEQ ID NO: 3360554 - RNA, 17 nt, Neisseria meningitidis Z2491
uauaguaauaaauuaau

SEQ ID NO: 3360555 - RNA, 17 nt, Neisseria meningitidis Z2491
uauagugaauuaaauuu

SEQ ID NO: 3360556 - RNA, 19 nt, Neisseria meningitidis Z2491
uauagugaauuaacaaaaa

SEQ ID NO: 3360557 - RNA, 16 nt, Neisseria meningitidis Z2491
uauaguggauuaaauu

SEQ ID NO: 3360558 - RNA, 18 nt, Neisseria meningitidis Z2491
uauaguggauuaaauuua

SEQ ID NO: 3360559 - RNA, 16 nt, Neisseria meningitidis Z2491
uauaguggauuaacaa

SEQ ID NO: 3360560 - RNA, 20 nt, Neisseria meningitidis Z2491
uauauaauccggagcagaau

SEQ ID NO: 3360561 - RNA, 21 nt, Neisseria meningitidis Z2491
uauauaguggauuaaauuuaa

SEQ ID NO: 3360562 - RNA, 12 nt, Neisseria meningitidis Z2491
uauaucauugcu

SEQ ID NO: 3360563 - RNA, 14 nt, Neisseria meningitidis Z2491
uauaucgaacagcc

SEQ ID NO: 3360564 - RNA, 18 nt, Neisseria meningitidis Z2491
uauauuaaggcugcggca

SEQ ID NO: 3360565 - RNA, 17 nt, Neisseria meningitidis Z2491
uauauucgaccagcucc

SEQ ID NO: 3360566 - RNA, 15 nt, Neisseria meningitidis Z2491
uauauucugauuuaa

SEQ ID NO: 3360567 - RNA, 15 nt, Neisseria meningitidis Z2491
uauauucugauuuau

SEQ ID NO: 3360568 - RNA, 18 nt, Neisseria meningitidis Z2491
uaucaaacaagaaaugau

SEQ ID NO: 3360569 - RNA, 22 nt, Neisseria meningitidis Z2491
uaucaagcccugaaagggauaa

SEQ ID NO: 3360570 - RNA, 23 nt, Neisseria meningitidis Z2491
uaucagaaaugacggaaacucaa

SEQ ID NO: 3360571 - RNA, 16 nt, Neisseria meningitidis Z2491
uaucagaaaugacuga

SEQ ID NO: 3360572 - RNA, 20 nt, Neisseria meningitidis Z2491
uaucagaaaugacugaaauu

SEQ ID NO: 3360573 - RNA, 19 nt, Neisseria meningitidis Z2491
uaucagacggacgagguua

SEQ ID NO: 3360574 - RNA, 19 nt, Neisseria meningitidis Z2491
uaucagaugccgucugaaa

SEQ ID NO: 3360575 - RNA, 18 nt, Neisseria meningitidis Z2491
uaucagggcugcaaaauu

SEQ ID NO: 3360576 - RNA, 21 nt, Neisseria meningitidis Z2491
uaucagggcugcaaaauuuau

SEQ ID NO: 3360577 - RNA, 23 nt, Neisseria meningitidis Z2491
uaucagggcugcaaaauuuaucc

SEQ ID NO: 3360578 - RNA, 14 nt, Neisseria meningitidis Z2491
uaucaguauuuucu

SEQ ID NO: 3360579 - RNA, 18 nt, Neisseria meningitidis Z2491
uaucauacauagcaggca

SEQ ID NO: 3360580 - RNA, 19 nt, Neisseria meningitidis Z2491
uaucauacauagcaggcau

SEQ ID NO: 3360581 - RNA, 21 nt, Neisseria meningitidis Z2491
uaucauucuguucuaaaagca

SEQ ID NO: 3360582 - RNA, 23 nt, Neisseria meningitidis Z2491
uaucauugcuuacaauccgcuuu

SEQ ID NO: 3360583 - RNA, 19 nt, Neisseria meningitidis Z2491
uauccaaacgcauaaccgu

SEQ ID NO: 3360584 - RNA, 14 nt, Neisseria meningitidis Z2491
uauccagaaaaucg

SEQ ID NO: 3360585 - RNA, 16 nt, Neisseria meningitidis Z2491
uauccauaccaaacag

SEQ ID NO: 3360586 - RNA, 16 nt, Neisseria meningitidis Z2491
uauccauagauaaauu

SEQ ID NO: 3360587 - RNA, 17 nt, Neisseria meningitidis Z2491
uauccauagauaaauuu

SEQ ID NO: 3360588 - RNA, 16 nt, Neisseria meningitidis Z2491
uaucccaacaagcuca

SEQ ID NO: 3360589 - RNA, 15 nt, Neisseria meningitidis Z2491
uaucccaauauuaag

SEQ ID NO: 3360590 - RNA, 14 nt, Neisseria meningitidis Z2491
uaucccauaaaaac

SEQ ID NO: 3360591 - RNA, 21 nt, Neisseria meningitidis Z2491
uaucccauaaaaacgggaauc

SEQ ID NO: 3360592 - RNA, 14 nt, Neisseria meningitidis Z2491
uauccgaaacaaca

SEQ ID NO: 3360593 - RNA, 15 nt, Neisseria meningitidis Z2491
uauccgaaacaacaa

SEQ ID NO: 3360594 - RNA, 14 nt, Neisseria meningitidis Z2491
uauccgacugugcc

SEQ ID NO: 3360595 - RNA, 19 nt, Neisseria meningitidis Z2491
uauccgcacacgaacugcc

SEQ ID NO: 3360596 - RNA, 21 nt, Neisseria meningitidis Z2491
uauccgcacacgaacugccuc

SEQ ID NO: 3360597 - RNA, 14 nt, Neisseria meningitidis Z2491
uauccgcacagaaa

SEQ ID NO: 3360598 - RNA, 13 nt, Neisseria meningitidis Z2491
uauccggcuccua

SEQ ID NO: 3360599 - RNA, 16 nt, Neisseria meningitidis Z2491
uauccuaguuauccag

SEQ ID NO: 3360600 - RNA, 22 nt, Neisseria meningitidis Z2491
uaucgcuguaauaaacagcauu

SEQ ID NO: 3360601 - RNA, 18 nt, Neisseria meningitidis Z2491
uaucggaggaguuugaug

SEQ ID NO: 3360602 - RNA, 22 nt, Neisseria meningitidis Z2491
uaucggcauauguuucaacaca

SEQ ID NO: 3360603 - RNA, 18 nt, Neisseria meningitidis Z2491
uaucggcuucgcgggcug

SEQ ID NO: 3360604 - RNA, 14 nt, Neisseria meningitidis Z2491
uaucgggaaaaacg

SEQ ID NO: 3360605 - RNA, 16 nt, Neisseria meningitidis Z2491
uaucgggaaaaauaga

SEQ ID NO: 3360606 - RNA, 16 nt, Neisseria meningitidis Z2491
uaucgggaaugacuga

SEQ ID NO: 3360607 - RNA, 14 nt, Neisseria meningitidis Z2491
uaucuauacuaaaa

SEQ ID NO: 3360608 - RNA, 23 nt, Neisseria meningitidis Z2491
uaucugccccguuuuacccucuc

SEQ ID NO: 3360609 - RNA, 20 nt, Neisseria meningitidis Z2491
uaucuucguccgugccgaaa

SEQ ID NO: 3360610 - RNA, 17 nt, Neisseria meningitidis Z2491
uaucuuuaaacagcaua

SEQ ID NO: 3360611 - RNA, 21 nt, Neisseria meningitidis Z2491
uaucuuucagcaauaaaauaa

SEQ ID NO: 3360612 - RNA, 21 nt, Neisseria meningitidis Z2491
uaugaaaccauuacaaaugcu

SEQ ID NO: 3360613 - RNA, 13 nt, Neisseria meningitidis Z2491
uaugauuuuucgg

SEQ ID NO: 3360614 - RNA, 12 nt, Neisseria meningitidis Z2491
uaugccaugucg

SEQ ID NO: 3360615 - RNA, 23 nt, Neisseria meningitidis Z2491
uaugccgccugccuguuuuucuu

SEQ ID NO: 3360616 - RNA, 12 nt, Neisseria meningitidis Z2491
uaugccgucuga

SEQ ID NO: 3360617 - RNA, 15 nt, Neisseria meningitidis Z2491
uaugccugccgaccc

SEQ ID NO: 3360618 - RNA, 17 nt, Neisseria meningitidis Z2491
ucaaccacgcuucugau

SEQ ID NO: 3360619 - RNA, 14 nt, Neisseria meningitidis Z2491
ucaaccccaggaua

SEQ ID NO: 3360620 - RNA, 22 nt, Neisseria meningitidis Z2491
ucaacgacuuccagcaccaguu

SEQ ID NO: 3360621 - RNA, 15 nt, Neisseria meningitidis Z2491
ucaacgcaagcggcg

SEQ ID NO: 3360622 - RNA, 21 nt, Neisseria meningitidis Z2491
ucaacgcacuggauucccgcc

SEQ ID NO: 3360623 - RNA, 20 nt, Neisseria meningitidis Z2491
ucaacgccggggcaaacaua

SEQ ID NO: 3360624 - RNA, 14 nt, Neisseria meningitidis Z2491
ucaagcaaaucuaa

SEQ ID NO: 3360625 - RNA, 21 nt, Neisseria meningitidis Z2491
ucaagcacagccuauuuuucu

SEQ ID NO: 3360626 - RNA, 11 nt, Neisseria meningitidis Z2491
ucaagcagcaa

SEQ ID NO: 3360627 - RNA, 18 nt, Neisseria meningitidis Z2491
ucaagccuucccguucca

SEQ ID NO: 3360628 - RNA, 20 nt, Neisseria meningitidis Z2491
ucaagcgaugccgcaccuaa

SEQ ID NO: 3360629 - RNA, 21 nt, Neisseria meningitidis Z2491
ucaaguccaaacaaaaaugcc

SEQ ID NO: 3360630 - RNA, 16 nt, Neisseria meningitidis Z2491
ucaagucuuccgguuc

SEQ ID NO: 3360631 - RNA, 19 nt, Neisseria meningitidis Z2491
ucaaguuccagacggcauu

SEQ ID NO: 3360632 - RNA, 19 nt, Neisseria meningitidis Z2491
ucaauaagucugcgaaaca

SEQ ID NO: 3360633 - RNA, 23 nt, Neisseria meningitidis Z2491
ucaaucacccgguccaacuucaa

SEQ ID NO: 3360634 - RNA, 12 nt, Neisseria meningitidis Z2491
ucaaucagcccc

SEQ ID NO: 3360635 - RNA, 13 nt, Neisseria meningitidis Z2491
ucaaucuuauuuu

SEQ ID NO: 3360636 - RNA, 14 nt, Neisseria meningitidis Z2491
ucaaucuuauuuuc

SEQ ID NO: 3360637 - RNA, 20 nt, Neisseria meningitidis Z2491
ucaaucuuauuuucaaaaug

SEQ ID NO: 3360638 - RNA, 14 nt, Neisseria meningitidis Z2491
ucaaugaaaauuug

SEQ ID NO: 3360639 - RNA, 13 nt, Neisseria meningitidis Z2491
ucaaugcuaaggc

SEQ ID NO: 3360640 - RNA, 16 nt, Neisseria meningitidis Z2491
ucaaugcuaaggcaau

SEQ ID NO: 3360641 - RNA, 15 nt, Neisseria meningitidis Z2491
ucaaugucaaaauau

SEQ ID NO: 3360642 - RNA, 16 nt, Neisseria meningitidis Z2491
ucaauuaaaaacaaaa

SEQ ID NO: 3360643 - RNA, 23 nt, Neisseria meningitidis Z2491
ucaauuaaaaacaaaauaguaca

SEQ ID NO: 3360644 - RNA, 16 nt, Neisseria meningitidis Z2491
ucaauuuaaacacuuc

SEQ ID NO: 3360645 - RNA, 22 nt, Neisseria meningitidis Z2491
ucacaaaaacagaaauucaaaa

SEQ ID NO: 3360646 - RNA, 22 nt, Neisseria meningitidis Z2491
ucacaaugaggucgaacugccu

SEQ ID NO: 3360647 - RNA, 18 nt, Neisseria meningitidis Z2491
ucacacguucgcaggcuu

SEQ ID NO: 3360648 - RNA, 13 nt, Neisseria meningitidis Z2491
ucacauagauggg

SEQ ID NO: 3360649 - RNA, 20 nt, Neisseria meningitidis Z2491
ucacauuuucuauuugauuu

SEQ ID NO: 3360650 - RNA, 16 nt, Neisseria meningitidis Z2491
ucacccugcaaggcgg

SEQ ID NO: 3360651 - RNA, 17 nt, Neisseria meningitidis Z2491
ucacccugcaaggcggc

SEQ ID NO: 3360652 - RNA, 19 nt, Neisseria meningitidis Z2491
ucaccgcgccgucaaucag

SEQ ID NO: 3360653 - RNA, 16 nt, Neisseria meningitidis Z2491
ucacgacuucagcagu

SEQ ID NO: 3360654 - RNA, 19 nt, Neisseria meningitidis Z2491
ucacgaguccaagacaggc

SEQ ID NO: 3360655 - RNA, 19 nt, Neisseria meningitidis Z2491
ucacgccauuggaagaaga

SEQ ID NO: 3360656 - RNA, 19 nt, Neisseria meningitidis Z2491
ucacgcccaaaucuugcaa

SEQ ID NO: 3360657 - RNA, 22 nt, Neisseria meningitidis Z2491
ucacgccgccgcgccccaagcc

SEQ ID NO: 3360658 - RNA, 22 nt, Neisseria meningitidis Z2491
ucacgccguguuucaaggcggc

SEQ ID NO: 3360659 - RNA, 22 nt, Neisseria meningitidis Z2491
ucacggcuuugucgguaaaaau

SEQ ID NO: 3360660 - RNA, 15 nt, Neisseria meningitidis Z2491
ucacggugaaaaaug

SEQ ID NO: 3360661 - RNA, 18 nt, Neisseria meningitidis Z2491
ucacguucugaaaaauau

SEQ ID NO: 3360662 - RNA, 20 nt, Neisseria meningitidis Z2491
ucacguucugaaaaauauug

SEQ ID NO: 3360663 - RNA, 18 nt, Neisseria meningitidis Z2491
ucacuauaccaaacggca

SEQ ID NO: 3360664 - RNA, 20 nt, Neisseria meningitidis Z2491
ucacuauaccaaacggcaua

SEQ ID NO: 3360665 - RNA, 16 nt, Neisseria meningitidis Z2491
ucacuauuaaaaugcg

SEQ ID NO: 3360666 - RNA, 21 nt, Neisseria meningitidis Z2491
ucacuuugcucagcccgaaau

SEQ ID NO: 3360667 - RNA, 22 nt, Neisseria meningitidis Z2491
ucacuuugcucagcccgaaaua

SEQ ID NO: 3360668 - RNA, 12 nt, Neisseria meningitidis Z2491
ucagaaaaguuu

SEQ ID NO: 3360669 - RNA, 21 nt, Neisseria meningitidis Z2491
ucagaaaauuucuugauuuuu

SEQ ID NO: 3360670 - RNA, 12 nt, Neisseria meningitidis Z2491
ucagaaaccuaa

SEQ ID NO: 3360671 - RNA, 13 nt, Neisseria meningitidis Z2491
ucagaaaccuaaa

SEQ ID NO: 3360672 - RNA, 17 nt, Neisseria meningitidis Z2491
ucagaaaccuaaaaucc

SEQ ID NO: 3360673 - RNA, 22 nt, Neisseria meningitidis Z2491
ucagaaaugacugaaauucaaa

SEQ ID NO: 3360674 - RNA, 15 nt, Neisseria meningitidis Z2491
ucagaauacugccug

SEQ ID NO: 3360675 - RNA, 14 nt, Neisseria meningitidis Z2491
ucagaauugauucu

SEQ ID NO: 3360676 - RNA, 20 nt, Neisseria meningitidis Z2491
ucagaauuuauuugaacaac

SEQ ID NO: 3360677 - RNA, 20 nt, Neisseria meningitidis Z2491
ucagacagcccucuugccuu

SEQ ID NO: 3360678 - RNA, 15 nt, Neisseria meningitidis Z2491
ucagacauuaaaaaa

SEQ ID NO: 3360679 - RNA, 16 nt, Neisseria meningitidis Z2491
ucagacauuaaaaaau

SEQ ID NO: 3360680 - RNA, 17 nt, Neisseria meningitidis Z2491
ucagacauuaaaaaaua

SEQ ID NO: 3360681 - RNA, 17 nt, Neisseria meningitidis Z2491
ucagaccccuuucggca

SEQ ID NO: 3360682 - RNA, 16 nt, Neisseria meningitidis Z2491
ucagaccgaauuuaau

SEQ ID NO: 3360683 - RNA, 20 nt, Neisseria meningitidis Z2491
ucagacggcauauuuuuugg

SEQ ID NO: 3360684 - RNA, 22 nt, Neisseria meningitidis Z2491
ucagacggcauccgcuuaaaaa

SEQ ID NO: 3360685 - RNA, 12 nt, Neisseria meningitidis Z2491
ucagacggcauu

SEQ ID NO: 3360686 - RNA, 17 nt, Neisseria meningitidis Z2491
ucagacggcauuucccg

SEQ ID NO: 3360687 - RNA, 21 nt, Neisseria meningitidis Z2491
ucagacggcauuugacccauu

SEQ ID NO: 3360688 - RNA, 17 nt, Neisseria meningitidis Z2491
ucagacggcauuuucaa

SEQ ID NO: 3360689 - RNA, 16 nt, Neisseria meningitidis Z2491
ucagacggcauuuugu

SEQ ID NO: 3360690 - RNA, 19 nt, Neisseria meningitidis Z2491
ucagacggcauuuuguuuu

SEQ ID NO: 3360691 - RNA, 18 nt, Neisseria meningitidis Z2491
ucagacggcauuuuucca

SEQ ID NO: 3360692 - RNA, 20 nt, Neisseria meningitidis Z2491
ucagacggcauuuuuuacgg

SEQ ID NO: 3360693 - RNA, 14 nt, Neisseria meningitidis Z2491
ucagagaaauggca

SEQ ID NO: 3360694 - RNA, 17 nt, Neisseria meningitidis Z2491
ucagagaaauggcagua

SEQ ID NO: 3360695 - RNA, 19 nt, Neisseria meningitidis Z2491
ucagauuauuuauuaauuu

SEQ ID NO: 3360696 - RNA, 16 nt, Neisseria meningitidis Z2491
ucagauugauaaaagc

SEQ ID NO: 3360697 - RNA, 14 nt, Neisseria meningitidis Z2491
ucagcaauaaaaua

SEQ ID NO: 3360698 - RNA, 14 nt, Neisseria meningitidis Z2491
ucagcacaaaugcc

SEQ ID NO: 3360699 - RNA, 15 nt, Neisseria meningitidis Z2491
ucagcacaaaugcca

SEQ ID NO: 3360700 - RNA, 15 nt, Neisseria meningitidis Z2491
ucagcaccuuagaga

SEQ ID NO: 3360701 - RNA, 17 nt, Neisseria meningitidis Z2491
ucagcacggggauuuuc

SEQ ID NO: 3360702 - RNA, 21 nt, Neisseria meningitidis Z2491
ucagcauauagugguuuuccg

SEQ ID NO: 3360703 - RNA, 23 nt, Neisseria meningitidis Z2491
ucagccaccagcgguacauccaa

SEQ ID NO: 3360704 - RNA, 16 nt, Neisseria meningitidis Z2491
ucagccaucuacaaaa

SEQ ID NO: 3360705 - RNA, 16 nt, Neisseria meningitidis Z2491
ucagcccgaaauaacu

SEQ ID NO: 3360706 - RNA, 15 nt, Neisseria meningitidis Z2491
ucagcuaugccugcc

SEQ ID NO: 3360707 - RNA, 19 nt, Neisseria meningitidis Z2491
ucagcuauuuagaauaaau

SEQ ID NO: 3360708 - RNA, 13 nt, Neisseria meningitidis Z2491
ucagcucuuugag

SEQ ID NO: 3360709 - RNA, 19 nt, Neisseria meningitidis Z2491
ucaggaauuugcggcaaau

SEQ ID NO: 3360710 - RNA, 14 nt, Neisseria meningitidis Z2491
ucaggacaaggcgg

SEQ ID NO: 3360711 - RNA, 22 nt, Neisseria meningitidis Z2491
ucaggacggaaauguucuuuca

SEQ ID NO: 3360712 - RNA, 13 nt, Neisseria meningitidis Z2491
ucaggacggcuuu

SEQ ID NO: 3360713 - RNA, 16 nt, Neisseria meningitidis Z2491
ucaggcaaauuucagu

SEQ ID NO: 3360714 - RNA, 17 nt, Neisseria meningitidis Z2491
ucaggcauccgggcugc

SEQ ID NO: 3360715 - RNA, 15 nt, Neisseria meningitidis Z2491
ucaggcccuguuugu

SEQ ID NO: 3360716 - RNA, 15 nt, Neisseria meningitidis Z2491
ucaggcguuuccaaa

SEQ ID NO: 3360717 - RNA, 18 nt, Neisseria meningitidis Z2491
ucaggcuggaaaacagcu

SEQ ID NO: 3360718 - RNA, 18 nt, Neisseria meningitidis Z2491
ucaggcuucagacggcau

SEQ ID NO: 3360719 - RNA, 18 nt, Neisseria meningitidis Z2491
uccaucacgacaacgguc

SEQ ID NO: 3360720 - RNA, 14 nt, Neisseria meningitidis Z2491
uccaucaguuucca

SEQ ID NO: 3360721 - RNA, 19 nt, Neisseria meningitidis Z2491
uccaucaguuuccacuaaa

SEQ ID NO: 3360722 - RNA, 14 nt, Neisseria meningitidis Z2491
uccauucccucucc

SEQ ID NO: 3360723 - RNA, 15 nt, Neisseria meningitidis Z2491
uccauucccucuccc

SEQ ID NO: 3360724 - RNA, 18 nt, Neisseria meningitidis Z2491
ucccaaaggcaauaacua

SEQ ID NO: 3360725 - RNA, 22 nt, Neisseria meningitidis Z2491
ucccaccauggucgcugacacc

SEQ ID NO: 3360726 - RNA, 11 nt, Neisseria meningitidis Z2491
ucccaccguuu

SEQ ID NO: 3360727 - RNA, 17 nt, Neisseria meningitidis Z2491
ucccaccguuucccauc

SEQ ID NO: 3360728 - RNA, 17 nt, Neisseria meningitidis Z2491
ucccacgcgcccaucgu

SEQ ID NO: 3360729 - RNA, 14 nt, Neisseria meningitidis Z2491
ucccacgggacuuu

SEQ ID NO: 3360730 - RNA, 21 nt, Neisseria meningitidis Z2491
ucccacuuucgugggaaugac

SEQ ID NO: 3360731 - RNA, 21 nt, Neisseria meningitidis Z2491
ucccacuuuugugggaaugac

SEQ ID NO: 3360732 - RNA, 15 nt, Neisseria meningitidis Z2491
ucccauuauuuucac

SEQ ID NO: 3360733 - RNA, 22 nt, Neisseria meningitidis Z2491
uccccauaugccgucugaagau

SEQ ID NO: 3360734 - RNA, 13 nt, Neisseria meningitidis Z2491
ucccccacagggg

SEQ ID NO: 3360735 - RNA, 19 nt, Neisseria meningitidis Z2491
ucccccgaagaugggaauc

SEQ ID NO: 3360736 - RNA, 19 nt, Neisseria meningitidis Z2491
uccccgaaaccgaaugcca

SEQ ID NO: 3360737 - RNA, 22 nt, Neisseria meningitidis Z2491
uccccgaauccacgcucaaaca

SEQ ID NO: 3360738 - RNA, 14 nt, Neisseria meningitidis Z2491
uccccuaugcuuug

SEQ ID NO: 3360739 - RNA, 20 nt, Neisseria meningitidis Z2491
ucccgacagccgaaacccaa

SEQ ID NO: 3360740 - RNA, 21 nt, Neisseria meningitidis Z2491
ucccgacagccgaaacccaaa

SEQ ID NO: 3360741 - RNA, 17 nt, Neisseria meningitidis Z2491
ucccgagaaaacagaaa

SEQ ID NO: 3360742 - RNA, 15 nt, Neisseria meningitidis Z2491
ucccgauaaaugccg

SEQ ID NO: 3360743 - RNA, 15 nt, Neisseria meningitidis Z2491
ucccgccaaacccuc

SEQ ID NO: 3360744 - RNA, 15 nt, Neisseria meningitidis Z2491
ucccgcccgcaggua

SEQ ID NO: 3360745 - RNA, 21 nt, Neisseria meningitidis Z2491
ucccgccugcgcgggaaugac

SEQ ID NO: 3360746 - RNA, 22 nt, Neisseria meningitidis Z2491
ucccgugguuuuucgguuacug

SEQ ID NO: 3360747 - RNA, 15 nt, Neisseria meningitidis Z2491
ucccguuauuuucac

SEQ ID NO: 3360748 - RNA, 22 nt, Neisseria meningitidis Z2491
ucccguugccaaaccggcauuc

SEQ ID NO: 3360749 - RNA, 23 nt, Neisseria meningitidis Z2491
ucccucaaaaacagaaaaccaaa

SEQ ID NO: 3360750 - RNA, 21 nt, Neisseria meningitidis Z2491
ucccucaaauaaaaugccguc

SEQ ID NO: 3360751 - RNA, 13 nt, Neisseria meningitidis Z2491
uccgaaacaacaa

SEQ ID NO: 3360752 - RNA, 12 nt, Neisseria meningitidis Z2491
uccgaaaccaag

SEQ ID NO: 3360753 - RNA, 17 nt, Neisseria meningitidis Z2491
uccgaaauauuacccaa

SEQ ID NO: 3360754 - RNA, 18 nt, Neisseria meningitidis Z2491
uccgaaauauuacccaac

SEQ ID NO: 3360755 - RNA, 14 nt, Neisseria meningitidis Z2491
uccgaaaucaucca

SEQ ID NO: 3360756 - RNA, 17 nt, Neisseria meningitidis Z2491
uccgaaccgcaaaugcu

SEQ ID NO: 3360757 - RNA, 19 nt, Neisseria meningitidis Z2491
uccgaacgcgaaaaugccg

SEQ ID NO: 3360758 - RNA, 13 nt, Neisseria meningitidis Z2491
uccgaacggcuug

SEQ ID NO: 3360759 - RNA, 22 nt, Neisseria meningitidis Z2491
uccgaauaugccagaccgucua

SEQ ID NO: 3360760 - RNA, 17 nt, Neisseria meningitidis Z2491
uccgaaucaacacgccu

SEQ ID NO: 3360761 - RNA, 19 nt, Neisseria meningitidis Z2491
uccgacaauuucuccgcca

SEQ ID NO: 3360762 - RNA, 23 nt, Neisseria meningitidis Z2491
uccgacaauuucuccgccagccu

SEQ ID NO: 3360763 - RNA, 13 nt, Neisseria meningitidis Z2491
uccgacaggcaaa

SEQ ID NO: 3360764 - RNA, 19 nt, Neisseria meningitidis Z2491
uccgaccaacucccaguuc

SEQ ID NO: 3360765 - RNA, 21 nt, Neisseria meningitidis Z2491
uccgacugugccgcguguccg

SEQ ID NO: 3360766 - RNA, 14 nt, Neisseria meningitidis Z2491
uccgaggcggcuuu

SEQ ID NO: 3360767 - RNA, 17 nt, Neisseria meningitidis Z2491
uccgaggcuguggagca

SEQ ID NO: 3360768 - RNA, 17 nt, Neisseria meningitidis Z2491
uccgauaaauuccuaaa

SEQ ID NO: 3360769 - RNA, 17 nt, Neisseria meningitidis Z2491
uccgauaaauucuugag

SEQ ID NO: 3360770 - RNA, 15 nt, Neisseria meningitidis Z2491
uccgauaaguuuccg

SEQ ID NO: 3360771 - RNA, 20 nt, Neisseria meningitidis Z2491
uccgauacguuuccgcaccg

SEQ ID NO: 3360772 - RNA, 20 nt, Neisseria meningitidis Z2491
uccgauggaaccguuuuccg

SEQ ID NO: 3360773 - RNA, 21 nt, Neisseria meningitidis Z2491
uccgcaaaaugccgucugaaa

SEQ ID NO: 3360774 - RNA, 17 nt, Neisseria meningitidis Z2491
uccgcaccgacagaccu

SEQ ID NO: 3360775 - RNA, 21 nt, Neisseria meningitidis Z2491
uccgccaaaaacggcacggcg

SEQ ID NO: 3360776 - RNA, 22 nt, Neisseria meningitidis Z2491
uccgccacguuugccaaggcgg

SEQ ID NO: 3360777 - RNA, 14 nt, Neisseria meningitidis Z2491
uccgccauuuccaa

SEQ ID NO: 3360778 - RNA, 21 nt, Neisseria meningitidis Z2491
uccgccauuuccaaacccaau

SEQ ID NO: 3360779 - RNA, 15 nt, Neisseria meningitidis Z2491
uccgcgauaaggcgc

SEQ ID NO: 3360780 - RNA, 20 nt, Neisseria meningitidis Z2491
uccgcgccgauguuuuccug

SEQ ID NO: 3360781 - RNA, 15 nt, Neisseria meningitidis Z2491
uccggaaucagaccg

SEQ ID NO: 3360782 - RNA, 11 nt, Neisseria meningitidis Z2491
uccggcagccu

SEQ ID NO: 3360783 - RNA, 21 nt, Neisseria meningitidis Z2491
uccggcagggcagguuuuggu

SEQ ID NO: 3360784 - RNA, 16 nt, Neisseria meningitidis Z2491
uccggccaaaaaaacg

SEQ ID NO: 3360785 - RNA, 18 nt, Neisseria meningitidis Z2491
uccggcuccuaucccuua

SEQ ID NO: 3360786 - RNA, 14 nt, Neisseria meningitidis Z2491
uccggcuuuccaug

SEQ ID NO: 3360787 - RNA, 16 nt, Neisseria meningitidis Z2491
uccgggauuuuaaagu

SEQ ID NO: 3360788 - RNA, 17 nt, Neisseria meningitidis Z2491
uccgguucauuucaggc

SEQ ID NO: 3360789 - RNA, 20 nt, Neisseria meningitidis Z2491
uccgguuuuuugaguuucag

SEQ ID NO: 3360790 - RNA, 15 nt, Neisseria meningitidis Z2491
uccguaaauugucca

SEQ ID NO: 3360791 - RNA, 15 nt, Neisseria meningitidis Z2491
uccguaagccuucau

SEQ ID NO: 3360792 - RNA, 11 nt, Neisseria meningitidis Z2491
uccgucagcac

SEQ ID NO: 3360793 - RNA, 14 nt, Neisseria meningitidis Z2491
uccgucauucccgc

SEQ ID NO: 3360794 - RNA, 17 nt, Neisseria meningitidis Z2491
uccgucauucccgcgaa

SEQ ID NO: 3360795 - RNA, 22 nt, Neisseria meningitidis Z2491
uccgucggggucuucgacgaag

SEQ ID NO: 3360796 - RNA, 14 nt, Neisseria meningitidis Z2491
uccguguguauagu

SEQ ID NO: 3360797 - RNA, 14 nt, Neisseria meningitidis Z2491
uccguuauucccgc

SEQ ID NO: 3360798 - RNA, 21 nt, Neisseria meningitidis Z2491
uccguucgggaauauucugau

SEQ ID NO: 3360799 - RNA, 14 nt, Neisseria meningitidis Z2491
uccguuugguuuua

SEQ ID NO: 3360800 - RNA, 13 nt, Neisseria meningitidis Z2491
uccuaaaaauuua

SEQ ID NO: 3360801 - RNA, 13 nt, Neisseria meningitidis Z2491
uccuaaaacuuaa

SEQ ID NO: 3360802 - RNA, 21 nt, Neisseria meningitidis Z2491
uccuaaaacuuaaaauuccgu

SEQ ID NO: 3360803 - RNA, 20 nt, Neisseria meningitidis Z2491
uccuaauauugagcaaaaag

SEQ ID NO: 3360804 - RNA, 17 nt, Neisseria meningitidis Z2491
uccuaauucuacccaaa

SEQ ID NO: 3360805 - RNA, 21 nt, Neisseria meningitidis Z2491
uccuaauucuacccaaauacc

SEQ ID NO: 3360806 - RNA, 14 nt, Neisseria meningitidis Z2491
uccuacuuuuugcu

SEQ ID NO: 3360807 - RNA, 13 nt, Neisseria meningitidis Z2491
uccucaacuuauu

SEQ ID NO: 3360808 - RNA, 17 nt, Neisseria meningitidis Z2491
uccuccaccauuucuuu

SEQ ID NO: 3360809 - RNA, 19 nt, Neisseria meningitidis Z2491
uccuccacuaaaaaaucca

SEQ ID NO: 3360810 - RNA, 17 nt, Neisseria meningitidis Z2491
uccucccacucuuucaa

SEQ ID NO: 3360811 - RNA, 20 nt, Neisseria meningitidis Z2491
uccuccucgccgucuuucag

SEQ ID NO: 3360812 - RNA, 20 nt, Neisseria meningitidis Z2491
uccucuuucaacggcacggc

SEQ ID NO: 3360813 - RNA, 18 nt, Neisseria meningitidis Z2491
uccugacaaauucccgcc

SEQ ID NO: 3360814 - RNA, 17 nt, Neisseria meningitidis Z2491
uccugaccuuugcagaa

SEQ ID NO: 3360815 - RNA, 22 nt, Neisseria meningitidis Z2491
uccugaugugccaaugccgucu

SEQ ID NO: 3360816 - RNA, 11 nt, Neisseria meningitidis Z2491
uccugauuuaa

SEQ ID NO: 3360817 - RNA, 13 nt, Neisseria meningitidis Z2491
uccugauuuaaau

SEQ ID NO: 3360818 - RNA, 17 nt, Neisseria meningitidis Z2491
uccugauuuaaauuuaa

SEQ ID NO: 3360819 - RNA, 18 nt, Neisseria meningitidis Z2491
uccugauuuaaauuuaau

SEQ ID NO: 3360820 - RNA, 21 nt, Neisseria meningitidis Z2491
uccugauuuuuguuaauccac

SEQ ID NO: 3360821 - RNA, 17 nt, Neisseria meningitidis Z2491
uccugcacgcgcuucaa

SEQ ID NO: 3360822 - RNA, 19 nt, Neisseria meningitidis Z2491
uccugcaggcguaugccuu

SEQ ID NO: 3360823 - RNA, 20 nt, Neisseria meningitidis Z2491
uccugcaucagcuucauacc

SEQ ID NO: 3360824 - RNA, 21 nt, Neisseria meningitidis Z2491
uccugccgccggaagcgcacc

SEQ ID NO: 3360825 - RNA, 19 nt, Neisseria meningitidis Z2491
uccugcguguucgggcguu

SEQ ID NO: 3360826 - RNA, 22 nt, Neisseria meningitidis Z2491
uccugugguuuuucgguuacug

SEQ ID NO: 3360827 - RNA, 21 nt, Neisseria meningitidis Z2491
uccuguucaaggcgacagccg

SEQ ID NO: 3360828 - RNA, 15 nt, Neisseria meningitidis Z2491
uccuuaaaaaaggcu

SEQ ID NO: 3360829 - RNA, 17 nt, Neisseria meningitidis Z2491
uccuuaucggcaaaaaa

SEQ ID NO: 3360830 - RNA, 15 nt, Neisseria meningitidis Z2491
uccuuauuucugcuu

SEQ ID NO: 3360831 - RNA, 14 nt, Neisseria meningitidis Z2491
uccuucacgccauu

SEQ ID NO: 3360832 - RNA, 12 nt, Neisseria meningitidis Z2491
uccuuccaaaag

SEQ ID NO: 3360833 - RNA, 22 nt, Neisseria meningitidis Z2491
uccuucccgcaaaaacggaaaa

SEQ ID NO: 3360834 - RNA, 15 nt, Neisseria meningitidis Z2491
uccuuccugaugaaa

SEQ ID NO: 3360835 - RNA, 21 nt, Neisseria meningitidis Z2491
uccuuguguugguuuugaggc

SEQ ID NO: 3360836 - RNA, 14 nt, Neisseria meningitidis Z2491
uccuuuaauuaaga

SEQ ID NO: 3360837 - RNA, 12 nt, Neisseria meningitidis Z2491
uccuuucccucc

SEQ ID NO: 3360838 - RNA, 13 nt, Neisseria meningitidis Z2491
uccuuuccucuuu

SEQ ID NO: 3360839 - RNA, 13 nt, Neisseria meningitidis Z2491
uccuuucuguauc

SEQ ID NO: 3360840 - RNA, 14 nt, Neisseria meningitidis Z2491
ucgaaaugccgucu

SEQ ID NO: 3360841 - RNA, 23 nt, Neisseria meningitidis Z2491
ucgaacaacucuuucgggcugcc

SEQ ID NO: 3360842 - RNA, 22 nt, Neisseria meningitidis Z2491
ucgaacagccuguccaaagccu

SEQ ID NO: 3360843 - RNA, 23 nt, Neisseria meningitidis Z2491
ucgaacgaucgaauuauuuaauc

SEQ ID NO: 3360844 - RNA, 15 nt, Neisseria meningitidis Z2491
ucgaagaaguggguc

SEQ ID NO: 3360845 - RNA, 17 nt, Neisseria meningitidis Z2491
ucgaaggcgcggcugcc

SEQ ID NO: 3360846 - RNA, 14 nt, Neisseria meningitidis Z2491
ucgaaucuucuuuu

SEQ ID NO: 3360847 - RNA, 13 nt, Neisseria meningitidis Z2491
ucgaccagcuccc

SEQ ID NO: 3360848 - RNA, 23 nt, Neisseria meningitidis Z2491
ucgaccugcuguuugagccugug

SEQ ID NO: 3360849 - RNA, 21 nt, Neisseria meningitidis Z2491
ucgacgauggaccucaggccg

SEQ ID NO: 3360850 - RNA, 14 nt, Neisseria meningitidis Z2491
ucgagacucguuuc

SEQ ID NO: 3360851 - RNA, 17 nt, Neisseria meningitidis Z2491
ucgagauaaguguugga

SEQ ID NO: 3360852 - RNA, 22 nt, Neisseria meningitidis Z2491
ucgagauaaguguuggacaaau

SEQ ID NO: 3360853 - RNA, 22 nt, Neisseria meningitidis Z2491
ucgagcaggcagcguucgacga

SEQ ID NO: 3360854 - RNA, 14 nt, Neisseria meningitidis Z2491
ucgagcggcagguc

SEQ ID NO: 3360855 - RNA, 18 nt, Neisseria meningitidis Z2491
ucgaggguuucuguuuuu

SEQ ID NO: 3360856 - RNA, 13 nt, Neisseria meningitidis Z2491
ucgaugccgaugc

SEQ ID NO: 3360857 - RNA, 23 nt, Neisseria meningitidis Z2491
ucgaugcgguugaucauuucagg

SEQ ID NO: 3360858 - RNA, 15 nt, Neisseria meningitidis Z2491
ucgauguggcugaug

SEQ ID NO: 3360859 - RNA, 17 nt, Neisseria meningitidis Z2491
ucgcaacuccaaagaga

SEQ ID NO: 3360860 - RNA, 18 nt, Neisseria meningitidis Z2491
ucgcaaugcugcggaugu

SEQ ID NO: 3360861 - RNA, 11 nt, Neisseria meningitidis Z2491
ucgcagauucg

SEQ ID NO: 3360862 - RNA, 20 nt, Neisseria meningitidis Z2491
ucgcaggcuucguaggcauc

SEQ ID NO: 3360863 - RNA, 21 nt, Neisseria meningitidis Z2491
ucgccacauaauucaaaugcg

SEQ ID NO: 3360864 - RNA, 15 nt, Neisseria meningitidis Z2491
ucgccauaaucagcc

SEQ ID NO: 3360865 - RNA, 13 nt, Neisseria meningitidis Z2491
ucgccauucccgu

SEQ ID NO: 3360866 - RNA, 19 nt, Neisseria meningitidis Z2491
ucgccccaaaaagaggcau

SEQ ID NO: 3360867 - RNA, 15 nt, Neisseria meningitidis Z2491
ucgccccaaauaccu

SEQ ID NO: 3360868 - RNA, 19 nt, Neisseria meningitidis Z2491
ucgcccguuaccagcagug

SEQ ID NO: 3360869 - RNA, 21 nt, Neisseria meningitidis Z2491
ucgccgacaucuucgaggaac

SEQ ID NO: 3360870 - RNA, 19 nt, Neisseria meningitidis Z2491
ucgccgccggaaagcugcc

SEQ ID NO: 3360871 - RNA, 11 nt, Neisseria meningitidis Z2491
ucgccgcuucu

SEQ ID NO: 3360872 - RNA, 18 nt, Neisseria meningitidis Z2491
ucgccguaaccgacgaag

SEQ ID NO: 3360873 - RNA, 16 nt, Neisseria meningitidis Z2491
ucgccgucauucccgc

SEQ ID NO: 3360874 - RNA, 17 nt, Neisseria meningitidis Z2491
ucgccgucuuucaggaa

SEQ ID NO: 3360875 - RNA, 16 nt, Neisseria meningitidis Z2491
ucgccgugcgcgaaac

SEQ ID NO: 3360876 - RNA, 19 nt, Neisseria meningitidis Z2491
ucgccuaucauauuuucag

SEQ ID NO: 3360877 - RNA, 19 nt, Neisseria meningitidis Z2491
ucgccuuccgcuucuucca

SEQ ID NO: 3360878 - RNA, 20 nt, Neisseria meningitidis Z2491
ucgccuuccgcuucuuccag

SEQ ID NO: 3360879 - RNA, 19 nt, Neisseria meningitidis Z2491
ucgccuuguccugauuuuu

SEQ ID NO: 3360880 - RNA, 16 nt, Neisseria meningitidis Z2491
ucgcgcaauuccugca

SEQ ID NO: 3360881 - RNA, 11 nt, Neisseria meningitidis Z2491
ucgcggcggca

SEQ ID NO: 3360882 - RNA, 16 nt, Neisseria meningitidis Z2491
ucgcucugcgcgcuug

SEQ ID NO: 3360883 - RNA, 16 nt, Neisseria meningitidis Z2491
ucgcuguuuucuguuu

SEQ ID NO: 3360884 - RNA, 19 nt, Neisseria meningitidis Z2491
ucgcuguuuucuguuuggc

SEQ ID NO: 3360885 - RNA, 14 nt, Neisseria meningitidis Z2491
ucggaaaugacuga

SEQ ID NO: 3360886 - RNA, 18 nt, Neisseria meningitidis Z2491
ucggaaaugacugaaacu

SEQ ID NO: 3360887 - RNA, 21 nt, Neisseria meningitidis Z2491
ucggaaaugaucaggcggauu

SEQ ID NO: 3360888 - RNA, 16 nt, Neisseria meningitidis Z2491
ucggacauuugacuug

SEQ ID NO: 3360889 - RNA, 22 nt, Neisseria meningitidis Z2491
ucggacggcaucguaugaaaca

SEQ ID NO: 3360890 - RNA, 12 nt, Neisseria meningitidis Z2491
ucggacuaaacc

SEQ ID NO: 3360891 - RNA, 17 nt, Neisseria meningitidis Z2491
ucggagagacugugcca

SEQ ID NO: 3360892 - RNA, 19 nt, Neisseria meningitidis Z2491
ucggauaaaacagaaauua

SEQ ID NO: 3360893 - RNA, 20 nt, Neisseria meningitidis Z2491
ucggauaaaacagaaauuaa

SEQ ID NO: 3360894 - RNA, 13 nt, Neisseria meningitidis Z2491
ucggauaaauucc

SEQ ID NO: 3360895 - RNA, 13 nt, Neisseria meningitidis Z2491
ucggauaaauuuu

SEQ ID NO: 3360896 - RNA, 16 nt, Neisseria meningitidis Z2491
ucggauaaucuuugaa

SEQ ID NO: 3360897 - RNA, 15 nt, Neisseria meningitidis Z2491
ucggauaggcaaaaa

SEQ ID NO: 3360898 - RNA, 20 nt, Neisseria meningitidis Z2491
ucggcaaacccuucgggaaa

SEQ ID NO: 3360899 - RNA, 12 nt, Neisseria meningitidis Z2491
ucggcaagaugg

SEQ ID NO: 3360900 - RNA, 22 nt, Neisseria meningitidis Z2491
ucggcaagauggggcaaguguc

SEQ ID NO: 3360901 - RNA, 23 nt, Neisseria meningitidis Z2491
ucggcaauccggucuuggcagca

SEQ ID NO: 3360902 - RNA, 14 nt, Neisseria meningitidis Z2491
ucggcacaagaugc

SEQ ID NO: 3360903 - RNA, 18 nt, Neisseria meningitidis Z2491
ucggcacgcgguuuugcg

SEQ ID NO: 3360904 - RNA, 14 nt, Neisseria meningitidis Z2491
ucggcagcuuuuuu

SEQ ID NO: 3360905 - RNA, 14 nt, Neisseria meningitidis Z2491
ucggcauggccgac

SEQ ID NO: 3360906 - RNA, 22 nt, Neisseria meningitidis Z2491
ucggcugucgggagggaaggga

SEQ ID NO: 3360907 - RNA, 18 nt, Neisseria meningitidis Z2491
ucggcuuucagacggcau

SEQ ID NO: 3360908 - RNA, 21 nt, Neisseria meningitidis Z2491
ucgggaaugacugaaacucaa

SEQ ID NO: 3360909 - RNA, 18 nt, Neisseria meningitidis Z2491
ucgggagcaacugaaacc

SEQ ID NO: 3360910 - RNA, 18 nt, Neisseria meningitidis Z2491
ucgggaucgcgcggauuc

SEQ ID NO: 3360911 - RNA, 15 nt, Neisseria meningitidis Z2491
ucgggcaaaagccag

SEQ ID NO: 3360912 - RNA, 22 nt, Neisseria meningitidis Z2491
ucgggcaaaagccagcggauug

SEQ ID NO: 3360913 - RNA, 20 nt, Neisseria meningitidis Z2491
ucgggcaaagcgucugccuc

SEQ ID NO: 3360914 - RNA, 19 nt, Neisseria meningitidis Z2491
ucgggcaacucgauuuccg

SEQ ID NO: 3360915 - RNA, 22 nt, Neisseria meningitidis Z2491
ucgggcaaugccgacgcgcugc

SEQ ID NO: 3360916 - RNA, 22 nt, Neisseria meningitidis Z2491
ucgggcagcggcaauauucaaa

SEQ ID NO: 3360917 - RNA, 23 nt, Neisseria meningitidis Z2491
ucgggcggcgguuugccgucuga

SEQ ID NO: 3360918 - RNA, 21 nt, Neisseria meningitidis Z2491
ucgggcgggaauagcucaguu

SEQ ID NO: 3360919 - RNA, 19 nt, Neisseria meningitidis Z2491
ucggggggggguauuugcu

SEQ ID NO: 3360920 - RNA, 18 nt, Neisseria meningitidis Z2491
ucggggguuucuguuuuu

SEQ ID NO: 3360921 - RNA, 21 nt, Neisseria meningitidis Z2491
ucugacaaggccgacaggcgu

SEQ ID NO: 3360922 - RNA, 16 nt, Neisseria meningitidis Z2491
ucugacgcguuuuacc

SEQ ID NO: 3360923 - RNA, 14 nt, Neisseria meningitidis Z2491
ucugagaacuucag

SEQ ID NO: 3360924 - RNA, 20 nt, Neisseria meningitidis Z2491
ucugagaccuuugcaaaaau

SEQ ID NO: 3360925 - RNA, 23 nt, Neisseria meningitidis Z2491
ucugagaccuuugcaaaaauaau

SEQ ID NO: 3360926 - RNA, 15 nt, Neisseria meningitidis Z2491
ucugauaagcaagca

SEQ ID NO: 3360927 - RNA, 22 nt, Neisseria meningitidis Z2491
ucugauagccgcccaaugccgu

SEQ ID NO: 3360928 - RNA, 15 nt, Neisseria meningitidis Z2491
ucugauuuauuuccu

SEQ ID NO: 3360929 - RNA, 18 nt, Neisseria meningitidis Z2491
ucugauuucguaauccgc

SEQ ID NO: 3360930 - RNA, 14 nt, Neisseria meningitidis Z2491
ucugauuuugauuu

SEQ ID NO: 3360931 - RNA, 14 nt, Neisseria meningitidis Z2491
ucugauuuuuccua

SEQ ID NO: 3360932 - RNA, 13 nt, Neisseria meningitidis Z2491
ucugcaagcagca

SEQ ID NO: 3360933 - RNA, 14 nt, Neisseria meningitidis Z2491
ucugcaagcagcag

SEQ ID NO: 3360934 - RNA, 14 nt, Neisseria meningitidis Z2491
ucugcacgccgacu

SEQ ID NO: 3360935 - RNA, 16 nt, Neisseria meningitidis Z2491
ucugcauuauuuggga

SEQ ID NO: 3360936 - RNA, 13 nt, Neisseria meningitidis Z2491
ucugccagcuccg

SEQ ID NO: 3360937 - RNA, 20 nt, Neisseria meningitidis Z2491
ucugccccguuuuacccucu

SEQ ID NO: 3360938 - RNA, 22 nt, Neisseria meningitidis Z2491
ucugccccguuuuacccucucc

SEQ ID NO: 3360939 - RNA, 23 nt, Neisseria meningitidis Z2491
ucugcccguauuugagugcggca

SEQ ID NO: 3360940 - RNA, 15 nt, Neisseria meningitidis Z2491
ucugccgacugccaa

SEQ ID NO: 3360941 - RNA, 22 nt, Neisseria meningitidis Z2491
ucugccuucgggauaaucuuuu

SEQ ID NO: 3360942 - RNA, 14 nt, Neisseria meningitidis Z2491
ucugccuucuucuu

SEQ ID NO: 3360943 - RNA, 21 nt, Neisseria meningitidis Z2491
ucugcgaaagggcaguuggga

SEQ ID NO: 3360944 - RNA, 23 nt, Neisseria meningitidis Z2491
ucugcggacuuaagaaacaaagc

SEQ ID NO: 3360945 - RNA, 19 nt, Neisseria meningitidis Z2491
ucugcggcuuugccgccuu

SEQ ID NO: 3360946 - RNA, 13 nt, Neisseria meningitidis Z2491
ucuggaaaccaaa

SEQ ID NO: 3360947 - RNA, 15 nt, Neisseria meningitidis Z2491
ucuguaacuuccaca

SEQ ID NO: 3360948 - RNA, 18 nt, Neisseria meningitidis Z2491
ucugucuccgccuguaug

SEQ ID NO: 3360949 - RNA, 16 nt, Neisseria meningitidis Z2491
ucugucucguuaagag

SEQ ID NO: 3360950 - RNA, 15 nt, Neisseria meningitidis Z2491
ucugugguuuaacuu

SEQ ID NO: 3360951 - RNA, 12 nt, Neisseria meningitidis Z2491
ucuguuguuucg

SEQ ID NO: 3360952 - RNA, 16 nt, Neisseria meningitidis Z2491
ucuguuguuucggaua

SEQ ID NO: 3360953 - RNA, 22 nt, Neisseria meningitidis Z2491
ucuguuguuucggauaaauuuu

SEQ ID NO: 3360954 - RNA, 13 nt, Neisseria meningitidis Z2491
ucuguuuggcuuu

SEQ ID NO: 3360955 - RNA, 12 nt, Neisseria meningitidis Z2491
ucuguuuuuccg

SEQ ID NO: 3360956 - RNA, 20 nt, Neisseria meningitidis Z2491
ucuuaaaaacaaaaugccgu

SEQ ID NO: 3360957 - RNA, 18 nt, Neisseria meningitidis Z2491
ucuuaauacguuuuucuc

SEQ ID NO: 3360958 - RNA, 14 nt, Neisseria meningitidis Z2491
ucuuauccauccca

SEQ ID NO: 3360959 - RNA, 22 nt, Neisseria meningitidis Z2491
ucuuaugccuauuuuuuaauca

SEQ ID NO: 3360960 - RNA, 22 nt, Neisseria meningitidis Z2491
ucuuauuaaauauuaaugauua

SEQ ID NO: 3360961 - RNA, 18 nt, Neisseria meningitidis Z2491
ucuuauuuauuuuuucuc

SEQ ID NO: 3360962 - RNA, 14 nt, Neisseria meningitidis Z2491
ucuuauuuucaaaa

SEQ ID NO: 3360963 - RNA, 14 nt, Neisseria meningitidis Z2491
ucuucaaaaucauc

SEQ ID NO: 3360964 - RNA, 17 nt, Neisseria meningitidis Z2491
ucuucaaaaucauccca

SEQ ID NO: 3360965 - RNA, 16 nt, Neisseria meningitidis Z2491
ucuucaaaggaaacau

SEQ ID NO: 3360966 - RNA, 19 nt, Neisseria meningitidis Z2491
ucuucagauuuuacguucu

SEQ ID NO: 3360967 - RNA, 22 nt, Neisseria meningitidis Z2491
ucuucauacgacucaaaaucau

SEQ ID NO: 3360968 - RNA, 16 nt, Neisseria meningitidis Z2491
ucuucauguucgugca

SEQ ID NO: 3360969 - RNA, 17 nt, Neisseria meningitidis Z2491
ucuucauguucgugcau

SEQ ID NO: 3360970 - RNA, 20 nt, Neisseria meningitidis Z2491
ucuuccgucaaaaaugccug

SEQ ID NO: 3360971 - RNA, 14 nt, Neisseria meningitidis Z2491
ucuuccugcggcau

SEQ ID NO: 3360972 - RNA, 15 nt, Neisseria meningitidis Z2491
ucuuccuucugaaau

SEQ ID NO: 3360973 - RNA, 22 nt, Neisseria meningitidis Z2491
ucuucgaggaacaaaaugccgc

SEQ ID NO: 3360974 - RNA, 14 nt, Neisseria meningitidis Z2491
ucuucgagggcaua

SEQ ID NO: 3360975 - RNA, 17 nt, Neisseria meningitidis Z2491
ucuucgcaguuggaaca

SEQ ID NO: 3360976 - RNA, 16 nt, Neisseria meningitidis Z2491
ucuucgcguacuuuau

SEQ ID NO: 3360977 - RNA, 16 nt, Neisseria meningitidis Z2491
ucuucggcaaugcccg

SEQ ID NO: 3360978 - RNA, 21 nt, Neisseria meningitidis Z2491
ucuucgggaacggauuguuug

SEQ ID NO: 3360979 - RNA, 14 nt, Neisseria meningitidis Z2491
ucuucuuacccaau

SEQ ID NO: 3360980 - RNA, 19 nt, Neisseria meningitidis Z2491
ucuucuuacccaaugacug

SEQ ID NO: 3360981 - RNA, 22 nt, Neisseria meningitidis Z2491
ucuugagauuuuacguucuaga

SEQ ID NO: 3360982 - RNA, 21 nt, Neisseria meningitidis Z2491
ucuugaggcauugaaauucca

SEQ ID NO: 3360983 - RNA, 18 nt, Neisseria meningitidis Z2491
ucuugaguugauaauaug

SEQ ID NO: 3360984 - RNA, 15 nt, Neisseria meningitidis Z2491
ucuugaguuucaguc

SEQ ID NO: 3360985 - RNA, 18 nt, Neisseria meningitidis Z2491
ucuugaguuucuguauuu

SEQ ID NO: 3360986 - RNA, 13 nt, Neisseria meningitidis Z2491
ucuugauuuuucu

SEQ ID NO: 3360987 - RNA, 18 nt, Neisseria meningitidis Z2491
ucuugauuuuucugaauu

SEQ ID NO: 3360988 - RNA, 16 nt, Neisseria meningitidis Z2491
ucuugcuguuggaaaa

SEQ ID NO: 3360989 - RNA, 17 nt, Neisseria meningitidis Z2491
ucuugcuguuggaaaaa

SEQ ID NO: 3360990 - RNA, 15 nt, Neisseria meningitidis Z2491
ucuugggaaaugccg

SEQ ID NO: 3360991 - RNA, 16 nt, Neisseria meningitidis Z2491
ucuugggaaaugccgu

SEQ ID NO: 3360992 - RNA, 22 nt, Neisseria meningitidis Z2491
ucuuuaaacuucgguuuuuucc

SEQ ID NO: 3360993 - RNA, 13 nt, Neisseria meningitidis Z2491
ucuuuaaauucaa

SEQ ID NO: 3360994 - RNA, 14 nt, Neisseria meningitidis Z2491
ucuuuaaauuuaaa

SEQ ID NO: 3360995 - RNA, 13 nt, Neisseria meningitidis Z2491
ucuuuagauuuua

SEQ ID NO: 3360996 - RNA, 13 nt, Neisseria meningitidis Z2491
ucuuucacauccu

SEQ ID NO: 3360997 - RNA, 16 nt, Neisseria meningitidis Z2491
ucuuugacaaaaucca

SEQ ID NO: 3360998 - RNA, 15 nt, Neisseria meningitidis Z2491
ucuuugagcuaaggc

SEQ ID NO: 3360999 - RNA, 23 nt, Neisseria meningitidis Z2491
ucuuugagcuaaggcgaggcaac

SEQ ID NO: 3361000 - RNA, 22 nt, Neisseria meningitidis Z2491
ucuuugccguagaauguuucca

SEQ ID NO: 3361001 - RNA, 15 nt, Neisseria meningitidis Z2491
ucuuugcuggaagca

SEQ ID NO: 3361002 - RNA, 17 nt, Neisseria meningitidis Z2491
ucuuuuaauuucaauac

SEQ ID NO: 3361003 - RNA, 14 nt, Neisseria meningitidis Z2491
ucuuuuauuuucaa

SEQ ID NO: 3361004 - RNA, 13 nt, Neisseria meningitidis Z2491
ucuuuucuaaaau

SEQ ID NO: 3361005 - RNA, 14 nt, Neisseria meningitidis Z2491
ucuuuucuaaaaua

SEQ ID NO: 3361006 - RNA, 14 nt, Neisseria meningitidis Z2491
ucuuuuuugccguc

SEQ ID NO: 3361007 - RNA, 15 nt, Neisseria meningitidis Z2491
ugaaaaaaugccguc

SEQ ID NO: 3361008 - RNA, 18 nt, Neisseria meningitidis Z2491
ugaaaaaaugccgucuga

SEQ ID NO: 3361009 - RNA, 19 nt, Neisseria meningitidis Z2491
ugaaaaaugccgucuggaa

SEQ ID NO: 3361010 - RNA, 20 nt, Neisseria meningitidis Z2491
ugaaaacagaaaccuaaaau

SEQ ID NO: 3361011 - RNA, 21 nt, Neisseria meningitidis Z2491
ugaaaacagaaaccuaaaauu

SEQ ID NO: 3361012 - RNA, 13 nt, Neisseria meningitidis Z2491
ugaaaaccuuuca

SEQ ID NO: 3361013 - RNA, 11 nt, Neisseria meningitidis Z2491
ugaaaacggga

SEQ ID NO: 3361014 - RNA, 20 nt, Neisseria meningitidis Z2491
ugaaaacgggaaucuagagc

SEQ ID NO: 3361015 - RNA, 19 nt, Neisseria meningitidis Z2491
ugaaaacggguucggacgg

SEQ ID NO: 3361016 - RNA, 23 nt, Neisseria meningitidis Z2491
ugaaaagcaagacguagcguggg

SEQ ID NO: 3361017 - RNA, 16 nt, Neisseria meningitidis Z2491
ugaaaauaacgggauu

SEQ ID NO: 3361018 - RNA, 13 nt, Neisseria meningitidis Z2491
ugaaaaugccguc

SEQ ID NO: 3361019 - RNA, 16 nt, Neisseria meningitidis Z2491
ugaaaaugccgucuga

SEQ ID NO: 3361020 - RNA, 17 nt, Neisseria meningitidis Z2491
ugaaacaucauuggcaa

SEQ ID NO: 3361021 - RNA, 20 nt, Neisseria meningitidis Z2491
ugaaaccauuacaaaugcuc

SEQ ID NO: 3361022 - RNA, 15 nt, Neisseria meningitidis Z2491
ugaaaccccauccuu

SEQ ID NO: 3361023 - RNA, 15 nt, Neisseria meningitidis Z2491
ugacgaaaauuuauc

SEQ ID NO: 3361024 - RNA, 16 nt, Neisseria meningitidis Z2491
ugacgaaaauuuaucc

SEQ ID NO: 3361025 - RNA, 13 nt, Neisseria meningitidis Z2491
ugacgaaaccaga

SEQ ID NO: 3361026 - RNA, 23 nt, Neisseria meningitidis Z2491
ugacgaaauuuuagauugcaggc

SEQ ID NO: 3361027 - RNA, 14 nt, Neisseria meningitidis Z2491
ugacgaauuucagg

SEQ ID NO: 3361028 - RNA, 20 nt, Neisseria meningitidis Z2491
ugacgcuccagcuccggcca

SEQ ID NO: 3361029 - RNA, 18 nt, Neisseria meningitidis Z2491
ugacgggauauagguuuc

SEQ ID NO: 3361030 - RNA, 22 nt, Neisseria meningitidis Z2491
ugacgguaaacguagcaacugc

SEQ ID NO: 3361031 - RNA, 15 nt, Neisseria meningitidis Z2491
ugacggucaggaaga

SEQ ID NO: 3361032 - RNA, 17 nt, Neisseria meningitidis Z2491
ugacuaaccgaaaauaa

SEQ ID NO: 3361033 - RNA, 14 nt, Neisseria meningitidis Z2491
ugacugaaacucaa

SEQ ID NO: 3361034 - RNA, 20 nt, Neisseria meningitidis Z2491
ugacugaaacucaaaaaacu

SEQ ID NO: 3361035 - RNA, 22 nt, Neisseria meningitidis Z2491
ugacuugaaggcguguuugccg

SEQ ID NO: 3361036 - RNA, 22 nt, Neisseria meningitidis Z2491
ugagaaaaagucgucuaagccg

SEQ ID NO: 3361037 - RNA, 15 nt, Neisseria meningitidis Z2491
ugagauugcggcauu

SEQ ID NO: 3361038 - RNA, 16 nt, Neisseria meningitidis Z2491
ugagauugcggcauuu

SEQ ID NO: 3361039 - RNA, 14 nt, Neisseria meningitidis Z2491
ugagcaaaugccgu

SEQ ID NO: 3361040 - RNA, 15 nt, Neisseria meningitidis Z2491
ugagcaaaugccuua

SEQ ID NO: 3361041 - RNA, 12 nt, Neisseria meningitidis Z2491
ugagcauaaaau

SEQ ID NO: 3361042 - RNA, 12 nt, Neisseria meningitidis Z2491
ugagcauagacg

SEQ ID NO: 3361043 - RNA, 16 nt, Neisseria meningitidis Z2491
ugagccgucauucccg

SEQ ID NO: 3361044 - RNA, 19 nt, Neisseria meningitidis Z2491
ugagcuaaggcgagccaac

SEQ ID NO: 3361045 - RNA, 18 nt, Neisseria meningitidis Z2491
ugagcuucgcgacgguau

SEQ ID NO: 3361046 - RNA, 20 nt, Neisseria meningitidis Z2491
ugagcuucgcgacgguauug

SEQ ID NO: 3361047 - RNA, 20 nt, Neisseria meningitidis Z2491
ugaggaucuugauguguuug

SEQ ID NO: 3361048 - RNA, 14 nt, Neisseria meningitidis Z2491
ugaggaugacggua

SEQ ID NO: 3361049 - RNA, 16 nt, Neisseria meningitidis Z2491
ugaggcaauagaagcc

SEQ ID NO: 3361050 - RNA, 19 nt, Neisseria meningitidis Z2491
ugaggcauugaaauuccag

SEQ ID NO: 3361051 - RNA, 17 nt, Neisseria meningitidis Z2491
ugaggcugccgucauug

SEQ ID NO: 3361052 - RNA, 13 nt, Neisseria meningitidis Z2491
ugaggucgcgagu

SEQ ID NO: 3361053 - RNA, 20 nt, Neisseria meningitidis Z2491
ugaggucgcgaguucgagac

SEQ ID NO: 3361054 - RNA, 15 nt, Neisseria meningitidis Z2491
ugaggucuuugauga

SEQ ID NO: 3361055 - RNA, 14 nt, Neisseria meningitidis Z2491
ugagguuagcggau

SEQ ID NO: 3361056 - RNA, 19 nt, Neisseria meningitidis Z2491
ugagguucuagauucccgu

SEQ ID NO: 3361057 - RNA, 15 nt, Neisseria meningitidis Z2491
ugaguccgaggcugu

SEQ ID NO: 3361058 - RNA, 19 nt, Neisseria meningitidis Z2491
ugaguuucuagauucccgc

SEQ ID NO: 3361059 - RNA, 23 nt, Neisseria meningitidis Z2491
ugauaaaagcacaaauuaaaaua

SEQ ID NO: 3361060 - RNA, 16 nt, Neisseria meningitidis Z2491
ugauaagcaagcaaua

SEQ ID NO: 3361061 - RNA, 20 nt, Neisseria meningitidis Z2491
ugauaaugcccacaaucuga

SEQ ID NO: 3361062 - RNA, 15 nt, Neisseria meningitidis Z2491
ugauacagccacgcc

SEQ ID NO: 3361063 - RNA, 20 nt, Neisseria meningitidis Z2491
ugauacagccacgccaaaaa

SEQ ID NO: 3361064 - RNA, 17 nt, Neisseria meningitidis Z2491
ugauacgggcggcucuc

SEQ ID NO: 3361065 - RNA, 23 nt, Neisseria meningitidis Z2491
ugauacgggcggcucucaaaaua

SEQ ID NO: 3361066 - RNA, 21 nt, Neisseria meningitidis Z2491
ugauagccgcccaaugccguc

SEQ ID NO: 3361067 - RNA, 23 nt, Neisseria meningitidis Z2491
ugauaucggaggaguuugaugcc

SEQ ID NO: 3361068 - RNA, 15 nt, Neisseria meningitidis Z2491
ugauauuuuuaucuu

SEQ ID NO: 3361069 - RNA, 20 nt, Neisseria meningitidis Z2491
ugaucaggcggauuucuccg

SEQ ID NO: 3361070 - RNA, 13 nt, Neisseria meningitidis Z2491
ugaucauuucagg

SEQ ID NO: 3361071 - RNA, 14 nt, Neisseria meningitidis Z2491
ugaucauuucagga

SEQ ID NO: 3361072 - RNA, 19 nt, Neisseria meningitidis Z2491
ugauccaaaccguggaaca

SEQ ID NO: 3361073 - RNA, 21 nt, Neisseria meningitidis Z2491
ugauccaaaccguggaacacg

SEQ ID NO: 3361074 - RNA, 19 nt, Neisseria meningitidis Z2491
ugaucggagugauuaucac

SEQ ID NO: 3361075 - RNA, 20 nt, Neisseria meningitidis Z2491
ugaucuaaaaauucuaacuc

SEQ ID NO: 3361076 - RNA, 19 nt, Neisseria meningitidis Z2491
ugaugauguccgacugggc

SEQ ID NO: 3361077 - RNA, 15 nt, Neisseria meningitidis Z2491
ugaugcggacggcgu

SEQ ID NO: 3361078 - RNA, 21 nt, Neisseria meningitidis Z2491
ugauggcaacgaugauuacca

SEQ ID NO: 3361079 - RNA, 20 nt, Neisseria meningitidis Z2491
ugauggcugaugacggcagc

SEQ ID NO: 3361080 - RNA, 18 nt, Neisseria meningitidis Z2491
ugauggcuucuaaaaauu

SEQ ID NO: 3361081 - RNA, 18 nt, Neisseria meningitidis Z2491
ugauguccagugcggcau

SEQ ID NO: 3361082 - RNA, 16 nt, Neisseria meningitidis Z2491
ugauuaaaacaaaaau

SEQ ID NO: 3361083 - RNA, 19 nt, Neisseria meningitidis Z2491
ugauuaaaacaaaaaugag

SEQ ID NO: 3361084 - RNA, 18 nt, Neisseria meningitidis Z2491
ugauuaucauaaaaucua

SEQ ID NO: 3361085 - RNA, 21 nt, Neisseria meningitidis Z2491
ugauugacuauuuuuuaauca

SEQ ID NO: 3361086 - RNA, 14 nt, Neisseria meningitidis Z2491
ugauuuaaauuuaa

SEQ ID NO: 3361087 - RNA, 18 nt, Neisseria meningitidis Z2491
ugauuuaaauuuaaucca

SEQ ID NO: 3361088 - RNA, 21 nt, Neisseria meningitidis Z2491
ugauuuaaauuuaauccacua

SEQ ID NO: 3361089 - RNA, 23 nt, Neisseria meningitidis Z2491
ugauuuugagaaaucugugaaaa

SEQ ID NO: 3361090 - RNA, 14 nt, Neisseria meningitidis Z2491
ugauuuuucuuuua

SEQ ID NO: 3361091 - RNA, 22 nt, Neisseria meningitidis Z2491
ugauuuuucuuuuauuuucaaa

SEQ ID NO: 3361092 - RNA, 17 nt, Neisseria meningitidis Z2491
ugauuuuuguuaaucac

SEQ ID NO: 3361093 - RNA, 21 nt, Neisseria meningitidis Z2491
ugauuuuuguuaauucacuau

SEQ ID NO: 3361094 - RNA, 18 nt, Neisseria meningitidis Z2491
ugcaaaaaguccuucacg

SEQ ID NO: 3361095 - RNA, 21 nt, Neisseria meningitidis Z2491
ugcaaaaaguccuucacgcca

SEQ ID NO: 3361096 - RNA, 12 nt, Neisseria meningitidis Z2491
ugcaaaaauuua

SEQ ID NO: 3361097 - RNA, 13 nt, Neisseria meningitidis Z2491
ugcaaaaauuuau

SEQ ID NO: 3361098 - RNA, 22 nt, Neisseria meningitidis Z2491
ugcaaaacuuuucugauuuuuc

SEQ ID NO: 3361099 - RNA, 15 nt, Neisseria meningitidis Z2491
ugcaaaauagaaaac

SEQ ID NO: 3361100 - RNA, 16 nt, Neisseria meningitidis Z2491
ugcaaaauuuauccga

SEQ ID NO: 3361101 - RNA, 14 nt, Neisseria meningitidis Z2491
ugcaaaccgucugc

SEQ ID NO: 3361102 - RNA, 13 nt, Neisseria meningitidis Z2491
ugcaaagaaaaac

SEQ ID NO: 3361103 - RNA, 15 nt, Neisseria meningitidis Z2491
ugcaaagaaaaacau

SEQ ID NO: 3361104 - RNA, 17 nt, Neisseria meningitidis Z2491
ugcaaagaaauguaaau

SEQ ID NO: 3361105 - RNA, 15 nt, Neisseria meningitidis Z2491
ugcaaagcggcuggg

SEQ ID NO: 3361106 - RNA, 14 nt, Neisseria meningitidis Z2491
ugcaacuuugcguu

SEQ ID NO: 3361107 - RNA, 21 nt, Neisseria meningitidis Z2491
ugcaacuuugcguuucuagau

SEQ ID NO: 3361108 - RNA, 16 nt, Neisseria meningitidis Z2491
ugcaagaacagcagca

SEQ ID NO: 3361109 - RNA, 19 nt, Neisseria meningitidis Z2491
ugcaagaaugacggaguuu

SEQ ID NO: 3361110 - RNA, 19 nt, Neisseria meningitidis Z2491
ugcaagaauggcaaaauuu

SEQ ID NO: 3361111 - RNA, 16 nt, Neisseria meningitidis Z2491
ugcaagaauuuaucgg

SEQ ID NO: 3361112 - RNA, 14 nt, Neisseria meningitidis Z2491
ugcaagcagcaggc

SEQ ID NO: 3361113 - RNA, 16 nt, Neisseria meningitidis Z2491
ugcaagcagcaggcgu

SEQ ID NO: 3361114 - RNA, 13 nt, Neisseria meningitidis Z2491
ugcaaggcaggca

SEQ ID NO: 3361115 - RNA, 16 nt, Neisseria meningitidis Z2491
ugcaaggcggcggcgu

SEQ ID NO: 3361116 - RNA, 15 nt, Neisseria meningitidis Z2491
ugcaauaacauaggu

SEQ ID NO: 3361117 - RNA, 23 nt, Neisseria meningitidis Z2491
ugcaauaacauagguuacuaaaa

SEQ ID NO: 3361118 - RNA, 18 nt, Neisseria meningitidis Z2491
ugcaccacgucauuccca

SEQ ID NO: 3361119 - RNA, 19 nt, Neisseria meningitidis Z2491
ugcaccacgucauucccac

SEQ ID NO: 3361120 - RNA, 20 nt, Neisseria meningitidis Z2491
ugcaccacgucauucccacg

SEQ ID NO: 3361121 - RNA, 15 nt, Neisseria meningitidis Z2491
ugcaccgcgucauuc

SEQ ID NO: 3361122 - RNA, 17 nt, Neisseria meningitidis Z2491
ugcacuugcugaacaaa

SEQ ID NO: 3361123 - RNA, 22 nt, Neisseria meningitidis Z2491
ugcagaaagcuuccaacucggc

SEQ ID NO: 3361124 - RNA, 20 nt, Neisseria meningitidis Z2491
ugccuguuuuucuucaucca

SEQ ID NO: 3361125 - RNA, 15 nt, Neisseria meningitidis Z2491
ugccuuauccagaaa

SEQ ID NO: 3361126 - RNA, 13 nt, Neisseria meningitidis Z2491
ugccuuauguaua

SEQ ID NO: 3361127 - RNA, 14 nt, Neisseria meningitidis Z2491
ugccuucauucuug

SEQ ID NO: 3361128 - RNA, 15 nt, Neisseria meningitidis Z2491
ugccuucuucuuugc

SEQ ID NO: 3361129 - RNA, 12 nt, Neisseria meningitidis Z2491
ugccuuucucug

SEQ ID NO: 3361130 - RNA, 19 nt, Neisseria meningitidis Z2491
ugcgaaagggcaguuggga

SEQ ID NO: 3361131 - RNA, 17 nt, Neisseria meningitidis Z2491
ugcgaaaugccgucuga

SEQ ID NO: 3361132 - RNA, 22 nt, Neisseria meningitidis Z2491
ugcgaaaugccgucugaagccu

SEQ ID NO: 3361133 - RNA, 14 nt, Neisseria meningitidis Z2491
ugcgaacugccugc

SEQ ID NO: 3361134 - RNA, 17 nt, Neisseria meningitidis Z2491
ugcgaacugccugcaac

SEQ ID NO: 3361135 - RNA, 15 nt, Neisseria meningitidis Z2491
ugcgaagacuuuaau

SEQ ID NO: 3361136 - RNA, 15 nt, Neisseria meningitidis Z2491
ugcgaaucugcugca

SEQ ID NO: 3361137 - RNA, 12 nt, Neisseria meningitidis Z2491
ugcgcagccugc

SEQ ID NO: 3361138 - RNA, 14 nt, Neisseria meningitidis Z2491
ugcgccacggcaua

SEQ ID NO: 3361139 - RNA, 20 nt, Neisseria meningitidis Z2491
ugcgccauuauacuggcaaa

SEQ ID NO: 3361140 - RNA, 15 nt, Neisseria meningitidis Z2491
ugcgcccaaagcggu

SEQ ID NO: 3361141 - RNA, 20 nt, Neisseria meningitidis Z2491
ugcgccgauuuuccggcguu

SEQ ID NO: 3361142 - RNA, 13 nt, Neisseria meningitidis Z2491
ugcgccggcauaa

SEQ ID NO: 3361143 - RNA, 15 nt, Neisseria meningitidis Z2491
ugcgccggcauaacc

SEQ ID NO: 3361144 - RNA, 19 nt, Neisseria meningitidis Z2491
ugcgcgaacagcgacaccc

SEQ ID NO: 3361145 - RNA, 13 nt, Neisseria meningitidis Z2491
ugcgcgcuuuuag

SEQ ID NO: 3361146 - RNA, 18 nt, Neisseria meningitidis Z2491
ugcgcgggaaugacggau

SEQ ID NO: 3361147 - RNA, 17 nt, Neisseria meningitidis Z2491
ugcggaaacguaucgga

SEQ ID NO: 3361148 - RNA, 14 nt, Neisseria meningitidis Z2491
ugcggaagaagugc

SEQ ID NO: 3361149 - RNA, 18 nt, Neisseria meningitidis Z2491
ugcggacaaaucuggauu

SEQ ID NO: 3361150 - RNA, 18 nt, Neisseria meningitidis Z2491
ugcggaugaauuuaaaca

SEQ ID NO: 3361151 - RNA, 16 nt, Neisseria meningitidis Z2491
ugcggcaaaaccggau

SEQ ID NO: 3361152 - RNA, 18 nt, Neisseria meningitidis Z2491
ugcggcaaaacgccuucu

SEQ ID NO: 3361153 - RNA, 13 nt, Neisseria meningitidis Z2491
ugcggcaaauuua

SEQ ID NO: 3361154 - RNA, 19 nt, Neisseria meningitidis Z2491
ugcggcacuagccaaaaaa

SEQ ID NO: 3361155 - RNA, 22 nt, Neisseria meningitidis Z2491
ugcggcacuagccaaaaaaacc

SEQ ID NO: 3361156 - RNA, 14 nt, Neisseria meningitidis Z2491
ugcggcgggcuugg

SEQ ID NO: 3361157 - RNA, 14 nt, Neisseria meningitidis Z2491
ugcggcuguggaac

SEQ ID NO: 3361158 - RNA, 17 nt, Neisseria meningitidis Z2491
ugcgggauuacugccgc

SEQ ID NO: 3361159 - RNA, 17 nt, Neisseria meningitidis Z2491
ugcgguucggacggcau

SEQ ID NO: 3361160 - RNA, 15 nt, Neisseria meningitidis Z2491
ugcguauaaaccgau

SEQ ID NO: 3361161 - RNA, 15 nt, Neisseria meningitidis Z2491
ugcgucaaaccagcu

SEQ ID NO: 3361162 - RNA, 14 nt, Neisseria meningitidis Z2491
ugcgucugccuucu

SEQ ID NO: 3361163 - RNA, 18 nt, Neisseria meningitidis Z2491
ugcgucugccuucuucuu

SEQ ID NO: 3361164 - RNA, 15 nt, Neisseria meningitidis Z2491
ugcguucaaaugccg

SEQ ID NO: 3361165 - RNA, 23 nt, Neisseria meningitidis Z2491
ugcguucagacggcaucaaaaac

SEQ ID NO: 3361166 - RNA, 15 nt, Neisseria meningitidis Z2491
ugcguugaguuucag

SEQ ID NO: 3361167 - RNA, 22 nt, Neisseria meningitidis Z2491
ugcguuucguguuauaauccgc

SEQ ID NO: 3361168 - RNA, 18 nt, Neisseria meningitidis Z2491
ugcguuuugacaaaauca

SEQ ID NO: 3361169 - RNA, 20 nt, Neisseria meningitidis Z2491
ugcuaaauaucuagcaaaaa

SEQ ID NO: 3361170 - RNA, 12 nt, Neisseria meningitidis Z2491
ugcuaaggcaau

SEQ ID NO: 3361171 - RNA, 15 nt, Neisseria meningitidis Z2491
ugcuagauauuuagc

SEQ ID NO: 3361172 - RNA, 14 nt, Neisseria meningitidis Z2491
ugcucagcccgaaa

SEQ ID NO: 3361173 - RNA, 20 nt, Neisseria meningitidis Z2491
ugcucauucacguaauucuc

SEQ ID NO: 3361174 - RNA, 23 nt, Neisseria meningitidis Z2491
ugcuccaaucuaccguuuccucc

SEQ ID NO: 3361175 - RNA, 21 nt, Neisseria meningitidis Z2491
ugcucgaagcguggcaguaca

SEQ ID NO: 3361176 - RNA, 20 nt, Neisseria meningitidis Z2491
ugcucgagcggcaggucuuc

SEQ ID NO: 3361177 - RNA, 19 nt, Neisseria meningitidis Z2491
ugcucuaccaacugagcua

SEQ ID NO: 3361178 - RNA, 17 nt, Neisseria meningitidis Z2491
ugcucugauagccgccc

SEQ ID NO: 3361179 - RNA, 13 nt, Neisseria meningitidis Z2491
ugcugaagcacca

SEQ ID NO: 3361180 - RNA, 17 nt, Neisseria meningitidis Z2491
ugcugaagcaccaagug

SEQ ID NO: 3361181 - RNA, 20 nt, Neisseria meningitidis Z2491
ugcugaagcaccaagugaau

SEQ ID NO: 3361182 - RNA, 13 nt, Neisseria meningitidis Z2491
ugcugaagcaccg

SEQ ID NO: 3361183 - RNA, 18 nt, Neisseria meningitidis Z2491
ugcugaagucgugaauua

SEQ ID NO: 3361184 - RNA, 18 nt, Neisseria meningitidis Z2491
ugcugccgugaugcccca

SEQ ID NO: 3361185 - RNA, 18 nt, Neisseria meningitidis Z2491
ugcugcuguauuuuucca

SEQ ID NO: 3361186 - RNA, 14 nt, Neisseria meningitidis Z2491
ugcugcuuuucauu

SEQ ID NO: 3361187 - RNA, 15 nt, Neisseria meningitidis Z2491
ugcuggaagcauuga

SEQ ID NO: 3361188 - RNA, 21 nt, Neisseria meningitidis Z2491
ugcuggaagcauugaccacuu

SEQ ID NO: 3361189 - RNA, 11 nt, Neisseria meningitidis Z2491
ugcugguuuuu

SEQ ID NO: 3361190 - RNA, 13 nt, Neisseria meningitidis Z2491
ugcugucugaaac

SEQ ID NO: 3361191 - RNA, 15 nt, Neisseria meningitidis Z2491
ugcugucugaaaccu

SEQ ID NO: 3361192 - RNA, 16 nt, Neisseria meningitidis Z2491
ugcuguugaaaaugcc

SEQ ID NO: 3361193 - RNA, 22 nt, Neisseria meningitidis Z2491
ugcuguuguucuaaggucuaga

SEQ ID NO: 3361194 - RNA, 19 nt, Neisseria meningitidis Z2491
ugcuguuucagacggcauu

SEQ ID NO: 3361195 - RNA, 20 nt, Neisseria meningitidis Z2491
ugcuguuucagacggcauuu

SEQ ID NO: 3361196 - RNA, 15 nt, Neisseria meningitidis Z2491
ugcuuacaauccgcu

SEQ ID NO: 3361197 - RNA, 17 nt, Neisseria meningitidis Z2491
ugcuuauugcacuaaaa

SEQ ID NO: 3361198 - RNA, 12 nt, Neisseria meningitidis Z2491
ugcuucaaccac

SEQ ID NO: 3361199 - RNA, 14 nt, Neisseria meningitidis Z2491
ugcuugcgcggcau

SEQ ID NO: 3361200 - RNA, 17 nt, Neisseria meningitidis Z2491
ugcuugcguaauuccgg

SEQ ID NO: 3361201 - RNA, 16 nt, Neisseria meningitidis Z2491
ugcuuucuccgggccc

SEQ ID NO: 3361202 - RNA, 18 nt, Neisseria meningitidis Z2491
ugcuuugagcuuguccag

SEQ ID NO: 3361203 - RNA, 20 nt, Neisseria meningitidis Z2491
ugcuuuggcagcacaggcaa

SEQ ID NO: 3361204 - RNA, 20 nt, Neisseria meningitidis Z2491
ugcuuuggcagcccauucug

SEQ ID NO: 3361205 - RNA, 20 nt, Neisseria meningitidis Z2491
uggaaaccaaaaaacaacag

SEQ ID NO: 3361206 - RNA, 19 nt, Neisseria meningitidis Z2491
uggaaagcguguuccgcau

SEQ ID NO: 3361207 - RNA, 12 nt, Neisseria meningitidis Z2491
uggaaaugccgu

SEQ ID NO: 3361208 - RNA, 16 nt, Neisseria meningitidis Z2491
uggaaaugccgucuga

SEQ ID NO: 3361209 - RNA, 20 nt, Neisseria meningitidis Z2491
uggaaauuaucggucagcuc

SEQ ID NO: 3361210 - RNA, 12 nt, Neisseria meningitidis Z2491
uggaacaaaaaa

SEQ ID NO: 3361211 - RNA, 13 nt, Neisseria meningitidis Z2491
uggaacaaagaaa

SEQ ID NO: 3361212 - RNA, 19 nt, Neisseria meningitidis Z2491
uggaaggcgggcaggcagu

SEQ ID NO: 3361213 - RNA, 23 nt, Neisseria meningitidis Z2491
uggacaacagcggguaggcggga

SEQ ID NO: 3361214 - RNA, 20 nt, Neisseria meningitidis Z2491
uggacagaaacgaaaaugcc

SEQ ID NO: 3361215 - RNA, 23 nt, Neisseria meningitidis Z2491
uggacauucucuuggucaaaaug

SEQ ID NO: 3361216 - RNA, 20 nt, Neisseria meningitidis Z2491
uggacgacgcggcugcugcc

SEQ ID NO: 3361217 - RNA, 21 nt, Neisseria meningitidis Z2491
uggacgacgcggcugcugccu

SEQ ID NO: 3361218 - RNA, 12 nt, Neisseria meningitidis Z2491
uggagaaaauau

SEQ ID NO: 3361219 - RNA, 20 nt, Neisseria meningitidis Z2491
uggagaaaauauagccgacc

SEQ ID NO: 3361220 - RNA, 22 nt, Neisseria meningitidis Z2491
uggagaaugaaaucgggcggga

SEQ ID NO: 3361221 - RNA, 12 nt, Neisseria meningitidis Z2491
uggagcaggcac

SEQ ID NO: 3361222 - RNA, 15 nt, Neisseria meningitidis Z2491
uggagcaguaaaauu

SEQ ID NO: 3361223 - RNA, 18 nt, Neisseria meningitidis Z2491
uggagcaguaaaauuuau

SEQ ID NO: 3361224 - RNA, 17 nt, Neisseria meningitidis Z2491
uggagucgccuucgcaa

SEQ ID NO: 3361225 - RNA, 17 nt, Neisseria meningitidis Z2491
uggauaccgucugaaca

SEQ ID NO: 3361226 - RNA, 16 nt, Neisseria meningitidis Z2491
uguauuugcgccgccc

SEQ ID NO: 3361227 - RNA, 14 nt, Neisseria meningitidis Z2491
uguauuuuaauaau

SEQ ID NO: 3361228 - RNA, 12 nt, Neisseria meningitidis Z2491
uguauuuuggua

SEQ ID NO: 3361229 - RNA, 13 nt, Neisseria meningitidis Z2491
ugucaaccaaaaa

SEQ ID NO: 3361230 - RNA, 15 nt, Neisseria meningitidis Z2491
ugucaaccaaaaaau

SEQ ID NO: 3361231 - RNA, 13 nt, Neisseria meningitidis Z2491
ugucaagaaacac

SEQ ID NO: 3361232 - RNA, 14 nt, Neisseria meningitidis Z2491
uguccaaagccucg

SEQ ID NO: 3361233 - RNA, 23 nt, Neisseria meningitidis Z2491
uguccagugcggcaucggaaaca

SEQ ID NO: 3361234 - RNA, 13 nt, Neisseria meningitidis Z2491
uguccgaaugccg

SEQ ID NO: 3361235 - RNA, 14 nt, Neisseria meningitidis Z2491
uguccgaaugccgc

SEQ ID NO: 3361236 - RNA, 22 nt, Neisseria meningitidis Z2491
uguccgaaugccgcaaaugccg

SEQ ID NO: 3361237 - RNA, 22 nt, Neisseria meningitidis Z2491
uguccguuugcggguuuauucc

SEQ ID NO: 3361238 - RNA, 18 nt, Neisseria meningitidis Z2491
uguccugaccuuugcaga

SEQ ID NO: 3361239 - RNA, 14 nt, Neisseria meningitidis Z2491
uguccugauuuaaa

SEQ ID NO: 3361240 - RNA, 21 nt, Neisseria meningitidis Z2491
ugucggaacagcaucaaacca

SEQ ID NO: 3361241 - RNA, 18 nt, Neisseria meningitidis Z2491
ugucggaauaagguuuga

SEQ ID NO: 3361242 - RNA, 19 nt, Neisseria meningitidis Z2491
ugucggcuuuugacagcag

SEQ ID NO: 3361243 - RNA, 15 nt, Neisseria meningitidis Z2491
ugucggggaauccgg

SEQ ID NO: 3361244 - RNA, 16 nt, Neisseria meningitidis Z2491
ugucggggaauccggu

SEQ ID NO: 3361245 - RNA, 21 nt, Neisseria meningitidis Z2491
ugucggguucggauauuuccg

SEQ ID NO: 3361246 - RNA, 17 nt, Neisseria meningitidis Z2491
ugucucggcagcggcau

SEQ ID NO: 3361247 - RNA, 13 nt, Neisseria meningitidis Z2491
ugucuguuucuuu

SEQ ID NO: 3361248 - RNA, 16 nt, Neisseria meningitidis Z2491
ugucuucaaaaaacaa

SEQ ID NO: 3361249 - RNA, 14 nt, Neisseria meningitidis Z2491
ugucuucaauuccu

SEQ ID NO: 3361250 - RNA, 17 nt, Neisseria meningitidis Z2491
ugucuucaauuccugcg

SEQ ID NO: 3361251 - RNA, 20 nt, Neisseria meningitidis Z2491
ugucuucauacgacucaaaa

SEQ ID NO: 3361252 - RNA, 13 nt, Neisseria meningitidis Z2491
ugucuuuucccuu

SEQ ID NO: 3361253 - RNA, 23 nt, Neisseria meningitidis Z2491
ugugaaaauaacgggauuucagc

SEQ ID NO: 3361254 - RNA, 18 nt, Neisseria meningitidis Z2491
ugugaaauaaaaaaugcc

SEQ ID NO: 3361255 - RNA, 19 nt, Neisseria meningitidis Z2491
ugugaaauaaaaaaugccg

SEQ ID NO: 3361256 - RNA, 20 nt, Neisseria meningitidis Z2491
ugugaaauaaaaaaugccgu

SEQ ID NO: 3361257 - RNA, 14 nt, Neisseria meningitidis Z2491
ugugaauccacuau

SEQ ID NO: 3361258 - RNA, 14 nt, Neisseria meningitidis Z2491
ugugcaaagaaaaa

SEQ ID NO: 3361259 - RNA, 19 nt, Neisseria meningitidis Z2491
ugugcauccgacaggcaaa

SEQ ID NO: 3361260 - RNA, 15 nt, Neisseria meningitidis Z2491
ugugcgccacgccau

SEQ ID NO: 3361261 - RNA, 20 nt, Neisseria meningitidis Z2491
ugugcggucgauguggcuga

SEQ ID NO: 3361262 - RNA, 16 nt, Neisseria meningitidis Z2491
ugugcgguucggcuug

SEQ ID NO: 3361263 - RNA, 22 nt, Neisseria meningitidis Z2491
ugugcuaugcaguugaguuuga

SEQ ID NO: 3361264 - RNA, 17 nt, Neisseria meningitidis Z2491
ugugcugucagaauuga

SEQ ID NO: 3361265 - RNA, 21 nt, Neisseria meningitidis Z2491
ugugcuguuucagacggcauu

SEQ ID NO: 3361266 - RNA, 16 nt, Neisseria meningitidis Z2491
uguggaaaaaguccag

SEQ ID NO: 3361267 - RNA, 17 nt, Neisseria meningitidis Z2491
uguggcgguuauugugc

SEQ ID NO: 3361268 - RNA, 23 nt, Neisseria meningitidis Z2491
uguggcuaacguacaaaugccgu

SEQ ID NO: 3361269 - RNA, 15 nt, Neisseria meningitidis Z2491
ugugggaaacuuuuc

SEQ ID NO: 3361270 - RNA, 17 nt, Neisseria meningitidis Z2491
ugugggaauccagaccu

SEQ ID NO: 3361271 - RNA, 14 nt, Neisseria meningitidis Z2491
ugugguagagaaaa

SEQ ID NO: 3361272 - RNA, 22 nt, Neisseria meningitidis Z2491
uguguggcgguuauugugcuuu

SEQ ID NO: 3361273 - RNA, 21 nt, Neisseria meningitidis Z2491
uguguuccgggccgaugccgg

SEQ ID NO: 3361274 - RNA, 14 nt, Neisseria meningitidis Z2491
uguguuugaauauu

SEQ ID NO: 3361275 - RNA, 18 nt, Neisseria meningitidis Z2491
uguuaauccacuauaaaa

SEQ ID NO: 3361276 - RNA, 22 nt, Neisseria meningitidis Z2491
uguuaauccacuauaaagaccg

SEQ ID NO: 3361277 - RNA, 22 nt, Neisseria meningitidis Z2491
uguuacgcggcguuuuuucugu

SEQ ID NO: 3361278 - RNA, 22 nt, Neisseria meningitidis Z2491
uguuaugaugcguucaaaucac

SEQ ID NO: 3361279 - RNA, 21 nt, Neisseria meningitidis Z2491
uguuauuuucacaaaaacaga

SEQ ID NO: 3361280 - RNA, 12 nt, Neisseria meningitidis Z2491
uguucaauagga

SEQ ID NO: 3361281 - RNA, 14 nt, Neisseria meningitidis Z2491
uguucagacggcau

SEQ ID NO: 3361282 - RNA, 20 nt, Neisseria meningitidis Z2491
uguucagacggcauuuucua

SEQ ID NO: 3361283 - RNA, 19 nt, Neisseria meningitidis Z2491
uguuccgauaccaagucgu

SEQ ID NO: 3361284 - RNA, 19 nt, Neisseria meningitidis Z2491
uguuccgggccgaugccgg

SEQ ID NO: 3361285 - RNA, 19 nt, Neisseria meningitidis Z2491
uguucgacggaaaucaauc

SEQ ID NO: 3361286 - RNA, 13 nt, Neisseria meningitidis Z2491
uguucggaaucac

SEQ ID NO: 3361287 - RNA, 17 nt, Neisseria meningitidis Z2491
uguucgugcaucaucac

SEQ ID NO: 3361288 - RNA, 12 nt, Neisseria meningitidis Z2491
uguucuuucaca

SEQ ID NO: 3361289 - RNA, 21 nt, Neisseria meningitidis Z2491
uguugaugccgucccugccgg

SEQ ID NO: 3361290 - RNA, 16 nt, Neisseria meningitidis Z2491
uguugccacaauauaa

SEQ ID NO: 3361291 - RNA, 14 nt, Neisseria meningitidis Z2491
uguugccacacaca

SEQ ID NO: 3361292 - RNA, 20 nt, Neisseria meningitidis Z2491
uguugcccuguguagcagcc

SEQ ID NO: 3361293 - RNA, 14 nt, Neisseria meningitidis Z2491
uguugccucgccuu

SEQ ID NO: 3361294 - RNA, 21 nt, Neisseria meningitidis Z2491
uguugcuccugauaaaugccg

SEQ ID NO: 3361295 - RNA, 17 nt, Neisseria meningitidis Z2491
uguuggccgcuuucaaa

SEQ ID NO: 3361296 - RNA, 18 nt, Neisseria meningitidis Z2491
uguuguauucauaaaaua

SEQ ID NO: 3361297 - RNA, 22 nt, Neisseria meningitidis Z2491
uguuuacggucagaaaauuucu

SEQ ID NO: 3361298 - RNA, 22 nt, Neisseria meningitidis Z2491
uguuuagacagcaucgccgccg

SEQ ID NO: 3361299 - RNA, 17 nt, Neisseria meningitidis Z2491
uguuucagacggcauuu

SEQ ID NO: 3361300 - RNA, 23 nt, Neisseria meningitidis Z2491
uguuucagacggcauuugacuuu

SEQ ID NO: 3361301 - RNA, 23 nt, Neisseria meningitidis Z2491
uguuuccacauugucggauuugu

SEQ ID NO: 3361302 - RNA, 21 nt, Neisseria meningitidis Z2491
uguuucggagaaguuucugca

SEQ ID NO: 3361303 - RNA, 15 nt, Neisseria meningitidis Z2491
uguuucggauaaauu

SEQ ID NO: 3361304 - RNA, 23 nt, Neisseria meningitidis Z2491
uguuucggcgcaucccgcaaaaa

SEQ ID NO: 3361305 - RNA, 14 nt, Neisseria meningitidis Z2491
uguuucuuuuugcu

SEQ ID NO: 3361306 - RNA, 16 nt, Neisseria meningitidis Z2491
uguuugagccugugcc

SEQ ID NO: 3361307 - RNA, 20 nt, Neisseria meningitidis Z2491
uguuugaguccgaccgccgc

SEQ ID NO: 3361308 - RNA, 17 nt, Neisseria meningitidis Z2491
uguuugcagauaaauuu

SEQ ID NO: 3361309 - RNA, 20 nt, Neisseria meningitidis Z2491
uguuugcagauaaauuuucc

SEQ ID NO: 3361310 - RNA, 19 nt, Neisseria meningitidis Z2491
uguuugccugauccaaacc

SEQ ID NO: 3361311 - RNA, 16 nt, Neisseria meningitidis Z2491
uguuuggaaaugucuu

SEQ ID NO: 3361312 - RNA, 15 nt, Neisseria meningitidis Z2491
uguuugguaaucagu

SEQ ID NO: 3361313 - RNA, 15 nt, Neisseria meningitidis Z2491
uguuuuaaaguccga

SEQ ID NO: 3361314 - RNA, 19 nt, Neisseria meningitidis Z2491
uguuuuauauucugauuua

SEQ ID NO: 3361315 - RNA, 13 nt, Neisseria meningitidis Z2491
uguuuucagcugu

SEQ ID NO: 3361316 - RNA, 21 nt, Neisseria meningitidis Z2491
uguuuucgcgcaauuccugca

SEQ ID NO: 3361317 - RNA, 12 nt, Neisseria meningitidis Z2491
uguuuugaaggu

SEQ ID NO: 3361318 - RNA, 14 nt, Neisseria meningitidis Z2491
uguuuugauauggc

SEQ ID NO: 3361319 - RNA, 15 nt, Neisseria meningitidis Z2491
uguuuuuccacaaaa

SEQ ID NO: 3361320 - RNA, 18 nt, Neisseria meningitidis Z2491
uguuuuuuccgauaaauu

SEQ ID NO: 3361321 - RNA, 12 nt, Neisseria meningitidis Z2491
uuaaaaacaaaa

SEQ ID NO: 3361322 - RNA, 13 nt, Neisseria meningitidis Z2491
uuaaaacaaaaau

SEQ ID NO: 3361323 - RNA, 13 nt, Neisseria meningitidis Z2491
uuaaaacagcauu

SEQ ID NO: 3361324 - RNA, 18 nt, Neisseria meningitidis Z2491
uuaaaagggaacggcauc

SEQ ID NO: 3361325 - RNA, 22 nt, Neisseria meningitidis Z2491
uuaaaauaaaaccgauaaacaa

SEQ ID NO: 3361326 - RNA, 20 nt, Neisseria meningitidis Z2491
uuaaaauuucaucauuccca

SEQ ID NO: 3361327 - RNA, 23 nt, Neisseria meningitidis Z2491
uuauguuucaaaccucauucaaa

SEQ ID NO: 3361328 - RNA, 18 nt, Neisseria meningitidis Z2491
uuauugaagauggcugaa

SEQ ID NO: 3361329 - RNA, 13 nt, Neisseria meningitidis Z2491
uuauuuccugaag

SEQ ID NO: 3361330 - RNA, 13 nt, Neisseria meningitidis Z2491
uuauuugaacgau

SEQ ID NO: 3361331 - RNA, 19 nt, Neisseria meningitidis Z2491
uuauuugagcaaaugccgu

SEQ ID NO: 3361332 - RNA, 12 nt, Neisseria meningitidis Z2491
uuauuuuccaua

SEQ ID NO: 3361333 - RNA, 18 nt, Neisseria meningitidis Z2491
uuauuuuccauaaaauac

SEQ ID NO: 3361334 - RNA, 20 nt, Neisseria meningitidis Z2491
uucaaaagccgugugaaaau

SEQ ID NO: 3361335 - RNA, 13 nt, Neisseria meningitidis Z2491
uucaaaauuuauu

SEQ ID NO: 3361336 - RNA, 19 nt, Neisseria meningitidis Z2491
uucaaaccccuucaaacca

SEQ ID NO: 3361337 - RNA, 16 nt, Neisseria meningitidis Z2491
uucaaaccucauucaa

SEQ ID NO: 3361338 - RNA, 21 nt, Neisseria meningitidis Z2491
uucaaacgggacugccuacac

SEQ ID NO: 3361339 - RNA, 22 nt, Neisseria meningitidis Z2491
uucaaacgggacugccuacaca

SEQ ID NO: 3361340 - RNA, 16 nt, Neisseria meningitidis Z2491
uucaaacuuuauccgu

SEQ ID NO: 3361341 - RNA, 16 nt, Neisseria meningitidis Z2491
uucaaagauuaucuga

SEQ ID NO: 3361342 - RNA, 21 nt, Neisseria meningitidis Z2491
uucaaauaaauuugaauagca

SEQ ID NO: 3361343 - RNA, 19 nt, Neisseria meningitidis Z2491
uucaaaucguuuugcgcca

SEQ ID NO: 3361344 - RNA, 21 nt, Neisseria meningitidis Z2491
uucaaaucuuccugcggcauu

SEQ ID NO: 3361345 - RNA, 17 nt, Neisseria meningitidis Z2491
uucaaauucggaagaca

SEQ ID NO: 3361346 - RNA, 19 nt, Neisseria meningitidis Z2491
uucaaauuuauuugaacga

SEQ ID NO: 3361347 - RNA, 13 nt, Neisseria meningitidis Z2491
uucaacagacggc

SEQ ID NO: 3361348 - RNA, 21 nt, Neisseria meningitidis Z2491
uucaacagcagcgaaggcgcg

SEQ ID NO: 3361349 - RNA, 17 nt, Neisseria meningitidis Z2491
uucaacagguucaaaca

SEQ ID NO: 3361350 - RNA, 19 nt, Neisseria meningitidis Z2491
uucaacgccgauuaauccg

SEQ ID NO: 3361351 - RNA, 17 nt, Neisseria meningitidis Z2491
uucaacggcacggcguu

SEQ ID NO: 3361352 - RNA, 21 nt, Neisseria meningitidis Z2491
uucaacuugguggucggcauu

SEQ ID NO: 3361353 - RNA, 13 nt, Neisseria meningitidis Z2491
uucaagcaaaucu

SEQ ID NO: 3361354 - RNA, 22 nt, Neisseria meningitidis Z2491
uucaaggcgcggcacacgcauu

SEQ ID NO: 3361355 - RNA, 16 nt, Neisseria meningitidis Z2491
uucaaggcgguuuuuu

SEQ ID NO: 3361356 - RNA, 19 nt, Neisseria meningitidis Z2491
uucaaguuccagacggcau

SEQ ID NO: 3361357 - RNA, 17 nt, Neisseria meningitidis Z2491
uucaauaccuugagcca

SEQ ID NO: 3361358 - RNA, 18 nt, Neisseria meningitidis Z2491
uucaauaccuugagccaa

SEQ ID NO: 3361359 - RNA, 13 nt, Neisseria meningitidis Z2491
uucaaucaaugug

SEQ ID NO: 3361360 - RNA, 23 nt, Neisseria meningitidis Z2491
uucaaucaaugugccucuuccca

SEQ ID NO: 3361361 - RNA, 16 nt, Neisseria meningitidis Z2491
uucaauccguugcucu

SEQ ID NO: 3361362 - RNA, 20 nt, Neisseria meningitidis Z2491
uucaauuuaaacacuucuuc

SEQ ID NO: 3361363 - RNA, 18 nt, Neisseria meningitidis Z2491
uucaauuucaacugauug

SEQ ID NO: 3361364 - RNA, 20 nt, Neisseria meningitidis Z2491
uucacaaaaacagaaaacca

SEQ ID NO: 3361365 - RNA, 17 nt, Neisseria meningitidis Z2491
uucaccgugauuuuacc

SEQ ID NO: 3361366 - RNA, 13 nt, Neisseria meningitidis Z2491
uucacuuggugcu

SEQ ID NO: 3361367 - RNA, 21 nt, Neisseria meningitidis Z2491
uucagacagcccucuugccuu

SEQ ID NO: 3361368 - RNA, 13 nt, Neisseria meningitidis Z2491
uucagacggcaua

SEQ ID NO: 3361369 - RNA, 20 nt, Neisseria meningitidis Z2491
uucagacggcauauguuuuu

SEQ ID NO: 3361370 - RNA, 13 nt, Neisseria meningitidis Z2491
uucagacggcauc

SEQ ID NO: 3361371 - RNA, 14 nt, Neisseria meningitidis Z2491
uucagacggcauca

SEQ ID NO: 3361372 - RNA, 16 nt, Neisseria meningitidis Z2491
uucagacggcaucaaa

SEQ ID NO: 3361373 - RNA, 20 nt, Neisseria meningitidis Z2491
uucagacggcauuuucaaca

SEQ ID NO: 3361374 - RNA, 16 nt, Neisseria meningitidis Z2491
uucagacggcauuuuu

SEQ ID NO: 3361375 - RNA, 17 nt, Neisseria meningitidis Z2491
uucagacggcauuuuua

SEQ ID NO: 3361376 - RNA, 21 nt, Neisseria meningitidis Z2491
uucagacggcauuuuugcgaa

SEQ ID NO: 3361377 - RNA, 16 nt, Neisseria meningitidis Z2491
uucagacggucugcca

SEQ ID NO: 3361378 - RNA, 21 nt, Neisseria meningitidis Z2491
uucagauaaucuuugaauauu

SEQ ID NO: 3361379 - RNA, 16 nt, Neisseria meningitidis Z2491
uucagcaauaaaauaa

SEQ ID NO: 3361380 - RNA, 18 nt, Neisseria meningitidis Z2491
uucagcaccuuagagaau

SEQ ID NO: 3361381 - RNA, 18 nt, Neisseria meningitidis Z2491
uucagcaguauagugaau

SEQ ID NO: 3361382 - RNA, 19 nt, Neisseria meningitidis Z2491
uucagcguuacuuugcguu

SEQ ID NO: 3361383 - RNA, 20 nt, Neisseria meningitidis Z2491
uucagcuauuuagaauaaau

SEQ ID NO: 3361384 - RNA, 12 nt, Neisseria meningitidis Z2491
uucagguaaaac

SEQ ID NO: 3361385 - RNA, 13 nt, Neisseria meningitidis Z2491
uucauaaguuucc

SEQ ID NO: 3361386 - RNA, 22 nt, Neisseria meningitidis Z2491
uucauacacagccaaaaaaaag

SEQ ID NO: 3361387 - RNA, 14 nt, Neisseria meningitidis Z2491
uucauaccucccaa

SEQ ID NO: 3361388 - RNA, 15 nt, Neisseria meningitidis Z2491
uucaucauuccuaca

SEQ ID NO: 3361389 - RNA, 16 nt, Neisseria meningitidis Z2491
uucauccaguuucuuu

SEQ ID NO: 3361390 - RNA, 22 nt, Neisseria meningitidis Z2491
uucaugcggcgggcuuggaaau

SEQ ID NO: 3361391 - RNA, 16 nt, Neisseria meningitidis Z2491
uucauggcguucaaca

SEQ ID NO: 3361392 - RNA, 17 nt, Neisseria meningitidis Z2491
uucauuaaagugccauu

SEQ ID NO: 3361393 - RNA, 16 nt, Neisseria meningitidis Z2491
uucauuucuagauucc

SEQ ID NO: 3361394 - RNA, 18 nt, Neisseria meningitidis Z2491
uucauuucuggauuccca

SEQ ID NO: 3361395 - RNA, 12 nt, Neisseria meningitidis Z2491
uucauuuugucg

SEQ ID NO: 3361396 - RNA, 21 nt, Neisseria meningitidis Z2491
uuccaaacccaaugcuucaac

SEQ ID NO: 3361397 - RNA, 13 nt, Neisseria meningitidis Z2491
uuccaacaaggaa

SEQ ID NO: 3361398 - RNA, 23 nt, Neisseria meningitidis Z2491
uuccaacccuccgccgcacaaac

SEQ ID NO: 3361399 - RNA, 22 nt, Neisseria meningitidis Z2491
uuccaacucuacggguuugccg

SEQ ID NO: 3361400 - RNA, 20 nt, Neisseria meningitidis Z2491
uuccaacuuggcaacgccac

SEQ ID NO: 3361401 - RNA, 19 nt, Neisseria meningitidis Z2491
uuccaagccgcauuguccc

SEQ ID NO: 3361402 - RNA, 20 nt, Neisseria meningitidis Z2491
uuccaagccgcauugucccu

SEQ ID NO: 3361403 - RNA, 23 nt, Neisseria meningitidis Z2491
uuccaaggcacgguaaaccgcca

SEQ ID NO: 3361404 - RNA, 20 nt, Neisseria meningitidis Z2491
uuccaaugacugcgggcuuu

SEQ ID NO: 3361405 - RNA, 13 nt, Neisseria meningitidis Z2491
uuccaauuccugu

SEQ ID NO: 3361406 - RNA, 14 nt, Neisseria meningitidis Z2491
uuccacaaaagaua

SEQ ID NO: 3361407 - RNA, 16 nt, Neisseria meningitidis Z2491
uuccacaaauccgccu

SEQ ID NO: 3361408 - RNA, 17 nt, Neisseria meningitidis Z2491
uuccaccgaugucggcu

SEQ ID NO: 3361409 - RNA, 22 nt, Neisseria meningitidis Z2491
uuccagaccagccgccuccauc

SEQ ID NO: 3361410 - RNA, 19 nt, Neisseria meningitidis Z2491
uuccagacggcauuuuuca

SEQ ID NO: 3361411 - RNA, 12 nt, Neisseria meningitidis Z2491
uuccauaaaaua

SEQ ID NO: 3361412 - RNA, 20 nt, Neisseria meningitidis Z2491
uuccaucaacaaaaugccgu

SEQ ID NO: 3361413 - RNA, 18 nt, Neisseria meningitidis Z2491
uuccaucgcgucuucaaa

SEQ ID NO: 3361414 - RNA, 23 nt, Neisseria meningitidis Z2491
uuccaugcuuaaacagcacugcc

SEQ ID NO: 3361415 - RNA, 13 nt, Neisseria meningitidis Z2491
uuccauuugagcc

SEQ ID NO: 3361416 - RNA, 22 nt, Neisseria meningitidis Z2491
uuccccucggggucuuuggcaa

SEQ ID NO: 3361417 - RNA, 19 nt, Neisseria meningitidis Z2491
uucccgcaaaaacaaaaaa

SEQ ID NO: 3361418 - RNA, 20 nt, Neisseria meningitidis Z2491
uucccgcaaaagcgggaauc

SEQ ID NO: 3361419 - RNA, 16 nt, Neisseria meningitidis Z2491
uucccgcgaaagcggg

SEQ ID NO: 3361420 - RNA, 14 nt, Neisseria meningitidis Z2491
uucccgcgcaggcg

SEQ ID NO: 3361421 - RNA, 20 nt, Neisseria meningitidis Z2491
uucccgcgcaggcgggaauc

SEQ ID NO: 3361422 - RNA, 19 nt, Neisseria meningitidis Z2491
uucccguuucagacggcau

SEQ ID NO: 3361423 - RNA, 19 nt, Neisseria meningitidis Z2491
uucccucaaaaacagaaaa

SEQ ID NO: 3361424 - RNA, 22 nt, Neisseria meningitidis Z2491
uucccucucccgugggagaggg

SEQ ID NO: 3361425 - RNA, 13 nt, Neisseria meningitidis Z2491
uucccugacaaac

SEQ ID NO: 3361426 - RNA, 22 nt, Neisseria meningitidis Z2491
uucccuugcaaauaauugaaau

SEQ ID NO: 3361427 - RNA, 13 nt, Neisseria meningitidis Z2491
uuccgaaaccaag

SEQ ID NO: 3361428 - RNA, 14 nt, Neisseria meningitidis Z2491
uucuguuuuuuccg

SEQ ID NO: 3361429 - RNA, 16 nt, Neisseria meningitidis Z2491
uucuuacccaaugacu

SEQ ID NO: 3361430 - RNA, 13 nt, Neisseria meningitidis Z2491
uucuuauguuuaa

SEQ ID NO: 3361431 - RNA, 21 nt, Neisseria meningitidis Z2491
uucuucgacguugccuucuuc

SEQ ID NO: 3361432 - RNA, 15 nt, Neisseria meningitidis Z2491
uucuucgaucaucca

SEQ ID NO: 3361433 - RNA, 17 nt, Neisseria meningitidis Z2491
uucuucgcaaccgacaa

SEQ ID NO: 3361434 - RNA, 22 nt, Neisseria meningitidis Z2491
uucuucuaaaaauacauauuga

SEQ ID NO: 3361435 - RNA, 18 nt, Neisseria meningitidis Z2491
uucuucuaucauugcaug

SEQ ID NO: 3361436 - RNA, 13 nt, Neisseria meningitidis Z2491
uucuugaggcauu

SEQ ID NO: 3361437 - RNA, 23 nt, Neisseria meningitidis Z2491
uucuugaggcauugaaauuccag

SEQ ID NO: 3361438 - RNA, 19 nt, Neisseria meningitidis Z2491
uucuuucacauccuccauc

SEQ ID NO: 3361439 - RNA, 24 nt, Neisseria meningitidis Z2491
uucuuugacggcgggcaggcggcu

SEQ ID NO: 3361440 - RNA, 15 nt, Neisseria meningitidis Z2491
uucuuuuauuuucaa

SEQ ID NO: 3361441 - RNA, 17 nt, Neisseria meningitidis Z2491
uugaaaacaucggguuu

SEQ ID NO: 3361442 - RNA, 13 nt, Neisseria meningitidis Z2491
uugaaaaugccgu

SEQ ID NO: 3361443 - RNA, 20 nt, Neisseria meningitidis Z2491
uugaaaaugccgucugaaac

SEQ ID NO: 3361444 - RNA, 17 nt, Neisseria meningitidis Z2491
uugaaacgcgccuucau

SEQ ID NO: 3361445 - RNA, 21 nt, Neisseria meningitidis Z2491
uugaaacgguuguucaaaucg

SEQ ID NO: 3361446 - RNA, 13 nt, Neisseria meningitidis Z2491
uugaaagagaaaa

SEQ ID NO: 3361447 - RNA, 12 nt, Neisseria meningitidis Z2491
uugaaaucaaca

SEQ ID NO: 3361448 - RNA, 14 nt, Neisseria meningitidis Z2491
uugaaauucuagau

SEQ ID NO: 3361449 - RNA, 17 nt, Neisseria meningitidis Z2491
uugaacguuugcaggac

SEQ ID NO: 3361450 - RNA, 21 nt, Neisseria meningitidis Z2491
uugacaaacauccauaucuuu

SEQ ID NO: 3361451 - RNA, 21 nt, Neisseria meningitidis Z2491
uugacaggucggacauuugac

SEQ ID NO: 3361452 - RNA, 22 nt, Neisseria meningitidis Z2491
uugacaggucggacauuugacu

SEQ ID NO: 3361453 - RNA, 12 nt, Neisseria meningitidis Z2491
uugacauauccg

SEQ ID NO: 3361454 - RNA, 17 nt, Neisseria meningitidis Z2491
uugacgaauucggauuu

SEQ ID NO: 3361455 - RNA, 18 nt, Neisseria meningitidis Z2491
uugacgcauaaaaaugcg

SEQ ID NO: 3361456 - RNA, 23 nt, Neisseria meningitidis Z2491
uugacggacggcggcagauaaau

SEQ ID NO: 3361457 - RNA, 17 nt, Neisseria meningitidis Z2491
uugacuugaaggcgugu

SEQ ID NO: 3361458 - RNA, 19 nt, Neisseria meningitidis Z2491
uugacuuuggaacaaaaaa

SEQ ID NO: 3361459 - RNA, 20 nt, Neisseria meningitidis Z2491
uugacuuuggaacaaaaaau

SEQ ID NO: 3361460 - RNA, 19 nt, Neisseria meningitidis Z2491
uugagaaaucugugaaaau

SEQ ID NO: 3361461 - RNA, 22 nt, Neisseria meningitidis Z2491
uugagaaaucugugaaaaucag

SEQ ID NO: 3361462 - RNA, 19 nt, Neisseria meningitidis Z2491
uugagauggucaauacaca

SEQ ID NO: 3361463 - RNA, 20 nt, Neisseria meningitidis Z2491
uugagauggucaauacacaa

SEQ ID NO: 3361464 - RNA, 21 nt, Neisseria meningitidis Z2491
uugagauuuuacguucuagau

SEQ ID NO: 3361465 - RNA, 22 nt, Neisseria meningitidis Z2491
uugagcaaaugccgucugaaau

SEQ ID NO: 3361466 - RNA, 12 nt, Neisseria meningitidis Z2491
uugagcauaaaa

SEQ ID NO: 3361467 - RNA, 13 nt, Neisseria meningitidis Z2491
uugagcauaaaau

SEQ ID NO: 3361468 - RNA, 12 nt, Neisseria meningitidis Z2491
uugagcguucag

SEQ ID NO: 3361469 - RNA, 19 nt, Neisseria meningitidis Z2491
uugagcuggauuuucgcaa

SEQ ID NO: 3361470 - RNA, 12 nt, Neisseria meningitidis Z2491
uugagcuucgcg

SEQ ID NO: 3361471 - RNA, 24 nt, Neisseria meningitidis Z2491
uugagggcguuuuuguaaacgaau

SEQ ID NO: 3361472 - RNA, 20 nt, Neisseria meningitidis Z2491
uugaggucgcgaguucgaga

SEQ ID NO: 3361473 - RNA, 22 nt, Neisseria meningitidis Z2491
uugaguugauaauaugaaacca

SEQ ID NO: 3361474 - RNA, 22 nt, Neisseria meningitidis Z2491
uugaguuucagcuauuuagaau

SEQ ID NO: 3361475 - RNA, 13 nt, Neisseria meningitidis Z2491
uugaguuucgguc

SEQ ID NO: 3361476 - RNA, 21 nt, Neisseria meningitidis Z2491
uugauaauaugaaaccauuac

SEQ ID NO: 3361477 - RNA, 15 nt, Neisseria meningitidis Z2491
uugauaguauucuau

SEQ ID NO: 3361478 - RNA, 20 nt, Neisseria meningitidis Z2491
uugauauggcguugacaaac

SEQ ID NO: 3361479 - RNA, 20 nt, Neisseria meningitidis Z2491
uugaugaugucgaaggcgcg

SEQ ID NO: 3361480 - RNA, 14 nt, Neisseria meningitidis Z2491
uugauggcgaaagc

SEQ ID NO: 3361481 - RNA, 19 nt, Neisseria meningitidis Z2491
uugaugguuuuccaauacg

SEQ ID NO: 3361482 - RNA, 19 nt, Neisseria meningitidis Z2491
uugaugucgugcagauggc

SEQ ID NO: 3361483 - RNA, 22 nt, Neisseria meningitidis Z2491
uugaugucgugcagauggcugu

SEQ ID NO: 3361484 - RNA, 13 nt, Neisseria meningitidis Z2491
uugauuaaaacaa

SEQ ID NO: 3361485 - RNA, 13 nt, Neisseria meningitidis Z2491
uugauuucuauua

SEQ ID NO: 3361486 - RNA, 15 nt, Neisseria meningitidis Z2491
uugcaaaauagaaaa

SEQ ID NO: 3361487 - RNA, 14 nt, Neisseria meningitidis Z2491
uugcaaagaaaugu

SEQ ID NO: 3361488 - RNA, 18 nt, Neisseria meningitidis Z2491
uugcaaaggucucaaaua

SEQ ID NO: 3361489 - RNA, 16 nt, Neisseria meningitidis Z2491
uugcaaauaauugaaa

SEQ ID NO: 3361490 - RNA, 19 nt, Neisseria meningitidis Z2491
uugcaaauaauugaaauca

SEQ ID NO: 3361491 - RNA, 20 nt, Neisseria meningitidis Z2491
uugcaaauaauugaaaucaa

SEQ ID NO: 3361492 - RNA, 14 nt, Neisseria meningitidis Z2491
uugcaacuuugcgu

SEQ ID NO: 3361493 - RNA, 19 nt, Neisseria meningitidis Z2491
uugcaagaauggcaaaauu

SEQ ID NO: 3361494 - RNA, 19 nt, Neisseria meningitidis Z2491
uugcaagcaguugaaauca

SEQ ID NO: 3361495 - RNA, 22 nt, Neisseria meningitidis Z2491
uugcaagcaguugaaaucaaca

SEQ ID NO: 3361496 - RNA, 14 nt, Neisseria meningitidis Z2491
uugcaauaacauag

SEQ ID NO: 3361497 - RNA, 21 nt, Neisseria meningitidis Z2491
uugcaauauacugauuuauau

SEQ ID NO: 3361498 - RNA, 18 nt, Neisseria meningitidis Z2491
uugcagacaaucagaucg

SEQ ID NO: 3361499 - RNA, 22 nt, Neisseria meningitidis Z2491
uugcagauagucgccgagcaga

SEQ ID NO: 3361500 - RNA, 21 nt, Neisseria meningitidis Z2491
uugcagccaugcggcaaaaag

SEQ ID NO: 3361501 - RNA, 23 nt, Neisseria meningitidis Z2491
uugcagcgcgcccgacaaaucgg

SEQ ID NO: 3361502 - RNA, 21 nt, Neisseria meningitidis Z2491
uugcaggaucuuauccauccc

SEQ ID NO: 3361503 - RNA, 23 nt, Neisseria meningitidis Z2491
uugcaggcauuuaucggauaaaa

SEQ ID NO: 3361504 - RNA, 17 nt, Neisseria meningitidis Z2491
uugcaguauccggcaag

SEQ ID NO: 3361505 - RNA, 20 nt, Neisseria meningitidis Z2491
uugcauaaucaauuaaaaac

SEQ ID NO: 3361506 - RNA, 23 nt, Neisseria meningitidis Z2491
uugccacaauauaaucaaacuca

SEQ ID NO: 3361507 - RNA, 14 nt, Neisseria meningitidis Z2491
uugccagcggguuu

SEQ ID NO: 3361508 - RNA, 17 nt, Neisseria meningitidis Z2491
uugcccacgcacccaaa

SEQ ID NO: 3361509 - RNA, 22 nt, Neisseria meningitidis Z2491
uugcccgacgacgaccuccuga

SEQ ID NO: 3361510 - RNA, 15 nt, Neisseria meningitidis Z2491
uugcccgauuuaaag

SEQ ID NO: 3361511 - RNA, 17 nt, Neisseria meningitidis Z2491
uugcccgcgaaauaaag

SEQ ID NO: 3361512 - RNA, 16 nt, Neisseria meningitidis Z2491
uugcccggaaaaaauu

SEQ ID NO: 3361513 - RNA, 19 nt, Neisseria meningitidis Z2491
uugcccguggcgacggcaa

SEQ ID NO: 3361514 - RNA, 16 nt, Neisseria meningitidis Z2491
uugccgcauuaaaauu

SEQ ID NO: 3361515 - RNA, 18 nt, Neisseria meningitidis Z2491
uugccgcgaccgaaaugc

SEQ ID NO: 3361516 - RNA, 20 nt, Neisseria meningitidis Z2491
uugccgucgcccaaaggccu

SEQ ID NO: 3361517 - RNA, 20 nt, Neisseria meningitidis Z2491
uugccgucugaagcguauuu

SEQ ID NO: 3361518 - RNA, 23 nt, Neisseria meningitidis Z2491
uugccgucugaagcguauuucua

SEQ ID NO: 3361519 - RNA, 22 nt, Neisseria meningitidis Z2491
uugccguuuuccuuucugacaa

SEQ ID NO: 3361520 - RNA, 13 nt, Neisseria meningitidis Z2491
uugccucgccuug

SEQ ID NO: 3361521 - RNA, 16 nt, Neisseria meningitidis Z2491
uugccugauccaaacc

SEQ ID NO: 3361522 - RNA, 16 nt, Neisseria meningitidis Z2491
uugcgaauaagugcgg

SEQ ID NO: 3361523 - RNA, 18 nt, Neisseria meningitidis Z2491
uugcgcagccugcagcag

SEQ ID NO: 3361524 - RNA, 23 nt, Neisseria meningitidis Z2491
uugcgccucgccuuucacaaagg

SEQ ID NO: 3361525 - RNA, 23 nt, Neisseria meningitidis Z2491
uugcggagcggcgguguuugcuu

SEQ ID NO: 3361526 - RNA, 18 nt, Neisseria meningitidis Z2491
uugcgucugccuucuucu

SEQ ID NO: 3361527 - RNA, 13 nt, Neisseria meningitidis Z2491
uugcguucagacg

SEQ ID NO: 3361528 - RNA, 19 nt, Neisseria meningitidis Z2491
uuucaaaauuuauucuaaa

SEQ ID NO: 3361529 - RNA, 19 nt, Neisseria meningitidis Z2491
uuucaaauucggaagacau

SEQ ID NO: 3361530 - RNA, 14 nt, Neisseria meningitidis Z2491
uuucaacaaucugc

SEQ ID NO: 3361531 - RNA, 20 nt, Neisseria meningitidis Z2491
uuucaacugauuguuuuuca

SEQ ID NO: 3361532 - RNA, 21 nt, Neisseria meningitidis Z2491
uuucaagaacaggcggcggca

SEQ ID NO: 3361533 - RNA, 18 nt, Neisseria meningitidis Z2491
uuucaagugcaacacuag

SEQ ID NO: 3361534 - RNA, 23 nt, Neisseria meningitidis Z2491
uuucaagugcaacacuaguguau

SEQ ID NO: 3361535 - RNA, 13 nt, Neisseria meningitidis Z2491
uuucacaucuuua

SEQ ID NO: 3361536 - RNA, 17 nt, Neisseria meningitidis Z2491
uuucacuucgauuucuu

SEQ ID NO: 3361537 - RNA, 16 nt, Neisseria meningitidis Z2491
uuucagacggcacuuu

SEQ ID NO: 3361538 - RNA, 22 nt, Neisseria meningitidis Z2491
uuucagacggcacuuucauuca

SEQ ID NO: 3361539 - RNA, 13 nt, Neisseria meningitidis Z2491
uuucagacggcau

SEQ ID NO: 3361540 - RNA, 18 nt, Neisseria meningitidis Z2491
uuucagacggcauaaaug

SEQ ID NO: 3361541 - RNA, 21 nt, Neisseria meningitidis Z2491
uuucagacggcauaaaugcgu

SEQ ID NO: 3361542 - RNA, 21 nt, Neisseria meningitidis Z2491
uuucagacggcaucaaaauga

SEQ ID NO: 3361543 - RNA, 18 nt, Neisseria meningitidis Z2491
uuucagacggcaucuuuu

SEQ ID NO: 3361544 - RNA, 20 nt, Neisseria meningitidis Z2491
uuucagacggcauugccucu

SEQ ID NO: 3361545 - RNA, 21 nt, Neisseria meningitidis Z2491
uuucagacggcauuuccuuua

SEQ ID NO: 3361546 - RNA, 19 nt, Neisseria meningitidis Z2491
uuucagacggcauuucggc

SEQ ID NO: 3361547 - RNA, 20 nt, Neisseria meningitidis Z2491
uuucagacggcauuuuccuu

SEQ ID NO: 3361548 - RNA, 23 nt, Neisseria meningitidis Z2491
uuucagacggcauuuugcugccg

SEQ ID NO: 3361549 - RNA, 17 nt, Neisseria meningitidis Z2491
uuucagacggcauuuuu

SEQ ID NO: 3361550 - RNA, 19 nt, Neisseria meningitidis Z2491
uuucagacggcauuuuuau

SEQ ID NO: 3361551 - RNA, 19 nt, Neisseria meningitidis Z2491
uuucagacggcauuuuuuc

SEQ ID NO: 3361552 - RNA, 17 nt, Neisseria meningitidis Z2491
uuucagacggucugcca

SEQ ID NO: 3361553 - RNA, 15 nt, Neisseria meningitidis Z2491
uuucagagcauugcg

SEQ ID NO: 3361554 - RNA, 12 nt, Neisseria meningitidis Z2491
uuucagauuauu

SEQ ID NO: 3361555 - RNA, 17 nt, Neisseria meningitidis Z2491
uuucagcuguuuucagc

SEQ ID NO: 3361556 - RNA, 21 nt, Neisseria meningitidis Z2491
uuucaggaagucgggcaaagc

SEQ ID NO: 3361557 - RNA, 19 nt, Neisseria meningitidis Z2491
uuucaggcacaaacaaggc

SEQ ID NO: 3361558 - RNA, 14 nt, Neisseria meningitidis Z2491
uuucaggguguuug

SEQ ID NO: 3361559 - RNA, 15 nt, Neisseria meningitidis Z2491
uuucauccaccagcc

SEQ ID NO: 3361560 - RNA, 12 nt, Neisseria meningitidis Z2491
uuucauuucuag

SEQ ID NO: 3361561 - RNA, 21 nt, Neisseria meningitidis Z2491
uuucauuucuagauucccacu

SEQ ID NO: 3361562 - RNA, 14 nt, Neisseria meningitidis Z2491
uuucauuucugaaa

SEQ ID NO: 3361563 - RNA, 22 nt, Neisseria meningitidis Z2491
uuucauuucuggauucccacuu

SEQ ID NO: 3361564 - RNA, 18 nt, Neisseria meningitidis Z2491
uuucauuuuucauaucau

SEQ ID NO: 3361565 - RNA, 17 nt, Neisseria meningitidis Z2491
uuuccaaaccugaaguu

SEQ ID NO: 3361566 - RNA, 12 nt, Neisseria meningitidis Z2491
uuuccaaaguga

SEQ ID NO: 3361567 - RNA, 22 nt, Neisseria meningitidis Z2491
uuuccaaauauaaaaaaugccg

SEQ ID NO: 3361568 - RNA, 11 nt, Neisseria meningitidis Z2491
uuuccaauaca

SEQ ID NO: 3361569 - RNA, 16 nt, Neisseria meningitidis Z2491
uuuccaauacaacaaa

SEQ ID NO: 3361570 - RNA, 21 nt, Neisseria meningitidis Z2491
uuuccaauacaacaaaaugcc

SEQ ID NO: 3361571 - RNA, 23 nt, Neisseria meningitidis Z2491
uuuccaauacggcgaccagcguu

SEQ ID NO: 3361572 - RNA, 16 nt, Neisseria meningitidis Z2491
uuuccacaaaaaacag

SEQ ID NO: 3361573 - RNA, 17 nt, Neisseria meningitidis Z2491
uuuccacaaaagauaca

SEQ ID NO: 3361574 - RNA, 21 nt, Neisseria meningitidis Z2491
uuuccacaaaagauacacaca

SEQ ID NO: 3361575 - RNA, 15 nt, Neisseria meningitidis Z2491
uuuccauaaaauaca

SEQ ID NO: 3361576 - RNA, 16 nt, Neisseria meningitidis Z2491
uuuccauaaaauacau

SEQ ID NO: 3361577 - RNA, 23 nt, Neisseria meningitidis Z2491
uuuccaugcuuaaacagcacugc

SEQ ID NO: 3361578 - RNA, 18 nt, Neisseria meningitidis Z2491
uuuccccuguaaacagau

SEQ ID NO: 3361579 - RNA, 18 nt, Neisseria meningitidis Z2491
uuucccgaaauuccaaca

SEQ ID NO: 3361580 - RNA, 23 nt, Neisseria meningitidis Z2491
uuuccgcaccgacagaccuagau

SEQ ID NO: 3361581 - RNA, 17 nt, Neisseria meningitidis Z2491
uuuccgucauuucugau

SEQ ID NO: 3361582 - RNA, 22 nt, Neisseria meningitidis Z2491
uuuccgucauuucugauaaauu

SEQ ID NO: 3361583 - RNA, 20 nt, Neisseria meningitidis Z2491
uuuccuacuuuuugcucaau

SEQ ID NO: 3361584 - RNA, 22 nt, Neisseria meningitidis Z2491
uuuccuccucgccgucuuucag

SEQ ID NO: 3361585 - RNA, 16 nt, Neisseria meningitidis Z2491
uuuccucuuucaucau

SEQ ID NO: 3361586 - RNA, 24 nt, Neisseria meningitidis Z2491
uuuccugcaucagcuucauacccc

SEQ ID NO: 3361587 - RNA, 19 nt, Neisseria meningitidis Z2491
uuucgcgcaccagcaaauc

SEQ ID NO: 3361588 - RNA, 16 nt, Neisseria meningitidis Z2491
uuucgcguaccaaaac

SEQ ID NO: 3361589 - RNA, 13 nt, Neisseria meningitidis Z2491
uuucggacggcau

SEQ ID NO: 3361590 - RNA, 14 nt, Neisseria meningitidis Z2491
uuucgggcaaaagc

SEQ ID NO: 3361591 - RNA, 15 nt, Neisseria meningitidis Z2491
uuucggguucccaua

SEQ ID NO: 3361592 - RNA, 17 nt, Neisseria meningitidis Z2491
uuucguauauucugcaa

SEQ ID NO: 3361593 - RNA, 17 nt, Neisseria meningitidis Z2491
uuucgugggaaugacgg

SEQ ID NO: 3361594 - RNA, 15 nt, Neisseria meningitidis Z2491
uuucguuaacagacu

SEQ ID NO: 3361595 - RNA, 21 nt, Neisseria meningitidis Z2491
uuucguuaacagacuauuuuu

SEQ ID NO: 3361596 - RNA, 15 nt, Neisseria meningitidis Z2491
uuucuagauucccac

SEQ ID NO: 3361597 - RNA, 16 nt, Neisseria meningitidis Z2491
uuucuagauucccacu

SEQ ID NO: 3361598 - RNA, 13 nt, Neisseria meningitidis Z2491
uuucuauugccuu

SEQ ID NO: 3361599 - RNA, 13 nt, Neisseria meningitidis Z2491
uuucuauuuugca

SEQ ID NO: 3361600 - RNA, 17 nt, Neisseria meningitidis Z2491
uuucuauuuuugugaaa

SEQ ID NO: 3361601 - RNA, 14 nt, Neisseria meningitidis Z2491
uuucugacaaaaau

SEQ ID NO: 3361602 - RNA, 13 nt, Neisseria meningitidis Z2491
uuucugauaaauu

SEQ ID NO: 3361603 - RNA, 20 nt, Neisseria meningitidis Z2491
uuucuguuucgguuuucuau

SEQ ID NO: 3361604 - RNA, 16 nt, Neisseria meningitidis Z2491
uuucuguuuggcuuuu

SEQ ID NO: 3361605 - RNA, 12 nt, Neisseria meningitidis Z2491
uuucuguuuuuu

SEQ ID NO: 3361606 - RNA, 13 nt, Neisseria meningitidis Z2491
uuucuguuuuuuc

SEQ ID NO: 3361607 - RNA, 20 nt, Neisseria meningitidis Z2491
uuucuuaugccuauuuuuua

SEQ ID NO: 3361608 - RNA, 12 nt, Neisseria meningitidis Z2491
uuucuucaucca

SEQ ID NO: 3361609 - RNA, 14 nt, Neisseria meningitidis Z2491
uuucuuccagcguu

SEQ ID NO: 3361610 - RNA, 19 nt, Neisseria meningitidis Z2491
uuucuucgcgggacauucu

SEQ ID NO: 3361611 - RNA, 15 nt, Neisseria meningitidis Z2491
uuucuugaguuucug

SEQ ID NO: 3361612 - RNA, 15 nt, Neisseria meningitidis Z2491
uuucuugugucauuu

SEQ ID NO: 3361613 - RNA, 22 nt, Neisseria meningitidis Z2491
uuucuuugacaaaauccaguuc

SEQ ID NO: 3361614 - RNA, 14 nt, Neisseria meningitidis Z2491
uuugaaagagaaaa

SEQ ID NO: 3361615 - RNA, 22 nt, Neisseria meningitidis Z2491
uuugaacaacaaacuagauucc

SEQ ID NO: 3361616 - RNA, 19 nt, Neisseria meningitidis Z2491
uuugaauacacuuaaaaau

SEQ ID NO: 3361617 - RNA, 16 nt, Neisseria meningitidis Z2491
uuugaauauugcuguu

SEQ ID NO: 3361618 - RNA, 16 nt, Neisseria meningitidis Z2491
uuugaaucugacuugc

SEQ ID NO: 3361619 - RNA, 19 nt, Neisseria meningitidis Z2491
uuugaaucugacuugccau

SEQ ID NO: 3361620 - RNA, 17 nt, Neisseria meningitidis Z2491
uuugaauggaaaugccg

SEQ ID NO: 3361621 - RNA, 22 nt, Neisseria meningitidis Z2491
uuugacacuucacauuuucuau

SEQ ID NO: 3361622 - RNA, 23 nt, Neisseria meningitidis Z2491
uuugacacuucacauuuucuauu

SEQ ID NO: 3361623 - RNA, 22 nt, Neisseria meningitidis Z2491
uuugacuuuuuuaccuugcugg

SEQ ID NO: 3361624 - RNA, 15 nt, Neisseria meningitidis Z2491
uuugagcaaaugccg

SEQ ID NO: 3361625 - RNA, 16 nt, Neisseria meningitidis Z2491
uuugagcaaaugccgu

SEQ ID NO: 3361626 - RNA, 16 nt, Neisseria meningitidis Z2491
uuugagcaguuuuuug

SEQ ID NO: 3361627 - RNA, 19 nt, Neisseria meningitidis Z2491
uuugagcuucgcgacggua

SEQ ID NO: 3361628 - RNA, 16 nt, Neisseria meningitidis Z2491
uuugagggaauggccg

SEQ ID NO: 3361629 - RNA, 13 nt, Neisseria meningitidis Z2491
uuuucuucugaau

SEQ ID NO: 3361630 - RNA, 22 nt, Neisseria meningitidis Z2491
uuuugacuuuggaacaaaaaau

SEQ ID NO: 3361631 - RNA, 14 nt, Neisseria meningitidis Z2491
uuuugaugacaggg

SEQ ID NO: 3361632 - RNA, 21 nt, Neisseria meningitidis Z2491
uuuugaugguuuugccgcugc

SEQ ID NO: 3361633 - RNA, 22 nt, Neisseria meningitidis Z2491
uuuugcaagaauggcaaaauuu

SEQ ID NO: 3361634 - RNA, 23 nt, Neisseria meningitidis Z2491
uuuugcaagaauggcaaaauuuc

SEQ ID NO: 3361635 - RNA, 16 nt, Neisseria meningitidis Z2491
uuuugcccgauuuaaa

SEQ ID NO: 3361636 - RNA, 21 nt, Neisseria meningitidis Z2491
uuuugccgcgaccgaaaugcc

SEQ ID NO: 3361637 - RNA, 24 nt, Neisseria meningitidis Z2491
uuuugccguccaucggcgcgccgc

SEQ ID NO: 3361638 - RNA, 22 nt, Neisseria meningitidis Z2491
uuuugccguguuggguucuaga

SEQ ID NO: 3361639 - RNA, 14 nt, Neisseria meningitidis Z2491
uuuugcucauucac

SEQ ID NO: 3361640 - RNA, 20 nt, Neisseria meningitidis Z2491
uuuuggagcaguaaaauuua

SEQ ID NO: 3361641 - RNA, 15 nt, Neisseria meningitidis Z2491
uuuuggcgcauuuuu

SEQ ID NO: 3361642 - RNA, 21 nt, Neisseria meningitidis Z2491
uuuugguauauuuuuucuaaa

SEQ ID NO: 3361643 - RNA, 23 nt, Neisseria meningitidis Z2491
uuuuguuaaucacuauaccaaac

SEQ ID NO: 3361644 - RNA, 17 nt, Neisseria meningitidis Z2491
uuuuguuaauccacuau

SEQ ID NO: 3361645 - RNA, 23 nt, Neisseria meningitidis Z2491
uuuuguuaauccacuauacugua

SEQ ID NO: 3361646 - RNA, 16 nt, Neisseria meningitidis Z2491
uuuuguucauccacua

SEQ ID NO: 3361647 - RNA, 15 nt, Neisseria meningitidis Z2491
uuuuuaaacaacaaa

SEQ ID NO: 3361648 - RNA, 20 nt, Neisseria meningitidis Z2491
uuuuuacacaauucccaccg

SEQ ID NO: 3361649 - RNA, 17 nt, Neisseria meningitidis Z2491
uuuuuagggaaacguuu

SEQ ID NO: 3361650 - RNA, 16 nt, Neisseria meningitidis Z2491
uuuuuauaccggggaa

SEQ ID NO: 3361651 - RNA, 19 nt, Neisseria meningitidis Z2491
uuuuucacggggaaaauac

SEQ ID NO: 3361652 - RNA, 20 nt, Neisseria meningitidis Z2491
uuuuucagauuauuuauuaa

SEQ ID NO: 3361653 - RNA, 12 nt, Neisseria meningitidis Z2491
uuuuuccaaacc

SEQ ID NO: 3361654 - RNA, 13 nt, Neisseria meningitidis Z2491
uuuuuccaaaccu

SEQ ID NO: 3361655 - RNA, 18 nt, Neisseria meningitidis Z2491
uuuuuccacaaaagauac

SEQ ID NO: 3361656 - RNA, 11 nt, Neisseria meningitidis Z2491
uuuuuccagca

SEQ ID NO: 3361657 - RNA, 12 nt, Neisseria meningitidis Z2491
uuuuuccuguuc

SEQ ID NO: 3361658 - RNA, 13 nt, Neisseria meningitidis Z2491
uuuuucugaaaaa

SEQ ID NO: 3361659 - RNA, 19 nt, Neisseria meningitidis Z2491
uuuuugaauuucgggcaac

SEQ ID NO: 3361660 - RNA, 22 nt, Neisseria meningitidis Z2491
uuuuugaguuuccgucauuucu

SEQ ID NO: 3361661 - RNA, 17 nt, Neisseria meningitidis Z2491
uuuuuggcgcauuuuuu

SEQ ID NO: 3361662 - RNA, 16 nt, Neisseria meningitidis Z2491
uuuuuguuaauccacu

SEQ ID NO: 3361663 - RNA, 13 nt, Neisseria meningitidis Z2491
uuuuuucaagccu

SEQ ID NO: 3361664 - RNA, 13 nt, Neisseria meningitidis Z2491
uuuuuucaggccu

SEQ ID NO: 3361665 - RNA, 18 nt, Neisseria meningitidis Z2491
uuuuuuccgauaaauucc

SEQ ID NO: 3361666 - RNA, 18 nt, Neisseria meningitidis Z2491
uuuuuuccgguaaauacc

SEQ ID NO: 3361667 - RNA, 18 nt, Neisseria meningitidis Z2491
uuuuuuccgguaaauucc

SEQ ID NO: 3361668 - RNA, 12 nt, Neisseria meningitidis Z2491
uuuuuuccuguu

SEQ ID NO: 3361669 - RNA, 11 nt, Neisseria meningitidis Z2491
uuuuuuggcaa

SEQ ID NO: 3361670 - RNA, 12 nt, Neisseria meningitidis Z2491
auuccuguuuuu

SEQ ID NO: 3361671 - RNA, 14 nt, Neisseria meningitidis Z2491
auucgacggcggaa

SEQ ID NO: 3361672 - RNA, 16 nt, Neisseria meningitidis Z2491
auucgccuuaaaaaac

SEQ ID NO: 3361673 - RNA, 14 nt, Neisseria meningitidis Z2491
auucggaggcgcau

SEQ ID NO: 3361674 - RNA, 17 nt, Neisseria meningitidis Z2491
auucggcuuaaaccuua

SEQ ID NO: 3361675 - RNA, 13 nt, Neisseria meningitidis Z2491
auucgucauuccc

SEQ ID NO: 3361676 - RNA, 14 nt, Neisseria meningitidis Z2491
auucguggaugcuu

SEQ ID NO: 3361677 - RNA, 14 nt, Neisseria meningitidis Z2491
auucgugggcgcau

SEQ ID NO: 3361678 - RNA, 15 nt, Neisseria meningitidis Z2491
auucuacccaaauac

SEQ ID NO: 3361679 - RNA, 15 nt, Neisseria meningitidis Z2491
auucuacccaaaucc

SEQ ID NO: 3361680 - RNA, 20 nt, Neisseria meningitidis Z2491
auucucgcgcaggcgggaau

SEQ ID NO: 3361681 - RNA, 17 nt, Neisseria meningitidis Z2491
auucucuaaggugcuga

SEQ ID NO: 3361682 - RNA, 19 nt, Neisseria meningitidis Z2491
auucugaugaaacgaugac

SEQ ID NO: 3361683 - RNA, 16 nt, Neisseria meningitidis Z2491
auucuguccagacgga

SEQ ID NO: 3361684 - RNA, 14 nt, Neisseria meningitidis Z2491
auucuuaagaugaa

SEQ ID NO: 3361685 - RNA, 16 nt, Neisseria meningitidis Z2491
auucuucgaucaucca

SEQ ID NO: 3361686 - RNA, 17 nt, Neisseria meningitidis Z2491
auucuucuuuccaucca

SEQ ID NO: 3361687 - RNA, 20 nt, Neisseria meningitidis Z2491
auucuucuuuccauccauca

SEQ ID NO: 3361688 - RNA, 19 nt, Neisseria meningitidis Z2491
auucuugcaaaauagaaaa

SEQ ID NO: 3361689 - RNA, 22 nt, Neisseria meningitidis Z2491
auucuuugaaaacagguuuaag

SEQ ID NO: 3361690 - RNA, 23 nt, Neisseria meningitidis Z2491
caaaacuuuucugauuuuuccua

SEQ ID NO: 3361691 - RNA, 20 nt, Neisseria meningitidis Z2491
caaaagaccgucugaacagu

SEQ ID NO: 3361692 - RNA, 15 nt, Neisseria meningitidis Z2491
caaaagccaaaaaac

SEQ ID NO: 3361693 - RNA, 11 nt, Neisseria meningitidis Z2491
caaaagccagc

SEQ ID NO: 3361694 - RNA, 16 nt, Neisseria meningitidis Z2491
caaaagccgugugaaa

SEQ ID NO: 3361695 - RNA, 15 nt, Neisseria meningitidis Z2491
caaaagcgggaaucc

SEQ ID NO: 3361696 - RNA, 16 nt, Neisseria meningitidis Z2491
caaaagcgggaaucua

SEQ ID NO: 3361697 - RNA, 21 nt, Neisseria meningitidis Z2491
caaaagcgggaaucuagaaac

SEQ ID NO: 3361698 - RNA, 14 nt, Neisseria meningitidis Z2491
caaaaggccgucug

SEQ ID NO: 3361699 - RNA, 17 nt, Neisseria meningitidis Z2491
caaaaggccgucugaaa

SEQ ID NO: 3361700 - RNA, 19 nt, Neisseria meningitidis Z2491
caaaagucggacuaaaccg

SEQ ID NO: 3361701 - RNA, 22 nt, Neisseria meningitidis Z2491
caaaauacauccuaaaaauuua

SEQ ID NO: 3361702 - RNA, 16 nt, Neisseria meningitidis Z2491
caaaauacccgaaaga

SEQ ID NO: 3361703 - RNA, 17 nt, Neisseria meningitidis Z2491
caaaauaccgucugaaa

SEQ ID NO: 3361704 - RNA, 13 nt, Neisseria meningitidis Z2491
caaaauagaaaac

SEQ ID NO: 3361705 - RNA, 15 nt, Neisseria meningitidis Z2491
caaaauagaaaaccg

SEQ ID NO: 3361706 - RNA, 21 nt, Neisseria meningitidis Z2491
caaaauaugccgucauucccg

SEQ ID NO: 3361707 - RNA, 16 nt, Neisseria meningitidis Z2491
caaaauauucaauuga

SEQ ID NO: 3361708 - RNA, 21 nt, Neisseria meningitidis Z2491
caaaaucagaaaccuaaaauc

SEQ ID NO: 3361709 - RNA, 14 nt, Neisseria meningitidis Z2491
caaaaucagcacaa

SEQ ID NO: 3361710 - RNA, 23 nt, Neisseria meningitidis Z2491
caaaaucagcacaaaugccaaag

SEQ ID NO: 3361711 - RNA, 16 nt, Neisseria meningitidis Z2491
caaaaucaguauagug

SEQ ID NO: 3361712 - RNA, 19 nt, Neisseria meningitidis Z2491
caaaauccgcaaacggcag

SEQ ID NO: 3361713 - RNA, 17 nt, Neisseria meningitidis Z2491
caaaaucggcauucucg

SEQ ID NO: 3361714 - RNA, 19 nt, Neisseria meningitidis Z2491
caaaaucggccauucccuc

SEQ ID NO: 3361715 - RNA, 23 nt, Neisseria meningitidis Z2491
caaaaucggccauucccucaaaa

SEQ ID NO: 3361716 - RNA, 20 nt, Neisseria meningitidis Z2491
caaaaucuggauuacugaua

SEQ ID NO: 3361717 - RNA, 17 nt, Neisseria meningitidis Z2491
caaaaugccgccgucga

SEQ ID NO: 3361718 - RNA, 15 nt, Neisseria meningitidis Z2491
caaaaugccgccuga

SEQ ID NO: 3361719 - RNA, 16 nt, Neisseria meningitidis Z2491
caaaaugccgccugaa

SEQ ID NO: 3361720 - RNA, 22 nt, Neisseria meningitidis Z2491
caaaaugccgccugaacauuuc

SEQ ID NO: 3361721 - RNA, 21 nt, Neisseria meningitidis Z2491
caaaaugccguccgaaccgca

SEQ ID NO: 3361722 - RNA, 16 nt, Neisseria meningitidis Z2491
caaaaugccgucugaa

SEQ ID NO: 3361723 - RNA, 17 nt, Neisseria meningitidis Z2491
caaaaugccgucugaac

SEQ ID NO: 3361724 - RNA, 19 nt, Neisseria meningitidis Z2491
caaaaugccgucugaacga

SEQ ID NO: 3361725 - RNA, 19 nt, Neisseria meningitidis Z2491
caaaauguccguuuucuuc

SEQ ID NO: 3361726 - RNA, 15 nt, Neisseria meningitidis Z2491
caaaauguucagacg

SEQ ID NO: 3361727 - RNA, 13 nt, Neisseria meningitidis Z2491
caaaauuuauccg

SEQ ID NO: 3361728 - RNA, 21 nt, Neisseria meningitidis Z2491
caaaauuuauccgaaacaaca

SEQ ID NO: 3361729 - RNA, 22 nt, Neisseria meningitidis Z2491
caaaauuuauucuaaauagcug

SEQ ID NO: 3361730 - RNA, 21 nt, Neisseria meningitidis Z2491
caaacaaaauaucguuuucca

SEQ ID NO: 3361731 - RNA, 14 nt, Neisseria meningitidis Z2491
caaacaccagcauc

SEQ ID NO: 3361732 - RNA, 21 nt, Neisseria meningitidis Z2491
caaacagacggaauaggacaa

SEQ ID NO: 3361733 - RNA, 14 nt, Neisseria meningitidis Z2491
caaacaggcagccu

SEQ ID NO: 3361734 - RNA, 20 nt, Neisseria meningitidis Z2491
caaacaggcagccuaaaaca

SEQ ID NO: 3361735 - RNA, 22 nt, Neisseria meningitidis Z2491
caaacaggcagccuaaaacauc

SEQ ID NO: 3361736 - RNA, 13 nt, Neisseria meningitidis Z2491
caaacaucugauu

SEQ ID NO: 3361737 - RNA, 22 nt, Neisseria meningitidis Z2491
caaacaucugccguaauaggca

SEQ ID NO: 3361738 - RNA, 18 nt, Neisseria meningitidis Z2491
caaacaugggcuaaaaau

SEQ ID NO: 3361739 - RNA, 14 nt, Neisseria meningitidis Z2491
caaacauuacugaa

SEQ ID NO: 3361740 - RNA, 16 nt, Neisseria meningitidis Z2491
caaacauuacugaaau

SEQ ID NO: 3361741 - RNA, 17 nt, Neisseria meningitidis Z2491
caaacccaaugcuucaa

SEQ ID NO: 3361742 - RNA, 18 nt, Neisseria meningitidis Z2491
caaaccccucaacacacc

SEQ ID NO: 3361743 - RNA, 20 nt, Neisseria meningitidis Z2491
caaacccucggcauucccgc

SEQ ID NO: 3361744 - RNA, 19 nt, Neisseria meningitidis Z2491
caaacccuuuuucugccgc

SEQ ID NO: 3361745 - RNA, 22 nt, Neisseria meningitidis Z2491
caaaccgaugccgucauucccg

SEQ ID NO: 3361746 - RNA, 20 nt, Neisseria meningitidis Z2491
caaaccggcauucugcacgc

SEQ ID NO: 3361747 - RNA, 23 nt, Neisseria meningitidis Z2491
caaaccggcauucugcacgccga

SEQ ID NO: 3361748 - RNA, 20 nt, Neisseria meningitidis Z2491
caaaccgggcauucgggguu

SEQ ID NO: 3361749 - RNA, 17 nt, Neisseria meningitidis Z2491
caaaccgucauucccgc

SEQ ID NO: 3361750 - RNA, 11 nt, Neisseria meningitidis Z2491
caaaccucauu

SEQ ID NO: 3361751 - RNA, 16 nt, Neisseria meningitidis Z2491
caaacgccagcacaaa

SEQ ID NO: 3361752 - RNA, 21 nt, Neisseria meningitidis Z2491
caaacgccgcaaaccuuccgc

SEQ ID NO: 3361753 - RNA, 17 nt, Neisseria meningitidis Z2491
caaacgcugcauuuguu

SEQ ID NO: 3361754 - RNA, 14 nt, Neisseria meningitidis Z2491
caaacgggacugcc

SEQ ID NO: 3361755 - RNA, 17 nt, Neisseria meningitidis Z2491
caaacgguacaggaaag

SEQ ID NO: 3361756 - RNA, 18 nt, Neisseria meningitidis Z2491
caaacuaacuuauacaca

SEQ ID NO: 3361757 - RNA, 15 nt, Neisseria meningitidis Z2491
caaacuagauucccg

SEQ ID NO: 3361758 - RNA, 15 nt, Neisseria meningitidis Z2491
caaacuuccaaauca

SEQ ID NO: 3361759 - RNA, 22 nt, Neisseria meningitidis Z2491
caaacuuucggauaaucuuuga

SEQ ID NO: 3361760 - RNA, 15 nt, Neisseria meningitidis Z2491
caaagaaauguaaau

SEQ ID NO: 3361761 - RNA, 15 nt, Neisseria meningitidis Z2491
caaagacauccccca

SEQ ID NO: 3361762 - RNA, 14 nt, Neisseria meningitidis Z2491
caaagccggcggca

SEQ ID NO: 3361763 - RNA, 18 nt, Neisseria meningitidis Z2491
caaagccucgucauuucc

SEQ ID NO: 3361764 - RNA, 12 nt, Neisseria meningitidis Z2491
caaagccuucag

SEQ ID NO: 3361765 - RNA, 14 nt, Neisseria meningitidis Z2491
caaagcuuuaaacu

SEQ ID NO: 3361766 - RNA, 18 nt, Neisseria meningitidis Z2491
caaaggcagugccgccaa

SEQ ID NO: 3361767 - RNA, 19 nt, Neisseria meningitidis Z2491
caaaggccuggauucccgc

SEQ ID NO: 3361768 - RNA, 22 nt, Neisseria meningitidis Z2491
caaaggccuggauucccgccug

SEQ ID NO: 3361769 - RNA, 23 nt, Neisseria meningitidis Z2491
caaaggggacagacggccaaaca

SEQ ID NO: 3361770 - RNA, 23 nt, Neisseria meningitidis Z2491
caaaggucucauccuguuauuuu

SEQ ID NO: 3361771 - RNA, 17 nt, Neisseria meningitidis Z2491
caaaggucucuauuugu

SEQ ID NO: 3361772 - RNA, 23 nt, Neisseria meningitidis Z2491
caaagucauauuaauuauagugg

SEQ ID NO: 3361773 - RNA, 11 nt, Neisseria meningitidis Z2491
caaauaguacg

SEQ ID NO: 3361774 - RNA, 16 nt, Neisseria meningitidis Z2491
caaauaguacggcaag

SEQ ID NO: 3361775 - RNA, 17 nt, Neisseria meningitidis Z2491
caaauaguacggcaagg

SEQ ID NO: 3361776 - RNA, 13 nt, Neisseria meningitidis Z2491
caaauauuuccug

SEQ ID NO: 3361777 - RNA, 20 nt, Neisseria meningitidis Z2491
caaaucacgcccaaaucuug

SEQ ID NO: 3361778 - RNA, 17 nt, Neisseria meningitidis Z2491
caaaucaggguaaacag

SEQ ID NO: 3361779 - RNA, 18 nt, Neisseria meningitidis Z2491
caaaucaggguaaacagg

SEQ ID NO: 3361780 - RNA, 12 nt, Neisseria meningitidis Z2491
caaaucauacgu

SEQ ID NO: 3361781 - RNA, 17 nt, Neisseria meningitidis Z2491
caaauccccccuuaauc

SEQ ID NO: 3361782 - RNA, 16 nt, Neisseria meningitidis Z2491
caaaucccgucauucc

SEQ ID NO: 3361783 - RNA, 18 nt, Neisseria meningitidis Z2491
caaaucccgucauucccg

SEQ ID NO: 3361784 - RNA, 21 nt, Neisseria meningitidis Z2491
caaauccgugcgccguccgua

SEQ ID NO: 3361785 - RNA, 17 nt, Neisseria meningitidis Z2491
caaauccugaucgauac

SEQ ID NO: 3361786 - RNA, 22 nt, Neisseria meningitidis Z2491
caaaucgcccguuaccagcagu

SEQ ID NO: 3361787 - RNA, 23 nt, Neisseria meningitidis Z2491
caaaucggacggauguucaaaca

SEQ ID NO: 3361788 - RNA, 20 nt, Neisseria meningitidis Z2491
caaaucggauaggcaaaaac

SEQ ID NO: 3361789 - RNA, 21 nt, Neisseria meningitidis Z2491
caaaucggauaggcaaaaacc

SEQ ID NO: 3361790 - RNA, 17 nt, Neisseria meningitidis Z2491
caaaucggcuucagaca

SEQ ID NO: 3361791 - RNA, 18 nt, Neisseria meningitidis Z2491
caagauaugcguagcaau

SEQ ID NO: 3361792 - RNA, 23 nt, Neisseria meningitidis Z2491
caagauuuccgccgucauucccg

SEQ ID NO: 3361793 - RNA, 17 nt, Neisseria meningitidis Z2491
caagcaguugaaaucaa

SEQ ID NO: 3361794 - RNA, 15 nt, Neisseria meningitidis Z2491
caagcauaucgggca

SEQ ID NO: 3361795 - RNA, 18 nt, Neisseria meningitidis Z2491
caagccaagauaugcgua

SEQ ID NO: 3361796 - RNA, 16 nt, Neisseria meningitidis Z2491
caagcccugaaaggga

SEQ ID NO: 3361797 - RNA, 17 nt, Neisseria meningitidis Z2491
caagccgacuucuuuua

SEQ ID NO: 3361798 - RNA, 20 nt, Neisseria meningitidis Z2491
caagccgacuuuuuccagca

SEQ ID NO: 3361799 - RNA, 17 nt, Neisseria meningitidis Z2491
caagccgccgaugcgga

SEQ ID NO: 3361800 - RNA, 21 nt, Neisseria meningitidis Z2491
caagccggagccguucaaagu

SEQ ID NO: 3361801 - RNA, 19 nt, Neisseria meningitidis Z2491
caagccuguuuuccugccc

SEQ ID NO: 3361802 - RNA, 12 nt, Neisseria meningitidis Z2491
caagcgaugccg

SEQ ID NO: 3361803 - RNA, 15 nt, Neisseria meningitidis Z2491
caagcguguccugac

SEQ ID NO: 3361804 - RNA, 14 nt, Neisseria meningitidis Z2491
caagcuaaaauccc

SEQ ID NO: 3361805 - RNA, 14 nt, Neisseria meningitidis Z2491
caaggcaaggcaac

SEQ ID NO: 3361806 - RNA, 11 nt, Neisseria meningitidis Z2491
caaggcagcaa

SEQ ID NO: 3361807 - RNA, 14 nt, Neisseria meningitidis Z2491
caaggcagcaacga

SEQ ID NO: 3361808 - RNA, 12 nt, Neisseria meningitidis Z2491
caaggcaggcag

SEQ ID NO: 3361809 - RNA, 12 nt, Neisseria meningitidis Z2491
caaggcgacagc

SEQ ID NO: 3361810 - RNA, 15 nt, Neisseria meningitidis Z2491
caaggcgacagccgc

SEQ ID NO: 3361811 - RNA, 12 nt, Neisseria meningitidis Z2491
caaggcgacgaa

SEQ ID NO: 3361812 - RNA, 14 nt, Neisseria meningitidis Z2491
caaggcggcgagcc

SEQ ID NO: 3361813 - RNA, 13 nt, Neisseria meningitidis Z2491
caaggcggcggcg

SEQ ID NO: 3361814 - RNA, 23 nt, Neisseria meningitidis Z2491
caaggcggcggcguucaaaucau

SEQ ID NO: 3361815 - RNA, 23 nt, Neisseria meningitidis Z2491
caaggcggcgggauugugaucga

SEQ ID NO: 3361816 - RNA, 16 nt, Neisseria meningitidis Z2491
caaggcuggauucccg

SEQ ID NO: 3361817 - RNA, 22 nt, Neisseria meningitidis Z2491
caagggaaauccgccguaucca

SEQ ID NO: 3361818 - RNA, 23 nt, Neisseria meningitidis Z2491
caagguucggacggcguuuuuua

SEQ ID NO: 3361819 - RNA, 15 nt, Neisseria meningitidis Z2491
caagguugucugaaa

SEQ ID NO: 3361820 - RNA, 13 nt, Neisseria meningitidis Z2491
caaguuugccgcc

SEQ ID NO: 3361821 - RNA, 21 nt, Neisseria meningitidis Z2491
caauaaaccgucaaacaaaau

SEQ ID NO: 3361822 - RNA, 21 nt, Neisseria meningitidis Z2491
caauaacauagguuacuaaaa

SEQ ID NO: 3361823 - RNA, 18 nt, Neisseria meningitidis Z2491
caauaagucugcgaaaca

SEQ ID NO: 3361824 - RNA, 13 nt, Neisseria meningitidis Z2491
caauacaacaaaa

SEQ ID NO: 3361825 - RNA, 14 nt, Neisseria meningitidis Z2491
caauacaacaaaau

SEQ ID NO: 3361826 - RNA, 11 nt, Neisseria meningitidis Z2491
caauaccaaac

SEQ ID NO: 3361827 - RNA, 16 nt, Neisseria meningitidis Z2491
caauagccaaaaauuc

SEQ ID NO: 3361828 - RNA, 20 nt, Neisseria meningitidis Z2491
caauaggauaggucucuucc

SEQ ID NO: 3361829 - RNA, 16 nt, Neisseria meningitidis Z2491
caauauaacgacugua

SEQ ID NO: 3361830 - RNA, 21 nt, Neisseria meningitidis Z2491
caauauauugggcaacaccau

SEQ ID NO: 3361831 - RNA, 13 nt, Neisseria meningitidis Z2491
caauauccgacca

SEQ ID NO: 3361832 - RNA, 19 nt, Neisseria meningitidis Z2491
caauaugcggcaggccaaa

SEQ ID NO: 3361833 - RNA, 20 nt, Neisseria meningitidis Z2491
caauauggugcugauaacau

SEQ ID NO: 3361834 - RNA, 15 nt, Neisseria meningitidis Z2491
caauauuaagaaaaa

SEQ ID NO: 3361835 - RNA, 17 nt, Neisseria meningitidis Z2491
caauauucaaagauuau

SEQ ID NO: 3361836 - RNA, 21 nt, Neisseria meningitidis Z2491
caauauucuuugaaaacaggu

SEQ ID NO: 3361837 - RNA, 19 nt, Neisseria meningitidis Z2491
caauauugcuccugacggc

SEQ ID NO: 3361838 - RNA, 13 nt, Neisseria meningitidis Z2491
caaucaaaauaaa

SEQ ID NO: 3361839 - RNA, 14 nt, Neisseria meningitidis Z2491
caaucaagaagaaa

SEQ ID NO: 3361840 - RNA, 23 nt, Neisseria meningitidis Z2491
caaucacgucaggcacgcgcugc

SEQ ID NO: 3361841 - RNA, 20 nt, Neisseria meningitidis Z2491
caaucagaauacugccugua

SEQ ID NO: 3361842 - RNA, 18 nt, Neisseria meningitidis Z2491
caaucagaucggcaaacc

SEQ ID NO: 3361843 - RNA, 15 nt, Neisseria meningitidis Z2491
caauccauucccucu

SEQ ID NO: 3361844 - RNA, 18 nt, Neisseria meningitidis Z2491
caaucccgcaggauuuua

SEQ ID NO: 3361845 - RNA, 20 nt, Neisseria meningitidis Z2491
caauccgcccgaauaaaaaa

SEQ ID NO: 3361846 - RNA, 21 nt, Neisseria meningitidis Z2491
caauccgcccgaauaaaaaau

SEQ ID NO: 3361847 - RNA, 22 nt, Neisseria meningitidis Z2491
caauccggucuuggcagcagau

SEQ ID NO: 3361848 - RNA, 11 nt, Neisseria meningitidis Z2491
caauccugccg

SEQ ID NO: 3361849 - RNA, 22 nt, Neisseria meningitidis Z2491
caaucgagauaaguguuggaca

SEQ ID NO: 3361850 - RNA, 18 nt, Neisseria meningitidis Z2491
caaucggcucgccgccuu

SEQ ID NO: 3361851 - RNA, 22 nt, Neisseria meningitidis Z2491
caaucguuucugucgccagcau

SEQ ID NO: 3361852 - RNA, 23 nt, Neisseria meningitidis Z2491
caaucucaaaucccgucauuccc

SEQ ID NO: 3361853 - RNA, 17 nt, Neisseria meningitidis Z2491
caaucucauuuucaaaa

SEQ ID NO: 3361854 - RNA, 21 nt, Neisseria meningitidis Z2491
caaucucauuuucaaaaugca

SEQ ID NO: 3361855 - RNA, 14 nt, Neisseria meningitidis Z2491
caaucugaaauuuu

SEQ ID NO: 3361856 - RNA, 12 nt, Neisseria meningitidis Z2491
caaucugcaucg

SEQ ID NO: 3361857 - RNA, 22 nt, Neisseria meningitidis Z2491
caaucuggucgccguucaaagu

SEQ ID NO: 3361858 - RNA, 21 nt, Neisseria meningitidis Z2491
caaucuuauuuucaaaaugca

SEQ ID NO: 3361859 - RNA, 14 nt, Neisseria meningitidis Z2491
caaugaaaauuugg

SEQ ID NO: 3361860 - RNA, 15 nt, Neisseria meningitidis Z2491
caaugacugcgggcu

SEQ ID NO: 3361861 - RNA, 18 nt, Neisseria meningitidis Z2491
caaugacugcgggcuuug

SEQ ID NO: 3361862 - RNA, 13 nt, Neisseria meningitidis Z2491
caaugcaaaaaca

SEQ ID NO: 3361863 - RNA, 15 nt, Neisseria meningitidis Z2491
caaugcaaaaacauc

SEQ ID NO: 3361864 - RNA, 19 nt, Neisseria meningitidis Z2491
caaugcaaaaacaucagcc

SEQ ID NO: 3361865 - RNA, 16 nt, Neisseria meningitidis Z2491
caaugcccgcaagcgu

SEQ ID NO: 3361866 - RNA, 15 nt, Neisseria meningitidis Z2491
caaugccgucugaaa

SEQ ID NO: 3361867 - RNA, 17 nt, Neisseria meningitidis Z2491
caaugccgucugaaacc

SEQ ID NO: 3361868 - RNA, 15 nt, Neisseria meningitidis Z2491
caaugccgucugaau

SEQ ID NO: 3361869 - RNA, 14 nt, Neisseria meningitidis Z2491
caaugccguuaaug

SEQ ID NO: 3361870 - RNA, 17 nt, Neisseria meningitidis Z2491
caaugcgccgauuuucc

SEQ ID NO: 3361871 - RNA, 14 nt, Neisseria meningitidis Z2491
caaugcuaaggcaa

SEQ ID NO: 3361872 - RNA, 16 nt, Neisseria meningitidis Z2491
caaugcuaaggcaauu

SEQ ID NO: 3361873 - RNA, 19 nt, Neisseria meningitidis Z2491
caaugcuaaggcaauuuau

SEQ ID NO: 3361874 - RNA, 17 nt, Neisseria meningitidis Z2491
caaugugcccgaaggga

SEQ ID NO: 3361875 - RNA, 16 nt, Neisseria meningitidis Z2491
caauuaaaaacaaaau

SEQ ID NO: 3361876 - RNA, 12 nt, Neisseria meningitidis Z2491
caauucaaaauu

SEQ ID NO: 3361877 - RNA, 15 nt, Neisseria meningitidis Z2491
caauucacuuggugc

SEQ ID NO: 3361878 - RNA, 23 nt, Neisseria meningitidis Z2491
caauucgcguucguucucguaca

SEQ ID NO: 3361879 - RNA, 22 nt, Neisseria meningitidis Z2491
caauucuucuuuauauucgacc

SEQ ID NO: 3361880 - RNA, 18 nt, Neisseria meningitidis Z2491
caauugaaaaauuuuugg

SEQ ID NO: 3361881 - RNA, 17 nt, Neisseria meningitidis Z2491
caauugaaaauuuuuug

SEQ ID NO: 3361882 - RNA, 21 nt, Neisseria meningitidis Z2491
caauuuaucgggaaugacuga

SEQ ID NO: 3361883 - RNA, 21 nt, Neisseria meningitidis Z2491
caauuucaaaucccgucauuc

SEQ ID NO: 3361884 - RNA, 23 nt, Neisseria meningitidis Z2491
caauuucaaaucccgucauuccc

SEQ ID NO: 3361885 - RNA, 15 nt, Neisseria meningitidis Z2491
caauuuuuuaaaugu

SEQ ID NO: 3361886 - RNA, 19 nt, Neisseria meningitidis Z2491
cacaaaaaacuucccgucc

SEQ ID NO: 3361887 - RNA, 15 nt, Neisseria meningitidis Z2491
cacaaaagauacaca

SEQ ID NO: 3361888 - RNA, 16 nt, Neisseria meningitidis Z2491
cacaaaagauacacac

SEQ ID NO: 3361889 - RNA, 17 nt, Neisseria meningitidis Z2491
cacaaaagauacacaca

SEQ ID NO: 3361890 - RNA, 17 nt, Neisseria meningitidis Z2491
cacaaacgccagcacaa

SEQ ID NO: 3361891 - RNA, 20 nt, Neisseria meningitidis Z2491
cacaaacgccagcacaaaca

SEQ ID NO: 3361892 - RNA, 16 nt, Neisseria meningitidis Z2491
cagaaaaccaaaauca

SEQ ID NO: 3361893 - RNA, 18 nt, Neisseria meningitidis Z2491
cagaaaacgccgucugaa

SEQ ID NO: 3361894 - RNA, 16 nt, Neisseria meningitidis Z2491
cagaaaauugaaauuc

SEQ ID NO: 3361895 - RNA, 14 nt, Neisseria meningitidis Z2491
cagaaaauuucuug

SEQ ID NO: 3361896 - RNA, 15 nt, Neisseria meningitidis Z2491
cagaaaauuucuuga

SEQ ID NO: 3361897 - RNA, 23 nt, Neisseria meningitidis Z2491
cagaaaauuucuugauuuuucug

SEQ ID NO: 3361898 - RNA, 23 nt, Neisseria meningitidis Z2491
cagaaaccacccugccgucauuc

SEQ ID NO: 3361899 - RNA, 17 nt, Neisseria meningitidis Z2491
cagaaaccuaaaauccg

SEQ ID NO: 3361900 - RNA, 17 nt, Neisseria meningitidis Z2491
cagaaaccuaaaauucg

SEQ ID NO: 3361901 - RNA, 18 nt, Neisseria meningitidis Z2491
cagaaagcaaaaccgccg

SEQ ID NO: 3361902 - RNA, 17 nt, Neisseria meningitidis Z2491
cagaaaguggaauugag

SEQ ID NO: 3361903 - RNA, 13 nt, Neisseria meningitidis Z2491
cagaaauaaggau

SEQ ID NO: 3361904 - RNA, 11 nt, Neisseria meningitidis Z2491
cagaaaugacu

SEQ ID NO: 3361905 - RNA, 14 nt, Neisseria meningitidis Z2491
cagaaaugacugaa

SEQ ID NO: 3361906 - RNA, 22 nt, Neisseria meningitidis Z2491
cagaaaugacugaaauucaaaa

SEQ ID NO: 3361907 - RNA, 19 nt, Neisseria meningitidis Z2491
cagaaauuuauaaacaaaa

SEQ ID NO: 3361908 - RNA, 22 nt, Neisseria meningitidis Z2491
cagaaccuacagauuccgaagg

SEQ ID NO: 3361909 - RNA, 19 nt, Neisseria meningitidis Z2491
cagaacgguuucuguuuuu

SEQ ID NO: 3361910 - RNA, 18 nt, Neisseria meningitidis Z2491
cagaacguaaaaucugaa

SEQ ID NO: 3361911 - RNA, 19 nt, Neisseria meningitidis Z2491
cagaacguaaaaucugaag

SEQ ID NO: 3361912 - RNA, 21 nt, Neisseria meningitidis Z2491
cagaacguaaaaucugaagaa

SEQ ID NO: 3361913 - RNA, 18 nt, Neisseria meningitidis Z2491
cagaaggggcggaaugcg

SEQ ID NO: 3361914 - RNA, 16 nt, Neisseria meningitidis Z2491
cagaaguuacucgaaa

SEQ ID NO: 3361915 - RNA, 15 nt, Neisseria meningitidis Z2491
cagaaucaaauauua

SEQ ID NO: 3361916 - RNA, 15 nt, Neisseria meningitidis Z2491
cagaaucugcaugag

SEQ ID NO: 3361917 - RNA, 16 nt, Neisseria meningitidis Z2491
cagaaugauaacccaa

SEQ ID NO: 3361918 - RNA, 18 nt, Neisseria meningitidis Z2491
cagacaaucagaucggca

SEQ ID NO: 3361919 - RNA, 18 nt, Neisseria meningitidis Z2491
cagacagcccucuugccu

SEQ ID NO: 3361920 - RNA, 13 nt, Neisseria meningitidis Z2491
cagacaggauucg

SEQ ID NO: 3361921 - RNA, 16 nt, Neisseria meningitidis Z2491
cagacaguacaaauag

SEQ ID NO: 3361922 - RNA, 13 nt, Neisseria meningitidis Z2491
cagacaguacaga

SEQ ID NO: 3361923 - RNA, 14 nt, Neisseria meningitidis Z2491
cagacauuaaaaaa

SEQ ID NO: 3361924 - RNA, 21 nt, Neisseria meningitidis Z2491
cagacauuaaaaaauacauug

SEQ ID NO: 3361925 - RNA, 18 nt, Neisseria meningitidis Z2491
cagacauugcuaaaacaa

SEQ ID NO: 3361926 - RNA, 17 nt, Neisseria meningitidis Z2491
cagaccuagauucccgc

SEQ ID NO: 3361927 - RNA, 18 nt, Neisseria meningitidis Z2491
cagacggcaucaaaaacu

SEQ ID NO: 3361928 - RNA, 15 nt, Neisseria meningitidis Z2491
cagacggcaucagua

SEQ ID NO: 3361929 - RNA, 18 nt, Neisseria meningitidis Z2491
cagacggcauccgcuuaa

SEQ ID NO: 3361930 - RNA, 17 nt, Neisseria meningitidis Z2491
cagacggcaucuuuuuu

SEQ ID NO: 3361931 - RNA, 20 nt, Neisseria meningitidis Z2491
cagacggcauuugacuuuca

SEQ ID NO: 3361932 - RNA, 16 nt, Neisseria meningitidis Z2491
cagacggcauuugucc

SEQ ID NO: 3361933 - RNA, 14 nt, Neisseria meningitidis Z2491
cagacggcauuuug

SEQ ID NO: 3361934 - RNA, 19 nt, Neisseria meningitidis Z2491
cagacggcauuuuuauugc

SEQ ID NO: 3361935 - RNA, 16 nt, Neisseria meningitidis Z2491
cagacggcauuuuugu

SEQ ID NO: 3361936 - RNA, 12 nt, Neisseria meningitidis Z2491
cagacggccaaa

SEQ ID NO: 3361937 - RNA, 18 nt, Neisseria meningitidis Z2491
cagacggccuuuuugcuu

SEQ ID NO: 3361938 - RNA, 13 nt, Neisseria meningitidis Z2491
cagacggucugcc

SEQ ID NO: 3361939 - RNA, 14 nt, Neisseria meningitidis Z2491
cagacggucugcca

SEQ ID NO: 3361940 - RNA, 19 nt, Neisseria meningitidis Z2491
cagacguucggcaaaaucc

SEQ ID NO: 3361941 - RNA, 19 nt, Neisseria meningitidis Z2491
cagagagccgcaggcaaau

SEQ ID NO: 3361942 - RNA, 18 nt, Neisseria meningitidis Z2491
cagagccucuucgcgcgc

SEQ ID NO: 3361943 - RNA, 19 nt, Neisseria meningitidis Z2491
cagagcgguuucuguuuuu

SEQ ID NO: 3361944 - RNA, 19 nt, Neisseria meningitidis Z2491
cagaggcggaaucgaaccg

SEQ ID NO: 3361945 - RNA, 19 nt, Neisseria meningitidis Z2491
cagagggaaagugauuuug

SEQ ID NO: 3361946 - RNA, 17 nt, Neisseria meningitidis Z2491
cagagguguuggaauca

SEQ ID NO: 3361947 - RNA, 13 nt, Neisseria meningitidis Z2491
cagauacaacaaa

SEQ ID NO: 3361948 - RNA, 17 nt, Neisseria meningitidis Z2491
cagauagcgcggacggc

SEQ ID NO: 3361949 - RNA, 18 nt, Neisseria meningitidis Z2491
cagauagcgcggacggcg

SEQ ID NO: 3361950 - RNA, 22 nt, Neisseria meningitidis Z2491
cagauagcugaacugcuugaau

SEQ ID NO: 3361951 - RNA, 20 nt, Neisseria meningitidis Z2491
cagauaguugcgguaauuuc

SEQ ID NO: 3361952 - RNA, 16 nt, Neisseria meningitidis Z2491
cagaugccgucugaaa

SEQ ID NO: 3361953 - RNA, 16 nt, Neisseria meningitidis Z2491
cagauggccuuuacuc

SEQ ID NO: 3361954 - RNA, 17 nt, Neisseria meningitidis Z2491
cagauggcguuaccaau

SEQ ID NO: 3361955 - RNA, 20 nt, Neisseria meningitidis Z2491
cagaugugguggacgaugag

SEQ ID NO: 3361956 - RNA, 15 nt, Neisseria meningitidis Z2491
cagauucaacgcaag

SEQ ID NO: 3361957 - RNA, 18 nt, Neisseria meningitidis Z2491
cagauuccgaauaccauu

SEQ ID NO: 3361958 - RNA, 22 nt, Neisseria meningitidis Z2491
cagauucuacguucuagauucc

SEQ ID NO: 3361959 - RNA, 16 nt, Neisseria meningitidis Z2491
cagauucuugucaaac

SEQ ID NO: 3361960 - RNA, 12 nt, Neisseria meningitidis Z2491
cagauugaggau

SEQ ID NO: 3361961 - RNA, 15 nt, Neisseria meningitidis Z2491
cagauugucaaaaua

SEQ ID NO: 3361962 - RNA, 17 nt, Neisseria meningitidis Z2491
cagauuuuggagcagua

SEQ ID NO: 3361963 - RNA, 19 nt, Neisseria meningitidis Z2491
cagcaaaauauggcugacu

SEQ ID NO: 3361964 - RNA, 16 nt, Neisseria meningitidis Z2491
cagcaacauuuccugc

SEQ ID NO: 3361965 - RNA, 18 nt, Neisseria meningitidis Z2491
cagcaacauuuccugcau

SEQ ID NO: 3361966 - RNA, 12 nt, Neisseria meningitidis Z2491
cagcaaccugaa

SEQ ID NO: 3361967 - RNA, 16 nt, Neisseria meningitidis Z2491
cagcaacgacagcagc

SEQ ID NO: 3361968 - RNA, 18 nt, Neisseria meningitidis Z2491
cagcaacgacagcagcag

SEQ ID NO: 3361969 - RNA, 21 nt, Neisseria meningitidis Z2491
cagcaagacuuuuucgcgcac

SEQ ID NO: 3361970 - RNA, 13 nt, Neisseria meningitidis Z2491
cagcaauaaaaua

SEQ ID NO: 3361971 - RNA, 14 nt, Neisseria meningitidis Z2491
cagcaauaaaauaa

SEQ ID NO: 3361972 - RNA, 12 nt, Neisseria meningitidis Z2491
cagcaaucaggg

SEQ ID NO: 3361973 - RNA, 16 nt, Neisseria meningitidis Z2491
cagcaaucagggccuu

SEQ ID NO: 3361974 - RNA, 14 nt, Neisseria meningitidis Z2491
cagcacaaacagca

SEQ ID NO: 3361975 - RNA, 16 nt, Neisseria meningitidis Z2491
cagcacaaacagcaug

SEQ ID NO: 3361976 - RNA, 14 nt, Neisseria meningitidis Z2491
cagcacaaaugcca

SEQ ID NO: 3361977 - RNA, 18 nt, Neisseria meningitidis Z2491
cagcacaaaugccaaagg

SEQ ID NO: 3361978 - RNA, 22 nt, Neisseria meningitidis Z2491
cagcacaaaugccaaaggcagu

SEQ ID NO: 3361979 - RNA, 16 nt, Neisseria meningitidis Z2491
cagcacaucgucugca

SEQ ID NO: 3361980 - RNA, 16 nt, Neisseria meningitidis Z2491
cagcaccgauggauuu

SEQ ID NO: 3361981 - RNA, 20 nt, Neisseria meningitidis Z2491
cagcaccguuuaaaacagca

SEQ ID NO: 3361982 - RNA, 23 nt, Neisseria meningitidis Z2491
cagcaccguuuaaaacagcauug

SEQ ID NO: 3361983 - RNA, 17 nt, Neisseria meningitidis Z2491
cagcacgauacacaaaa

SEQ ID NO: 3361984 - RNA, 21 nt, Neisseria meningitidis Z2491
cagcacguguuccaaacgccg

SEQ ID NO: 3361985 - RNA, 12 nt, Neisseria meningitidis Z2491
cagcacugccuc

SEQ ID NO: 3361986 - RNA, 21 nt, Neisseria meningitidis Z2491
cagcagaaucuguugcggccc

SEQ ID NO: 3361987 - RNA, 22 nt, Neisseria meningitidis Z2491
cagcagcaacacauugccaccg

SEQ ID NO: 3361988 - RNA, 15 nt, Neisseria meningitidis Z2491
cagcagcccucccca

SEQ ID NO: 3361989 - RNA, 17 nt, Neisseria meningitidis Z2491
cagcagcccuugcccca

SEQ ID NO: 3361990 - RNA, 17 nt, Neisseria meningitidis Z2491
cagcaggaaggcggcaa

SEQ ID NO: 3361991 - RNA, 20 nt, Neisseria meningitidis Z2491
cagcaggggauugccgcccc

SEQ ID NO: 3361992 - RNA, 21 nt, Neisseria meningitidis Z2491
cagcaggggauugccgccccu

SEQ ID NO: 3361993 - RNA, 13 nt, Neisseria meningitidis Z2491
cagcauaacaccu

SEQ ID NO: 3361994 - RNA, 23 nt, Neisseria meningitidis Z2491
caguguauucgacgcgcuugaug

SEQ ID NO: 3361995 - RNA, 22 nt, Neisseria meningitidis Z2491
caguguugcgucgaaguggcug

SEQ ID NO: 3361996 - RNA, 14 nt, Neisseria meningitidis Z2491
caguguuucagacg

SEQ ID NO: 3361997 - RNA, 18 nt, Neisseria meningitidis Z2491
caguguuucagacggccu

SEQ ID NO: 3361998 - RNA, 16 nt, Neisseria meningitidis Z2491
caguucagacggcauu

SEQ ID NO: 3361999 - RNA, 14 nt, Neisseria meningitidis Z2491
caguuccaaagccu

SEQ ID NO: 3362000 - RNA, 14 nt, Neisseria meningitidis Z2491
caguucggcaaacg

SEQ ID NO: 3362001 - RNA, 17 nt, Neisseria meningitidis Z2491
caguucgucgaaacggc

SEQ ID NO: 3362002 - RNA, 17 nt, Neisseria meningitidis Z2491
caguugaaaucaacaga

SEQ ID NO: 3362003 - RNA, 12 nt, Neisseria meningitidis Z2491
caguuggaacag

SEQ ID NO: 3362004 - RNA, 13 nt, Neisseria meningitidis Z2491
caguuggaacagc

SEQ ID NO: 3362005 - RNA, 18 nt, Neisseria meningitidis Z2491
caguugggaaucaaauac

SEQ ID NO: 3362006 - RNA, 16 nt, Neisseria meningitidis Z2491
caguuuccaauacaac

SEQ ID NO: 3362007 - RNA, 19 nt, Neisseria meningitidis Z2491
caguuuccaauacaacaaa

SEQ ID NO: 3362008 - RNA, 17 nt, Neisseria meningitidis Z2491
caguuucggucauuucc

SEQ ID NO: 3362009 - RNA, 17 nt, Neisseria meningitidis Z2491
caguuucuugaguuuca

SEQ ID NO: 3362010 - RNA, 13 nt, Neisseria meningitidis Z2491
caguuugaugccg

SEQ ID NO: 3362011 - RNA, 12 nt, Neisseria meningitidis Z2491
caguuuuugucu

SEQ ID NO: 3362012 - RNA, 20 nt, Neisseria meningitidis Z2491
cauaaaauaugccgucugaa

SEQ ID NO: 3362013 - RNA, 17 nt, Neisseria meningitidis Z2491
cauaaaaugccgucuga

SEQ ID NO: 3362014 - RNA, 15 nt, Neisseria meningitidis Z2491
cauaaagagcaggac

SEQ ID NO: 3362015 - RNA, 14 nt, Neisseria meningitidis Z2491
cauaaaucaacagc

SEQ ID NO: 3362016 - RNA, 16 nt, Neisseria meningitidis Z2491
cauaaaucaacagcag

SEQ ID NO: 3362017 - RNA, 15 nt, Neisseria meningitidis Z2491
cauaaaugccgucug

SEQ ID NO: 3362018 - RNA, 16 nt, Neisseria meningitidis Z2491
cauaaaugccgucuga

SEQ ID NO: 3362019 - RNA, 22 nt, Neisseria meningitidis Z2491
cauaaaugcguuuugacaaaau

SEQ ID NO: 3362020 - RNA, 14 nt, Neisseria meningitidis Z2491
cauaaauuuuaaau

SEQ ID NO: 3362021 - RNA, 18 nt, Neisseria meningitidis Z2491
cauaaauuuuaaauaaau

SEQ ID NO: 3362022 - RNA, 22 nt, Neisseria meningitidis Z2491
cauaaauuuuaaauaaaucaag

SEQ ID NO: 3362023 - RNA, 13 nt, Neisseria meningitidis Z2491
cauaacacaccca

SEQ ID NO: 3362024 - RNA, 12 nt, Neisseria meningitidis Z2491
cauaacccaaac

SEQ ID NO: 3362025 - RNA, 15 nt, Neisseria meningitidis Z2491
cauaaccgaaaccug

SEQ ID NO: 3362026 - RNA, 18 nt, Neisseria meningitidis Z2491
cauaaccgcuugacgcua

SEQ ID NO: 3362027 - RNA, 21 nt, Neisseria meningitidis Z2491
cauaagccgccaucaaagccc

SEQ ID NO: 3362028 - RNA, 16 nt, Neisseria meningitidis Z2491
cauaaguguauucgga

SEQ ID NO: 3362029 - RNA, 12 nt, Neisseria meningitidis Z2491
cauaauaaaaau

SEQ ID NO: 3362030 - RNA, 13 nt, Neisseria meningitidis Z2491
cauaauaaaaaua

SEQ ID NO: 3362031 - RNA, 17 nt, Neisseria meningitidis Z2491
cauaaucaauuaaaaac

SEQ ID NO: 3362032 - RNA, 18 nt, Neisseria meningitidis Z2491
cauaaucaauuaaaaaca

SEQ ID NO: 3362033 - RNA, 19 nt, Neisseria meningitidis Z2491
cauaaucaauuaaaaacaa

SEQ ID NO: 3362034 - RNA, 22 nt, Neisseria meningitidis Z2491
cauaaucugcggcaguuuuucu

SEQ ID NO: 3362035 - RNA, 18 nt, Neisseria meningitidis Z2491
cauaaugcccaaaccgcc

SEQ ID NO: 3362036 - RNA, 16 nt, Neisseria meningitidis Z2491
cauaccccacugccag

SEQ ID NO: 3362037 - RNA, 21 nt, Neisseria meningitidis Z2491
cauaccgaugaugacggucag

SEQ ID NO: 3362038 - RNA, 20 nt, Neisseria meningitidis Z2491
cauaccgccccuaaaaugcc

SEQ ID NO: 3362039 - RNA, 21 nt, Neisseria meningitidis Z2491
cauaccgccccuaaaaugccc

SEQ ID NO: 3362040 - RNA, 17 nt, Neisseria meningitidis Z2491
cauaccgccuucaucaa

SEQ ID NO: 3362041 - RNA, 21 nt, Neisseria meningitidis Z2491
cauaccgccuucaucaaaauc

SEQ ID NO: 3362042 - RNA, 20 nt, Neisseria meningitidis Z2491
cauaccguugcgugucuucg

SEQ ID NO: 3362043 - RNA, 19 nt, Neisseria meningitidis Z2491
cauaccucccaauccugca

SEQ ID NO: 3362044 - RNA, 23 nt, Neisseria meningitidis Z2491
cauacuacgcggcugaaaaaaug

SEQ ID NO: 3362045 - RNA, 18 nt, Neisseria meningitidis Z2491
cauacugugggaaacuuu

SEQ ID NO: 3362046 - RNA, 17 nt, Neisseria meningitidis Z2491
cauagacuguaccaaau

SEQ ID NO: 3362047 - RNA, 22 nt, Neisseria meningitidis Z2491
cauagacuguaccaaauuauug

SEQ ID NO: 3362048 - RNA, 23 nt, Neisseria meningitidis Z2491
cauagacuguaccaaauuauugc

SEQ ID NO: 3362049 - RNA, 16 nt, Neisseria meningitidis Z2491
cauagccuucacgcac

SEQ ID NO: 3362050 - RNA, 20 nt, Neisseria meningitidis Z2491
cauagcguguauuuugguag

SEQ ID NO: 3362051 - RNA, 16 nt, Neisseria meningitidis Z2491
cauagguuacuaaaau

SEQ ID NO: 3362052 - RNA, 21 nt, Neisseria meningitidis Z2491
cauagguuacuaaaauuuuau

SEQ ID NO: 3362053 - RNA, 17 nt, Neisseria meningitidis Z2491
cauaguuuggacggcgg

SEQ ID NO: 3362054 - RNA, 20 nt, Neisseria meningitidis Z2491
cauauaacaccuuucaauca

SEQ ID NO: 3362055 - RNA, 23 nt, Neisseria meningitidis Z2491
cauaucaacgcgggaauagcuca

SEQ ID NO: 3362056 - RNA, 17 nt, Neisseria meningitidis Z2491
cauauccggcgcggcaa

SEQ ID NO: 3362057 - RNA, 16 nt, Neisseria meningitidis Z2491
cauaucgagguuguuc

SEQ ID NO: 3362058 - RNA, 17 nt, Neisseria meningitidis Z2491
cauaucgagguuguuca

SEQ ID NO: 3362059 - RNA, 15 nt, Neisseria meningitidis Z2491
cauaucggcaaucac

SEQ ID NO: 3362060 - RNA, 18 nt, Neisseria meningitidis Z2491
cauauguuuuuuccuguu

SEQ ID NO: 3362061 - RNA, 22 nt, Neisseria meningitidis Z2491
cauauuccggugcgaccguaug

SEQ ID NO: 3362062 - RNA, 21 nt, Neisseria meningitidis Z2491
cauauugacggacggcggcag

SEQ ID NO: 3362063 - RNA, 23 nt, Neisseria meningitidis Z2491
cauauugcccaacagcagcauaa

SEQ ID NO: 3362064 - RNA, 14 nt, Neisseria meningitidis Z2491
cauauuugaaccug

SEQ ID NO: 3362065 - RNA, 16 nt, Neisseria meningitidis Z2491
cauauuugaaccugac

SEQ ID NO: 3362066 - RNA, 16 nt, Neisseria meningitidis Z2491
caucaaaaaggcuuug

SEQ ID NO: 3362067 - RNA, 16 nt, Neisseria meningitidis Z2491
caucacaauggcggaa

SEQ ID NO: 3362068 - RNA, 18 nt, Neisseria meningitidis Z2491
caucacguuuuccaaggc

SEQ ID NO: 3362069 - RNA, 17 nt, Neisseria meningitidis Z2491
caucacuccgucuuuca

SEQ ID NO: 3362070 - RNA, 21 nt, Neisseria meningitidis Z2491
caucacuccgucuuucauuuu

SEQ ID NO: 3362071 - RNA, 15 nt, Neisseria meningitidis Z2491
caucagauugauaaa

SEQ ID NO: 3362072 - RNA, 21 nt, Neisseria meningitidis Z2491
caucagcaccacuguugccac

SEQ ID NO: 3362073 - RNA, 15 nt, Neisseria meningitidis Z2491
caucaggaaugcaaa

SEQ ID NO: 3362074 - RNA, 20 nt, Neisseria meningitidis Z2491
caucaggcggcguucuucuu

SEQ ID NO: 3362075 - RNA, 21 nt, Neisseria meningitidis Z2491
caucauccugcuuuaauucuc

SEQ ID NO: 3362076 - RNA, 20 nt, Neisseria meningitidis Z2491
caucaugcggaagaagugcg

SEQ ID NO: 3362077 - RNA, 12 nt, Neisseria meningitidis Z2491
caucauucccac

SEQ ID NO: 3362078 - RNA, 13 nt, Neisseria meningitidis Z2491
cauccacagccgc

SEQ ID NO: 3362079 - RNA, 20 nt, Neisseria meningitidis Z2491
cauccauaaucaaaaccagc

SEQ ID NO: 3362080 - RNA, 20 nt, Neisseria meningitidis Z2491
cauccauacggaaaccugca

SEQ ID NO: 3362081 - RNA, 21 nt, Neisseria meningitidis Z2491
caucccaaaaacgaagagcgg

SEQ ID NO: 3362082 - RNA, 22 nt, Neisseria meningitidis Z2491
cauccccgcgaaagcgggaauc

SEQ ID NO: 3362083 - RNA, 17 nt, Neisseria meningitidis Z2491
cauccgaauaugccaga

SEQ ID NO: 3362084 - RNA, 23 nt, Neisseria meningitidis Z2491
cauccgaccgccccgucauuccc

SEQ ID NO: 3362085 - RNA, 18 nt, Neisseria meningitidis Z2491
cauccgcuuaaaaaacaa

SEQ ID NO: 3362086 - RNA, 22 nt, Neisseria meningitidis Z2491
cauccgcuuaaaaaacaacuga

SEQ ID NO: 3362087 - RNA, 19 nt, Neisseria meningitidis Z2491
cauccgggcugcuuuuuag

SEQ ID NO: 3362088 - RNA, 17 nt, Neisseria meningitidis Z2491
caucgagugugggguag

SEQ ID NO: 3362089 - RNA, 18 nt, Neisseria meningitidis Z2491
caucgccgcaccccgacc

SEQ ID NO: 3362090 - RNA, 11 nt, Neisseria meningitidis Z2491
caucgccgccg

SEQ ID NO: 3362091 - RNA, 16 nt, Neisseria meningitidis Z2491
caucgccgcuucaucu

SEQ ID NO: 3362092 - RNA, 20 nt, Neisseria meningitidis Z2491
caucgcgcccaauucuucuu

SEQ ID NO: 3362093 - RNA, 18 nt, Neisseria meningitidis Z2491
caucgcucaaauucuguu

SEQ ID NO: 3362094 - RNA, 21 nt, Neisseria meningitidis Z2491
caucggacaagggaaauccgc

SEQ ID NO: 3362095 - RNA, 19 nt, Neisseria meningitidis Z2491
cauuugcacacguuugccg

SEQ ID NO: 3362096 - RNA, 21 nt, Neisseria meningitidis Z2491
cauuugcacacguuugccguu

SEQ ID NO: 3362097 - RNA, 16 nt, Neisseria meningitidis Z2491
cauuugcgcagccugc

SEQ ID NO: 3362098 - RNA, 14 nt, Neisseria meningitidis Z2491
cauuuggaaagccg

SEQ ID NO: 3362099 - RNA, 13 nt, Neisseria meningitidis Z2491
cauuuggcagcug

SEQ ID NO: 3362100 - RNA, 19 nt, Neisseria meningitidis Z2491
cauuuguuccaauuccugu

SEQ ID NO: 3362101 - RNA, 18 nt, Neisseria meningitidis Z2491
ccacucggauuaauccga

SEQ ID NO: 3362102 - RNA, 16 nt, Neisseria meningitidis Z2491
ccacugccagccgccg

SEQ ID NO: 3362103 - RNA, 20 nt, Neisseria meningitidis Z2491
ccacuuuuuucaagccuugc

SEQ ID NO: 3362104 - RNA, 19 nt, Neisseria meningitidis Z2491
ccagaacguaaaaucugaa

SEQ ID NO: 3362105 - RNA, 17 nt, Neisseria meningitidis Z2491
ccagacggcauuuuuca

SEQ ID NO: 3362106 - RNA, 18 nt, Neisseria meningitidis Z2491
ccagacggcauuuuucau

SEQ ID NO: 3362107 - RNA, 16 nt, Neisseria meningitidis Z2491
ccagaggcggaaucga

SEQ ID NO: 3362108 - RNA, 12 nt, Neisseria meningitidis Z2491
ccagagggaaag

SEQ ID NO: 3362109 - RNA, 13 nt, Neisseria meningitidis Z2491
ccagagggaaagu

SEQ ID NO: 3362110 - RNA, 11 nt, Neisseria meningitidis Z2491
ccagauuccca

SEQ ID NO: 3362111 - RNA, 16 nt, Neisseria meningitidis Z2491
ccagcaacauuuccug

SEQ ID NO: 3362112 - RNA, 20 nt, Neisseria meningitidis Z2491
ccagcaacauuuccugcauc

SEQ ID NO: 3362113 - RNA, 16 nt, Neisseria meningitidis Z2491
ccagcaaugccgucug

SEQ ID NO: 3362114 - RNA, 17 nt, Neisseria meningitidis Z2491
ccagcaaugcgucuucc

SEQ ID NO: 3362115 - RNA, 21 nt, Neisseria meningitidis Z2491
ccagcagcaacacauugccac

SEQ ID NO: 3362116 - RNA, 12 nt, Neisseria meningitidis Z2491
ccagcagcagcc

SEQ ID NO: 3362117 - RNA, 13 nt, Neisseria meningitidis Z2491
ccagcagcagccc

SEQ ID NO: 3362118 - RNA, 17 nt, Neisseria meningitidis Z2491
ccagcagcccuugcccc

SEQ ID NO: 3362119 - RNA, 14 nt, Neisseria meningitidis Z2491
ccagccagccguau

SEQ ID NO: 3362120 - RNA, 12 nt, Neisseria meningitidis Z2491
ccagcccgccgc

SEQ ID NO: 3362121 - RNA, 22 nt, Neisseria meningitidis Z2491
ccagccguauuugucuuccgcc

SEQ ID NO: 3362122 - RNA, 22 nt, Neisseria meningitidis Z2491
ccagcgcaccguuuucaagccu

SEQ ID NO: 3362123 - RNA, 19 nt, Neisseria meningitidis Z2491
ccagcgugcggacguucaa

SEQ ID NO: 3362124 - RNA, 23 nt, Neisseria meningitidis Z2491
ccaggcguauauggcugucuuug

SEQ ID NO: 3362125 - RNA, 21 nt, Neisseria meningitidis Z2491
ccaguccuacccaaaaggaag

SEQ ID NO: 3362126 - RNA, 22 nt, Neisseria meningitidis Z2491
ccaguuccuccacuaaaaaauc

SEQ ID NO: 3362127 - RNA, 15 nt, Neisseria meningitidis Z2491
ccauaaauuuuaaau

SEQ ID NO: 3362128 - RNA, 18 nt, Neisseria meningitidis Z2491
ccauacaaacaggcuuca

SEQ ID NO: 3362129 - RNA, 21 nt, Neisseria meningitidis Z2491
ccauacaaacaggcuucagac

SEQ ID NO: 3362130 - RNA, 19 nt, Neisseria meningitidis Z2491
ccauaccguuuggcggcau

SEQ ID NO: 3362131 - RNA, 19 nt, Neisseria meningitidis Z2491
ccauagauaaauuucagau

SEQ ID NO: 3362132 - RNA, 16 nt, Neisseria meningitidis Z2491
ccauauggaaaaaucu

SEQ ID NO: 3362133 - RNA, 20 nt, Neisseria meningitidis Z2491
ccaucaauuuccacaauuca

SEQ ID NO: 3362134 - RNA, 13 nt, Neisseria meningitidis Z2491
ccaucagcacgcc

SEQ ID NO: 3362135 - RNA, 14 nt, Neisseria meningitidis Z2491
ccaucagcacgccg

SEQ ID NO: 3362136 - RNA, 15 nt, Neisseria meningitidis Z2491
ccaucagcacgccgc

SEQ ID NO: 3362137 - RNA, 13 nt, Neisseria meningitidis Z2491
ccaucaggaaugc

SEQ ID NO: 3362138 - RNA, 21 nt, Neisseria meningitidis Z2491
ccaucaggaaugcaaaccggc

SEQ ID NO: 3362139 - RNA, 22 nt, Neisseria meningitidis Z2491
ccaucaguuuccacuaaaugcu

SEQ ID NO: 3362140 - RNA, 15 nt, Neisseria meningitidis Z2491
ccaucccaaaaacga

SEQ ID NO: 3362141 - RNA, 21 nt, Neisseria meningitidis Z2491
ccaucccauauuccacaguga

SEQ ID NO: 3362142 - RNA, 22 nt, Neisseria meningitidis Z2491
ccauccgcacggaaaccugcac

SEQ ID NO: 3362143 - RNA, 17 nt, Neisseria meningitidis Z2491
ccaucgagcugccuuuu

SEQ ID NO: 3362144 - RNA, 18 nt, Neisseria meningitidis Z2491
ccaucgcaaucauggcgc

SEQ ID NO: 3362145 - RNA, 18 nt, Neisseria meningitidis Z2491
ccaucggcaaaguuauuc

SEQ ID NO: 3362146 - RNA, 21 nt, Neisseria meningitidis Z2491
ccaucuacauaaacaggcgcg

SEQ ID NO: 3362147 - RNA, 11 nt, Neisseria meningitidis Z2491
ccaugauuuuu

SEQ ID NO: 3362148 - RNA, 14 nt, Neisseria meningitidis Z2491
ccaugcuauucaaa

SEQ ID NO: 3362149 - RNA, 19 nt, Neisseria meningitidis Z2491
ccauggaaaccaagggcag

SEQ ID NO: 3362150 - RNA, 19 nt, Neisseria meningitidis Z2491
ccaugucgaacaguucuuu

SEQ ID NO: 3362151 - RNA, 15 nt, Neisseria meningitidis Z2491
ccauuacaaaugcuc

SEQ ID NO: 3362152 - RNA, 22 nt, Neisseria meningitidis Z2491
ccauuauuuucacaaaaacaga

SEQ ID NO: 3362153 - RNA, 21 nt, Neisseria meningitidis Z2491
ccauucccguaauuaccgaaa

SEQ ID NO: 3362154 - RNA, 14 nt, Neisseria meningitidis Z2491
ccauucuugcaaaa

SEQ ID NO: 3362155 - RNA, 13 nt, Neisseria meningitidis Z2491
ccauuguuucuga

SEQ ID NO: 3362156 - RNA, 15 nt, Neisseria meningitidis Z2491
ccauuuccaaaccca

SEQ ID NO: 3362157 - RNA, 14 nt, Neisseria meningitidis Z2491
ccauuugagccgca

SEQ ID NO: 3362158 - RNA, 15 nt, Neisseria meningitidis Z2491
ccauuugagccgcac

SEQ ID NO: 3362159 - RNA, 16 nt, Neisseria meningitidis Z2491
cccaaaaagaggcaua

SEQ ID NO: 3362160 - RNA, 19 nt, Neisseria meningitidis Z2491
cccaaaaggaagucaugcc

SEQ ID NO: 3362161 - RNA, 20 nt, Neisseria meningitidis Z2491
cccaaacaaucccaccaugg

SEQ ID NO: 3362162 - RNA, 11 nt, Neisseria meningitidis Z2491
cccaaacacag

SEQ ID NO: 3362163 - RNA, 23 nt, Neisseria meningitidis Z2491
cccaaacaucgcucaaauucugu

SEQ ID NO: 3362164 - RNA, 20 nt, Neisseria meningitidis Z2491
cccaauauuaagaaaaacag

SEQ ID NO: 3362165 - RNA, 19 nt, Neisseria meningitidis Z2491
cccaaugacugcccguccc

SEQ ID NO: 3362166 - RNA, 17 nt, Neisseria meningitidis Z2491
cccaaugccgucugaau

SEQ ID NO: 3362167 - RNA, 22 nt, Neisseria meningitidis Z2491
cccaauguuucaacgccucgcc

SEQ ID NO: 3362168 - RNA, 13 nt, Neisseria meningitidis Z2491
cccaauuccugcg

SEQ ID NO: 3362169 - RNA, 17 nt, Neisseria meningitidis Z2491
cccacaaauccugcugc

SEQ ID NO: 3362170 - RNA, 20 nt, Neisseria meningitidis Z2491
cccacaagcuaaaaucccau

SEQ ID NO: 3362171 - RNA, 16 nt, Neisseria meningitidis Z2491
cccaccauuguuuccg

SEQ ID NO: 3362172 - RNA, 15 nt, Neisseria meningitidis Z2491
cccaccguuucccau

SEQ ID NO: 3362173 - RNA, 20 nt, Neisseria meningitidis Z2491
cccaccguuucccaucaucc

SEQ ID NO: 3362174 - RNA, 21 nt, Neisseria meningitidis Z2491
cccacgaaagugggaauccag

SEQ ID NO: 3362175 - RNA, 21 nt, Neisseria meningitidis Z2491
cccacgaaaguuggaauccag

SEQ ID NO: 3362176 - RNA, 14 nt, Neisseria meningitidis Z2491
cccacgcacccaaa

SEQ ID NO: 3362177 - RNA, 16 nt, Neisseria meningitidis Z2491
cccacgcaggcgggaa

SEQ ID NO: 3362178 - RNA, 13 nt, Neisseria meningitidis Z2491
cccacggaagugg

SEQ ID NO: 3362179 - RNA, 24 nt, Neisseria meningitidis Z2491
cccacggaagugggaaucuagaaa

SEQ ID NO: 3362180 - RNA, 20 nt, Neisseria meningitidis Z2491
cccacgggacuuugcggcug

SEQ ID NO: 3362181 - RNA, 16 nt, Neisseria meningitidis Z2491
cccacuuccgugggaa

SEQ ID NO: 3362182 - RNA, 20 nt, Neisseria meningitidis Z2491
cccacuuuugugggaaugac

SEQ ID NO: 3362183 - RNA, 23 nt, Neisseria meningitidis Z2491
cccauacuacgcggcugaaaaaa

SEQ ID NO: 3362184 - RNA, 15 nt, Neisseria meningitidis Z2491
cccauaugccgucug

SEQ ID NO: 3362185 - RNA, 20 nt, Neisseria meningitidis Z2491
cccauaugguguugaugccg

SEQ ID NO: 3362186 - RNA, 17 nt, Neisseria meningitidis Z2491
cccaucgccucuucaau

SEQ ID NO: 3362187 - RNA, 17 nt, Neisseria meningitidis Z2491
cccaucgucuagaggcc

SEQ ID NO: 3362188 - RNA, 13 nt, Neisseria meningitidis Z2491
cccauuacggcaa

SEQ ID NO: 3362189 - RNA, 19 nt, Neisseria meningitidis Z2491
cccauucccacgcgcccau

SEQ ID NO: 3362190 - RNA, 15 nt, Neisseria meningitidis Z2491
cccauugccacgccg

SEQ ID NO: 3362191 - RNA, 18 nt, Neisseria meningitidis Z2491
cccauuuggagucgccuu

SEQ ID NO: 3362192 - RNA, 19 nt, Neisseria meningitidis Z2491
cccauuuguagggcgugcc

SEQ ID NO: 3362193 - RNA, 19 nt, Neisseria meningitidis Z2491
ccccacugccagccgccga

SEQ ID NO: 3362194 - RNA, 16 nt, Neisseria meningitidis Z2491
ccccaguucuucgaug

SEQ ID NO: 3362195 - RNA, 13 nt, Neisseria meningitidis Z2491
cccccaccgccgc

SEQ ID NO: 3362196 - RNA, 11 nt, Neisseria meningitidis Z2491
cccccgcgcag

SEQ ID NO: 3362197 - RNA, 14 nt, Neisseria meningitidis Z2491
ccccgugaaaaaau

SEQ ID NO: 3362198 - RNA, 11 nt, Neisseria meningitidis Z2491
ccccguucccu

SEQ ID NO: 3362199 - RNA, 17 nt, Neisseria meningitidis Z2491
ccccguucccuguacca

SEQ ID NO: 3362200 - RNA, 14 nt, Neisseria meningitidis Z2491
ccccuaaaaugccc

SEQ ID NO: 3362201 - RNA, 17 nt, Neisseria meningitidis Z2491
ccccuaaaggcuucaga

SEQ ID NO: 3362202 - RNA, 15 nt, Neisseria meningitidis Z2491
ccccucaacacacca

SEQ ID NO: 3362203 - RNA, 22 nt, Neisseria meningitidis Z2491
ccccuguaaacagauaaaacca

SEQ ID NO: 3362204 - RNA, 19 nt, Neisseria meningitidis Z2491
ccccuuaugccuuuuucaa

SEQ ID NO: 3362205 - RNA, 15 nt, Neisseria meningitidis Z2491
ccccuuuaacggcaa

SEQ ID NO: 3362206 - RNA, 18 nt, Neisseria meningitidis Z2491
cccgaaauaggcugcccg

SEQ ID NO: 3362207 - RNA, 13 nt, Neisseria meningitidis Z2491
cccgaaauuccaa

SEQ ID NO: 3362208 - RNA, 15 nt, Neisseria meningitidis Z2491
cccgaaccaaaccgu

SEQ ID NO: 3362209 - RNA, 21 nt, Neisseria meningitidis Z2491
cccgaauccacgcucaaacac

SEQ ID NO: 3362210 - RNA, 16 nt, Neisseria meningitidis Z2491
cccgacaaaauaccgu

SEQ ID NO: 3362211 - RNA, 18 nt, Neisseria meningitidis Z2491
cccgacgcuugucccaca

SEQ ID NO: 3362212 - RNA, 17 nt, Neisseria meningitidis Z2491
cccgagaaaacagaaag

SEQ ID NO: 3362213 - RNA, 16 nt, Neisseria meningitidis Z2491
cccgagauuacagaaa

SEQ ID NO: 3362214 - RNA, 13 nt, Neisseria meningitidis Z2491
cccgauaaaugcc

SEQ ID NO: 3362215 - RNA, 21 nt, Neisseria meningitidis Z2491
cccgauucgaacgggcggaua

SEQ ID NO: 3362216 - RNA, 18 nt, Neisseria meningitidis Z2491
cccgcagccggggcaggc

SEQ ID NO: 3362217 - RNA, 15 nt, Neisseria meningitidis Z2491
cccgccgaucugccc

SEQ ID NO: 3362218 - RNA, 16 nt, Neisseria meningitidis Z2491
cccgccuacgcgggaa

SEQ ID NO: 3362219 - RNA, 20 nt, Neisseria meningitidis Z2491
cccgccuacgcgggaaugac

SEQ ID NO: 3362220 - RNA, 20 nt, Neisseria meningitidis Z2491
cccgccugcgcgggaaugac

SEQ ID NO: 3362221 - RNA, 20 nt, Neisseria meningitidis Z2491
cccgccuucgcgggaaugac

SEQ ID NO: 3362222 - RNA, 18 nt, Neisseria meningitidis Z2491
cccgcgaaagcgggaauc

SEQ ID NO: 3362223 - RNA, 17 nt, Neisseria meningitidis Z2491
cccgcgagaacagaaaa

SEQ ID NO: 3362224 - RNA, 13 nt, Neisseria meningitidis Z2491
cccgcgcaggcgg

SEQ ID NO: 3362225 - RNA, 20 nt, Neisseria meningitidis Z2491
cccgcuuucacgggaaugac

SEQ ID NO: 3362226 - RNA, 20 nt, Neisseria meningitidis Z2491
cccgcuuucgcgggaaugac

SEQ ID NO: 3362227 - RNA, 22 nt, Neisseria meningitidis Z2491
cccgguuggaaggcggcggcaa

SEQ ID NO: 3362228 - RNA, 14 nt, Neisseria meningitidis Z2491
cccgucauucccac

SEQ ID NO: 3362229 - RNA, 17 nt, Neisseria meningitidis Z2491
cccgucauucccacgca

SEQ ID NO: 3362230 - RNA, 20 nt, Neisseria meningitidis Z2491
cccgucauucccgcaaaagc

SEQ ID NO: 3362231 - RNA, 16 nt, Neisseria meningitidis Z2491
cccgucauucccgcca

SEQ ID NO: 3362232 - RNA, 13 nt, Neisseria meningitidis Z2491
cccgucauucccu

SEQ ID NO: 3362233 - RNA, 19 nt, Neisseria meningitidis Z2491
cccgucauuccucaaaaac

SEQ ID NO: 3362234 - RNA, 16 nt, Neisseria meningitidis Z2491
cccgucccgaugccgc

SEQ ID NO: 3362235 - RNA, 18 nt, Neisseria meningitidis Z2491
cccgugaaaacgggaauc

SEQ ID NO: 3362236 - RNA, 18 nt, Neisseria meningitidis Z2491
cccgugcaggcgggaauc

SEQ ID NO: 3362237 - RNA, 17 nt, Neisseria meningitidis Z2491
cccguuaaggcagagau

SEQ ID NO: 3362238 - RNA, 19 nt, Neisseria meningitidis Z2491
cccguuauuuucacaaaaa

SEQ ID NO: 3362239 - RNA, 21 nt, Neisseria meningitidis Z2491
cccguuccacaauauccgacc

SEQ ID NO: 3362240 - RNA, 16 nt, Neisseria meningitidis Z2491
cccguuucagacggca

SEQ ID NO: 3362241 - RNA, 20 nt, Neisseria meningitidis Z2491
cccguuuucacgggaaugac

SEQ ID NO: 3362242 - RNA, 20 nt, Neisseria meningitidis Z2491
cccguuuuuacgggaaugac

SEQ ID NO: 3362243 - RNA, 21 nt, Neisseria meningitidis Z2491
cccuaaaggcuucagacggca

SEQ ID NO: 3362244 - RNA, 17 nt, Neisseria meningitidis Z2491
cccuaccauuguuucug

SEQ ID NO: 3362245 - RNA, 17 nt, Neisseria meningitidis Z2491
cccucaaaaacagaaaa

SEQ ID NO: 3362246 - RNA, 22 nt, Neisseria meningitidis Z2491
cccucaauucuucgaucaucca

SEQ ID NO: 3362247 - RNA, 23 nt, Neisseria meningitidis Z2491
cccucccgacagccgaaacccaa

SEQ ID NO: 3362248 - RNA, 16 nt, Neisseria meningitidis Z2491
cccuccugcgcgggaa

SEQ ID NO: 3362249 - RNA, 21 nt, Neisseria meningitidis Z2491
cccucgaagcggcagagcaag

SEQ ID NO: 3362250 - RNA, 21 nt, Neisseria meningitidis Z2491
cccucggauggggugcggcac

SEQ ID NO: 3362251 - RNA, 22 nt, Neisseria meningitidis Z2491
cccucggauggggugcggcacg

SEQ ID NO: 3362252 - RNA, 21 nt, Neisseria meningitidis Z2491
cccucuucgaugacugccuua

SEQ ID NO: 3362253 - RNA, 12 nt, Neisseria meningitidis Z2491
cccugaaaggga

SEQ ID NO: 3362254 - RNA, 20 nt, Neisseria meningitidis Z2491
cccugauuucgcuuucgggc

SEQ ID NO: 3362255 - RNA, 15 nt, Neisseria meningitidis Z2491
cccugccgcuucaca

SEQ ID NO: 3362256 - RNA, 18 nt, Neisseria meningitidis Z2491
cccuguuucgggcaaaag

SEQ ID NO: 3362257 - RNA, 19 nt, Neisseria meningitidis Z2491
cccuguuucgggcaaaagc

SEQ ID NO: 3362258 - RNA, 20 nt, Neisseria meningitidis Z2491
cccuguuucgggcaaaagcc

SEQ ID NO: 3362259 - RNA, 23 nt, Neisseria meningitidis Z2491
cccuguuucgggcaaaagccagc

SEQ ID NO: 3362260 - RNA, 15 nt, Neisseria meningitidis Z2491
cccuuaauccucucc

SEQ ID NO: 3362261 - RNA, 17 nt, Neisseria meningitidis Z2491
cccuuaucccaauauua

SEQ ID NO: 3362262 - RNA, 15 nt, Neisseria meningitidis Z2491
cccuuucagacggca

SEQ ID NO: 3362263 - RNA, 17 nt, Neisseria meningitidis Z2491
cccuuucagacggcauu

SEQ ID NO: 3362264 - RNA, 16 nt, Neisseria meningitidis Z2491
cccuuuuguaaaggaa

SEQ ID NO: 3362265 - RNA, 13 nt, Neisseria meningitidis Z2491
ccgaaaaaauaau

SEQ ID NO: 3362266 - RNA, 15 nt, Neisseria meningitidis Z2491
ccgaaaacaaagggu

SEQ ID NO: 3362267 - RNA, 19 nt, Neisseria meningitidis Z2491
ccgaaaauaauugccuuuu

SEQ ID NO: 3362268 - RNA, 13 nt, Neisseria meningitidis Z2491
ccgaaacagaaac

SEQ ID NO: 3362269 - RNA, 14 nt, Neisseria meningitidis Z2491
ccgaaaccaaaagc

SEQ ID NO: 3362270 - RNA, 17 nt, Neisseria meningitidis Z2491
ccgaaaccaaaagccaa

SEQ ID NO: 3362271 - RNA, 22 nt, Neisseria meningitidis Z2491
ccgaaauaucggcaacaccgcu

SEQ ID NO: 3362272 - RNA, 13 nt, Neisseria meningitidis Z2491
ccgaaaucaucca

SEQ ID NO: 3362273 - RNA, 20 nt, Neisseria meningitidis Z2491
ccgaaaugccgucauucccg

SEQ ID NO: 3362274 - RNA, 19 nt, Neisseria meningitidis Z2491
ccgaaaugguuuaagagcu

SEQ ID NO: 3362275 - RNA, 15 nt, Neisseria meningitidis Z2491
ccgaacaccagugcg

SEQ ID NO: 3362276 - RNA, 16 nt, Neisseria meningitidis Z2491
ccgaacacgauggcgc

SEQ ID NO: 3362277 - RNA, 22 nt, Neisseria meningitidis Z2491
ccgaacggacuagauucccgcc

SEQ ID NO: 3362278 - RNA, 18 nt, Neisseria meningitidis Z2491
ccgaagcauaagccgcca

SEQ ID NO: 3362279 - RNA, 19 nt, Neisseria meningitidis Z2491
ccgaagcauaagccgccau

SEQ ID NO: 3362280 - RNA, 22 nt, Neisseria meningitidis Z2491
ccgaagcgacaacaaucuuuuc

SEQ ID NO: 3362281 - RNA, 17 nt, Neisseria meningitidis Z2491
ccgaaggacagaugucc

SEQ ID NO: 3362282 - RNA, 12 nt, Neisseria meningitidis Z2491
ccgaagggaaag

SEQ ID NO: 3362283 - RNA, 13 nt, Neisseria meningitidis Z2491
ccgaagggaaagc

SEQ ID NO: 3362284 - RNA, 14 nt, Neisseria meningitidis Z2491
ccgaaguuuaaaga

SEQ ID NO: 3362285 - RNA, 14 nt, Neisseria meningitidis Z2491
ccgaauaaaaaaua

SEQ ID NO: 3362286 - RNA, 13 nt, Neisseria meningitidis Z2491
ccgaauaaccgcu

SEQ ID NO: 3362287 - RNA, 19 nt, Neisseria meningitidis Z2491
ccgaauauccccagugcga

SEQ ID NO: 3362288 - RNA, 20 nt, Neisseria meningitidis Z2491
ccgaauauuuccucacugcc

SEQ ID NO: 3362289 - RNA, 22 nt, Neisseria meningitidis Z2491
ccgaaugaugccgugccggcgg

SEQ ID NO: 3362290 - RNA, 23 nt, Neisseria meningitidis Z2491
ccgacaaaauaccgucugaaacc

SEQ ID NO: 3362291 - RNA, 20 nt, Neisseria meningitidis Z2491
ccgacaaaucgguacgcagc

SEQ ID NO: 3362292 - RNA, 14 nt, Neisseria meningitidis Z2491
ccgacacaaugaaa

SEQ ID NO: 3362293 - RNA, 22 nt, Neisseria meningitidis Z2491
ccgacacaaugaaaguuugccg

SEQ ID NO: 3362294 - RNA, 17 nt, Neisseria meningitidis Z2491
ccgacagugcggacacc

SEQ ID NO: 3362295 - RNA, 21 nt, Neisseria meningitidis Z2491
ccgacccugccgucugaaacc

SEQ ID NO: 3362296 - RNA, 23 nt, Neisseria meningitidis Z2491
ccgacggcguaauccgccugcgc

SEQ ID NO: 3362297 - RNA, 14 nt, Neisseria meningitidis Z2491
ccgacugccgccgc

SEQ ID NO: 3362298 - RNA, 21 nt, Neisseria meningitidis Z2491
ccgacuggauggcgcguuuga

SEQ ID NO: 3362299 - RNA, 15 nt, Neisseria meningitidis Z2491
ccgacuucugacagc

SEQ ID NO: 3362300 - RNA, 17 nt, Neisseria meningitidis Z2491
ccgacuucugacagcau

SEQ ID NO: 3362301 - RNA, 20 nt, Neisseria meningitidis Z2491
ccgacuucuuuuaagaacgu

SEQ ID NO: 3362302 - RNA, 15 nt, Neisseria meningitidis Z2491
ccgagaaaacagaaa

SEQ ID NO: 3362303 - RNA, 18 nt, Neisseria meningitidis Z2491
ccgagauuacagaaaccu

SEQ ID NO: 3362304 - RNA, 15 nt, Neisseria meningitidis Z2491
ccgagcaggacggcu

SEQ ID NO: 3362305 - RNA, 20 nt, Neisseria meningitidis Z2491
ccgucauuccuguaaaaaca

SEQ ID NO: 3362306 - RNA, 22 nt, Neisseria meningitidis Z2491
ccguccgaaccgcaaaugcugu

SEQ ID NO: 3362307 - RNA, 20 nt, Neisseria meningitidis Z2491
ccgucgccauaaucagcccg

SEQ ID NO: 3362308 - RNA, 14 nt, Neisseria meningitidis Z2491
ccgucgggauucag

SEQ ID NO: 3362309 - RNA, 18 nt, Neisseria meningitidis Z2491
ccgucgggcaucugcagc

SEQ ID NO: 3362310 - RNA, 18 nt, Neisseria meningitidis Z2491
ccgucuaaacgguauuca

SEQ ID NO: 3362311 - RNA, 13 nt, Neisseria meningitidis Z2491
ccgucugaaaaac

SEQ ID NO: 3362312 - RNA, 15 nt, Neisseria meningitidis Z2491
ccgucugaaaagaua

SEQ ID NO: 3362313 - RNA, 14 nt, Neisseria meningitidis Z2491
ccgucugaaaccgc

SEQ ID NO: 3362314 - RNA, 20 nt, Neisseria meningitidis Z2491
ccgucugaaacggcggcagg

SEQ ID NO: 3362315 - RNA, 18 nt, Neisseria meningitidis Z2491
ccgucugaaacgggaauc

SEQ ID NO: 3362316 - RNA, 12 nt, Neisseria meningitidis Z2491
ccgucugaaauc

SEQ ID NO: 3362317 - RNA, 22 nt, Neisseria meningitidis Z2491
ccgucugaacccgauuggauuc

SEQ ID NO: 3362318 - RNA, 21 nt, Neisseria meningitidis Z2491
ccgucugaagauauuggaaca

SEQ ID NO: 3362319 - RNA, 14 nt, Neisseria meningitidis Z2491
ccgucugaagcccu

SEQ ID NO: 3362320 - RNA, 15 nt, Neisseria meningitidis Z2491
ccgucugaagcccug

SEQ ID NO: 3362321 - RNA, 19 nt, Neisseria meningitidis Z2491
ccgucugaagcccugccug

SEQ ID NO: 3362322 - RNA, 19 nt, Neisseria meningitidis Z2491
ccgucugaagccuucagac

SEQ ID NO: 3362323 - RNA, 19 nt, Neisseria meningitidis Z2491
ccgucugaaguuucugccc

SEQ ID NO: 3362324 - RNA, 19 nt, Neisseria meningitidis Z2491
ccgucuguuuucgacgccc

SEQ ID NO: 3362325 - RNA, 15 nt, Neisseria meningitidis Z2491
ccgucuugggaaaug

SEQ ID NO: 3362326 - RNA, 16 nt, Neisseria meningitidis Z2491
ccgugaugccccaaua

SEQ ID NO: 3362327 - RNA, 17 nt, Neisseria meningitidis Z2491
ccgugccgacaaaaccc

SEQ ID NO: 3362328 - RNA, 14 nt, Neisseria meningitidis Z2491
ccgugcgccguccg

SEQ ID NO: 3362329 - RNA, 18 nt, Neisseria meningitidis Z2491
ccgugcggcacgccgccg

SEQ ID NO: 3362330 - RNA, 13 nt, Neisseria meningitidis Z2491
ccgugggaaugac

SEQ ID NO: 3362331 - RNA, 16 nt, Neisseria meningitidis Z2491
ccguguguauagugga

SEQ ID NO: 3362332 - RNA, 20 nt, Neisseria meningitidis Z2491
ccguguucggguacaaccaa

SEQ ID NO: 3362333 - RNA, 22 nt, Neisseria meningitidis Z2491
ccguuauuuucacaaaaacaga

SEQ ID NO: 3362334 - RNA, 11 nt, Neisseria meningitidis Z2491
ccguucaauuu

SEQ ID NO: 3362335 - RNA, 20 nt, Neisseria meningitidis Z2491
ccguugcagccaugcggcaa

SEQ ID NO: 3362336 - RNA, 19 nt, Neisseria meningitidis Z2491
ccguugcucuaccaacuga

SEQ ID NO: 3362337 - RNA, 15 nt, Neisseria meningitidis Z2491
ccguuucagacggca

SEQ ID NO: 3362338 - RNA, 16 nt, Neisseria meningitidis Z2491
ccguuucagacggcau

SEQ ID NO: 3362339 - RNA, 20 nt, Neisseria meningitidis Z2491
ccguuucaggaauuugcggc

SEQ ID NO: 3362340 - RNA, 14 nt, Neisseria meningitidis Z2491
ccguuucccaucau

SEQ ID NO: 3362341 - RNA, 20 nt, Neisseria meningitidis Z2491
ccguuuccuccucgccgucu

SEQ ID NO: 3362342 - RNA, 14 nt, Neisseria meningitidis Z2491
ccguuugcggguuu

SEQ ID NO: 3362343 - RNA, 13 nt, Neisseria meningitidis Z2491
ccguuuucaagcc

SEQ ID NO: 3362344 - RNA, 19 nt, Neisseria meningitidis Z2491
ccguuuucacgggaaugac

SEQ ID NO: 3362345 - RNA, 19 nt, Neisseria meningitidis Z2491
ccguuuuucauggcgacga

SEQ ID NO: 3362346 - RNA, 15 nt, Neisseria meningitidis Z2491
ccuaaaaccuuccua

SEQ ID NO: 3362347 - RNA, 20 nt, Neisseria meningitidis Z2491
ccuaaaauccgucauucccg

SEQ ID NO: 3362348 - RNA, 20 nt, Neisseria meningitidis Z2491
ccuaaaauucgucauuccca

SEQ ID NO: 3362349 - RNA, 21 nt, Neisseria meningitidis Z2491
ccuaaaauuucgucauucccg

SEQ ID NO: 3362350 - RNA, 13 nt, Neisseria meningitidis Z2491
ccuaaaggcuuca

SEQ ID NO: 3362351 - RNA, 19 nt, Neisseria meningitidis Z2491
ccuaaauacggcaauagaa

SEQ ID NO: 3362352 - RNA, 15 nt, Neisseria meningitidis Z2491
ccuaaccgaaaaaau

SEQ ID NO: 3362353 - RNA, 17 nt, Neisseria meningitidis Z2491
ccuaaccgaaaaaauaa

SEQ ID NO: 3362354 - RNA, 15 nt, Neisseria meningitidis Z2491
ccuaauguacuucug

SEQ ID NO: 3362355 - RNA, 19 nt, Neisseria meningitidis Z2491
ccuacgaaccuacauuccg

SEQ ID NO: 3362356 - RNA, 21 nt, Neisseria meningitidis Z2491
ccuauaguggauuaacaaaaa

SEQ ID NO: 3362357 - RNA, 14 nt, Neisseria meningitidis Z2491
ccuaucacuuccag

SEQ ID NO: 3362358 - RNA, 15 nt, Neisseria meningitidis Z2491
ccucacugccgccaa

SEQ ID NO: 3362359 - RNA, 17 nt, Neisseria meningitidis Z2491
ccucacugccgccaauc

SEQ ID NO: 3362360 - RNA, 16 nt, Neisseria meningitidis Z2491
ccucagccaccagcgg

SEQ ID NO: 3362361 - RNA, 12 nt, Neisseria meningitidis Z2491
ccucagccaucu

SEQ ID NO: 3362362 - RNA, 20 nt, Neisseria meningitidis Z2491
ccucaucguucaacagcagc

SEQ ID NO: 3362363 - RNA, 21 nt, Neisseria meningitidis Z2491
ccucaucguucaacagcagcg

SEQ ID NO: 3362364 - RNA, 22 nt, Neisseria meningitidis Z2491
ccuccaucagcacgccgccugc

SEQ ID NO: 3362365 - RNA, 20 nt, Neisseria meningitidis Z2491
ccucccaauguuucaacgcc

SEQ ID NO: 3362366 - RNA, 15 nt, Neisseria meningitidis Z2491
ccuccucgccgucuu

SEQ ID NO: 3362367 - RNA, 19 nt, Neisseria meningitidis Z2491
ccucgccgucuuucaggaa

SEQ ID NO: 3362368 - RNA, 13 nt, Neisseria meningitidis Z2491
ccucgccuuagcu

SEQ ID NO: 3362369 - RNA, 17 nt, Neisseria meningitidis Z2491
ccucgcggcucgcccac

SEQ ID NO: 3362370 - RNA, 20 nt, Neisseria meningitidis Z2491
ccucggauggggugcggcac

SEQ ID NO: 3362371 - RNA, 18 nt, Neisseria meningitidis Z2491
ccucgucauuuccacaaa

SEQ ID NO: 3362372 - RNA, 18 nt, Neisseria meningitidis Z2491
ccucguucggacggcauu

SEQ ID NO: 3362373 - RNA, 15 nt, Neisseria meningitidis Z2491
ccucugccagcuccg

SEQ ID NO: 3362374 - RNA, 22 nt, Neisseria meningitidis Z2491
ccucuuggauaaacauuuuugc

SEQ ID NO: 3362375 - RNA, 14 nt, Neisseria meningitidis Z2491
ccucuuuaaauuua

SEQ ID NO: 3362376 - RNA, 22 nt, Neisseria meningitidis Z2491
ccugaaacggacaaaccgccau

SEQ ID NO: 3362377 - RNA, 23 nt, Neisseria meningitidis Z2491
ccugaaauaugguucagacggca

SEQ ID NO: 3362378 - RNA, 20 nt, Neisseria meningitidis Z2491
ccugaaauucgucauucccg

SEQ ID NO: 3362379 - RNA, 18 nt, Neisseria meningitidis Z2491
ccugaaccuuauagugga

SEQ ID NO: 3362380 - RNA, 19 nt, Neisseria meningitidis Z2491
ccugaauaaaacgcgugca

SEQ ID NO: 3362381 - RNA, 15 nt, Neisseria meningitidis Z2491
ccugacaaauucccg

SEQ ID NO: 3362382 - RNA, 14 nt, Neisseria meningitidis Z2491
ccugacgcuccagc

SEQ ID NO: 3362383 - RNA, 13 nt, Neisseria meningitidis Z2491
ccugagcaaaugc

SEQ ID NO: 3362384 - RNA, 17 nt, Neisseria meningitidis Z2491
ccugagcaaaugccuua

SEQ ID NO: 3362385 - RNA, 23 nt, Neisseria meningitidis Z2491
ccugauaaaugccgcaaucucaa

SEQ ID NO: 3362386 - RNA, 22 nt, Neisseria meningitidis Z2491
ccugauacagccacgccaaaaa

SEQ ID NO: 3362387 - RNA, 17 nt, Neisseria meningitidis Z2491
ccugaucuaaaaauucu

SEQ ID NO: 3362388 - RNA, 17 nt, Neisseria meningitidis Z2491
ccugaugauuuuuucaa

SEQ ID NO: 3362389 - RNA, 22 nt, Neisseria meningitidis Z2491
ccugauucucaugaucuucuua

SEQ ID NO: 3362390 - RNA, 12 nt, Neisseria meningitidis Z2491
ccugauuuuugu

SEQ ID NO: 3362391 - RNA, 22 nt, Neisseria meningitidis Z2491
ccugcaaugcacuacuucauuu

SEQ ID NO: 3362392 - RNA, 20 nt, Neisseria meningitidis Z2491
ccugcaccacgucauuccca

SEQ ID NO: 3362393 - RNA, 20 nt, Neisseria meningitidis Z2491
ccugcaccgcgucauuccca

SEQ ID NO: 3362394 - RNA, 23 nt, Neisseria meningitidis Z2491
ccugcagauugaggaucuugaug

SEQ ID NO: 3362395 - RNA, 18 nt, Neisseria meningitidis Z2491
ccugcccgacagccgcaa

SEQ ID NO: 3362396 - RNA, 21 nt, Neisseria meningitidis Z2491
ccugccguauuuauuuccgcc

SEQ ID NO: 3362397 - RNA, 20 nt, Neisseria meningitidis Z2491
ccugccugccauuccccuau

SEQ ID NO: 3362398 - RNA, 17 nt, Neisseria meningitidis Z2491
ccugccuucauucuuga

SEQ ID NO: 3362399 - RNA, 16 nt, Neisseria meningitidis Z2491
ccugcgcgagaauaau

SEQ ID NO: 3362400 - RNA, 20 nt, Neisseria meningitidis Z2491
ccugcgcgggaaugacaaaa

SEQ ID NO: 3362401 - RNA, 14 nt, Neisseria meningitidis Z2491
ccugcguuugccgc

SEQ ID NO: 3362402 - RNA, 17 nt, Neisseria meningitidis Z2491
ccugcguuugccgccau

SEQ ID NO: 3362403 - RNA, 16 nt, Neisseria meningitidis Z2491
ccugcucgagcggcag

SEQ ID NO: 3362404 - RNA, 21 nt, Neisseria meningitidis Z2491
ccugcugcugguuuuucggca

SEQ ID NO: 3362405 - RNA, 22 nt, Neisseria meningitidis Z2491
ccugcugcugguuuuucggcac

SEQ ID NO: 3362406 - RNA, 18 nt, Neisseria meningitidis Z2491
cgaauccgacacggcuua

SEQ ID NO: 3362407 - RNA, 17 nt, Neisseria meningitidis Z2491
cgaaucuuauccacaga

SEQ ID NO: 3362408 - RNA, 23 nt, Neisseria meningitidis Z2491
cgaaucuuccaagaaaagccgua

SEQ ID NO: 3362409 - RNA, 19 nt, Neisseria meningitidis Z2491
cgaauugaaucaugccgcu

SEQ ID NO: 3362410 - RNA, 12 nt, Neisseria meningitidis Z2491
cgaauugcgccg

SEQ ID NO: 3362411 - RNA, 19 nt, Neisseria meningitidis Z2491
cgaauugcgccgacagcag

SEQ ID NO: 3362412 - RNA, 12 nt, Neisseria meningitidis Z2491
cgacaaauuccu

SEQ ID NO: 3362413 - RNA, 20 nt, Neisseria meningitidis Z2491
cgacaaccgcccagccgaau

SEQ ID NO: 3362414 - RNA, 20 nt, Neisseria meningitidis Z2491
cgacaaggcuggauucccgc

SEQ ID NO: 3362415 - RNA, 16 nt, Neisseria meningitidis Z2491
cgacacccgccccgcc

SEQ ID NO: 3362416 - RNA, 12 nt, Neisseria meningitidis Z2491
cgacagcagcag

SEQ ID NO: 3362417 - RNA, 15 nt, Neisseria meningitidis Z2491
cgacagcagcagccc

SEQ ID NO: 3362418 - RNA, 16 nt, Neisseria meningitidis Z2491
cgacagccgaaaccca

SEQ ID NO: 3362419 - RNA, 12 nt, Neisseria meningitidis Z2491
cgacagccgcaa

SEQ ID NO: 3362420 - RNA, 14 nt, Neisseria meningitidis Z2491
cgacaggcggcgga

SEQ ID NO: 3362421 - RNA, 23 nt, Neisseria meningitidis Z2491
cgacaguuucgcuggaugccgcg

SEQ ID NO: 3362422 - RNA, 19 nt, Neisseria meningitidis Z2491
cgacaucccccagccgaaa

SEQ ID NO: 3362423 - RNA, 14 nt, Neisseria meningitidis Z2491
cgacaugcaagcau

SEQ ID NO: 3362424 - RNA, 16 nt, Neisseria meningitidis Z2491
cgaccaacgccgccga

SEQ ID NO: 3362425 - RNA, 21 nt, Neisseria meningitidis Z2491
cgaccagugcgccggcauaac

SEQ ID NO: 3362426 - RNA, 22 nt, Neisseria meningitidis Z2491
cgaccaucguccaaccuucccg

SEQ ID NO: 3362427 - RNA, 16 nt, Neisseria meningitidis Z2491
cgaccgccgccgccuu

SEQ ID NO: 3362428 - RNA, 13 nt, Neisseria meningitidis Z2491
cgacgaagccgca

SEQ ID NO: 3362429 - RNA, 14 nt, Neisseria meningitidis Z2491
cgacgaagccgcag

SEQ ID NO: 3362430 - RNA, 14 nt, Neisseria meningitidis Z2491
cgacgagaauuuau

SEQ ID NO: 3362431 - RNA, 24 nt, Neisseria meningitidis Z2491
cgacgcccccgcaggcagcagauc

SEQ ID NO: 3362432 - RNA, 17 nt, Neisseria meningitidis Z2491
cgacgcggcugcugccu

SEQ ID NO: 3362433 - RNA, 17 nt, Neisseria meningitidis Z2491
cgacgguggugcguuug

SEQ ID NO: 3362434 - RNA, 20 nt, Neisseria meningitidis Z2491
cgacgguucgauaucgccuc

SEQ ID NO: 3362435 - RNA, 17 nt, Neisseria meningitidis Z2491
cgacugccgccgcgccu

SEQ ID NO: 3362436 - RNA, 11 nt, Neisseria meningitidis Z2491
cgacuggaugg

SEQ ID NO: 3362437 - RNA, 13 nt, Neisseria meningitidis Z2491
cgacugugcccac

SEQ ID NO: 3362438 - RNA, 22 nt, Neisseria meningitidis Z2491
cgacuuccagcaccaguucguc

SEQ ID NO: 3362439 - RNA, 18 nt, Neisseria meningitidis Z2491
cgacuucugacagcauuu

SEQ ID NO: 3362440 - RNA, 14 nt, Neisseria meningitidis Z2491
cgagaaaacagaaa

SEQ ID NO: 3362441 - RNA, 18 nt, Neisseria meningitidis Z2491
cgagaauuuaucagaaau

SEQ ID NO: 3362442 - RNA, 20 nt, Neisseria meningitidis Z2491
cgagaauuuaucagaaauga

SEQ ID NO: 3362443 - RNA, 21 nt, Neisseria meningitidis Z2491
cgagcaauauuggcacgggcg

SEQ ID NO: 3362444 - RNA, 21 nt, Neisseria meningitidis Z2491
cgagcagcagucccaucccgc

SEQ ID NO: 3362445 - RNA, 20 nt, Neisseria meningitidis Z2491
cgagcaggguuugcaggcgu

SEQ ID NO: 3362446 - RNA, 15 nt, Neisseria meningitidis Z2491
cgagcagguugcggu

SEQ ID NO: 3362447 - RNA, 16 nt, Neisseria meningitidis Z2491
cgagcauaccguucaa

SEQ ID NO: 3362448 - RNA, 16 nt, Neisseria meningitidis Z2491
cgagccaauagccgcc

SEQ ID NO: 3362449 - RNA, 16 nt, Neisseria meningitidis Z2491
cgagccaugcgugccc

SEQ ID NO: 3362450 - RNA, 14 nt, Neisseria meningitidis Z2491
cgagccgcagacag

SEQ ID NO: 3362451 - RNA, 19 nt, Neisseria meningitidis Z2491
cgaggaugucggacauuuu

SEQ ID NO: 3362452 - RNA, 14 nt, Neisseria meningitidis Z2491
cgaggcaacgccgu

SEQ ID NO: 3362453 - RNA, 15 nt, Neisseria meningitidis Z2491
cgaggcgcaggguca

SEQ ID NO: 3362454 - RNA, 14 nt, Neisseria meningitidis Z2491
cgagggcgcgggcg

SEQ ID NO: 3362455 - RNA, 13 nt, Neisseria meningitidis Z2491
cgaggucgccggc

SEQ ID NO: 3362456 - RNA, 21 nt, Neisseria meningitidis Z2491
cgaguggcuuccuuuuuaaag

SEQ ID NO: 3362457 - RNA, 15 nt, Neisseria meningitidis Z2491
cgaguucuuuuaaag

SEQ ID NO: 3362458 - RNA, 17 nt, Neisseria meningitidis Z2491
cgaguucuuuuaaagga

SEQ ID NO: 3362459 - RNA, 14 nt, Neisseria meningitidis Z2491
cgaguuuuugguag

SEQ ID NO: 3362460 - RNA, 22 nt, Neisseria meningitidis Z2491
cgauaacgccgccguccaucac

SEQ ID NO: 3362461 - RNA, 18 nt, Neisseria meningitidis Z2491
cgauaaugcgguguaucu

SEQ ID NO: 3362462 - RNA, 13 nt, Neisseria meningitidis Z2491
cgauagauucccg

SEQ ID NO: 3362463 - RNA, 14 nt, Neisseria meningitidis Z2491
cgauagauuccugu

SEQ ID NO: 3362464 - RNA, 22 nt, Neisseria meningitidis Z2491
cgauauaguggauuaacaaaaa

SEQ ID NO: 3362465 - RNA, 23 nt, Neisseria meningitidis Z2491
cgauauaguggauuaacaaaaau

SEQ ID NO: 3362466 - RNA, 11 nt, Neisseria meningitidis Z2491
cgauauaugcg

SEQ ID NO: 3362467 - RNA, 22 nt, Neisseria meningitidis Z2491
cgauauuacgaacaaugcaaaa

SEQ ID NO: 3362468 - RNA, 12 nt, Neisseria meningitidis Z2491
cgauauuuuuga

SEQ ID NO: 3362469 - RNA, 22 nt, Neisseria meningitidis Z2491
cgauccguuugguuuuauagug

SEQ ID NO: 3362470 - RNA, 20 nt, Neisseria meningitidis Z2491
cgaugaugacggucaggaag

SEQ ID NO: 3362471 - RNA, 19 nt, Neisseria meningitidis Z2491
cgaugauguguuucaacac

SEQ ID NO: 3362472 - RNA, 22 nt, Neisseria meningitidis Z2491
cgaugauguguuucaacaccgc

SEQ ID NO: 3362473 - RNA, 15 nt, Neisseria meningitidis Z2491
cgaugcagaacggcg

SEQ ID NO: 3362474 - RNA, 22 nt, Neisseria meningitidis Z2491
cgaugccgcaaccaacgaaaca

SEQ ID NO: 3362475 - RNA, 18 nt, Neisseria meningitidis Z2491
cgaugccgucauucccgc

SEQ ID NO: 3362476 - RNA, 22 nt, Neisseria meningitidis Z2491
cgaugccgucauucccgcgcag

SEQ ID NO: 3362477 - RNA, 23 nt, Neisseria meningitidis Z2491
cgaugccgucauucccgcgcagg

SEQ ID NO: 3362478 - RNA, 17 nt, Neisseria meningitidis Z2491
cgauggaccucaggccg

SEQ ID NO: 3362479 - RNA, 13 nt, Neisseria meningitidis Z2491
cgaugggcaaggc

SEQ ID NO: 3362480 - RNA, 23 nt, Neisseria meningitidis Z2491
cgaugggcaaggcgccggcggcu

SEQ ID NO: 3362481 - RNA, 21 nt, Neisseria meningitidis Z2491
cgaugggcuucaucaguuucc

SEQ ID NO: 3362482 - RNA, 12 nt, Neisseria meningitidis Z2491
cgauguaaaccu

SEQ ID NO: 3362483 - RNA, 12 nt, Neisseria meningitidis Z2491
cgauguccugac

SEQ ID NO: 3362484 - RNA, 18 nt, Neisseria meningitidis Z2491
cgauguggguaaacggca

SEQ ID NO: 3362485 - RNA, 13 nt, Neisseria meningitidis Z2491
cgauuaauccgcu

SEQ ID NO: 3362486 - RNA, 14 nt, Neisseria meningitidis Z2491
cgauuaauccgcuu

SEQ ID NO: 3362487 - RNA, 16 nt, Neisseria meningitidis Z2491
cgauuauaucggcaag

SEQ ID NO: 3362488 - RNA, 15 nt, Neisseria meningitidis Z2491
cgauuauuuuuuaga

SEQ ID NO: 3362489 - RNA, 22 nt, Neisseria meningitidis Z2491
cgauugagggcacagucggcau

SEQ ID NO: 3362490 - RNA, 16 nt, Neisseria meningitidis Z2491
cgauuggauucagacg

SEQ ID NO: 3362491 - RNA, 14 nt, Neisseria meningitidis Z2491
cgauuucgagauac

SEQ ID NO: 3362492 - RNA, 18 nt, Neisseria meningitidis Z2491
cgauuucgcguaccaaaa

SEQ ID NO: 3362493 - RNA, 16 nt, Neisseria meningitidis Z2491
cgauuucuuugccgcc

SEQ ID NO: 3362494 - RNA, 12 nt, Neisseria meningitidis Z2491
cgauuugaacca

SEQ ID NO: 3362495 - RNA, 17 nt, Neisseria meningitidis Z2491
cgauuuugugccguucc

SEQ ID NO: 3362496 - RNA, 14 nt, Neisseria meningitidis Z2491
cgcaaaagcgggaa

SEQ ID NO: 3362497 - RNA, 14 nt, Neisseria meningitidis Z2491
cgcaaaagcgggag

SEQ ID NO: 3362498 - RNA, 13 nt, Neisseria meningitidis Z2491
cgcaaacaccagc

SEQ ID NO: 3362499 - RNA, 20 nt, Neisseria meningitidis Z2491
cgcaaacgcugcauuuguuc

SEQ ID NO: 3362500 - RNA, 22 nt, Neisseria meningitidis Z2491
cgcaaacuaacuuauacacacg

SEQ ID NO: 3362501 - RNA, 15 nt, Neisseria meningitidis Z2491
cgcaaaucggcuuca

SEQ ID NO: 3362502 - RNA, 19 nt, Neisseria meningitidis Z2491
cgcaaaucggcuucagaca

SEQ ID NO: 3362503 - RNA, 18 nt, Neisseria meningitidis Z2491
cgcaaaugcguaugcccc

SEQ ID NO: 3362504 - RNA, 22 nt, Neisseria meningitidis Z2491
cgcaaccaaaaucaucacgccg

SEQ ID NO: 3362505 - RNA, 13 nt, Neisseria meningitidis Z2491
cgcaaccuugcca

SEQ ID NO: 3362506 - RNA, 15 nt, Neisseria meningitidis Z2491
cgcaaggacgggcag

SEQ ID NO: 3362507 - RNA, 16 nt, Neisseria meningitidis Z2491
cgcaaggucggcggcg

SEQ ID NO: 3362508 - RNA, 18 nt, Neisseria meningitidis Z2491
cgcgcaggguuuccacgu

SEQ ID NO: 3362509 - RNA, 19 nt, Neisseria meningitidis Z2491
cgcgcccaauucuucuuua

SEQ ID NO: 3362510 - RNA, 22 nt, Neisseria meningitidis Z2491
cgcgcccacgcccucggcggcg

SEQ ID NO: 3362511 - RNA, 18 nt, Neisseria meningitidis Z2491
cgcgccgaucgcgaugcc

SEQ ID NO: 3362512 - RNA, 15 nt, Neisseria meningitidis Z2491
cgcgccguccaaaaa

SEQ ID NO: 3362513 - RNA, 19 nt, Neisseria meningitidis Z2491
cgcgccugccacgaugggc

SEQ ID NO: 3362514 - RNA, 19 nt, Neisseria meningitidis Z2491
cgcgcgaaugugcgccggu

SEQ ID NO: 3362515 - RNA, 18 nt, Neisseria meningitidis Z2491
cgcgcgccaaggcuuuca

SEQ ID NO: 3362516 - RNA, 13 nt, Neisseria meningitidis Z2491
cgcgcgccgucca

SEQ ID NO: 3362517 - RNA, 11 nt, Neisseria meningitidis Z2491
cgcgcggauuc

SEQ ID NO: 3362518 - RNA, 18 nt, Neisseria meningitidis Z2491
cgcggacacgguucugca

SEQ ID NO: 3362519 - RNA, 23 nt, Neisseria meningitidis Z2491
cgcggacacgguucugcaccgcu

SEQ ID NO: 3362520 - RNA, 16 nt, Neisseria meningitidis Z2491
cgcggauucgacggcg

SEQ ID NO: 3362521 - RNA, 18 nt, Neisseria meningitidis Z2491
cgcggauucgacggcgga

SEQ ID NO: 3362522 - RNA, 15 nt, Neisseria meningitidis Z2491
cgcggcgcggcgggc

SEQ ID NO: 3362523 - RNA, 14 nt, Neisseria meningitidis Z2491
cgcggcgggcggcu

SEQ ID NO: 3362524 - RNA, 15 nt, Neisseria meningitidis Z2491
cgcggcugccgaccg

SEQ ID NO: 3362525 - RNA, 20 nt, Neisseria meningitidis Z2491
cgcgggaaugacgaauuuca

SEQ ID NO: 3362526 - RNA, 17 nt, Neisseria meningitidis Z2491
cgcgguuggcggcggcg

SEQ ID NO: 3362527 - RNA, 17 nt, Neisseria meningitidis Z2491
cgcguccaacacgcagc

SEQ ID NO: 3362528 - RNA, 13 nt, Neisseria meningitidis Z2491
cgcgugcaggcgc

SEQ ID NO: 3362529 - RNA, 15 nt, Neisseria meningitidis Z2491
cgcguuugaccauaa

SEQ ID NO: 3362530 - RNA, 17 nt, Neisseria meningitidis Z2491
cgcguuuuaccugcccg

SEQ ID NO: 3362531 - RNA, 16 nt, Neisseria meningitidis Z2491
cgcuauaacagcaacc

SEQ ID NO: 3362532 - RNA, 16 nt, Neisseria meningitidis Z2491
cgcuauaauuuauuga

SEQ ID NO: 3362533 - RNA, 15 nt, Neisseria meningitidis Z2491
cgcuauauauucuga

SEQ ID NO: 3362534 - RNA, 17 nt, Neisseria meningitidis Z2491
cgcucaaacacccccga

SEQ ID NO: 3362535 - RNA, 17 nt, Neisseria meningitidis Z2491
cgcucugccgucauucc

SEQ ID NO: 3362536 - RNA, 13 nt, Neisseria meningitidis Z2491
cgcugcauuuguu

SEQ ID NO: 3362537 - RNA, 14 nt, Neisseria meningitidis Z2491
cgcugccgccgccc

SEQ ID NO: 3362538 - RNA, 12 nt, Neisseria meningitidis Z2491
cgcugccgucga

SEQ ID NO: 3362539 - RNA, 10 nt, Neisseria meningitidis Z2491
cgcugccuuu

SEQ ID NO: 3362540 - RNA, 13 nt, Neisseria meningitidis Z2491
cgcugcucggcuu

SEQ ID NO: 3362541 - RNA, 19 nt, Neisseria meningitidis Z2491
cgcuggaugccgcgccgcc

SEQ ID NO: 3362542 - RNA, 20 nt, Neisseria meningitidis Z2491
cgcuguacgaauccgccggc

SEQ ID NO: 3362543 - RNA, 21 nt, Neisseria meningitidis Z2491
cgcuguauuugcgccgcccga

SEQ ID NO: 3362544 - RNA, 16 nt, Neisseria meningitidis Z2491
cgcuguuccaaaagcc

SEQ ID NO: 3362545 - RNA, 21 nt, Neisseria meningitidis Z2491
cgcuguuccaaaagccgcccg

SEQ ID NO: 3362546 - RNA, 15 nt, Neisseria meningitidis Z2491
cgcuucagacggcau

SEQ ID NO: 3362547 - RNA, 18 nt, Neisseria meningitidis Z2491
cgcuucagacggcauuuu

SEQ ID NO: 3362548 - RNA, 22 nt, Neisseria meningitidis Z2491
cgcuucaucuuuacuuguuucg

SEQ ID NO: 3362549 - RNA, 19 nt, Neisseria meningitidis Z2491
cgcuucggaaggcgcguca

SEQ ID NO: 3362550 - RNA, 16 nt, Neisseria meningitidis Z2491
cgcuucggucggaugu

SEQ ID NO: 3362551 - RNA, 14 nt, Neisseria meningitidis Z2491
cgcuuuauuuugug

SEQ ID NO: 3362552 - RNA, 16 nt, Neisseria meningitidis Z2491
cgcuuucgcgggaaug

SEQ ID NO: 3362553 - RNA, 14 nt, Neisseria meningitidis Z2491
cgcuuucggggaag

SEQ ID NO: 3362554 - RNA, 15 nt, Neisseria meningitidis Z2491
cggaaacucaaaaaa

SEQ ID NO: 3362555 - RNA, 24 nt, Neisseria meningitidis Z2491
cggaaaugacugaaacucaacgaa

SEQ ID NO: 3362556 - RNA, 21 nt, Neisseria meningitidis Z2491
cggaagaggcgguguuuuuua

SEQ ID NO: 3362557 - RNA, 22 nt, Neisseria meningitidis Z2491
cggaagaucauaccuaccgccu

SEQ ID NO: 3362558 - RNA, 14 nt, Neisseria meningitidis Z2491
cggaaggguuuugu

SEQ ID NO: 3362559 - RNA, 18 nt, Neisseria meningitidis Z2491
cggaaguacucauuuuuc

SEQ ID NO: 3362560 - RNA, 19 nt, Neisseria meningitidis Z2491
cggaagugggaaucuagaa

SEQ ID NO: 3362561 - RNA, 15 nt, Neisseria meningitidis Z2491
cggaaucgauucacu

SEQ ID NO: 3362562 - RNA, 13 nt, Neisseria meningitidis Z2491
cggacaagggaaa

SEQ ID NO: 3362563 - RNA, 22 nt, Neisseria meningitidis Z2491
cggacgcaucgaguguggggua

SEQ ID NO: 3362564 - RNA, 20 nt, Neisseria meningitidis Z2491
cggacggauguucaaacacg

SEQ ID NO: 3362565 - RNA, 21 nt, Neisseria meningitidis Z2491
cggacuggauucccgccugcg

SEQ ID NO: 3362566 - RNA, 21 nt, Neisseria meningitidis Z2491
cggagaggcuuucagacggcc

SEQ ID NO: 3362567 - RNA, 22 nt, Neisseria meningitidis Z2491
cggagaggcuuucagacggccu

SEQ ID NO: 3362568 - RNA, 16 nt, Neisseria meningitidis Z2491
cggagcaguuuuucaa

SEQ ID NO: 3362569 - RNA, 18 nt, Neisseria meningitidis Z2491
cggagccuaucaucagau

SEQ ID NO: 3362570 - RNA, 20 nt, Neisseria meningitidis Z2491
cggaggaauaagucagcgug

SEQ ID NO: 3362571 - RNA, 13 nt, Neisseria meningitidis Z2491
cggauaaaacaga

SEQ ID NO: 3362572 - RNA, 17 nt, Neisseria meningitidis Z2491
cggauaaaacgguuucu

SEQ ID NO: 3362573 - RNA, 16 nt, Neisseria meningitidis Z2491
cggauaggcaaaaacc

SEQ ID NO: 3362574 - RNA, 15 nt, Neisseria meningitidis Z2491
cggaucggcagcuuu

SEQ ID NO: 3362575 - RNA, 23 nt, Neisseria meningitidis Z2491
cggaugaauuuaaacaggcacag

SEQ ID NO: 3362576 - RNA, 17 nt, Neisseria meningitidis Z2491
cggauguccgcgcccac

SEQ ID NO: 3362577 - RNA, 23 nt, Neisseria meningitidis Z2491
cggauuagagcguggauuuuuuu

SEQ ID NO: 3362578 - RNA, 11 nt, Neisseria meningitidis Z2491
cggauuccugu

SEQ ID NO: 3362579 - RNA, 19 nt, Neisseria meningitidis Z2491
cggauuuauacgcccagca

SEQ ID NO: 3362580 - RNA, 17 nt, Neisseria meningitidis Z2491
cggauuuccuuaaaaaa

SEQ ID NO: 3362581 - RNA, 16 nt, Neisseria meningitidis Z2491
cggauuuucaauccgu

SEQ ID NO: 3362582 - RNA, 16 nt, Neisseria meningitidis Z2491
cggcaaaaauuuaucc

SEQ ID NO: 3362583 - RNA, 20 nt, Neisseria meningitidis Z2491
cggcaaaaguaucaggcauc

SEQ ID NO: 3362584 - RNA, 23 nt, Neisseria meningitidis Z2491
cggcaacauaaacaaagccggcg

SEQ ID NO: 3362585 - RNA, 18 nt, Neisseria meningitidis Z2491
cggcaagaucggaaauga

SEQ ID NO: 3362586 - RNA, 21 nt, Neisseria meningitidis Z2491
cggcaagguugcgucugccuu

SEQ ID NO: 3362587 - RNA, 14 nt, Neisseria meningitidis Z2491
cggcaauccggucu

SEQ ID NO: 3362588 - RNA, 24 nt, Neisseria meningitidis Z2491
cggcaaucuucccgggucgcuuua

SEQ ID NO: 3362589 - RNA, 22 nt, Neisseria meningitidis Z2491
cggcaaugcgcccgauguaguc

SEQ ID NO: 3362590 - RNA, 16 nt, Neisseria meningitidis Z2491
cggcaauuuccgccgg

SEQ ID NO: 3362591 - RNA, 21 nt, Neisseria meningitidis Z2491
cggcacaaccgcccuauauuu

SEQ ID NO: 3362592 - RNA, 22 nt, Neisseria meningitidis Z2491
cggcacaaccgcccuauauuug

SEQ ID NO: 3362593 - RNA, 13 nt, Neisseria meningitidis Z2491
cggcacaggcuca

SEQ ID NO: 3362594 - RNA, 16 nt, Neisseria meningitidis Z2491
cggcacgcgguuuugc

SEQ ID NO: 3362595 - RNA, 14 nt, Neisseria meningitidis Z2491
cggcacuugccgca

SEQ ID NO: 3362596 - RNA, 19 nt, Neisseria meningitidis Z2491
cggcagauacaacaaacag

SEQ ID NO: 3362597 - RNA, 11 nt, Neisseria meningitidis Z2491
cggcagccugc

SEQ ID NO: 3362598 - RNA, 18 nt, Neisseria meningitidis Z2491
cggcagccugccgcugau

SEQ ID NO: 3362599 - RNA, 17 nt, Neisseria meningitidis Z2491
cggcagccugcucgagc

SEQ ID NO: 3362600 - RNA, 23 nt, Neisseria meningitidis Z2491
cggcagccugcucgagcggcagg

SEQ ID NO: 3362601 - RNA, 21 nt, Neisseria meningitidis Z2491
cggcagccuuaacagggaaag

SEQ ID NO: 3362602 - RNA, 12 nt, Neisseria meningitidis Z2491
cggcagcggcau

SEQ ID NO: 3362603 - RNA, 16 nt, Neisseria meningitidis Z2491
cggcaggaacacggcg

SEQ ID NO: 3362604 - RNA, 11 nt, Neisseria meningitidis Z2491
cggcaggaauu

SEQ ID NO: 3362605 - RNA, 17 nt, Neisseria meningitidis Z2491
cggcaguuuccaauaca

SEQ ID NO: 3362606 - RNA, 16 nt, Neisseria meningitidis Z2491
cggcauauguuuucug

SEQ ID NO: 3362607 - RNA, 19 nt, Neisseria meningitidis Z2491
cggcauauuuuuuggacgg

SEQ ID NO: 3362608 - RNA, 22 nt, Neisseria meningitidis Z2491
cggcauauuuuuuggacggcgc

SEQ ID NO: 3362609 - RNA, 17 nt, Neisseria meningitidis Z2491
cggucgaggaaccagcg

SEQ ID NO: 3362610 - RNA, 14 nt, Neisseria meningitidis Z2491
cggucggaccaguc

SEQ ID NO: 3362611 - RNA, 21 nt, Neisseria meningitidis Z2491
cggucgggcgcguacacgacg

SEQ ID NO: 3362612 - RNA, 16 nt, Neisseria meningitidis Z2491
cggucgugcagccugc

SEQ ID NO: 3362613 - RNA, 18 nt, Neisseria meningitidis Z2491
cggucguggcaacuucca

SEQ ID NO: 3362614 - RNA, 16 nt, Neisseria meningitidis Z2491
cggugaacacuucuuc

SEQ ID NO: 3362615 - RNA, 22 nt, Neisseria meningitidis Z2491
cggugaacacuucuucgggcgu

SEQ ID NO: 3362616 - RNA, 15 nt, Neisseria meningitidis Z2491
cggugcgguacggca

SEQ ID NO: 3362617 - RNA, 16 nt, Neisseria meningitidis Z2491
cggugcgguagccgcc

SEQ ID NO: 3362618 - RNA, 18 nt, Neisseria meningitidis Z2491
cggugcgguagccgccuu

SEQ ID NO: 3362619 - RNA, 12 nt, Neisseria meningitidis Z2491
cgguggcggcau

SEQ ID NO: 3362620 - RNA, 16 nt, Neisseria meningitidis Z2491
cggugggcugaagccc

SEQ ID NO: 3362621 - RNA, 19 nt, Neisseria meningitidis Z2491
cggugucuucaauuccugc

SEQ ID NO: 3362622 - RNA, 16 nt, Neisseria meningitidis Z2491
cggugugcaggcugcc

SEQ ID NO: 3362623 - RNA, 18 nt, Neisseria meningitidis Z2491
cggugugccgcugauuug

SEQ ID NO: 3362624 - RNA, 15 nt, Neisseria meningitidis Z2491
cggugugcgccgccg

SEQ ID NO: 3362625 - RNA, 16 nt, Neisseria meningitidis Z2491
cgguuacacaaauaua

SEQ ID NO: 3362626 - RNA, 16 nt, Neisseria meningitidis Z2491
cgguucguccagcagc

SEQ ID NO: 3362627 - RNA, 21 nt, Neisseria meningitidis Z2491
cgguuguauuuuuauuauuau

SEQ ID NO: 3362628 - RNA, 19 nt, Neisseria meningitidis Z2491
cgguuuaaauuuaauccac

SEQ ID NO: 3362629 - RNA, 14 nt, Neisseria meningitidis Z2491
cgguuuaauccgcc

SEQ ID NO: 3362630 - RNA, 18 nt, Neisseria meningitidis Z2491
cgguuucgguuuuuuuug

SEQ ID NO: 3362631 - RNA, 12 nt, Neisseria meningitidis Z2491
cgguuuguauuu

SEQ ID NO: 3362632 - RNA, 18 nt, Neisseria meningitidis Z2491
cgguuuuuucugccaaua

SEQ ID NO: 3362633 - RNA, 15 nt, Neisseria meningitidis Z2491
cgguuuuuugaguuu

SEQ ID NO: 3362634 - RNA, 17 nt, Neisseria meningitidis Z2491
cguaaccgacgaaggca

SEQ ID NO: 3362635 - RNA, 17 nt, Neisseria meningitidis Z2491
cguaauagccugacaca

SEQ ID NO: 3362636 - RNA, 23 nt, Neisseria meningitidis Z2491
cguaaucccauuucuuccugacg

SEQ ID NO: 3362637 - RNA, 13 nt, Neisseria meningitidis Z2491
cguacaaaugccg

SEQ ID NO: 3362638 - RNA, 16 nt, Neisseria meningitidis Z2491
cguacaucaggcggcg

SEQ ID NO: 3362639 - RNA, 22 nt, Neisseria meningitidis Z2491
cguaccaaccguccacacauca

SEQ ID NO: 3362640 - RNA, 14 nt, Neisseria meningitidis Z2491
cguaccgcgcgcca

SEQ ID NO: 3362641 - RNA, 15 nt, Neisseria meningitidis Z2491
cguaccguccaaacu

SEQ ID NO: 3362642 - RNA, 15 nt, Neisseria meningitidis Z2491
cguacuauuuacacu

SEQ ID NO: 3362643 - RNA, 17 nt, Neisseria meningitidis Z2491
cguacuccuguuuuuaa

SEQ ID NO: 3362644 - RNA, 23 nt, Neisseria meningitidis Z2491
cguacugguuuaaauuuaaucca

SEQ ID NO: 3362645 - RNA, 18 nt, Neisseria meningitidis Z2491
cguagccggccaacauca

SEQ ID NO: 3362646 - RNA, 20 nt, Neisseria meningitidis Z2491
cguaggaugccuagauggcg

SEQ ID NO: 3362647 - RNA, 14 nt, Neisseria meningitidis Z2491
cguaggcggcggcg

SEQ ID NO: 3362648 - RNA, 18 nt, Neisseria meningitidis Z2491
cguaggucuucagcuuga

SEQ ID NO: 3362649 - RNA, 16 nt, Neisseria meningitidis Z2491
cguaucaaaaaacaac

SEQ ID NO: 3362650 - RNA, 21 nt, Neisseria meningitidis Z2491
cguaucaaacaagaaaugaua

SEQ ID NO: 3362651 - RNA, 16 nt, Neisseria meningitidis Z2491
cguaugauuuuucggg

SEQ ID NO: 3362652 - RNA, 14 nt, Neisseria meningitidis Z2491
cguauguggucagg

SEQ ID NO: 3362653 - RNA, 21 nt, Neisseria meningitidis Z2491
cguauugcuaaauuucuagaa

SEQ ID NO: 3362654 - RNA, 17 nt, Neisseria meningitidis Z2491
cguauuggggcaaagcg

SEQ ID NO: 3362655 - RNA, 22 nt, Neisseria meningitidis Z2491
cguauuugcuguuggggaagcg

SEQ ID NO: 3362656 - RNA, 15 nt, Neisseria meningitidis Z2491
cgucaaaaacgggcu

SEQ ID NO: 3362657 - RNA, 18 nt, Neisseria meningitidis Z2491
cgucaaacagaaaaacaa

SEQ ID NO: 3362658 - RNA, 12 nt, Neisseria meningitidis Z2491
cgucaaaccagc

SEQ ID NO: 3362659 - RNA, 19 nt, Neisseria meningitidis Z2491
cgucaaaccgaugccguca

SEQ ID NO: 3362660 - RNA, 23 nt, Neisseria meningitidis Z2491
cgucaaaucggauaggcaaaaac

SEQ ID NO: 3362661 - RNA, 11 nt, Neisseria meningitidis Z2491
cgucauucccg

SEQ ID NO: 3362662 - RNA, 12 nt, Neisseria meningitidis Z2491
cgucauucccgc

SEQ ID NO: 3362663 - RNA, 19 nt, Neisseria meningitidis Z2491
cgucauucccgcaaaaaca

SEQ ID NO: 3362664 - RNA, 16 nt, Neisseria meningitidis Z2491
cgucauucccgcgcag

SEQ ID NO: 3362665 - RNA, 21 nt, Neisseria meningitidis Z2491
cgucauucccgcgcaggcggg

SEQ ID NO: 3362666 - RNA, 12 nt, Neisseria meningitidis Z2491
cgucauucccgu

SEQ ID NO: 3362667 - RNA, 20 nt, Neisseria meningitidis Z2491
cguccaaaaggacguagucg

SEQ ID NO: 3362668 - RNA, 22 nt, Neisseria meningitidis Z2491
cguccaaaugccgcaaaugccg

SEQ ID NO: 3362669 - RNA, 16 nt, Neisseria meningitidis Z2491
cguccaacacgcagcc

SEQ ID NO: 3362670 - RNA, 20 nt, Neisseria meningitidis Z2491
cguccaacacgcagccgagc

SEQ ID NO: 3362671 - RNA, 14 nt, Neisseria meningitidis Z2491
cguccaaccuuccc

SEQ ID NO: 3362672 - RNA, 14 nt, Neisseria meningitidis Z2491
cguccaauacggcg

SEQ ID NO: 3362673 - RNA, 17 nt, Neisseria meningitidis Z2491
cguccacaagccgccga

SEQ ID NO: 3362674 - RNA, 19 nt, Neisseria meningitidis Z2491
cguccacuuucgccauaau

SEQ ID NO: 3362675 - RNA, 21 nt, Neisseria meningitidis Z2491
cguccccgaaaccgaaugcca

SEQ ID NO: 3362676 - RNA, 23 nt, Neisseria meningitidis Z2491
cguccgacaauuucuccgccagc

SEQ ID NO: 3362677 - RNA, 15 nt, Neisseria meningitidis Z2491
cguccgccauuucca

SEQ ID NO: 3362678 - RNA, 18 nt, Neisseria meningitidis Z2491
cgucgaaguggcuggcuu

SEQ ID NO: 3362679 - RNA, 21 nt, Neisseria meningitidis Z2491
cgucgaccugcuguuugagcc

SEQ ID NO: 3362680 - RNA, 16 nt, Neisseria meningitidis Z2491
cgucgccuuguccuga

SEQ ID NO: 3362681 - RNA, 18 nt, Neisseria meningitidis Z2491
cgucgggauucagauguu

SEQ ID NO: 3362682 - RNA, 21 nt, Neisseria meningitidis Z2491
cgucgggcaacucgauuuccg

SEQ ID NO: 3362683 - RNA, 14 nt, Neisseria meningitidis Z2491
cgucugaaaagucu

SEQ ID NO: 3362684 - RNA, 21 nt, Neisseria meningitidis Z2491
cgucugaaaagucuuucagac

SEQ ID NO: 3362685 - RNA, 19 nt, Neisseria meningitidis Z2491
cgucugaaacaaaauguuc

SEQ ID NO: 3362686 - RNA, 21 nt, Neisseria meningitidis Z2491
cgucugaaaccaaaucggcuu

SEQ ID NO: 3362687 - RNA, 20 nt, Neisseria meningitidis Z2491
cgucugaaacccggaaaaaa

SEQ ID NO: 3362688 - RNA, 16 nt, Neisseria meningitidis Z2491
cgucugaaaccggcag

SEQ ID NO: 3362689 - RNA, 12 nt, Neisseria meningitidis Z2491
cgucugaaaccu

SEQ ID NO: 3362690 - RNA, 14 nt, Neisseria meningitidis Z2491
cgucugaaaccugu

SEQ ID NO: 3362691 - RNA, 17 nt, Neisseria meningitidis Z2491
cgucugaaaccuguuuc

SEQ ID NO: 3362692 - RNA, 19 nt, Neisseria meningitidis Z2491
cgucugaaacggcauccuu

SEQ ID NO: 3362693 - RNA, 17 nt, Neisseria meningitidis Z2491
cgucugaaacggcggca

SEQ ID NO: 3362694 - RNA, 19 nt, Neisseria meningitidis Z2491
cgucugaaauccuauuuuc

SEQ ID NO: 3362695 - RNA, 23 nt, Neisseria meningitidis Z2491
cgucugaaauguucagacggcau

SEQ ID NO: 3362696 - RNA, 14 nt, Neisseria meningitidis Z2491
cgucugaacacggg

SEQ ID NO: 3362697 - RNA, 17 nt, Neisseria meningitidis Z2491
cgucugaacagcauuug

SEQ ID NO: 3362698 - RNA, 23 nt, Neisseria meningitidis Z2491
cgucugaagcgguucagacggca

SEQ ID NO: 3362699 - RNA, 19 nt, Neisseria meningitidis Z2491
cgucuucaaaaucauccca

SEQ ID NO: 3362700 - RNA, 19 nt, Neisseria meningitidis Z2491
cgucuugggaaaugccguc

SEQ ID NO: 3362701 - RNA, 15 nt, Neisseria meningitidis Z2491
cgucuuuaaucaggc

SEQ ID NO: 3362702 - RNA, 18 nt, Neisseria meningitidis Z2491
cgucuuuuccuuccaaaa

SEQ ID NO: 3362703 - RNA, 14 nt, Neisseria meningitidis Z2491
cgugaauuaaaugc

SEQ ID NO: 3362704 - RNA, 22 nt, Neisseria meningitidis Z2491
cgugcaaaaauucgucggucag

SEQ ID NO: 3362705 - RNA, 13 nt, Neisseria meningitidis Z2491
cgugcaauacacu

SEQ ID NO: 3362706 - RNA, 13 nt, Neisseria meningitidis Z2491
cgugcaucaucac

SEQ ID NO: 3362707 - RNA, 15 nt, Neisseria meningitidis Z2491
cgugcauucagcagg

SEQ ID NO: 3362708 - RNA, 13 nt, Neisseria meningitidis Z2491
cgugccggcggcg

SEQ ID NO: 3362709 - RNA, 16 nt, Neisseria meningitidis Z2491
cgugcggacguucaaa

SEQ ID NO: 3362710 - RNA, 16 nt, Neisseria meningitidis Z2491
aaaacauaugccgucu

SEQ ID NO: 3362711 - RNA, 13 nt, Neisseria meningitidis Z2491
aaaaccaaaaaca

SEQ ID NO: 3362712 - RNA, 15 nt, Neisseria meningitidis Z2491
aaaaccaaaaacaga

SEQ ID NO: 3362713 - RNA, 17 nt, Neisseria meningitidis Z2491
aaaaccaaaaacagcaa

SEQ ID NO: 3362714 - RNA, 13 nt, Neisseria meningitidis Z2491
aaaaccaaaauca

SEQ ID NO: 3362715 - RNA, 15 nt, Neisseria meningitidis Z2491
aaaaccgaaacagaa

SEQ ID NO: 3362716 - RNA, 17 nt, Neisseria meningitidis Z2491
aaaaccgauaaacaaca

SEQ ID NO: 3362717 - RNA, 19 nt, Neisseria meningitidis Z2491
aaaaccggccggaaaaccu

SEQ ID NO: 3362718 - RNA, 20 nt, Neisseria meningitidis Z2491
aaaaccuuccuaauauugag

SEQ ID NO: 3362719 - RNA, 14 nt, Neisseria meningitidis Z2491
aaaaccuuucagac

SEQ ID NO: 3362720 - RNA, 23 nt, Neisseria meningitidis Z2491
aaaaccuuucccguuucagacgg

SEQ ID NO: 3362721 - RNA, 23 nt, Neisseria meningitidis Z2491
aaaacgacgagaauuuaucagaa

SEQ ID NO: 3362722 - RNA, 15 nt, Neisseria meningitidis Z2491
aaaacgccaauuugu

SEQ ID NO: 3362723 - RNA, 16 nt, Neisseria meningitidis Z2491
aaaacgccaauuugua

SEQ ID NO: 3362724 - RNA, 20 nt, Neisseria meningitidis Z2491
aaaacgccaauuuguauuca

SEQ ID NO: 3362725 - RNA, 17 nt, Neisseria meningitidis Z2491
aaaacgggaaucuagaa

SEQ ID NO: 3362726 - RNA, 17 nt, Neisseria meningitidis Z2491
aaaacuaagccguuuca

SEQ ID NO: 3362727 - RNA, 22 nt, Neisseria meningitidis Z2491
aaaacucuccugaucuaaaaau

SEQ ID NO: 3362728 - RNA, 16 nt, Neisseria meningitidis Z2491
aaaacugccuacacga

SEQ ID NO: 3362729 - RNA, 12 nt, Neisseria meningitidis Z2491
aaaacuuaaaau

SEQ ID NO: 3362730 - RNA, 13 nt, Neisseria meningitidis Z2491
aaaacuuaaaauu

SEQ ID NO: 3362731 - RNA, 14 nt, Neisseria meningitidis Z2491
aaaacuuaaaauuc

SEQ ID NO: 3362732 - RNA, 22 nt, Neisseria meningitidis Z2491
aaaacuucccguccguauuuuc

SEQ ID NO: 3362733 - RNA, 13 nt, Neisseria meningitidis Z2491
aaaacuuuucuga

SEQ ID NO: 3362734 - RNA, 16 nt, Neisseria meningitidis Z2491
aaaacuuuucugauuu

SEQ ID NO: 3362735 - RNA, 18 nt, Neisseria meningitidis Z2491
aaaacuuuucugauuuuu

SEQ ID NO: 3362736 - RNA, 22 nt, Neisseria meningitidis Z2491
aaaacuuuucugauuuuuccua

SEQ ID NO: 3362737 - RNA, 14 nt, Neisseria meningitidis Z2491
aaaagauacacaca

SEQ ID NO: 3362738 - RNA, 15 nt, Neisseria meningitidis Z2491
aaaagauacacacac

SEQ ID NO: 3362739 - RNA, 14 nt, Neisseria meningitidis Z2491
aaaagaugccgucu

SEQ ID NO: 3362740 - RNA, 16 nt, Neisseria meningitidis Z2491
aaaagcgggaauccaa

SEQ ID NO: 3362741 - RNA, 19 nt, Neisseria meningitidis Z2491
aaaagcgggaauccggaaa

SEQ ID NO: 3362742 - RNA, 22 nt, Neisseria meningitidis Z2491
aaaagcgggaaucuagaaacuc

SEQ ID NO: 3362743 - RNA, 14 nt, Neisseria meningitidis Z2491
aaaagcuaaagcaa

SEQ ID NO: 3362744 - RNA, 15 nt, Neisseria meningitidis Z2491
aaaaggucuuuucua

SEQ ID NO: 3362745 - RNA, 16 nt, Neisseria meningitidis Z2491
aaaaggucuuuucuaa

SEQ ID NO: 3362746 - RNA, 17 nt, Neisseria meningitidis Z2491
aaaaguugcaagaauga

SEQ ID NO: 3362747 - RNA, 19 nt, Neisseria meningitidis Z2491
aaaaguuuugcauuuugaa

SEQ ID NO: 3362748 - RNA, 20 nt, Neisseria meningitidis Z2491
aaaaguuuugcauuuugaaa

SEQ ID NO: 3362749 - RNA, 12 nt, Neisseria meningitidis Z2491
aaaauaaaaaua

SEQ ID NO: 3362750 - RNA, 13 nt, Neisseria meningitidis Z2491
aaaauaaaaauac

SEQ ID NO: 3362751 - RNA, 21 nt, Neisseria meningitidis Z2491
aaaauaaaaccgauaaacaac

SEQ ID NO: 3362752 - RNA, 14 nt, Neisseria meningitidis Z2491
aaaauaaacucauu

SEQ ID NO: 3362753 - RNA, 19 nt, Neisseria meningitidis Z2491
aaaauaacgggauuucagc

SEQ ID NO: 3362754 - RNA, 21 nt, Neisseria meningitidis Z2491
aaaauaaucgaaccaaauaaa

SEQ ID NO: 3362755 - RNA, 20 nt, Neisseria meningitidis Z2491
aaaauaaucuuccuucugaa

SEQ ID NO: 3362756 - RNA, 14 nt, Neisseria meningitidis Z2491
aaaauaauugccuu

SEQ ID NO: 3362757 - RNA, 19 nt, Neisseria meningitidis Z2491
aaaauacauccuaaaaauu

SEQ ID NO: 3362758 - RNA, 16 nt, Neisseria meningitidis Z2491
aaaauacauugggcau

SEQ ID NO: 3362759 - RNA, 19 nt, Neisseria meningitidis Z2491
aaaauaccgucugaaaccg

SEQ ID NO: 3362760 - RNA, 20 nt, Neisseria meningitidis Z2491
aaaauaccgucugaaaggcu

SEQ ID NO: 3362761 - RNA, 21 nt, Neisseria meningitidis Z2491
aaaauacggacgggaaguuuu

SEQ ID NO: 3362762 - RNA, 19 nt, Neisseria meningitidis Z2491
aaaauacugaggaaaccau

SEQ ID NO: 3362763 - RNA, 14 nt, Neisseria meningitidis Z2491
aaaauagaaaaccg

SEQ ID NO: 3362764 - RNA, 15 nt, Neisseria meningitidis Z2491
aaaauagaaaaccga

SEQ ID NO: 3362765 - RNA, 17 nt, Neisseria meningitidis Z2491
aaaauagaaaaccgaaa

SEQ ID NO: 3362766 - RNA, 19 nt, Neisseria meningitidis Z2491
aaaauagaaauacuuaaca

SEQ ID NO: 3362767 - RNA, 23 nt, Neisseria meningitidis Z2491
aaaauauaguggauuaacaaaaa

SEQ ID NO: 3362768 - RNA, 23 nt, Neisseria meningitidis Z2491
aaaauaucuucuccgaccuauag

SEQ ID NO: 3362769 - RNA, 14 nt, Neisseria meningitidis Z2491
aaaauaugcagaga

SEQ ID NO: 3362770 - RNA, 17 nt, Neisseria meningitidis Z2491
aaaauaugccgucauuc

SEQ ID NO: 3362771 - RNA, 18 nt, Neisseria meningitidis Z2491
aaaauaugccgucauucc

SEQ ID NO: 3362772 - RNA, 23 nt, Neisseria meningitidis Z2491
aaaauauggcugcuuugguaaaa

SEQ ID NO: 3362773 - RNA, 13 nt, Neisseria meningitidis Z2491
aaaauauuaauca

SEQ ID NO: 3362774 - RNA, 14 nt, Neisseria meningitidis Z2491
aaaauauucaauug

SEQ ID NO: 3362775 - RNA, 22 nt, Neisseria meningitidis Z2491
aaaauauucaauugacaaaaac

SEQ ID NO: 3362776 - RNA, 21 nt, Neisseria meningitidis Z2491
aaaauauuugcacaucaggcg

SEQ ID NO: 3362777 - RNA, 15 nt, Neisseria meningitidis Z2491
aaaaucaaaaaaaaa

SEQ ID NO: 3362778 - RNA, 13 nt, Neisseria meningitidis Z2491
aaaaucagaaacc

SEQ ID NO: 3362779 - RNA, 19 nt, Neisseria meningitidis Z2491
aaaaucagcacaaaugcca

SEQ ID NO: 3362780 - RNA, 20 nt, Neisseria meningitidis Z2491
aaaaucagcacaaaugccaa

SEQ ID NO: 3362781 - RNA, 24 nt, Neisseria meningitidis Z2491
aaaaucggccauucccucaaaaac

SEQ ID NO: 3362782 - RNA, 14 nt, Neisseria meningitidis Z2491
aaaaucuauagugg

SEQ ID NO: 3362783 - RNA, 15 nt, Neisseria meningitidis Z2491
aaaaucucgucauuc

SEQ ID NO: 3362784 - RNA, 15 nt, Neisseria meningitidis Z2491
aaaaucugauaagca

SEQ ID NO: 3362785 - RNA, 18 nt, Neisseria meningitidis Z2491
aaaaugacacaaagccuu

SEQ ID NO: 3362786 - RNA, 14 nt, Neisseria meningitidis Z2491
aaaaugagauugag

SEQ ID NO: 3362787 - RNA, 15 nt, Neisseria meningitidis Z2491
aaaaugcaaaacuuu

SEQ ID NO: 3362788 - RNA, 21 nt, Neisseria meningitidis Z2491
aaaaugccgccugaacauuuc

SEQ ID NO: 3362789 - RNA, 18 nt, Neisseria meningitidis Z2491
aaaaugccguccgaacag

SEQ ID NO: 3362790 - RNA, 12 nt, Neisseria meningitidis Z2491
aaaaugccgucu

SEQ ID NO: 3362791 - RNA, 14 nt, Neisseria meningitidis Z2491
aaaaugccgucuga

SEQ ID NO: 3362792 - RNA, 19 nt, Neisseria meningitidis Z2491
aaaaugccgucugaaaaca

SEQ ID NO: 3362793 - RNA, 22 nt, Neisseria meningitidis Z2491
aaaaugccgucugaaaacaguu

SEQ ID NO: 3362794 - RNA, 20 nt, Neisseria meningitidis Z2491
aaaaugccgucugaaaaccu

SEQ ID NO: 3362795 - RNA, 19 nt, Neisseria meningitidis Z2491
aaaaugccgucugaaaccc

SEQ ID NO: 3362796 - RNA, 22 nt, Neisseria meningitidis Z2491
aaaaugccgucugaaacgcauu

SEQ ID NO: 3362797 - RNA, 23 nt, Neisseria meningitidis Z2491
aaaaugccgucuggaacuugaaa

SEQ ID NO: 3362798 - RNA, 23 nt, Neisseria meningitidis Z2491
aaaaugcgccaaaaaauuuucaa

SEQ ID NO: 3362799 - RNA, 20 nt, Neisseria meningitidis Z2491
aaaaugugcauuucuaauuu

SEQ ID NO: 3362800 - RNA, 16 nt, Neisseria meningitidis Z2491
aaaauuaaaguuucag

SEQ ID NO: 3362801 - RNA, 16 nt, Neisseria meningitidis Z2491
aaaauuccguuauucc

SEQ ID NO: 3362802 - RNA, 14 nt, Neisseria meningitidis Z2491
aaaauucgucauuc

SEQ ID NO: 3362803 - RNA, 15 nt, Neisseria meningitidis Z2491
aaaauucgucauucc

SEQ ID NO: 3362804 - RNA, 15 nt, Neisseria meningitidis Z2491
aaaauugaaauucgu

SEQ ID NO: 3362805 - RNA, 16 nt, Neisseria meningitidis Z2491
aaaauugcugcaucac

SEQ ID NO: 3362806 - RNA, 20 nt, Neisseria meningitidis Z2491
aaaauuuauccgaaacaaca

SEQ ID NO: 3362807 - RNA, 20 nt, Neisseria meningitidis Z2491
aaaauuuauccgaaaucaca

SEQ ID NO: 3362808 - RNA, 22 nt, Neisseria meningitidis Z2491
aaaauuuauccgaagcgacaac

SEQ ID NO: 3362809 - RNA, 18 nt, Neisseria meningitidis Z2491
aaaauuuaugaaauacau

SEQ ID NO: 3362810 - RNA, 21 nt, Neisseria meningitidis Z2491
aaaauuuauuuagaaacaacu

SEQ ID NO: 3362811 - RNA, 15 nt, Neisseria meningitidis Z2491
aaacgucguacagau

SEQ ID NO: 3362812 - RNA, 20 nt, Neisseria meningitidis Z2491
aaacguuucagacggcauuu

SEQ ID NO: 3362813 - RNA, 14 nt, Neisseria meningitidis Z2491
aaacuaaaugccaa

SEQ ID NO: 3362814 - RNA, 22 nt, Neisseria meningitidis Z2491
aaacuauaguggauuaacaaaa

SEQ ID NO: 3362815 - RNA, 19 nt, Neisseria meningitidis Z2491
aaacuauaucuauacuaaa

SEQ ID NO: 3362816 - RNA, 20 nt, Neisseria meningitidis Z2491
aaacucaaaaaacuggauuc

SEQ ID NO: 3362817 - RNA, 20 nt, Neisseria meningitidis Z2491
aaacucaacgcacuggauuc

SEQ ID NO: 3362818 - RNA, 22 nt, Neisseria meningitidis Z2491
aaacugcguuacauaauccggc

SEQ ID NO: 3362819 - RNA, 20 nt, Neisseria meningitidis Z2491
aaacuuaucggauaaaacgg

SEQ ID NO: 3362820 - RNA, 20 nt, Neisseria meningitidis Z2491
aaacuuaucggguaaaacgg

SEQ ID NO: 3362821 - RNA, 21 nt, Neisseria meningitidis Z2491
aaacuuggagauucuagauuc

SEQ ID NO: 3362822 - RNA, 22 nt, Neisseria meningitidis Z2491
aaacuuuaaucccgucauuccc

SEQ ID NO: 3362823 - RNA, 22 nt, Neisseria meningitidis Z2491
aaacuuucagauaaucuuugaa

SEQ ID NO: 3362824 - RNA, 15 nt, Neisseria meningitidis Z2491
aaacuuuucauauca

SEQ ID NO: 3362825 - RNA, 19 nt, Neisseria meningitidis Z2491
aaacuuuucugauuuugag

SEQ ID NO: 3362826 - RNA, 15 nt, Neisseria meningitidis Z2491
aaagaccgucauucc

SEQ ID NO: 3362827 - RNA, 16 nt, Neisseria meningitidis Z2491
aaagaccgucauuccu

SEQ ID NO: 3362828 - RNA, 14 nt, Neisseria meningitidis Z2491
aaagaccgucugaa

SEQ ID NO: 3362829 - RNA, 22 nt, Neisseria meningitidis Z2491
aaagagcaggacaaaguuggca

SEQ ID NO: 3362830 - RNA, 13 nt, Neisseria meningitidis Z2491
aaagaugccgucu

SEQ ID NO: 3362831 - RNA, 20 nt, Neisseria meningitidis Z2491
aaagauugagaccuuugcaa

SEQ ID NO: 3362832 - RNA, 12 nt, Neisseria meningitidis Z2491
aaagcacaaauu

SEQ ID NO: 3362833 - RNA, 19 nt, Neisseria meningitidis Z2491
aaagccaaaaacagaaacc

SEQ ID NO: 3362834 - RNA, 21 nt, Neisseria meningitidis Z2491
aaagccgcagacaguacagau

SEQ ID NO: 3362835 - RNA, 16 nt, Neisseria meningitidis Z2491
aaagccgcccgcccgg

SEQ ID NO: 3362836 - RNA, 21 nt, Neisseria meningitidis Z2491
aaagccgugugaaaauuuaaa

SEQ ID NO: 3362837 - RNA, 22 nt, Neisseria meningitidis Z2491
aaagccuaaauacaaaaggccg

SEQ ID NO: 3362838 - RNA, 18 nt, Neisseria meningitidis Z2491
aaagccugaaucuuuuuu

SEQ ID NO: 3362839 - RNA, 18 nt, Neisseria meningitidis Z2491
aaagcggcaaucaaaucc

SEQ ID NO: 3362840 - RNA, 16 nt, Neisseria meningitidis Z2491
aaagcgggaauccaaa

SEQ ID NO: 3362841 - RNA, 17 nt, Neisseria meningitidis Z2491
aaagcgggaaucuagaa

SEQ ID NO: 3362842 - RNA, 19 nt, Neisseria meningitidis Z2491
aaagcgggaaucuagaaac

SEQ ID NO: 3362843 - RNA, 23 nt, Neisseria meningitidis Z2491
aaagcugcccgagauuacagaaa

SEQ ID NO: 3362844 - RNA, 14 nt, Neisseria meningitidis Z2491
aaagcuggauuccc

SEQ ID NO: 3362845 - RNA, 22 nt, Neisseria meningitidis Z2491
aaagcugguagggauacaaauc

SEQ ID NO: 3362846 - RNA, 16 nt, Neisseria meningitidis Z2491
aaaggaaaugccgucu

SEQ ID NO: 3362847 - RNA, 21 nt, Neisseria meningitidis Z2491
aaaggaagucaugcccaaaag

SEQ ID NO: 3362848 - RNA, 14 nt, Neisseria meningitidis Z2491
aaaggaaguuuugu

SEQ ID NO: 3362849 - RNA, 19 nt, Neisseria meningitidis Z2491
aaaggaauuuugcaaaggu

SEQ ID NO: 3362850 - RNA, 22 nt, Neisseria meningitidis Z2491
aaaggcaaaugccgucugaaaa

SEQ ID NO: 3362851 - RNA, 12 nt, Neisseria meningitidis Z2491
aaaggcaauaac

SEQ ID NO: 3362852 - RNA, 18 nt, Neisseria meningitidis Z2491
aaaggcagugccgccaaa

SEQ ID NO: 3362853 - RNA, 14 nt, Neisseria meningitidis Z2491
aaaggccuggauuc

SEQ ID NO: 3362854 - RNA, 18 nt, Neisseria meningitidis Z2491
aaaggccuggauucccgc

SEQ ID NO: 3362855 - RNA, 17 nt, Neisseria meningitidis Z2491
aaaggcuucagacggca

SEQ ID NO: 3362856 - RNA, 20 nt, Neisseria meningitidis Z2491
aaaggcuucagacggcauuu

SEQ ID NO: 3362857 - RNA, 21 nt, Neisseria meningitidis Z2491
aaaggcuuuuucagacggcau

SEQ ID NO: 3362858 - RNA, 13 nt, Neisseria meningitidis Z2491
aaaggucuagauu

SEQ ID NO: 3362859 - RNA, 17 nt, Neisseria meningitidis Z2491
aaaggucuagauucccg

SEQ ID NO: 3362860 - RNA, 22 nt, Neisseria meningitidis Z2491
aaagguuagcugaagcuuuaga

SEQ ID NO: 3362861 - RNA, 18 nt, Neisseria meningitidis Z2491
aaagguugugggaaucca

SEQ ID NO: 3362862 - RNA, 14 nt, Neisseria meningitidis Z2491
aaaguacaaaaugc

SEQ ID NO: 3362863 - RNA, 16 nt, Neisseria meningitidis Z2491
aaaguacaaaaugccg

SEQ ID NO: 3362864 - RNA, 17 nt, Neisseria meningitidis Z2491
aaagucauauuaauuau

SEQ ID NO: 3362865 - RNA, 22 nt, Neisseria meningitidis Z2491
aaagucauauuaauuauagugg

SEQ ID NO: 3362866 - RNA, 20 nt, Neisseria meningitidis Z2491
aaaguccggcauaaauccuu

SEQ ID NO: 3362867 - RNA, 19 nt, Neisseria meningitidis Z2491
aaagugccauuuaaaaucu

SEQ ID NO: 3362868 - RNA, 19 nt, Neisseria meningitidis Z2491
aaaguggguguagcguggg

SEQ ID NO: 3362869 - RNA, 20 nt, Neisseria meningitidis Z2491
aaaguuacagaaauuuauaa

SEQ ID NO: 3362870 - RNA, 21 nt, Neisseria meningitidis Z2491
aaaguuauucaauuuaaacac

SEQ ID NO: 3362871 - RNA, 20 nt, Neisseria meningitidis Z2491
aaaguuugaaguucuagauu

SEQ ID NO: 3362872 - RNA, 20 nt, Neisseria meningitidis Z2491
aaaguuugagguucuagauu

SEQ ID NO: 3362873 - RNA, 17 nt, Neisseria meningitidis Z2491
aaaguuuugcauuuuga

SEQ ID NO: 3362874 - RNA, 12 nt, Neisseria meningitidis Z2491
aaauaaaaauac

SEQ ID NO: 3362875 - RNA, 17 nt, Neisseria meningitidis Z2491
aaauaaaaauacuuaua

SEQ ID NO: 3362876 - RNA, 13 nt, Neisseria meningitidis Z2491
aaauaaaacaaaa

SEQ ID NO: 3362877 - RNA, 12 nt, Neisseria meningitidis Z2491
aaauaaacaagg

SEQ ID NO: 3362878 - RNA, 14 nt, Neisseria meningitidis Z2491
aaauaaacaagguc

SEQ ID NO: 3362879 - RNA, 14 nt, Neisseria meningitidis Z2491
aaauaaauucugaa

SEQ ID NO: 3362880 - RNA, 21 nt, Neisseria meningitidis Z2491
aaauaaauucugaaacuuuaa

SEQ ID NO: 3362881 - RNA, 14 nt, Neisseria meningitidis Z2491
aaauaacucaucau

SEQ ID NO: 3362882 - RNA, 17 nt, Neisseria meningitidis Z2491
aaauaagcgguuuuccc

SEQ ID NO: 3362883 - RNA, 19 nt, Neisseria meningitidis Z2491
aaauaauggccuuuucccu

SEQ ID NO: 3362884 - RNA, 12 nt, Neisseria meningitidis Z2491
aaauaauugaaa

SEQ ID NO: 3362885 - RNA, 21 nt, Neisseria meningitidis Z2491
aaauaauugucuuuucccuug

SEQ ID NO: 3362886 - RNA, 18 nt, Neisseria meningitidis Z2491
aaauacaaaaggccgucu

SEQ ID NO: 3362887 - RNA, 23 nt, Neisseria meningitidis Z2491
aaauacaaaaggccgucugaaau

SEQ ID NO: 3362888 - RNA, 21 nt, Neisseria meningitidis Z2491
aaauacccaaaugcagaauaa

SEQ ID NO: 3362889 - RNA, 18 nt, Neisseria meningitidis Z2491
aaauacccacaagcuaaa

SEQ ID NO: 3362890 - RNA, 20 nt, Neisseria meningitidis Z2491
aaauaccgccuaauucuacc

SEQ ID NO: 3362891 - RNA, 17 nt, Neisseria meningitidis Z2491
aaauaccuccuaauucu

SEQ ID NO: 3362892 - RNA, 15 nt, Neisseria meningitidis Z2491
aaauacgcguaagcg

SEQ ID NO: 3362893 - RNA, 23 nt, Neisseria meningitidis Z2491
aaauagaaaaccgaaacagaaac

SEQ ID NO: 3362894 - RNA, 22 nt, Neisseria meningitidis Z2491
aaauaguacggaaccaauucac

SEQ ID NO: 3362895 - RNA, 23 nt, Neisseria meningitidis Z2491
aaauauaguggauuaacaaaaau

SEQ ID NO: 3362896 - RNA, 22 nt, Neisseria meningitidis Z2491
aaauauccggcaagccuuucaa

SEQ ID NO: 3362897 - RNA, 22 nt, Neisseria meningitidis Z2491
aaauaucgggguucucauccaa

SEQ ID NO: 3362898 - RNA, 16 nt, Neisseria meningitidis Z2491
aaauaucgucauuccc

SEQ ID NO: 3362899 - RNA, 14 nt, Neisseria meningitidis Z2491
aaauaucugacaaa

SEQ ID NO: 3362900 - RNA, 18 nt, Neisseria meningitidis Z2491
aaauaugccgucauuccc

SEQ ID NO: 3362901 - RNA, 20 nt, Neisseria meningitidis Z2491
aaauaugccgucauucccgc

SEQ ID NO: 3362902 - RNA, 12 nt, Neisseria meningitidis Z2491
aaauauuaaaaa

SEQ ID NO: 3362903 - RNA, 13 nt, Neisseria meningitidis Z2491
aaauauuaaucag

SEQ ID NO: 3362904 - RNA, 17 nt, Neisseria meningitidis Z2491
aaauauucaauugacaa

SEQ ID NO: 3362905 - RNA, 21 nt, Neisseria meningitidis Z2491
aaauauucaauugacaaaaac

SEQ ID NO: 3362906 - RNA, 12 nt, Neisseria meningitidis Z2491
aaaucaaaaaca

SEQ ID NO: 3362907 - RNA, 20 nt, Neisseria meningitidis Z2491
aaaucaaaaacagaaaccuc

SEQ ID NO: 3362908 - RNA, 20 nt, Neisseria meningitidis Z2491
aaaucaacagauugucaaaa

SEQ ID NO: 3362909 - RNA, 16 nt, Neisseria meningitidis Z2491
aaaucaacggauugac

SEQ ID NO: 3362910 - RNA, 20 nt, Neisseria meningitidis Z2491
aaaucaccaucacgcugccg

SEQ ID NO: 3362911 - RNA, 17 nt, Neisseria meningitidis Z2491
aaauugccaacaccguu

SEQ ID NO: 3362912 - RNA, 23 nt, Neisseria meningitidis Z2491
aaauugcugcaucacguucugaa

SEQ ID NO: 3362913 - RNA, 13 nt, Neisseria meningitidis Z2491
aaauuuaaaccag

SEQ ID NO: 3362914 - RNA, 15 nt, Neisseria meningitidis Z2491
aaauuuaauccauua

SEQ ID NO: 3362915 - RNA, 16 nt, Neisseria meningitidis Z2491
aaauuuauaaacaaaa

SEQ ID NO: 3362916 - RNA, 13 nt, Neisseria meningitidis Z2491
aaauuuauccgaa

SEQ ID NO: 3362917 - RNA, 19 nt, Neisseria meningitidis Z2491
aaauuuauccgaaaucaca

SEQ ID NO: 3362918 - RNA, 16 nt, Neisseria meningitidis Z2491
aaauuucaucauuccc

SEQ ID NO: 3362919 - RNA, 16 nt, Neisseria meningitidis Z2491
aaauuucaucauuccu

SEQ ID NO: 3362920 - RNA, 12 nt, Neisseria meningitidis Z2491
aaauuucuagaa

SEQ ID NO: 3362921 - RNA, 22 nt, Neisseria meningitidis Z2491
aaauuuuagguuucugauuuug

SEQ ID NO: 3362922 - RNA, 16 nt, Neisseria meningitidis Z2491
aaauuuugcagcccug

SEQ ID NO: 3362923 - RNA, 13 nt, Neisseria meningitidis Z2491
aaauuuugccauu

SEQ ID NO: 3362924 - RNA, 22 nt, Neisseria meningitidis Z2491
aaauuuugccauucuugcaaaa

SEQ ID NO: 3362925 - RNA, 15 nt, Neisseria meningitidis Z2491
aaauuuuuaaaaccg

SEQ ID NO: 3362926 - RNA, 16 nt, Neisseria meningitidis Z2491
aaauuuuuaaaaccgu

SEQ ID NO: 3362927 - RNA, 21 nt, Neisseria meningitidis Z2491
aaauuuuuauauucacauaga

SEQ ID NO: 3362928 - RNA, 15 nt, Neisseria meningitidis Z2491
aaauuuuugccgugu

SEQ ID NO: 3362929 - RNA, 20 nt, Neisseria meningitidis Z2491
aaauuuuuggcgcauuuuua

SEQ ID NO: 3362930 - RNA, 23 nt, Neisseria meningitidis Z2491
aaauuuuuggcgcauuuuuaugc

SEQ ID NO: 3362931 - RNA, 22 nt, Neisseria meningitidis Z2491
aaauuuuuuggcgcauuuuuau

SEQ ID NO: 3362932 - RNA, 12 nt, Neisseria meningitidis Z2491
aacaaaaaccag

SEQ ID NO: 3362933 - RNA, 15 nt, Neisseria meningitidis Z2491
aacaaaaaucaggac

SEQ ID NO: 3362934 - RNA, 12 nt, Neisseria meningitidis Z2491
aacaaaaugccg

SEQ ID NO: 3362935 - RNA, 14 nt, Neisseria meningitidis Z2491
aacaaaaugccguc

SEQ ID NO: 3362936 - RNA, 19 nt, Neisseria meningitidis Z2491
aacaaacccccgcuuuugc

SEQ ID NO: 3362937 - RNA, 17 nt, Neisseria meningitidis Z2491
aacaaacccuuucagac

SEQ ID NO: 3362938 - RNA, 19 nt, Neisseria meningitidis Z2491
aacaaacccuuucagacgg

SEQ ID NO: 3362939 - RNA, 16 nt, Neisseria meningitidis Z2491
aacaaacuagauuccc

SEQ ID NO: 3362940 - RNA, 16 nt, Neisseria meningitidis Z2491
aacaaauuuuugauuu

SEQ ID NO: 3362941 - RNA, 14 nt, Neisseria meningitidis Z2491
aacaacagaaacca

SEQ ID NO: 3362942 - RNA, 17 nt, Neisseria meningitidis Z2491
aacaacaggaauuuauc

SEQ ID NO: 3362943 - RNA, 13 nt, Neisseria meningitidis Z2491
aacaacaguaaua

SEQ ID NO: 3362944 - RNA, 20 nt, Neisseria meningitidis Z2491
aacaacaucagcucgggcug

SEQ ID NO: 3362945 - RNA, 21 nt, Neisseria meningitidis Z2491
aacaacugaaaccgcucugcc

SEQ ID NO: 3362946 - RNA, 17 nt, Neisseria meningitidis Z2491
aacaagccuguuuuccu

SEQ ID NO: 3362947 - RNA, 19 nt, Neisseria meningitidis Z2491
aacaagcgauuauuuuuua

SEQ ID NO: 3362948 - RNA, 21 nt, Neisseria meningitidis Z2491
aacaaguugcccaauaccguc

SEQ ID NO: 3362949 - RNA, 20 nt, Neisseria meningitidis Z2491
aacaauauaucgaacagccu

SEQ ID NO: 3362950 - RNA, 23 nt, Neisseria meningitidis Z2491
aacaauauaucgaacagccuguc

SEQ ID NO: 3362951 - RNA, 22 nt, Neisseria meningitidis Z2491
aacaauccgcccgaauaaaaaa

SEQ ID NO: 3362952 - RNA, 13 nt, Neisseria meningitidis Z2491
aacaaugcaaaga

SEQ ID NO: 3362953 - RNA, 15 nt, Neisseria meningitidis Z2491
aacaaugcaaagaac

SEQ ID NO: 3362954 - RNA, 19 nt, Neisseria meningitidis Z2491
aacaaugcccgcaaucuga

SEQ ID NO: 3362955 - RNA, 21 nt, Neisseria meningitidis Z2491
aacaaugcccgcaaucugaaa

SEQ ID NO: 3362956 - RNA, 21 nt, Neisseria meningitidis Z2491
aacacaaaaaacuucccgucc

SEQ ID NO: 3362957 - RNA, 18 nt, Neisseria meningitidis Z2491
aacacaaaugccgucuga

SEQ ID NO: 3362958 - RNA, 15 nt, Neisseria meningitidis Z2491
aacacagccaaaaua

SEQ ID NO: 3362959 - RNA, 18 nt, Neisseria meningitidis Z2491
aacacagguuuucagcug

SEQ ID NO: 3362960 - RNA, 12 nt, Neisseria meningitidis Z2491
aacacaucgcuu

SEQ ID NO: 3362961 - RNA, 16 nt, Neisseria meningitidis Z2491
aacacaucgcuuucag

SEQ ID NO: 3362962 - RNA, 20 nt, Neisseria meningitidis Z2491
aacacauugcguucagacgg

SEQ ID NO: 3362963 - RNA, 19 nt, Neisseria meningitidis Z2491
aacacccugauucucauga

SEQ ID NO: 3362964 - RNA, 17 nt, Neisseria meningitidis Z2491
aacacgcagccgagcag

SEQ ID NO: 3362965 - RNA, 17 nt, Neisseria meningitidis Z2491
aacacgcuuuaccugug

SEQ ID NO: 3362966 - RNA, 20 nt, Neisseria meningitidis Z2491
aacacggcaaaaauuuaucc

SEQ ID NO: 3362967 - RNA, 13 nt, Neisseria meningitidis Z2491
aacagaaaaacaa

SEQ ID NO: 3362968 - RNA, 12 nt, Neisseria meningitidis Z2491
aacagaaaacca

SEQ ID NO: 3362969 - RNA, 23 nt, Neisseria meningitidis Z2491
aacagaaaaccaaaaacagaaac

SEQ ID NO: 3362970 - RNA, 15 nt, Neisseria meningitidis Z2491
aacagaaacccgaaa

SEQ ID NO: 3362971 - RNA, 17 nt, Neisseria meningitidis Z2491
aacagaaaccuaaaauu

SEQ ID NO: 3362972 - RNA, 19 nt, Neisseria meningitidis Z2491
aacagaaaucccaaacccu

SEQ ID NO: 3362973 - RNA, 20 nt, Neisseria meningitidis Z2491
aacagacauugcuaaaacaa

SEQ ID NO: 3362974 - RNA, 21 nt, Neisseria meningitidis Z2491
aacagacauugcuaaaacaac

SEQ ID NO: 3362975 - RNA, 14 nt, Neisseria meningitidis Z2491
aacagcaacccugu

SEQ ID NO: 3362976 - RNA, 18 nt, Neisseria meningitidis Z2491
aacagcaaccugaaauuc

SEQ ID NO: 3362977 - RNA, 15 nt, Neisseria meningitidis Z2491
aacagcaaucaaaau

SEQ ID NO: 3362978 - RNA, 16 nt, Neisseria meningitidis Z2491
aacagcacgauacaca

SEQ ID NO: 3362979 - RNA, 13 nt, Neisseria meningitidis Z2491
aacagcagcagag

SEQ ID NO: 3362980 - RNA, 12 nt, Neisseria meningitidis Z2491
aacagccaggcg

SEQ ID NO: 3362981 - RNA, 15 nt, Neisseria meningitidis Z2491
aacagccgaaaaccu

SEQ ID NO: 3362982 - RNA, 14 nt, Neisseria meningitidis Z2491
aacagcucagacgg

SEQ ID NO: 3362983 - RNA, 15 nt, Neisseria meningitidis Z2491
aacagcugaaaacag

SEQ ID NO: 3362984 - RNA, 15 nt, Neisseria meningitidis Z2491
aacagcugaaaaccu

SEQ ID NO: 3362985 - RNA, 14 nt, Neisseria meningitidis Z2491
aacagcuuaaaauc

SEQ ID NO: 3362986 - RNA, 14 nt, Neisseria meningitidis Z2491
aacaggacaaaaau

SEQ ID NO: 3362987 - RNA, 13 nt, Neisseria meningitidis Z2491
aacagggaaagca

SEQ ID NO: 3362988 - RNA, 19 nt, Neisseria meningitidis Z2491
aacagggaaagcagcagcc

SEQ ID NO: 3362989 - RNA, 15 nt, Neisseria meningitidis Z2491
aacauaaacaaagcc

SEQ ID NO: 3362990 - RNA, 13 nt, Neisseria meningitidis Z2491
aacauaaaugccg

SEQ ID NO: 3362991 - RNA, 18 nt, Neisseria meningitidis Z2491
aacauacuuuguuucaaa

SEQ ID NO: 3362992 - RNA, 20 nt, Neisseria meningitidis Z2491
aacauagguuacuaaaauuu

SEQ ID NO: 3362993 - RNA, 19 nt, Neisseria meningitidis Z2491
aacaucccgguaacgaaga

SEQ ID NO: 3362994 - RNA, 17 nt, Neisseria meningitidis Z2491
aacaucgcucaaauucu

SEQ ID NO: 3362995 - RNA, 17 nt, Neisseria meningitidis Z2491
aacaucuuucagacggc

SEQ ID NO: 3362996 - RNA, 22 nt, Neisseria meningitidis Z2491
aacauuaucugacaggaaauuu

SEQ ID NO: 3362997 - RNA, 12 nt, Neisseria meningitidis Z2491
aacauuucagac

SEQ ID NO: 3362998 - RNA, 13 nt, Neisseria meningitidis Z2491
aacauuuugauug

SEQ ID NO: 3362999 - RNA, 23 nt, Neisseria meningitidis Z2491
aacauuuuugcguauucgccggu

SEQ ID NO: 3363000 - RNA, 18 nt, Neisseria meningitidis Z2491
aaccaaaaaaucugauaa

SEQ ID NO: 3363001 - RNA, 12 nt, Neisseria meningitidis Z2491
aaccaaaagcca

SEQ ID NO: 3363002 - RNA, 12 nt, Neisseria meningitidis Z2491
aaccaaaucggc

SEQ ID NO: 3363003 - RNA, 14 nt, Neisseria meningitidis Z2491
aaccaacgaaacac

SEQ ID NO: 3363004 - RNA, 15 nt, Neisseria meningitidis Z2491
aaccaacgaaacacu

SEQ ID NO: 3363005 - RNA, 16 nt, Neisseria meningitidis Z2491
aaccaauuuguuggca

SEQ ID NO: 3363006 - RNA, 18 nt, Neisseria meningitidis Z2491
aaccaccgccaucaggaa

SEQ ID NO: 3363007 - RNA, 15 nt, Neisseria meningitidis Z2491
aaccacgcuucugau

SEQ ID NO: 3363008 - RNA, 14 nt, Neisseria meningitidis Z2491
aaccacguuuccga

SEQ ID NO: 3363009 - RNA, 18 nt, Neisseria meningitidis Z2491
aaccagcccgauaagcug

SEQ ID NO: 3363010 - RNA, 15 nt, Neisseria meningitidis Z2491
aaccaguacgguguu

SEQ ID NO: 3363011 - RNA, 16 nt, Neisseria meningitidis Z2491
aaccaguacgguguug

SEQ ID NO: 3363012 - RNA, 16 nt, Neisseria meningitidis Z2491
aaccauuacaaaugcu

SEQ ID NO: 3363013 - RNA, 15 nt, Neisseria meningitidis Z2491
aacguauucgccgua

SEQ ID NO: 3363014 - RNA, 21 nt, Neisseria meningitidis Z2491
aacgucaagcaaaaaaugccg

SEQ ID NO: 3363015 - RNA, 18 nt, Neisseria meningitidis Z2491
aacguggggaacagucuu

SEQ ID NO: 3363016 - RNA, 15 nt, Neisseria meningitidis Z2491
aacguuucagacggu

SEQ ID NO: 3363017 - RNA, 23 nt, Neisseria meningitidis Z2491
aacguuucagacgguauuuuuua

SEQ ID NO: 3363018 - RNA, 13 nt, Neisseria meningitidis Z2491
aacuaacuuauac

SEQ ID NO: 3363019 - RNA, 21 nt, Neisseria meningitidis Z2491
aacuagcggcguuugaacagc

SEQ ID NO: 3363020 - RNA, 23 nt, Neisseria meningitidis Z2491
aacuauaguggauuaacaaaaau

SEQ ID NO: 3363021 - RNA, 13 nt, Neisseria meningitidis Z2491
aacucaaaaaacc

SEQ ID NO: 3363022 - RNA, 13 nt, Neisseria meningitidis Z2491
aacucaaaaaacu

SEQ ID NO: 3363023 - RNA, 19 nt, Neisseria meningitidis Z2491
aacucaaaaaacuggauuc

SEQ ID NO: 3363024 - RNA, 19 nt, Neisseria meningitidis Z2491
aacucaaaaagcuggauuc

SEQ ID NO: 3363025 - RNA, 17 nt, Neisseria meningitidis Z2491
aacucaacgaaccugga

SEQ ID NO: 3363026 - RNA, 15 nt, Neisseria meningitidis Z2491
aacuccaaagagaaa

SEQ ID NO: 3363027 - RNA, 20 nt, Neisseria meningitidis Z2491
aacucgauuuuguauccguc

SEQ ID NO: 3363028 - RNA, 16 nt, Neisseria meningitidis Z2491
aacucggcaaacgcuu

SEQ ID NO: 3363029 - RNA, 13 nt, Neisseria meningitidis Z2491
aacucuaaaccgu

SEQ ID NO: 3363030 - RNA, 21 nt, Neisseria meningitidis Z2491
aacucucuauaaaaucccccg

SEQ ID NO: 3363031 - RNA, 13 nt, Neisseria meningitidis Z2491
aacucuuccauuu

SEQ ID NO: 3363032 - RNA, 21 nt, Neisseria meningitidis Z2491
aacucuuccauuugagccgca

SEQ ID NO: 3363033 - RNA, 14 nt, Neisseria meningitidis Z2491
aacugacuagguaa

SEQ ID NO: 3363034 - RNA, 17 nt, Neisseria meningitidis Z2491
aacugccuuugaugcug

SEQ ID NO: 3363035 - RNA, 17 nt, Neisseria meningitidis Z2491
aacugcuaugcggcaaa

SEQ ID NO: 3363036 - RNA, 21 nt, Neisseria meningitidis Z2491
aacuuaaaauuucaucauucc

SEQ ID NO: 3363037 - RNA, 21 nt, Neisseria meningitidis Z2491
aacuuauacacacgguuuuca

SEQ ID NO: 3363038 - RNA, 23 nt, Neisseria meningitidis Z2491
aacuucaaaccccuucaaaccaa

SEQ ID NO: 3363039 - RNA, 16 nt, Neisseria meningitidis Z2491
aacuucaauaguggga

SEQ ID NO: 3363040 - RNA, 13 nt, Neisseria meningitidis Z2491
aacuucagacggc

SEQ ID NO: 3363041 - RNA, 21 nt, Neisseria meningitidis Z2491
aacuucauccguugcuucaau

SEQ ID NO: 3363042 - RNA, 19 nt, Neisseria meningitidis Z2491
aacuucuaacaaauaaugu

SEQ ID NO: 3363043 - RNA, 17 nt, Neisseria meningitidis Z2491
aacuugauauugcggcu

SEQ ID NO: 3363044 - RNA, 13 nt, Neisseria meningitidis Z2491
aacuugauucaag

SEQ ID NO: 3363045 - RNA, 21 nt, Neisseria meningitidis Z2491
aacuuguccgcacggaaacuu

SEQ ID NO: 3363046 - RNA, 17 nt, Neisseria meningitidis Z2491
aacuuuucauaucaugc

SEQ ID NO: 3363047 - RNA, 14 nt, Neisseria meningitidis Z2491
aacuuuucugauuu

SEQ ID NO: 3363048 - RNA, 12 nt, Neisseria meningitidis Z2491
aagaaaaacagc

SEQ ID NO: 3363049 - RNA, 20 nt, Neisseria meningitidis Z2491
aagaacccaaaccgucauuc

SEQ ID NO: 3363050 - RNA, 18 nt, Neisseria meningitidis Z2491
aagaacuuuauccccagc

SEQ ID NO: 3363051 - RNA, 14 nt, Neisseria meningitidis Z2491
aagaagauuuuugu

SEQ ID NO: 3363052 - RNA, 19 nt, Neisseria meningitidis Z2491
aagaaugacggaguuucag

SEQ ID NO: 3363053 - RNA, 15 nt, Neisseria meningitidis Z2491
aagaccaaacagaac

SEQ ID NO: 3363054 - RNA, 19 nt, Neisseria meningitidis Z2491
aagaccaaacagaacgcaa

SEQ ID NO: 3363055 - RNA, 23 nt, Neisseria meningitidis Z2491
aagacuuuuucgcgcaccagcaa

SEQ ID NO: 3363056 - RNA, 14 nt, Neisseria meningitidis Z2491
aagauauuggaaca

SEQ ID NO: 3363057 - RNA, 22 nt, Neisseria meningitidis Z2491
aagaucauaccuaccgccuauc

SEQ ID NO: 3363058 - RNA, 14 nt, Neisseria meningitidis Z2491
aagauggcugaaau

SEQ ID NO: 3363059 - RNA, 23 nt, Neisseria meningitidis Z2491
aagauuccggcggcuuuuucgca

SEQ ID NO: 3363060 - RNA, 15 nt, Neisseria meningitidis Z2491
aagauugguaucaac

SEQ ID NO: 3363061 - RNA, 20 nt, Neisseria meningitidis Z2491
aagcaauaccgcaaccugaa

SEQ ID NO: 3363062 - RNA, 22 nt, Neisseria meningitidis Z2491
aagcaccaagugaaucgguucc

SEQ ID NO: 3363063 - RNA, 19 nt, Neisseria meningitidis Z2491
aagcagcagcccuccccag

SEQ ID NO: 3363064 - RNA, 15 nt, Neisseria meningitidis Z2491
aagcagcucggcaau

SEQ ID NO: 3363065 - RNA, 19 nt, Neisseria meningitidis Z2491
aagcaggcguuuuucagac

SEQ ID NO: 3363066 - RNA, 15 nt, Neisseria meningitidis Z2491
aagcaguugaaauca

SEQ ID NO: 3363067 - RNA, 17 nt, Neisseria meningitidis Z2491
aagcaguugaaaucaac

SEQ ID NO: 3363068 - RNA, 21 nt, Neisseria meningitidis Z2491
aagcauugaccacuucagggc

SEQ ID NO: 3363069 - RNA, 13 nt, Neisseria meningitidis Z2491
aagccaagauaug

SEQ ID NO: 3363070 - RNA, 17 nt, Neisseria meningitidis Z2491
aagccacgcgccgaaua

SEQ ID NO: 3363071 - RNA, 12 nt, Neisseria meningitidis Z2491
aagcccaugucg

SEQ ID NO: 3363072 - RNA, 22 nt, Neisseria meningitidis Z2491
aagcccgcacauuccaucaaca

SEQ ID NO: 3363073 - RNA, 12 nt, Neisseria meningitidis Z2491
aagcccugccug

SEQ ID NO: 3363074 - RNA, 20 nt, Neisseria meningitidis Z2491
aagcccuuucagacggcauu

SEQ ID NO: 3363075 - RNA, 15 nt, Neisseria meningitidis Z2491
aagccgcauuguccc

SEQ ID NO: 3363076 - RNA, 15 nt, Neisseria meningitidis Z2491
aagccggcggcaaca

SEQ ID NO: 3363077 - RNA, 20 nt, Neisseria meningitidis Z2491
aagccggcggcaacaaugcc

SEQ ID NO: 3363078 - RNA, 20 nt, Neisseria meningitidis Z2491
aagccgugugaaaauuuaaa

SEQ ID NO: 3363079 - RNA, 20 nt, Neisseria meningitidis Z2491
aagccuauccauuccugcgu

SEQ ID NO: 3363080 - RNA, 17 nt, Neisseria meningitidis Z2491
aagccucgucauuucca

SEQ ID NO: 3363081 - RNA, 17 nt, Neisseria meningitidis Z2491
aagccuucagacggcau

SEQ ID NO: 3363082 - RNA, 18 nt, Neisseria meningitidis Z2491
aagccuucagacggcaua

SEQ ID NO: 3363083 - RNA, 21 nt, Neisseria meningitidis Z2491
aagccuucagacggcauuucc

SEQ ID NO: 3363084 - RNA, 14 nt, Neisseria meningitidis Z2491
aagccuuucaacaa

SEQ ID NO: 3363085 - RNA, 13 nt, Neisseria meningitidis Z2491
aagccuuucagac

SEQ ID NO: 3363086 - RNA, 21 nt, Neisseria meningitidis Z2491
aagcggaauacggcaacauca

SEQ ID NO: 3363087 - RNA, 19 nt, Neisseria meningitidis Z2491
aagcggacgauuucccugu

SEQ ID NO: 3363088 - RNA, 16 nt, Neisseria meningitidis Z2491
aagcggcaaugccguc

SEQ ID NO: 3363089 - RNA, 12 nt, Neisseria meningitidis Z2491
aagcggcggcau

SEQ ID NO: 3363090 - RNA, 20 nt, Neisseria meningitidis Z2491
aagcggcugggcaugcagca

SEQ ID NO: 3363091 - RNA, 18 nt, Neisseria meningitidis Z2491
aagcuauccgcacagaaa

SEQ ID NO: 3363092 - RNA, 14 nt, Neisseria meningitidis Z2491
aagcucaaaaaacc

SEQ ID NO: 3363093 - RNA, 18 nt, Neisseria meningitidis Z2491
aagcugcaacugaaacca

SEQ ID NO: 3363094 - RNA, 20 nt, Neisseria meningitidis Z2491
aagcugccccgugauuuugc

SEQ ID NO: 3363095 - RNA, 17 nt, Neisseria meningitidis Z2491
aagcuuccaacucggca

SEQ ID NO: 3363096 - RNA, 22 nt, Neisseria meningitidis Z2491
aagcuuuagagauucuggauuc

SEQ ID NO: 3363097 - RNA, 12 nt, Neisseria meningitidis Z2491
aaggaugccguu

SEQ ID NO: 3363098 - RNA, 19 nt, Neisseria meningitidis Z2491
aaggaugggguuucagauu

SEQ ID NO: 3363099 - RNA, 14 nt, Neisseria meningitidis Z2491
aaggcaaaauugcu

SEQ ID NO: 3363100 - RNA, 19 nt, Neisseria meningitidis Z2491
aaggcagcaacgacagcag

SEQ ID NO: 3363101 - RNA, 23 nt, Neisseria meningitidis Z2491
aaggcagcaccguuuaaaacagc

SEQ ID NO: 3363102 - RNA, 23 nt, Neisseria meningitidis Z2491
aaggcauacggggaggaaagucc

SEQ ID NO: 3363103 - RNA, 14 nt, Neisseria meningitidis Z2491
aaggcgaggcaacg

SEQ ID NO: 3363104 - RNA, 15 nt, Neisseria meningitidis Z2491
aaggcgaggcaacgc

SEQ ID NO: 3363105 - RNA, 18 nt, Neisseria meningitidis Z2491
aaggcgaggcaacgcugu

SEQ ID NO: 3363106 - RNA, 17 nt, Neisseria meningitidis Z2491
aaggcggcgagccgcag

SEQ ID NO: 3363107 - RNA, 22 nt, Neisseria meningitidis Z2491
aaggcggcgagccgcagacggu

SEQ ID NO: 3363108 - RNA, 13 nt, Neisseria meningitidis Z2491
aaggcggcggcaa

SEQ ID NO: 3363109 - RNA, 13 nt, Neisseria meningitidis Z2491
aaggcggcggcag

SEQ ID NO: 3363110 - RNA, 19 nt, Neisseria meningitidis Z2491
aaggcggcggcguucaaau

SEQ ID NO: 3363111 - RNA, 12 nt, Neisseria meningitidis Z2491
aaggcugcggca

SEQ ID NO: 3363112 - RNA, 15 nt, Neisseria meningitidis Z2491
aaggcuggauucccg

SEQ ID NO: 3363113 - RNA, 17 nt, Neisseria meningitidis Z2491
aaggcuggauucccgcc

SEQ ID NO: 3363114 - RNA, 16 nt, Neisseria meningitidis Z2491
aauauucaacuuugaa

SEQ ID NO: 3363115 - RNA, 17 nt, Neisseria meningitidis Z2491
aauauucauacuguggg

SEQ ID NO: 3363116 - RNA, 15 nt, Neisseria meningitidis Z2491
aauauugagcaaaaa

SEQ ID NO: 3363117 - RNA, 17 nt, Neisseria meningitidis Z2491
aauauugcuguuguucu

SEQ ID NO: 3363118 - RNA, 18 nt, Neisseria meningitidis Z2491
aauauugcuguuguucua

SEQ ID NO: 3363119 - RNA, 23 nt, Neisseria meningitidis Z2491
aaucaaaaacacaaaacugaaau

SEQ ID NO: 3363120 - RNA, 15 nt, Neisseria meningitidis Z2491
aaucaaaaccagccc

SEQ ID NO: 3363121 - RNA, 22 nt, Neisseria meningitidis Z2491
aaucaaagagcgcacaguuccc

SEQ ID NO: 3363122 - RNA, 12 nt, Neisseria meningitidis Z2491
aaucaaguuuau

SEQ ID NO: 3363123 - RNA, 21 nt, Neisseria meningitidis Z2491
aaucaauccuuccugaugaaa

SEQ ID NO: 3363124 - RNA, 13 nt, Neisseria meningitidis Z2491
aaucaauuaaaaa

SEQ ID NO: 3363125 - RNA, 14 nt, Neisseria meningitidis Z2491
aaucaauuaaaaac

SEQ ID NO: 3363126 - RNA, 14 nt, Neisseria meningitidis Z2491
aaucacaaacaucg

SEQ ID NO: 3363127 - RNA, 19 nt, Neisseria meningitidis Z2491
aaucaccgcaacauuaaau

SEQ ID NO: 3363128 - RNA, 14 nt, Neisseria meningitidis Z2491
aaucacuauaccaa

SEQ ID NO: 3363129 - RNA, 16 nt, Neisseria meningitidis Z2491
aaucacuauaccaaac

SEQ ID NO: 3363130 - RNA, 19 nt, Neisseria meningitidis Z2491
aaucagaucggcaaacccu

SEQ ID NO: 3363131 - RNA, 17 nt, Neisseria meningitidis Z2491
aaucagcacaaaugcca

SEQ ID NO: 3363132 - RNA, 17 nt, Neisseria meningitidis Z2491
aaucagcguacccacgc

SEQ ID NO: 3363133 - RNA, 20 nt, Neisseria meningitidis Z2491
aaucagcuauauauaguuga

SEQ ID NO: 3363134 - RNA, 16 nt, Neisseria meningitidis Z2491
aaucagcuuuuuguga

SEQ ID NO: 3363135 - RNA, 16 nt, Neisseria meningitidis Z2491
aaucaguuuuugucuu

SEQ ID NO: 3363136 - RNA, 12 nt, Neisseria meningitidis Z2491
aaucaguuuuuu

SEQ ID NO: 3363137 - RNA, 19 nt, Neisseria meningitidis Z2491
aaucaguuuuuucagcggc

SEQ ID NO: 3363138 - RNA, 20 nt, Neisseria meningitidis Z2491
aaucaguuuuuucagcggcg

SEQ ID NO: 3363139 - RNA, 15 nt, Neisseria meningitidis Z2491
aaucaucccaaacau

SEQ ID NO: 3363140 - RNA, 19 nt, Neisseria meningitidis Z2491
aaucaucccaaacaucgcu

SEQ ID NO: 3363141 - RNA, 22 nt, Neisseria meningitidis Z2491
aaucaucguauuuuuaucuuuu

SEQ ID NO: 3363142 - RNA, 16 nt, Neisseria meningitidis Z2491
aaucauuucugucugu

SEQ ID NO: 3363143 - RNA, 19 nt, Neisseria meningitidis Z2491
aaucauuucugucuguuuc

SEQ ID NO: 3363144 - RNA, 14 nt, Neisseria meningitidis Z2491
aauccaacgcugca

SEQ ID NO: 3363145 - RNA, 18 nt, Neisseria meningitidis Z2491
aauccaagauuucaucau

SEQ ID NO: 3363146 - RNA, 17 nt, Neisseria meningitidis Z2491
aauccaagguugucuga

SEQ ID NO: 3363147 - RNA, 21 nt, Neisseria meningitidis Z2491
aauccacgcaaucaagaagaa

SEQ ID NO: 3363148 - RNA, 17 nt, Neisseria meningitidis Z2491
aauccacgcucaaacac

SEQ ID NO: 3363149 - RNA, 17 nt, Neisseria meningitidis Z2491
aauccacuauaaaaaau

SEQ ID NO: 3363150 - RNA, 21 nt, Neisseria meningitidis Z2491
aauccacuauaaaaaaucccu

SEQ ID NO: 3363151 - RNA, 17 nt, Neisseria meningitidis Z2491
aauccacuauacuauag

SEQ ID NO: 3363152 - RNA, 14 nt, Neisseria meningitidis Z2491
aauccacuauacug

SEQ ID NO: 3363153 - RNA, 21 nt, Neisseria meningitidis Z2491
aauccacuauauuuucgcaag

SEQ ID NO: 3363154 - RNA, 21 nt, Neisseria meningitidis Z2491
aauccagaacguaaaaucuga

SEQ ID NO: 3363155 - RNA, 18 nt, Neisseria meningitidis Z2491
aauccagcaaugccgucu

SEQ ID NO: 3363156 - RNA, 18 nt, Neisseria meningitidis Z2491
aauccauucccucucccg

SEQ ID NO: 3363157 - RNA, 21 nt, Neisseria meningitidis Z2491
aaucccgcaacucuccgucau

SEQ ID NO: 3363158 - RNA, 15 nt, Neisseria meningitidis Z2491
aaucccgucauuccc

SEQ ID NO: 3363159 - RNA, 15 nt, Neisseria meningitidis Z2491
aaucccguugccaaa

SEQ ID NO: 3363160 - RNA, 12 nt, Neisseria meningitidis Z2491
aauccgaaucca

SEQ ID NO: 3363161 - RNA, 22 nt, Neisseria meningitidis Z2491
aauccgcccgaauaaaaaauau

SEQ ID NO: 3363162 - RNA, 18 nt, Neisseria meningitidis Z2491
aauccgcuauaacagcaa

SEQ ID NO: 3363163 - RNA, 15 nt, Neisseria meningitidis Z2491
aauccgguucauuuc

SEQ ID NO: 3363164 - RNA, 22 nt, Neisseria meningitidis Z2491
aauccugaaugcccauuuguug

SEQ ID NO: 3363165 - RNA, 15 nt, Neisseria meningitidis Z2491
aauccuucagcucuc

SEQ ID NO: 3363166 - RNA, 20 nt, Neisseria meningitidis Z2491
aaucgaagaaagcauacggc

SEQ ID NO: 3363167 - RNA, 21 nt, Neisseria meningitidis Z2491
aaucgacggagcugcuggaaa

SEQ ID NO: 3363168 - RNA, 15 nt, Neisseria meningitidis Z2491
aaucgccaaacauuu

SEQ ID NO: 3363169 - RNA, 19 nt, Neisseria meningitidis Z2491
aaucgcggcggcacuguca

SEQ ID NO: 3363170 - RNA, 23 nt, Neisseria meningitidis Z2491
aaucgcgugcugcaucggcguau

SEQ ID NO: 3363171 - RNA, 18 nt, Neisseria meningitidis Z2491
aaucggcuuucagacggc

SEQ ID NO: 3363172 - RNA, 15 nt, Neisseria meningitidis Z2491
aaucgggugauacuu

SEQ ID NO: 3363173 - RNA, 14 nt, Neisseria meningitidis Z2491
aaucggguuucaga

SEQ ID NO: 3363174 - RNA, 22 nt, Neisseria meningitidis Z2491
aaucggguuucagacggcauuu

SEQ ID NO: 3363175 - RNA, 12 nt, Neisseria meningitidis Z2491
aaucguuucugu

SEQ ID NO: 3363176 - RNA, 21 nt, Neisseria meningitidis Z2491
aaucguuucugucgccagcau

SEQ ID NO: 3363177 - RNA, 18 nt, Neisseria meningitidis Z2491
aaucuaaauagcguuuua

SEQ ID NO: 3363178 - RNA, 18 nt, Neisseria meningitidis Z2491
aaucuaccguuuccuccu

SEQ ID NO: 3363179 - RNA, 17 nt, Neisseria meningitidis Z2491
aaucuagaaacucaaag

SEQ ID NO: 3363180 - RNA, 11 nt, Neisseria meningitidis Z2491
aaucuagaaau

SEQ ID NO: 3363181 - RNA, 18 nt, Neisseria meningitidis Z2491
aaucuagaaaugaaaaac

SEQ ID NO: 3363182 - RNA, 21 nt, Neisseria meningitidis Z2491
aaucuagaaccucaaacuuuc

SEQ ID NO: 3363183 - RNA, 16 nt, Neisseria meningitidis Z2491
aaucuagaacguggaa

SEQ ID NO: 3363184 - RNA, 16 nt, Neisseria meningitidis Z2491
aaucuagacauucaau

SEQ ID NO: 3363185 - RNA, 19 nt, Neisseria meningitidis Z2491
aaucuagacauucaaugcu

SEQ ID NO: 3363186 - RNA, 17 nt, Neisseria meningitidis Z2491
aaucuaggucuuuaaac

SEQ ID NO: 3363187 - RNA, 22 nt, Neisseria meningitidis Z2491
aaucuaguuuguuguucaaaua

SEQ ID NO: 3363188 - RNA, 21 nt, Neisseria meningitidis Z2491
aaucucaaaaaaugccgucug

SEQ ID NO: 3363189 - RNA, 15 nt, Neisseria meningitidis Z2491
aaucucaaaucccgu

SEQ ID NO: 3363190 - RNA, 22 nt, Neisseria meningitidis Z2491
aaucucauuuucaaaaugcaaa

SEQ ID NO: 3363191 - RNA, 19 nt, Neisseria meningitidis Z2491
aaucucggacuuucagaua

SEQ ID NO: 3363192 - RNA, 16 nt, Neisseria meningitidis Z2491
aaucucgucccaaaca

SEQ ID NO: 3363193 - RNA, 13 nt, Neisseria meningitidis Z2491
aaucugaaauuuu

SEQ ID NO: 3363194 - RNA, 14 nt, Neisseria meningitidis Z2491
aaucugugaaaauc

SEQ ID NO: 3363195 - RNA, 15 nt, Neisseria meningitidis Z2491
aaucuguggauaaac

SEQ ID NO: 3363196 - RNA, 17 nt, Neisseria meningitidis Z2491
aaucuguggauaaacau

SEQ ID NO: 3363197 - RNA, 17 nt, Neisseria meningitidis Z2491
aaucuguuaacgaaauu

SEQ ID NO: 3363198 - RNA, 21 nt, Neisseria meningitidis Z2491
aaucuucccgggucgcuuuau

SEQ ID NO: 3363199 - RNA, 14 nt, Neisseria meningitidis Z2491
aaucuuugaauauu

SEQ ID NO: 3363200 - RNA, 17 nt, Neisseria meningitidis Z2491
aaucuuugaauauugcc

SEQ ID NO: 3363201 - RNA, 17 nt, Neisseria meningitidis Z2491
aaugaaaaaugccgucu

SEQ ID NO: 3363202 - RNA, 18 nt, Neisseria meningitidis Z2491
aaugaaaaugccgucuga

SEQ ID NO: 3363203 - RNA, 12 nt, Neisseria meningitidis Z2491
aaugaaaauuug

SEQ ID NO: 3363204 - RNA, 20 nt, Neisseria meningitidis Z2491
aaugaaaauuugguaaugca

SEQ ID NO: 3363205 - RNA, 15 nt, Neisseria meningitidis Z2491
aaugaccgaaacuca

SEQ ID NO: 3363206 - RNA, 15 nt, Neisseria meningitidis Z2491
aaugacgaaaaguug

SEQ ID NO: 3363207 - RNA, 22 nt, Neisseria meningitidis Z2491
aaugacgcgaacagaaaccuca

SEQ ID NO: 3363208 - RNA, 13 nt, Neisseria meningitidis Z2491
aaugacggcggag

SEQ ID NO: 3363209 - RNA, 20 nt, Neisseria meningitidis Z2491
aaugacgggauuuuagguuu

SEQ ID NO: 3363210 - RNA, 17 nt, Neisseria meningitidis Z2491
aaugacggggguuuggc

SEQ ID NO: 3363211 - RNA, 22 nt, Neisseria meningitidis Z2491
aaugacggucgaggguuucugu

SEQ ID NO: 3363212 - RNA, 13 nt, Neisseria meningitidis Z2491
aaugacugaaacu

SEQ ID NO: 3363213 - RNA, 15 nt, Neisseria meningitidis Z2491
aaugacugaaacuca

SEQ ID NO: 3363214 - RNA, 16 nt, Neisseria meningitidis Z2491
aaugacugaagcucaa

SEQ ID NO: 3363215 - RNA, 21 nt, Neisseria meningitidis Z2491
aauuuauucuaaauagcugaa

SEQ ID NO: 3363216 - RNA, 18 nt, Neisseria meningitidis Z2491
aauuuauuggucaacucu

SEQ ID NO: 3363217 - RNA, 15 nt, Neisseria meningitidis Z2491
aauuuauuugaacga

SEQ ID NO: 3363218 - RNA, 12 nt, Neisseria meningitidis Z2491
aauuucauuuuu

SEQ ID NO: 3363219 - RNA, 14 nt, Neisseria meningitidis Z2491
aauuucuugauuuu

SEQ ID NO: 3363220 - RNA, 18 nt, Neisseria meningitidis Z2491
aauuugacgcauaaaaau

SEQ ID NO: 3363221 - RNA, 16 nt, Neisseria meningitidis Z2491
aauuuguauucaagca

SEQ ID NO: 3363222 - RNA, 20 nt, Neisseria meningitidis Z2491
aauuugucggcuuuugacag

SEQ ID NO: 3363223 - RNA, 19 nt, Neisseria meningitidis Z2491
aauuugucgggaaaacagc

SEQ ID NO: 3363224 - RNA, 20 nt, Neisseria meningitidis Z2491
aauuuguuggcaguaaucca

SEQ ID NO: 3363225 - RNA, 14 nt, Neisseria meningitidis Z2491
aauuuuaaauaaau

SEQ ID NO: 3363226 - RNA, 22 nt, Neisseria meningitidis Z2491
aauuuuagguuucugauuuuga

SEQ ID NO: 3363227 - RNA, 22 nt, Neisseria meningitidis Z2491
aauuuuauggcagguuuuuaua

SEQ ID NO: 3363228 - RNA, 17 nt, Neisseria meningitidis Z2491
aauuuugaacaucuugu

SEQ ID NO: 3363229 - RNA, 22 nt, Neisseria meningitidis Z2491
aauuuugcaaaggucucaaaua

SEQ ID NO: 3363230 - RNA, 14 nt, Neisseria meningitidis Z2491
aauuuuuaaaaccg

SEQ ID NO: 3363231 - RNA, 18 nt, Neisseria meningitidis Z2491
aauuuuuggcgcauuuuu

SEQ ID NO: 3363232 - RNA, 19 nt, Neisseria meningitidis Z2491
aauuuuuuggcgcauuuuu

SEQ ID NO: 3363233 - RNA, 18 nt, Neisseria meningitidis Z2491
acaaaaaacagaaacccg

SEQ ID NO: 3363234 - RNA, 16 nt, Neisseria meningitidis Z2491
acaaaaaauauagugg

SEQ ID NO: 3363235 - RNA, 14 nt, Neisseria meningitidis Z2491
acaaaaaaucaaaa

SEQ ID NO: 3363236 - RNA, 11 nt, Neisseria meningitidis Z2491
acaaaaacaga

SEQ ID NO: 3363237 - RNA, 12 nt, Neisseria meningitidis Z2491
acaaaaacagaa

SEQ ID NO: 3363238 - RNA, 14 nt, Neisseria meningitidis Z2491
acaaaaauaccguc

SEQ ID NO: 3363239 - RNA, 21 nt, Neisseria meningitidis Z2491
acaaaaauccugcuuauugca

SEQ ID NO: 3363240 - RNA, 16 nt, Neisseria meningitidis Z2491
acaaaagauacacaca

SEQ ID NO: 3363241 - RNA, 17 nt, Neisseria meningitidis Z2491
acaaaagauacacacac

SEQ ID NO: 3363242 - RNA, 14 nt, Neisseria meningitidis Z2491
acaaaaggccgucu

SEQ ID NO: 3363243 - RNA, 19 nt, Neisseria meningitidis Z2491
acaaaaggccgucugaaau

SEQ ID NO: 3363244 - RNA, 17 nt, Neisseria meningitidis Z2491
acaaaauaaaaaacaaa

SEQ ID NO: 3363245 - RNA, 14 nt, Neisseria meningitidis Z2491
acaaaauaccgucu

SEQ ID NO: 3363246 - RNA, 16 nt, Neisseria meningitidis Z2491
acaaaaugccgccuga

SEQ ID NO: 3363247 - RNA, 16 nt, Neisseria meningitidis Z2491
acaaaaugccguccga

SEQ ID NO: 3363248 - RNA, 14 nt, Neisseria meningitidis Z2491
acaaaaugccgucu

SEQ ID NO: 3363249 - RNA, 16 nt, Neisseria meningitidis Z2491
acaaaaugccgucuga

SEQ ID NO: 3363250 - RNA, 21 nt, Neisseria meningitidis Z2491
acaaaaugccgucugaaaacc

SEQ ID NO: 3363251 - RNA, 20 nt, Neisseria meningitidis Z2491
acaaaauuaaaguuucagaa

SEQ ID NO: 3363252 - RNA, 19 nt, Neisseria meningitidis Z2491
acaaacagauuuuuugccu

SEQ ID NO: 3363253 - RNA, 12 nt, Neisseria meningitidis Z2491
acaaacagcaug

SEQ ID NO: 3363254 - RNA, 11 nt, Neisseria meningitidis Z2491
acaaacaggca

SEQ ID NO: 3363255 - RNA, 22 nt, Neisseria meningitidis Z2491
acaaacaggcagccuaaaacau

SEQ ID NO: 3363256 - RNA, 13 nt, Neisseria meningitidis Z2491
acaaacaggcuuc

SEQ ID NO: 3363257 - RNA, 15 nt, Neisseria meningitidis Z2491
acaaacaggcuucag

SEQ ID NO: 3363258 - RNA, 15 nt, Neisseria meningitidis Z2491
acaaacaucugauuu

SEQ ID NO: 3363259 - RNA, 13 nt, Neisseria meningitidis Z2491
acaaacccuuuca

SEQ ID NO: 3363260 - RNA, 14 nt, Neisseria meningitidis Z2491
acaaacgccagcac

SEQ ID NO: 3363261 - RNA, 16 nt, Neisseria meningitidis Z2491
acaaacgccagcacaa

SEQ ID NO: 3363262 - RNA, 19 nt, Neisseria meningitidis Z2491
acaaacgccagcacaaaca

SEQ ID NO: 3363263 - RNA, 23 nt, Neisseria meningitidis Z2491
acaaacgccagcacaaacagcau

SEQ ID NO: 3363264 - RNA, 19 nt, Neisseria meningitidis Z2491
acaaagaaagcagaaauaa

SEQ ID NO: 3363265 - RNA, 20 nt, Neisseria meningitidis Z2491
acaaagccgcagacaguaca

SEQ ID NO: 3363266 - RNA, 21 nt, Neisseria meningitidis Z2491
acaaagccggcggcaacaaug

SEQ ID NO: 3363267 - RNA, 19 nt, Neisseria meningitidis Z2491
acaaauagcacggaaucga

SEQ ID NO: 3363268 - RNA, 21 nt, Neisseria meningitidis Z2491
acaaauaguacggcaaggcaa

SEQ ID NO: 3363269 - RNA, 13 nt, Neisseria meningitidis Z2491
acaaauauauucg

SEQ ID NO: 3363270 - RNA, 20 nt, Neisseria meningitidis Z2491
acaaaucgguacgcagcagu

SEQ ID NO: 3363271 - RNA, 17 nt, Neisseria meningitidis Z2491
acaaaugccgccagcca

SEQ ID NO: 3363272 - RNA, 12 nt, Neisseria meningitidis Z2491
acaaaugccguc

SEQ ID NO: 3363273 - RNA, 17 nt, Neisseria meningitidis Z2491
acaaauuccuaaaacuu

SEQ ID NO: 3363274 - RNA, 21 nt, Neisseria meningitidis Z2491
acaaauuccuaaaacuuaaaa

SEQ ID NO: 3363275 - RNA, 14 nt, Neisseria meningitidis Z2491
acaacaaaaugccg

SEQ ID NO: 3363276 - RNA, 14 nt, Neisseria meningitidis Z2491
acaacaaauuuuug

SEQ ID NO: 3363277 - RNA, 16 nt, Neisseria meningitidis Z2491
acaacggcguuuucaa

SEQ ID NO: 3363278 - RNA, 22 nt, Neisseria meningitidis Z2491
acaacggucguggcaacuucca

SEQ ID NO: 3363279 - RNA, 12 nt, Neisseria meningitidis Z2491
acaacucuuucg

SEQ ID NO: 3363280 - RNA, 18 nt, Neisseria meningitidis Z2491
acaacucuuucgggcugc

SEQ ID NO: 3363281 - RNA, 22 nt, Neisseria meningitidis Z2491
acaacugcaauuauaagguaag

SEQ ID NO: 3363282 - RNA, 17 nt, Neisseria meningitidis Z2491
acaagcgauuauuuuuu

SEQ ID NO: 3363283 - RNA, 13 nt, Neisseria meningitidis Z2491
acaagcuaaaauc

SEQ ID NO: 3363284 - RNA, 20 nt, Neisseria meningitidis Z2491
acaagcuacggcucguuuaa

SEQ ID NO: 3363285 - RNA, 18 nt, Neisseria meningitidis Z2491
acaaggacaaaaaaccaa

SEQ ID NO: 3363286 - RNA, 17 nt, Neisseria meningitidis Z2491
acaaggacagaaaacca

SEQ ID NO: 3363287 - RNA, 18 nt, Neisseria meningitidis Z2491
acaaggcuggauucccgc

SEQ ID NO: 3363288 - RNA, 12 nt, Neisseria meningitidis Z2491
acaagguuuuug

SEQ ID NO: 3363289 - RNA, 22 nt, Neisseria meningitidis Z2491
acaaucagaucggcaaacccuu

SEQ ID NO: 3363290 - RNA, 14 nt, Neisseria meningitidis Z2491
acaaucaucaucac

SEQ ID NO: 3363291 - RNA, 18 nt, Neisseria meningitidis Z2491
acaaucaucaucacaaug

SEQ ID NO: 3363292 - RNA, 17 nt, Neisseria meningitidis Z2491
acaauccgcuuuuuaaa

SEQ ID NO: 3363293 - RNA, 21 nt, Neisseria meningitidis Z2491
acaauccgcuuuuuaaacaac

SEQ ID NO: 3363294 - RNA, 20 nt, Neisseria meningitidis Z2491
acaaugaggucgaacugccu

SEQ ID NO: 3363295 - RNA, 12 nt, Neisseria meningitidis Z2491
acaauucccacc

SEQ ID NO: 3363296 - RNA, 22 nt, Neisseria meningitidis Z2491
acaauucccaccguuucccauc

SEQ ID NO: 3363297 - RNA, 12 nt, Neisseria meningitidis Z2491
acaauuucuccg

SEQ ID NO: 3363298 - RNA, 19 nt, Neisseria meningitidis Z2491
acaauuucuccgccagccu

SEQ ID NO: 3363299 - RNA, 18 nt, Neisseria meningitidis Z2491
acacaaaaaagccagcag

SEQ ID NO: 3363300 - RNA, 13 nt, Neisseria meningitidis Z2491
acacaaauauauu

SEQ ID NO: 3363301 - RNA, 15 nt, Neisseria meningitidis Z2491
acacaauucccaccg

SEQ ID NO: 3363302 - RNA, 14 nt, Neisseria meningitidis Z2491
acacaccauccuca

SEQ ID NO: 3363303 - RNA, 15 nt, Neisseria meningitidis Z2491
acacagccaaaauau

SEQ ID NO: 3363304 - RNA, 22 nt, Neisseria meningitidis Z2491
acaccgccgccaacaccgcgcc

SEQ ID NO: 3363305 - RNA, 22 nt, Neisseria meningitidis Z2491
acaccgccgcuccgcaaacaaa

SEQ ID NO: 3363306 - RNA, 20 nt, Neisseria meningitidis Z2491
acaccggauacggugucuuc

SEQ ID NO: 3363307 - RNA, 23 nt, Neisseria meningitidis Z2491
acaccuuucaaucaaugugccuc

SEQ ID NO: 3363308 - RNA, 20 nt, Neisseria meningitidis Z2491
acacgcagccgagcagcagu

SEQ ID NO: 3363309 - RNA, 22 nt, Neisseria meningitidis Z2491
acacgcccuuccacgcgcaccu

SEQ ID NO: 3363310 - RNA, 18 nt, Neisseria meningitidis Z2491
acacgcugccgcccaagc

SEQ ID NO: 3363311 - RNA, 12 nt, Neisseria meningitidis Z2491
acacggcaaaaa

SEQ ID NO: 3363312 - RNA, 16 nt, Neisseria meningitidis Z2491
acacggcaaaaauuua

SEQ ID NO: 3363313 - RNA, 20 nt, Neisseria meningitidis Z2491
acacggcggcacuugccgca

SEQ ID NO: 3363314 - RNA, 18 nt, Neisseria meningitidis Z2491
acacgggugauuuaagga

SEQ ID NO: 3363315 - RNA, 16 nt, Neisseria meningitidis Z2491
acacgguucugcaccg

SEQ ID NO: 3363316 - RNA, 16 nt, Neisseria meningitidis Z2491
acacgucguagccguc

SEQ ID NO: 3363317 - RNA, 20 nt, Neisseria meningitidis Z2491
acauuuguuccaauuccugu

SEQ ID NO: 3363318 - RNA, 20 nt, Neisseria meningitidis Z2491
acauuuucuugcuguuggaa

SEQ ID NO: 3363319 - RNA, 21 nt, Neisseria meningitidis Z2491
acauuuugcucauucacguaa

SEQ ID NO: 3363320 - RNA, 18 nt, Neisseria meningitidis Z2491
accaaaaacagaaaccug

SEQ ID NO: 3363321 - RNA, 14 nt, Neisseria meningitidis Z2491
accaaaaauuaaau

SEQ ID NO: 3363322 - RNA, 21 nt, Neisseria meningitidis Z2491
accaaaagccaaaaaacacaa

SEQ ID NO: 3363323 - RNA, 22 nt, Neisseria meningitidis Z2491
accaaaaugcccgccaguccua

SEQ ID NO: 3363324 - RNA, 19 nt, Neisseria meningitidis Z2491
accaaaucggcuuucagac

SEQ ID NO: 3363325 - RNA, 22 nt, Neisseria meningitidis Z2491
accaaccggguauucauacaca

SEQ ID NO: 3363326 - RNA, 16 nt, Neisseria meningitidis Z2491
accaacgaaacacucg

SEQ ID NO: 3363327 - RNA, 13 nt, Neisseria meningitidis Z2491
accaauaccgccu

SEQ ID NO: 3363328 - RNA, 16 nt, Neisseria meningitidis Z2491
accaauauucauacug

SEQ ID NO: 3363329 - RNA, 17 nt, Neisseria meningitidis Z2491
accaccagccacaacac

SEQ ID NO: 3363330 - RNA, 20 nt, Neisseria meningitidis Z2491
accacgucauucccacgaaa

SEQ ID NO: 3363331 - RNA, 13 nt, Neisseria meningitidis Z2491
accagaaucacuu

SEQ ID NO: 3363332 - RNA, 18 nt, Neisseria meningitidis Z2491
accagcagugccgcacca

SEQ ID NO: 3363333 - RNA, 20 nt, Neisseria meningitidis Z2491
accagcgcgaugucgcugcc

SEQ ID NO: 3363334 - RNA, 23 nt, Neisseria meningitidis Z2491
accaguacggcguucccucgccu

SEQ ID NO: 3363335 - RNA, 18 nt, Neisseria meningitidis Z2491
accaguacgguguugccu

SEQ ID NO: 3363336 - RNA, 16 nt, Neisseria meningitidis Z2491
accaguucccacgccc

SEQ ID NO: 3363337 - RNA, 13 nt, Neisseria meningitidis Z2491
accauaaagagca

SEQ ID NO: 3363338 - RNA, 16 nt, Neisseria meningitidis Z2491
accauaaauuuuaaau

SEQ ID NO: 3363339 - RNA, 17 nt, Neisseria meningitidis Z2491
accauaaauuuuaaaua

SEQ ID NO: 3363340 - RNA, 18 nt, Neisseria meningitidis Z2491
accauaccgccuucauca

SEQ ID NO: 3363341 - RNA, 22 nt, Neisseria meningitidis Z2491
accauaccgccuucaucaaaau

SEQ ID NO: 3363342 - RNA, 19 nt, Neisseria meningitidis Z2491
accaucguccaaccuuccc

SEQ ID NO: 3363343 - RNA, 16 nt, Neisseria meningitidis Z2491
accaucucuaagauuu

SEQ ID NO: 3363344 - RNA, 19 nt, Neisseria meningitidis Z2491
accaucuucuucaacaccu

SEQ ID NO: 3363345 - RNA, 17 nt, Neisseria meningitidis Z2491
accauggucgcugacac

SEQ ID NO: 3363346 - RNA, 16 nt, Neisseria meningitidis Z2491
accauuaccgcuuuaa

SEQ ID NO: 3363347 - RNA, 18 nt, Neisseria meningitidis Z2491
accauuggacagcggcaa

SEQ ID NO: 3363348 - RNA, 14 nt, Neisseria meningitidis Z2491
accauuguuucuga

SEQ ID NO: 3363349 - RNA, 19 nt, Neisseria meningitidis Z2491
accauuguuucugaagcca

SEQ ID NO: 3363350 - RNA, 14 nt, Neisseria meningitidis Z2491
acccaaauccgcca

SEQ ID NO: 3363351 - RNA, 20 nt, Neisseria meningitidis Z2491
acccaacaggguuccgaaau

SEQ ID NO: 3363352 - RNA, 16 nt, Neisseria meningitidis Z2491
acccaacuguuugcgc

SEQ ID NO: 3363353 - RNA, 17 nt, Neisseria meningitidis Z2491
acccaacuuacgcaacc

SEQ ID NO: 3363354 - RNA, 21 nt, Neisseria meningitidis Z2491
acccaaugcuucaaccacgcu

SEQ ID NO: 3363355 - RNA, 19 nt, Neisseria meningitidis Z2491
acccauauaaggcugcaaa

SEQ ID NO: 3363356 - RNA, 21 nt, Neisseria meningitidis Z2491
acccaugccauacugccugcc

SEQ ID NO: 3363357 - RNA, 21 nt, Neisseria meningitidis Z2491
acccauuuggagucgccuucg

SEQ ID NO: 3363358 - RNA, 16 nt, Neisseria meningitidis Z2491
accccaggauaaaggg

SEQ ID NO: 3363359 - RNA, 19 nt, Neisseria meningitidis Z2491
acccccgaaugacaacccu

SEQ ID NO: 3363360 - RNA, 16 nt, Neisseria meningitidis Z2491
acccgaaucacaaaca

SEQ ID NO: 3363361 - RNA, 19 nt, Neisseria meningitidis Z2491
acccgacuucugacagcau

SEQ ID NO: 3363362 - RNA, 19 nt, Neisseria meningitidis Z2491
acccgguuuugcgccucgc

SEQ ID NO: 3363363 - RNA, 19 nt, Neisseria meningitidis Z2491
acccgucauucccacgcag

SEQ ID NO: 3363364 - RNA, 20 nt, Neisseria meningitidis Z2491
acccuaccauuguuucugaa

SEQ ID NO: 3363365 - RNA, 14 nt, Neisseria meningitidis Z2491
acccucucaaacgu

SEQ ID NO: 3363366 - RNA, 17 nt, Neisseria meningitidis Z2491
acccugcaaggcggcgg

SEQ ID NO: 3363367 - RNA, 19 nt, Neisseria meningitidis Z2491
acccugccgucauucccgc

SEQ ID NO: 3363368 - RNA, 22 nt, Neisseria meningitidis Z2491
acccugucgccgucauucccgc

SEQ ID NO: 3363369 - RNA, 18 nt, Neisseria meningitidis Z2491
acccuuaucccaauauua

SEQ ID NO: 3363370 - RNA, 12 nt, Neisseria meningitidis Z2491
accgaaaaauaa

SEQ ID NO: 3363371 - RNA, 12 nt, Neisseria meningitidis Z2491
accgaaacagaa

SEQ ID NO: 3363372 - RNA, 18 nt, Neisseria meningitidis Z2491
accgaaacagaaacccaa

SEQ ID NO: 3363373 - RNA, 17 nt, Neisseria meningitidis Z2491
accgaagcucuguucga

SEQ ID NO: 3363374 - RNA, 15 nt, Neisseria meningitidis Z2491
accgaaguuuaaaga

SEQ ID NO: 3363375 - RNA, 14 nt, Neisseria meningitidis Z2491
accgacgaaggcaa

SEQ ID NO: 3363376 - RNA, 16 nt, Neisseria meningitidis Z2491
accgaugccgucauuc

SEQ ID NO: 3363377 - RNA, 19 nt, Neisseria meningitidis Z2491
accgauuaagguuaauuaa

SEQ ID NO: 3363378 - RNA, 21 nt, Neisseria meningitidis Z2491
accgauucacuuggugcuuca

SEQ ID NO: 3363379 - RNA, 12 nt, Neisseria meningitidis Z2491
accgcacccccg

SEQ ID NO: 3363380 - RNA, 22 nt, Neisseria meningitidis Z2491
accgccaaguggagcuggauga

SEQ ID NO: 3363381 - RNA, 11 nt, Neisseria meningitidis Z2491
accgccagccu

SEQ ID NO: 3363382 - RNA, 20 nt, Neisseria meningitidis Z2491
accgccaucaggaaugcaaa

SEQ ID NO: 3363383 - RNA, 14 nt, Neisseria meningitidis Z2491
accgccauucccgc

SEQ ID NO: 3363384 - RNA, 21 nt, Neisseria meningitidis Z2491
accgccgccaacaccgcgccu

SEQ ID NO: 3363385 - RNA, 21 nt, Neisseria meningitidis Z2491
accgccgccgccaaugccguc

SEQ ID NO: 3363386 - RNA, 14 nt, Neisseria meningitidis Z2491
accgccgccgccuu

SEQ ID NO: 3363387 - RNA, 16 nt, Neisseria meningitidis Z2491
accgccgccguaaccg

SEQ ID NO: 3363388 - RNA, 17 nt, Neisseria meningitidis Z2491
accgccgcuccgcaaac

SEQ ID NO: 3363389 - RNA, 22 nt, Neisseria meningitidis Z2491
accgccgcuccgcaaacaaaau

SEQ ID NO: 3363390 - RNA, 20 nt, Neisseria meningitidis Z2491
accgcgaacaucaucuaaau

SEQ ID NO: 3363391 - RNA, 13 nt, Neisseria meningitidis Z2491
accgcgccugcca

SEQ ID NO: 3363392 - RNA, 11 nt, Neisseria meningitidis Z2491
accgcgcgcca

SEQ ID NO: 3363393 - RNA, 20 nt, Neisseria meningitidis Z2491
accgcuccgccgucauuccc

SEQ ID NO: 3363394 - RNA, 13 nt, Neisseria meningitidis Z2491
accgcuguuuccg

SEQ ID NO: 3363395 - RNA, 22 nt, Neisseria meningitidis Z2491
accgcuuuguccaaaucggcaa

SEQ ID NO: 3363396 - RNA, 21 nt, Neisseria meningitidis Z2491
accggauacggugucuucaau

SEQ ID NO: 3363397 - RNA, 13 nt, Neisseria meningitidis Z2491
accggauucccgc

SEQ ID NO: 3363398 - RNA, 22 nt, Neisseria meningitidis Z2491
accggauuccuacgaaaacagg

SEQ ID NO: 3363399 - RNA, 15 nt, Neisseria meningitidis Z2491
accggcauucugcac

SEQ ID NO: 3363400 - RNA, 11 nt, Neisseria meningitidis Z2491
accgggcaggc

SEQ ID NO: 3363401 - RNA, 23 nt, Neisseria meningitidis Z2491
accgguacggcguugccucgccu

SEQ ID NO: 3363402 - RNA, 14 nt, Neisseria meningitidis Z2491
accgguccuuccau

SEQ ID NO: 3363403 - RNA, 16 nt, Neisseria meningitidis Z2491
accguacugguuuaaa

SEQ ID NO: 3363404 - RNA, 14 nt, Neisseria meningitidis Z2491
accguauauuuccc

SEQ ID NO: 3363405 - RNA, 15 nt, Neisseria meningitidis Z2491
accguaucaaacaag

SEQ ID NO: 3363406 - RNA, 16 nt, Neisseria meningitidis Z2491
accguaugcaaaaaca

SEQ ID NO: 3363407 - RNA, 18 nt, Neisseria meningitidis Z2491
accguaugcaaaaacaac

SEQ ID NO: 3363408 - RNA, 17 nt, Neisseria meningitidis Z2491
accguccaaacuuccga

SEQ ID NO: 3363409 - RNA, 19 nt, Neisseria meningitidis Z2491
accgucgggcaucugcagc

SEQ ID NO: 3363410 - RNA, 18 nt, Neisseria meningitidis Z2491
accgucugaacaucgugu

SEQ ID NO: 3363411 - RNA, 20 nt, Neisseria meningitidis Z2491
accgugcggcacgccgccgu

SEQ ID NO: 3363412 - RNA, 16 nt, Neisseria meningitidis Z2491
accguucaauuucaac

SEQ ID NO: 3363413 - RNA, 23 nt, Neisseria meningitidis Z2491
accguugaaugugcgccacgcca

SEQ ID NO: 3363414 - RNA, 21 nt, Neisseria meningitidis Z2491
accguugcagccaugcggcaa

SEQ ID NO: 3363415 - RNA, 22 nt, Neisseria meningitidis Z2491
accguugcagccaugcggcaaa

SEQ ID NO: 3363416 - RNA, 15 nt, Neisseria meningitidis Z2491
accguuuaaaacagc

SEQ ID NO: 3363417 - RNA, 18 nt, Neisseria meningitidis Z2491
accguuuaaaacagcauu

SEQ ID NO: 3363418 - RNA, 15 nt, Neisseria meningitidis Z2491
acggcaaccggccgg

SEQ ID NO: 3363419 - RNA, 15 nt, Neisseria meningitidis Z2491
acggcaacguucagg

SEQ ID NO: 3363420 - RNA, 15 nt, Neisseria meningitidis Z2491
acggcaauauucaaa

SEQ ID NO: 3363421 - RNA, 18 nt, Neisseria meningitidis Z2491
acggcacaaacgccagca

SEQ ID NO: 3363422 - RNA, 16 nt, Neisseria meningitidis Z2491
acggcacuuucauuca

SEQ ID NO: 3363423 - RNA, 14 nt, Neisseria meningitidis Z2491
acggcagagcgguu

SEQ ID NO: 3363424 - RNA, 14 nt, Neisseria meningitidis Z2491
acggcaggcaaaaa

SEQ ID NO: 3363425 - RNA, 16 nt, Neisseria meningitidis Z2491
acggcaggcaaaaaaa

SEQ ID NO: 3363426 - RNA, 20 nt, Neisseria meningitidis Z2491
acggcagguaaaaaauagaa

SEQ ID NO: 3363427 - RNA, 19 nt, Neisseria meningitidis Z2491
acggcaguuuccaauacaa

SEQ ID NO: 3363428 - RNA, 23 nt, Neisseria meningitidis Z2491
acggcauaucccgacagaacaga

SEQ ID NO: 3363429 - RNA, 15 nt, Neisseria meningitidis Z2491
acggcaucaaaaacu

SEQ ID NO: 3363430 - RNA, 22 nt, Neisseria meningitidis Z2491
acggcauccgcuuaaaaaacaa

SEQ ID NO: 3363431 - RNA, 22 nt, Neisseria meningitidis Z2491
acggcauccuugaucugcgaaa

SEQ ID NO: 3363432 - RNA, 20 nt, Neisseria meningitidis Z2491
acggcaucgguuucuucuuc

SEQ ID NO: 3363433 - RNA, 16 nt, Neisseria meningitidis Z2491
acggcaucuuuuuuug

SEQ ID NO: 3363434 - RNA, 20 nt, Neisseria meningitidis Z2491
acggcauuuuagauuuggca

SEQ ID NO: 3363435 - RNA, 14 nt, Neisseria meningitidis Z2491
acggcauuuucaac

SEQ ID NO: 3363436 - RNA, 16 nt, Neisseria meningitidis Z2491
acggcauuuugauugc

SEQ ID NO: 3363437 - RNA, 22 nt, Neisseria meningitidis Z2491
acggcauuuuguuuuuaagaag

SEQ ID NO: 3363438 - RNA, 21 nt, Neisseria meningitidis Z2491
acggcauuuuuacaaggcagc

SEQ ID NO: 3363439 - RNA, 20 nt, Neisseria meningitidis Z2491
acggcauuuuuauugcuuca

SEQ ID NO: 3363440 - RNA, 13 nt, Neisseria meningitidis Z2491
acggcauuuuuga

SEQ ID NO: 3363441 - RNA, 13 nt, Neisseria meningitidis Z2491
acggcauuuuugc

SEQ ID NO: 3363442 - RNA, 18 nt, Neisseria meningitidis Z2491
acggccggcgcagcuccu

SEQ ID NO: 3363443 - RNA, 14 nt, Neisseria meningitidis Z2491
acggcggcagccug

SEQ ID NO: 3363444 - RNA, 19 nt, Neisseria meningitidis Z2491
acggcggcagggucggcga

SEQ ID NO: 3363445 - RNA, 17 nt, Neisseria meningitidis Z2491
acggcggcaggguuuua

SEQ ID NO: 3363446 - RNA, 16 nt, Neisseria meningitidis Z2491
acggcgggcaggcggc

SEQ ID NO: 3363447 - RNA, 15 nt, Neisseria meningitidis Z2491
acggcggggggauuu

SEQ ID NO: 3363448 - RNA, 21 nt, Neisseria meningitidis Z2491
acggcguucccucgccuugcc

SEQ ID NO: 3363449 - RNA, 14 nt, Neisseria meningitidis Z2491
acggcguuuucaac

SEQ ID NO: 3363450 - RNA, 18 nt, Neisseria meningitidis Z2491
acgggaaguuuuuugugu

SEQ ID NO: 3363451 - RNA, 16 nt, Neisseria meningitidis Z2491
acgggaaugacgaaga

SEQ ID NO: 3363452 - RNA, 19 nt, Neisseria meningitidis Z2491
acgggacuuugcggcugug

SEQ ID NO: 3363453 - RNA, 12 nt, Neisseria meningitidis Z2491
acgggauuuuag

SEQ ID NO: 3363454 - RNA, 23 nt, Neisseria meningitidis Z2491
acgggcaaccuuauuuccgucag

SEQ ID NO: 3363455 - RNA, 15 nt, Neisseria meningitidis Z2491
acggggaggaaaguc

SEQ ID NO: 3363456 - RNA, 22 nt, Neisseria meningitidis Z2491
acgggguugccugcaaugcacu

SEQ ID NO: 3363457 - RNA, 16 nt, Neisseria meningitidis Z2491
acgggugauuuaagga

SEQ ID NO: 3363458 - RNA, 17 nt, Neisseria meningitidis Z2491
acggguucagacggcau

SEQ ID NO: 3363459 - RNA, 20 nt, Neisseria meningitidis Z2491
acggguuugcuuucgcugcc

SEQ ID NO: 3363460 - RNA, 15 nt, Neisseria meningitidis Z2491
acgguauucauaccu

SEQ ID NO: 3363461 - RNA, 14 nt, Neisseria meningitidis Z2491
acgguauucuuucg

SEQ ID NO: 3363462 - RNA, 22 nt, Neisseria meningitidis Z2491
acggucaacccguaugccgccu

SEQ ID NO: 3363463 - RNA, 16 nt, Neisseria meningitidis Z2491
acggucagaaaauuuc

SEQ ID NO: 3363464 - RNA, 17 nt, Neisseria meningitidis Z2491
acggugucagacggcau

SEQ ID NO: 3363465 - RNA, 19 nt, Neisseria meningitidis Z2491
acggugugccgaaguuaaa

SEQ ID NO: 3363466 - RNA, 17 nt, Neisseria meningitidis Z2491
acgguguugccucgccu

SEQ ID NO: 3363467 - RNA, 17 nt, Neisseria meningitidis Z2491
acgguuugucugccgag

SEQ ID NO: 3363468 - RNA, 14 nt, Neisseria meningitidis Z2491
acguacaaaugccg

SEQ ID NO: 3363469 - RNA, 19 nt, Neisseria meningitidis Z2491
acguacugguuuuuguuaa

SEQ ID NO: 3363470 - RNA, 16 nt, Neisseria meningitidis Z2491
acguaucggauaaaac

SEQ ID NO: 3363471 - RNA, 20 nt, Neisseria meningitidis Z2491
acgucaagcaaaaaaugccg

SEQ ID NO: 3363472 - RNA, 18 nt, Neisseria meningitidis Z2491
acguccaccugaacggca

SEQ ID NO: 3363473 - RNA, 21 nt, Neisseria meningitidis Z2491
acguccaccugaacggcacaa

SEQ ID NO: 3363474 - RNA, 21 nt, Neisseria meningitidis Z2491
acgucggcagucuguaccgca

SEQ ID NO: 3363475 - RNA, 20 nt, Neisseria meningitidis Z2491
acgucuuacucaauaagucu

SEQ ID NO: 3363476 - RNA, 20 nt, Neisseria meningitidis Z2491
acguggguuugagauauagu

SEQ ID NO: 3363477 - RNA, 12 nt, Neisseria meningitidis Z2491
acguucuagauu

SEQ ID NO: 3363478 - RNA, 12 nt, Neisseria meningitidis Z2491
acguucuggauu

SEQ ID NO: 3363479 - RNA, 11 nt, Neisseria meningitidis Z2491
acguuuuccaa

SEQ ID NO: 3363480 - RNA, 19 nt, Neisseria meningitidis Z2491
acuaaaaccggucggaaga

SEQ ID NO: 3363481 - RNA, 15 nt, Neisseria meningitidis Z2491
acuaaaauuuuaugc

SEQ ID NO: 3363482 - RNA, 17 nt, Neisseria meningitidis Z2491
acuaacuuauacacacg

SEQ ID NO: 3363483 - RNA, 18 nt, Neisseria meningitidis Z2491
acuacgcggcugaaaaaa

SEQ ID NO: 3363484 - RNA, 19 nt, Neisseria meningitidis Z2491
acuacgcggcugaaaaaau

SEQ ID NO: 3363485 - RNA, 23 nt, Neisseria meningitidis Z2491
acuacgcggcugaaaaaaugccg

SEQ ID NO: 3363486 - RNA, 13 nt, Neisseria meningitidis Z2491
acuagccaaaaaa

SEQ ID NO: 3363487 - RNA, 19 nt, Neisseria meningitidis Z2491
acuagccaaaaaaaccgaa

SEQ ID NO: 3363488 - RNA, 20 nt, Neisseria meningitidis Z2491
acuauaauuuauugaagaug

SEQ ID NO: 3363489 - RNA, 20 nt, Neisseria meningitidis Z2491
acuauaauuuuuaaaauuuu

SEQ ID NO: 3363490 - RNA, 19 nt, Neisseria meningitidis Z2491
acuauaggaacauuuagaa

SEQ ID NO: 3363491 - RNA, 17 nt, Neisseria meningitidis Z2491
acuauaguggauuaaca

SEQ ID NO: 3363492 - RNA, 16 nt, Neisseria meningitidis Z2491
acuauaucgucauucc

SEQ ID NO: 3363493 - RNA, 17 nt, Neisseria meningitidis Z2491
acuauaucgucauuccc

SEQ ID NO: 3363494 - RNA, 21 nt, Neisseria meningitidis Z2491
acuauuuguacugucugcggc

SEQ ID NO: 3363495 - RNA, 22 nt, Neisseria meningitidis Z2491
acuauuuguacugucugcggcu

SEQ ID NO: 3363496 - RNA, 15 nt, Neisseria meningitidis Z2491
acucaaagcugcaag

SEQ ID NO: 3363497 - RNA, 20 nt, Neisseria meningitidis Z2491
acucaaucaaaucgggaauc

SEQ ID NO: 3363498 - RNA, 13 nt, Neisseria meningitidis Z2491
acucacuuuaauc

SEQ ID NO: 3363499 - RNA, 15 nt, Neisseria meningitidis Z2491
acucacuuuaaucaa

SEQ ID NO: 3363500 - RNA, 21 nt, Neisseria meningitidis Z2491
acucacuuuaaucaauccgaa

SEQ ID NO: 3363501 - RNA, 16 nt, Neisseria meningitidis Z2491
acucauucaauccuca

SEQ ID NO: 3363502 - RNA, 13 nt, Neisseria meningitidis Z2491
acuccaaagagaa

SEQ ID NO: 3363503 - RNA, 17 nt, Neisseria meningitidis Z2491
acuccaaagagaaagaa

SEQ ID NO: 3363504 - RNA, 18 nt, Neisseria meningitidis Z2491
acucggcaaacgcuucgc

SEQ ID NO: 3363505 - RNA, 19 nt, Neisseria meningitidis Z2491
acucuaaaccgucauuccu

SEQ ID NO: 3363506 - RNA, 20 nt, Neisseria meningitidis Z2491
acucuaaucgcgucauuccc

SEQ ID NO: 3363507 - RNA, 21 nt, Neisseria meningitidis Z2491
acucugcggacuuaagaaaca

SEQ ID NO: 3363508 - RNA, 22 nt, Neisseria meningitidis Z2491
acucugcggacuuaagaaacaa

SEQ ID NO: 3363509 - RNA, 23 nt, Neisseria meningitidis Z2491
acucugcggacuuaagaaacaaa

SEQ ID NO: 3363510 - RNA, 13 nt, Neisseria meningitidis Z2491
acucuuaaaacac

SEQ ID NO: 3363511 - RNA, 19 nt, Neisseria meningitidis Z2491
acugaaaaauacgaugccg

SEQ ID NO: 3363512 - RNA, 18 nt, Neisseria meningitidis Z2491
acugaaacucaaaaaaac

SEQ ID NO: 3363513 - RNA, 17 nt, Neisseria meningitidis Z2491
acugagaccuuugcaau

SEQ ID NO: 3363514 - RNA, 12 nt, Neisseria meningitidis Z2491
acugaucagaca

SEQ ID NO: 3363515 - RNA, 18 nt, Neisseria meningitidis Z2491
acugauuuacgucggcac

SEQ ID NO: 3363516 - RNA, 16 nt, Neisseria meningitidis Z2491
acugauuuauauuguu

SEQ ID NO: 3363517 - RNA, 17 nt, Neisseria meningitidis Z2491
acugcaguaacuucaaa

SEQ ID NO: 3363518 - RNA, 17 nt, Neisseria meningitidis Z2491
acugccagucuuuaaau

SEQ ID NO: 3363519 - RNA, 20 nt, Neisseria meningitidis Z2491
agauuuuuguuuaucuuuca

SEQ ID NO: 3363520 - RNA, 19 nt, Neisseria meningitidis Z2491
agauuuuuuuauuuaaaca

SEQ ID NO: 3363521 - RNA, 16 nt, Neisseria meningitidis Z2491
agcaaaaaaugccguc

SEQ ID NO: 3363522 - RNA, 19 nt, Neisseria meningitidis Z2491
agcaaaaagguuuucagac

SEQ ID NO: 3363523 - RNA, 15 nt, Neisseria meningitidis Z2491
agcaaaaaugccguc

SEQ ID NO: 3363524 - RNA, 19 nt, Neisseria meningitidis Z2491
agcaaaagaccgucugaac

SEQ ID NO: 3363525 - RNA, 13 nt, Neisseria meningitidis Z2491
agcaaaugccguc

SEQ ID NO: 3363526 - RNA, 14 nt, Neisseria meningitidis Z2491
agcaaaugccgucu

SEQ ID NO: 3363527 - RNA, 23 nt, Neisseria meningitidis Z2491
agcaaaugccuuauccagaaaau

SEQ ID NO: 3363528 - RNA, 16 nt, Neisseria meningitidis Z2491
agcaacgacagcagca

SEQ ID NO: 3363529 - RNA, 19 nt, Neisseria meningitidis Z2491
agcaacugaaccgucauuc

SEQ ID NO: 3363530 - RNA, 21 nt, Neisseria meningitidis Z2491
agcaacugaaccgucauuccc

SEQ ID NO: 3363531 - RNA, 22 nt, Neisseria meningitidis Z2491
agcaacugaaccgucauuccca

SEQ ID NO: 3363532 - RNA, 14 nt, Neisseria meningitidis Z2491
agcaauccauuccc

SEQ ID NO: 3363533 - RNA, 16 nt, Neisseria meningitidis Z2491
agcaauccauucccuc

SEQ ID NO: 3363534 - RNA, 12 nt, Neisseria meningitidis Z2491
agcaauccugcc

SEQ ID NO: 3363535 - RNA, 12 nt, Neisseria meningitidis Z2491
agcaaugcgucu

SEQ ID NO: 3363536 - RNA, 14 nt, Neisseria meningitidis Z2491
agcacaaacagcau

SEQ ID NO: 3363537 - RNA, 15 nt, Neisseria meningitidis Z2491
agcacaaacagcaug

SEQ ID NO: 3363538 - RNA, 15 nt, Neisseria meningitidis Z2491
agcacaaaugccaaa

SEQ ID NO: 3363539 - RNA, 16 nt, Neisseria meningitidis Z2491
agcacaaaugccaaag

SEQ ID NO: 3363540 - RNA, 16 nt, Neisseria meningitidis Z2491
agcacaaauuaaaaua

SEQ ID NO: 3363541 - RNA, 12 nt, Neisseria meningitidis Z2491
agcacaggcaag

SEQ ID NO: 3363542 - RNA, 16 nt, Neisseria meningitidis Z2491
agcacaucgucugcaa

SEQ ID NO: 3363543 - RNA, 18 nt, Neisseria meningitidis Z2491
agcacaucgucugcaagc

SEQ ID NO: 3363544 - RNA, 23 nt, Neisseria meningitidis Z2491
agcaccaagugaaucgguuccgu

SEQ ID NO: 3363545 - RNA, 21 nt, Neisseria meningitidis Z2491
agcaccguuuaaaacagcauu

SEQ ID NO: 3363546 - RNA, 19 nt, Neisseria meningitidis Z2491
agcacgauacacaaaaaag

SEQ ID NO: 3363547 - RNA, 22 nt, Neisseria meningitidis Z2491
agcacgauacacaaaaaagcca

SEQ ID NO: 3363548 - RNA, 23 nt, Neisseria meningitidis Z2491
agcacgauacacaaaaaagccag

SEQ ID NO: 3363549 - RNA, 21 nt, Neisseria meningitidis Z2491
agcacugccucuuuucagaca

SEQ ID NO: 3363550 - RNA, 16 nt, Neisseria meningitidis Z2491
agcagaaucaaauauu

SEQ ID NO: 3363551 - RNA, 18 nt, Neisseria meningitidis Z2491
agcagaaucaaauauuaa

SEQ ID NO: 3363552 - RNA, 13 nt, Neisseria meningitidis Z2491
agcagagcugugc

SEQ ID NO: 3363553 - RNA, 11 nt, Neisseria meningitidis Z2491
agcagcagccc

SEQ ID NO: 3363554 - RNA, 20 nt, Neisseria meningitidis Z2491
agcagcccgucuaugccgag

SEQ ID NO: 3363555 - RNA, 21 nt, Neisseria meningitidis Z2491
agcagcuuuugcgccacggca

SEQ ID NO: 3363556 - RNA, 17 nt, Neisseria meningitidis Z2491
agcaggacggcuuugaa

SEQ ID NO: 3363557 - RNA, 14 nt, Neisseria meningitidis Z2491
agcaggguuuucau

SEQ ID NO: 3363558 - RNA, 21 nt, Neisseria meningitidis Z2491
agcaguaaaauuuauuaugua

SEQ ID NO: 3363559 - RNA, 16 nt, Neisseria meningitidis Z2491
agcagugccgcaccac

SEQ ID NO: 3363560 - RNA, 16 nt, Neisseria meningitidis Z2491
agcaguuuuuugacuu

SEQ ID NO: 3363561 - RNA, 15 nt, Neisseria meningitidis Z2491
agcauaaaauuuuag

SEQ ID NO: 3363562 - RNA, 22 nt, Neisseria meningitidis Z2491
agcauaccguucaaacugcccg

SEQ ID NO: 3363563 - RNA, 22 nt, Neisseria meningitidis Z2491
agcauauaacaccuuucaauca

SEQ ID NO: 3363564 - RNA, 15 nt, Neisseria meningitidis Z2491
agcaucaaaccauau

SEQ ID NO: 3363565 - RNA, 19 nt, Neisseria meningitidis Z2491
agcaucauauugguuccgu

SEQ ID NO: 3363566 - RNA, 16 nt, Neisseria meningitidis Z2491
agcauccuuuccucuu

SEQ ID NO: 3363567 - RNA, 15 nt, Neisseria meningitidis Z2491
agcaucgcagauucg

SEQ ID NO: 3363568 - RNA, 17 nt, Neisseria meningitidis Z2491
agcaucguuacaaauuu

SEQ ID NO: 3363569 - RNA, 21 nt, Neisseria meningitidis Z2491
agcaucuuguuuuucaaucaa

SEQ ID NO: 3363570 - RNA, 24 nt, Neisseria meningitidis Z2491
agcauuuaauucacgacuucagca

SEQ ID NO: 3363571 - RNA, 21 nt, Neisseria meningitidis Z2491
agccaaaaacagaaaccuaaa

SEQ ID NO: 3363572 - RNA, 19 nt, Neisseria meningitidis Z2491
agccaaaccgcagcaacgu

SEQ ID NO: 3363573 - RNA, 18 nt, Neisseria meningitidis Z2491
agccaugcggcaaaaagc

SEQ ID NO: 3363574 - RNA, 18 nt, Neisseria meningitidis Z2491
agcccacccuaccauugu

SEQ ID NO: 3363575 - RNA, 14 nt, Neisseria meningitidis Z2491
agcccgagauaacu

SEQ ID NO: 3363576 - RNA, 14 nt, Neisseria meningitidis Z2491
agccgaaaaccugu

SEQ ID NO: 3363577 - RNA, 15 nt, Neisseria meningitidis Z2491
agccgaaaaccugug

SEQ ID NO: 3363578 - RNA, 18 nt, Neisseria meningitidis Z2491
agccgaaacccaaacaca

SEQ ID NO: 3363579 - RNA, 18 nt, Neisseria meningitidis Z2491
agccgaacaccagugcga

SEQ ID NO: 3363580 - RNA, 20 nt, Neisseria meningitidis Z2491
agccgcccaaugccgucuga

SEQ ID NO: 3363581 - RNA, 18 nt, Neisseria meningitidis Z2491
agccgcuucagacggcau

SEQ ID NO: 3363582 - RNA, 16 nt, Neisseria meningitidis Z2491
agccggccaacaucag

SEQ ID NO: 3363583 - RNA, 18 nt, Neisseria meningitidis Z2491
agccggccaacaucagca

SEQ ID NO: 3363584 - RNA, 21 nt, Neisseria meningitidis Z2491
agccggcgauauuguguaccg

SEQ ID NO: 3363585 - RNA, 13 nt, Neisseria meningitidis Z2491
agccggggcaggc

SEQ ID NO: 3363586 - RNA, 23 nt, Neisseria meningitidis Z2491
agccguauuugucuuccgccaaa

SEQ ID NO: 3363587 - RNA, 21 nt, Neisseria meningitidis Z2491
agccguauuuuuuaaccaacu

SEQ ID NO: 3363588 - RNA, 15 nt, Neisseria meningitidis Z2491
agccgucauucccgc

SEQ ID NO: 3363589 - RNA, 17 nt, Neisseria meningitidis Z2491
agccgucgccccaaaaa

SEQ ID NO: 3363590 - RNA, 18 nt, Neisseria meningitidis Z2491
agccgucgccccaaaaag

SEQ ID NO: 3363591 - RNA, 13 nt, Neisseria meningitidis Z2491
agccuaaaacauc

SEQ ID NO: 3363592 - RNA, 21 nt, Neisseria meningitidis Z2491
agccuacuugcccgccuucag

SEQ ID NO: 3363593 - RNA, 15 nt, Neisseria meningitidis Z2491
agccuaucaucagau

SEQ ID NO: 3363594 - RNA, 13 nt, Neisseria meningitidis Z2491
agccuauccauuc

SEQ ID NO: 3363595 - RNA, 21 nt, Neisseria meningitidis Z2491
agccuauuuuucugaaaaauu

SEQ ID NO: 3363596 - RNA, 13 nt, Neisseria meningitidis Z2491
agccugcagcaga

SEQ ID NO: 3363597 - RNA, 13 nt, Neisseria meningitidis Z2491
agccugcccaucg

SEQ ID NO: 3363598 - RNA, 16 nt, Neisseria meningitidis Z2491
agccugcccaucgccu

SEQ ID NO: 3363599 - RNA, 19 nt, Neisseria meningitidis Z2491
agccugcucggccugcccu

SEQ ID NO: 3363600 - RNA, 20 nt, Neisseria meningitidis Z2491
agccuguccaaagccucgcg

SEQ ID NO: 3363601 - RNA, 20 nt, Neisseria meningitidis Z2491
agccuuaacagggaaagcag

SEQ ID NO: 3363602 - RNA, 13 nt, Neisseria meningitidis Z2491
agccuucaaacgc

SEQ ID NO: 3363603 - RNA, 23 nt, Neisseria meningitidis Z2491
agccuucacgccgccgcgcccca

SEQ ID NO: 3363604 - RNA, 16 nt, Neisseria meningitidis Z2491
agccuucagacggcau

SEQ ID NO: 3363605 - RNA, 18 nt, Neisseria meningitidis Z2491
agccuucuucuaaaaaua

SEQ ID NO: 3363606 - RNA, 23 nt, Neisseria meningitidis Z2491
agccuuuagggguuucagacggc

SEQ ID NO: 3363607 - RNA, 12 nt, Neisseria meningitidis Z2491
agccuuucagac

SEQ ID NO: 3363608 - RNA, 20 nt, Neisseria meningitidis Z2491
agccuuucagacggcauuuu

SEQ ID NO: 3363609 - RNA, 21 nt, Neisseria meningitidis Z2491
agcgacacgaccgaccggcau

SEQ ID NO: 3363610 - RNA, 12 nt, Neisseria meningitidis Z2491
agcgagacggca

SEQ ID NO: 3363611 - RNA, 13 nt, Neisseria meningitidis Z2491
agcgagacggcau

SEQ ID NO: 3363612 - RNA, 15 nt, Neisseria meningitidis Z2491
agcgauuauuuuuua

SEQ ID NO: 3363613 - RNA, 18 nt, Neisseria meningitidis Z2491
agcgcaaccuugccaagg

SEQ ID NO: 3363614 - RNA, 21 nt, Neisseria meningitidis Z2491
agcgcaaccuugccaagguug

SEQ ID NO: 3363615 - RNA, 14 nt, Neisseria meningitidis Z2491
agcgcgucaaacag

SEQ ID NO: 3363616 - RNA, 21 nt, Neisseria meningitidis Z2491
agcgcgucaaacagacggaau

SEQ ID NO: 3363617 - RNA, 17 nt, Neisseria meningitidis Z2491
agcgcguuuucauccac

SEQ ID NO: 3363618 - RNA, 13 nt, Neisseria meningitidis Z2491
agcggaaauccag

SEQ ID NO: 3363619 - RNA, 16 nt, Neisseria meningitidis Z2491
agcggaaaucguacca

SEQ ID NO: 3363620 - RNA, 19 nt, Neisseria meningitidis Z2491
aggcgggcaggcagugcau

SEQ ID NO: 3363621 - RNA, 20 nt, Neisseria meningitidis Z2491
aggcguaggucagcccggcg

SEQ ID NO: 3363622 - RNA, 14 nt, Neisseria meningitidis Z2491
aggcguguuugccg

SEQ ID NO: 3363623 - RNA, 16 nt, Neisseria meningitidis Z2491
aggcguugggaaaggu

SEQ ID NO: 3363624 - RNA, 19 nt, Neisseria meningitidis Z2491
aggcugccgcacaagcccu

SEQ ID NO: 3363625 - RNA, 15 nt, Neisseria meningitidis Z2491
aggcugccuuaugua

SEQ ID NO: 3363626 - RNA, 20 nt, Neisseria meningitidis Z2491
aggcugcggcaacgggagga

SEQ ID NO: 3363627 - RNA, 18 nt, Neisseria meningitidis Z2491
aggcuggaaaacagcugu

SEQ ID NO: 3363628 - RNA, 22 nt, Neisseria meningitidis Z2491
aggcuguaugccgucugaaacc

SEQ ID NO: 3363629 - RNA, 14 nt, Neisseria meningitidis Z2491
aggcuguggagcau

SEQ ID NO: 3363630 - RNA, 22 nt, Neisseria meningitidis Z2491
aggcuuacucguucggcagccu

SEQ ID NO: 3363631 - RNA, 14 nt, Neisseria meningitidis Z2491
aggcuuauuucacu

SEQ ID NO: 3363632 - RNA, 14 nt, Neisseria meningitidis Z2491
aggcuucagacggc

SEQ ID NO: 3363633 - RNA, 16 nt, Neisseria meningitidis Z2491
aggcuucagacggcau

SEQ ID NO: 3363634 - RNA, 17 nt, Neisseria meningitidis Z2491
aggcuucagacggcauc

SEQ ID NO: 3363635 - RNA, 17 nt, Neisseria meningitidis Z2491
aggcuucagacggcauu

SEQ ID NO: 3363636 - RNA, 20 nt, Neisseria meningitidis Z2491
aggcuucagacgguauucuu

SEQ ID NO: 3363637 - RNA, 13 nt, Neisseria meningitidis Z2491
aggcuuucagacg

SEQ ID NO: 3363638 - RNA, 16 nt, Neisseria meningitidis Z2491
aggcuuucagacggca

SEQ ID NO: 3363639 - RNA, 17 nt, Neisseria meningitidis Z2491
aggcuuucagacggcau

SEQ ID NO: 3363640 - RNA, 16 nt, Neisseria meningitidis Z2491
aggcuuuugaggcugc

SEQ ID NO: 3363641 - RNA, 17 nt, Neisseria meningitidis Z2491
aggcuuuuucagacggc

SEQ ID NO: 3363642 - RNA, 19 nt, Neisseria meningitidis Z2491
aggcuuuuucagacggcau

SEQ ID NO: 3363643 - RNA, 15 nt, Neisseria meningitidis Z2491
aggcuuuuuucuguu

SEQ ID NO: 3363644 - RNA, 18 nt, Neisseria meningitidis Z2491
agggaaagugauuuuguc

SEQ ID NO: 3363645 - RNA, 22 nt, Neisseria meningitidis Z2491
agggaauggccgauuuuggguu

SEQ ID NO: 3363646 - RNA, 18 nt, Neisseria meningitidis Z2491
agggcaaguuugccgccu

SEQ ID NO: 3363647 - RNA, 16 nt, Neisseria meningitidis Z2491
agggcaguugggaauc

SEQ ID NO: 3363648 - RNA, 16 nt, Neisseria meningitidis Z2491
agggcugcaaaauuua

SEQ ID NO: 3363649 - RNA, 14 nt, Neisseria meningitidis Z2491
agggguaaauccuc

SEQ ID NO: 3363650 - RNA, 18 nt, Neisseria meningitidis Z2491
aggggucugacgaugcca

SEQ ID NO: 3363651 - RNA, 18 nt, Neisseria meningitidis Z2491
agggguuucagacggcau

SEQ ID NO: 3363652 - RNA, 19 nt, Neisseria meningitidis Z2491
agggugauuucuguggaga

SEQ ID NO: 3363653 - RNA, 15 nt, Neisseria meningitidis Z2491
aggguuaagaaaacc

SEQ ID NO: 3363654 - RNA, 17 nt, Neisseria meningitidis Z2491
aggguuccgaaaucauc

SEQ ID NO: 3363655 - RNA, 19 nt, Neisseria meningitidis Z2491
aggguuccgaaaucaucca

SEQ ID NO: 3363656 - RNA, 23 nt, Neisseria meningitidis Z2491
aggguuccgaaaucauccacagc

SEQ ID NO: 3363657 - RNA, 22 nt, Neisseria meningitidis Z2491
aggguucggacggcauuaaaau

SEQ ID NO: 3363658 - RNA, 23 nt, Neisseria meningitidis Z2491
aggguucggacggcauuaaaauu

SEQ ID NO: 3363659 - RNA, 17 nt, Neisseria meningitidis Z2491
agguaaaaaauagaaau

SEQ ID NO: 3363660 - RNA, 18 nt, Neisseria meningitidis Z2491
agguaaaaaauagaaaua

SEQ ID NO: 3363661 - RNA, 15 nt, Neisseria meningitidis Z2491
agguaacgguuuuuu

SEQ ID NO: 3363662 - RNA, 16 nt, Neisseria meningitidis Z2491
agguaaucguuuuuuc

SEQ ID NO: 3363663 - RNA, 13 nt, Neisseria meningitidis Z2491
aggucgacggcaa

SEQ ID NO: 3363664 - RNA, 21 nt, Neisseria meningitidis Z2491
aggucgagcaggaugcugcgg

SEQ ID NO: 3363665 - RNA, 17 nt, Neisseria meningitidis Z2491
aggucggacauuugacu

SEQ ID NO: 3363666 - RNA, 15 nt, Neisseria meningitidis Z2491
aggucgucugaaaag

SEQ ID NO: 3363667 - RNA, 19 nt, Neisseria meningitidis Z2491
aggucgucugaaaagaugc

SEQ ID NO: 3363668 - RNA, 12 nt, Neisseria meningitidis Z2491
aggucucagacu

SEQ ID NO: 3363669 - RNA, 21 nt, Neisseria meningitidis Z2491
aggucucauauucacuaaauu

SEQ ID NO: 3363670 - RNA, 17 nt, Neisseria meningitidis Z2491
aggucuucagcuugagc

SEQ ID NO: 3363671 - RNA, 17 nt, Neisseria meningitidis Z2491
aggucuuuucuaaaaua

SEQ ID NO: 3363672 - RNA, 18 nt, Neisseria meningitidis Z2491
aggucuuuucuaaaauau

SEQ ID NO: 3363673 - RNA, 13 nt, Neisseria meningitidis Z2491
aggugcagauguu

SEQ ID NO: 3363674 - RNA, 17 nt, Neisseria meningitidis Z2491
aggugggucaaugggug

SEQ ID NO: 3363675 - RNA, 15 nt, Neisseria meningitidis Z2491
agguguaacugcaag

SEQ ID NO: 3363676 - RNA, 16 nt, Neisseria meningitidis Z2491
agguguuggaaucagg

SEQ ID NO: 3363677 - RNA, 18 nt, Neisseria meningitidis Z2491
agguuaauuaaaauacga

SEQ ID NO: 3363678 - RNA, 14 nt, Neisseria meningitidis Z2491
agguuacuaaaauu

SEQ ID NO: 3363679 - RNA, 18 nt, Neisseria meningitidis Z2491
agguucaaacacaucgcc

SEQ ID NO: 3363680 - RNA, 21 nt, Neisseria meningitidis Z2491
agguucagcaggaaggcggca

SEQ ID NO: 3363681 - RNA, 13 nt, Neisseria meningitidis Z2491
agguucagucauu

SEQ ID NO: 3363682 - RNA, 16 nt, Neisseria meningitidis Z2491
agguucuagauucccg

SEQ ID NO: 3363683 - RNA, 19 nt, Neisseria meningitidis Z2491
agguugaccagaaucacuu

SEQ ID NO: 3363684 - RNA, 22 nt, Neisseria meningitidis Z2491
agguugguuugaaagagaaaag

SEQ ID NO: 3363685 - RNA, 16 nt, Neisseria meningitidis Z2491
agguugucugaaaacu

SEQ ID NO: 3363686 - RNA, 18 nt, Neisseria meningitidis Z2491
agguugugggaauccaga

SEQ ID NO: 3363687 - RNA, 18 nt, Neisseria meningitidis Z2491
agguuugagcaguuuuuu

SEQ ID NO: 3363688 - RNA, 18 nt, Neisseria meningitidis Z2491
agguuuucggacggcauu

SEQ ID NO: 3363689 - RNA, 16 nt, Neisseria meningitidis Z2491
agguuuucgucuauuu

SEQ ID NO: 3363690 - RNA, 21 nt, Neisseria meningitidis Z2491
agguuuucgucuauuuucgcc

SEQ ID NO: 3363691 - RNA, 13 nt, Neisseria meningitidis Z2491
agguuuugcugcc

SEQ ID NO: 3363692 - RNA, 19 nt, Neisseria meningitidis Z2491
aguaaaaacaauuuuaugg

SEQ ID NO: 3363693 - RNA, 14 nt, Neisseria meningitidis Z2491
aguaaaauuuauua

SEQ ID NO: 3363694 - RNA, 16 nt, Neisseria meningitidis Z2491
aguaacuucaaacccc

SEQ ID NO: 3363695 - RNA, 13 nt, Neisseria meningitidis Z2491
aguaauaaauuaa

SEQ ID NO: 3363696 - RNA, 17 nt, Neisseria meningitidis Z2491
aguaauauucaaagguu

SEQ ID NO: 3363697 - RNA, 15 nt, Neisseria meningitidis Z2491
aguaaucacaacggc

SEQ ID NO: 3363698 - RNA, 23 nt, Neisseria meningitidis Z2491
aguaaucacaacggcguuuucaa

SEQ ID NO: 3363699 - RNA, 19 nt, Neisseria meningitidis Z2491
aguacaaaaugccgucuga

SEQ ID NO: 3363700 - RNA, 13 nt, Neisseria meningitidis Z2491
aguacaaauagua

SEQ ID NO: 3363701 - RNA, 20 nt, Neisseria meningitidis Z2491
aguacagccccuuaaaguuu

SEQ ID NO: 3363702 - RNA, 18 nt, Neisseria meningitidis Z2491
aguacauuuugguuguuc

SEQ ID NO: 3363703 - RNA, 14 nt, Neisseria meningitidis Z2491
aguaccguuuuuuu

SEQ ID NO: 3363704 - RNA, 15 nt, Neisseria meningitidis Z2491
aguacgcgcugugca

SEQ ID NO: 3363705 - RNA, 20 nt, Neisseria meningitidis Z2491
aguacggcaaggcgaggcaa

SEQ ID NO: 3363706 - RNA, 21 nt, Neisseria meningitidis Z2491
aguauaguggauuaacaaaaa

SEQ ID NO: 3363707 - RNA, 21 nt, Neisseria meningitidis Z2491
aguauuuuacaaucagaauac

SEQ ID NO: 3363708 - RNA, 12 nt, Neisseria meningitidis Z2491
agucaauguuuu

SEQ ID NO: 3363709 - RNA, 12 nt, Neisseria meningitidis Z2491
agucauuuuuga

SEQ ID NO: 3363710 - RNA, 15 nt, Neisseria meningitidis Z2491
aguccaaacaaaaau

SEQ ID NO: 3363711 - RNA, 15 nt, Neisseria meningitidis Z2491
aguccaagacaggcg

SEQ ID NO: 3363712 - RNA, 17 nt, Neisseria meningitidis Z2491
aguccauggaaaccaag

SEQ ID NO: 3363713 - RNA, 18 nt, Neisseria meningitidis Z2491
agucccaucccgcgaacc

SEQ ID NO: 3363714 - RNA, 14 nt, Neisseria meningitidis Z2491
aguccgaccgccgc

SEQ ID NO: 3363715 - RNA, 23 nt, Neisseria meningitidis Z2491
aguccggcauaaauccuucacca

SEQ ID NO: 3363716 - RNA, 12 nt, Neisseria meningitidis Z2491
aguccguucagu

SEQ ID NO: 3363717 - RNA, 13 nt, Neisseria meningitidis Z2491
aguccuacccaaa

SEQ ID NO: 3363718 - RNA, 20 nt, Neisseria meningitidis Z2491
aguccuacccaaaaggaagu

SEQ ID NO: 3363719 - RNA, 16 nt, Neisseria meningitidis Z2491
aguccuucacgccauu

SEQ ID NO: 3363720 - RNA, 17 nt, Neisseria meningitidis Z2491
aguccuuguuucaccaa

SEQ ID NO: 3363721 - RNA, 19 nt, Neisseria meningitidis Z2491
agucggcuuggcgggaagc

SEQ ID NO: 3363722 - RNA, 18 nt, Neisseria meningitidis Z2491
auaaucaucacuccgucu

SEQ ID NO: 3363723 - RNA, 21 nt, Neisseria meningitidis Z2491
auaauccuuaucggcaaaaaa

SEQ ID NO: 3363724 - RNA, 19 nt, Neisseria meningitidis Z2491
auaaucuuccuucugaaau

SEQ ID NO: 3363725 - RNA, 20 nt, Neisseria meningitidis Z2491
auaaucuuccuucugaaaua

SEQ ID NO: 3363726 - RNA, 19 nt, Neisseria meningitidis Z2491
auaaucuuugaauauugcc

SEQ ID NO: 3363727 - RNA, 23 nt, Neisseria meningitidis Z2491
auaaucuuugaauauugccgucg

SEQ ID NO: 3363728 - RNA, 21 nt, Neisseria meningitidis Z2491
auaaugaaaaugugcauuucu

SEQ ID NO: 3363729 - RNA, 15 nt, Neisseria meningitidis Z2491
auaaugcccauuccc

SEQ ID NO: 3363730 - RNA, 17 nt, Neisseria meningitidis Z2491
auaaugcccauucccac

SEQ ID NO: 3363731 - RNA, 18 nt, Neisseria meningitidis Z2491
auaaugcgguguaucuuu

SEQ ID NO: 3363732 - RNA, 19 nt, Neisseria meningitidis Z2491
auaaugcgguguaucuuuu

SEQ ID NO: 3363733 - RNA, 21 nt, Neisseria meningitidis Z2491
auaauggaacaaagaaagcag

SEQ ID NO: 3363734 - RNA, 20 nt, Neisseria meningitidis Z2491
auaauggccuuuucccuugc

SEQ ID NO: 3363735 - RNA, 17 nt, Neisseria meningitidis Z2491
auaauguucaaugaacg

SEQ ID NO: 3363736 - RNA, 14 nt, Neisseria meningitidis Z2491
auaauucauacaaa

SEQ ID NO: 3363737 - RNA, 22 nt, Neisseria meningitidis Z2491
auaauuggggucaguuuuccuu

SEQ ID NO: 3363738 - RNA, 20 nt, Neisseria meningitidis Z2491
auaauugucuuuucccuugc

SEQ ID NO: 3363739 - RNA, 20 nt, Neisseria meningitidis Z2491
auaauuuuuaaaauuuuuau

SEQ ID NO: 3363740 - RNA, 21 nt, Neisseria meningitidis Z2491
auacaaaaggccgucugaaau

SEQ ID NO: 3363741 - RNA, 17 nt, Neisseria meningitidis Z2491
auacaaacaucugauuu

SEQ ID NO: 3363742 - RNA, 21 nt, Neisseria meningitidis Z2491
auacaaacaucugauuuuucu

SEQ ID NO: 3363743 - RNA, 22 nt, Neisseria meningitidis Z2491
auacaaacaucugauuuuucuu

SEQ ID NO: 3363744 - RNA, 17 nt, Neisseria meningitidis Z2491
auacaaaugccgucuga

SEQ ID NO: 3363745 - RNA, 16 nt, Neisseria meningitidis Z2491
auacacaagguuauuu

SEQ ID NO: 3363746 - RNA, 19 nt, Neisseria meningitidis Z2491
auacacaagguuauuuucu

SEQ ID NO: 3363747 - RNA, 17 nt, Neisseria meningitidis Z2491
auacacacgguuuucac

SEQ ID NO: 3363748 - RNA, 19 nt, Neisseria meningitidis Z2491
auacacuguaaucucaaau

SEQ ID NO: 3363749 - RNA, 23 nt, Neisseria meningitidis Z2491
auacauaaccuuguuccuccaaa

SEQ ID NO: 3363750 - RNA, 16 nt, Neisseria meningitidis Z2491
auacauagcaggcauu

SEQ ID NO: 3363751 - RNA, 19 nt, Neisseria meningitidis Z2491
auacauaggguuaauauca

SEQ ID NO: 3363752 - RNA, 21 nt, Neisseria meningitidis Z2491
auacauauugagaccuuugca

SEQ ID NO: 3363753 - RNA, 16 nt, Neisseria meningitidis Z2491
auacauccgaauaugc

SEQ ID NO: 3363754 - RNA, 15 nt, Neisseria meningitidis Z2491
auacauccuaaaaau

SEQ ID NO: 3363755 - RNA, 22 nt, Neisseria meningitidis Z2491
auacauccuaaaaauuuaauaa

SEQ ID NO: 3363756 - RNA, 17 nt, Neisseria meningitidis Z2491
auacauuucggcaaggu

SEQ ID NO: 3363757 - RNA, 14 nt, Neisseria meningitidis Z2491
auaccaaacggcau

SEQ ID NO: 3363758 - RNA, 15 nt, Neisseria meningitidis Z2491
auaccaaacggcaua

SEQ ID NO: 3363759 - RNA, 14 nt, Neisseria meningitidis Z2491
auaccauaaauuuu

SEQ ID NO: 3363760 - RNA, 17 nt, Neisseria meningitidis Z2491
auacccccuuaauccuc

SEQ ID NO: 3363761 - RNA, 15 nt, Neisseria meningitidis Z2491
auaccgcaaccugaa

SEQ ID NO: 3363762 - RNA, 17 nt, Neisseria meningitidis Z2491
auaccgccuucaucaaa

SEQ ID NO: 3363763 - RNA, 21 nt, Neisseria meningitidis Z2491
auaccgucugaaaccugcaac

SEQ ID NO: 3363764 - RNA, 22 nt, Neisseria meningitidis Z2491
auaccgucugaaaggcuuucag

SEQ ID NO: 3363765 - RNA, 16 nt, Neisseria meningitidis Z2491
auaccgucugaacacg

SEQ ID NO: 3363766 - RNA, 13 nt, Neisseria meningitidis Z2491
auaccguucaaac

SEQ ID NO: 3363767 - RNA, 17 nt, Neisseria meningitidis Z2491
auaccguuuggcggcau

SEQ ID NO: 3363768 - RNA, 17 nt, Neisseria meningitidis Z2491
auaccucccaauccugc

SEQ ID NO: 3363769 - RNA, 15 nt, Neisseria meningitidis Z2491
auacgcgacaauaaa

SEQ ID NO: 3363770 - RNA, 21 nt, Neisseria meningitidis Z2491
auacggacgggaaguuuuuug

SEQ ID NO: 3363771 - RNA, 20 nt, Neisseria meningitidis Z2491
auacggcggcauucggcagu

SEQ ID NO: 3363772 - RNA, 22 nt, Neisseria meningitidis Z2491
auacgggcggcucucaaaauau

SEQ ID NO: 3363773 - RNA, 18 nt, Neisseria meningitidis Z2491
auacgguuuuccgccuga

SEQ ID NO: 3363774 - RNA, 21 nt, Neisseria meningitidis Z2491
auacguuuuucucgugcauau

SEQ ID NO: 3363775 - RNA, 22 nt, Neisseria meningitidis Z2491
auacguuuuucucgugcauaug

SEQ ID NO: 3363776 - RNA, 18 nt, Neisseria meningitidis Z2491
auacuacgcggcugaaaa

SEQ ID NO: 3363777 - RNA, 19 nt, Neisseria meningitidis Z2491
auacugccuguaaaaccaa

SEQ ID NO: 3363778 - RNA, 12 nt, Neisseria meningitidis Z2491
auacugcugaag

SEQ ID NO: 3363779 - RNA, 16 nt, Neisseria meningitidis Z2491
auacuggcaaauugaa

SEQ ID NO: 3363780 - RNA, 17 nt, Neisseria meningitidis Z2491
auacuguaaucagggau

SEQ ID NO: 3363781 - RNA, 20 nt, Neisseria meningitidis Z2491
auacuuggcaaaaucuggau

SEQ ID NO: 3363782 - RNA, 19 nt, Neisseria meningitidis Z2491
auacuuuguuucaaaaugu

SEQ ID NO: 3363783 - RNA, 20 nt, Neisseria meningitidis Z2491
auagaaaaccgaaacagaaa

SEQ ID NO: 3363784 - RNA, 15 nt, Neisseria meningitidis Z2491
auagaaaaucaaaaa

SEQ ID NO: 3363785 - RNA, 13 nt, Neisseria meningitidis Z2491
auagaaucuuucc

SEQ ID NO: 3363786 - RNA, 21 nt, Neisseria meningitidis Z2491
auagaauuuauacccucucaa

SEQ ID NO: 3363787 - RNA, 16 nt, Neisseria meningitidis Z2491
auagacuguaccaaau

SEQ ID NO: 3363788 - RNA, 14 nt, Neisseria meningitidis Z2491
auagauaaauuuca

SEQ ID NO: 3363789 - RNA, 12 nt, Neisseria meningitidis Z2491
auagauucccgu

SEQ ID NO: 3363790 - RNA, 20 nt, Neisseria meningitidis Z2491
auagccgcccaaugccgucu

SEQ ID NO: 3363791 - RNA, 11 nt, Neisseria meningitidis Z2491
auagccgccgc

SEQ ID NO: 3363792 - RNA, 11 nt, Neisseria meningitidis Z2491
auagccgccgg

SEQ ID NO: 3363793 - RNA, 23 nt, Neisseria meningitidis Z2491
auagccgccgguggcgguuugac

SEQ ID NO: 3363794 - RNA, 18 nt, Neisseria meningitidis Z2491
auagcgcggacggcggca

SEQ ID NO: 3363795 - RNA, 15 nt, Neisseria meningitidis Z2491
auagcugaaacucaa

SEQ ID NO: 3363796 - RNA, 13 nt, Neisseria meningitidis Z2491
auagcuguuugca

SEQ ID NO: 3363797 - RNA, 17 nt, Neisseria meningitidis Z2491
auagcuucgucauuccc

SEQ ID NO: 3363798 - RNA, 19 nt, Neisseria meningitidis Z2491
auagcuucgucauucccgc

SEQ ID NO: 3363799 - RNA, 16 nt, Neisseria meningitidis Z2491
auaggaacauuuagaa

SEQ ID NO: 3363800 - RNA, 16 nt, Neisseria meningitidis Z2491
auaggguuaauaucag

SEQ ID NO: 3363801 - RNA, 14 nt, Neisseria meningitidis Z2491
auagguuacuaaaa

SEQ ID NO: 3363802 - RNA, 22 nt, Neisseria meningitidis Z2491
auagguuacuaaaauuuuaugc

SEQ ID NO: 3363803 - RNA, 18 nt, Neisseria meningitidis Z2491
auagguugaccagaauca

SEQ ID NO: 3363804 - RNA, 20 nt, Neisseria meningitidis Z2491
auagguugaccagaaucacu

SEQ ID NO: 3363805 - RNA, 22 nt, Neisseria meningitidis Z2491
auaguacggaaccgauucacuu

SEQ ID NO: 3363806 - RNA, 19 nt, Neisseria meningitidis Z2491
auaguacggcaaggcaagg

SEQ ID NO: 3363807 - RNA, 22 nt, Neisseria meningitidis Z2491
auaguacggcaaggcgaggcaa

SEQ ID NO: 3363808 - RNA, 18 nt, Neisseria meningitidis Z2491
auagugaauuaacaaaaa

SEQ ID NO: 3363809 - RNA, 18 nt, Neisseria meningitidis Z2491
auaguggauuaaauuuaa

SEQ ID NO: 3363810 - RNA, 21 nt, Neisseria meningitidis Z2491
auaguggauuaaauuuaaauc

SEQ ID NO: 3363811 - RNA, 14 nt, Neisseria meningitidis Z2491
auaguggauuaaca

SEQ ID NO: 3363812 - RNA, 19 nt, Neisseria meningitidis Z2491
auaguggauuaacaaaaac

SEQ ID NO: 3363813 - RNA, 19 nt, Neisseria meningitidis Z2491
auaguggauuaacaaaaau

SEQ ID NO: 3363814 - RNA, 20 nt, Neisseria meningitidis Z2491
auaguggauuaauaaaaauc

SEQ ID NO: 3363815 - RNA, 20 nt, Neisseria meningitidis Z2491
auaguugauuaaaacaaaaa

SEQ ID NO: 3363816 - RNA, 23 nt, Neisseria meningitidis Z2491
auaguugauuaaaacaaaaauga

SEQ ID NO: 3363817 - RNA, 22 nt, Neisseria meningitidis Z2491
auaguugcgguaauuuccgacc

SEQ ID NO: 3363818 - RNA, 22 nt, Neisseria meningitidis Z2491
auaguuuguaaaaucucuugcc

SEQ ID NO: 3363819 - RNA, 20 nt, Neisseria meningitidis Z2491
auauaaacucucuauaaaau

SEQ ID NO: 3363820 - RNA, 21 nt, Neisseria meningitidis Z2491
auauaacaccuuucaaucaau

SEQ ID NO: 3363821 - RNA, 22 nt, Neisseria meningitidis Z2491
auauaaucaaacucacccugca

SEQ ID NO: 3363822 - RNA, 21 nt, Neisseria meningitidis Z2491
aucagauuuuggagcaguaaa

SEQ ID NO: 3363823 - RNA, 18 nt, Neisseria meningitidis Z2491
aucagcaguucguucugc

SEQ ID NO: 3363824 - RNA, 22 nt, Neisseria meningitidis Z2491
aucagcaguucguucugcauau

SEQ ID NO: 3363825 - RNA, 19 nt, Neisseria meningitidis Z2491
aucagcauagggacgaaaa

SEQ ID NO: 3363826 - RNA, 21 nt, Neisseria meningitidis Z2491
aucagcauagggacgaaaauc

SEQ ID NO: 3363827 - RNA, 19 nt, Neisseria meningitidis Z2491
aucagcuauauauaguuga

SEQ ID NO: 3363828 - RNA, 17 nt, Neisseria meningitidis Z2491
aucaggacaaggcaacg

SEQ ID NO: 3363829 - RNA, 12 nt, Neisseria meningitidis Z2491
aucaggacucga

SEQ ID NO: 3363830 - RNA, 18 nt, Neisseria meningitidis Z2491
aucaggcaucacauaaug

SEQ ID NO: 3363831 - RNA, 20 nt, Neisseria meningitidis Z2491
aucaggcguaauguugugca

SEQ ID NO: 3363832 - RNA, 18 nt, Neisseria meningitidis Z2491
aucagggcugcaaaauuu

SEQ ID NO: 3363833 - RNA, 15 nt, Neisseria meningitidis Z2491
aucagguugaaaaug

SEQ ID NO: 3363834 - RNA, 14 nt, Neisseria meningitidis Z2491
aucaguauuuuaca

SEQ ID NO: 3363835 - RNA, 15 nt, Neisseria meningitidis Z2491
aucaguauuuuacaa

SEQ ID NO: 3363836 - RNA, 22 nt, Neisseria meningitidis Z2491
aucauaccuaccgccuaucacu

SEQ ID NO: 3363837 - RNA, 14 nt, Neisseria meningitidis Z2491
aucauagaaaucag

SEQ ID NO: 3363838 - RNA, 17 nt, Neisseria meningitidis Z2491
aucauauagauuuuuau

SEQ ID NO: 3363839 - RNA, 16 nt, Neisseria meningitidis Z2491
aucauaugcaucagca

SEQ ID NO: 3363840 - RNA, 15 nt, Neisseria meningitidis Z2491
aucaucacuccgucu

SEQ ID NO: 3363841 - RNA, 12 nt, Neisseria meningitidis Z2491
aucauccacagc

SEQ ID NO: 3363842 - RNA, 15 nt, Neisseria meningitidis Z2491
aucaucccaaacauc

SEQ ID NO: 3363843 - RNA, 20 nt, Neisseria meningitidis Z2491
aucaucggaaacagcauccu

SEQ ID NO: 3363844 - RNA, 23 nt, Neisseria meningitidis Z2491
aucauggcgcguuggcguuggcc

SEQ ID NO: 3363845 - RNA, 20 nt, Neisseria meningitidis Z2491
aucauugcgggaauagcuca

SEQ ID NO: 3363846 - RNA, 21 nt, Neisseria meningitidis Z2491
aucauugcuuacaauccgcuu

SEQ ID NO: 3363847 - RNA, 12 nt, Neisseria meningitidis Z2491
aucauuucagga

SEQ ID NO: 3363848 - RNA, 12 nt, Neisseria meningitidis Z2491
auccaaggcauc

SEQ ID NO: 3363849 - RNA, 13 nt, Neisseria meningitidis Z2491
auccaauaauccg

SEQ ID NO: 3363850 - RNA, 20 nt, Neisseria meningitidis Z2491
auccacagagauuguuuccc

SEQ ID NO: 3363851 - RNA, 21 nt, Neisseria meningitidis Z2491
auccacagccgcaaaagccag

SEQ ID NO: 3363852 - RNA, 12 nt, Neisseria meningitidis Z2491
auccaccagccc

SEQ ID NO: 3363853 - RNA, 15 nt, Neisseria meningitidis Z2491
auccacuauaaaaac

SEQ ID NO: 3363854 - RNA, 23 nt, Neisseria meningitidis Z2491
auccacuauaauccaccauauuu

SEQ ID NO: 3363855 - RNA, 18 nt, Neisseria meningitidis Z2491
auccacuauaugagugua

SEQ ID NO: 3363856 - RNA, 15 nt, Neisseria meningitidis Z2491
auccacuauauuuuc

SEQ ID NO: 3363857 - RNA, 20 nt, Neisseria meningitidis Z2491
auccagacauucaaugcuaa

SEQ ID NO: 3363858 - RNA, 24 nt, Neisseria meningitidis Z2491
auccagugcguugaguuucagcua

SEQ ID NO: 3363859 - RNA, 20 nt, Neisseria meningitidis Z2491
auccaguuucuugaguuuca

SEQ ID NO: 3363860 - RNA, 23 nt, Neisseria meningitidis Z2491
auccaguuucuugaguuucaguc

SEQ ID NO: 3363861 - RNA, 22 nt, Neisseria meningitidis Z2491
auccauaccaaacagcgcggcg

SEQ ID NO: 3363862 - RNA, 21 nt, Neisseria meningitidis Z2491
auccauagauaaauuucagau

SEQ ID NO: 3363863 - RNA, 15 nt, Neisseria meningitidis Z2491
auccaucacaaugag

SEQ ID NO: 3363864 - RNA, 15 nt, Neisseria meningitidis Z2491
auccaucaguuucca

SEQ ID NO: 3363865 - RNA, 20 nt, Neisseria meningitidis Z2491
auccaucaguuuccacuaaa

SEQ ID NO: 3363866 - RNA, 17 nt, Neisseria meningitidis Z2491
auccaucccauauucca

SEQ ID NO: 3363867 - RNA, 16 nt, Neisseria meningitidis Z2491
auccauucccucuccc

SEQ ID NO: 3363868 - RNA, 21 nt, Neisseria meningitidis Z2491
auccauucgccgacuuugguu

SEQ ID NO: 3363869 - RNA, 13 nt, Neisseria meningitidis Z2491
aucccaaacccuc

SEQ ID NO: 3363870 - RNA, 22 nt, Neisseria meningitidis Z2491
aucccaaacccucggcauuccc

SEQ ID NO: 3363871 - RNA, 18 nt, Neisseria meningitidis Z2491
aucccaacaagcucaaac

SEQ ID NO: 3363872 - RNA, 19 nt, Neisseria meningitidis Z2491
aucccauauuccacaguga

SEQ ID NO: 3363873 - RNA, 15 nt, Neisseria meningitidis Z2491
auccccagcgaacgc

SEQ ID NO: 3363874 - RNA, 20 nt, Neisseria meningitidis Z2491
auccccgcgaaagcgggaau

SEQ ID NO: 3363875 - RNA, 23 nt, Neisseria meningitidis Z2491
aucccgcaaaaacgcagccagca

SEQ ID NO: 3363876 - RNA, 17 nt, Neisseria meningitidis Z2491
aucccgcaggauuuuaa

SEQ ID NO: 3363877 - RNA, 16 nt, Neisseria meningitidis Z2491
aucccgucauucccgc

SEQ ID NO: 3363878 - RNA, 19 nt, Neisseria meningitidis Z2491
aucccgucauucccgcgaa

SEQ ID NO: 3363879 - RNA, 18 nt, Neisseria meningitidis Z2491
aucccugacaaucaggaa

SEQ ID NO: 3363880 - RNA, 17 nt, Neisseria meningitidis Z2491
aucccuguguccuuauu

SEQ ID NO: 3363881 - RNA, 15 nt, Neisseria meningitidis Z2491
auccgaaacaacaaa

SEQ ID NO: 3363882 - RNA, 20 nt, Neisseria meningitidis Z2491
auccgaaacaacagaaacca

SEQ ID NO: 3363883 - RNA, 18 nt, Neisseria meningitidis Z2491
auccgaccgccccgucau

SEQ ID NO: 3363884 - RNA, 23 nt, Neisseria meningitidis Z2491
auccgaguggcuuccuuuuuaaa

SEQ ID NO: 3363885 - RNA, 18 nt, Neisseria meningitidis Z2491
auccgauaaguuuccgug

SEQ ID NO: 3363886 - RNA, 16 nt, Neisseria meningitidis Z2491
auccgccaaaaacggc

SEQ ID NO: 3363887 - RNA, 21 nt, Neisseria meningitidis Z2491
auccgccaaaaacggcacggc

SEQ ID NO: 3363888 - RNA, 14 nt, Neisseria meningitidis Z2491
auccgccaaccugc

SEQ ID NO: 3363889 - RNA, 23 nt, Neisseria meningitidis Z2491
auccgccaaccugcugcccauga

SEQ ID NO: 3363890 - RNA, 20 nt, Neisseria meningitidis Z2491
auccgcguguuguuuuaaag

SEQ ID NO: 3363891 - RNA, 22 nt, Neisseria meningitidis Z2491
auccgcuauaacagcaacccug

SEQ ID NO: 3363892 - RNA, 14 nt, Neisseria meningitidis Z2491
auccggucuuggca

SEQ ID NO: 3363893 - RNA, 20 nt, Neisseria meningitidis Z2491
auccgguuuuuugaguuucc

SEQ ID NO: 3363894 - RNA, 21 nt, Neisseria meningitidis Z2491
auccguuugguuuuauagugg

SEQ ID NO: 3363895 - RNA, 16 nt, Neisseria meningitidis Z2491
auccuaguuauccagg

SEQ ID NO: 3363896 - RNA, 14 nt, Neisseria meningitidis Z2491
auccuccaucacaa

SEQ ID NO: 3363897 - RNA, 15 nt, Neisseria meningitidis Z2491
auccucccacucuuu

SEQ ID NO: 3363898 - RNA, 20 nt, Neisseria meningitidis Z2491
auccucccacucuuucaaca

SEQ ID NO: 3363899 - RNA, 20 nt, Neisseria meningitidis Z2491
auccucggcagacaaaccgu

SEQ ID NO: 3363900 - RNA, 17 nt, Neisseria meningitidis Z2491
auccugccuucauucuu

SEQ ID NO: 3363901 - RNA, 16 nt, Neisseria meningitidis Z2491
auccuguuauuuucac

SEQ ID NO: 3363902 - RNA, 17 nt, Neisseria meningitidis Z2491
auccuuaucggcaaaaa

SEQ ID NO: 3363903 - RNA, 18 nt, Neisseria meningitidis Z2491
auccuucccgcaaaaacg

SEQ ID NO: 3363904 - RNA, 17 nt, Neisseria meningitidis Z2491
aucgaaaaagccgccgg

SEQ ID NO: 3363905 - RNA, 13 nt, Neisseria meningitidis Z2491
aucgaaagccuca

SEQ ID NO: 3363906 - RNA, 15 nt, Neisseria meningitidis Z2491
aucgaacacgaugcu

SEQ ID NO: 3363907 - RNA, 16 nt, Neisseria meningitidis Z2491
aucgaaccaaauaaac

SEQ ID NO: 3363908 - RNA, 18 nt, Neisseria meningitidis Z2491
aucgacacccgccccgcc

SEQ ID NO: 3363909 - RNA, 22 nt, Neisseria meningitidis Z2491
aucgacugcaguaacuucaaac

SEQ ID NO: 3363910 - RNA, 12 nt, Neisseria meningitidis Z2491
aucgaugccguu

SEQ ID NO: 3363911 - RNA, 20 nt, Neisseria meningitidis Z2491
aucgauguuuuugcguucag

SEQ ID NO: 3363912 - RNA, 22 nt, Neisseria meningitidis Z2491
aucgccguaaccgacgaaggca

SEQ ID NO: 3363913 - RNA, 13 nt, Neisseria meningitidis Z2491
aucgccucauaca

SEQ ID NO: 3363914 - RNA, 19 nt, Neisseria meningitidis Z2491
aucgcgcacuugagccgca

SEQ ID NO: 3363915 - RNA, 14 nt, Neisseria meningitidis Z2491
aucgcgcugaaugu

SEQ ID NO: 3363916 - RNA, 16 nt, Neisseria meningitidis Z2491
aucgcgcugccgucga

SEQ ID NO: 3363917 - RNA, 15 nt, Neisseria meningitidis Z2491
aucgcguaaggcaua

SEQ ID NO: 3363918 - RNA, 16 nt, Neisseria meningitidis Z2491
aucgcgucuucaaaau

SEQ ID NO: 3363919 - RNA, 21 nt, Neisseria meningitidis Z2491
aucggacggauguucaaacac

SEQ ID NO: 3363920 - RNA, 23 nt, Neisseria meningitidis Z2491
aucggaggaguuugaugccgucu

SEQ ID NO: 3363921 - RNA, 18 nt, Neisseria meningitidis Z2491
aucggcaaaguuauucaa

SEQ ID NO: 3363922 - RNA, 22 nt, Neisseria meningitidis Z2491
aucggcaagguugcgucugccu

SEQ ID NO: 3363923 - RNA, 23 nt, Neisseria meningitidis Z2491
augauuuuguucugguugcguuu

SEQ ID NO: 3363924 - RNA, 15 nt, Neisseria meningitidis Z2491
augauuuuuucaaca

SEQ ID NO: 3363925 - RNA, 19 nt, Neisseria meningitidis Z2491
augauuuuuucaacaccaa

SEQ ID NO: 3363926 - RNA, 19 nt, Neisseria meningitidis Z2491
augcaaaaaauaugccguc

SEQ ID NO: 3363927 - RNA, 15 nt, Neisseria meningitidis Z2491
augcaaaaacaaccc

SEQ ID NO: 3363928 - RNA, 16 nt, Neisseria meningitidis Z2491
augcaaaacuuuucug

SEQ ID NO: 3363929 - RNA, 20 nt, Neisseria meningitidis Z2491
augcacuacuucauuuuuuc

SEQ ID NO: 3363930 - RNA, 20 nt, Neisseria meningitidis Z2491
augcacugcgcgaugcauau

SEQ ID NO: 3363931 - RNA, 21 nt, Neisseria meningitidis Z2491
augcacugcgcgaugcauauc

SEQ ID NO: 3363932 - RNA, 19 nt, Neisseria meningitidis Z2491
augcagagaccuuugcaau

SEQ ID NO: 3363933 - RNA, 21 nt, Neisseria meningitidis Z2491
augcagcauauguuugcugcu

SEQ ID NO: 3363934 - RNA, 14 nt, Neisseria meningitidis Z2491
augccaaaggcagu

SEQ ID NO: 3363935 - RNA, 22 nt, Neisseria meningitidis Z2491
augccaccgugcgcugucaaac

SEQ ID NO: 3363936 - RNA, 17 nt, Neisseria meningitidis Z2491
augccauacugccugcc

SEQ ID NO: 3363937 - RNA, 13 nt, Neisseria meningitidis Z2491
augcccaaaccgc

SEQ ID NO: 3363938 - RNA, 19 nt, Neisseria meningitidis Z2491
augcccauuuguuggaugu

SEQ ID NO: 3363939 - RNA, 18 nt, Neisseria meningitidis Z2491
augcccgaaccgucauuc

SEQ ID NO: 3363940 - RNA, 19 nt, Neisseria meningitidis Z2491
augcccuucauccggcagg

SEQ ID NO: 3363941 - RNA, 18 nt, Neisseria meningitidis Z2491
augccgaacagcuuggua

SEQ ID NO: 3363942 - RNA, 14 nt, Neisseria meningitidis Z2491
augccgaacaggcg

SEQ ID NO: 3363943 - RNA, 15 nt, Neisseria meningitidis Z2491
augccgaugucggcc

SEQ ID NO: 3363944 - RNA, 17 nt, Neisseria meningitidis Z2491
augccgcaaaugccguc

SEQ ID NO: 3363945 - RNA, 19 nt, Neisseria meningitidis Z2491
augccgcaaaugccgucug

SEQ ID NO: 3363946 - RNA, 18 nt, Neisseria meningitidis Z2491
augccgcaccuaaaggga

SEQ ID NO: 3363947 - RNA, 16 nt, Neisseria meningitidis Z2491
augccgccagccacca

SEQ ID NO: 3363948 - RNA, 15 nt, Neisseria meningitidis Z2491
augccgcgccgccgg

SEQ ID NO: 3363949 - RNA, 14 nt, Neisseria meningitidis Z2491
augccgucugaaac

SEQ ID NO: 3363950 - RNA, 22 nt, Neisseria meningitidis Z2491
augccgucugaaacgcauucag

SEQ ID NO: 3363951 - RNA, 20 nt, Neisseria meningitidis Z2491
augccgucugaaacggcauc

SEQ ID NO: 3363952 - RNA, 20 nt, Neisseria meningitidis Z2491
augccgucugaaacgggaau

SEQ ID NO: 3363953 - RNA, 18 nt, Neisseria meningitidis Z2491
augccgucugaaacuucg

SEQ ID NO: 3363954 - RNA, 22 nt, Neisseria meningitidis Z2491
augccgucugaaagccuuucag

SEQ ID NO: 3363955 - RNA, 23 nt, Neisseria meningitidis Z2491
augccgucugaaaggcuucagac

SEQ ID NO: 3363956 - RNA, 23 nt, Neisseria meningitidis Z2491
augccgucugaaaggcuuuuuca

SEQ ID NO: 3363957 - RNA, 15 nt, Neisseria meningitidis Z2491
augccgucugaaaug

SEQ ID NO: 3363958 - RNA, 20 nt, Neisseria meningitidis Z2491
augccgucugaacacagggu

SEQ ID NO: 3363959 - RNA, 20 nt, Neisseria meningitidis Z2491
augccgucugaagccuucag

SEQ ID NO: 3363960 - RNA, 20 nt, Neisseria meningitidis Z2491
augccgucugaagcgguuca

SEQ ID NO: 3363961 - RNA, 21 nt, Neisseria meningitidis Z2491
augccgucugaaggcuucaga

SEQ ID NO: 3363962 - RNA, 18 nt, Neisseria meningitidis Z2491
augccguuucagacggca

SEQ ID NO: 3363963 - RNA, 20 nt, Neisseria meningitidis Z2491
augccguuucagacggcauc

SEQ ID NO: 3363964 - RNA, 16 nt, Neisseria meningitidis Z2491
augccuagaggaauga

SEQ ID NO: 3363965 - RNA, 13 nt, Neisseria meningitidis Z2491
augccuauuuuuu

SEQ ID NO: 3363966 - RNA, 14 nt, Neisseria meningitidis Z2491
augccuauuuuuua

SEQ ID NO: 3363967 - RNA, 21 nt, Neisseria meningitidis Z2491
augccugcucaaauaggcauu

SEQ ID NO: 3363968 - RNA, 15 nt, Neisseria meningitidis Z2491
augccuuuuucaaac

SEQ ID NO: 3363969 - RNA, 16 nt, Neisseria meningitidis Z2491
augcgaaucugcugca

SEQ ID NO: 3363970 - RNA, 14 nt, Neisseria meningitidis Z2491
augcgccaaaaaau

SEQ ID NO: 3363971 - RNA, 20 nt, Neisseria meningitidis Z2491
augcgccugcauaucggcaa

SEQ ID NO: 3363972 - RNA, 22 nt, Neisseria meningitidis Z2491
augcggacggcgugaaugcguc

SEQ ID NO: 3363973 - RNA, 12 nt, Neisseria meningitidis Z2491
augcggggaaac

SEQ ID NO: 3363974 - RNA, 14 nt, Neisseria meningitidis Z2491
augcgucaaauuuc

SEQ ID NO: 3363975 - RNA, 13 nt, Neisseria meningitidis Z2491
augcgucuuccaa

SEQ ID NO: 3363976 - RNA, 19 nt, Neisseria meningitidis Z2491
augcguucaaaucacgccc

SEQ ID NO: 3363977 - RNA, 16 nt, Neisseria meningitidis Z2491
augcguucaaaugccg

SEQ ID NO: 3363978 - RNA, 18 nt, Neisseria meningitidis Z2491
augcguucaaaugccguc

SEQ ID NO: 3363979 - RNA, 14 nt, Neisseria meningitidis Z2491
augcguuucagagc

SEQ ID NO: 3363980 - RNA, 17 nt, Neisseria meningitidis Z2491
augcguuucagagcauu

SEQ ID NO: 3363981 - RNA, 22 nt, Neisseria meningitidis Z2491
augcguuuucggguucccauac

SEQ ID NO: 3363982 - RNA, 14 nt, Neisseria meningitidis Z2491
augcuaaggcaauu

SEQ ID NO: 3363983 - RNA, 16 nt, Neisseria meningitidis Z2491
augcuauucaaauuua

SEQ ID NO: 3363984 - RNA, 17 nt, Neisseria meningitidis Z2491
augcucaaucucauuuu

SEQ ID NO: 3363985 - RNA, 19 nt, Neisseria meningitidis Z2491
augcucaaucucauuuuca

SEQ ID NO: 3363986 - RNA, 23 nt, Neisseria meningitidis Z2491
augcucaaucucauuuucaaaau

SEQ ID NO: 3363987 - RNA, 13 nt, Neisseria meningitidis Z2491
augcugcggaugu

SEQ ID NO: 3363988 - RNA, 16 nt, Neisseria meningitidis Z2491
augcugcggauguuug

SEQ ID NO: 3363989 - RNA, 20 nt, Neisseria meningitidis Z2491
augcugcguuuggagaaaau

SEQ ID NO: 3363990 - RNA, 15 nt, Neisseria meningitidis Z2491
augcugucugaaacc

SEQ ID NO: 3363991 - RNA, 16 nt, Neisseria meningitidis Z2491
augcugucugaaaccu

SEQ ID NO: 3363992 - RNA, 14 nt, Neisseria meningitidis Z2491
auggaaaugccguc

SEQ ID NO: 3363993 - RNA, 16 nt, Neisseria meningitidis Z2491
auggaaccguuuuccg

SEQ ID NO: 3363994 - RNA, 22 nt, Neisseria meningitidis Z2491
auggaucagacauuaaaaaaua

SEQ ID NO: 3363995 - RNA, 14 nt, Neisseria meningitidis Z2491
auggcaaaauuuca

SEQ ID NO: 3363996 - RNA, 14 nt, Neisseria meningitidis Z2491
auggcaaccaaaac

SEQ ID NO: 3363997 - RNA, 16 nt, Neisseria meningitidis Z2491
auggccgaccauuucu

SEQ ID NO: 3363998 - RNA, 20 nt, Neisseria meningitidis Z2491
auggccuuuacucauucaau

SEQ ID NO: 3363999 - RNA, 15 nt, Neisseria meningitidis Z2491
auggccuuuucccuu

SEQ ID NO: 3364000 - RNA, 21 nt, Neisseria meningitidis Z2491
auggcggugcgguagccgccu

SEQ ID NO: 3364001 - RNA, 16 nt, Neisseria meningitidis Z2491
auggcguugacaaaca

SEQ ID NO: 3364002 - RNA, 19 nt, Neisseria meningitidis Z2491
auggcugcuuuggcagcac

SEQ ID NO: 3364003 - RNA, 15 nt, Neisseria meningitidis Z2491
auggcuucuaaaaau

SEQ ID NO: 3364004 - RNA, 16 nt, Neisseria meningitidis Z2491
auggcuucuaaaaauu

SEQ ID NO: 3364005 - RNA, 19 nt, Neisseria meningitidis Z2491
auggcuucuaaaaauucuu

SEQ ID NO: 3364006 - RNA, 22 nt, Neisseria meningitidis Z2491
augggaauccgggauuuuaaag

SEQ ID NO: 3364007 - RNA, 20 nt, Neisseria meningitidis Z2491
augggauuuaggguucugau

SEQ ID NO: 3364008 - RNA, 19 nt, Neisseria meningitidis Z2491
augggcuucagacggcauc

SEQ ID NO: 3364009 - RNA, 13 nt, Neisseria meningitidis Z2491
augguuugcaguc

SEQ ID NO: 3364010 - RNA, 16 nt, Neisseria meningitidis Z2491
auguaaauuuuuaaau

SEQ ID NO: 3364011 - RNA, 15 nt, Neisseria meningitidis Z2491
auguaccaagcgguu

SEQ ID NO: 3364012 - RNA, 19 nt, Neisseria meningitidis Z2491
auguacuucuggaaagugg

SEQ ID NO: 3364013 - RNA, 22 nt, Neisseria meningitidis Z2491
auguagauuuuuuuauuuaaac

SEQ ID NO: 3364014 - RNA, 15 nt, Neisseria meningitidis Z2491
auguauuagaaauga

SEQ ID NO: 3364015 - RNA, 16 nt, Neisseria meningitidis Z2491
auguauuagaaaugac

SEQ ID NO: 3364016 - RNA, 18 nt, Neisseria meningitidis Z2491
augucaaaauaugccguc

SEQ ID NO: 3364017 - RNA, 18 nt, Neisseria meningitidis Z2491
auguccgaaugccgcaaa

SEQ ID NO: 3364018 - RNA, 15 nt, Neisseria meningitidis Z2491
auguccguuuucuuc

SEQ ID NO: 3364019 - RNA, 22 nt, Neisseria meningitidis Z2491
augucgaggaugucggacauuu

SEQ ID NO: 3364020 - RNA, 19 nt, Neisseria meningitidis Z2491
augucgaguucuuuuaaag

SEQ ID NO: 3364021 - RNA, 19 nt, Neisseria meningitidis Z2491
augucggccaauuugcuuu

SEQ ID NO: 3364022 - RNA, 13 nt, Neisseria meningitidis Z2491
augucggggaauc

SEQ ID NO: 3364023 - RNA, 22 nt, Neisseria meningitidis Z2491
augucggguucggauauuuccg

SEQ ID NO: 3364024 - RNA, 15 nt, Neisseria meningitidis Z2491
augucgguaaucgcc

SEQ ID NO: 3364025 - RNA, 17 nt, Neisseria meningitidis Z2491
augucgugcagauggcu

SEQ ID NO: 3364026 - RNA, 12 nt, Neisseria meningitidis Z2491
augucugccuga

SEQ ID NO: 3364027 - RNA, 23 nt, Neisseria meningitidis Z2491
augucuucauacgacucaaaauc

SEQ ID NO: 3364028 - RNA, 15 nt, Neisseria meningitidis Z2491
augugcucggguugu

SEQ ID NO: 3364029 - RNA, 16 nt, Neisseria meningitidis Z2491
augugguagagaaaau

SEQ ID NO: 3364030 - RNA, 16 nt, Neisseria meningitidis Z2491
auguguucgcauuuug

SEQ ID NO: 3364031 - RNA, 12 nt, Neisseria meningitidis Z2491
auguucaaugaa

SEQ ID NO: 3364032 - RNA, 11 nt, Neisseria meningitidis Z2491
auguucagacg

SEQ ID NO: 3364033 - RNA, 14 nt, Neisseria meningitidis Z2491
auguucagacggca

SEQ ID NO: 3364034 - RNA, 15 nt, Neisseria meningitidis Z2491
auguucagacggcau

SEQ ID NO: 3364035 - RNA, 19 nt, Neisseria meningitidis Z2491
auguucagacggcauuuuc

SEQ ID NO: 3364036 - RNA, 20 nt, Neisseria meningitidis Z2491
auguucagacggcauuuucu

SEQ ID NO: 3364037 - RNA, 15 nt, Neisseria meningitidis Z2491
auguucgugcaucau

SEQ ID NO: 3364038 - RNA, 14 nt, Neisseria meningitidis Z2491
auguugcggcacua

SEQ ID NO: 3364039 - RNA, 18 nt, Neisseria meningitidis Z2491
auguuucaacgccucgcc

SEQ ID NO: 3364040 - RNA, 22 nt, Neisseria meningitidis Z2491
auguuugcugcuguauuuuucc

SEQ ID NO: 3364041 - RNA, 22 nt, Neisseria meningitidis Z2491
auguuuuuccacaaaagauaca

SEQ ID NO: 3364042 - RNA, 19 nt, Neisseria meningitidis Z2491
auguuuuugcguucagacg

SEQ ID NO: 3364043 - RNA, 12 nt, Neisseria meningitidis Z2491
auuaaaauaaaa

SEQ ID NO: 3364044 - RNA, 21 nt, Neisseria meningitidis Z2491
auuaaaauuuggcuguauuuu

SEQ ID NO: 3364045 - RNA, 20 nt, Neisseria meningitidis Z2491
auuaaagugccauuuaaaau

SEQ ID NO: 3364046 - RNA, 15 nt, Neisseria meningitidis Z2491
auuaaauuuaaacca

SEQ ID NO: 3364047 - RNA, 19 nt, Neisseria meningitidis Z2491
auuaaauuuuauuuaaaua

SEQ ID NO: 3364048 - RNA, 11 nt, Neisseria meningitidis Z2491
auuaacaaaaa

SEQ ID NO: 3364049 - RNA, 12 nt, Neisseria meningitidis Z2491
auuaacaaaaac

SEQ ID NO: 3364050 - RNA, 13 nt, Neisseria meningitidis Z2491
auuaacaaaaacc

SEQ ID NO: 3364051 - RNA, 20 nt, Neisseria meningitidis Z2491
auuaacaaaaaucaggacaa

SEQ ID NO: 3364052 - RNA, 19 nt, Neisseria meningitidis Z2491
auuaagaaaaacagcaauc

SEQ ID NO: 3364053 - RNA, 17 nt, Neisseria meningitidis Z2491
auuaagauguuuuucca

SEQ ID NO: 3364054 - RNA, 18 nt, Neisseria meningitidis Z2491
auuaagauguuuuuccac

SEQ ID NO: 3364055 - RNA, 19 nt, Neisseria meningitidis Z2491
auuaaggggguauuugggu

SEQ ID NO: 3364056 - RNA, 17 nt, Neisseria meningitidis Z2491
auuaagguuaauuaaaa

SEQ ID NO: 3364057 - RNA, 16 nt, Neisseria meningitidis Z2491
auuaaucaucggaaac

SEQ ID NO: 3364058 - RNA, 22 nt, Neisseria meningitidis Z2491
auuaauuauaguggauuaacaa

SEQ ID NO: 3364059 - RNA, 15 nt, Neisseria meningitidis Z2491
auuaauuucggaaau

SEQ ID NO: 3364060 - RNA, 21 nt, Neisseria meningitidis Z2491
auuaccgguauuuuuuucuua

SEQ ID NO: 3364061 - RNA, 20 nt, Neisseria meningitidis Z2491
auuacgaacaggacaaaaau

SEQ ID NO: 3364062 - RNA, 17 nt, Neisseria meningitidis Z2491
auuacgggacgacaugc

SEQ ID NO: 3364063 - RNA, 14 nt, Neisseria meningitidis Z2491
auuacuaaaacaca

SEQ ID NO: 3364064 - RNA, 17 nt, Neisseria meningitidis Z2491
auuagaaaugacugaaa

SEQ ID NO: 3364065 - RNA, 15 nt, Neisseria meningitidis Z2491
auuauaaaagacauu

SEQ ID NO: 3364066 - RNA, 16 nt, Neisseria meningitidis Z2491
auuauauuuguccaug

SEQ ID NO: 3364067 - RNA, 16 nt, Neisseria meningitidis Z2491
auuaucaguauuuucu

SEQ ID NO: 3364068 - RNA, 20 nt, Neisseria meningitidis Z2491
auuaucaguauuuucuauuu

SEQ ID NO: 3364069 - RNA, 16 nt, Neisseria meningitidis Z2491
auuaucaucgauguuu

SEQ ID NO: 3364070 - RNA, 23 nt, Neisseria meningitidis Z2491
auuaucggucagcucuuugagcc

SEQ ID NO: 3364071 - RNA, 21 nt, Neisseria meningitidis Z2491
auuaucugacaggaaauuucc

SEQ ID NO: 3364072 - RNA, 23 nt, Neisseria meningitidis Z2491
auuauugccagcauuaauauacu

SEQ ID NO: 3364073 - RNA, 15 nt, Neisseria meningitidis Z2491
auuauuuauuuugaa

SEQ ID NO: 3364074 - RNA, 16 nt, Neisseria meningitidis Z2491
auuauuuucacaaaaa

SEQ ID NO: 3364075 - RNA, 21 nt, Neisseria meningitidis Z2491
auuauuuucacaaaaacagaa

SEQ ID NO: 3364076 - RNA, 19 nt, Neisseria meningitidis Z2491
auucaaacggcggcgggca

SEQ ID NO: 3364077 - RNA, 14 nt, Neisseria meningitidis Z2491
auucaaacgguuuu

SEQ ID NO: 3364078 - RNA, 15 nt, Neisseria meningitidis Z2491
auucaaagauuaucu

SEQ ID NO: 3364079 - RNA, 19 nt, Neisseria meningitidis Z2491
auucaaugcuaaggcaauu

SEQ ID NO: 3364080 - RNA, 16 nt, Neisseria meningitidis Z2491
auucaauugacaaaaa

SEQ ID NO: 3364081 - RNA, 14 nt, Neisseria meningitidis Z2491
auucaauuuaaaca

SEQ ID NO: 3364082 - RNA, 15 nt, Neisseria meningitidis Z2491
auucacuaaauugca

SEQ ID NO: 3364083 - RNA, 16 nt, Neisseria meningitidis Z2491
auucacuuggugcuuc

SEQ ID NO: 3364084 - RNA, 18 nt, Neisseria meningitidis Z2491
auucacuuggugcuucag

SEQ ID NO: 3364085 - RNA, 21 nt, Neisseria meningitidis Z2491
auucacuuggugcuucagcac

SEQ ID NO: 3364086 - RNA, 13 nt, Neisseria meningitidis Z2491
auucagacggcau

SEQ ID NO: 3364087 - RNA, 14 nt, Neisseria meningitidis Z2491
auucaggcuuuccg

SEQ ID NO: 3364088 - RNA, 13 nt, Neisseria meningitidis Z2491
auucauagcaaaa

SEQ ID NO: 3364089 - RNA, 19 nt, Neisseria meningitidis Z2491
auucaucgcgcugccgucg

SEQ ID NO: 3364090 - RNA, 23 nt, Neisseria meningitidis Z2491
auuccacagugauggcuucuaaa

SEQ ID NO: 3364091 - RNA, 24 nt, Neisseria meningitidis Z2491
auuccacguucuagauucccgccu

SEQ ID NO: 3364092 - RNA, 17 nt, Neisseria meningitidis Z2491
auuccaucaacaaaaug

SEQ ID NO: 3364093 - RNA, 20 nt, Neisseria meningitidis Z2491
auuccaucaacaaaaugccg

SEQ ID NO: 3364094 - RNA, 22 nt, Neisseria meningitidis Z2491
auuccaucaacaaaaugccguc

SEQ ID NO: 3364095 - RNA, 18 nt, Neisseria meningitidis Z2491
auucccacgaaaguggga

SEQ ID NO: 3364096 - RNA, 15 nt, Neisseria meningitidis Z2491
auucccacgaaccca

SEQ ID NO: 3364097 - RNA, 20 nt, Neisseria meningitidis Z2491
auucccacgcaggcgggaau

SEQ ID NO: 3364098 - RNA, 18 nt, Neisseria meningitidis Z2491
auucccacggaaguggga

SEQ ID NO: 3364099 - RNA, 20 nt, Neisseria meningitidis Z2491
auucccacggaagugggaau

SEQ ID NO: 3364100 - RNA, 21 nt, Neisseria meningitidis Z2491
auucccacggaagugggaauc

SEQ ID NO: 3364101 - RNA, 20 nt, Neisseria meningitidis Z2491
auucccacuuccgugggaau

SEQ ID NO: 3364102 - RNA, 20 nt, Neisseria meningitidis Z2491
auucccacuuucgugggaau

SEQ ID NO: 3364103 - RNA, 17 nt, Neisseria meningitidis Z2491
auucccacuuuuguggg

SEQ ID NO: 3364104 - RNA, 21 nt, Neisseria meningitidis Z2491
auucccccgaagaugggaauc

SEQ ID NO: 3364105 - RNA, 23 nt, Neisseria meningitidis Z2491
auuccccucggggucuuuggcaa

SEQ ID NO: 3364106 - RNA, 17 nt, Neisseria meningitidis Z2491
auucccgagaaaacaga

SEQ ID NO: 3364107 - RNA, 15 nt, Neisseria meningitidis Z2491
auucccgcaaaagcg

SEQ ID NO: 3364108 - RNA, 15 nt, Neisseria meningitidis Z2491
auucccgcaaccuuu

SEQ ID NO: 3364109 - RNA, 18 nt, Neisseria meningitidis Z2491
auucccgccaucuaaaau

SEQ ID NO: 3364110 - RNA, 20 nt, Neisseria meningitidis Z2491
auucccgccuacgcgggaau

SEQ ID NO: 3364111 - RNA, 20 nt, Neisseria meningitidis Z2491
auucccgccugcgcgggaau

SEQ ID NO: 3364112 - RNA, 21 nt, Neisseria meningitidis Z2491
auucccgcgaaaaauagaaaa

SEQ ID NO: 3364113 - RNA, 20 nt, Neisseria meningitidis Z2491
auucccgcgaaagagggaau

SEQ ID NO: 3364114 - RNA, 23 nt, Neisseria meningitidis Z2491
auucccgcgaaagcggaaaucca

SEQ ID NO: 3364115 - RNA, 20 nt, Neisseria meningitidis Z2491
auucccgcgaaagcgggaau

SEQ ID NO: 3364116 - RNA, 20 nt, Neisseria meningitidis Z2491
auucccgcgaaagugggaau

SEQ ID NO: 3364117 - RNA, 18 nt, Neisseria meningitidis Z2491
auucccgcgagaacagaa

SEQ ID NO: 3364118 - RNA, 20 nt, Neisseria meningitidis Z2491
auucccgcgagaacagaaaa

SEQ ID NO: 3364119 - RNA, 20 nt, Neisseria meningitidis Z2491
auucccgcgcaggcgggaau

SEQ ID NO: 3364120 - RNA, 20 nt, Neisseria meningitidis Z2491
auucccgcguucgcgggaau

SEQ ID NO: 3364121 - RNA, 18 nt, Neisseria meningitidis Z2491
auucccgcuuucacggga

SEQ ID NO: 3364122 - RNA, 20 nt, Neisseria meningitidis Z2491
auucccgcuuucacgggaau

SEQ ID NO: 3364123 - RNA, 20 nt, Neisseria meningitidis Z2491
auucccgcuuuugcgagaau

SEQ ID NO: 3364124 - RNA, 15 nt, Neisseria meningitidis Z2491
auucccgugaaaacg

SEQ ID NO: 3364125 - RNA, 17 nt, Neisseria meningitidis Z2491
auuuagauaaugugcgg

SEQ ID NO: 3364126 - RNA, 12 nt, Neisseria meningitidis Z2491
auuuaguucacu

SEQ ID NO: 3364127 - RNA, 23 nt, Neisseria meningitidis Z2491
auuuauaguggauuaacaaaaac

SEQ ID NO: 3364128 - RNA, 23 nt, Neisseria meningitidis Z2491
auuuauaguggauuaacaaaaau

SEQ ID NO: 3364129 - RNA, 17 nt, Neisseria meningitidis Z2491
auuuauauuguuauuuu

SEQ ID NO: 3364130 - RNA, 15 nt, Neisseria meningitidis Z2491
auuuaucagaaauga

SEQ ID NO: 3364131 - RNA, 19 nt, Neisseria meningitidis Z2491
auuuauccgaaacaacaga

SEQ ID NO: 3364132 - RNA, 23 nt, Neisseria meningitidis Z2491
auuuauccgaaauaacaacaauc

SEQ ID NO: 3364133 - RNA, 21 nt, Neisseria meningitidis Z2491
auuuauccgaagcgacaacaa

SEQ ID NO: 3364134 - RNA, 22 nt, Neisseria meningitidis Z2491
auuuauccgaagcgacaacaau

SEQ ID NO: 3364135 - RNA, 20 nt, Neisseria meningitidis Z2491
auuuaucggaaaagcagaaa

SEQ ID NO: 3364136 - RNA, 20 nt, Neisseria meningitidis Z2491
auuuaucggaaaugacugaa

SEQ ID NO: 3364137 - RNA, 21 nt, Neisseria meningitidis Z2491
auuuaucggaaaugacugaaa

SEQ ID NO: 3364138 - RNA, 22 nt, Neisseria meningitidis Z2491
auuuaucggaaaugacugaaac

SEQ ID NO: 3364139 - RNA, 17 nt, Neisseria meningitidis Z2491
auuuaucggauaaaaca

SEQ ID NO: 3364140 - RNA, 22 nt, Neisseria meningitidis Z2491
auuuaucggauaaaacagaaau

SEQ ID NO: 3364141 - RNA, 19 nt, Neisseria meningitidis Z2491
auuuaucgggaaugacuga

SEQ ID NO: 3364142 - RNA, 21 nt, Neisseria meningitidis Z2491
auuuaucgggaaugacugaaa

SEQ ID NO: 3364143 - RNA, 22 nt, Neisseria meningitidis Z2491
auuuaucgggaaugacugaaac

SEQ ID NO: 3364144 - RNA, 14 nt, Neisseria meningitidis Z2491
auuuauuauguaua

SEQ ID NO: 3364145 - RNA, 22 nt, Neisseria meningitidis Z2491
auuuauucuaaauagcugaaac

SEQ ID NO: 3364146 - RNA, 14 nt, Neisseria meningitidis Z2491
auuuauucuguugu

SEQ ID NO: 3364147 - RNA, 23 nt, Neisseria meningitidis Z2491
auuuauugaagauggcugaaauu

SEQ ID NO: 3364148 - RNA, 14 nt, Neisseria meningitidis Z2491
auuuauugggaaua

SEQ ID NO: 3364149 - RNA, 18 nt, Neisseria meningitidis Z2491
auuuauuugaacaacaaa

SEQ ID NO: 3364150 - RNA, 14 nt, Neisseria meningitidis Z2491
auuuauuuugaaaa

SEQ ID NO: 3364151 - RNA, 16 nt, Neisseria meningitidis Z2491
auuuauuuugaaaaug

SEQ ID NO: 3364152 - RNA, 19 nt, Neisseria meningitidis Z2491
auuuauuuugaaaauggua

SEQ ID NO: 3364153 - RNA, 12 nt, Neisseria meningitidis Z2491
auuucacuucca

SEQ ID NO: 3364154 - RNA, 15 nt, Neisseria meningitidis Z2491
auuucagacggcauu

SEQ ID NO: 3364155 - RNA, 18 nt, Neisseria meningitidis Z2491
auuucagauugcgggcau

SEQ ID NO: 3364156 - RNA, 15 nt, Neisseria meningitidis Z2491
auuucaucauuccca

SEQ ID NO: 3364157 - RNA, 23 nt, Neisseria meningitidis Z2491
auuuccaaauauaaaaaaugccg

SEQ ID NO: 3364158 - RNA, 14 nt, Neisseria meningitidis Z2491
auuuccacaaaaaa

SEQ ID NO: 3364159 - RNA, 16 nt, Neisseria meningitidis Z2491
auuucccgucugccca

SEQ ID NO: 3364160 - RNA, 16 nt, Neisseria meningitidis Z2491
auuuccgacuggaugg

SEQ ID NO: 3364161 - RNA, 17 nt, Neisseria meningitidis Z2491
auuuccgauaaauuccu

SEQ ID NO: 3364162 - RNA, 20 nt, Neisseria meningitidis Z2491
auuuccgauaaauuccugcu

SEQ ID NO: 3364163 - RNA, 18 nt, Neisseria meningitidis Z2491
auuuccgauaaauucuug

SEQ ID NO: 3364164 - RNA, 16 nt, Neisseria meningitidis Z2491
auuuccgccgucauuc

SEQ ID NO: 3364165 - RNA, 22 nt, Neisseria meningitidis Z2491
auuuccgucaggcacgaagccc

SEQ ID NO: 3364166 - RNA, 20 nt, Neisseria meningitidis Z2491
auuuccucuuucaacggcac

SEQ ID NO: 3364167 - RNA, 15 nt, Neisseria meningitidis Z2491
auuuccuuaaaaaag

SEQ ID NO: 3364168 - RNA, 13 nt, Neisseria meningitidis Z2491
auuucgauacacc

SEQ ID NO: 3364169 - RNA, 19 nt, Neisseria meningitidis Z2491
auuucgcuuucgggcgcau

SEQ ID NO: 3364170 - RNA, 16 nt, Neisseria meningitidis Z2491
auuucggcaguuuuca

SEQ ID NO: 3364171 - RNA, 20 nt, Neisseria meningitidis Z2491
auuucgggcgaggguuugga

SEQ ID NO: 3364172 - RNA, 14 nt, Neisseria meningitidis Z2491
auuucuaauuuuua

SEQ ID NO: 3364173 - RNA, 17 nt, Neisseria meningitidis Z2491
auuucuaauuuuuauag

SEQ ID NO: 3364174 - RNA, 15 nt, Neisseria meningitidis Z2491
auuucuagauuccca

SEQ ID NO: 3364175 - RNA, 19 nt, Neisseria meningitidis Z2491
auuucuagauucccacuuu

SEQ ID NO: 3364176 - RNA, 16 nt, Neisseria meningitidis Z2491
auuucuauuuuuuacc

SEQ ID NO: 3364177 - RNA, 20 nt, Neisseria meningitidis Z2491
auuucugcgaaagcgggaau

SEQ ID NO: 3364178 - RNA, 20 nt, Neisseria meningitidis Z2491
auuucugcgcaggcgggaau

SEQ ID NO: 3364179 - RNA, 12 nt, Neisseria meningitidis Z2491
auuucuuauguu

SEQ ID NO: 3364180 - RNA, 16 nt, Neisseria meningitidis Z2491
auuucuuauguuuaau

SEQ ID NO: 3364181 - RNA, 15 nt, Neisseria meningitidis Z2491
auuucuucuaucauu

SEQ ID NO: 3364182 - RNA, 19 nt, Neisseria meningitidis Z2491
auuugaaguuucuccacau

SEQ ID NO: 3364183 - RNA, 15 nt, Neisseria meningitidis Z2491
auuugacccauuacu

SEQ ID NO: 3364184 - RNA, 16 nt, Neisseria meningitidis Z2491
auuugagcaaaugccg

SEQ ID NO: 3364185 - RNA, 18 nt, Neisseria meningitidis Z2491
auuugcacacguuugccg

SEQ ID NO: 3364186 - RNA, 13 nt, Neisseria meningitidis Z2491
auuugcacaucag

SEQ ID NO: 3364187 - RNA, 12 nt, Neisseria meningitidis Z2491
auuugccgccga

SEQ ID NO: 3364188 - RNA, 23 nt, Neisseria meningitidis Z2491
auuugccgcguaugcguucaaau

SEQ ID NO: 3364189 - RNA, 13 nt, Neisseria meningitidis Z2491
auuuggaauuuau

SEQ ID NO: 3364190 - RNA, 17 nt, Neisseria meningitidis Z2491
auuuggcagcugaagcc

SEQ ID NO: 3364191 - RNA, 18 nt, Neisseria meningitidis Z2491
auuuggggcgaaaacagc

SEQ ID NO: 3364192 - RNA, 17 nt, Neisseria meningitidis Z2491
auuugguaaugcaaaaa

SEQ ID NO: 3364193 - RNA, 18 nt, Neisseria meningitidis Z2491
auuuuacagcggauuaaa

SEQ ID NO: 3364194 - RNA, 16 nt, Neisseria meningitidis Z2491
auuuuacguucuagau

SEQ ID NO: 3364195 - RNA, 18 nt, Neisseria meningitidis Z2491
auuuuauaguggauuaaa

SEQ ID NO: 3364196 - RNA, 17 nt, Neisseria meningitidis Z2491
auuuuaugcucaaucuc

SEQ ID NO: 3364197 - RNA, 20 nt, Neisseria meningitidis Z2491
auuuuaugcucaaucucauu

SEQ ID NO: 3364198 - RNA, 20 nt, Neisseria meningitidis Z2491
auuuuauggcagguuuuuau

SEQ ID NO: 3364199 - RNA, 20 nt, Neisseria meningitidis Z2491
auuuucaaaaugcaaaacuu

SEQ ID NO: 3364200 - RNA, 13 nt, Neisseria meningitidis Z2491
auuuucaaacauu

SEQ ID NO: 3364201 - RNA, 14 nt, Neisseria meningitidis Z2491
auuuucaaacauua

SEQ ID NO: 3364202 - RNA, 14 nt, Neisseria meningitidis Z2491
auuuucacaaaaac

SEQ ID NO: 3364203 - RNA, 15 nt, Neisseria meningitidis Z2491
auuuucacaaaaaca

SEQ ID NO: 3364204 - RNA, 18 nt, Neisseria meningitidis Z2491
auuuucacaaaaacagaa

SEQ ID NO: 3364205 - RNA, 22 nt, Neisseria meningitidis Z2491
auuuuccauaaaauacaugaca

SEQ ID NO: 3364206 - RNA, 21 nt, Neisseria meningitidis Z2491
auuuuccccgugaaaaaaugc

SEQ ID NO: 3364207 - RNA, 17 nt, Neisseria meningitidis Z2491
auuuucuauuugauuuu

SEQ ID NO: 3364208 - RNA, 13 nt, Neisseria meningitidis Z2491
auuuucuugaguu

SEQ ID NO: 3364209 - RNA, 18 nt, Neisseria meningitidis Z2491
auuuucuugaguuucugu

SEQ ID NO: 3364210 - RNA, 21 nt, Neisseria meningitidis Z2491
auuuucuugaguuucuguauu

SEQ ID NO: 3364211 - RNA, 20 nt, Neisseria meningitidis Z2491
auuuugacuuuggaacaaaa

SEQ ID NO: 3364212 - RNA, 10 nt, Neisseria meningitidis Z2491
auuuugauug

SEQ ID NO: 3364213 - RNA, 23 nt, Neisseria meningitidis Z2491
auuuugcaagaauggcaaaauuu

SEQ ID NO: 3364214 - RNA, 22 nt, Neisseria meningitidis Z2491
auuuugcagcccugauaaaaaa

SEQ ID NO: 3364215 - RNA, 23 nt, Neisseria meningitidis Z2491
auuuugcagcccugauaaaaaau

SEQ ID NO: 3364216 - RNA, 21 nt, Neisseria meningitidis Z2491
auuuugcuuuggucgcugccu

SEQ ID NO: 3364217 - RNA, 21 nt, Neisseria meningitidis Z2491
auuuuggagcaguaaaauuua

SEQ ID NO: 3364218 - RNA, 18 nt, Neisseria meningitidis Z2491
auuuugguuuauuuuugg

SEQ ID NO: 3364219 - RNA, 16 nt, Neisseria meningitidis Z2491
auuuuguugaauuuua

SEQ ID NO: 3364220 - RNA, 17 nt, Neisseria meningitidis Z2491
auuuuguugaauuuuau

SEQ ID NO: 3364221 - RNA, 15 nt, Neisseria meningitidis Z2491
auuuuuagcccaugu

SEQ ID NO: 3364222 - RNA, 22 nt, Neisseria meningitidis Z2491
auuuuuauagugauuaacaaaa

SEQ ID NO: 3364223 - RNA, 23 nt, Neisseria meningitidis Z2491
auuuuuauaguggauuaacaaaa

SEQ ID NO: 3364224 - RNA, 18 nt, Neisseria meningitidis Z2491
auuuuuaucguguuuccu

SEQ ID NO: 3364225 - RNA, 19 nt, Neisseria meningitidis Z2491
auuuuuaugcgucaaauuu

SEQ ID NO: 3364226 - RNA, 17 nt, Neisseria meningitidis Z2491
caaaccgccauucccgc

SEQ ID NO: 3364227 - RNA, 15 nt, Neisseria meningitidis Z2491
caaaccgucauuccc

SEQ ID NO: 3364228 - RNA, 14 nt, Neisseria meningitidis Z2491
caaaccguccccuu

SEQ ID NO: 3364229 - RNA, 22 nt, Neisseria meningitidis Z2491
caaaccgucgccgaacgccauc

SEQ ID NO: 3364230 - RNA, 14 nt, Neisseria meningitidis Z2491
caaaccgucugcca

SEQ ID NO: 3364231 - RNA, 17 nt, Neisseria meningitidis Z2491
caaacggcaggcaaaaa

SEQ ID NO: 3364232 - RNA, 19 nt, Neisseria meningitidis Z2491
caaacggguuucagacggc

SEQ ID NO: 3364233 - RNA, 17 nt, Neisseria meningitidis Z2491
caaacgguaccugauga

SEQ ID NO: 3364234 - RNA, 17 nt, Neisseria meningitidis Z2491
caaacguccgauuaauu

SEQ ID NO: 3364235 - RNA, 23 nt, Neisseria meningitidis Z2491
caaacguuuuuccaaaccuuuga

SEQ ID NO: 3364236 - RNA, 20 nt, Neisseria meningitidis Z2491
caaacuaacuuauacacacg

SEQ ID NO: 3364237 - RNA, 22 nt, Neisseria meningitidis Z2491
caaacuacccgguuuugcgccu

SEQ ID NO: 3364238 - RNA, 16 nt, Neisseria meningitidis Z2491
caaacuagauucccgc

SEQ ID NO: 3364239 - RNA, 14 nt, Neisseria meningitidis Z2491
caaacuauaucuau

SEQ ID NO: 3364240 - RNA, 18 nt, Neisseria meningitidis Z2491
caaacuauaucuauacua

SEQ ID NO: 3364241 - RNA, 22 nt, Neisseria meningitidis Z2491
caaacuauaucuauacuaaaac

SEQ ID NO: 3364242 - RNA, 16 nt, Neisseria meningitidis Z2491
caaacuccuuggaaug

SEQ ID NO: 3364243 - RNA, 22 nt, Neisseria meningitidis Z2491
caaacugcccgaccuguaaaau

SEQ ID NO: 3364244 - RNA, 13 nt, Neisseria meningitidis Z2491
caaacuuccaaau

SEQ ID NO: 3364245 - RNA, 22 nt, Neisseria meningitidis Z2491
caaacuuucagauaaucuuuga

SEQ ID NO: 3364246 - RNA, 23 nt, Neisseria meningitidis Z2491
caaagaaaauauuacgguaaaca

SEQ ID NO: 3364247 - RNA, 16 nt, Neisseria meningitidis Z2491
caaagaaagcagaaau

SEQ ID NO: 3364248 - RNA, 20 nt, Neisseria meningitidis Z2491
caaagaaauguaaauuuuua

SEQ ID NO: 3364249 - RNA, 20 nt, Neisseria meningitidis Z2491
caaagacagaaaaccaaaaa

SEQ ID NO: 3364250 - RNA, 19 nt, Neisseria meningitidis Z2491
caaagacaucccccaacca

SEQ ID NO: 3364251 - RNA, 20 nt, Neisseria meningitidis Z2491
caaagagaaagaacccaaac

SEQ ID NO: 3364252 - RNA, 15 nt, Neisseria meningitidis Z2491
caaagauuaucugaa

SEQ ID NO: 3364253 - RNA, 16 nt, Neisseria meningitidis Z2491
caaagauuaucugaaa

SEQ ID NO: 3364254 - RNA, 17 nt, Neisseria meningitidis Z2491
caaagcccccugcacgc

SEQ ID NO: 3364255 - RNA, 22 nt, Neisseria meningitidis Z2491
caaagccucgucauuuccacaa

SEQ ID NO: 3364256 - RNA, 14 nt, Neisseria meningitidis Z2491
caaagcggcuggga

SEQ ID NO: 3364257 - RNA, 15 nt, Neisseria meningitidis Z2491
caaagcgguuucuug

SEQ ID NO: 3364258 - RNA, 21 nt, Neisseria meningitidis Z2491
caaagcgguuucuugugucau

SEQ ID NO: 3364259 - RNA, 21 nt, Neisseria meningitidis Z2491
caaagcuuuaaacuauagugg

SEQ ID NO: 3364260 - RNA, 23 nt, Neisseria meningitidis Z2491
caaaggagugaauguucgccaac

SEQ ID NO: 3364261 - RNA, 19 nt, Neisseria meningitidis Z2491
caaaggggacagacggcca

SEQ ID NO: 3364262 - RNA, 15 nt, Neisseria meningitidis Z2491
caaaggucucuauuu

SEQ ID NO: 3364263 - RNA, 21 nt, Neisseria meningitidis Z2491
caaaggucucuauuuguucga

SEQ ID NO: 3364264 - RNA, 15 nt, Neisseria meningitidis Z2491
caaagucauauuaau

SEQ ID NO: 3364265 - RNA, 16 nt, Neisseria meningitidis Z2491
caaaguuauuaaguga

SEQ ID NO: 3364266 - RNA, 14 nt, Neisseria meningitidis Z2491
caaauaaagucuga

SEQ ID NO: 3364267 - RNA, 15 nt, Neisseria meningitidis Z2491
caaauaaauucugaa

SEQ ID NO: 3364268 - RNA, 14 nt, Neisseria meningitidis Z2491
caaauaauguucaa

SEQ ID NO: 3364269 - RNA, 13 nt, Neisseria meningitidis Z2491
caaauaauugaaa

SEQ ID NO: 3364270 - RNA, 19 nt, Neisseria meningitidis Z2491
caaauacccaaaugcagaa

SEQ ID NO: 3364271 - RNA, 14 nt, Neisseria meningitidis Z2491
caaauauaaaaaau

SEQ ID NO: 3364272 - RNA, 15 nt, Neisseria meningitidis Z2491
caaauauccggcaag

SEQ ID NO: 3364273 - RNA, 22 nt, Neisseria meningitidis Z2491
caaauauccggcaagccuuuca

SEQ ID NO: 3364274 - RNA, 20 nt, Neisseria meningitidis Z2491
caaaucauauuccagcgugc

SEQ ID NO: 3364275 - RNA, 19 nt, Neisseria meningitidis Z2491
caaaucccgucauucccgc

SEQ ID NO: 3364276 - RNA, 15 nt, Neisseria meningitidis Z2491
caaaucgacaguuuc

SEQ ID NO: 3364277 - RNA, 23 nt, Neisseria meningitidis Z2491
caaaucgaugcguuccugccaga

SEQ ID NO: 3364278 - RNA, 15 nt, Neisseria meningitidis Z2491
caaaucggauaggca

SEQ ID NO: 3364279 - RNA, 17 nt, Neisseria meningitidis Z2491
caaaucgucauucccgc

SEQ ID NO: 3364280 - RNA, 14 nt, Neisseria meningitidis Z2491
caaaucuaaauagc

SEQ ID NO: 3364281 - RNA, 21 nt, Neisseria meningitidis Z2491
caaaucuuuggcaaccgucag

SEQ ID NO: 3364282 - RNA, 23 nt, Neisseria meningitidis Z2491
caaaugaauguggucguucaaau

SEQ ID NO: 3364283 - RNA, 15 nt, Neisseria meningitidis Z2491
caaaugccaaaggca

SEQ ID NO: 3364284 - RNA, 14 nt, Neisseria meningitidis Z2491
caaaugccgucuga

SEQ ID NO: 3364285 - RNA, 15 nt, Neisseria meningitidis Z2491
caaaugccgucugaa

SEQ ID NO: 3364286 - RNA, 16 nt, Neisseria meningitidis Z2491
caaaugccgucugaaa

SEQ ID NO: 3364287 - RNA, 18 nt, Neisseria meningitidis Z2491
caaaugccgucugaaaac

SEQ ID NO: 3364288 - RNA, 20 nt, Neisseria meningitidis Z2491
caaaugccgucugaaaacag

SEQ ID NO: 3364289 - RNA, 23 nt, Neisseria meningitidis Z2491
caaaugccgucugaaaacaguuc

SEQ ID NO: 3364290 - RNA, 20 nt, Neisseria meningitidis Z2491
caaaugccgucugaaaggcu

SEQ ID NO: 3364291 - RNA, 19 nt, Neisseria meningitidis Z2491
caaaugccgucugaaaugu

SEQ ID NO: 3364292 - RNA, 21 nt, Neisseria meningitidis Z2491
caaaugccgucugaaauguuc

SEQ ID NO: 3364293 - RNA, 22 nt, Neisseria meningitidis Z2491
caaaugccgucugaagcccugc

SEQ ID NO: 3364294 - RNA, 16 nt, Neisseria meningitidis Z2491
caaaugcugucugaaa

SEQ ID NO: 3364295 - RNA, 18 nt, Neisseria meningitidis Z2491
caaaugcugucugaaacc

SEQ ID NO: 3364296 - RNA, 13 nt, Neisseria meningitidis Z2491
caaauuaaaauaa

SEQ ID NO: 3364297 - RNA, 15 nt, Neisseria meningitidis Z2491
caaauuaaaauaaaa

SEQ ID NO: 3364298 - RNA, 16 nt, Neisseria meningitidis Z2491
caaauuccagcaaugc

SEQ ID NO: 3364299 - RNA, 14 nt, Neisseria meningitidis Z2491
caaauuccuaaaac

SEQ ID NO: 3364300 - RNA, 18 nt, Neisseria meningitidis Z2491
caaauugaaaugccgucu

SEQ ID NO: 3364301 - RNA, 23 nt, Neisseria meningitidis Z2491
caaauugauuuuuagcccauguu

SEQ ID NO: 3364302 - RNA, 17 nt, Neisseria meningitidis Z2491
caacaaaccaaaagccg

SEQ ID NO: 3364303 - RNA, 16 nt, Neisseria meningitidis Z2491
caacaaauuuuugauu

SEQ ID NO: 3364304 - RNA, 15 nt, Neisseria meningitidis Z2491
caacacaaaauaaaa

SEQ ID NO: 3364305 - RNA, 20 nt, Neisseria meningitidis Z2491
caacaccugcagauugagga

SEQ ID NO: 3364306 - RNA, 19 nt, Neisseria meningitidis Z2491
caacacgcaaaacacaacu

SEQ ID NO: 3364307 - RNA, 11 nt, Neisseria meningitidis Z2491
caacacgccca

SEQ ID NO: 3364308 - RNA, 13 nt, Neisseria meningitidis Z2491
caacacgcggcgc

SEQ ID NO: 3364309 - RNA, 20 nt, Neisseria meningitidis Z2491
caacacuaguguauuagugg

SEQ ID NO: 3364310 - RNA, 17 nt, Neisseria meningitidis Z2491
caacagaaauaaaagca

SEQ ID NO: 3364311 - RNA, 16 nt, Neisseria meningitidis Z2491
caacagcuuaaaaucc

SEQ ID NO: 3364312 - RNA, 14 nt, Neisseria meningitidis Z2491
caacaggaauuuau

SEQ ID NO: 3364313 - RNA, 15 nt, Neisseria meningitidis Z2491
caacaggaauuuauc

SEQ ID NO: 3364314 - RNA, 16 nt, Neisseria meningitidis Z2491
caacaggaauuuaucc

SEQ ID NO: 3364315 - RNA, 14 nt, Neisseria meningitidis Z2491
caacaggcgggcgu

SEQ ID NO: 3364316 - RNA, 22 nt, Neisseria meningitidis Z2491
caacaggcgggcguuccacaaa

SEQ ID NO: 3364317 - RNA, 15 nt, Neisseria meningitidis Z2491
caacaguaauauuca

SEQ ID NO: 3364318 - RNA, 23 nt, Neisseria meningitidis Z2491
caacaucagcauagggacgaaaa

SEQ ID NO: 3364319 - RNA, 18 nt, Neisseria meningitidis Z2491
caacaucagcucgggcug

SEQ ID NO: 3364320 - RNA, 17 nt, Neisseria meningitidis Z2491
caacaucauagaaauca

SEQ ID NO: 3364321 - RNA, 21 nt, Neisseria meningitidis Z2491
caacaucguacugguuuaaau

SEQ ID NO: 3364322 - RNA, 15 nt, Neisseria meningitidis Z2491
caacauuuccugcau

SEQ ID NO: 3364323 - RNA, 16 nt, Neisseria meningitidis Z2491
caacauuuccugcauc

SEQ ID NO: 3364324 - RNA, 17 nt, Neisseria meningitidis Z2491
caacauuugcgcagccu

SEQ ID NO: 3364325 - RNA, 13 nt, Neisseria meningitidis Z2491
caaccaaaaaauc

SEQ ID NO: 3364326 - RNA, 16 nt, Neisseria meningitidis Z2491
caaccaacgaaacacu

SEQ ID NO: 3364327 - RNA, 15 nt, Neisseria meningitidis Z2491
caaugaaaguuugcc

SEQ ID NO: 3364328 - RNA, 20 nt, Neisseria meningitidis Z2491
caaugaggcaauagaagcca

SEQ ID NO: 3364329 - RNA, 14 nt, Neisseria meningitidis Z2491
caaugcaaaaacau

SEQ ID NO: 3364330 - RNA, 11 nt, Neisseria meningitidis Z2491
caaugccgucu

SEQ ID NO: 3364331 - RNA, 13 nt, Neisseria meningitidis Z2491
caaugccgucuga

SEQ ID NO: 3364332 - RNA, 21 nt, Neisseria meningitidis Z2491
caaugccgucugaaaaccuuu

SEQ ID NO: 3364333 - RNA, 22 nt, Neisseria meningitidis Z2491
caaugccgucugaacccgccug

SEQ ID NO: 3364334 - RNA, 15 nt, Neisseria meningitidis Z2491
caaugccgucugaag

SEQ ID NO: 3364335 - RNA, 16 nt, Neisseria meningitidis Z2491
caaugccgucugaauc

SEQ ID NO: 3364336 - RNA, 13 nt, Neisseria meningitidis Z2491
caaugccuuuucc

SEQ ID NO: 3364337 - RNA, 14 nt, Neisseria meningitidis Z2491
caaugccuuuuccg

SEQ ID NO: 3364338 - RNA, 19 nt, Neisseria meningitidis Z2491
caaugcgcccgauguaguc

SEQ ID NO: 3364339 - RNA, 14 nt, Neisseria meningitidis Z2491
caaugcucgggcaa

SEQ ID NO: 3364340 - RNA, 13 nt, Neisseria meningitidis Z2491
caaugcuucaacc

SEQ ID NO: 3364341 - RNA, 17 nt, Neisseria meningitidis Z2491
caaugcuucaaccacgc

SEQ ID NO: 3364342 - RNA, 14 nt, Neisseria meningitidis Z2491
caauuaaaaacaaa

SEQ ID NO: 3364343 - RNA, 15 nt, Neisseria meningitidis Z2491
caauuaaaaacaaaa

SEQ ID NO: 3364344 - RNA, 24 nt, Neisseria meningitidis Z2491
caauucacuuggugcuucagcacc

SEQ ID NO: 3364345 - RNA, 11 nt, Neisseria meningitidis Z2491
caauucccacc

SEQ ID NO: 3364346 - RNA, 14 nt, Neisseria meningitidis Z2491
caauugacaaaaac

SEQ ID NO: 3364347 - RNA, 20 nt, Neisseria meningitidis Z2491
caauuuaaacacuucuucau

SEQ ID NO: 3364348 - RNA, 23 nt, Neisseria meningitidis Z2491
caauuuaucggaaaaaaccgaag

SEQ ID NO: 3364349 - RNA, 21 nt, Neisseria meningitidis Z2491
caauuuaucggaaaugacuga

SEQ ID NO: 3364350 - RNA, 16 nt, Neisseria meningitidis Z2491
caauuuccacaauuca

SEQ ID NO: 3364351 - RNA, 18 nt, Neisseria meningitidis Z2491
caauuuguauucaagcaa

SEQ ID NO: 3364352 - RNA, 13 nt, Neisseria meningitidis Z2491
caauuuuuuaaau

SEQ ID NO: 3364353 - RNA, 16 nt, Neisseria meningitidis Z2491
cacaaaaaacuucccg

SEQ ID NO: 3364354 - RNA, 13 nt, Neisseria meningitidis Z2491
cacaaaaaagcca

SEQ ID NO: 3364355 - RNA, 18 nt, Neisseria meningitidis Z2491
cacaaaaaagccagcagc

SEQ ID NO: 3364356 - RNA, 15 nt, Neisseria meningitidis Z2491
cacaaaaacagaaaa

SEQ ID NO: 3364357 - RNA, 19 nt, Neisseria meningitidis Z2491
cacaaaagauacacacacc

SEQ ID NO: 3364358 - RNA, 20 nt, Neisseria meningitidis Z2491
cacaaaagauacacacaccg

SEQ ID NO: 3364359 - RNA, 14 nt, Neisseria meningitidis Z2491
cacaaaauaaaaaa

SEQ ID NO: 3364360 - RNA, 22 nt, Neisseria meningitidis Z2491
cacaaacgccagcacaaacagc

SEQ ID NO: 3364361 - RNA, 10 nt, Neisseria meningitidis Z2491
cacaaaggag

SEQ ID NO: 3364362 - RNA, 19 nt, Neisseria meningitidis Z2491
cacaaaugccaaaggcagu

SEQ ID NO: 3364363 - RNA, 19 nt, Neisseria meningitidis Z2491
cacaaccgcccuauauuug

SEQ ID NO: 3364364 - RNA, 21 nt, Neisseria meningitidis Z2491
cacaaccgcccuauauuugcc

SEQ ID NO: 3364365 - RNA, 18 nt, Neisseria meningitidis Z2491
cacaagccgccgaugcgg

SEQ ID NO: 3364366 - RNA, 17 nt, Neisseria meningitidis Z2491
cacaagguuauuuucuu

SEQ ID NO: 3364367 - RNA, 18 nt, Neisseria meningitidis Z2491
cacaagguuauuuucuug

SEQ ID NO: 3364368 - RNA, 12 nt, Neisseria meningitidis Z2491
cacaaucugaaa

SEQ ID NO: 3364369 - RNA, 12 nt, Neisseria meningitidis Z2491
cacaauggcgga

SEQ ID NO: 3364370 - RNA, 14 nt, Neisseria meningitidis Z2491
cacacaagcgcaug

SEQ ID NO: 3364371 - RNA, 17 nt, Neisseria meningitidis Z2491
cacacacaagccguaca

SEQ ID NO: 3364372 - RNA, 14 nt, Neisseria meningitidis Z2491
cacacgaacugccu

SEQ ID NO: 3364373 - RNA, 16 nt, Neisseria meningitidis Z2491
cacacgguuuucacau

SEQ ID NO: 3364374 - RNA, 17 nt, Neisseria meningitidis Z2491
cacacguuuugcaggua

SEQ ID NO: 3364375 - RNA, 17 nt, Neisseria meningitidis Z2491
cacagacauagacugua

SEQ ID NO: 3364376 - RNA, 22 nt, Neisseria meningitidis Z2491
cacagccaaaauauucaauuga

SEQ ID NO: 3364377 - RNA, 17 nt, Neisseria meningitidis Z2491
cacaggggagggaguca

SEQ ID NO: 3364378 - RNA, 22 nt, Neisseria meningitidis Z2491
cacagguuuucgucuauuuucg

SEQ ID NO: 3364379 - RNA, 22 nt, Neisseria meningitidis Z2491
cacagugauggcuucuaaaaau

SEQ ID NO: 3364380 - RNA, 16 nt, Neisseria meningitidis Z2491
cacauaauucaaaugc

SEQ ID NO: 3364381 - RNA, 20 nt, Neisseria meningitidis Z2491
cacauccuccaucacaacuu

SEQ ID NO: 3364382 - RNA, 14 nt, Neisseria meningitidis Z2491
cacaucgucugcaa

SEQ ID NO: 3364383 - RNA, 13 nt, Neisseria meningitidis Z2491
cacauuccaucaa

SEQ ID NO: 3364384 - RNA, 14 nt, Neisseria meningitidis Z2491
cacauuuguuccaa

SEQ ID NO: 3364385 - RNA, 18 nt, Neisseria meningitidis Z2491
cacauuuucuauuugauu

SEQ ID NO: 3364386 - RNA, 21 nt, Neisseria meningitidis Z2491
cacauuuucuauuugauuuuc

SEQ ID NO: 3364387 - RNA, 13 nt, Neisseria meningitidis Z2491
caccaauucuuca

SEQ ID NO: 3364388 - RNA, 19 nt, Neisseria meningitidis Z2491
caccacgucauucccacga

SEQ ID NO: 3364389 - RNA, 20 nt, Neisseria meningitidis Z2491
caccaguucgucaugcaccu

SEQ ID NO: 3364390 - RNA, 17 nt, Neisseria meningitidis Z2491
caccaucgagcugccuu

SEQ ID NO: 3364391 - RNA, 19 nt, Neisseria meningitidis Z2491
caccaucggcaaaguuauu

SEQ ID NO: 3364392 - RNA, 23 nt, Neisseria meningitidis Z2491
cacccgccccgccgaucugcccg

SEQ ID NO: 3364393 - RNA, 22 nt, Neisseria meningitidis Z2491
cacccuaccauuguuucugaag

SEQ ID NO: 3364394 - RNA, 19 nt, Neisseria meningitidis Z2491
cacccugcaaggcggcggc

SEQ ID NO: 3364395 - RNA, 14 nt, Neisseria meningitidis Z2491
cacccuuaagauuu

SEQ ID NO: 3364396 - RNA, 19 nt, Neisseria meningitidis Z2491
cacccuuaagauuuguggc

SEQ ID NO: 3364397 - RNA, 22 nt, Neisseria meningitidis Z2491
caccgacagaccuagauucccg

SEQ ID NO: 3364398 - RNA, 23 nt, Neisseria meningitidis Z2491
caccgacauuucauugccgccca

SEQ ID NO: 3364399 - RNA, 15 nt, Neisseria meningitidis Z2491
caccgacggaauaug

SEQ ID NO: 3364400 - RNA, 22 nt, Neisseria meningitidis Z2491
caccgauggauuuuuuuguugc

SEQ ID NO: 3364401 - RNA, 13 nt, Neisseria meningitidis Z2491
caccgcgcauuug

SEQ ID NO: 3364402 - RNA, 19 nt, Neisseria meningitidis Z2491
caccgcuuuguccaaaucg

SEQ ID NO: 3364403 - RNA, 19 nt, Neisseria meningitidis Z2491
caccgggcuucaucugccg

SEQ ID NO: 3364404 - RNA, 13 nt, Neisseria meningitidis Z2491
caccgugauuuua

SEQ ID NO: 3364405 - RNA, 15 nt, Neisseria meningitidis Z2491
caccguuauggaaau

SEQ ID NO: 3364406 - RNA, 17 nt, Neisseria meningitidis Z2491
caccguuuaaaacagca

SEQ ID NO: 3364407 - RNA, 18 nt, Neisseria meningitidis Z2491
caccugaacggcacaaac

SEQ ID NO: 3364408 - RNA, 21 nt, Neisseria meningitidis Z2491
caccugcagauugaggaucuu

SEQ ID NO: 3364409 - RNA, 18 nt, Neisseria meningitidis Z2491
caccuuugggcucaauga

SEQ ID NO: 3364410 - RNA, 14 nt, Neisseria meningitidis Z2491
cacgaacugccucc

SEQ ID NO: 3364411 - RNA, 12 nt, Neisseria meningitidis Z2491
cacgaagaugaa

SEQ ID NO: 3364412 - RNA, 12 nt, Neisseria meningitidis Z2491
cacgaagcccuc

SEQ ID NO: 3364413 - RNA, 22 nt, Neisseria meningitidis Z2491
cacgaagcccucagcuaugccu

SEQ ID NO: 3364414 - RNA, 18 nt, Neisseria meningitidis Z2491
cacgaaucuuauccacag

SEQ ID NO: 3364415 - RNA, 24 nt, Neisseria meningitidis Z2491
cacgacgcagaccguccacaagcc

SEQ ID NO: 3364416 - RNA, 21 nt, Neisseria meningitidis Z2491
cacgauacacaaaaaagccag

SEQ ID NO: 3364417 - RNA, 13 nt, Neisseria meningitidis Z2491
cacgcaggaaauu

SEQ ID NO: 3364418 - RNA, 16 nt, Neisseria meningitidis Z2491
cacgcaggcgaccgcc

SEQ ID NO: 3364419 - RNA, 15 nt, Neisseria meningitidis Z2491
cacgcaugaagccgu

SEQ ID NO: 3364420 - RNA, 15 nt, Neisseria meningitidis Z2491
cacgcauuccgacag

SEQ ID NO: 3364421 - RNA, 15 nt, Neisseria meningitidis Z2491
cacgcccgcaucuuu

SEQ ID NO: 3364422 - RNA, 21 nt, Neisseria meningitidis Z2491
cacgcccuuccacgcgcaccu

SEQ ID NO: 3364423 - RNA, 14 nt, Neisseria meningitidis Z2491
cacgccgacugccg

SEQ ID NO: 3364424 - RNA, 20 nt, Neisseria meningitidis Z2491
cacgccgacuucgauugcca

SEQ ID NO: 3364425 - RNA, 20 nt, Neisseria meningitidis Z2491
cacgccgccugcaaaggcaa

SEQ ID NO: 3364426 - RNA, 21 nt, Neisseria meningitidis Z2491
cacgccguguuucaaggcggc

SEQ ID NO: 3364427 - RNA, 16 nt, Neisseria meningitidis Z2491
cacgcgcaccugacgc

SEQ ID NO: 3364428 - RNA, 14 nt, Neisseria meningitidis Z2491
cacgcgcuucaaau

SEQ ID NO: 3364429 - RNA, 12 nt, Neisseria meningitidis Z2491
cagcacaggcaa

SEQ ID NO: 3364430 - RNA, 18 nt, Neisseria meningitidis Z2491
cagcacaucgucugcaag

SEQ ID NO: 3364431 - RNA, 13 nt, Neisseria meningitidis Z2491
cagcaccacaccu

SEQ ID NO: 3364432 - RNA, 23 nt, Neisseria meningitidis Z2491
cagcacgauacacaaaaaagcca

SEQ ID NO: 3364433 - RNA, 22 nt, Neisseria meningitidis Z2491
cagcacguguuccaaacgccgc

SEQ ID NO: 3364434 - RNA, 14 nt, Neisseria meningitidis Z2491
cagcacugccucuu

SEQ ID NO: 3364435 - RNA, 18 nt, Neisseria meningitidis Z2491
cagcacugccucuuuuca

SEQ ID NO: 3364436 - RNA, 22 nt, Neisseria meningitidis Z2491
cagcagagcugugcagucgggc

SEQ ID NO: 3364437 - RNA, 19 nt, Neisseria meningitidis Z2491
cagcagaucgaccgcuucc

SEQ ID NO: 3364438 - RNA, 12 nt, Neisseria meningitidis Z2491
cagcagcagccc

SEQ ID NO: 3364439 - RNA, 16 nt, Neisseria meningitidis Z2491
cagcagcagcccgaac

SEQ ID NO: 3364440 - RNA, 16 nt, Neisseria meningitidis Z2491
cagcagcccuccccag

SEQ ID NO: 3364441 - RNA, 14 nt, Neisseria meningitidis Z2491
cagcagcgaaggcg

SEQ ID NO: 3364442 - RNA, 15 nt, Neisseria meningitidis Z2491
cagcagcgaaggcgc

SEQ ID NO: 3364443 - RNA, 19 nt, Neisseria meningitidis Z2491
cagcaggggauugccgccc

SEQ ID NO: 3364444 - RNA, 20 nt, Neisseria meningitidis Z2491
cagcauaguggggaguccuu

SEQ ID NO: 3364445 - RNA, 21 nt, Neisseria meningitidis Z2491
cagcauuaauauacuuggcaa

SEQ ID NO: 3364446 - RNA, 23 nt, Neisseria meningitidis Z2491
cagcauuaauauacuuggcaaaa

SEQ ID NO: 3364447 - RNA, 14 nt, Neisseria meningitidis Z2491
cagcauuuccacau

SEQ ID NO: 3364448 - RNA, 15 nt, Neisseria meningitidis Z2491
cagcauuuccacauc

SEQ ID NO: 3364449 - RNA, 15 nt, Neisseria meningitidis Z2491
cagccaaaauauuca

SEQ ID NO: 3364450 - RNA, 15 nt, Neisseria meningitidis Z2491
cagccacgccaaaaa

SEQ ID NO: 3364451 - RNA, 19 nt, Neisseria meningitidis Z2491
cagccagcaucgcagauuc

SEQ ID NO: 3364452 - RNA, 20 nt, Neisseria meningitidis Z2491
cagccaggcgcagguuuugu

SEQ ID NO: 3364453 - RNA, 15 nt, Neisseria meningitidis Z2491
cagccaucuacaaaa

SEQ ID NO: 3364454 - RNA, 22 nt, Neisseria meningitidis Z2491
cagccccaugcguucgagcagg

SEQ ID NO: 3364455 - RNA, 22 nt, Neisseria meningitidis Z2491
cagccccuuaaaguuugucccg

SEQ ID NO: 3364456 - RNA, 14 nt, Neisseria meningitidis Z2491
cagcccuccccaga

SEQ ID NO: 3364457 - RNA, 21 nt, Neisseria meningitidis Z2491
cagcccucuugccuuaucccg

SEQ ID NO: 3364458 - RNA, 16 nt, Neisseria meningitidis Z2491
cagccgaaacccaaac

SEQ ID NO: 3364459 - RNA, 22 nt, Neisseria meningitidis Z2491
cagccgaaugauucauaaaaua

SEQ ID NO: 3364460 - RNA, 21 nt, Neisseria meningitidis Z2491
cagccuaauguacuucuggaa

SEQ ID NO: 3364461 - RNA, 19 nt, Neisseria meningitidis Z2491
cagccuacuugcccgccuu

SEQ ID NO: 3364462 - RNA, 12 nt, Neisseria meningitidis Z2491
cagccugcucga

SEQ ID NO: 3364463 - RNA, 20 nt, Neisseria meningitidis Z2491
cagccugcucggccugcccu

SEQ ID NO: 3364464 - RNA, 22 nt, Neisseria meningitidis Z2491
cagccuuaacagggaaagcagc

SEQ ID NO: 3364465 - RNA, 19 nt, Neisseria meningitidis Z2491
cagccuuucaacacgcccu

SEQ ID NO: 3364466 - RNA, 23 nt, Neisseria meningitidis Z2491
cagcgacacccucaauucuucga

SEQ ID NO: 3364467 - RNA, 18 nt, Neisseria meningitidis Z2491
cagcgcguuuucauccac

SEQ ID NO: 3364468 - RNA, 11 nt, Neisseria meningitidis Z2491
cagcggacagu

SEQ ID NO: 3364469 - RNA, 22 nt, Neisseria meningitidis Z2491
cagcggauuguucggaucggca

SEQ ID NO: 3364470 - RNA, 21 nt, Neisseria meningitidis Z2491
cagcggguaggcgggacggcc

SEQ ID NO: 3364471 - RNA, 21 nt, Neisseria meningitidis Z2491
cagcgugaugauguccgacug

SEQ ID NO: 3364472 - RNA, 18 nt, Neisseria meningitidis Z2491
cagcguuacuuugcguuc

SEQ ID NO: 3364473 - RNA, 16 nt, Neisseria meningitidis Z2491
cagcguugccucgccu

SEQ ID NO: 3364474 - RNA, 16 nt, Neisseria meningitidis Z2491
cagcuaugccugccga

SEQ ID NO: 3364475 - RNA, 21 nt, Neisseria meningitidis Z2491
cagcuauuuagaauaaauuuu

SEQ ID NO: 3364476 - RNA, 16 nt, Neisseria meningitidis Z2491
cagcuccggccaaaaa

SEQ ID NO: 3364477 - RNA, 23 nt, Neisseria meningitidis Z2491
cagcucgauauccgacugugccg

SEQ ID NO: 3364478 - RNA, 14 nt, Neisseria meningitidis Z2491
cagcucucccucuu

SEQ ID NO: 3364479 - RNA, 22 nt, Neisseria meningitidis Z2491
cagcugaaaacagcugaaaacc

SEQ ID NO: 3364480 - RNA, 17 nt, Neisseria meningitidis Z2491
cagcuucaccgcgccgu

SEQ ID NO: 3364481 - RNA, 22 nt, Neisseria meningitidis Z2491
cagcuucauaccccacugccag

SEQ ID NO: 3364482 - RNA, 14 nt, Neisseria meningitidis Z2491
cagcuucgucgccu

SEQ ID NO: 3364483 - RNA, 20 nt, Neisseria meningitidis Z2491
cagcuucgucgccuuguccu

SEQ ID NO: 3364484 - RNA, 17 nt, Neisseria meningitidis Z2491
cagcuugggcggacugc

SEQ ID NO: 3364485 - RNA, 16 nt, Neisseria meningitidis Z2491
caggaaauuuccaaau

SEQ ID NO: 3364486 - RNA, 17 nt, Neisseria meningitidis Z2491
caggaacacggcggcac

SEQ ID NO: 3364487 - RNA, 19 nt, Neisseria meningitidis Z2491
caggaacgaaucaggcaaa

SEQ ID NO: 3364488 - RNA, 20 nt, Neisseria meningitidis Z2491
caggaaucggguuucagacg

SEQ ID NO: 3364489 - RNA, 10 nt, Neisseria meningitidis Z2491
caggaaucuu

SEQ ID NO: 3364490 - RNA, 13 nt, Neisseria meningitidis Z2491
caggaauuuaucc

SEQ ID NO: 3364491 - RNA, 14 nt, Neisseria meningitidis Z2491
caggaauuuauccg

SEQ ID NO: 3364492 - RNA, 23 nt, Neisseria meningitidis Z2491
caggacaaaguuggcaaggaaug

SEQ ID NO: 3364493 - RNA, 15 nt, Neisseria meningitidis Z2491
caggacaaggcaacg

SEQ ID NO: 3364494 - RNA, 16 nt, Neisseria meningitidis Z2491
caggacaaggcaacga

SEQ ID NO: 3364495 - RNA, 22 nt, Neisseria meningitidis Z2491
caggacagccccuaaauuuaaa

SEQ ID NO: 3364496 - RNA, 15 nt, Neisseria meningitidis Z2491
caggagcaacagaaa

SEQ ID NO: 3364497 - RNA, 19 nt, Neisseria meningitidis Z2491
caggaucuuauccauccca

SEQ ID NO: 3364498 - RNA, 15 nt, Neisseria meningitidis Z2491
caggaugucugccug

SEQ ID NO: 3364499 - RNA, 15 nt, Neisseria meningitidis Z2491
caggauguuuucggc

SEQ ID NO: 3364500 - RNA, 21 nt, Neisseria meningitidis Z2491
caggcacaaggcggcggcaga

SEQ ID NO: 3364501 - RNA, 15 nt, Neisseria meningitidis Z2491
caggcacgaagcccu

SEQ ID NO: 3364502 - RNA, 15 nt, Neisseria meningitidis Z2491
caggcccaaaacaaa

SEQ ID NO: 3364503 - RNA, 22 nt, Neisseria meningitidis Z2491
caggcccaaaacaaauacccaa

SEQ ID NO: 3364504 - RNA, 16 nt, Neisseria meningitidis Z2491
caggcgcgcaauccgc

SEQ ID NO: 3364505 - RNA, 15 nt, Neisseria meningitidis Z2491
caggcggcggcauau

SEQ ID NO: 3364506 - RNA, 19 nt, Neisseria meningitidis Z2491
caggcggcguucuucuucg

SEQ ID NO: 3364507 - RNA, 14 nt, Neisseria meningitidis Z2491
caggcgggaaucca

SEQ ID NO: 3364508 - RNA, 19 nt, Neisseria meningitidis Z2491
caggcgggaauccaggacg

SEQ ID NO: 3364509 - RNA, 21 nt, Neisseria meningitidis Z2491
caggcgggaauccaguccguu

SEQ ID NO: 3364510 - RNA, 22 nt, Neisseria meningitidis Z2491
caggcgggaaucuagacauuca

SEQ ID NO: 3364511 - RNA, 18 nt, Neisseria meningitidis Z2491
caggcgggaaucuagacc

SEQ ID NO: 3364512 - RNA, 20 nt, Neisseria meningitidis Z2491
caggcgggcguuccacaaau

SEQ ID NO: 3364513 - RNA, 16 nt, Neisseria meningitidis Z2491
caggcguuuccaaagu

SEQ ID NO: 3364514 - RNA, 14 nt, Neisseria meningitidis Z2491
caggcguuuuucag

SEQ ID NO: 3364515 - RNA, 17 nt, Neisseria meningitidis Z2491
caggcguuuuucagacg

SEQ ID NO: 3364516 - RNA, 20 nt, Neisseria meningitidis Z2491
caggcugccgcacaagcccu

SEQ ID NO: 3364517 - RNA, 17 nt, Neisseria meningitidis Z2491
caggcuucagacggcau

SEQ ID NO: 3364518 - RNA, 18 nt, Neisseria meningitidis Z2491
caggcuucagacggcauu

SEQ ID NO: 3364519 - RNA, 15 nt, Neisseria meningitidis Z2491
caggcuuucaccgac

SEQ ID NO: 3364520 - RNA, 23 nt, Neisseria meningitidis Z2491
caggcuuuuuucuguuuggcuuu

SEQ ID NO: 3364521 - RNA, 15 nt, Neisseria meningitidis Z2491
cagggaaagcagcag

SEQ ID NO: 3364522 - RNA, 18 nt, Neisseria meningitidis Z2491
cagggaaagcagcagccc

SEQ ID NO: 3364523 - RNA, 16 nt, Neisseria meningitidis Z2491
cagggacagcggacgc

SEQ ID NO: 3364524 - RNA, 20 nt, Neisseria meningitidis Z2491
cagggacagcggacgcguug

SEQ ID NO: 3364525 - RNA, 21 nt, Neisseria meningitidis Z2491
cagggaccuuuaauuacacgg

SEQ ID NO: 3364526 - RNA, 18 nt, Neisseria meningitidis Z2491
caggggauugccgccccu

SEQ ID NO: 3364527 - RNA, 13 nt, Neisseria meningitidis Z2491
caggguaaugacc

SEQ ID NO: 3364528 - RNA, 12 nt, Neisseria meningitidis Z2491
cagggucauggc

SEQ ID NO: 3364529 - RNA, 15 nt, Neisseria meningitidis Z2491
caggguuaaggcuua

SEQ ID NO: 3364530 - RNA, 16 nt, Neisseria meningitidis Z2491
caucaaaccauaugga

SEQ ID NO: 3364531 - RNA, 20 nt, Neisseria meningitidis Z2491
caucaacauuugcgcagccu

SEQ ID NO: 3364532 - RNA, 19 nt, Neisseria meningitidis Z2491
caucaauuuccacaauuca

SEQ ID NO: 3364533 - RNA, 14 nt, Neisseria meningitidis Z2491
caucagcaccacug

SEQ ID NO: 3364534 - RNA, 20 nt, Neisseria meningitidis Z2491
caucagccaaaccgcagcaa

SEQ ID NO: 3364535 - RNA, 18 nt, Neisseria meningitidis Z2491
caucagcuucauacccca

SEQ ID NO: 3364536 - RNA, 18 nt, Neisseria meningitidis Z2491
caucauagaaaucagcgu

SEQ ID NO: 3364537 - RNA, 15 nt, Neisseria meningitidis Z2491
caucauaugcaucag

SEQ ID NO: 3364538 - RNA, 13 nt, Neisseria meningitidis Z2491
caucaucacaaug

SEQ ID NO: 3364539 - RNA, 13 nt, Neisseria meningitidis Z2491
caucaucacgcug

SEQ ID NO: 3364540 - RNA, 18 nt, Neisseria meningitidis Z2491
caucauccugcuuuaauu

SEQ ID NO: 3364541 - RNA, 22 nt, Neisseria meningitidis Z2491
caucauccugcuuuaauucucc

SEQ ID NO: 3364542 - RNA, 20 nt, Neisseria meningitidis Z2491
caucaucggcguaauaauau

SEQ ID NO: 3364543 - RNA, 13 nt, Neisseria meningitidis Z2491
caucauucccaca

SEQ ID NO: 3364544 - RNA, 15 nt, Neisseria meningitidis Z2491
cauccaccagcccgc

SEQ ID NO: 3364545 - RNA, 22 nt, Neisseria meningitidis Z2491
cauccaccagcccgccgcgccc

SEQ ID NO: 3364546 - RNA, 15 nt, Neisseria meningitidis Z2491
cauccaguucuucua

SEQ ID NO: 3364547 - RNA, 21 nt, Neisseria meningitidis Z2491
cauccaucacgccgguaccca

SEQ ID NO: 3364548 - RNA, 15 nt, Neisseria meningitidis Z2491
caucccccaaccaau

SEQ ID NO: 3364549 - RNA, 14 nt, Neisseria meningitidis Z2491
cauccgacaggcaa

SEQ ID NO: 3364550 - RNA, 19 nt, Neisseria meningitidis Z2491
cauccgcaacgcgcaaacc

SEQ ID NO: 3364551 - RNA, 15 nt, Neisseria meningitidis Z2491
cauccuaaaaauuua

SEQ ID NO: 3364552 - RNA, 23 nt, Neisseria meningitidis Z2491
cauccuaaaaauuuaauaacuua

SEQ ID NO: 3364553 - RNA, 14 nt, Neisseria meningitidis Z2491
cauccugcuuuaau

SEQ ID NO: 3364554 - RNA, 22 nt, Neisseria meningitidis Z2491
cauccuguuauuuucacaaaaa

SEQ ID NO: 3364555 - RNA, 21 nt, Neisseria meningitidis Z2491
cauccuuuccucuuucaucau

SEQ ID NO: 3364556 - RNA, 16 nt, Neisseria meningitidis Z2491
caucgacacccgcccc

SEQ ID NO: 3364557 - RNA, 17 nt, Neisseria meningitidis Z2491
caucgacacccgccccg

SEQ ID NO: 3364558 - RNA, 20 nt, Neisseria meningitidis Z2491
caucgacacccgccccgccg

SEQ ID NO: 3364559 - RNA, 15 nt, Neisseria meningitidis Z2491
caucgagcugccuuu

SEQ ID NO: 3364560 - RNA, 23 nt, Neisseria meningitidis Z2491
caucgagcugccuuuuaccuuga

SEQ ID NO: 3364561 - RNA, 21 nt, Neisseria meningitidis Z2491
caucgcaacuccaaagagaaa

SEQ ID NO: 3364562 - RNA, 22 nt, Neisseria meningitidis Z2491
caucgcaucagguuaucacuug

SEQ ID NO: 3364563 - RNA, 20 nt, Neisseria meningitidis Z2491
caucgcgguccaaaacggcg

SEQ ID NO: 3364564 - RNA, 14 nt, Neisseria meningitidis Z2491
caucgcuuucaggu

SEQ ID NO: 3364565 - RNA, 20 nt, Neisseria meningitidis Z2491
caucgcuuucagguggcuuu

SEQ ID NO: 3364566 - RNA, 23 nt, Neisseria meningitidis Z2491
caucggcaaucagucaugaccga

SEQ ID NO: 3364567 - RNA, 15 nt, Neisseria meningitidis Z2491
caucgguuucuucuu

SEQ ID NO: 3364568 - RNA, 16 nt, Neisseria meningitidis Z2491
caucgguuucuucuuc

SEQ ID NO: 3364569 - RNA, 17 nt, Neisseria meningitidis Z2491
caucgguuucuucuucg

SEQ ID NO: 3364570 - RNA, 23 nt, Neisseria meningitidis Z2491
caucguaaaaaugccgucugaaa

SEQ ID NO: 3364571 - RNA, 12 nt, Neisseria meningitidis Z2491
caucguaaggcu

SEQ ID NO: 3364572 - RNA, 22 nt, Neisseria meningitidis Z2491
caucguaugaaacaauccgccc

SEQ ID NO: 3364573 - RNA, 17 nt, Neisseria meningitidis Z2491
caucguccacuucaacc

SEQ ID NO: 3364574 - RNA, 17 nt, Neisseria meningitidis Z2491
caucguuacaaauuuaa

SEQ ID NO: 3364575 - RNA, 23 nt, Neisseria meningitidis Z2491
caucguuuuauuacgcaauggca

SEQ ID NO: 3364576 - RNA, 13 nt, Neisseria meningitidis Z2491
caucuaaauguuu

SEQ ID NO: 3364577 - RNA, 22 nt, Neisseria meningitidis Z2491
caucucuggcaaugucuucaua

SEQ ID NO: 3364578 - RNA, 19 nt, Neisseria meningitidis Z2491
caucucuucuauaaagccu

SEQ ID NO: 3364579 - RNA, 16 nt, Neisseria meningitidis Z2491
caucugauacaccggu

SEQ ID NO: 3364580 - RNA, 12 nt, Neisseria meningitidis Z2491
caucugauuuuu

SEQ ID NO: 3364581 - RNA, 18 nt, Neisseria meningitidis Z2491
caucuuguuuuucaauca

SEQ ID NO: 3364582 - RNA, 22 nt, Neisseria meningitidis Z2491
caugcagcauauguuugcugcu

SEQ ID NO: 3364583 - RNA, 21 nt, Neisseria meningitidis Z2491
caugcccaaaagcagcccgaa

SEQ ID NO: 3364584 - RNA, 12 nt, Neisseria meningitidis Z2491
caugcggcgggc

SEQ ID NO: 3364585 - RNA, 20 nt, Neisseria meningitidis Z2491
caugcggcgggcuuggaaau

SEQ ID NO: 3364586 - RNA, 15 nt, Neisseria meningitidis Z2491
cauggcguucaacac

SEQ ID NO: 3364587 - RNA, 20 nt, Neisseria meningitidis Z2491
cauguaguagcgcgccaccg

SEQ ID NO: 3364588 - RNA, 21 nt, Neisseria meningitidis Z2491
caugucgccgguacacagggu

SEQ ID NO: 3364589 - RNA, 23 nt, Neisseria meningitidis Z2491
caugucgcgggcggugcgcggca

SEQ ID NO: 3364590 - RNA, 16 nt, Neisseria meningitidis Z2491
cauguucgugcaucau

SEQ ID NO: 3364591 - RNA, 17 nt, Neisseria meningitidis Z2491
cauuaaaauucuagauu

SEQ ID NO: 3364592 - RNA, 22 nt, Neisseria meningitidis Z2491
cauuaaaggggugcguuuuauu

SEQ ID NO: 3364593 - RNA, 17 nt, Neisseria meningitidis Z2491
cauuaaauuuccagauu

SEQ ID NO: 3364594 - RNA, 23 nt, Neisseria meningitidis Z2491
cauuauuugggauauuuucuucc

SEQ ID NO: 3364595 - RNA, 18 nt, Neisseria meningitidis Z2491
cauuauuuucacaaaaac

SEQ ID NO: 3364596 - RNA, 14 nt, Neisseria meningitidis Z2491
cauucaaugcuaag

SEQ ID NO: 3364597 - RNA, 17 nt, Neisseria meningitidis Z2491
cauucaaugcuaaggca

SEQ ID NO: 3364598 - RNA, 14 nt, Neisseria meningitidis Z2491
cauucagacggcau

SEQ ID NO: 3364599 - RNA, 20 nt, Neisseria meningitidis Z2491
cauucagacggcauccgcuu

SEQ ID NO: 3364600 - RNA, 18 nt, Neisseria meningitidis Z2491
cauucccacgaaaguggg

SEQ ID NO: 3364601 - RNA, 21 nt, Neisseria meningitidis Z2491
cauucccacgaaagugggaau

SEQ ID NO: 3364602 - RNA, 18 nt, Neisseria meningitidis Z2491
cauucccacggaaguggg

SEQ ID NO: 3364603 - RNA, 22 nt, Neisseria meningitidis Z2491
cauucccacggaagugggaauc

SEQ ID NO: 3364604 - RNA, 16 nt, Neisseria meningitidis Z2491
cauucccgcaaaaaca

SEQ ID NO: 3364605 - RNA, 17 nt, Neisseria meningitidis Z2491
cauucccgcaaaaacaa

SEQ ID NO: 3364606 - RNA, 20 nt, Neisseria meningitidis Z2491
cauucccgcaaaaacaaaaa

SEQ ID NO: 3364607 - RNA, 15 nt, Neisseria meningitidis Z2491
cauucccgcgcagau

SEQ ID NO: 3364608 - RNA, 17 nt, Neisseria meningitidis Z2491
cauucccucaaaaacag

SEQ ID NO: 3364609 - RNA, 21 nt, Neisseria meningitidis Z2491
cauucccucaaaaacagaaaa

SEQ ID NO: 3364610 - RNA, 14 nt, Neisseria meningitidis Z2491
cauucccucucccg

SEQ ID NO: 3364611 - RNA, 16 nt, Neisseria meningitidis Z2491
cauuccgucauuccca

SEQ ID NO: 3364612 - RNA, 23 nt, Neisseria meningitidis Z2491
cauuccguuaucccauaaaaacg

SEQ ID NO: 3364613 - RNA, 15 nt, Neisseria meningitidis Z2491
cauuccuacgaaccu

SEQ ID NO: 3364614 - RNA, 15 nt, Neisseria meningitidis Z2491
cauuccuguaaaaac

SEQ ID NO: 3364615 - RNA, 16 nt, Neisseria meningitidis Z2491
cauuccuguaaaaaca

SEQ ID NO: 3364616 - RNA, 20 nt, Neisseria meningitidis Z2491
cauuccuguaaaaacaaaaa

SEQ ID NO: 3364617 - RNA, 21 nt, Neisseria meningitidis Z2491
cauucggcuuaaaccuuaucc

SEQ ID NO: 3364618 - RNA, 20 nt, Neisseria meningitidis Z2491
cauucggggcagauguauug

SEQ ID NO: 3364619 - RNA, 22 nt, Neisseria meningitidis Z2491
cauucgugggcgcauucggggc

SEQ ID NO: 3364620 - RNA, 17 nt, Neisseria meningitidis Z2491
cauucucacaaaaacag

SEQ ID NO: 3364621 - RNA, 14 nt, Neisseria meningitidis Z2491
cauucuugauggcg

SEQ ID NO: 3364622 - RNA, 15 nt, Neisseria meningitidis Z2491
cauucuugcaaaaua

SEQ ID NO: 3364623 - RNA, 14 nt, Neisseria meningitidis Z2491
cauugaaauuccag

SEQ ID NO: 3364624 - RNA, 16 nt, Neisseria meningitidis Z2491
cauugaaauuccagau

SEQ ID NO: 3364625 - RNA, 17 nt, Neisseria meningitidis Z2491
cauugaaauucuagauu

SEQ ID NO: 3364626 - RNA, 19 nt, Neisseria meningitidis Z2491
cauugacauauccggcucc

SEQ ID NO: 3364627 - RNA, 12 nt, Neisseria meningitidis Z2491
cauugccaccgc

SEQ ID NO: 3364628 - RNA, 21 nt, Neisseria meningitidis Z2491
cauugccgcccguuuaaacac

SEQ ID NO: 3364629 - RNA, 16 nt, Neisseria meningitidis Z2491
cauugcgggaauagcu

SEQ ID NO: 3364630 - RNA, 21 nt, Neisseria meningitidis Z2491
cauuggacagcggcaauauuc

SEQ ID NO: 3364631 - RNA, 19 nt, Neisseria meningitidis Z2491
ccacuuuuugcgccagcgg

SEQ ID NO: 3364632 - RNA, 22 nt, Neisseria meningitidis Z2491
ccagaaucucuaaagcuucagc

SEQ ID NO: 3364633 - RNA, 19 nt, Neisseria meningitidis Z2491
ccagacaggcuuuuuucug

SEQ ID NO: 3364634 - RNA, 15 nt, Neisseria meningitidis Z2491
ccagacauucaaugc

SEQ ID NO: 3364635 - RNA, 22 nt, Neisseria meningitidis Z2491
ccagaccauuggacagcggcaa

SEQ ID NO: 3364636 - RNA, 22 nt, Neisseria meningitidis Z2491
ccagaccuucgggcagcggcaa

SEQ ID NO: 3364637 - RNA, 21 nt, Neisseria meningitidis Z2491
ccagaccuuugggcggcggca

SEQ ID NO: 3364638 - RNA, 18 nt, Neisseria meningitidis Z2491
ccagacggagauuuuguu

SEQ ID NO: 3364639 - RNA, 23 nt, Neisseria meningitidis Z2491
ccagaggcggaaucgaaccgccg

SEQ ID NO: 3364640 - RNA, 11 nt, Neisseria meningitidis Z2491
ccagauucccg

SEQ ID NO: 3364641 - RNA, 13 nt, Neisseria meningitidis Z2491
ccagauucccgcu

SEQ ID NO: 3364642 - RNA, 20 nt, Neisseria meningitidis Z2491
ccagcaaucagggccuugac

SEQ ID NO: 3364643 - RNA, 14 nt, Neisseria meningitidis Z2491
ccagcacaaacagc

SEQ ID NO: 3364644 - RNA, 15 nt, Neisseria meningitidis Z2491
ccagcacaaacagca

SEQ ID NO: 3364645 - RNA, 17 nt, Neisseria meningitidis Z2491
ccagcagguugauggcg

SEQ ID NO: 3364646 - RNA, 19 nt, Neisseria meningitidis Z2491
ccagcagugccgcaccacc

SEQ ID NO: 3364647 - RNA, 22 nt, Neisseria meningitidis Z2491
ccagccacaacacgcaaaacac

SEQ ID NO: 3364648 - RNA, 17 nt, Neisseria meningitidis Z2491
ccagcccgccgcgcccg

SEQ ID NO: 3364649 - RNA, 20 nt, Neisseria meningitidis Z2491
ccagccgaaaauacugagga

SEQ ID NO: 3364650 - RNA, 20 nt, Neisseria meningitidis Z2491
ccagcgcgaugucgcugccc

SEQ ID NO: 3364651 - RNA, 18 nt, Neisseria meningitidis Z2491
ccagcucccaaucccgau

SEQ ID NO: 3364652 - RNA, 17 nt, Neisseria meningitidis Z2491
ccagcuccggccaaaaa

SEQ ID NO: 3364653 - RNA, 14 nt, Neisseria meningitidis Z2491
ccagcuuccgcagg

SEQ ID NO: 3364654 - RNA, 16 nt, Neisseria meningitidis Z2491
ccagcuuuaaggcuuc

SEQ ID NO: 3364655 - RNA, 19 nt, Neisseria meningitidis Z2491
ccaguaacgccaccaaggc

SEQ ID NO: 3364656 - RNA, 17 nt, Neisseria meningitidis Z2491
ccaguacgguguugccu

SEQ ID NO: 3364657 - RNA, 16 nt, Neisseria meningitidis Z2491
ccaguccguucaguuu

SEQ ID NO: 3364658 - RNA, 15 nt, Neisseria meningitidis Z2491
ccagugcaucgacca

SEQ ID NO: 3364659 - RNA, 17 nt, Neisseria meningitidis Z2491
ccagugcgccggcauaa

SEQ ID NO: 3364660 - RNA, 20 nt, Neisseria meningitidis Z2491
ccaguucggcaaacggcagg

SEQ ID NO: 3364661 - RNA, 22 nt, Neisseria meningitidis Z2491
ccaguuuguucaggaaggacug

SEQ ID NO: 3364662 - RNA, 11 nt, Neisseria meningitidis Z2491
ccauaaaaacg

SEQ ID NO: 3364663 - RNA, 22 nt, Neisseria meningitidis Z2491
ccauaaauuuuaaauaaaucaa

SEQ ID NO: 3364664 - RNA, 23 nt, Neisseria meningitidis Z2491
ccauaaggcuuuaagcaaucauc

SEQ ID NO: 3364665 - RNA, 17 nt, Neisseria meningitidis Z2491
ccauaaucaaaaccagc

SEQ ID NO: 3364666 - RNA, 19 nt, Neisseria meningitidis Z2491
ccauaauccaagauuucau

SEQ ID NO: 3364667 - RNA, 15 nt, Neisseria meningitidis Z2491
ccauaaucugcggca

SEQ ID NO: 3364668 - RNA, 19 nt, Neisseria meningitidis Z2491
ccauacggaaaccugcauc

SEQ ID NO: 3364669 - RNA, 23 nt, Neisseria meningitidis Z2491
ccauacuacgcggcugaaaaaau

SEQ ID NO: 3364670 - RNA, 13 nt, Neisseria meningitidis Z2491
ccauagaaaggga

SEQ ID NO: 3364671 - RNA, 18 nt, Neisseria meningitidis Z2491
ccauagauaaauuucaga

SEQ ID NO: 3364672 - RNA, 12 nt, Neisseria meningitidis Z2491
ccauauuuuuua

SEQ ID NO: 3364673 - RNA, 13 nt, Neisseria meningitidis Z2491
ccaucaacaaaau

SEQ ID NO: 3364674 - RNA, 14 nt, Neisseria meningitidis Z2491
ccaucaauuuccac

SEQ ID NO: 3364675 - RNA, 18 nt, Neisseria meningitidis Z2491
ccauccauacggaaaccu

SEQ ID NO: 3364676 - RNA, 23 nt, Neisseria meningitidis Z2491
ccauccauacggaaaccugcauc

SEQ ID NO: 3364677 - RNA, 15 nt, Neisseria meningitidis Z2491
ccauccucaucaacg

SEQ ID NO: 3364678 - RNA, 20 nt, Neisseria meningitidis Z2491
ccaucgcaaucauggcgcgu

SEQ ID NO: 3364679 - RNA, 22 nt, Neisseria meningitidis Z2491
ccaucgcgauugaaacaucauu

SEQ ID NO: 3364680 - RNA, 15 nt, Neisseria meningitidis Z2491
ccaucgucauucccg

SEQ ID NO: 3364681 - RNA, 18 nt, Neisseria meningitidis Z2491
ccaucuacaaaauaaucu

SEQ ID NO: 3364682 - RNA, 15 nt, Neisseria meningitidis Z2491
ccaucuucuucaaca

SEQ ID NO: 3364683 - RNA, 13 nt, Neisseria meningitidis Z2491
ccauggaaaccaa

SEQ ID NO: 3364684 - RNA, 22 nt, Neisseria meningitidis Z2491
ccauuacugcugcggcucugaa

SEQ ID NO: 3364685 - RNA, 18 nt, Neisseria meningitidis Z2491
ccauugacaacgcagccc

SEQ ID NO: 3364686 - RNA, 13 nt, Neisseria meningitidis Z2491
ccauugccgcgcu

SEQ ID NO: 3364687 - RNA, 17 nt, Neisseria meningitidis Z2491
ccauuggacagcggcaa

SEQ ID NO: 3364688 - RNA, 22 nt, Neisseria meningitidis Z2491
ccauuggacagcggcaauauuc

SEQ ID NO: 3364689 - RNA, 20 nt, Neisseria meningitidis Z2491
ccauuguguuuuccuugugu

SEQ ID NO: 3364690 - RNA, 17 nt, Neisseria meningitidis Z2491
ccauuguuuccgcuucc

SEQ ID NO: 3364691 - RNA, 11 nt, Neisseria meningitidis Z2491
ccauuguuucu

SEQ ID NO: 3364692 - RNA, 13 nt, Neisseria meningitidis Z2491
ccauuuaaaaucu

SEQ ID NO: 3364693 - RNA, 18 nt, Neisseria meningitidis Z2491
ccauuucuuccugacgga

SEQ ID NO: 3364694 - RNA, 22 nt, Neisseria meningitidis Z2491
cccaaaaagccgccuuuuucca

SEQ ID NO: 3364695 - RNA, 24 nt, Neisseria meningitidis Z2491
cccaaaggcaauaacuauagugga

SEQ ID NO: 3364696 - RNA, 18 nt, Neisseria meningitidis Z2491
cccaaaucuugcaaaccc

SEQ ID NO: 3364697 - RNA, 16 nt, Neisseria meningitidis Z2491
cccaaccgugcggcac

SEQ ID NO: 3364698 - RNA, 18 nt, Neisseria meningitidis Z2491
cccaagccgaauugcagc

SEQ ID NO: 3364699 - RNA, 22 nt, Neisseria meningitidis Z2491
cccaagcggucuucuuuggcuu

SEQ ID NO: 3364700 - RNA, 17 nt, Neisseria meningitidis Z2491
cccaauccugcacgcgc

SEQ ID NO: 3364701 - RNA, 14 nt, Neisseria meningitidis Z2491
cccaaugccgucug

SEQ ID NO: 3364702 - RNA, 20 nt, Neisseria meningitidis Z2491
cccaaugcggcggacgcggc

SEQ ID NO: 3364703 - RNA, 17 nt, Neisseria meningitidis Z2491
cccaaugcuucaaccac

SEQ ID NO: 3364704 - RNA, 17 nt, Neisseria meningitidis Z2491
cccaccguuucccauca

SEQ ID NO: 3364705 - RNA, 20 nt, Neisseria meningitidis Z2491
cccaccguuucccauccuuc

SEQ ID NO: 3364706 - RNA, 13 nt, Neisseria meningitidis Z2491
cccacgaaagugg

SEQ ID NO: 3364707 - RNA, 16 nt, Neisseria meningitidis Z2491
cccacgaaagugggaa

SEQ ID NO: 3364708 - RNA, 16 nt, Neisseria meningitidis Z2491
cccacgaacccacauc

SEQ ID NO: 3364709 - RNA, 16 nt, Neisseria meningitidis Z2491
cccacggaagugggaa

SEQ ID NO: 3364710 - RNA, 23 nt, Neisseria meningitidis Z2491
cccacugagaccuuugcaauaac

SEQ ID NO: 3364711 - RNA, 17 nt, Neisseria meningitidis Z2491
cccacugccagccgccg

SEQ ID NO: 3364712 - RNA, 18 nt, Neisseria meningitidis Z2491
cccacuuccgugggaaug

SEQ ID NO: 3364713 - RNA, 20 nt, Neisseria meningitidis Z2491
cccacuuccgugggaaugac

SEQ ID NO: 3364714 - RNA, 16 nt, Neisseria meningitidis Z2491
cccacuuucgugggaa

SEQ ID NO: 3364715 - RNA, 20 nt, Neisseria meningitidis Z2491
cccacuuucgugggaaugac

SEQ ID NO: 3364716 - RNA, 22 nt, Neisseria meningitidis Z2491
cccaggauuuucaaaucuuccu

SEQ ID NO: 3364717 - RNA, 23 nt, Neisseria meningitidis Z2491
cccaggauuuucaaaucuuccug

SEQ ID NO: 3364718 - RNA, 16 nt, Neisseria meningitidis Z2491
cccagugcgaugacga

SEQ ID NO: 3364719 - RNA, 23 nt, Neisseria meningitidis Z2491
cccauaguuuguaaaaucucuug

SEQ ID NO: 3364720 - RNA, 13 nt, Neisseria meningitidis Z2491
cccauaugccguc

SEQ ID NO: 3364721 - RNA, 17 nt, Neisseria meningitidis Z2491
cccauccgcccaagucg

SEQ ID NO: 3364722 - RNA, 20 nt, Neisseria meningitidis Z2491
cccaugcguucgagcaggaa

SEQ ID NO: 3364723 - RNA, 20 nt, Neisseria meningitidis Z2491
cccauuauuuucacaaaaac

SEQ ID NO: 3364724 - RNA, 11 nt, Neisseria meningitidis Z2491
cccauucccac

SEQ ID NO: 3364725 - RNA, 20 nt, Neisseria meningitidis Z2491
cccauugccacgccgaaccc

SEQ ID NO: 3364726 - RNA, 12 nt, Neisseria meningitidis Z2491
cccauugccgcg

SEQ ID NO: 3364727 - RNA, 20 nt, Neisseria meningitidis Z2491
cccccuuaauccuccacgga

SEQ ID NO: 3364728 - RNA, 20 nt, Neisseria meningitidis Z2491
cccccuuaauccucuccgga

SEQ ID NO: 3364729 - RNA, 17 nt, Neisseria meningitidis Z2491
ccccguaccgggcaggc

SEQ ID NO: 3364730 - RNA, 16 nt, Neisseria meningitidis Z2491
ccccgucauucccgcc

SEQ ID NO: 3364731 - RNA, 18 nt, Neisseria meningitidis Z2491
ccccguuaacggcgcaac

SEQ ID NO: 3364732 - RNA, 16 nt, Neisseria meningitidis Z2491
ccgcaaacggcagcag

SEQ ID NO: 3364733 - RNA, 20 nt, Neisseria meningitidis Z2491
ccgcaaagccgccgccgaca

SEQ ID NO: 3364734 - RNA, 13 nt, Neisseria meningitidis Z2491
ccgcaaccgccga

SEQ ID NO: 3364735 - RNA, 22 nt, Neisseria meningitidis Z2491
ccgcaaccugaaaggcacaacg

SEQ ID NO: 3364736 - RNA, 22 nt, Neisseria meningitidis Z2491
ccgcacauuccaucaacaaaau

SEQ ID NO: 3364737 - RNA, 16 nt, Neisseria meningitidis Z2491
ccgcaccgacagaccu

SEQ ID NO: 3364738 - RNA, 11 nt, Neisseria meningitidis Z2491
ccgcagacagu

SEQ ID NO: 3364739 - RNA, 19 nt, Neisseria meningitidis Z2491
ccgcagacaguacaaauag

SEQ ID NO: 3364740 - RNA, 15 nt, Neisseria meningitidis Z2491
ccgcagacaguacag

SEQ ID NO: 3364741 - RNA, 16 nt, Neisseria meningitidis Z2491
ccgcagccggggcagg

SEQ ID NO: 3364742 - RNA, 17 nt, Neisseria meningitidis Z2491
ccgcagccggggcaggc

SEQ ID NO: 3364743 - RNA, 20 nt, Neisseria meningitidis Z2491
ccgcagccggggcaggcggu

SEQ ID NO: 3364744 - RNA, 17 nt, Neisseria meningitidis Z2491
ccgccaaaaacggcacg

SEQ ID NO: 3364745 - RNA, 12 nt, Neisseria meningitidis Z2491
ccgccaaacccu

SEQ ID NO: 3364746 - RNA, 13 nt, Neisseria meningitidis Z2491
ccgccaacaccgc

SEQ ID NO: 3364747 - RNA, 15 nt, Neisseria meningitidis Z2491
ccgccacacccccgu

SEQ ID NO: 3364748 - RNA, 17 nt, Neisseria meningitidis Z2491
ccgccacguuugccaag

SEQ ID NO: 3364749 - RNA, 20 nt, Neisseria meningitidis Z2491
ccgccgacaucgaaaugccg

SEQ ID NO: 3364750 - RNA, 18 nt, Neisseria meningitidis Z2491
ccgccgcacaaaccgcgc

SEQ ID NO: 3364751 - RNA, 19 nt, Neisseria meningitidis Z2491
ccgccgccaugucgcgggc

SEQ ID NO: 3364752 - RNA, 14 nt, Neisseria meningitidis Z2491
ccgccgcgcccgca

SEQ ID NO: 3364753 - RNA, 14 nt, Neisseria meningitidis Z2491
ccgccguauccuca

SEQ ID NO: 3364754 - RNA, 22 nt, Neisseria meningitidis Z2491
ccgccuaucacuuccagcgcac

SEQ ID NO: 3364755 - RNA, 20 nt, Neisseria meningitidis Z2491
ccgccuccgaagccucgccc

SEQ ID NO: 3364756 - RNA, 23 nt, Neisseria meningitidis Z2491
ccgccugaacauuucagacggca

SEQ ID NO: 3364757 - RNA, 14 nt, Neisseria meningitidis Z2491
ccgccugcaaaggc

SEQ ID NO: 3364758 - RNA, 16 nt, Neisseria meningitidis Z2491
ccgccugucgggcuuc

SEQ ID NO: 3364759 - RNA, 16 nt, Neisseria meningitidis Z2491
ccgcgaaaaauagaaa

SEQ ID NO: 3364760 - RNA, 15 nt, Neisseria meningitidis Z2491
ccgcgagaacagaaa

SEQ ID NO: 3364761 - RNA, 16 nt, Neisseria meningitidis Z2491
ccgcgauaaggcgcgu

SEQ ID NO: 3364762 - RNA, 23 nt, Neisseria meningitidis Z2491
ccgcgauaaggcgcguccaacac

SEQ ID NO: 3364763 - RNA, 12 nt, Neisseria meningitidis Z2491
ccgcgcaggcgg

SEQ ID NO: 3364764 - RNA, 19 nt, Neisseria meningitidis Z2491
ccgcgccgauguuuuccug

SEQ ID NO: 3364765 - RNA, 23 nt, Neisseria meningitidis Z2491
ccgcgcugacuuuggaagccucc

SEQ ID NO: 3364766 - RNA, 21 nt, Neisseria meningitidis Z2491
ccgcguaucgcguaaggcaua

SEQ ID NO: 3364767 - RNA, 17 nt, Neisseria meningitidis Z2491
ccgcguguccgcgcguu

SEQ ID NO: 3364768 - RNA, 15 nt, Neisseria meningitidis Z2491
ccgcguucuuggcuu

SEQ ID NO: 3364769 - RNA, 14 nt, Neisseria meningitidis Z2491
ccgcuauauauucu

SEQ ID NO: 3364770 - RNA, 21 nt, Neisseria meningitidis Z2491
ccgcucgcguauccagccgcc

SEQ ID NO: 3364771 - RNA, 10 nt, Neisseria meningitidis Z2491
ccgcugaaaa

SEQ ID NO: 3364772 - RNA, 17 nt, Neisseria meningitidis Z2491
ccgcugacgaaaccaga

SEQ ID NO: 3364773 - RNA, 23 nt, Neisseria meningitidis Z2491
ccgcugcgggccaucacccugcc

SEQ ID NO: 3364774 - RNA, 14 nt, Neisseria meningitidis Z2491
ccgcugcugggggc

SEQ ID NO: 3364775 - RNA, 14 nt, Neisseria meningitidis Z2491
ccgcugguaucuuu

SEQ ID NO: 3364776 - RNA, 21 nt, Neisseria meningitidis Z2491
ccgcuguacgaauccgccggc

SEQ ID NO: 3364777 - RNA, 17 nt, Neisseria meningitidis Z2491
ccgcuguauuugcgccg

SEQ ID NO: 3364778 - RNA, 20 nt, Neisseria meningitidis Z2491
ccgcuguauuugcgccgccc

SEQ ID NO: 3364779 - RNA, 17 nt, Neisseria meningitidis Z2491
ccgcuucaaggcgguuu

SEQ ID NO: 3364780 - RNA, 14 nt, Neisseria meningitidis Z2491
ccgcuucggaaacg

SEQ ID NO: 3364781 - RNA, 19 nt, Neisseria meningitidis Z2491
ccgcuuuacgcgcgccguc

SEQ ID NO: 3364782 - RNA, 20 nt, Neisseria meningitidis Z2491
ccgcuuuacgcgcgccgucc

SEQ ID NO: 3364783 - RNA, 21 nt, Neisseria meningitidis Z2491
ccgcuuuguccaaaucggcaa

SEQ ID NO: 3364784 - RNA, 13 nt, Neisseria meningitidis Z2491
ccggaaagcuggu

SEQ ID NO: 3364785 - RNA, 20 nt, Neisseria meningitidis Z2491
ccggagagcucggucagaua

SEQ ID NO: 3364786 - RNA, 19 nt, Neisseria meningitidis Z2491
ccggagcagaaucaaauau

SEQ ID NO: 3364787 - RNA, 17 nt, Neisseria meningitidis Z2491
ccggagucucagggcug

SEQ ID NO: 3364788 - RNA, 13 nt, Neisseria meningitidis Z2491
ccggaugcaugau

SEQ ID NO: 3364789 - RNA, 14 nt, Neisseria meningitidis Z2491
ccggaugcaugauu

SEQ ID NO: 3364790 - RNA, 18 nt, Neisseria meningitidis Z2491
ccggauugcggccgucgg

SEQ ID NO: 3364791 - RNA, 13 nt, Neisseria meningitidis Z2491
ccggcaagccuuu

SEQ ID NO: 3364792 - RNA, 19 nt, Neisseria meningitidis Z2491
ccggcauaacccaaaccgu

SEQ ID NO: 3364793 - RNA, 15 nt, Neisseria meningitidis Z2491
ccggcaugauuuucu

SEQ ID NO: 3364794 - RNA, 21 nt, Neisseria meningitidis Z2491
ccggcaugauuuucuuuuuga

SEQ ID NO: 3364795 - RNA, 17 nt, Neisseria meningitidis Z2491
ccggcauucugcacgcc

SEQ ID NO: 3364796 - RNA, 14 nt, Neisseria meningitidis Z2491
ccggccaacaucag

SEQ ID NO: 3364797 - RNA, 23 nt, Neisseria meningitidis Z2491
ccggcgcagcuccucccuccccc

SEQ ID NO: 3364798 - RNA, 15 nt, Neisseria meningitidis Z2491
ccggcgcggcaaaag

SEQ ID NO: 3364799 - RNA, 12 nt, Neisseria meningitidis Z2491
ccggcgcggcgc

SEQ ID NO: 3364800 - RNA, 16 nt, Neisseria meningitidis Z2491
ccggcgcguucggcgc

SEQ ID NO: 3364801 - RNA, 21 nt, Neisseria meningitidis Z2491
ccggcgguuaccagcgguagc

SEQ ID NO: 3364802 - RNA, 21 nt, Neisseria meningitidis Z2491
ccggcuguguuuaucuuuucu

SEQ ID NO: 3364803 - RNA, 17 nt, Neisseria meningitidis Z2491
ccggcuucagacggcau

SEQ ID NO: 3364804 - RNA, 18 nt, Neisseria meningitidis Z2491
ccggcuucagacggcaua

SEQ ID NO: 3364805 - RNA, 12 nt, Neisseria meningitidis Z2491
ccggcuuuccau

SEQ ID NO: 3364806 - RNA, 14 nt, Neisseria meningitidis Z2491
ccgggcaagacgaa

SEQ ID NO: 3364807 - RNA, 16 nt, Neisseria meningitidis Z2491
ccgggguuuaucagaa

SEQ ID NO: 3364808 - RNA, 14 nt, Neisseria meningitidis Z2491
ccgguaaauaccca

SEQ ID NO: 3364809 - RNA, 23 nt, Neisseria meningitidis Z2491
ccgguagugauggcaagcuuuuu

SEQ ID NO: 3364810 - RNA, 21 nt, Neisseria meningitidis Z2491
ccggugcgaccguaugcaaaa

SEQ ID NO: 3364811 - RNA, 18 nt, Neisseria meningitidis Z2491
ccgguuuaauccgccgcg

SEQ ID NO: 3364812 - RNA, 13 nt, Neisseria meningitidis Z2491
ccgguuuguauuu

SEQ ID NO: 3364813 - RNA, 14 nt, Neisseria meningitidis Z2491
ccguaccgggcagg

SEQ ID NO: 3364814 - RNA, 15 nt, Neisseria meningitidis Z2491
ccguaccgggcaggc

SEQ ID NO: 3364815 - RNA, 18 nt, Neisseria meningitidis Z2491
ccguaccgggcaggcuga

SEQ ID NO: 3364816 - RNA, 15 nt, Neisseria meningitidis Z2491
ccguauccgccagua

SEQ ID NO: 3364817 - RNA, 12 nt, Neisseria meningitidis Z2491
ccguaugcaaaa

SEQ ID NO: 3364818 - RNA, 19 nt, Neisseria meningitidis Z2491
ccguaugcaaaaacaaccc

SEQ ID NO: 3364819 - RNA, 18 nt, Neisseria meningitidis Z2491
ccguaugccgccugccug

SEQ ID NO: 3364820 - RNA, 12 nt, Neisseria meningitidis Z2491
ccguauuuuuua

SEQ ID NO: 3364821 - RNA, 23 nt, Neisseria meningitidis Z2491
ccgucagcacguguuccaaacgc

SEQ ID NO: 3364822 - RNA, 13 nt, Neisseria meningitidis Z2491
ccgucauucccac

SEQ ID NO: 3364823 - RNA, 21 nt, Neisseria meningitidis Z2491
ccgucauucccgugcaggcgg

SEQ ID NO: 3364824 - RNA, 19 nt, Neisseria meningitidis Z2491
ccgucccagccaguccgga

SEQ ID NO: 3364825 - RNA, 13 nt, Neisseria meningitidis Z2491
ccguccguaagcc

SEQ ID NO: 3364826 - RNA, 16 nt, Neisseria meningitidis Z2491
ccgucgccauaaucag

SEQ ID NO: 3364827 - RNA, 23 nt, Neisseria meningitidis Z2491
ccgucggcacgaaccgcauugcc

SEQ ID NO: 3364828 - RNA, 19 nt, Neisseria meningitidis Z2491
ccgucggcagugauuuccc

SEQ ID NO: 3364829 - RNA, 19 nt, Neisseria meningitidis Z2491
ccgucgguuuucaacaccc

SEQ ID NO: 3364830 - RNA, 23 nt, Neisseria meningitidis Z2491
ccgucugaaaaaccuuucccguu

SEQ ID NO: 3364831 - RNA, 23 nt, Neisseria meningitidis Z2491
ccgucugaaaacagcaaaaaggu

SEQ ID NO: 3364832 - RNA, 23 nt, Neisseria meningitidis Z2491
ccgucugaaacccgauuccuguu

SEQ ID NO: 3364833 - RNA, 21 nt, Neisseria meningitidis Z2491
ccugauugaccgaaaaauaau

SEQ ID NO: 3364834 - RNA, 14 nt, Neisseria meningitidis Z2491
ccugauuucgcuuu

SEQ ID NO: 3364835 - RNA, 19 nt, Neisseria meningitidis Z2491
ccugauuuuuguuaauuca

SEQ ID NO: 3364836 - RNA, 15 nt, Neisseria meningitidis Z2491
ccugcagcagagcug

SEQ ID NO: 3364837 - RNA, 19 nt, Neisseria meningitidis Z2491
ccugcaggcguaugccuuu

SEQ ID NO: 3364838 - RNA, 20 nt, Neisseria meningitidis Z2491
ccugcaggcguaugccuuug

SEQ ID NO: 3364839 - RNA, 16 nt, Neisseria meningitidis Z2491
ccugcccaaauccagc

SEQ ID NO: 3364840 - RNA, 17 nt, Neisseria meningitidis Z2491
ccugcccaaauccagca

SEQ ID NO: 3364841 - RNA, 16 nt, Neisseria meningitidis Z2491
ccugcccgacagccgc

SEQ ID NO: 3364842 - RNA, 16 nt, Neisseria meningitidis Z2491
ccugcccugccaaaac

SEQ ID NO: 3364843 - RNA, 15 nt, Neisseria meningitidis Z2491
ccugccgaccccgau

SEQ ID NO: 3364844 - RNA, 16 nt, Neisseria meningitidis Z2491
ccugccgucauucccg

SEQ ID NO: 3364845 - RNA, 20 nt, Neisseria meningitidis Z2491
ccugccugcgcgggaaugac

SEQ ID NO: 3364846 - RNA, 19 nt, Neisseria meningitidis Z2491
ccugcgcgggaaugacgau

SEQ ID NO: 3364847 - RNA, 21 nt, Neisseria meningitidis Z2491
ccugcgcgggaaugacggcag

SEQ ID NO: 3364848 - RNA, 16 nt, Neisseria meningitidis Z2491
ccugcggcauuucguc

SEQ ID NO: 3364849 - RNA, 17 nt, Neisseria meningitidis Z2491
ccugcucggccugcccu

SEQ ID NO: 3364850 - RNA, 22 nt, Neisseria meningitidis Z2491
ccugguugaugucgugcaauac

SEQ ID NO: 3364851 - RNA, 16 nt, Neisseria meningitidis Z2491
ccuguaaaaacaaaaa

SEQ ID NO: 3364852 - RNA, 13 nt, Neisseria meningitidis Z2491
ccuguaaaaccaa

SEQ ID NO: 3364853 - RNA, 12 nt, Neisseria meningitidis Z2491
ccuguaaacaga

SEQ ID NO: 3364854 - RNA, 19 nt, Neisseria meningitidis Z2491
ccugucgccgucauucccg

SEQ ID NO: 3364855 - RNA, 21 nt, Neisseria meningitidis Z2491
ccugugagaacaagccuguuu

SEQ ID NO: 3364856 - RNA, 23 nt, Neisseria meningitidis Z2491
ccuguuauuuucacaaaaacaga

SEQ ID NO: 3364857 - RNA, 18 nt, Neisseria meningitidis Z2491
ccuguuucgggcaaaagc

SEQ ID NO: 3364858 - RNA, 20 nt, Neisseria meningitidis Z2491
ccuguuucgggcaaaagcca

SEQ ID NO: 3364859 - RNA, 23 nt, Neisseria meningitidis Z2491
ccuguuugaauggaaaugccguc

SEQ ID NO: 3364860 - RNA, 18 nt, Neisseria meningitidis Z2491
ccuguuuucgcgggaauc

SEQ ID NO: 3364861 - RNA, 15 nt, Neisseria meningitidis Z2491
ccuguuuuucaaagc

SEQ ID NO: 3364862 - RNA, 13 nt, Neisseria meningitidis Z2491
ccuuaaaaaacaa

SEQ ID NO: 3364863 - RNA, 14 nt, Neisseria meningitidis Z2491
ccuuaaaaaacaaa

SEQ ID NO: 3364864 - RNA, 20 nt, Neisseria meningitidis Z2491
ccuuaaccguaucaaacaag

SEQ ID NO: 3364865 - RNA, 22 nt, Neisseria meningitidis Z2491
ccuuagagaaucguucucuuug

SEQ ID NO: 3364866 - RNA, 16 nt, Neisseria meningitidis Z2491
ccuuauaguggauuaa

SEQ ID NO: 3364867 - RNA, 18 nt, Neisseria meningitidis Z2491
ccuuauaguggauuaaau

SEQ ID NO: 3364868 - RNA, 18 nt, Neisseria meningitidis Z2491
ccuuauccagaaaaucgg

SEQ ID NO: 3364869 - RNA, 16 nt, Neisseria meningitidis Z2491
ccuuauccauauccaa

SEQ ID NO: 3364870 - RNA, 15 nt, Neisseria meningitidis Z2491
ccuuaucccgauuug

SEQ ID NO: 3364871 - RNA, 13 nt, Neisseria meningitidis Z2491
ccuuaugccuuuu

SEQ ID NO: 3364872 - RNA, 23 nt, Neisseria meningitidis Z2491
ccuuauguauaguaauaaauuaa

SEQ ID NO: 3364873 - RNA, 14 nt, Neisseria meningitidis Z2491
ccuucacgccgccg

SEQ ID NO: 3364874 - RNA, 14 nt, Neisseria meningitidis Z2491
ccuucagacggcau

SEQ ID NO: 3364875 - RNA, 16 nt, Neisseria meningitidis Z2491
ccuucagacggcauug

SEQ ID NO: 3364876 - RNA, 23 nt, Neisseria meningitidis Z2491
ccuucagauggcuuugugcacuc

SEQ ID NO: 3364877 - RNA, 22 nt, Neisseria meningitidis Z2491
ccuucagcucucccucuuuaaa

SEQ ID NO: 3364878 - RNA, 13 nt, Neisseria meningitidis Z2491
ccuuccaaaagcg

SEQ ID NO: 3364879 - RNA, 17 nt, Neisseria meningitidis Z2491
ccuuccaucacguuuuc

SEQ ID NO: 3364880 - RNA, 22 nt, Neisseria meningitidis Z2491
ccuuccaucacguuuuccaagg

SEQ ID NO: 3364881 - RNA, 16 nt, Neisseria meningitidis Z2491
ccuucccgcgccaauu

SEQ ID NO: 3364882 - RNA, 13 nt, Neisseria meningitidis Z2491
ccuuccgcuucuu

SEQ ID NO: 3364883 - RNA, 19 nt, Neisseria meningitidis Z2491
ccuucgcgggaaugacgaa

SEQ ID NO: 3364884 - RNA, 17 nt, Neisseria meningitidis Z2491
ccuucgggcagcggcaa

SEQ ID NO: 3364885 - RNA, 19 nt, Neisseria meningitidis Z2491
ccuucgggcagcggcaaua

SEQ ID NO: 3364886 - RNA, 20 nt, Neisseria meningitidis Z2491
ccuucuucuaaaaauacaua

SEQ ID NO: 3364887 - RNA, 20 nt, Neisseria meningitidis Z2491
ccuugccaagguugaggucg

SEQ ID NO: 3364888 - RNA, 18 nt, Neisseria meningitidis Z2491
ccuuguccugauuuuugu

SEQ ID NO: 3364889 - RNA, 17 nt, Neisseria meningitidis Z2491
ccuugugccugcuccau

SEQ ID NO: 3364890 - RNA, 20 nt, Neisseria meningitidis Z2491
ccuuuaauuaagauccuccc

SEQ ID NO: 3364891 - RNA, 22 nt, Neisseria meningitidis Z2491
ccuuuacucauucaauccucaa

SEQ ID NO: 3364892 - RNA, 20 nt, Neisseria meningitidis Z2491
ccuuucaacacgcccuucca

SEQ ID NO: 3364893 - RNA, 17 nt, Neisseria meningitidis Z2491
ccuuucaaucaaugugc

SEQ ID NO: 3364894 - RNA, 22 nt, Neisseria meningitidis Z2491
ccuuucagacggcauuuuaugu

SEQ ID NO: 3364895 - RNA, 21 nt, Neisseria meningitidis Z2491
ccuuugacuuucguaccuugu

SEQ ID NO: 3364896 - RNA, 14 nt, Neisseria meningitidis Z2491
ccuuugauuucggc

SEQ ID NO: 3364897 - RNA, 23 nt, Neisseria meningitidis Z2491
ccuuugccaccaauaccgccuug

SEQ ID NO: 3364898 - RNA, 22 nt, Neisseria meningitidis Z2491
ccuuugggcgacggcaauauuc

SEQ ID NO: 3364899 - RNA, 11 nt, Neisseria meningitidis Z2491
ccuuuucccuu

SEQ ID NO: 3364900 - RNA, 12 nt, Neisseria meningitidis Z2491
ccuuuucuuccu

SEQ ID NO: 3364901 - RNA, 20 nt, Neisseria meningitidis Z2491
ccuuuugauuaacaggcaac

SEQ ID NO: 3364902 - RNA, 22 nt, Neisseria meningitidis Z2491
ccuuuuguaaaggaaguuuugu

SEQ ID NO: 3364903 - RNA, 20 nt, Neisseria meningitidis Z2491
ccuuuuuacccgauaaguuu

SEQ ID NO: 3364904 - RNA, 13 nt, Neisseria meningitidis Z2491
ccuuuuuguuuuc

SEQ ID NO: 3364905 - RNA, 22 nt, Neisseria meningitidis Z2491
ccuuuuuuuucuauugccuuua

SEQ ID NO: 3364906 - RNA, 17 nt, Neisseria meningitidis Z2491
cgaaaaauagaaaauca

SEQ ID NO: 3364907 - RNA, 16 nt, Neisseria meningitidis Z2491
cgaaaacaggaauccg

SEQ ID NO: 3364908 - RNA, 15 nt, Neisseria meningitidis Z2491
cgaaaaccuguguuu

SEQ ID NO: 3364909 - RNA, 16 nt, Neisseria meningitidis Z2491
cgaaaaguugcaagaa

SEQ ID NO: 3364910 - RNA, 11 nt, Neisseria meningitidis Z2491
cgaaacagaaa

SEQ ID NO: 3364911 - RNA, 15 nt, Neisseria meningitidis Z2491
cgaaacagaaaccca

SEQ ID NO: 3364912 - RNA, 16 nt, Neisseria meningitidis Z2491
cgaaacagaaacccaa

SEQ ID NO: 3364913 - RNA, 13 nt, Neisseria meningitidis Z2491
cgaaacauuccgc

SEQ ID NO: 3364914 - RNA, 12 nt, Neisseria meningitidis Z2491
cgaaagcgggaa

SEQ ID NO: 3364915 - RNA, 16 nt, Neisseria meningitidis Z2491
cgaaagcgggaaugcc

SEQ ID NO: 3364916 - RNA, 17 nt, Neisseria meningitidis Z2491
cgaaagguugugggaau

SEQ ID NO: 3364917 - RNA, 19 nt, Neisseria meningitidis Z2491
cgaaagguugugggaaucc

SEQ ID NO: 3364918 - RNA, 16 nt, Neisseria meningitidis Z2491
cgaaaguuggaaucca

SEQ ID NO: 3364919 - RNA, 22 nt, Neisseria meningitidis Z2491
cgaaauaacucaucaucggcgu

SEQ ID NO: 3364920 - RNA, 13 nt, Neisseria meningitidis Z2491
cgaaauaucggca

SEQ ID NO: 3364921 - RNA, 14 nt, Neisseria meningitidis Z2491
cgaaaugccgucug

SEQ ID NO: 3364922 - RNA, 19 nt, Neisseria meningitidis Z2491
cgaaaugccgucugaaacc

SEQ ID NO: 3364923 - RNA, 14 nt, Neisseria meningitidis Z2491
cgaaauuccaacau

SEQ ID NO: 3364924 - RNA, 22 nt, Neisseria meningitidis Z2491
cgaaauuuuagauugcaggcau

SEQ ID NO: 3364925 - RNA, 18 nt, Neisseria meningitidis Z2491
cgaacagaccggauuccc

SEQ ID NO: 3364926 - RNA, 20 nt, Neisseria meningitidis Z2491
cgaacagaccggauucccgc

SEQ ID NO: 3364927 - RNA, 21 nt, Neisseria meningitidis Z2491
cgaacagaccggauucccgca

SEQ ID NO: 3364928 - RNA, 17 nt, Neisseria meningitidis Z2491
cgaacaucaucuaaaug

SEQ ID NO: 3364929 - RNA, 19 nt, Neisseria meningitidis Z2491
cgaacaucaucuaaauguu

SEQ ID NO: 3364930 - RNA, 15 nt, Neisseria meningitidis Z2491
cgaacccguuuggca

SEQ ID NO: 3364931 - RNA, 16 nt, Neisseria meningitidis Z2491
cgaaccgaaacggcgc

SEQ ID NO: 3364932 - RNA, 17 nt, Neisseria meningitidis Z2491
cgaaccuggauucccgc

SEQ ID NO: 3364933 - RNA, 19 nt, Neisseria meningitidis Z2491
cgaacgggcggauaaugaa

SEQ ID NO: 3364934 - RNA, 13 nt, Neisseria meningitidis Z2491
cgcaauggcaaaa

SEQ ID NO: 3364935 - RNA, 13 nt, Neisseria meningitidis Z2491
cgcaauuccugca

SEQ ID NO: 3364936 - RNA, 16 nt, Neisseria meningitidis Z2491
cgcacauuuuuuucau

SEQ ID NO: 3364937 - RNA, 13 nt, Neisseria meningitidis Z2491
cgcacccgcaacc

SEQ ID NO: 3364938 - RNA, 21 nt, Neisseria meningitidis Z2491
cgcaccugacgcuccagcucc

SEQ ID NO: 3364939 - RNA, 15 nt, Neisseria meningitidis Z2491
cgcacuuagccuguu

SEQ ID NO: 3364940 - RNA, 14 nt, Neisseria meningitidis Z2491
cgcagacaguacaa

SEQ ID NO: 3364941 - RNA, 17 nt, Neisseria meningitidis Z2491
cgcagacaguacaaaua

SEQ ID NO: 3364942 - RNA, 15 nt, Neisseria meningitidis Z2491
cgcagcaguauuaga

SEQ ID NO: 3364943 - RNA, 15 nt, Neisseria meningitidis Z2491
cgcagccgagcagca

SEQ ID NO: 3364944 - RNA, 13 nt, Neisseria meningitidis Z2491
cgcagccugcagc

SEQ ID NO: 3364945 - RNA, 20 nt, Neisseria meningitidis Z2491
cgcaggcagcagaucgaccg

SEQ ID NO: 3364946 - RNA, 16 nt, Neisseria meningitidis Z2491
cgcaggcgggaaucca

SEQ ID NO: 3364947 - RNA, 23 nt, Neisseria meningitidis Z2491
cgcaggcgggaaucuagacauuc

SEQ ID NO: 3364948 - RNA, 20 nt, Neisseria meningitidis Z2491
cgcaggcgggaaucuagacc

SEQ ID NO: 3364949 - RNA, 11 nt, Neisseria meningitidis Z2491
cgcaggcuucg

SEQ ID NO: 3364950 - RNA, 20 nt, Neisseria meningitidis Z2491
cgcagguguaacugcaagaa

SEQ ID NO: 3364951 - RNA, 15 nt, Neisseria meningitidis Z2491
cgcagguuguuggaa

SEQ ID NO: 3364952 - RNA, 23 nt, Neisseria meningitidis Z2491
cgcagguuuuguuuuuccaaacg

SEQ ID NO: 3364953 - RNA, 23 nt, Neisseria meningitidis Z2491
cgcauaaaaaugcgccaaaaaau

SEQ ID NO: 3364954 - RNA, 14 nt, Neisseria meningitidis Z2491
cgcauaauaaaaau

SEQ ID NO: 3364955 - RNA, 20 nt, Neisseria meningitidis Z2491
cgcauccgagccgccguugg

SEQ ID NO: 3364956 - RNA, 21 nt, Neisseria meningitidis Z2491
cgcaucggcggcguauuugcu

SEQ ID NO: 3364957 - RNA, 14 nt, Neisseria meningitidis Z2491
cgcauuaaaauucu

SEQ ID NO: 3364958 - RNA, 12 nt, Neisseria meningitidis Z2491
cgcauucagacg

SEQ ID NO: 3364959 - RNA, 20 nt, Neisseria meningitidis Z2491
cgcauucuuucaagaacagu

SEQ ID NO: 3364960 - RNA, 12 nt, Neisseria meningitidis Z2491
cgcauugucccu

SEQ ID NO: 3364961 - RNA, 15 nt, Neisseria meningitidis Z2491
cgcauuguuggaaau

SEQ ID NO: 3364962 - RNA, 14 nt, Neisseria meningitidis Z2491
cgccaaaaaauuuu

SEQ ID NO: 3364963 - RNA, 20 nt, Neisseria meningitidis Z2491
cgccaaacccucgucauucu

SEQ ID NO: 3364964 - RNA, 23 nt, Neisseria meningitidis Z2491
cgccaacguaccguccaaacuuc

SEQ ID NO: 3364965 - RNA, 17 nt, Neisseria meningitidis Z2491
cgccaauccugccuuca

SEQ ID NO: 3364966 - RNA, 20 nt, Neisseria meningitidis Z2491
cgccaaugccgucugaagcc

SEQ ID NO: 3364967 - RNA, 19 nt, Neisseria meningitidis Z2491
cgccacauaauucaaaugc

SEQ ID NO: 3364968 - RNA, 14 nt, Neisseria meningitidis Z2491
cgccacggcauaac

SEQ ID NO: 3364969 - RNA, 15 nt, Neisseria meningitidis Z2491
cgccagccaccacgu

SEQ ID NO: 3364970 - RNA, 22 nt, Neisseria meningitidis Z2491
cgccagccuuucaacacgcccu

SEQ ID NO: 3364971 - RNA, 17 nt, Neisseria meningitidis Z2491
cgccaguccuacccaaa

SEQ ID NO: 3364972 - RNA, 23 nt, Neisseria meningitidis Z2491
cgccauauaaaaaacgccguccg

SEQ ID NO: 3364973 - RNA, 18 nt, Neisseria meningitidis Z2491
cgccaugucgcgggcggu

SEQ ID NO: 3364974 - RNA, 12 nt, Neisseria meningitidis Z2491
cgccauuuccaa

SEQ ID NO: 3364975 - RNA, 19 nt, Neisseria meningitidis Z2491
cgcccacgcgguaugcggc

SEQ ID NO: 3364976 - RNA, 21 nt, Neisseria meningitidis Z2491
cgccccaaauaccgccuaauu

SEQ ID NO: 3364977 - RNA, 16 nt, Neisseria meningitidis Z2491
cgccccaaauaccucc

SEQ ID NO: 3364978 - RNA, 14 nt, Neisseria meningitidis Z2491
cgcccgacaaccgc

SEQ ID NO: 3364979 - RNA, 20 nt, Neisseria meningitidis Z2491
cgcccgauuuccucuuucaa

SEQ ID NO: 3364980 - RNA, 13 nt, Neisseria meningitidis Z2491
cgcccuauauuug

SEQ ID NO: 3364981 - RNA, 23 nt, Neisseria meningitidis Z2491
cgcccuuugcccguggcgacggc

SEQ ID NO: 3364982 - RNA, 13 nt, Neisseria meningitidis Z2491
cgccgaaccgcgc

SEQ ID NO: 3364983 - RNA, 14 nt, Neisseria meningitidis Z2491
cgccgacauccccc

SEQ ID NO: 3364984 - RNA, 17 nt, Neisseria meningitidis Z2491
cgccgacaucccccagc

SEQ ID NO: 3364985 - RNA, 17 nt, Neisseria meningitidis Z2491
cgccgauggcugcuuug

SEQ ID NO: 3364986 - RNA, 22 nt, Neisseria meningitidis Z2491
cgccgaugggcaaggcgccggc

SEQ ID NO: 3364987 - RNA, 13 nt, Neisseria meningitidis Z2491
cgccgauguaaac

SEQ ID NO: 3364988 - RNA, 14 nt, Neisseria meningitidis Z2491
cgccgauguccuga

SEQ ID NO: 3364989 - RNA, 14 nt, Neisseria meningitidis Z2491
cgccgcagauuccg

SEQ ID NO: 3364990 - RNA, 19 nt, Neisseria meningitidis Z2491
cgccgccaacaccgcgccu

SEQ ID NO: 3364991 - RNA, 23 nt, Neisseria meningitidis Z2491
cgccgccgacaucccccagccga

SEQ ID NO: 3364992 - RNA, 21 nt, Neisseria meningitidis Z2491
cgccgccggaaagcugccccg

SEQ ID NO: 3364993 - RNA, 13 nt, Neisseria meningitidis Z2491
cgccgccguaacc

SEQ ID NO: 3364994 - RNA, 19 nt, Neisseria meningitidis Z2491
cgccgcuguauuugcgccg

SEQ ID NO: 3364995 - RNA, 14 nt, Neisseria meningitidis Z2491
cgccggaaagcugg

SEQ ID NO: 3364996 - RNA, 21 nt, Neisseria meningitidis Z2491
cgccggaagauuccggcggcu

SEQ ID NO: 3364997 - RNA, 23 nt, Neisseria meningitidis Z2491
cgccgggaccgacgggcaggccc

SEQ ID NO: 3364998 - RNA, 21 nt, Neisseria meningitidis Z2491
cgccgggguuuaucagaaaug

SEQ ID NO: 3364999 - RNA, 18 nt, Neisseria meningitidis Z2491
cgccggucuguccgaccu

SEQ ID NO: 3365000 - RNA, 14 nt, Neisseria meningitidis Z2491
cgccgguggcggca

SEQ ID NO: 3365001 - RNA, 12 nt, Neisseria meningitidis Z2491
cgccgguuuugc

SEQ ID NO: 3365002 - RNA, 21 nt, Neisseria meningitidis Z2491
cgccgucauucccgcaaaagc

SEQ ID NO: 3365003 - RNA, 20 nt, Neisseria meningitidis Z2491
cgccgucauucccgcgcagg

SEQ ID NO: 3365004 - RNA, 16 nt, Neisseria meningitidis Z2491
cgccguccguaccgcg

SEQ ID NO: 3365005 - RNA, 15 nt, Neisseria meningitidis Z2491
cgccgucggcuucca

SEQ ID NO: 3365006 - RNA, 16 nt, Neisseria meningitidis Z2491
cgccguguucgagcag

SEQ ID NO: 3365007 - RNA, 22 nt, Neisseria meningitidis Z2491
cgccguguuucaaggcggcggc

SEQ ID NO: 3365008 - RNA, 23 nt, Neisseria meningitidis Z2491
cgccguguuucaaggcggcggcg

SEQ ID NO: 3365009 - RNA, 20 nt, Neisseria meningitidis Z2491
cgccuccgaagccucgcccg

SEQ ID NO: 3365010 - RNA, 18 nt, Neisseria meningitidis Z2491
cgccugcguuugccgcca

SEQ ID NO: 3365011 - RNA, 12 nt, Neisseria meningitidis Z2491
cgccuuaaaaaa

SEQ ID NO: 3365012 - RNA, 18 nt, Neisseria meningitidis Z2491
cgccuuccgcuucuucca

SEQ ID NO: 3365013 - RNA, 18 nt, Neisseria meningitidis Z2491
cgccuuguccugauuuuu

SEQ ID NO: 3365014 - RNA, 18 nt, Neisseria meningitidis Z2491
cgccuugugccugcucca

SEQ ID NO: 3365015 - RNA, 13 nt, Neisseria meningitidis Z2491
cgccuuugagcgc

SEQ ID NO: 3365016 - RNA, 19 nt, Neisseria meningitidis Z2491
cgccuuugccaccaauacc

SEQ ID NO: 3365017 - RNA, 13 nt, Neisseria meningitidis Z2491
cgcgacggcggca

SEQ ID NO: 3365018 - RNA, 15 nt, Neisseria meningitidis Z2491
cgcgacggcggcagg

SEQ ID NO: 3365019 - RNA, 17 nt, Neisseria meningitidis Z2491
cgcgauaaggcgcgucc

SEQ ID NO: 3365020 - RNA, 14 nt, Neisseria meningitidis Z2491
cgcgauauucaggu

SEQ ID NO: 3365021 - RNA, 16 nt, Neisseria meningitidis Z2491
cgcgcaaacccgccug

SEQ ID NO: 3365022 - RNA, 15 nt, Neisseria meningitidis Z2491
cgcgcaccugacgcu

SEQ ID NO: 3365023 - RNA, 20 nt, Neisseria meningitidis Z2491
cgcgcaggcgggaaucuaga

SEQ ID NO: 3365024 - RNA, 22 nt, Neisseria meningitidis Z2491
cgcgcauauugcccaacagcag

SEQ ID NO: 3365025 - RNA, 12 nt, Neisseria meningitidis Z2491
cgcgcaucgcca

SEQ ID NO: 3365026 - RNA, 16 nt, Neisseria meningitidis Z2491
cgcgcauuugguaaca

SEQ ID NO: 3365027 - RNA, 20 nt, Neisseria meningitidis Z2491
cgcgccaaaucauagaggcg

SEQ ID NO: 3365028 - RNA, 22 nt, Neisseria meningitidis Z2491
cgcgccgaauauccccagugcg

SEQ ID NO: 3365029 - RNA, 21 nt, Neisseria meningitidis Z2491
cgcgccgauguuuuccugcca

SEQ ID NO: 3365030 - RNA, 13 nt, Neisseria meningitidis Z2491
cgcgccgcgcgcc

SEQ ID NO: 3365031 - RNA, 18 nt, Neisseria meningitidis Z2491
cgcgccguguucgagcag

SEQ ID NO: 3365032 - RNA, 18 nt, Neisseria meningitidis Z2491
cgcgcgaaugugcgccgg

SEQ ID NO: 3365033 - RNA, 15 nt, Neisseria meningitidis Z2491
cgcgcgggaauagcu

SEQ ID NO: 3365034 - RNA, 12 nt, Neisseria meningitidis Z2491
cgcgcucugcca

SEQ ID NO: 3365035 - RNA, 20 nt, Neisseria meningitidis Z2491
cggcagguaaaaaauagaaa

SEQ ID NO: 3365036 - RNA, 18 nt, Neisseria meningitidis Z2491
cggcaggucuucgggcag

SEQ ID NO: 3365037 - RNA, 22 nt, Neisseria meningitidis Z2491
cggcaggucuucgggcagggug

SEQ ID NO: 3365038 - RNA, 15 nt, Neisseria meningitidis Z2491
cggcagugauuuccc

SEQ ID NO: 3365039 - RNA, 13 nt, Neisseria meningitidis Z2491
cggcauaacacac

SEQ ID NO: 3365040 - RNA, 10 nt, Neisseria meningitidis Z2491
cggcauauca

SEQ ID NO: 3365041 - RNA, 22 nt, Neisseria meningitidis Z2491
cggcauaucccgacagaacaga

SEQ ID NO: 3365042 - RNA, 14 nt, Neisseria meningitidis Z2491
cggcaucaaaaacu

SEQ ID NO: 3365043 - RNA, 16 nt, Neisseria meningitidis Z2491
cggcaucgcaacucca

SEQ ID NO: 3365044 - RNA, 19 nt, Neisseria meningitidis Z2491
cggcaucgguuucuucuuc

SEQ ID NO: 3365045 - RNA, 16 nt, Neisseria meningitidis Z2491
cggcauuaaaauuugg

SEQ ID NO: 3365046 - RNA, 18 nt, Neisseria meningitidis Z2491
cggcauuaaaauuuggcu

SEQ ID NO: 3365047 - RNA, 20 nt, Neisseria meningitidis Z2491
cggcauugacauauccggcu

SEQ ID NO: 3365048 - RNA, 17 nt, Neisseria meningitidis Z2491
cggcauuggguuuucug

SEQ ID NO: 3365049 - RNA, 18 nt, Neisseria meningitidis Z2491
cggcauuguuuuucguua

SEQ ID NO: 3365050 - RNA, 16 nt, Neisseria meningitidis Z2491
cggcauuucugcgaaa

SEQ ID NO: 3365051 - RNA, 20 nt, Neisseria meningitidis Z2491
cggcauuuguccauucggcu

SEQ ID NO: 3365052 - RNA, 22 nt, Neisseria meningitidis Z2491
cggcauuuugcugccggcagga

SEQ ID NO: 3365053 - RNA, 19 nt, Neisseria meningitidis Z2491
cggcauuuuguugccgucg

SEQ ID NO: 3365054 - RNA, 14 nt, Neisseria meningitidis Z2491
cggcauuuuguuua

SEQ ID NO: 3365055 - RNA, 16 nt, Neisseria meningitidis Z2491
cggcauuuuucauuuu

SEQ ID NO: 3365056 - RNA, 18 nt, Neisseria meningitidis Z2491
cggcauuuuuuccgacag

SEQ ID NO: 3365057 - RNA, 13 nt, Neisseria meningitidis Z2491
cggccaaacacau

SEQ ID NO: 3365058 - RNA, 16 nt, Neisseria meningitidis Z2491
cggccaacaucagcau

SEQ ID NO: 3365059 - RNA, 24 nt, Neisseria meningitidis Z2491
cggccauugugcccacggggugcg

SEQ ID NO: 3365060 - RNA, 21 nt, Neisseria meningitidis Z2491
cggcccgaauugcgccgacag

SEQ ID NO: 3365061 - RNA, 18 nt, Neisseria meningitidis Z2491
cggccgguugcguaucaa

SEQ ID NO: 3365062 - RNA, 20 nt, Neisseria meningitidis Z2491
cggccugcccugccaaaacu

SEQ ID NO: 3365063 - RNA, 19 nt, Neisseria meningitidis Z2491
cggcgaaaaaauggugucc

SEQ ID NO: 3365064 - RNA, 16 nt, Neisseria meningitidis Z2491
cggcgagcaggggaau

SEQ ID NO: 3365065 - RNA, 15 nt, Neisseria meningitidis Z2491
cggcgagccgcagac

SEQ ID NO: 3365066 - RNA, 23 nt, Neisseria meningitidis Z2491
cggcgaugccggaaauaccgacg

SEQ ID NO: 3365067 - RNA, 15 nt, Neisseria meningitidis Z2491
cggcgcaaccgccgg

SEQ ID NO: 3365068 - RNA, 19 nt, Neisseria meningitidis Z2491
cggcgcguucggcgcggcu

SEQ ID NO: 3365069 - RNA, 23 nt, Neisseria meningitidis Z2491
cggcggauuucagugcugcgccc

SEQ ID NO: 3365070 - RNA, 21 nt, Neisseria meningitidis Z2491
cggcggcaaucguuucugucg

SEQ ID NO: 3365071 - RNA, 18 nt, Neisseria meningitidis Z2491
cggcggcagcguggaggg

SEQ ID NO: 3365072 - RNA, 11 nt, Neisseria meningitidis Z2491
cggcggcggca

SEQ ID NO: 3365073 - RNA, 18 nt, Neisseria meningitidis Z2491
cggcggcguucaaaucau

SEQ ID NO: 3365074 - RNA, 16 nt, Neisseria meningitidis Z2491
cggcgggacgcgcgcc

SEQ ID NO: 3365075 - RNA, 22 nt, Neisseria meningitidis Z2491
cggcgggcaggcggcugcgggc

SEQ ID NO: 3365076 - RNA, 22 nt, Neisseria meningitidis Z2491
cggcggggggauuucuguuuuu

SEQ ID NO: 3365077 - RNA, 23 nt, Neisseria meningitidis Z2491
cggcgggggggauuucuguuuuu

SEQ ID NO: 3365078 - RNA, 15 nt, Neisseria meningitidis Z2491
cggcggugucggaca

SEQ ID NO: 3365079 - RNA, 21 nt, Neisseria meningitidis Z2491
cggcgguuauuucggaugcgc

SEQ ID NO: 3365080 - RNA, 15 nt, Neisseria meningitidis Z2491
cggcguaggcggcgg

SEQ ID NO: 3365081 - RNA, 14 nt, Neisseria meningitidis Z2491
cggcguggaaggca

SEQ ID NO: 3365082 - RNA, 20 nt, Neisseria meningitidis Z2491
cggcguggaggggcaaugca

SEQ ID NO: 3365083 - RNA, 17 nt, Neisseria meningitidis Z2491
cggcguucccucgccuu

SEQ ID NO: 3365084 - RNA, 16 nt, Neisseria meningitidis Z2491
cggcugaacauuccgu

SEQ ID NO: 3365085 - RNA, 16 nt, Neisseria meningitidis Z2491
cggcugaccgcgccgu

SEQ ID NO: 3365086 - RNA, 18 nt, Neisseria meningitidis Z2491
cggcugccgaccgcgcac

SEQ ID NO: 3365087 - RNA, 22 nt, Neisseria meningitidis Z2491
cggcugccgaccgcgcacgcca

SEQ ID NO: 3365088 - RNA, 22 nt, Neisseria meningitidis Z2491
cggcugcugccuuggcggauaa

SEQ ID NO: 3365089 - RNA, 16 nt, Neisseria meningitidis Z2491
cggcugcuucggcuuc

SEQ ID NO: 3365090 - RNA, 15 nt, Neisseria meningitidis Z2491
cggcuguggaacgcg

SEQ ID NO: 3365091 - RNA, 14 nt, Neisseria meningitidis Z2491
cggcuuauggcgaa

SEQ ID NO: 3365092 - RNA, 19 nt, Neisseria meningitidis Z2491
cggcuucaacagacggcgu

SEQ ID NO: 3365093 - RNA, 16 nt, Neisseria meningitidis Z2491
cggcuucagacggcau

SEQ ID NO: 3365094 - RNA, 12 nt, Neisseria meningitidis Z2491
cggcuugccgcc

SEQ ID NO: 3365095 - RNA, 16 nt, Neisseria meningitidis Z2491
cggcuugccgccgcca

SEQ ID NO: 3365096 - RNA, 13 nt, Neisseria meningitidis Z2491
cggcuuucagacg

SEQ ID NO: 3365097 - RNA, 16 nt, Neisseria meningitidis Z2491
cggcuuucgcgccgcg

SEQ ID NO: 3365098 - RNA, 22 nt, Neisseria meningitidis Z2491
cggcuuugccgccuuguccuga

SEQ ID NO: 3365099 - RNA, 17 nt, Neisseria meningitidis Z2491
cggcuuuggucggagug

SEQ ID NO: 3365100 - RNA, 17 nt, Neisseria meningitidis Z2491
cggcuuuguuuacaugg

SEQ ID NO: 3365101 - RNA, 23 nt, Neisseria meningitidis Z2491
cgggaaaaauaucgggacgcugc

SEQ ID NO: 3365102 - RNA, 20 nt, Neisseria meningitidis Z2491
cgggaacuugauucaagguu

SEQ ID NO: 3365103 - RNA, 19 nt, Neisseria meningitidis Z2491
cgggaauagcucaguuggu

SEQ ID NO: 3365104 - RNA, 17 nt, Neisseria meningitidis Z2491
cgggaauccagaccauu

SEQ ID NO: 3365105 - RNA, 12 nt, Neisseria meningitidis Z2491
cgggaauccagu

SEQ ID NO: 3365106 - RNA, 19 nt, Neisseria meningitidis Z2491
cgggaauccgguuuuuuga

SEQ ID NO: 3365107 - RNA, 22 nt, Neisseria meningitidis Z2491
cgggaauccgguuuuuugaguu

SEQ ID NO: 3365108 - RNA, 14 nt, Neisseria meningitidis Z2491
cgggaaucuagaca

SEQ ID NO: 3365109 - RNA, 16 nt, Neisseria meningitidis Z2491
cgggaaucuagacauu

SEQ ID NO: 3365110 - RNA, 14 nt, Neisseria meningitidis Z2491
cgggaaucuagacc

SEQ ID NO: 3365111 - RNA, 10 nt, Neisseria meningitidis Z2491
cgggaaugac

SEQ ID NO: 3365112 - RNA, 14 nt, Neisseria meningitidis Z2491
cgggaaugacaaaa

SEQ ID NO: 3365113 - RNA, 20 nt, Neisseria meningitidis Z2491
cgggaaugacgaauuucagg

SEQ ID NO: 3365114 - RNA, 23 nt, Neisseria meningitidis Z2491
cgggaaugacgagauuuuagguu

SEQ ID NO: 3365115 - RNA, 19 nt, Neisseria meningitidis Z2491
cgggaaugacggcagagcg

SEQ ID NO: 3365116 - RNA, 13 nt, Neisseria meningitidis Z2491
cgggaaugacuga

SEQ ID NO: 3365117 - RNA, 19 nt, Neisseria meningitidis Z2491
cgggaaugacugaaacuca

SEQ ID NO: 3365118 - RNA, 20 nt, Neisseria meningitidis Z2491
cgggaccgacgggcaggccc

SEQ ID NO: 3365119 - RNA, 16 nt, Neisseria meningitidis Z2491
cgggaugcagguuucu

SEQ ID NO: 3365120 - RNA, 15 nt, Neisseria meningitidis Z2491
cgggauucagauguu

SEQ ID NO: 3365121 - RNA, 15 nt, Neisseria meningitidis Z2491
cgggauuuuaaaguu

SEQ ID NO: 3365122 - RNA, 14 nt, Neisseria meningitidis Z2491
cgggauuuuagguu

SEQ ID NO: 3365123 - RNA, 15 nt, Neisseria meningitidis Z2491
cgggcaaaagccagc

SEQ ID NO: 3365124 - RNA, 21 nt, Neisseria meningitidis Z2491
cgggcaacacgcccaagcggu

SEQ ID NO: 3365125 - RNA, 21 nt, Neisseria meningitidis Z2491
cgggcaaugccgacgcgcugc

SEQ ID NO: 3365126 - RNA, 21 nt, Neisseria meningitidis Z2491
cgggcauuguuaaguauuucu

SEQ ID NO: 3365127 - RNA, 22 nt, Neisseria meningitidis Z2491
cgggcauuguuaaguauuucua

SEQ ID NO: 3365128 - RNA, 16 nt, Neisseria meningitidis Z2491
cgggcccauugacaac

SEQ ID NO: 3365129 - RNA, 18 nt, Neisseria meningitidis Z2491
cgggccuuuggcggcggc

SEQ ID NO: 3365130 - RNA, 15 nt, Neisseria meningitidis Z2491
cgggcgcguagccgg

SEQ ID NO: 3365131 - RNA, 16 nt, Neisseria meningitidis Z2491
cgggcguuccacaaau

SEQ ID NO: 3365132 - RNA, 21 nt, Neisseria meningitidis Z2491
cgggcguucgucuaagaaaac

SEQ ID NO: 3365133 - RNA, 18 nt, Neisseria meningitidis Z2491
cgggcugaaucgccaaug

SEQ ID NO: 3365134 - RNA, 16 nt, Neisseria meningitidis Z2491
cgggcuuuucgggaag

SEQ ID NO: 3365135 - RNA, 17 nt, Neisseria meningitidis Z2491
cgggcuuuucgggaagu

SEQ ID NO: 3365136 - RNA, 22 nt, Neisseria meningitidis Z2491
cgucugaaacaaaauguucaga

SEQ ID NO: 3365137 - RNA, 13 nt, Neisseria meningitidis Z2491
cgucugaaacagg

SEQ ID NO: 3365138 - RNA, 20 nt, Neisseria meningitidis Z2491
cgucugaaacggcauccuug

SEQ ID NO: 3365139 - RNA, 14 nt, Neisseria meningitidis Z2491
cgucugaaacggcg

SEQ ID NO: 3365140 - RNA, 19 nt, Neisseria meningitidis Z2491
cgucugaaacguuucagac

SEQ ID NO: 3365141 - RNA, 16 nt, Neisseria meningitidis Z2491
cgucugaaaggcuuca

SEQ ID NO: 3365142 - RNA, 23 nt, Neisseria meningitidis Z2491
cgucugaaaggcuucagacggca

SEQ ID NO: 3365143 - RNA, 17 nt, Neisseria meningitidis Z2491
cgucugaaauguucaga

SEQ ID NO: 3365144 - RNA, 22 nt, Neisseria meningitidis Z2491
cgucugaaauguucagacggca

SEQ ID NO: 3365145 - RNA, 19 nt, Neisseria meningitidis Z2491
cgucugaacacauugcguu

SEQ ID NO: 3365146 - RNA, 16 nt, Neisseria meningitidis Z2491
cgucugaacaucgugu

SEQ ID NO: 3365147 - RNA, 22 nt, Neisseria meningitidis Z2491
cgucugaacgcuucagacggca

SEQ ID NO: 3365148 - RNA, 19 nt, Neisseria meningitidis Z2491
cgucugaacucaggcuuca

SEQ ID NO: 3365149 - RNA, 22 nt, Neisseria meningitidis Z2491
cgucugaagccuucagacggca

SEQ ID NO: 3365150 - RNA, 22 nt, Neisseria meningitidis Z2491
cgucugaaggcuucagacggca

SEQ ID NO: 3365151 - RNA, 11 nt, Neisseria meningitidis Z2491
cgucugccuuc

SEQ ID NO: 3365152 - RNA, 13 nt, Neisseria meningitidis Z2491
cgucugccuucuu

SEQ ID NO: 3365153 - RNA, 15 nt, Neisseria meningitidis Z2491
cgucugccuucuucu

SEQ ID NO: 3365154 - RNA, 14 nt, Neisseria meningitidis Z2491
cgucugcggcggga

SEQ ID NO: 3365155 - RNA, 13 nt, Neisseria meningitidis Z2491
cgugaauuaaaug

SEQ ID NO: 3365156 - RNA, 17 nt, Neisseria meningitidis Z2491
cgugagcuuuugcagaa

SEQ ID NO: 3365157 - RNA, 14 nt, Neisseria meningitidis Z2491
cgugcaauacggcg

SEQ ID NO: 3365158 - RNA, 18 nt, Neisseria meningitidis Z2491
cgugcaauacggcgacgg

SEQ ID NO: 3365159 - RNA, 22 nt, Neisseria meningitidis Z2491
cgugcaucgcgcccaauucuuc

SEQ ID NO: 3365160 - RNA, 13 nt, Neisseria meningitidis Z2491
cgugccuucuucg

SEQ ID NO: 3365161 - RNA, 16 nt, Neisseria meningitidis Z2491
cgugcgaacaaccgga

SEQ ID NO: 3365162 - RNA, 15 nt, Neisseria meningitidis Z2491
cgugcggcacgccgc

SEQ ID NO: 3365163 - RNA, 21 nt, Neisseria meningitidis Z2491
cgugcggucgcaucggcggcg

SEQ ID NO: 3365164 - RNA, 23 nt, Neisseria meningitidis Z2491
cguggaaucuaaagaaaccguuu

SEQ ID NO: 3365165 - RNA, 15 nt, Neisseria meningitidis Z2491
cguggagggacagcg

SEQ ID NO: 3365166 - RNA, 22 nt, Neisseria meningitidis Z2491
cguggcguauccauagauaaau

SEQ ID NO: 3365167 - RNA, 15 nt, Neisseria meningitidis Z2491
cgugggaaugacgga

SEQ ID NO: 3365168 - RNA, 19 nt, Neisseria meningitidis Z2491
cgugggcgcauucggggca

SEQ ID NO: 3365169 - RNA, 17 nt, Neisseria meningitidis Z2491
cguggguuugagauaua

SEQ ID NO: 3365170 - RNA, 16 nt, Neisseria meningitidis Z2491
cguggugcagguuucu

SEQ ID NO: 3365171 - RNA, 23 nt, Neisseria meningitidis Z2491
cguguccugaccuuugcagaaag

SEQ ID NO: 3365172 - RNA, 16 nt, Neisseria meningitidis Z2491
cgugugaaaauuuaaa

SEQ ID NO: 3365173 - RNA, 20 nt, Neisseria meningitidis Z2491
cgugugaaaauuuaaaaggu

SEQ ID NO: 3365174 - RNA, 17 nt, Neisseria meningitidis Z2491
cgugugcgacaacggcg

SEQ ID NO: 3365175 - RNA, 23 nt, Neisseria meningitidis Z2491
cguguuccgcaucgucgggaaaa

SEQ ID NO: 3365176 - RNA, 13 nt, Neisseria meningitidis Z2491
cguguucuucaug

SEQ ID NO: 3365177 - RNA, 21 nt, Neisseria meningitidis Z2491
cguguuugccgcgauucagcc

SEQ ID NO: 3365178 - RNA, 18 nt, Neisseria meningitidis Z2491
cguuaacagacuauuuuu

SEQ ID NO: 3365179 - RNA, 22 nt, Neisseria meningitidis Z2491
cguuaacagacuauuuuugcaa

SEQ ID NO: 3365180 - RNA, 16 nt, Neisseria meningitidis Z2491
cguuaacgauacggcg

SEQ ID NO: 3365181 - RNA, 19 nt, Neisseria meningitidis Z2491
cguuaaggcagagauaaaa

SEQ ID NO: 3365182 - RNA, 16 nt, Neisseria meningitidis Z2491
cguucaaacugcccga

SEQ ID NO: 3365183 - RNA, 16 nt, Neisseria meningitidis Z2491
cguucaaaucacgccc

SEQ ID NO: 3365184 - RNA, 23 nt, Neisseria meningitidis Z2491
cguucaauugcuuauuuguucaa

SEQ ID NO: 3365185 - RNA, 11 nt, Neisseria meningitidis Z2491
cguucagacgg

SEQ ID NO: 3365186 - RNA, 14 nt, Neisseria meningitidis Z2491
cguucagacggcau

SEQ ID NO: 3365187 - RNA, 15 nt, Neisseria meningitidis Z2491
cguucagacggcauc

SEQ ID NO: 3365188 - RNA, 23 nt, Neisseria meningitidis Z2491
cguucagacggcauuguuuaucu

SEQ ID NO: 3365189 - RNA, 12 nt, Neisseria meningitidis Z2491
cguucagauucc

SEQ ID NO: 3365190 - RNA, 21 nt, Neisseria meningitidis Z2491
cguucagcggacagugcagcg

SEQ ID NO: 3365191 - RNA, 20 nt, Neisseria meningitidis Z2491
cguuccaaauauuuccugca

SEQ ID NO: 3365192 - RNA, 19 nt, Neisseria meningitidis Z2491
cguuccacaaauccgccug

SEQ ID NO: 3365193 - RNA, 16 nt, Neisseria meningitidis Z2491
cguuccgaaaccaaga

SEQ ID NO: 3365194 - RNA, 18 nt, Neisseria meningitidis Z2491
cguucgcugacgguauag

SEQ ID NO: 3365195 - RNA, 15 nt, Neisseria meningitidis Z2491
cguucggaacacaaa

SEQ ID NO: 3365196 - RNA, 16 nt, Neisseria meningitidis Z2491
cguucggaacacaaaa

SEQ ID NO: 3365197 - RNA, 14 nt, Neisseria meningitidis Z2491
cguucggacggcau

SEQ ID NO: 3365198 - RNA, 17 nt, Neisseria meningitidis Z2491
cguucggcaaaauccgc

SEQ ID NO: 3365199 - RNA, 18 nt, Neisseria meningitidis Z2491
cguucggcaaaauccgca

SEQ ID NO: 3365200 - RNA, 22 nt, Neisseria meningitidis Z2491
cguucgggaauauucugauagg

SEQ ID NO: 3365201 - RNA, 14 nt, Neisseria meningitidis Z2491
cguucgugcagaua

SEQ ID NO: 3365202 - RNA, 16 nt, Neisseria meningitidis Z2491
cguucuggauucccac

SEQ ID NO: 3365203 - RNA, 12 nt, Neisseria meningitidis Z2491
cguucuucuucg

SEQ ID NO: 3365204 - RNA, 13 nt, Neisseria meningitidis Z2491
cguugaaauccug

SEQ ID NO: 3365205 - RNA, 15 nt, Neisseria meningitidis Z2491
cguugaaccacguuu

SEQ ID NO: 3365206 - RNA, 22 nt, Neisseria meningitidis Z2491
cguugagccuucacgccgccgc

SEQ ID NO: 3365207 - RNA, 14 nt, Neisseria meningitidis Z2491
cguugccucgccuu

SEQ ID NO: 3365208 - RNA, 22 nt, Neisseria meningitidis Z2491
cguugccugcgaacuagcggcg

SEQ ID NO: 3365209 - RNA, 18 nt, Neisseria meningitidis Z2491
cguuguauaguggauuaa

SEQ ID NO: 3365210 - RNA, 11 nt, Neisseria meningitidis Z2491
cguuucagacg

SEQ ID NO: 3365211 - RNA, 14 nt, Neisseria meningitidis Z2491
cguuucagacggca

SEQ ID NO: 3365212 - RNA, 15 nt, Neisseria meningitidis Z2491
cguuucagacggcau

SEQ ID NO: 3365213 - RNA, 21 nt, Neisseria meningitidis Z2491
cguuucagacggcauuuucaa

SEQ ID NO: 3365214 - RNA, 18 nt, Neisseria meningitidis Z2491
cguuuccuccucgccguc

SEQ ID NO: 3365215 - RNA, 20 nt, Neisseria meningitidis Z2491
cguuucuagauucccacuuu

SEQ ID NO: 3365216 - RNA, 18 nt, Neisseria meningitidis Z2491
cguuugaaaacaaucagu

SEQ ID NO: 3365217 - RNA, 17 nt, Neisseria meningitidis Z2491
cguuugccaaggcggcg

SEQ ID NO: 3365218 - RNA, 15 nt, Neisseria meningitidis Z2491
cguuuggaugccguc

SEQ ID NO: 3365219 - RNA, 13 nt, Neisseria meningitidis Z2491
cguuuguucaacu

SEQ ID NO: 3365220 - RNA, 12 nt, Neisseria meningitidis Z2491
cguuuuaauucg

SEQ ID NO: 3365221 - RNA, 22 nt, Neisseria meningitidis Z2491
cguuuuacccucuccccgaccc

SEQ ID NO: 3365222 - RNA, 21 nt, Neisseria meningitidis Z2491
cguuuuccaaggcgguuuugu

SEQ ID NO: 3365223 - RNA, 13 nt, Neisseria meningitidis Z2491
cguuuuccaccgc

SEQ ID NO: 3365224 - RNA, 19 nt, Neisseria meningitidis Z2491
cguuuugaugguuuuccaa

SEQ ID NO: 3365225 - RNA, 21 nt, Neisseria meningitidis Z2491
cguuuuuacgggaaugacgaa

SEQ ID NO: 3365226 - RNA, 13 nt, Neisseria meningitidis Z2491
cguuuuucagacg

SEQ ID NO: 3365227 - RNA, 14 nt, Neisseria meningitidis Z2491
cguuuuuccaaacc

SEQ ID NO: 3365228 - RNA, 21 nt, Neisseria meningitidis Z2491
cguuuuuguuuuauauucuga

SEQ ID NO: 3365229 - RNA, 22 nt, Neisseria meningitidis Z2491
cguuuuuguuuuauauucugau

SEQ ID NO: 3365230 - RNA, 15 nt, Neisseria meningitidis Z2491
cguuuuuuuccugcc

SEQ ID NO: 3365231 - RNA, 16 nt, Neisseria meningitidis Z2491
cguuuuuuuccugcca

SEQ ID NO: 3365232 - RNA, 21 nt, Neisseria meningitidis Z2491
cuaaaaauucuucuuuccauc

SEQ ID NO: 3365233 - RNA, 15 nt, Neisseria meningitidis Z2491
cuaaaacuuaaaauu

SEQ ID NO: 3365234 - RNA, 17 nt, Neisseria meningitidis Z2491
cuaaaacuuaaaauucc

SEQ ID NO: 3365235 - RNA, 14 nt, Neisseria meningitidis Z2491
cuaaaaucccguca

SEQ ID NO: 3365236 - RNA, 18 nt, Neisseria meningitidis Z2491
cuaaaauccgucauuccc

SEQ ID NO: 3365237 - RNA, 17 nt, Neisseria meningitidis Z2491
cucaauauuaggaaggu

SEQ ID NO: 3365238 - RNA, 12 nt, Neisseria meningitidis Z2491
cucaaucccguu

SEQ ID NO: 3365239 - RNA, 17 nt, Neisseria meningitidis Z2491
cucaaucgcggcggcac

SEQ ID NO: 3365240 - RNA, 18 nt, Neisseria meningitidis Z2491
cucaaucucauuuucaaa

SEQ ID NO: 3365241 - RNA, 23 nt, Neisseria meningitidis Z2491
cucaaucucauuuucaaaaugca

SEQ ID NO: 3365242 - RNA, 18 nt, Neisseria meningitidis Z2491
cucaaucuuauuuucaaa

SEQ ID NO: 3365243 - RNA, 22 nt, Neisseria meningitidis Z2491
cucacacucuucgucauucccg

SEQ ID NO: 3365244 - RNA, 23 nt, Neisseria meningitidis Z2491
cucacacucuucgucauucccgu

SEQ ID NO: 3365245 - RNA, 17 nt, Neisseria meningitidis Z2491
cucagccaccagcggua

SEQ ID NO: 3365246 - RNA, 21 nt, Neisseria meningitidis Z2491
cucagcccgaaauaggcugcc

SEQ ID NO: 3365247 - RNA, 13 nt, Neisseria meningitidis Z2491
cucauaagccgcc

SEQ ID NO: 3365248 - RNA, 15 nt, Neisseria meningitidis Z2491
cucauauucacuaaa

SEQ ID NO: 3365249 - RNA, 23 nt, Neisseria meningitidis Z2491
cucaucaacgccggggcaaacau

SEQ ID NO: 3365250 - RNA, 12 nt, Neisseria meningitidis Z2491
cucauucaaucc

SEQ ID NO: 3365251 - RNA, 18 nt, Neisseria meningitidis Z2491
cucauugagcuauuuguc

SEQ ID NO: 3365252 - RNA, 20 nt, Neisseria meningitidis Z2491
cuccaaaggagcaauuaaau

SEQ ID NO: 3365253 - RNA, 22 nt, Neisseria meningitidis Z2491
cuccaaguuccaauacauuuuu

SEQ ID NO: 3365254 - RNA, 16 nt, Neisseria meningitidis Z2491
cuccacgggucuccga

SEQ ID NO: 3365255 - RNA, 19 nt, Neisseria meningitidis Z2491
cuccagcuccggccaaaaa

SEQ ID NO: 3365256 - RNA, 20 nt, Neisseria meningitidis Z2491
cuccauaauccaagauuuca

SEQ ID NO: 3365257 - RNA, 16 nt, Neisseria meningitidis Z2491
cucccgauaaaugccg

SEQ ID NO: 3365258 - RNA, 23 nt, Neisseria meningitidis Z2491
cucccgugggagagggugaggga

SEQ ID NO: 3365259 - RNA, 23 nt, Neisseria meningitidis Z2491
cucccucuuuaaauuuaaaaggg

SEQ ID NO: 3365260 - RNA, 14 nt, Neisseria meningitidis Z2491
cuccgagcaucaag

SEQ ID NO: 3365261 - RNA, 16 nt, Neisseria meningitidis Z2491
cuccgcaaacaccagc

SEQ ID NO: 3365262 - RNA, 20 nt, Neisseria meningitidis Z2491
cuccgccucugccagcuccg

SEQ ID NO: 3365263 - RNA, 23 nt, Neisseria meningitidis Z2491
cuccggauuccuguuuucgcggg

SEQ ID NO: 3365264 - RNA, 14 nt, Neisseria meningitidis Z2491
cuccguaaauuguc

SEQ ID NO: 3365265 - RNA, 13 nt, Neisseria meningitidis Z2491
cuccgucaaaaca

SEQ ID NO: 3365266 - RNA, 22 nt, Neisseria meningitidis Z2491
cuccugaucuaaaaauucuaac

SEQ ID NO: 3365267 - RNA, 19 nt, Neisseria meningitidis Z2491
cuccuucgggcgcuuggaa

SEQ ID NO: 3365268 - RNA, 22 nt, Neisseria meningitidis Z2491
cucgaaagcgggaauucagguu

SEQ ID NO: 3365269 - RNA, 17 nt, Neisseria meningitidis Z2491
cucgauuugaaaucuga

SEQ ID NO: 3365270 - RNA, 21 nt, Neisseria meningitidis Z2491
cucgccgaacgagccguaacc

SEQ ID NO: 3365271 - RNA, 18 nt, Neisseria meningitidis Z2491
cucgccuuagcucaaaga

SEQ ID NO: 3365272 - RNA, 23 nt, Neisseria meningitidis Z2491
cucgccuugccguacuaucugua

SEQ ID NO: 3365273 - RNA, 17 nt, Neisseria meningitidis Z2491
cucgcguauccagccgc

SEQ ID NO: 3365274 - RNA, 20 nt, Neisseria meningitidis Z2491
cucgcguauccagccgccau

SEQ ID NO: 3365275 - RNA, 21 nt, Neisseria meningitidis Z2491
cucggcaaacgcuucgcuuuu

SEQ ID NO: 3365276 - RNA, 21 nt, Neisseria meningitidis Z2491
cucggcagacaaaccgucccc

SEQ ID NO: 3365277 - RNA, 16 nt, Neisseria meningitidis Z2491
cucggccugcccugcc

SEQ ID NO: 3365278 - RNA, 16 nt, Neisseria meningitidis Z2491
cucggggucaagcgcg

SEQ ID NO: 3365279 - RNA, 13 nt, Neisseria meningitidis Z2491
cucguuauuucca

SEQ ID NO: 3365280 - RNA, 18 nt, Neisseria meningitidis Z2491
cucguuauuuccacaaaa

SEQ ID NO: 3365281 - RNA, 17 nt, Neisseria meningitidis Z2491
cucguuuuccgcuccaa

SEQ ID NO: 3365282 - RNA, 20 nt, Neisseria meningitidis Z2491
cucuaaggugcugaagcacc

SEQ ID NO: 3365283 - RNA, 18 nt, Neisseria meningitidis Z2491
cucuauaaaaucccccgc

SEQ ID NO: 3365284 - RNA, 13 nt, Neisseria meningitidis Z2491
cucucaaaauauu

SEQ ID NO: 3365285 - RNA, 17 nt, Neisseria meningitidis Z2491
cucuccccgacccuccc

SEQ ID NO: 3365286 - RNA, 14 nt, Neisseria meningitidis Z2491
cucucccucuuuaa

SEQ ID NO: 3365287 - RNA, 20 nt, Neisseria meningitidis Z2491
cucuccgucauucccacgga

SEQ ID NO: 3365288 - RNA, 16 nt, Neisseria meningitidis Z2491
cucugaaagccagcgg

SEQ ID NO: 3365289 - RNA, 16 nt, Neisseria meningitidis Z2491
cucugauagccgccca

SEQ ID NO: 3365290 - RNA, 23 nt, Neisseria meningitidis Z2491
cucugauagccgcccaaugccgu

SEQ ID NO: 3365291 - RNA, 21 nt, Neisseria meningitidis Z2491
cucugcggacuuaagaaacaa

SEQ ID NO: 3365292 - RNA, 17 nt, Neisseria meningitidis Z2491
cucuucgcguacuuuau

SEQ ID NO: 3365293 - RNA, 16 nt, Neisseria meningitidis Z2491
cucuuggucaaaaugu

SEQ ID NO: 3365294 - RNA, 13 nt, Neisseria meningitidis Z2491
cucuuuaaauuua

SEQ ID NO: 3365295 - RNA, 16 nt, Neisseria meningitidis Z2491
cucuuucaacggcacg

SEQ ID NO: 3365296 - RNA, 13 nt, Neisseria meningitidis Z2491
cucuuuucagaca

SEQ ID NO: 3365297 - RNA, 14 nt, Neisseria meningitidis Z2491
cugaaaaaaugccg

SEQ ID NO: 3365298 - RNA, 19 nt, Neisseria meningitidis Z2491
cugaaaaaccuuucccguu

SEQ ID NO: 3365299 - RNA, 14 nt, Neisseria meningitidis Z2491
cugaaaaauuuaug

SEQ ID NO: 3365300 - RNA, 13 nt, Neisseria meningitidis Z2491
cugaaaacagaaa

SEQ ID NO: 3365301 - RNA, 22 nt, Neisseria meningitidis Z2491
cugaaaacagaaaccuaaaauu

SEQ ID NO: 3365302 - RNA, 14 nt, Neisseria meningitidis Z2491
cugaaaacaggaau

SEQ ID NO: 3365303 - RNA, 19 nt, Neisseria meningitidis Z2491
cugaaaacgcuguuuuuug

SEQ ID NO: 3365304 - RNA, 20 nt, Neisseria meningitidis Z2491
cugaaaacuuggagauucua

SEQ ID NO: 3365305 - RNA, 15 nt, Neisseria meningitidis Z2491
cugaaaaucggguuu

SEQ ID NO: 3365306 - RNA, 22 nt, Neisseria meningitidis Z2491
cugaaacacuguucagacgguc

SEQ ID NO: 3365307 - RNA, 21 nt, Neisseria meningitidis Z2491
cugaaaccaaaucggcuuuca

SEQ ID NO: 3365308 - RNA, 21 nt, Neisseria meningitidis Z2491
cugaaaccccauccuucccgc

SEQ ID NO: 3365309 - RNA, 16 nt, Neisseria meningitidis Z2491
cugaaacccggaaaaa

SEQ ID NO: 3365310 - RNA, 18 nt, Neisseria meningitidis Z2491
cugaaacgcauucagacg

SEQ ID NO: 3365311 - RNA, 16 nt, Neisseria meningitidis Z2491
cugaaacgggaaucuc

SEQ ID NO: 3365312 - RNA, 14 nt, Neisseria meningitidis Z2491
cugaaacucaaaaa

SEQ ID NO: 3365313 - RNA, 18 nt, Neisseria meningitidis Z2491
cugaaacucaaaaaaccg

SEQ ID NO: 3365314 - RNA, 18 nt, Neisseria meningitidis Z2491
cugaaacucaaaaagcug

SEQ ID NO: 3365315 - RNA, 20 nt, Neisseria meningitidis Z2491
cugaaacuucgccauucccg

SEQ ID NO: 3365316 - RNA, 21 nt, Neisseria meningitidis Z2491
cugaaacuucgccauucccgu

SEQ ID NO: 3365317 - RNA, 17 nt, Neisseria meningitidis Z2491
cugaaacuuuaauuuug

SEQ ID NO: 3365318 - RNA, 13 nt, Neisseria meningitidis Z2491
cugaaaggcuuca

SEQ ID NO: 3365319 - RNA, 14 nt, Neisseria meningitidis Z2491
cugaaaggcuucag

SEQ ID NO: 3365320 - RNA, 20 nt, Neisseria meningitidis Z2491
cugaaaggcuucagacggca

SEQ ID NO: 3365321 - RNA, 21 nt, Neisseria meningitidis Z2491
cugaaaggcuuuuucagacgg

SEQ ID NO: 3365322 - RNA, 22 nt, Neisseria meningitidis Z2491
cugaaagguuuucagacggcau

SEQ ID NO: 3365323 - RNA, 18 nt, Neisseria meningitidis Z2491
cugaaauagaaaauauug

SEQ ID NO: 3365324 - RNA, 20 nt, Neisseria meningitidis Z2491
cugaaauaucgucauucccg

SEQ ID NO: 3365325 - RNA, 23 nt, Neisseria meningitidis Z2491
cugaaauccuauuuucagauggc

SEQ ID NO: 3365326 - RNA, 16 nt, Neisseria meningitidis Z2491
cugaaauguucagacg

SEQ ID NO: 3365327 - RNA, 17 nt, Neisseria meningitidis Z2491
cugaaauucgucauucc

SEQ ID NO: 3365328 - RNA, 21 nt, Neisseria meningitidis Z2491
cugaaauucgucauucccgcu

SEQ ID NO: 3365329 - RNA, 16 nt, Neisseria meningitidis Z2491
cugaaauuuugccauu

SEQ ID NO: 3365330 - RNA, 22 nt, Neisseria meningitidis Z2491
cugaacacggguucagacggca

SEQ ID NO: 3365331 - RNA, 23 nt, Neisseria meningitidis Z2491
cugaacacggguucagacggcau

SEQ ID NO: 3365332 - RNA, 20 nt, Neisseria meningitidis Z2491
cugaacaguguuucagacgg

SEQ ID NO: 3365333 - RNA, 22 nt, Neisseria meningitidis Z2491
cugaacaguguuucagacggcc

SEQ ID NO: 3365334 - RNA, 15 nt, Neisseria meningitidis Z2491
cugaacauaaaugcc

SEQ ID NO: 3365335 - RNA, 22 nt, Neisseria meningitidis Z2491
cugaacaucuuucagacggcau

SEQ ID NO: 3365336 - RNA, 16 nt, Neisseria meningitidis Z2491
cugaacauuucagacg

SEQ ID NO: 3365337 - RNA, 21 nt, Neisseria meningitidis Z2491
cugccugauacagccacgcca

SEQ ID NO: 3365338 - RNA, 18 nt, Neisseria meningitidis Z2491
cugccugcaacgcuugug

SEQ ID NO: 3365339 - RNA, 18 nt, Neisseria meningitidis Z2491
cugccuguaaaaccaagu

SEQ ID NO: 3365340 - RNA, 14 nt, Neisseria meningitidis Z2491
cugccuucuucuuu

SEQ ID NO: 3365341 - RNA, 23 nt, Neisseria meningitidis Z2491
cugcgccacggcuuucgcgccgc

SEQ ID NO: 3365342 - RNA, 19 nt, Neisseria meningitidis Z2491
cugcgcgaacagcgacacc

SEQ ID NO: 3365343 - RNA, 16 nt, Neisseria meningitidis Z2491
cugcgcgcggacggau

SEQ ID NO: 3365344 - RNA, 20 nt, Neisseria meningitidis Z2491
cugcgcgggaaugacggcag

SEQ ID NO: 3365345 - RNA, 14 nt, Neisseria meningitidis Z2491
cugcggacguugug

SEQ ID NO: 3365346 - RNA, 18 nt, Neisseria meningitidis Z2491
cugcggacuuaagaaaca

SEQ ID NO: 3365347 - RNA, 17 nt, Neisseria meningitidis Z2491
cugcggcucugaaacca

SEQ ID NO: 3365348 - RNA, 18 nt, Neisseria meningitidis Z2491
cugcggcuucguugccuu

SEQ ID NO: 3365349 - RNA, 15 nt, Neisseria meningitidis Z2491
cugcgucaaaccagc

SEQ ID NO: 3365350 - RNA, 20 nt, Neisseria meningitidis Z2491
cugcguuacauaauccggcu

SEQ ID NO: 3365351 - RNA, 17 nt, Neisseria meningitidis Z2491
cugcucggaggcuuugu

SEQ ID NO: 3365352 - RNA, 19 nt, Neisseria meningitidis Z2491
cugcugaagucgugaauua

SEQ ID NO: 3365353 - RNA, 23 nt, Neisseria meningitidis Z2491
cugcugacuaaccgaaaauaauu

SEQ ID NO: 3365354 - RNA, 21 nt, Neisseria meningitidis Z2491
cugcugcaaaccgucugccaa

SEQ ID NO: 3365355 - RNA, 16 nt, Neisseria meningitidis Z2491
cugcugcugaccgccg

SEQ ID NO: 3365356 - RNA, 18 nt, Neisseria meningitidis Z2491
cugcuggaaauugccuuc

SEQ ID NO: 3365357 - RNA, 22 nt, Neisseria meningitidis Z2491
cugcuguauuuuucgaggcgca

SEQ ID NO: 3365358 - RNA, 15 nt, Neisseria meningitidis Z2491
cugcuguugcaaagc

SEQ ID NO: 3365359 - RNA, 16 nt, Neisseria meningitidis Z2491
cugcuguugcaaagcc

SEQ ID NO: 3365360 - RNA, 20 nt, Neisseria meningitidis Z2491
cugcuguuugacaggucgga

SEQ ID NO: 3365361 - RNA, 18 nt, Neisseria meningitidis Z2491
cugcuuccgaggcggcuu

SEQ ID NO: 3365362 - RNA, 16 nt, Neisseria meningitidis Z2491
cugcuuuaauucucca

SEQ ID NO: 3365363 - RNA, 22 nt, Neisseria meningitidis Z2491
cugcuuuggcagcacaggcaag

SEQ ID NO: 3365364 - RNA, 11 nt, Neisseria meningitidis Z2491
cuggauuccca

SEQ ID NO: 3365365 - RNA, 12 nt, Neisseria meningitidis Z2491
cuggauucccgc

SEQ ID NO: 3365366 - RNA, 19 nt, Neisseria meningitidis Z2491
cuggcaaauugaaaugccg

SEQ ID NO: 3365367 - RNA, 17 nt, Neisseria meningitidis Z2491
cuggcgauaugcuucaa

SEQ ID NO: 3365368 - RNA, 15 nt, Neisseria meningitidis Z2491
cuggcgguaaagugc

SEQ ID NO: 3365369 - RNA, 12 nt, Neisseria meningitidis Z2491
cuggcugccgau

SEQ ID NO: 3365370 - RNA, 18 nt, Neisseria meningitidis Z2491
cugguaucuuuaaacagc

SEQ ID NO: 3365371 - RNA, 21 nt, Neisseria meningitidis Z2491
cuggugguacgcccgcagccg

SEQ ID NO: 3365372 - RNA, 20 nt, Neisseria meningitidis Z2491
cugguuuaaauuuaauccac

SEQ ID NO: 3365373 - RNA, 21 nt, Neisseria meningitidis Z2491
cugguuuaaauuuaauccacu

SEQ ID NO: 3365374 - RNA, 20 nt, Neisseria meningitidis Z2491
cugguuuaaauuuaauucac

SEQ ID NO: 3365375 - RNA, 21 nt, Neisseria meningitidis Z2491
cugguuuaaauuuaauucacu

SEQ ID NO: 3365376 - RNA, 19 nt, Neisseria meningitidis Z2491
cugguuuaaauuuaguuca

SEQ ID NO: 3365377 - RNA, 19 nt, Neisseria meningitidis Z2491
cugguuuuugugaauccac

SEQ ID NO: 3365378 - RNA, 18 nt, Neisseria meningitidis Z2491
cugguuuuuguuaaucca

SEQ ID NO: 3365379 - RNA, 20 nt, Neisseria meningitidis Z2491
cugguuuuuguuaauccacu

SEQ ID NO: 3365380 - RNA, 18 nt, Neisseria meningitidis Z2491
cugguuuuuguuaauccg

SEQ ID NO: 3365381 - RNA, 19 nt, Neisseria meningitidis Z2491
cugguuuuuguuaauccgc

SEQ ID NO: 3365382 - RNA, 20 nt, Neisseria meningitidis Z2491
cugguuuuuguuaauccgcu

SEQ ID NO: 3365383 - RNA, 15 nt, Neisseria meningitidis Z2491
cuguaaacagauaaa

SEQ ID NO: 3365384 - RNA, 20 nt, Neisseria meningitidis Z2491
cuguaaacagauaaaaccaa

SEQ ID NO: 3365385 - RNA, 19 nt, Neisseria meningitidis Z2491
cuguaaagauaaaucuaug

SEQ ID NO: 3365386 - RNA, 18 nt, Neisseria meningitidis Z2491
cuguaccgcaucuucaaa

SEQ ID NO: 3365387 - RNA, 22 nt, Neisseria meningitidis Z2491
cuguaccgcaucuucaaaggaa

SEQ ID NO: 3365388 - RNA, 21 nt, Neisseria meningitidis Z2491
cuguaccguuucagacggcau

SEQ ID NO: 3365389 - RNA, 14 nt, Neisseria meningitidis Z2491
cuguacuagauuag

SEQ ID NO: 3365390 - RNA, 16 nt, Neisseria meningitidis Z2491
cuguacugguuuaaau

SEQ ID NO: 3365391 - RNA, 20 nt, Neisseria meningitidis Z2491
cuguacugguuuaaauuuaa

SEQ ID NO: 3365392 - RNA, 22 nt, Neisseria meningitidis Z2491
cuguacugguuuaaauuuaauu

SEQ ID NO: 3365393 - RNA, 16 nt, Neisseria meningitidis Z2491
cuguacugucugcggc

SEQ ID NO: 3365394 - RNA, 17 nt, Neisseria meningitidis Z2491
cuguaugccgucugaaa

SEQ ID NO: 3365395 - RNA, 19 nt, Neisseria meningitidis Z2491
cuguaugcggcuugggcga

SEQ ID NO: 3365396 - RNA, 15 nt, Neisseria meningitidis Z2491
cuguauuuguauagu

SEQ ID NO: 3365397 - RNA, 17 nt, Neisseria meningitidis Z2491
cuguauuuguauagugg

SEQ ID NO: 3365398 - RNA, 21 nt, Neisseria meningitidis Z2491
cuguauuuuucgaggcgcagg

SEQ ID NO: 3365399 - RNA, 11 nt, Neisseria meningitidis Z2491
cuguccaaagc

SEQ ID NO: 3365400 - RNA, 16 nt, Neisseria meningitidis Z2491
cuguccaaagccucgc

SEQ ID NO: 3365401 - RNA, 23 nt, Neisseria meningitidis Z2491
cuguccaaagccucgcggcucgc

SEQ ID NO: 3365402 - RNA, 22 nt, Neisseria meningitidis Z2491
cuguccagacggagauuuuguu

SEQ ID NO: 3365403 - RNA, 16 nt, Neisseria meningitidis Z2491
cuguccggcaugauuu

SEQ ID NO: 3365404 - RNA, 22 nt, Neisseria meningitidis Z2491
cugucgccagacaggcuuuuuu

SEQ ID NO: 3365405 - RNA, 22 nt, Neisseria meningitidis Z2491
cugucgccgucauucccgcaaa

SEQ ID NO: 3365406 - RNA, 17 nt, Neisseria meningitidis Z2491
cugucgggcuucagacg

SEQ ID NO: 3365407 - RNA, 23 nt, Neisseria meningitidis Z2491
cugucuccgccuguaugcggcuu

SEQ ID NO: 3365408 - RNA, 18 nt, Neisseria meningitidis Z2491
cugucucggcagcggcau

SEQ ID NO: 3365409 - RNA, 17 nt, Neisseria meningitidis Z2491
cugucugcggcucgccg

SEQ ID NO: 3365410 - RNA, 16 nt, Neisseria meningitidis Z2491
cugucuuucaauauac

SEQ ID NO: 3365411 - RNA, 17 nt, Neisseria meningitidis Z2491
cugugagaacaagccug

SEQ ID NO: 3365412 - RNA, 17 nt, Neisseria meningitidis Z2491
cugugccgguucaaacu

SEQ ID NO: 3365413 - RNA, 12 nt, Neisseria meningitidis Z2491
cugugcggauag

SEQ ID NO: 3365414 - RNA, 15 nt, Neisseria meningitidis Z2491
cuguggauaaacauu

SEQ ID NO: 3365415 - RNA, 21 nt, Neisseria meningitidis Z2491
cuguggauucgccuuaaaaaa

SEQ ID NO: 3365416 - RNA, 13 nt, Neisseria meningitidis Z2491
cuguguuucaaua

SEQ ID NO: 3365417 - RNA, 17 nt, Neisseria meningitidis Z2491
cuguuaacgaaauuuga

SEQ ID NO: 3365418 - RNA, 15 nt, Neisseria meningitidis Z2491
cuguucagacggcau

SEQ ID NO: 3365419 - RNA, 21 nt, Neisseria meningitidis Z2491
cuguucagacggucuuuugcu

SEQ ID NO: 3365420 - RNA, 21 nt, Neisseria meningitidis Z2491
cuguucggucauagccagaga

SEQ ID NO: 3365421 - RNA, 13 nt, Neisseria meningitidis Z2491
cuguucguuuuug

SEQ ID NO: 3365422 - RNA, 16 nt, Neisseria meningitidis Z2491
cuguugaaaaugccgu

SEQ ID NO: 3365423 - RNA, 22 nt, Neisseria meningitidis Z2491
cuguugcggcccgaauugcgcc

SEQ ID NO: 3365424 - RNA, 11 nt, Neisseria meningitidis Z2491
cuguuggaaaa

SEQ ID NO: 3365425 - RNA, 15 nt, Neisseria meningitidis Z2491
cuguuggaaaaacug

SEQ ID NO: 3365426 - RNA, 23 nt, Neisseria meningitidis Z2491
cuguuggaaaaacugggcggauc

SEQ ID NO: 3365427 - RNA, 16 nt, Neisseria meningitidis Z2491
cuguuguuucggauaa

SEQ ID NO: 3365428 - RNA, 17 nt, Neisseria meningitidis Z2491
cuguuucagacggcauu

SEQ ID NO: 3365429 - RNA, 21 nt, Neisseria meningitidis Z2491
cuguuucagacggcauuuuug

SEQ ID NO: 3365430 - RNA, 16 nt, Neisseria meningitidis Z2491
cuguuuccaagccgca

SEQ ID NO: 3365431 - RNA, 19 nt, Neisseria meningitidis Z2491
cuguuucgggcaaaagcca

SEQ ID NO: 3365432 - RNA, 14 nt, Neisseria meningitidis Z2491
cuguuucuucaaaa

SEQ ID NO: 3365433 - RNA, 20 nt, Neisseria meningitidis Z2491
cuguuugcgauaggauuugc

SEQ ID NO: 3365434 - RNA, 15 nt, Neisseria meningitidis Z2491
cuguuuggcuuuuuu

SEQ ID NO: 3365435 - RNA, 22 nt, Neisseria meningitidis Z2491
cuguuuggcuuuuuucuguuug

SEQ ID NO: 3365436 - RNA, 18 nt, Neisseria meningitidis Z2491
cuguuuguuaaagccgua

SEQ ID NO: 3365437 - RNA, 19 nt, Neisseria meningitidis Z2491
cuugcugugaacggacgca

SEQ ID NO: 3365438 - RNA, 21 nt, Neisseria meningitidis Z2491
cuuggagauucuagauucccg

SEQ ID NO: 3365439 - RNA, 17 nt, Neisseria meningitidis Z2491
cuuggcgggaagccagg

SEQ ID NO: 3365440 - RNA, 14 nt, Neisseria meningitidis Z2491
cuugggaaaugccg

SEQ ID NO: 3365441 - RNA, 21 nt, Neisseria meningitidis Z2491
cuugggcggcaggcuugcccu

SEQ ID NO: 3365442 - RNA, 13 nt, Neisseria meningitidis Z2491
cuuggucaaaaug

SEQ ID NO: 3365443 - RNA, 18 nt, Neisseria meningitidis Z2491
cuuggucgcgcacgauuu

SEQ ID NO: 3365444 - RNA, 18 nt, Neisseria meningitidis Z2491
cuuggugcuucagcaccu

SEQ ID NO: 3365445 - RNA, 20 nt, Neisseria meningitidis Z2491
cuuggugcuucagcaccuua

SEQ ID NO: 3365446 - RNA, 20 nt, Neisseria meningitidis Z2491
cuuguauggauaacgagauu

SEQ ID NO: 3365447 - RNA, 15 nt, Neisseria meningitidis Z2491
cuugucaaaccaacc

SEQ ID NO: 3365448 - RNA, 15 nt, Neisseria meningitidis Z2491
cuugucaagaaacac

SEQ ID NO: 3365449 - RNA, 14 nt, Neisseria meningitidis Z2491
cuuguccugauuua

SEQ ID NO: 3365450 - RNA, 21 nt, Neisseria meningitidis Z2491
cuuguccugauuuaaauuuaa

SEQ ID NO: 3365451 - RNA, 18 nt, Neisseria meningitidis Z2491
cuugucggcuucguauuc

SEQ ID NO: 3365452 - RNA, 24 nt, Neisseria meningitidis Z2491
cuugucgggauugucgauaguguu

SEQ ID NO: 3365453 - RNA, 16 nt, Neisseria meningitidis Z2491
cuugugccagcucuug

SEQ ID NO: 3365454 - RNA, 21 nt, Neisseria meningitidis Z2491
cuugugccagcucuugaaaua

SEQ ID NO: 3365455 - RNA, 19 nt, Neisseria meningitidis Z2491
cuuguguugguuuugaggc

SEQ ID NO: 3365456 - RNA, 18 nt, Neisseria meningitidis Z2491
cuuuaagcaaucaucucu

SEQ ID NO: 3365457 - RNA, 20 nt, Neisseria meningitidis Z2491
cuuuaaucccgucauuccca

SEQ ID NO: 3365458 - RNA, 21 nt, Neisseria meningitidis Z2491
cuuuaaucccgucauucccac

SEQ ID NO: 3365459 - RNA, 20 nt, Neisseria meningitidis Z2491
cuuuaauuuugucauucccg

SEQ ID NO: 3365460 - RNA, 21 nt, Neisseria meningitidis Z2491
cuuuaauuuugucauucccgc

SEQ ID NO: 3365461 - RNA, 21 nt, Neisseria meningitidis Z2491
cuuuacgcgcgccguccaaaa

SEQ ID NO: 3365462 - RNA, 21 nt, Neisseria meningitidis Z2491
cuuuagagauucuggauuccc

SEQ ID NO: 3365463 - RNA, 18 nt, Neisseria meningitidis Z2491
cuuuagggguuucagacg

SEQ ID NO: 3365464 - RNA, 22 nt, Neisseria meningitidis Z2491
cuuucaaaagguucaaacacau

SEQ ID NO: 3365465 - RNA, 19 nt, Neisseria meningitidis Z2491
cuuucaacacgcccuucca

SEQ ID NO: 3365466 - RNA, 22 nt, Neisseria meningitidis Z2491
cuuucaacagguucaaacacau

SEQ ID NO: 3365467 - RNA, 14 nt, Neisseria meningitidis Z2491
cuuucacaaaggag

SEQ ID NO: 3365468 - RNA, 15 nt, Neisseria meningitidis Z2491
cuuucacggcggcaa

SEQ ID NO: 3365469 - RNA, 19 nt, Neisseria meningitidis Z2491
cuuucacgggaaugacgaa

SEQ ID NO: 3365470 - RNA, 22 nt, Neisseria meningitidis Z2491
cuuucagacggcauaaaugcgu

SEQ ID NO: 3365471 - RNA, 21 nt, Neisseria meningitidis Z2491
cuuucagacggcaucaaaaug

SEQ ID NO: 3365472 - RNA, 22 nt, Neisseria meningitidis Z2491
cuuucagacggcaucaaaauga

SEQ ID NO: 3365473 - RNA, 20 nt, Neisseria meningitidis Z2491
cuuucagacggcauuuuaug

SEQ ID NO: 3365474 - RNA, 20 nt, Neisseria meningitidis Z2491
cuuucagacggcauuuuuuu

SEQ ID NO: 3365475 - RNA, 20 nt, Neisseria meningitidis Z2491
cuuucagauaaucuuugaau

SEQ ID NO: 3365476 - RNA, 23 nt, Neisseria meningitidis Z2491
cuuucagcaauaaaauaaagucc

SEQ ID NO: 3365477 - RNA, 14 nt, Neisseria meningitidis Z2491
cuuuccauccauca

SEQ ID NO: 3365478 - RNA, 13 nt, Neisseria meningitidis Z2491
cuuucccucccga

SEQ ID NO: 3365479 - RNA, 16 nt, Neisseria meningitidis Z2491
cuuuccgccgucauuc

SEQ ID NO: 3365480 - RNA, 15 nt, Neisseria meningitidis Z2491
cuuucgccauaaucu

SEQ ID NO: 3365481 - RNA, 14 nt, Neisseria meningitidis Z2491
cuuucgccgccugu

SEQ ID NO: 3365482 - RNA, 21 nt, Neisseria meningitidis Z2491
cuuucgcgagaacgacgggau

SEQ ID NO: 3365483 - RNA, 21 nt, Neisseria meningitidis Z2491
cuuucgcgggaaugacgggau

SEQ ID NO: 3365484 - RNA, 20 nt, Neisseria meningitidis Z2491
cuuucggauaaucuuugaau

SEQ ID NO: 3365485 - RNA, 13 nt, Neisseria meningitidis Z2491
cuuucguauccaa

SEQ ID NO: 3365486 - RNA, 15 nt, Neisseria meningitidis Z2491
cuuucguauccaaau

SEQ ID NO: 3365487 - RNA, 21 nt, Neisseria meningitidis Z2491
cuuucgugggaaugacggcag

SEQ ID NO: 3365488 - RNA, 21 nt, Neisseria meningitidis Z2491
cuuucgugggaaugacgggau

SEQ ID NO: 3365489 - RNA, 16 nt, Neisseria meningitidis Z2491
cuuucucuguuuuucg

SEQ ID NO: 3365490 - RNA, 19 nt, Neisseria meningitidis Z2491
cuuugaaacgguuguucaa

SEQ ID NO: 3365491 - RNA, 16 nt, Neisseria meningitidis Z2491
cuuugagcuaaggcga

SEQ ID NO: 3365492 - RNA, 14 nt, Neisseria meningitidis Z2491
cuuugagcuggauu

SEQ ID NO: 3365493 - RNA, 14 nt, Neisseria meningitidis Z2491
cuuugaguuaaggc

SEQ ID NO: 3365494 - RNA, 22 nt, Neisseria meningitidis Z2491
cuuugaguucgucaaccgugaa

SEQ ID NO: 3365495 - RNA, 19 nt, Neisseria meningitidis Z2491
cuuugcaaaauuccuuucc

SEQ ID NO: 3365496 - RNA, 14 nt, Neisseria meningitidis Z2491
cuuugcaauaacau

SEQ ID NO: 3365497 - RNA, 21 nt, Neisseria meningitidis Z2491
cuuugcccguggcgacggcaa

SEQ ID NO: 3365498 - RNA, 19 nt, Neisseria meningitidis Z2491
cuuugcggcugugcagcuc

SEQ ID NO: 3365499 - RNA, 20 nt, Neisseria meningitidis Z2491
cuuugcguuucuagauuccc

SEQ ID NO: 3365500 - RNA, 22 nt, Neisseria meningitidis Z2491
cuuugcguuucuagauucccac

SEQ ID NO: 3365501 - RNA, 16 nt, Neisseria meningitidis Z2491
cuuugcuggaagcauu

SEQ ID NO: 3365502 - RNA, 21 nt, Neisseria meningitidis Z2491
cuuugcuggaagcauugacca

SEQ ID NO: 3365503 - RNA, 14 nt, Neisseria meningitidis Z2491
cuuuggaacaaaaa

SEQ ID NO: 3365504 - RNA, 20 nt, Neisseria meningitidis Z2491
cuuuggaaugguucggcuug

SEQ ID NO: 3365505 - RNA, 16 nt, Neisseria meningitidis Z2491
cuuuggcaaccgucag

SEQ ID NO: 3365506 - RNA, 15 nt, Neisseria meningitidis Z2491
cuuuggcggcggcag

SEQ ID NO: 3365507 - RNA, 15 nt, Neisseria meningitidis Z2491
cuuuggcugauaagg

SEQ ID NO: 3365508 - RNA, 22 nt, Neisseria meningitidis Z2491
cuuuggcuuccagaccagccgc

SEQ ID NO: 3365509 - RNA, 20 nt, Neisseria meningitidis Z2491
cuuugggcucaaugaaaauu

SEQ ID NO: 3365510 - RNA, 14 nt, Neisseria meningitidis Z2491
cuuugguaaaaaaa

SEQ ID NO: 3365511 - RNA, 16 nt, Neisseria meningitidis Z2491
cuuugguaaaaaaaug

SEQ ID NO: 3365512 - RNA, 22 nt, Neisseria meningitidis Z2491
cuuuguuucaaaauguucaaua

SEQ ID NO: 3365513 - RNA, 15 nt, Neisseria meningitidis Z2491
cuuuuauuuucaaac

SEQ ID NO: 3365514 - RNA, 18 nt, Neisseria meningitidis Z2491
cuuuuauuuucaaacauu

SEQ ID NO: 3365515 - RNA, 16 nt, Neisseria meningitidis Z2491
cuuuucauaucaugcc

SEQ ID NO: 3365516 - RNA, 19 nt, Neisseria meningitidis Z2491
cuuuucaucgucauucccg

SEQ ID NO: 3365517 - RNA, 15 nt, Neisseria meningitidis Z2491
cuuuuccuuccaaaa

SEQ ID NO: 3365518 - RNA, 14 nt, Neisseria meningitidis Z2491
cuuuucgucgaauc

SEQ ID NO: 3365519 - RNA, 13 nt, Neisseria meningitidis Z2491
cuuuucugauuuu

SEQ ID NO: 3365520 - RNA, 16 nt, Neisseria meningitidis Z2491
cuuuucugauuuugag

SEQ ID NO: 3365521 - RNA, 20 nt, Neisseria meningitidis Z2491
cuuuugagccgucauucccg

SEQ ID NO: 3365522 - RNA, 20 nt, Neisseria meningitidis Z2491
cuuuugaguuucggucauuu

SEQ ID NO: 3365523 - RNA, 21 nt, Neisseria meningitidis Z2491
cuuuugcgggaaugacggcag

SEQ ID NO: 3365524 - RNA, 18 nt, Neisseria meningitidis Z2491
cuuuuggcggcuuuuuug

SEQ ID NO: 3365525 - RNA, 21 nt, Neisseria meningitidis Z2491
cuuuugugguuuuaaccugca

SEQ ID NO: 3365526 - RNA, 23 nt, Neisseria meningitidis Z2491
cuuuuuaaacaacaaauuuuuga

SEQ ID NO: 3365527 - RNA, 17 nt, Neisseria meningitidis Z2491
cuuuuuaugccuguucu

SEQ ID NO: 3365528 - RNA, 21 nt, Neisseria meningitidis Z2491
cuuuuuaugccuguucuuuuu

SEQ ID NO: 3365529 - RNA, 15 nt, Neisseria meningitidis Z2491
cuuuuucagacggca

SEQ ID NO: 3365530 - RNA, 16 nt, Neisseria meningitidis Z2491
cuuuuucagacggcau

SEQ ID NO: 3365531 - RNA, 16 nt, Neisseria meningitidis Z2491
cuuuuuccaauucgcu

SEQ ID NO: 3365532 - RNA, 19 nt, Neisseria meningitidis Z2491
cuuuuugcaggaucuuauc

SEQ ID NO: 3365533 - RNA, 23 nt, Neisseria meningitidis Z2491
cuuuuugcgccagcggcaccaau

SEQ ID NO: 3365534 - RNA, 19 nt, Neisseria meningitidis Z2491
cuuuuugcucaauauuagg

SEQ ID NO: 3365535 - RNA, 19 nt, Neisseria meningitidis Z2491
cuuuuuggcgcauuuuuuc

SEQ ID NO: 3365536 - RNA, 17 nt, Neisseria meningitidis Z2491
cuuuuuuauaccgggga

SEQ ID NO: 3365537 - RNA, 16 nt, Neisseria meningitidis Z2491
gaaaguggaacagaaa

SEQ ID NO: 3365538 - RNA, 17 nt, Neisseria meningitidis Z2491
gaaaguuggaauccagu

SEQ ID NO: 3365539 - RNA, 20 nt, Neisseria meningitidis Z2491
gaaaguuuagagguucuaga

SEQ ID NO: 3365540 - RNA, 17 nt, Neisseria meningitidis Z2491
gaaaguuugaaguucua

SEQ ID NO: 3365541 - RNA, 19 nt, Neisseria meningitidis Z2491
gaaaguuugaaguucuaga

SEQ ID NO: 3365542 - RNA, 19 nt, Neisseria meningitidis Z2491
gaaaguuugagguucuaga

SEQ ID NO: 3365543 - RNA, 20 nt, Neisseria meningitidis Z2491
gaaaguuugagguucuagau

SEQ ID NO: 3365544 - RNA, 20 nt, Neisseria meningitidis Z2491
gaaauaaaagcaucuuguuu

SEQ ID NO: 3365545 - RNA, 19 nt, Neisseria meningitidis Z2491
gaaauaccgucugaaagcu

SEQ ID NO: 3365546 - RNA, 20 nt, Neisseria meningitidis Z2491
gaaauacuuaacaaugcccg

SEQ ID NO: 3365547 - RNA, 21 nt, Neisseria meningitidis Z2491
gaaauacuuaacaaugcccgc

SEQ ID NO: 3365548 - RNA, 17 nt, Neisseria meningitidis Z2491
gaaauaugguucagacg

SEQ ID NO: 3365549 - RNA, 22 nt, Neisseria meningitidis Z2491
gaaaucaauccuuccugaugaa

SEQ ID NO: 3365550 - RNA, 13 nt, Neisseria meningitidis Z2491
gaaaucuauaucu

SEQ ID NO: 3365551 - RNA, 15 nt, Neisseria meningitidis Z2491
gaaaugacugaaacu

SEQ ID NO: 3365552 - RNA, 19 nt, Neisseria meningitidis Z2491
gaaaugacugaaacucaaa

SEQ ID NO: 3365553 - RNA, 16 nt, Neisseria meningitidis Z2491
gaaaugaucaggcgga

SEQ ID NO: 3365554 - RNA, 22 nt, Neisseria meningitidis Z2491
gaaaugaucaggcggauuucuc

SEQ ID NO: 3365555 - RNA, 14 nt, Neisseria meningitidis Z2491
gaaaugccgucuga

SEQ ID NO: 3365556 - RNA, 16 nt, Neisseria meningitidis Z2491
gaaaugccgucugaag

SEQ ID NO: 3365557 - RNA, 19 nt, Neisseria meningitidis Z2491
gaaaugccgucugaagccu

SEQ ID NO: 3365558 - RNA, 22 nt, Neisseria meningitidis Z2491
gaaaugccgucugaagccuguu

SEQ ID NO: 3365559 - RNA, 21 nt, Neisseria meningitidis Z2491
gaaaugucgcccgacaaccgc

SEQ ID NO: 3365560 - RNA, 14 nt, Neisseria meningitidis Z2491
gaaauguucagacg

SEQ ID NO: 3365561 - RNA, 18 nt, Neisseria meningitidis Z2491
gaaauguucagacggcau

SEQ ID NO: 3365562 - RNA, 15 nt, Neisseria meningitidis Z2491
gaaauuacccgaaac

SEQ ID NO: 3365563 - RNA, 16 nt, Neisseria meningitidis Z2491
gaaauucaaaaaaccg

SEQ ID NO: 3365564 - RNA, 16 nt, Neisseria meningitidis Z2491
gaaauuccaacauaac

SEQ ID NO: 3365565 - RNA, 19 nt, Neisseria meningitidis Z2491
gaaauuccaacauaaccga

SEQ ID NO: 3365566 - RNA, 19 nt, Neisseria meningitidis Z2491
gaaauuccgauaaggcaag

SEQ ID NO: 3365567 - RNA, 12 nt, Neisseria meningitidis Z2491
gaaauucuagau

SEQ ID NO: 3365568 - RNA, 23 nt, Neisseria meningitidis Z2491
gaaauugcguucgcugacgguau

SEQ ID NO: 3365569 - RNA, 23 nt, Neisseria meningitidis Z2491
gaaauuuugccauucuugcaaaa

SEQ ID NO: 3365570 - RNA, 14 nt, Neisseria meningitidis Z2491
gaacacaaaaaacu

SEQ ID NO: 3365571 - RNA, 21 nt, Neisseria meningitidis Z2491
gaacacgaccaacgccgccga

SEQ ID NO: 3365572 - RNA, 13 nt, Neisseria meningitidis Z2491
gaacacggcggca

SEQ ID NO: 3365573 - RNA, 19 nt, Neisseria meningitidis Z2491
gaacacggcggcacuugcc

SEQ ID NO: 3365574 - RNA, 17 nt, Neisseria meningitidis Z2491
gaacacggguucagacg

SEQ ID NO: 3365575 - RNA, 14 nt, Neisseria meningitidis Z2491
gaacagaaaccuca

SEQ ID NO: 3365576 - RNA, 22 nt, Neisseria meningitidis Z2491
gaacagccugucccccaccgcc

SEQ ID NO: 3365577 - RNA, 13 nt, Neisseria meningitidis Z2491
gaacaggcggcgg

SEQ ID NO: 3365578 - RNA, 14 nt, Neisseria meningitidis Z2491
gaacaggcggcggc

SEQ ID NO: 3365579 - RNA, 16 nt, Neisseria meningitidis Z2491
gaacaggcggcggcau

SEQ ID NO: 3365580 - RNA, 20 nt, Neisseria meningitidis Z2491
gaacaggcuucagacggcau

SEQ ID NO: 3365581 - RNA, 20 nt, Neisseria meningitidis Z2491
gaacauaaaugccgucugaa

SEQ ID NO: 3365582 - RNA, 18 nt, Neisseria meningitidis Z2491
gaacaucuuucagacggc

SEQ ID NO: 3365583 - RNA, 20 nt, Neisseria meningitidis Z2491
gaacaucuuucagacggcau

SEQ ID NO: 3365584 - RNA, 14 nt, Neisseria meningitidis Z2491
gaacauuucagacg

SEQ ID NO: 3365585 - RNA, 18 nt, Neisseria meningitidis Z2491
gaacauuucagacggcau

SEQ ID NO: 3365586 - RNA, 17 nt, Neisseria meningitidis Z2491
gaaccaaauaaacaagg

SEQ ID NO: 3365587 - RNA, 11 nt, Neisseria meningitidis Z2491
gaaccauuucc

SEQ ID NO: 3365588 - RNA, 13 nt, Neisseria meningitidis Z2491
gaaccauuuccac

SEQ ID NO: 3365589 - RNA, 12 nt, Neisseria meningitidis Z2491
gaacccaaaccg

SEQ ID NO: 3365590 - RNA, 13 nt, Neisseria meningitidis Z2491
gaacccaaaccgu

SEQ ID NO: 3365591 - RNA, 20 nt, Neisseria meningitidis Z2491
gaacccaaaggggacagacg

SEQ ID NO: 3365592 - RNA, 18 nt, Neisseria meningitidis Z2491
gaaccgauucacuuggug

SEQ ID NO: 3365593 - RNA, 14 nt, Neisseria meningitidis Z2491
gaaccggauucccg

SEQ ID NO: 3365594 - RNA, 19 nt, Neisseria meningitidis Z2491
gaaccucuaaacuuucaga

SEQ ID NO: 3365595 - RNA, 15 nt, Neisseria meningitidis Z2491
gaaccuggauucccg

SEQ ID NO: 3365596 - RNA, 20 nt, Neisseria meningitidis Z2491
gaacgacgguauaaaccaaa

SEQ ID NO: 3365597 - RNA, 21 nt, Neisseria meningitidis Z2491
gaacgaguuuucagacggcau

SEQ ID NO: 3365598 - RNA, 21 nt, Neisseria meningitidis Z2491
gaacgauucucuaaggugcug

SEQ ID NO: 3365599 - RNA, 19 nt, Neisseria meningitidis Z2491
gaacgauuugaaccauuuc

SEQ ID NO: 3365600 - RNA, 23 nt, Neisseria meningitidis Z2491
gaacgauuuuuuuucuaaccagc

SEQ ID NO: 3365601 - RNA, 14 nt, Neisseria meningitidis Z2491
gaacgcuucagacg

SEQ ID NO: 3365602 - RNA, 20 nt, Neisseria meningitidis Z2491
gaacggcacaaacgccagca

SEQ ID NO: 3365603 - RNA, 15 nt, Neisseria meningitidis Z2491
gaacggguuuucggu

SEQ ID NO: 3365604 - RNA, 18 nt, Neisseria meningitidis Z2491
gaacguaaaaucugaaga

SEQ ID NO: 3365605 - RNA, 23 nt, Neisseria meningitidis Z2491
gaacgucgccccuuuaacggcaa

SEQ ID NO: 3365606 - RNA, 19 nt, Neisseria meningitidis Z2491
gaacgucgggcaacggcaa

SEQ ID NO: 3365607 - RNA, 21 nt, Neisseria meningitidis Z2491
gaacguggaaucuaagaaacc

SEQ ID NO: 3365608 - RNA, 21 nt, Neisseria meningitidis Z2491
gaacugcgguucggacggcau

SEQ ID NO: 3365609 - RNA, 12 nt, Neisseria meningitidis Z2491
gaacuucagacg

SEQ ID NO: 3365610 - RNA, 16 nt, Neisseria meningitidis Z2491
gaacuuuauccccagc

SEQ ID NO: 3365611 - RNA, 19 nt, Neisseria meningitidis Z2491
gaagaacgccaaacccaac

SEQ ID NO: 3365612 - RNA, 20 nt, Neisseria meningitidis Z2491
gaagaagugcguacgcaggc

SEQ ID NO: 3365613 - RNA, 19 nt, Neisseria meningitidis Z2491
gaagagcugcgggaaugac

SEQ ID NO: 3365614 - RNA, 16 nt, Neisseria meningitidis Z2491
gaagcaccaagugaau

SEQ ID NO: 3365615 - RNA, 20 nt, Neisseria meningitidis Z2491
gaagccagggcggauugcag

SEQ ID NO: 3365616 - RNA, 19 nt, Neisseria meningitidis Z2491
gaagccuguuucagacggc

SEQ ID NO: 3365617 - RNA, 20 nt, Neisseria meningitidis Z2491
gaagccuguuucagacggca

SEQ ID NO: 3365618 - RNA, 14 nt, Neisseria meningitidis Z2491
gaagcgaaaagugg

SEQ ID NO: 3365619 - RNA, 14 nt, Neisseria meningitidis Z2491
gaagcgcguuuugc

SEQ ID NO: 3365620 - RNA, 16 nt, Neisseria meningitidis Z2491
gaagcgcguuuugcgu

SEQ ID NO: 3365621 - RNA, 23 nt, Neisseria meningitidis Z2491
gaagcggaaaucguaccaaccgu

SEQ ID NO: 3365622 - RNA, 12 nt, Neisseria meningitidis Z2491
gaagcggcggca

SEQ ID NO: 3365623 - RNA, 18 nt, Neisseria meningitidis Z2491
gaagcguauguggucagg

SEQ ID NO: 3365624 - RNA, 23 nt, Neisseria meningitidis Z2491
gaagcguguuuguuucagacggc

SEQ ID NO: 3365625 - RNA, 14 nt, Neisseria meningitidis Z2491
gaagcuauccgcac

SEQ ID NO: 3365626 - RNA, 16 nt, Neisseria meningitidis Z2491
gaagcucaaaaaaccg

SEQ ID NO: 3365627 - RNA, 14 nt, Neisseria meningitidis Z2491
gaaggcuaucacgg

SEQ ID NO: 3365628 - RNA, 18 nt, Neisseria meningitidis Z2491
gaaggcuucagacggcau

SEQ ID NO: 3365629 - RNA, 14 nt, Neisseria meningitidis Z2491
gaaggguuuuguuu

SEQ ID NO: 3365630 - RNA, 23 nt, Neisseria meningitidis Z2491
gaagguuuuaggcaauugaaaaa

SEQ ID NO: 3365631 - RNA, 14 nt, Neisseria meningitidis Z2491
gaagugggucagcc

SEQ ID NO: 3365632 - RNA, 13 nt, Neisseria meningitidis Z2491
gaaguucuagauu

SEQ ID NO: 3365633 - RNA, 17 nt, Neisseria meningitidis Z2491
gaaguuucagacggcau

SEQ ID NO: 3365634 - RNA, 15 nt, Neisseria meningitidis Z2491
gaauacggcaacauc

SEQ ID NO: 3365635 - RNA, 16 nt, Neisseria meningitidis Z2491
gaauacggcaacauca

SEQ ID NO: 3365636 - RNA, 23 nt, Neisseria meningitidis Z2491
gaauacugccuguaaaaccaagu

SEQ ID NO: 3365637 - RNA, 19 nt, Neisseria meningitidis Z2491
gaauauugcuguuguucua

SEQ ID NO: 3365638 - RNA, 16 nt, Neisseria meningitidis Z2491
gaccguaucauacaua

SEQ ID NO: 3365639 - RNA, 14 nt, Neisseria meningitidis Z2491
gaccguguuuccaa

SEQ ID NO: 3365640 - RNA, 19 nt, Neisseria meningitidis Z2491
gaccguuccgaaaccaaga

SEQ ID NO: 3365641 - RNA, 16 nt, Neisseria meningitidis Z2491
gaccugauaaacgcuc

SEQ ID NO: 3365642 - RNA, 14 nt, Neisseria meningitidis Z2491
gaccuguaaaauau

SEQ ID NO: 3365643 - RNA, 17 nt, Neisseria meningitidis Z2491
gaccuuagaacaacagu

SEQ ID NO: 3365644 - RNA, 19 nt, Neisseria meningitidis Z2491
gaccuucgggcagcggcaa

SEQ ID NO: 3365645 - RNA, 15 nt, Neisseria meningitidis Z2491
gaccuuugcaaaaau

SEQ ID NO: 3365646 - RNA, 13 nt, Neisseria meningitidis Z2491
gacgaaaaccugu

SEQ ID NO: 3365647 - RNA, 18 nt, Neisseria meningitidis Z2491
gacgaaaaucggcgcagu

SEQ ID NO: 3365648 - RNA, 12 nt, Neisseria meningitidis Z2491
gacgaaaccaga

SEQ ID NO: 3365649 - RNA, 20 nt, Neisseria meningitidis Z2491
gacgaagaaauagccgccgc

SEQ ID NO: 3365650 - RNA, 22 nt, Neisseria meningitidis Z2491
gacgaagaaauagccgccgccg

SEQ ID NO: 3365651 - RNA, 23 nt, Neisseria meningitidis Z2491
gacgaagcuauccgcacagaaac

SEQ ID NO: 3365652 - RNA, 15 nt, Neisseria meningitidis Z2491
gacgaccaucgucca

SEQ ID NO: 3365653 - RNA, 18 nt, Neisseria meningitidis Z2491
gacgaugaguuuuuugcc

SEQ ID NO: 3365654 - RNA, 17 nt, Neisseria meningitidis Z2491
gacgaugccgaacagcu

SEQ ID NO: 3365655 - RNA, 20 nt, Neisseria meningitidis Z2491
gacgcaggguuaagaaaacc

SEQ ID NO: 3365656 - RNA, 14 nt, Neisseria meningitidis Z2491
gacgcauaaaaaug

SEQ ID NO: 3365657 - RNA, 14 nt, Neisseria meningitidis Z2491
gacggaaacucaaa

SEQ ID NO: 3365658 - RNA, 16 nt, Neisseria meningitidis Z2491
gacggacacgcccuca

SEQ ID NO: 3365659 - RNA, 20 nt, Neisseria meningitidis Z2491
gacggaguuucaggcggcau

SEQ ID NO: 3365660 - RNA, 17 nt, Neisseria meningitidis Z2491
gacggaucauagacauc

SEQ ID NO: 3365661 - RNA, 15 nt, Neisseria meningitidis Z2491
gacggcaauauucaa

SEQ ID NO: 3365662 - RNA, 15 nt, Neisseria meningitidis Z2491
gacggcauauguuuu

SEQ ID NO: 3365663 - RNA, 22 nt, Neisseria meningitidis Z2491
gacggcauauguuuuuuccugu

SEQ ID NO: 3365664 - RNA, 15 nt, Neisseria meningitidis Z2491
gacggcauuaaaauu

SEQ ID NO: 3365665 - RNA, 20 nt, Neisseria meningitidis Z2491
gacggcauuuucaacagcag

SEQ ID NO: 3365666 - RNA, 17 nt, Neisseria meningitidis Z2491
gacggcauuuucuauuu

SEQ ID NO: 3365667 - RNA, 23 nt, Neisseria meningitidis Z2491
gacggcauuuucuauuuuacagc

SEQ ID NO: 3365668 - RNA, 17 nt, Neisseria meningitidis Z2491
gacggcauuuuucauuu

SEQ ID NO: 3365669 - RNA, 21 nt, Neisseria meningitidis Z2491
gacggcauuuuuguguggcgg

SEQ ID NO: 3365670 - RNA, 22 nt, Neisseria meningitidis Z2491
gacggcauuuuuguguggcggu

SEQ ID NO: 3365671 - RNA, 21 nt, Neisseria meningitidis Z2491
gacggccuucgcgguuuuccg

SEQ ID NO: 3365672 - RNA, 19 nt, Neisseria meningitidis Z2491
gacggcguauuguuccgau

SEQ ID NO: 3365673 - RNA, 21 nt, Neisseria meningitidis Z2491
gacggcguuucuuguuuuugg

SEQ ID NO: 3365674 - RNA, 22 nt, Neisseria meningitidis Z2491
gacggcguuuuuguuuuauauu

SEQ ID NO: 3365675 - RNA, 20 nt, Neisseria meningitidis Z2491
gacggcguuuuuuauauggc

SEQ ID NO: 3365676 - RNA, 15 nt, Neisseria meningitidis Z2491
gacgggaaguuuuuu

SEQ ID NO: 3365677 - RNA, 17 nt, Neisseria meningitidis Z2491
gacgggauauagguuuc

SEQ ID NO: 3365678 - RNA, 18 nt, Neisseria meningitidis Z2491
gacgggauuuuagguuuc

SEQ ID NO: 3365679 - RNA, 22 nt, Neisseria meningitidis Z2491
gacgggauuuuagguuucugau

SEQ ID NO: 3365680 - RNA, 19 nt, Neisseria meningitidis Z2491
gacggggguuuggcgggaa

SEQ ID NO: 3365681 - RNA, 21 nt, Neisseria meningitidis Z2491
gacgguaucgccguuuugcag

SEQ ID NO: 3365682 - RNA, 13 nt, Neisseria meningitidis Z2491
gacggucaggaag

SEQ ID NO: 3365683 - RNA, 14 nt, Neisseria meningitidis Z2491
gacgguucggacac

SEQ ID NO: 3365684 - RNA, 18 nt, Neisseria meningitidis Z2491
gacgguucguccagcagc

SEQ ID NO: 3365685 - RNA, 18 nt, Neisseria meningitidis Z2491
gacguaaaaucuauagug

SEQ ID NO: 3365686 - RNA, 21 nt, Neisseria meningitidis Z2491
gacguaaaaucuauaguggau

SEQ ID NO: 3365687 - RNA, 19 nt, Neisseria meningitidis Z2491
gacguacaucaggcggcgu

SEQ ID NO: 3365688 - RNA, 19 nt, Neisseria meningitidis Z2491
gacguaguuuacugugucg

SEQ ID NO: 3365689 - RNA, 13 nt, Neisseria meningitidis Z2491
gacguugccuucu

SEQ ID NO: 3365690 - RNA, 17 nt, Neisseria meningitidis Z2491
gacguuuccgcccugcc

SEQ ID NO: 3365691 - RNA, 19 nt, Neisseria meningitidis Z2491
gacguuuuggaagcggaaa

SEQ ID NO: 3365692 - RNA, 17 nt, Neisseria meningitidis Z2491
gacuaaccgaaaauaau

SEQ ID NO: 3365693 - RNA, 13 nt, Neisseria meningitidis Z2491
gacuauuuuugca

SEQ ID NO: 3365694 - RNA, 15 nt, Neisseria meningitidis Z2491
gacuauuuuugcaaa

SEQ ID NO: 3365695 - RNA, 16 nt, Neisseria meningitidis Z2491
gacuauuuuugcaaag

SEQ ID NO: 3365696 - RNA, 15 nt, Neisseria meningitidis Z2491
gacucgcuugcuggu

SEQ ID NO: 3365697 - RNA, 21 nt, Neisseria meningitidis Z2491
gacucgcuugcugguaacauu

SEQ ID NO: 3365698 - RNA, 11 nt, Neisseria meningitidis Z2491
gacugaaacuc

SEQ ID NO: 3365699 - RNA, 18 nt, Neisseria meningitidis Z2491
gacugaaacucaaaaaaa

SEQ ID NO: 3365700 - RNA, 21 nt, Neisseria meningitidis Z2491
gacugaaacucaaaaaaacua

SEQ ID NO: 3365701 - RNA, 23 nt, Neisseria meningitidis Z2491
gacugaaacucaacgaaccugga

SEQ ID NO: 3365702 - RNA, 15 nt, Neisseria meningitidis Z2491
gacugaauaaacagc

SEQ ID NO: 3365703 - RNA, 19 nt, Neisseria meningitidis Z2491
gacuguccgagacagaacc

SEQ ID NO: 3365704 - RNA, 16 nt, Neisseria meningitidis Z2491
gacuucgauugccaag

SEQ ID NO: 3365705 - RNA, 14 nt, Neisseria meningitidis Z2491
gacuucgggcgcgu

SEQ ID NO: 3365706 - RNA, 14 nt, Neisseria meningitidis Z2491
gacuuucagauaau

SEQ ID NO: 3365707 - RNA, 22 nt, Neisseria meningitidis Z2491
gacuuucagauaaucuuugaau

SEQ ID NO: 3365708 - RNA, 15 nt, Neisseria meningitidis Z2491
gacuuuggaacaaaa

SEQ ID NO: 3365709 - RNA, 12 nt, Neisseria meningitidis Z2491
gagaaaacagaa

SEQ ID NO: 3365710 - RNA, 12 nt, Neisseria meningitidis Z2491
gagaacagaaaa

SEQ ID NO: 3365711 - RNA, 23 nt, Neisseria meningitidis Z2491
gagaacagaaaaccaaaaacaga

SEQ ID NO: 3365712 - RNA, 20 nt, Neisseria meningitidis Z2491
gagaaucguucucuuugagu

SEQ ID NO: 3365713 - RNA, 21 nt, Neisseria meningitidis Z2491
gagacaacgccguacugguuu

SEQ ID NO: 3365714 - RNA, 21 nt, Neisseria meningitidis Z2491
gagaggcuuucagacggccuu

SEQ ID NO: 3365715 - RNA, 13 nt, Neisseria meningitidis Z2491
gagaugcggugcg

SEQ ID NO: 3365716 - RNA, 18 nt, Neisseria meningitidis Z2491
gagauucuagauucccgc

SEQ ID NO: 3365717 - RNA, 24 nt, Neisseria meningitidis Z2491
gagauuucgcgguagguauuuugc

SEQ ID NO: 3365718 - RNA, 19 nt, Neisseria meningitidis Z2491
gagauuuuacguucuagau

SEQ ID NO: 3365719 - RNA, 10 nt, Neisseria meningitidis Z2491
gagcaaaaag

SEQ ID NO: 3365720 - RNA, 17 nt, Neisseria meningitidis Z2491
gagcaagaccaaacaga

SEQ ID NO: 3365721 - RNA, 19 nt, Neisseria meningitidis Z2491
gagcaagaccaaacagaac

SEQ ID NO: 3365722 - RNA, 23 nt, Neisseria meningitidis Z2491
gagcagauugacccaaugugcgc

SEQ ID NO: 3365723 - RNA, 20 nt, Neisseria meningitidis Z2491
gagcaggcacaaggcggcgg

SEQ ID NO: 3365724 - RNA, 11 nt, Neisseria meningitidis Z2491
gagcaggcagc

SEQ ID NO: 3365725 - RNA, 16 nt, Neisseria meningitidis Z2491
gagcaggguuuucaug

SEQ ID NO: 3365726 - RNA, 18 nt, Neisseria meningitidis Z2491
gagcaggugcuggguggu

SEQ ID NO: 3365727 - RNA, 23 nt, Neisseria meningitidis Z2491
gagcaugaguuccugcgagccuu

SEQ ID NO: 3365728 - RNA, 14 nt, Neisseria meningitidis Z2491
gagcgagcgggcgu

SEQ ID NO: 3365729 - RNA, 14 nt, Neisseria meningitidis Z2491
gagcgcaaccuugc

SEQ ID NO: 3365730 - RNA, 23 nt, Neisseria meningitidis Z2491
gagcgggcgcacuucaaguccga

SEQ ID NO: 3365731 - RNA, 15 nt, Neisseria meningitidis Z2491
gagcguucagacggc

SEQ ID NO: 3365732 - RNA, 24 nt, Neisseria meningitidis Z2491
gagcucggucagauagcggucgga

SEQ ID NO: 3365733 - RNA, 21 nt, Neisseria meningitidis Z2491
gaggaaaguccgggcuccgca

SEQ ID NO: 3365734 - RNA, 20 nt, Neisseria meningitidis Z2491
gaggaagaugucgggggcgg

SEQ ID NO: 3365735 - RNA, 14 nt, Neisseria meningitidis Z2491
gaggaugacgguau

SEQ ID NO: 3365736 - RNA, 15 nt, Neisseria meningitidis Z2491
gaggauuaagggggu

SEQ ID NO: 3365737 - RNA, 21 nt, Neisseria meningitidis Z2491
gaggcaacgcuguacugguuu

SEQ ID NO: 3365738 - RNA, 17 nt, Neisseria meningitidis Z2491
gaggcauugaaauucca

SEQ ID NO: 3365739 - RNA, 17 nt, Neisseria meningitidis Z2491
gauugaccgaaaaauaa

SEQ ID NO: 3365740 - RNA, 14 nt, Neisseria meningitidis Z2491
gauugauaaaagca

SEQ ID NO: 3365741 - RNA, 19 nt, Neisseria meningitidis Z2491
gauugcgacauuuaucggg

SEQ ID NO: 3365742 - RNA, 16 nt, Neisseria meningitidis Z2491
gauuguacggcagcca

SEQ ID NO: 3365743 - RNA, 16 nt, Neisseria meningitidis Z2491
gauugucaaaauacau

SEQ ID NO: 3365744 - RNA, 15 nt, Neisseria meningitidis Z2491
gauuuccuuaaaaaa

SEQ ID NO: 3365745 - RNA, 23 nt, Neisseria meningitidis Z2491
gauuucguaauccgcaauauuca

SEQ ID NO: 3365746 - RNA, 10 nt, Neisseria meningitidis Z2491
gauuucuguu

SEQ ID NO: 3365747 - RNA, 15 nt, Neisseria meningitidis Z2491
gauuugaacgacggu

SEQ ID NO: 3365748 - RNA, 20 nt, Neisseria meningitidis Z2491
gauuugaaucugacuugcca

SEQ ID NO: 3365749 - RNA, 15 nt, Neisseria meningitidis Z2491
gauuuucaaaucuuc

SEQ ID NO: 3365750 - RNA, 19 nt, Neisseria meningitidis Z2491
gauuuugguuuauuuuugg

SEQ ID NO: 3365751 - RNA, 15 nt, Neisseria meningitidis Z2491
gauuuugguuuucug

SEQ ID NO: 3365752 - RNA, 16 nt, Neisseria meningitidis Z2491
gauuuuuccuacuuuu

SEQ ID NO: 3365753 - RNA, 21 nt, Neisseria meningitidis Z2491
gauuuuuccuacuuuuugcuc

SEQ ID NO: 3365754 - RNA, 23 nt, Neisseria meningitidis Z2491
gauuuuuccuacuuuuugcucaa

SEQ ID NO: 3365755 - RNA, 17 nt, Neisseria meningitidis Z2491
gauuuuuguuaauccac

SEQ ID NO: 3365756 - RNA, 19 nt, Neisseria meningitidis Z2491
gcaaaaaaagaugccgucu

SEQ ID NO: 3365757 - RNA, 16 nt, Neisseria meningitidis Z2491
gcaaaaacaaaaaaaa

SEQ ID NO: 3365758 - RNA, 17 nt, Neisseria meningitidis Z2491
gcaaaaaggccgucuga

SEQ ID NO: 3365759 - RNA, 17 nt, Neisseria meningitidis Z2491
gcaaaaaguccuucacg

SEQ ID NO: 3365760 - RNA, 12 nt, Neisseria meningitidis Z2491
gcaaaaauuuau

SEQ ID NO: 3365761 - RNA, 13 nt, Neisseria meningitidis Z2491
gcaaaaccgccga

SEQ ID NO: 3365762 - RNA, 17 nt, Neisseria meningitidis Z2491
gcaaaaccggcuugaac

SEQ ID NO: 3365763 - RNA, 22 nt, Neisseria meningitidis Z2491
gcaaaacuuuucugauuuuucc

SEQ ID NO: 3365764 - RNA, 16 nt, Neisseria meningitidis Z2491
gcaaaagaccgucuga

SEQ ID NO: 3365765 - RNA, 21 nt, Neisseria meningitidis Z2491
gcaaaagaccgucugaacagu

SEQ ID NO: 3365766 - RNA, 20 nt, Neisseria meningitidis Z2491
gcaaaagcgggaaucuagaa

SEQ ID NO: 3365767 - RNA, 21 nt, Neisseria meningitidis Z2491
gcaaaauaaaaugccgucuga

SEQ ID NO: 3365768 - RNA, 15 nt, Neisseria meningitidis Z2491
gcaaaauagaaaacc

SEQ ID NO: 3365769 - RNA, 11 nt, Neisseria meningitidis Z2491
gcaaaauaugg

SEQ ID NO: 3365770 - RNA, 14 nt, Neisseria meningitidis Z2491
gcaaaaucagcaca

SEQ ID NO: 3365771 - RNA, 16 nt, Neisseria meningitidis Z2491
gcaaaaucagcacaaa

SEQ ID NO: 3365772 - RNA, 19 nt, Neisseria meningitidis Z2491
gcaaaaucagcacaaaugc

SEQ ID NO: 3365773 - RNA, 19 nt, Neisseria meningitidis Z2491
gcaaaaucuggauuacuga

SEQ ID NO: 3365774 - RNA, 14 nt, Neisseria meningitidis Z2491
gcaaaauuuauccg

SEQ ID NO: 3365775 - RNA, 14 nt, Neisseria meningitidis Z2491
gcaaaauuucagau

SEQ ID NO: 3365776 - RNA, 23 nt, Neisseria meningitidis Z2491
gcaaacaaaauaucguuuuccaa

SEQ ID NO: 3365777 - RNA, 14 nt, Neisseria meningitidis Z2491
gcaaacggcaggca

SEQ ID NO: 3365778 - RNA, 20 nt, Neisseria meningitidis Z2491
gcaaacuaacuuauacacac

SEQ ID NO: 3365779 - RNA, 19 nt, Neisseria meningitidis Z2491
gcaaacuauaucuauacua

SEQ ID NO: 3365780 - RNA, 21 nt, Neisseria meningitidis Z2491
gcaaacuccuuggaaugguug

SEQ ID NO: 3365781 - RNA, 18 nt, Neisseria meningitidis Z2491
gcaaagccgccgccgaca

SEQ ID NO: 3365782 - RNA, 21 nt, Neisseria meningitidis Z2491
gcaaagccuccgacugcucgg

SEQ ID NO: 3365783 - RNA, 15 nt, Neisseria meningitidis Z2491
gcaaagcggcaauca

SEQ ID NO: 3365784 - RNA, 15 nt, Neisseria meningitidis Z2491
gcaaagucauauuaa

SEQ ID NO: 3365785 - RNA, 18 nt, Neisseria meningitidis Z2491
gcaaagucauauuaauua

SEQ ID NO: 3365786 - RNA, 10 nt, Neisseria meningitidis Z2491
gcaaauaauu

SEQ ID NO: 3365787 - RNA, 19 nt, Neisseria meningitidis Z2491
gcaaauaauugaaaucaac

SEQ ID NO: 3365788 - RNA, 22 nt, Neisseria meningitidis Z2491
gcaaauacuucguauuccgaca

SEQ ID NO: 3365789 - RNA, 14 nt, Neisseria meningitidis Z2491
gcaaaucaggcagg

SEQ ID NO: 3365790 - RNA, 23 nt, Neisseria meningitidis Z2491
gcaaaucgaugcguuccugccag

SEQ ID NO: 3365791 - RNA, 17 nt, Neisseria meningitidis Z2491
gcaaaucggcuucagac

SEQ ID NO: 3365792 - RNA, 18 nt, Neisseria meningitidis Z2491
gcaaaucggcuucagaca

SEQ ID NO: 3365793 - RNA, 12 nt, Neisseria meningitidis Z2491
gcaaaugccguc

SEQ ID NO: 3365794 - RNA, 17 nt, Neisseria meningitidis Z2491
gcaaaugccgucugaaa

SEQ ID NO: 3365795 - RNA, 20 nt, Neisseria meningitidis Z2491
gcaaaugccgucugaaaggc

SEQ ID NO: 3365796 - RNA, 15 nt, Neisseria meningitidis Z2491
gcaaaugcugucuga

SEQ ID NO: 3365797 - RNA, 20 nt, Neisseria meningitidis Z2491
gcaaauuccagcaaugcguc

SEQ ID NO: 3365798 - RNA, 21 nt, Neisseria meningitidis Z2491
gcaaauugaaaugccgucuga

SEQ ID NO: 3365799 - RNA, 22 nt, Neisseria meningitidis Z2491
gcaaauugaaaugccgucugaa

SEQ ID NO: 3365800 - RNA, 14 nt, Neisseria meningitidis Z2491
gcaaccaaaaccga

SEQ ID NO: 3365801 - RNA, 17 nt, Neisseria meningitidis Z2491
gcaaccaacgaaacacu

SEQ ID NO: 3365802 - RNA, 23 nt, Neisseria meningitidis Z2491
gcaacccugucgccgucauuccc

SEQ ID NO: 3365803 - RNA, 16 nt, Neisseria meningitidis Z2491
gcaaccgguccuucca

SEQ ID NO: 3365804 - RNA, 22 nt, Neisseria meningitidis Z2491
gcaaccuuuccgccgucauucc

SEQ ID NO: 3365805 - RNA, 23 nt, Neisseria meningitidis Z2491
gcaaccuuuccgccgucauuccc

SEQ ID NO: 3365806 - RNA, 19 nt, Neisseria meningitidis Z2491
gcaaccuuucgucauuccc

SEQ ID NO: 3365807 - RNA, 17 nt, Neisseria meningitidis Z2491
gcaacgacagcagcagc

SEQ ID NO: 3365808 - RNA, 18 nt, Neisseria meningitidis Z2491
gcaacgacagcagcagcc

SEQ ID NO: 3365809 - RNA, 21 nt, Neisseria meningitidis Z2491
gcaacgccguacugguuuuug

SEQ ID NO: 3365810 - RNA, 19 nt, Neisseria meningitidis Z2491
gcaacucuccgucauuccc

SEQ ID NO: 3365811 - RNA, 22 nt, Neisseria meningitidis Z2491
gcaacucuccgucauucccacg

SEQ ID NO: 3365812 - RNA, 19 nt, Neisseria meningitidis Z2491
gcaacugaaccgucauucc

SEQ ID NO: 3365813 - RNA, 17 nt, Neisseria meningitidis Z2491
gcaacuuugcguuucua

SEQ ID NO: 3365814 - RNA, 21 nt, Neisseria meningitidis Z2491
gcaacuuugcguuucuagauu

SEQ ID NO: 3365815 - RNA, 12 nt, Neisseria meningitidis Z2491
gcaagaauuuau

SEQ ID NO: 3365816 - RNA, 18 nt, Neisseria meningitidis Z2491
gcaagaccaaacagaacg

SEQ ID NO: 3365817 - RNA, 23 nt, Neisseria meningitidis Z2491
gcaagacgaagaaauagccgccg

SEQ ID NO: 3365818 - RNA, 16 nt, Neisseria meningitidis Z2491
gcaagacuuuuucgcg

SEQ ID NO: 3365819 - RNA, 20 nt, Neisseria meningitidis Z2491
gcaagcagcaggcguucgga

SEQ ID NO: 3365820 - RNA, 16 nt, Neisseria meningitidis Z2491
gcaagcagggcuuuug

SEQ ID NO: 3365821 - RNA, 20 nt, Neisseria meningitidis Z2491
gcaagcaguugaaaucaaca

SEQ ID NO: 3365822 - RNA, 15 nt, Neisseria meningitidis Z2491
gcaagccuuucaaca

SEQ ID NO: 3365823 - RNA, 23 nt, Neisseria meningitidis Z2491
gcaagccuuucaacaaucugcau

SEQ ID NO: 3365824 - RNA, 14 nt, Neisseria meningitidis Z2491
gcaagcguguccug

SEQ ID NO: 3365825 - RNA, 19 nt, Neisseria meningitidis Z2491
gcaagcguucacgccagca

SEQ ID NO: 3365826 - RNA, 14 nt, Neisseria meningitidis Z2491
gcaaggcgccggcg

SEQ ID NO: 3365827 - RNA, 13 nt, Neisseria meningitidis Z2491
gcaaggcggcggc

SEQ ID NO: 3365828 - RNA, 23 nt, Neisseria meningitidis Z2491
gcaaggucggcggcggauucggu

SEQ ID NO: 3365829 - RNA, 23 nt, Neisseria meningitidis Z2491
gcaaguuccaagauggcgagcga

SEQ ID NO: 3365830 - RNA, 18 nt, Neisseria meningitidis Z2491
gcaauaauggcaaccaaa

SEQ ID NO: 3365831 - RNA, 18 nt, Neisseria meningitidis Z2491
gcaauaccgcaaccugaa

SEQ ID NO: 3365832 - RNA, 12 nt, Neisseria meningitidis Z2491
gcaauacggcga

SEQ ID NO: 3365833 - RNA, 20 nt, Neisseria meningitidis Z2491
gcaauagaagaagcguuuug

SEQ ID NO: 3365834 - RNA, 20 nt, Neisseria meningitidis Z2491
gcaauagaagccaaaauauc

SEQ ID NO: 3365835 - RNA, 19 nt, Neisseria meningitidis Z2491
gcaauauacugauuuauau

SEQ ID NO: 3365836 - RNA, 16 nt, Neisseria meningitidis Z2491
gcaauaucuugccgau

SEQ ID NO: 3365837 - RNA, 14 nt, Neisseria meningitidis Z2491
gcaauauucaaaga

SEQ ID NO: 3365838 - RNA, 23 nt, Neisseria meningitidis Z2491
gcaauauucaaagauuaucugaa

SEQ ID NO: 3365839 - RNA, 22 nt, Neisseria meningitidis Z2491
gcaauauugcuccugacggcaa

SEQ ID NO: 3365840 - RNA, 14 nt, Neisseria meningitidis Z2491
gcagugggauuuug

SEQ ID NO: 3365841 - RNA, 15 nt, Neisseria meningitidis Z2491
gcaguugaaaucaac

SEQ ID NO: 3365842 - RNA, 17 nt, Neisseria meningitidis Z2491
gcaguugaaaucaacag

SEQ ID NO: 3365843 - RNA, 18 nt, Neisseria meningitidis Z2491
gcaguugugcgccgacuu

SEQ ID NO: 3365844 - RNA, 16 nt, Neisseria meningitidis Z2491
gcauaaaucaacagca

SEQ ID NO: 3365845 - RNA, 17 nt, Neisseria meningitidis Z2491
gcauaaaucaacagcag

SEQ ID NO: 3365846 - RNA, 11 nt, Neisseria meningitidis Z2491
gcauaaauccu

SEQ ID NO: 3365847 - RNA, 14 nt, Neisseria meningitidis Z2491
gcauaaauccuuca

SEQ ID NO: 3365848 - RNA, 14 nt, Neisseria meningitidis Z2491
gcauaauaaaaaua

SEQ ID NO: 3365849 - RNA, 20 nt, Neisseria meningitidis Z2491
gcauaaucaauuaaaaacaa

SEQ ID NO: 3365850 - RNA, 19 nt, Neisseria meningitidis Z2491
gcauacgaaacggguucug

SEQ ID NO: 3365851 - RNA, 18 nt, Neisseria meningitidis Z2491
gcauacgguuuuccgccu

SEQ ID NO: 3365852 - RNA, 19 nt, Neisseria meningitidis Z2491
gcauacgguuuuccgccug

SEQ ID NO: 3365853 - RNA, 21 nt, Neisseria meningitidis Z2491
gcauaguuuccggcaagcagg

SEQ ID NO: 3365854 - RNA, 22 nt, Neisseria meningitidis Z2491
gcauaguuuccggcaagcaggg

SEQ ID NO: 3365855 - RNA, 22 nt, Neisseria meningitidis Z2491
gcauaucgucgggcugccaagc

SEQ ID NO: 3365856 - RNA, 19 nt, Neisseria meningitidis Z2491
gcauaugccauuacauucu

SEQ ID NO: 3365857 - RNA, 15 nt, Neisseria meningitidis Z2491
gcauauguuucaaca

SEQ ID NO: 3365858 - RNA, 16 nt, Neisseria meningitidis Z2491
gcauauguuucaacac

SEQ ID NO: 3365859 - RNA, 18 nt, Neisseria meningitidis Z2491
gcaucaaaccauauggaa

SEQ ID NO: 3365860 - RNA, 15 nt, Neisseria meningitidis Z2491
gcaucacauaaugcc

SEQ ID NO: 3365861 - RNA, 13 nt, Neisseria meningitidis Z2491
gcaucacgacggu

SEQ ID NO: 3365862 - RNA, 19 nt, Neisseria meningitidis Z2491
gcaucaggaacaucagcac

SEQ ID NO: 3365863 - RNA, 14 nt, Neisseria meningitidis Z2491
gcaucaguauuuua

SEQ ID NO: 3365864 - RNA, 15 nt, Neisseria meningitidis Z2491
gcaucauauugguuc

SEQ ID NO: 3365865 - RNA, 15 nt, Neisseria meningitidis Z2491
gcaucaucacgcuga

SEQ ID NO: 3365866 - RNA, 16 nt, Neisseria meningitidis Z2491
gcauccgagccgccgu

SEQ ID NO: 3365867 - RNA, 18 nt, Neisseria meningitidis Z2491
gcauccgcuuaaaaaaca

SEQ ID NO: 3365868 - RNA, 15 nt, Neisseria meningitidis Z2491
gcauccgggcugcuu

SEQ ID NO: 3365869 - RNA, 20 nt, Neisseria meningitidis Z2491
gcaucgccgcuucaucuuua

SEQ ID NO: 3365870 - RNA, 17 nt, Neisseria meningitidis Z2491
gcaucggaaacagccag

SEQ ID NO: 3365871 - RNA, 16 nt, Neisseria meningitidis Z2491
gcaucguaaaaaugcc

SEQ ID NO: 3365872 - RNA, 14 nt, Neisseria meningitidis Z2491
gcaucguaaggcug

SEQ ID NO: 3365873 - RNA, 18 nt, Neisseria meningitidis Z2491
gcaucguccacuucaacc

SEQ ID NO: 3365874 - RNA, 19 nt, Neisseria meningitidis Z2491
gcaucgucgggaaaaauau

SEQ ID NO: 3365875 - RNA, 18 nt, Neisseria meningitidis Z2491
gcaucguuacaaauuuaa

SEQ ID NO: 3365876 - RNA, 20 nt, Neisseria meningitidis Z2491
gcauggcgacaaucucgucc

SEQ ID NO: 3365877 - RNA, 15 nt, Neisseria meningitidis Z2491
gcauucagacggcau

SEQ ID NO: 3365878 - RNA, 22 nt, Neisseria meningitidis Z2491
gcauuuaucggauaaaacagaa

SEQ ID NO: 3365879 - RNA, 17 nt, Neisseria meningitidis Z2491
gcauuucauuauccgcc

SEQ ID NO: 3365880 - RNA, 21 nt, Neisseria meningitidis Z2491
gcauuuccacaucguucaaac

SEQ ID NO: 3365881 - RNA, 22 nt, Neisseria meningitidis Z2491
gcauuuccggcaucgcaacucc

SEQ ID NO: 3365882 - RNA, 22 nt, Neisseria meningitidis Z2491
gcauuuccuuuaaacucuuaaa

SEQ ID NO: 3365883 - RNA, 18 nt, Neisseria meningitidis Z2491
gcauuucggcaguuuuca

SEQ ID NO: 3365884 - RNA, 16 nt, Neisseria meningitidis Z2491
gcauuuuuaucuuuuu

SEQ ID NO: 3365885 - RNA, 11 nt, Neisseria meningitidis Z2491
gccaaaaacag

SEQ ID NO: 3365886 - RNA, 15 nt, Neisseria meningitidis Z2491
gccaaaccgcagcaa

SEQ ID NO: 3365887 - RNA, 23 nt, Neisseria meningitidis Z2491
gccaaagcguaaagccgcgucca

SEQ ID NO: 3365888 - RNA, 15 nt, Neisseria meningitidis Z2491
gccaaaguauccgcg

SEQ ID NO: 3365889 - RNA, 15 nt, Neisseria meningitidis Z2491
gccaaagugccaaau

SEQ ID NO: 3365890 - RNA, 22 nt, Neisseria meningitidis Z2491
gccaacccuugugcuucuucga

SEQ ID NO: 3365891 - RNA, 19 nt, Neisseria meningitidis Z2491
gccaaccguuccaacgcga

SEQ ID NO: 3365892 - RNA, 11 nt, Neisseria meningitidis Z2491
gccaaccugcu

SEQ ID NO: 3365893 - RNA, 12 nt, Neisseria meningitidis Z2491
gccaaccugcug

SEQ ID NO: 3365894 - RNA, 16 nt, Neisseria meningitidis Z2491
gccaaggcuuucagau

SEQ ID NO: 3365895 - RNA, 19 nt, Neisseria meningitidis Z2491
gccaaucucuuaaccaugc

SEQ ID NO: 3365896 - RNA, 12 nt, Neisseria meningitidis Z2491
gccaaugccguc

SEQ ID NO: 3365897 - RNA, 15 nt, Neisseria meningitidis Z2491
gccaaugccgucuga

SEQ ID NO: 3365898 - RNA, 16 nt, Neisseria meningitidis Z2491
gccaaugccgucugaa

SEQ ID NO: 3365899 - RNA, 17 nt, Neisseria meningitidis Z2491
gccaaugccgucugaag

SEQ ID NO: 3365900 - RNA, 14 nt, Neisseria meningitidis Z2491
gccaauuccuucau

SEQ ID NO: 3365901 - RNA, 21 nt, Neisseria meningitidis Z2491
gccacaauauaaucaaacuca

SEQ ID NO: 3365902 - RNA, 21 nt, Neisseria meningitidis Z2491
gccaccagcgguacauccaau

SEQ ID NO: 3365903 - RNA, 14 nt, Neisseria meningitidis Z2491
gccacgccaaaaau

SEQ ID NO: 3365904 - RNA, 18 nt, Neisseria meningitidis Z2491
gccacgccgaacccgacu

SEQ ID NO: 3365905 - RNA, 14 nt, Neisseria meningitidis Z2491
gccacgccgacugc

SEQ ID NO: 3365906 - RNA, 14 nt, Neisseria meningitidis Z2491
gccacggcauaaca

SEQ ID NO: 3365907 - RNA, 19 nt, Neisseria meningitidis Z2491
gccacggcuuucgcgccgc

SEQ ID NO: 3365908 - RNA, 21 nt, Neisseria meningitidis Z2491
gccacggcuuucgcgccgcgc

SEQ ID NO: 3365909 - RNA, 23 nt, Neisseria meningitidis Z2491
gccacuuuuugcgccagcggcac

SEQ ID NO: 3365910 - RNA, 17 nt, Neisseria meningitidis Z2491
gccagagagccgcaggc

SEQ ID NO: 3365911 - RNA, 19 nt, Neisseria meningitidis Z2491
gccagaggcggaaucgaac

SEQ ID NO: 3365912 - RNA, 18 nt, Neisseria meningitidis Z2491
gccagcaaucagggccuu

SEQ ID NO: 3365913 - RNA, 13 nt, Neisseria meningitidis Z2491
gccagcacaaaca

SEQ ID NO: 3365914 - RNA, 17 nt, Neisseria meningitidis Z2491
gccagcacaaacagcau

SEQ ID NO: 3365915 - RNA, 16 nt, Neisseria meningitidis Z2491
gccagcagcagcccgu

SEQ ID NO: 3365916 - RNA, 19 nt, Neisseria meningitidis Z2491
gccagccaccacguccacc

SEQ ID NO: 3365917 - RNA, 17 nt, Neisseria meningitidis Z2491
gccagccccaccauugu

SEQ ID NO: 3365918 - RNA, 15 nt, Neisseria meningitidis Z2491
gccagccgccgagca

SEQ ID NO: 3365919 - RNA, 14 nt, Neisseria meningitidis Z2491
gccagccguauuug

SEQ ID NO: 3365920 - RNA, 22 nt, Neisseria meningitidis Z2491
gccagccguauuugucuuccgc

SEQ ID NO: 3365921 - RNA, 12 nt, Neisseria meningitidis Z2491
gccagcggauug

SEQ ID NO: 3365922 - RNA, 16 nt, Neisseria meningitidis Z2491
gccaggcguauauggc

SEQ ID NO: 3365923 - RNA, 17 nt, Neisseria meningitidis Z2491
gccaguccggacgguca

SEQ ID NO: 3365924 - RNA, 20 nt, Neisseria meningitidis Z2491
gccaguucggcaaacggcag

SEQ ID NO: 3365925 - RNA, 19 nt, Neisseria meningitidis Z2491
gccauaaugcccaaaccgc

SEQ ID NO: 3365926 - RNA, 19 nt, Neisseria meningitidis Z2491
gccauauucgcacgcauga

SEQ ID NO: 3365927 - RNA, 18 nt, Neisseria meningitidis Z2491
gccaucacguccgccauu

SEQ ID NO: 3365928 - RNA, 17 nt, Neisseria meningitidis Z2491
gccaucaggaaugcaaa

SEQ ID NO: 3365929 - RNA, 20 nt, Neisseria meningitidis Z2491
gccaucaggacucgaacacc

SEQ ID NO: 3365930 - RNA, 17 nt, Neisseria meningitidis Z2491
gccauccagcaaacggu

SEQ ID NO: 3365931 - RNA, 16 nt, Neisseria meningitidis Z2491
gccaugcggcaaaaag

SEQ ID NO: 3365932 - RNA, 14 nt, Neisseria meningitidis Z2491
gccauuacauucuc

SEQ ID NO: 3365933 - RNA, 15 nt, Neisseria meningitidis Z2491
gccauucccgcaaaa

SEQ ID NO: 3365934 - RNA, 18 nt, Neisseria meningitidis Z2491
gccauucccgcaaaagcg

SEQ ID NO: 3365935 - RNA, 21 nt, Neisseria meningitidis Z2491
gccauucccucaaaaacagaa

SEQ ID NO: 3365936 - RNA, 22 nt, Neisseria meningitidis Z2491
gccauucccucaaaaacagaaa

SEQ ID NO: 3365937 - RNA, 22 nt, Neisseria meningitidis Z2491
gcccaaccgugcggcacgccgc

SEQ ID NO: 3365938 - RNA, 23 nt, Neisseria meningitidis Z2491
gcccaagccgacuuuuuccagca

SEQ ID NO: 3365939 - RNA, 15 nt, Neisseria meningitidis Z2491
gcccaauaccguccc

SEQ ID NO: 3365940 - RNA, 20 nt, Neisseria meningitidis Z2491
gcccaauaccguccccgaaa

SEQ ID NO: 3365941 - RNA, 23 nt, Neisseria meningitidis Z2491
gccgucugaaucgcgugcugcau

SEQ ID NO: 3365942 - RNA, 23 nt, Neisseria meningitidis Z2491
gccgucuuucaggaagucgggca

SEQ ID NO: 3365943 - RNA, 23 nt, Neisseria meningitidis Z2491
gccguuucagacggcaucuuuuu

SEQ ID NO: 3365944 - RNA, 15 nt, Neisseria meningitidis Z2491
gccguuuugcagugc

SEQ ID NO: 3365945 - RNA, 17 nt, Neisseria meningitidis Z2491
gccguuuuucauggcga

SEQ ID NO: 3365946 - RNA, 23 nt, Neisseria meningitidis Z2491
gccuaugcaaugggcgaccagcc

SEQ ID NO: 3365947 - RNA, 17 nt, Neisseria meningitidis Z2491
gccuauuuuucugaaaa

SEQ ID NO: 3365948 - RNA, 21 nt, Neisseria meningitidis Z2491
gccuccaucagcacgccgccu

SEQ ID NO: 3365949 - RNA, 14 nt, Neisseria meningitidis Z2491
gccuccgacugcuc

SEQ ID NO: 3365950 - RNA, 15 nt, Neisseria meningitidis Z2491
gccucgcccggccga

SEQ ID NO: 3365951 - RNA, 18 nt, Neisseria meningitidis Z2491
gccucgccuugccguacu

SEQ ID NO: 3365952 - RNA, 16 nt, Neisseria meningitidis Z2491
gccucgucauuuccac

SEQ ID NO: 3365953 - RNA, 16 nt, Neisseria meningitidis Z2491
gccucugccagcuccg

SEQ ID NO: 3365954 - RNA, 15 nt, Neisseria meningitidis Z2491
gccucuucgcgcgcu

SEQ ID NO: 3365955 - RNA, 22 nt, Neisseria meningitidis Z2491
gccugaacauuucagacggcau

SEQ ID NO: 3365956 - RNA, 15 nt, Neisseria meningitidis Z2491
gccugagcaaaugcc

SEQ ID NO: 3365957 - RNA, 14 nt, Neisseria meningitidis Z2491
gccugauccaaacc

SEQ ID NO: 3365958 - RNA, 13 nt, Neisseria meningitidis Z2491
gccugauggcuga

SEQ ID NO: 3365959 - RNA, 22 nt, Neisseria meningitidis Z2491
gccugauggcugaugacggcag

SEQ ID NO: 3365960 - RNA, 15 nt, Neisseria meningitidis Z2491
gccugcagcagagcu

SEQ ID NO: 3365961 - RNA, 14 nt, Neisseria meningitidis Z2491
gccugccaaaaucg

SEQ ID NO: 3365962 - RNA, 16 nt, Neisseria meningitidis Z2491
gccugccauuccccua

SEQ ID NO: 3365963 - RNA, 15 nt, Neisseria meningitidis Z2491
gccugccgaccccga

SEQ ID NO: 3365964 - RNA, 23 nt, Neisseria meningitidis Z2491
gccugccuguuuuucuucaucca

SEQ ID NO: 3365965 - RNA, 15 nt, Neisseria meningitidis Z2491
gccugccuuccccau

SEQ ID NO: 3365966 - RNA, 19 nt, Neisseria meningitidis Z2491
gccugcgcgagaauaauga

SEQ ID NO: 3365967 - RNA, 13 nt, Neisseria meningitidis Z2491
gccugugcggcgg

SEQ ID NO: 3365968 - RNA, 14 nt, Neisseria meningitidis Z2491
gccugugcggcgga

SEQ ID NO: 3365969 - RNA, 22 nt, Neisseria meningitidis Z2491
gccuuaacagggaaagcagcag

SEQ ID NO: 3365970 - RNA, 15 nt, Neisseria meningitidis Z2491
gccuucagacggcau

SEQ ID NO: 3365971 - RNA, 16 nt, Neisseria meningitidis Z2491
gccuucagacggcauu

SEQ ID NO: 3365972 - RNA, 17 nt, Neisseria meningitidis Z2491
gccuucagacggcauug

SEQ ID NO: 3365973 - RNA, 23 nt, Neisseria meningitidis Z2491
gccuucaugcggcgggcuuggaa

SEQ ID NO: 3365974 - RNA, 14 nt, Neisseria meningitidis Z2491
gccuucgggauaau

SEQ ID NO: 3365975 - RNA, 15 nt, Neisseria meningitidis Z2491
gccuucuucuaaaaa

SEQ ID NO: 3365976 - RNA, 13 nt, Neisseria meningitidis Z2491
gccuucuucuuug

SEQ ID NO: 3365977 - RNA, 19 nt, Neisseria meningitidis Z2491
gccuugccuucaaauucug

SEQ ID NO: 3365978 - RNA, 20 nt, Neisseria meningitidis Z2491
gccuuguaaaaaugccgucu

SEQ ID NO: 3365979 - RNA, 19 nt, Neisseria meningitidis Z2491
gccuuguccugauuuuugu

SEQ ID NO: 3365980 - RNA, 20 nt, Neisseria meningitidis Z2491
gccuuuacucauucaauccu

SEQ ID NO: 3365981 - RNA, 16 nt, Neisseria meningitidis Z2491
gccuuucaacaaucug

SEQ ID NO: 3365982 - RNA, 16 nt, Neisseria meningitidis Z2491
gccuuucagacggcau

SEQ ID NO: 3365983 - RNA, 18 nt, Neisseria meningitidis Z2491
gccuuuucuuccuugcca

SEQ ID NO: 3365984 - RNA, 12 nt, Neisseria meningitidis Z2491
gcgaaaaauaga

SEQ ID NO: 3365985 - RNA, 23 nt, Neisseria meningitidis Z2491
gcgaaacagacauugcuaaaaca

SEQ ID NO: 3365986 - RNA, 20 nt, Neisseria meningitidis Z2491
gcgaaagcgggaaucuagaa

SEQ ID NO: 3365987 - RNA, 18 nt, Neisseria meningitidis Z2491
gcgaacagaaaccucaaa

SEQ ID NO: 3365988 - RNA, 18 nt, Neisseria meningitidis Z2491
gcgaacagaaggggcgga

SEQ ID NO: 3365989 - RNA, 19 nt, Neisseria meningitidis Z2491
gcgaacggagccagcccgc

SEQ ID NO: 3365990 - RNA, 20 nt, Neisseria meningitidis Z2491
gcgaaggcgaccgccugcgc

SEQ ID NO: 3365991 - RNA, 18 nt, Neisseria meningitidis Z2491
gcgaaucugcugcaaacc

SEQ ID NO: 3365992 - RNA, 20 nt, Neisseria meningitidis Z2491
gcgacacgaccgaccggcau

SEQ ID NO: 3365993 - RNA, 17 nt, Neisseria meningitidis Z2491
gcgacagcuugggcgga

SEQ ID NO: 3365994 - RNA, 22 nt, Neisseria meningitidis Z2491
gcgacagcuugggcggacugcu

SEQ ID NO: 3365995 - RNA, 20 nt, Neisseria meningitidis Z2491
gcgaccgaaaugccgucauu

SEQ ID NO: 3365996 - RNA, 15 nt, Neisseria meningitidis Z2491
gcgacgaagccgcag

SEQ ID NO: 3365997 - RNA, 16 nt, Neisseria meningitidis Z2491
gcgacgaagccgcaga

SEQ ID NO: 3365998 - RNA, 14 nt, Neisseria meningitidis Z2491
gcgagaacgacggg

SEQ ID NO: 3365999 - RNA, 16 nt, Neisseria meningitidis Z2491
gcgagaauaaugaaaa

SEQ ID NO: 3366000 - RNA, 18 nt, Neisseria meningitidis Z2491
gcgagacaacgccguacu

SEQ ID NO: 3366001 - RNA, 12 nt, Neisseria meningitidis Z2491
gcgagacggcau

SEQ ID NO: 3366002 - RNA, 14 nt, Neisseria meningitidis Z2491
gcgagauagcaaag

SEQ ID NO: 3366003 - RNA, 12 nt, Neisseria meningitidis Z2491
gcgagaugacgg

SEQ ID NO: 3366004 - RNA, 16 nt, Neisseria meningitidis Z2491
gcgagccuugugugcg

SEQ ID NO: 3366005 - RNA, 13 nt, Neisseria meningitidis Z2491
gcgaggccaguuu

SEQ ID NO: 3366006 - RNA, 17 nt, Neisseria meningitidis Z2491
gcgaggcgugccuugcc

SEQ ID NO: 3366007 - RNA, 15 nt, Neisseria meningitidis Z2491
gcgaugcgccuugcc

SEQ ID NO: 3366008 - RNA, 21 nt, Neisseria meningitidis Z2491
gcgauuaucgggaaaaauaga

SEQ ID NO: 3366009 - RNA, 21 nt, Neisseria meningitidis Z2491
gcgauuucgcguaccaaaacc

SEQ ID NO: 3366010 - RNA, 19 nt, Neisseria meningitidis Z2491
gcgcaaccuugccaagguu

SEQ ID NO: 3366011 - RNA, 17 nt, Neisseria meningitidis Z2491
gcgcaaucgaaaaagcc

SEQ ID NO: 3366012 - RNA, 14 nt, Neisseria meningitidis Z2491
gcgcaccgcgcauu

SEQ ID NO: 3366013 - RNA, 22 nt, Neisseria meningitidis Z2491
gcgcaccuccauaauccaagau

SEQ ID NO: 3366014 - RNA, 21 nt, Neisseria meningitidis Z2491
gcgcaggcgggaaucuagaac

SEQ ID NO: 3366015 - RNA, 23 nt, Neisseria meningitidis Z2491
gcgcaggcgggaaucuagacauu

SEQ ID NO: 3366016 - RNA, 22 nt, Neisseria meningitidis Z2491
gcgcaggcgggaaucuagaccu

SEQ ID NO: 3366017 - RNA, 14 nt, Neisseria meningitidis Z2491
gcgcaggcgguggc

SEQ ID NO: 3366018 - RNA, 17 nt, Neisseria meningitidis Z2491
gcgcaguuaccgcccau

SEQ ID NO: 3366019 - RNA, 22 nt, Neisseria meningitidis Z2491
gcgcaucgccauauucgcacgc

SEQ ID NO: 3366020 - RNA, 18 nt, Neisseria meningitidis Z2491
gcgccaaaucggacggau

SEQ ID NO: 3366021 - RNA, 17 nt, Neisseria meningitidis Z2491
gcgccaaggcuuucaga

SEQ ID NO: 3366022 - RNA, 12 nt, Neisseria meningitidis Z2491
gcgccaauuccu

SEQ ID NO: 3366023 - RNA, 18 nt, Neisseria meningitidis Z2491
gcgccaccgacauuucau

SEQ ID NO: 3366024 - RNA, 20 nt, Neisseria meningitidis Z2491
gcgcccacgcccucggcggc

SEQ ID NO: 3366025 - RNA, 21 nt, Neisseria meningitidis Z2491
gcgcccgcaccgugugcgaca

SEQ ID NO: 3366026 - RNA, 18 nt, Neisseria meningitidis Z2491
gcgccgagguaguuuuug

SEQ ID NO: 3366027 - RNA, 18 nt, Neisseria meningitidis Z2491
gcgccgcacacgggacgg

SEQ ID NO: 3366028 - RNA, 11 nt, Neisseria meningitidis Z2491
gcgccgcccga

SEQ ID NO: 3366029 - RNA, 12 nt, Neisseria meningitidis Z2491
gcgccgcgcgcc

SEQ ID NO: 3366030 - RNA, 14 nt, Neisseria meningitidis Z2491
gcgcgaaugugcgc

SEQ ID NO: 3366031 - RNA, 15 nt, Neisseria meningitidis Z2491
gcgcgccgauguucu

SEQ ID NO: 3366032 - RNA, 14 nt, Neisseria meningitidis Z2491
gcgcggcaaaagua

SEQ ID NO: 3366033 - RNA, 17 nt, Neisseria meningitidis Z2491
gcgcgggaauagcucag

SEQ ID NO: 3366034 - RNA, 16 nt, Neisseria meningitidis Z2491
gcgcgggaaugacggc

SEQ ID NO: 3366035 - RNA, 17 nt, Neisseria meningitidis Z2491
gcgcgggaaugacggga

SEQ ID NO: 3366036 - RNA, 19 nt, Neisseria meningitidis Z2491
gcgcgggcguucagauucc

SEQ ID NO: 3366037 - RNA, 15 nt, Neisseria meningitidis Z2491
gcgcguaucggcggc

SEQ ID NO: 3366038 - RNA, 21 nt, Neisseria meningitidis Z2491
gcgcguaucggcggcaagcug

SEQ ID NO: 3366039 - RNA, 11 nt, Neisseria meningitidis Z2491
gcgcugcucgg

SEQ ID NO: 3366040 - RNA, 12 nt, Neisseria meningitidis Z2491
gcgcugcucggc

SEQ ID NO: 3366041 - RNA, 12 nt, Neisseria meningitidis Z2491
gcgcuucaaauc

SEQ ID NO: 3366042 - RNA, 22 nt, Neisseria meningitidis Z2491
gcguuuuuuauauggcggauuu

SEQ ID NO: 3366043 - RNA, 22 nt, Neisseria meningitidis Z2491
gcguuuuuuugccguauccaua

SEQ ID NO: 3366044 - RNA, 16 nt, Neisseria meningitidis Z2491
gcuaaaaucccguuau

SEQ ID NO: 3366045 - RNA, 18 nt, Neisseria meningitidis Z2491
gcuaaggcaauuuaucgg

SEQ ID NO: 3366046 - RNA, 15 nt, Neisseria meningitidis Z2491
gcuaccgaaauggaa

SEQ ID NO: 3366047 - RNA, 16 nt, Neisseria meningitidis Z2491
gcuauccgcacagaaa

SEQ ID NO: 3366048 - RNA, 17 nt, Neisseria meningitidis Z2491
gcuaugccugccgaccc

SEQ ID NO: 3366049 - RNA, 13 nt, Neisseria meningitidis Z2491
gcuauuuagaaua

SEQ ID NO: 3366050 - RNA, 13 nt, Neisseria meningitidis Z2491
gcucaaaaaaccg

SEQ ID NO: 3366051 - RNA, 14 nt, Neisseria meningitidis Z2491
gcucaaaaaaccgg

SEQ ID NO: 3366052 - RNA, 20 nt, Neisseria meningitidis Z2491
gcucaaucccguugccaaac

SEQ ID NO: 3366053 - RNA, 18 nt, Neisseria meningitidis Z2491
gcucaaucucauuuucaa

SEQ ID NO: 3366054 - RNA, 21 nt, Neisseria meningitidis Z2491
gcucaguugguagagcgcaac

SEQ ID NO: 3366055 - RNA, 17 nt, Neisseria meningitidis Z2491
gcucauuuuuguauaaa

SEQ ID NO: 3366056 - RNA, 11 nt, Neisseria meningitidis Z2491
gcuccaaguuu

SEQ ID NO: 3366057 - RNA, 16 nt, Neisseria meningitidis Z2491
gcucccgauaaaugcc

SEQ ID NO: 3366058 - RNA, 21 nt, Neisseria meningitidis Z2491
gcuccgcaggguagaaugccg

SEQ ID NO: 3366059 - RNA, 16 nt, Neisseria meningitidis Z2491
gcuccggccaaaaaaa

SEQ ID NO: 3366060 - RNA, 12 nt, Neisseria meningitidis Z2491
gcuccugacggc

SEQ ID NO: 3366061 - RNA, 19 nt, Neisseria meningitidis Z2491
gcuccugacggcaaacugc

SEQ ID NO: 3366062 - RNA, 12 nt, Neisseria meningitidis Z2491
gcucgccacaua

SEQ ID NO: 3366063 - RNA, 16 nt, Neisseria meningitidis Z2491
gcucgccgccuugucc

SEQ ID NO: 3366064 - RNA, 15 nt, Neisseria meningitidis Z2491
gcucgcguauccagc

SEQ ID NO: 3366065 - RNA, 18 nt, Neisseria meningitidis Z2491
gcucgcguauccagccgc

SEQ ID NO: 3366066 - RNA, 23 nt, Neisseria meningitidis Z2491
gcucggaggcuuuguuauuuuua

SEQ ID NO: 3366067 - RNA, 23 nt, Neisseria meningitidis Z2491
gcucggcguuuuucagacggccu

SEQ ID NO: 3366068 - RNA, 16 nt, Neisseria meningitidis Z2491
gcucugauagccgccc

SEQ ID NO: 3366069 - RNA, 22 nt, Neisseria meningitidis Z2491
gcucugccgucauucccgcgca

SEQ ID NO: 3366070 - RNA, 14 nt, Neisseria meningitidis Z2491
gcugaaaaaaugcc

SEQ ID NO: 3366071 - RNA, 18 nt, Neisseria meningitidis Z2491
gcugaaaaaaugccgucu

SEQ ID NO: 3366072 - RNA, 11 nt, Neisseria meningitidis Z2491
gcugaaacuca

SEQ ID NO: 3366073 - RNA, 14 nt, Neisseria meningitidis Z2491
gcugaaauugaaag

SEQ ID NO: 3366074 - RNA, 23 nt, Neisseria meningitidis Z2491
gcugaaauugaaaguuacagaaa

SEQ ID NO: 3366075 - RNA, 16 nt, Neisseria meningitidis Z2491
gcugaagcuuuagaga

SEQ ID NO: 3366076 - RNA, 15 nt, Neisseria meningitidis Z2491
gcugaauuugaaacg

SEQ ID NO: 3366077 - RNA, 15 nt, Neisseria meningitidis Z2491
gcugacuaaccgaaa

SEQ ID NO: 3366078 - RNA, 23 nt, Neisseria meningitidis Z2491
gcugaugaugauggcggcaacau

SEQ ID NO: 3366079 - RNA, 12 nt, Neisseria meningitidis Z2491
gcugauguugug

SEQ ID NO: 3366080 - RNA, 17 nt, Neisseria meningitidis Z2491
gcugcaaagcggcuggg

SEQ ID NO: 3366081 - RNA, 15 nt, Neisseria meningitidis Z2491
gcugccgaaaccaaa

SEQ ID NO: 3366082 - RNA, 17 nt, Neisseria meningitidis Z2491
gcugccgcacaagcccu

SEQ ID NO: 3366083 - RNA, 13 nt, Neisseria meningitidis Z2491
gcugccggcagga

SEQ ID NO: 3366084 - RNA, 22 nt, Neisseria meningitidis Z2491
gcugccgucgauuuugcagcug

SEQ ID NO: 3366085 - RNA, 23 nt, Neisseria meningitidis Z2491
gcugccgucgauuuugcagcuga

SEQ ID NO: 3366086 - RNA, 16 nt, Neisseria meningitidis Z2491
gcugcgggaaugacgg

SEQ ID NO: 3366087 - RNA, 19 nt, Neisseria meningitidis Z2491
gcugcgguacaaggaugau

SEQ ID NO: 3366088 - RNA, 15 nt, Neisseria meningitidis Z2491
gcugcgucgcgggcg

SEQ ID NO: 3366089 - RNA, 21 nt, Neisseria meningitidis Z2491
gcugcugaccgccggaaagcu

SEQ ID NO: 3366090 - RNA, 13 nt, Neisseria meningitidis Z2491
gcugcuguauuuu

SEQ ID NO: 3366091 - RNA, 17 nt, Neisseria meningitidis Z2491
gcugcuguauuuuucca

SEQ ID NO: 3366092 - RNA, 23 nt, Neisseria meningitidis Z2491
gcugcuguauuuuucgaggcgca

SEQ ID NO: 3366093 - RNA, 15 nt, Neisseria meningitidis Z2491
gcuggaagcauugac

SEQ ID NO: 3366094 - RNA, 20 nt, Neisseria meningitidis Z2491
gcuggaugaucggagugauu

SEQ ID NO: 3366095 - RNA, 13 nt, Neisseria meningitidis Z2491
gcuggcagacgua

SEQ ID NO: 3366096 - RNA, 16 nt, Neisseria meningitidis Z2491
gcuggcuguauggugc

SEQ ID NO: 3366097 - RNA, 21 nt, Neisseria meningitidis Z2491
gcugguaucuuuaaacagcau

SEQ ID NO: 3366098 - RNA, 14 nt, Neisseria meningitidis Z2491
gcuguacagguuug

SEQ ID NO: 3366099 - RNA, 18 nt, Neisseria meningitidis Z2491
gcuguacagguuugagcc

SEQ ID NO: 3366100 - RNA, 14 nt, Neisseria meningitidis Z2491
gcuguacgcugaug

SEQ ID NO: 3366101 - RNA, 16 nt, Neisseria meningitidis Z2491
gcuguaugccgucuga

SEQ ID NO: 3366102 - RNA, 17 nt, Neisseria meningitidis Z2491
gcuguaugccgucugaa

SEQ ID NO: 3366103 - RNA, 22 nt, Neisseria meningitidis Z2491
gcuguauuuuucgaggcgcagg

SEQ ID NO: 3366104 - RNA, 20 nt, Neisseria meningitidis Z2491
gcugucgucauuuccaauuu

SEQ ID NO: 3366105 - RNA, 14 nt, Neisseria meningitidis Z2491
gcugucugaaaccu

SEQ ID NO: 3366106 - RNA, 23 nt, Neisseria meningitidis Z2491
gcuguggaacgcgucaaccuuaa

SEQ ID NO: 3366107 - RNA, 17 nt, Neisseria meningitidis Z2491
gcuguguuuaucuuuuc

SEQ ID NO: 3366108 - RNA, 18 nt, Neisseria meningitidis Z2491
gcuguuccaaaagccgcc

SEQ ID NO: 3366109 - RNA, 12 nt, Neisseria meningitidis Z2491
gcuguuucuuca

SEQ ID NO: 3366110 - RNA, 21 nt, Neisseria meningitidis Z2491
gcuguuugcagggaccuuuaa

SEQ ID NO: 3366111 - RNA, 16 nt, Neisseria meningitidis Z2491
gcuguuugcgcuguug

SEQ ID NO: 3366112 - RNA, 17 nt, Neisseria meningitidis Z2491
gcuguuuuucaguuuaa

SEQ ID NO: 3366113 - RNA, 13 nt, Neisseria meningitidis Z2491
gcuguuuuuuguu

SEQ ID NO: 3366114 - RNA, 13 nt, Neisseria meningitidis Z2491
gcuuaaaaaacaa

SEQ ID NO: 3366115 - RNA, 14 nt, Neisseria meningitidis Z2491
gcuuaaaaaacaac

SEQ ID NO: 3366116 - RNA, 20 nt, Neisseria meningitidis Z2491
gcuuaaacagcacugccucu

SEQ ID NO: 3366117 - RNA, 17 nt, Neisseria meningitidis Z2491
gcuuaaaccuuauccau

SEQ ID NO: 3366118 - RNA, 22 nt, Neisseria meningitidis Z2491
gcuuaaaccuuauccauaucca

SEQ ID NO: 3366119 - RNA, 18 nt, Neisseria meningitidis Z2491
gcuuaccgaccaacugcu

SEQ ID NO: 3366120 - RNA, 21 nt, Neisseria meningitidis Z2491
gcuuaucuaaaggaaugguug

SEQ ID NO: 3366121 - RNA, 22 nt, Neisseria meningitidis Z2491
gcuuaucuaaaggaaugguuga

SEQ ID NO: 3366122 - RNA, 21 nt, Neisseria meningitidis Z2491
gcuuauggcgaacaaacaaca

SEQ ID NO: 3366123 - RNA, 19 nt, Neisseria meningitidis Z2491
gcuuauuuguucaaauauc

SEQ ID NO: 3366124 - RNA, 20 nt, Neisseria meningitidis Z2491
gcuucaaccacgcuucugau

SEQ ID NO: 3366125 - RNA, 16 nt, Neisseria meningitidis Z2491
gcuucaaggcgguuuu

SEQ ID NO: 3366126 - RNA, 20 nt, Neisseria meningitidis Z2491
gcuucacacguucgcaggcu

SEQ ID NO: 3366127 - RNA, 14 nt, Neisseria meningitidis Z2491
gcuucagacggcau

SEQ ID NO: 3366128 - RNA, 15 nt, Neisseria meningitidis Z2491
gcuucagacggcauc

SEQ ID NO: 3366129 - RNA, 20 nt, Neisseria meningitidis Z2491
gcuucagcuaaccuuugaau

SEQ ID NO: 3366130 - RNA, 19 nt, Neisseria meningitidis Z2491
gcuucauaccccacugcca

SEQ ID NO: 3366131 - RNA, 21 nt, Neisseria meningitidis Z2491
gcuucaucucgccaaucucac

SEQ ID NO: 3366132 - RNA, 14 nt, Neisseria meningitidis Z2491
gcuucaucuuuacu

SEQ ID NO: 3366133 - RNA, 15 nt, Neisseria meningitidis Z2491
gcuucaucuuuacuu

SEQ ID NO: 3366134 - RNA, 19 nt, Neisseria meningitidis Z2491
gcuucaucuuuacuuguuu

SEQ ID NO: 3366135 - RNA, 15 nt, Neisseria meningitidis Z2491
gcuuccaaaaccacu

SEQ ID NO: 3366136 - RNA, 19 nt, Neisseria meningitidis Z2491
gcuuccguguguauagugg

SEQ ID NO: 3366137 - RNA, 22 nt, Neisseria meningitidis Z2491
gcuucgacguuuuuacgcguga

SEQ ID NO: 3366138 - RNA, 13 nt, Neisseria meningitidis Z2491
gcuucgcgggcug

SEQ ID NO: 3366139 - RNA, 18 nt, Neisseria meningitidis Z2491
gcuucgguuguauuuuua

SEQ ID NO: 3366140 - RNA, 18 nt, Neisseria meningitidis Z2491
gcuucguaggcaucgucc

SEQ ID NO: 3366141 - RNA, 17 nt, Neisseria meningitidis Z2491
gcuucgucgccuugucc

SEQ ID NO: 3366142 - RNA, 17 nt, Neisseria meningitidis Z2491
gcuucuuucgccgccug

SEQ ID NO: 3366143 - RNA, 23 nt, Neisseria meningitidis Z2491
ggauuaaauuuaaaucaggacaa

SEQ ID NO: 3366144 - RNA, 16 nt, Neisseria meningitidis Z2491
ggauuaacaaaaauca

SEQ ID NO: 3366145 - RNA, 22 nt, Neisseria meningitidis Z2491
ggauuaauaaaaaucaggacaa

SEQ ID NO: 3366146 - RNA, 20 nt, Neisseria meningitidis Z2491
ggauucccgcaaccuuucgu

SEQ ID NO: 3366147 - RNA, 19 nt, Neisseria meningitidis Z2491
ggauuccuacgaaaacagg

SEQ ID NO: 3366148 - RNA, 15 nt, Neisseria meningitidis Z2491
ggauucgggcgugcg

SEQ ID NO: 3366149 - RNA, 15 nt, Neisseria meningitidis Z2491
ggauuuuagguuucu

SEQ ID NO: 3366150 - RNA, 20 nt, Neisseria meningitidis Z2491
ggauuuuugcccgauuuaaa

SEQ ID NO: 3366151 - RNA, 14 nt, Neisseria meningitidis Z2491
ggcaaaaaaaauaa

SEQ ID NO: 3366152 - RNA, 19 nt, Neisseria meningitidis Z2491
ggcaaaacgccuucuucgc

SEQ ID NO: 3366153 - RNA, 20 nt, Neisseria meningitidis Z2491
ggcaaaacggccgcaaaguc

SEQ ID NO: 3366154 - RNA, 20 nt, Neisseria meningitidis Z2491
ggcaaaauccgcaaacggca

SEQ ID NO: 3366155 - RNA, 14 nt, Neisseria meningitidis Z2491
ggcaaacuauaucu

SEQ ID NO: 3366156 - RNA, 21 nt, Neisseria meningitidis Z2491
ggcaaagcggcaaucaaaucc

SEQ ID NO: 3366157 - RNA, 15 nt, Neisseria meningitidis Z2491
ggcaacacaaaugcc

SEQ ID NO: 3366158 - RNA, 12 nt, Neisseria meningitidis Z2491
ggcaaccgucag

SEQ ID NO: 3366159 - RNA, 23 nt, Neisseria meningitidis Z2491
ggcaacgccguacugguuuuugu

SEQ ID NO: 3366160 - RNA, 23 nt, Neisseria meningitidis Z2491
ggcaacuuuuuucgauaugaaaa

SEQ ID NO: 3366161 - RNA, 15 nt, Neisseria meningitidis Z2491
ggcaaggcgccggcg

SEQ ID NO: 3366162 - RNA, 23 nt, Neisseria meningitidis Z2491
ggcaagggugaaaaggugcggua

SEQ ID NO: 3366163 - RNA, 16 nt, Neisseria meningitidis Z2491
ggcaauauucaaagau

SEQ ID NO: 3366164 - RNA, 18 nt, Neisseria meningitidis Z2491
ggcaaucauuucugucug

SEQ ID NO: 3366165 - RNA, 20 nt, Neisseria meningitidis Z2491
ggcaaucguuucugucgcca

SEQ ID NO: 3366166 - RNA, 13 nt, Neisseria meningitidis Z2491
ggcaaugaaaacc

SEQ ID NO: 3366167 - RNA, 17 nt, Neisseria meningitidis Z2491
ggcaaugaggcaauaga

SEQ ID NO: 3366168 - RNA, 20 nt, Neisseria meningitidis Z2491
ggcaauuuaucgggaaugac

SEQ ID NO: 3366169 - RNA, 19 nt, Neisseria meningitidis Z2491
ggcaauuugacacuucaca

SEQ ID NO: 3366170 - RNA, 17 nt, Neisseria meningitidis Z2491
ggcacaaacgccagcac

SEQ ID NO: 3366171 - RNA, 17 nt, Neisseria meningitidis Z2491
ggcacaaggcggcggca

SEQ ID NO: 3366172 - RNA, 18 nt, Neisseria meningitidis Z2491
ggcacacgcauuccgaca

SEQ ID NO: 3366173 - RNA, 22 nt, Neisseria meningitidis Z2491
ggcacaggcucaaacagcaggu

SEQ ID NO: 3366174 - RNA, 16 nt, Neisseria meningitidis Z2491
ggcacgaaccgcauug

SEQ ID NO: 3366175 - RNA, 13 nt, Neisseria meningitidis Z2491
ggcacggcaggga

SEQ ID NO: 3366176 - RNA, 22 nt, Neisseria meningitidis Z2491
ggcacggcgcaggcaaacgcga

SEQ ID NO: 3366177 - RNA, 18 nt, Neisseria meningitidis Z2491
ggcacuugccgcauaaau

SEQ ID NO: 3366178 - RNA, 17 nt, Neisseria meningitidis Z2491
ggcagagcgguuucugu

SEQ ID NO: 3366179 - RNA, 15 nt, Neisseria meningitidis Z2491
ggcagcaacgacagc

SEQ ID NO: 3366180 - RNA, 18 nt, Neisseria meningitidis Z2491
ggcagcaacgacagcagc

SEQ ID NO: 3366181 - RNA, 20 nt, Neisseria meningitidis Z2491
ggcagcaacgacagcagcag

SEQ ID NO: 3366182 - RNA, 21 nt, Neisseria meningitidis Z2491
ggcagcaacgacagcagcagc

SEQ ID NO: 3366183 - RNA, 15 nt, Neisseria meningitidis Z2491
ggcagcacugaucag

SEQ ID NO: 3366184 - RNA, 21 nt, Neisseria meningitidis Z2491
ggcagccaccucgccgcgcgu

SEQ ID NO: 3366185 - RNA, 16 nt, Neisseria meningitidis Z2491
ggcagccugcucgagc

SEQ ID NO: 3366186 - RNA, 17 nt, Neisseria meningitidis Z2491
ggcagccugcucgagcg

SEQ ID NO: 3366187 - RNA, 13 nt, Neisseria meningitidis Z2491
ggcagcguggagg

SEQ ID NO: 3366188 - RNA, 14 nt, Neisseria meningitidis Z2491
ggcagcugaagccc

SEQ ID NO: 3366189 - RNA, 19 nt, Neisseria meningitidis Z2491
ggcagguaaaaaauagaaa

SEQ ID NO: 3366190 - RNA, 14 nt, Neisseria meningitidis Z2491
ggcaguaaugccgc

SEQ ID NO: 3366191 - RNA, 20 nt, Neisseria meningitidis Z2491
ggcagucccguuugaaaaca

SEQ ID NO: 3366192 - RNA, 17 nt, Neisseria meningitidis Z2491
ggcagugauuucccguc

SEQ ID NO: 3366193 - RNA, 16 nt, Neisseria meningitidis Z2491
ggcagugccguuuugu

SEQ ID NO: 3366194 - RNA, 20 nt, Neisseria meningitidis Z2491
ggcaguuuccaauacaacaa

SEQ ID NO: 3366195 - RNA, 22 nt, Neisseria meningitidis Z2491
ggcaguuuccaauacaacaaaa

SEQ ID NO: 3366196 - RNA, 22 nt, Neisseria meningitidis Z2491
ggcauauugacggacggcggca

SEQ ID NO: 3366197 - RNA, 17 nt, Neisseria meningitidis Z2491
ggcaucccaguuuugca

SEQ ID NO: 3366198 - RNA, 20 nt, Neisseria meningitidis Z2491
ggcaucgaugaugugaaaca

SEQ ID NO: 3366199 - RNA, 19 nt, Neisseria meningitidis Z2491
ggcaucggaaacagccagg

SEQ ID NO: 3366200 - RNA, 20 nt, Neisseria meningitidis Z2491
ggcaucggaaacagccaggc

SEQ ID NO: 3366201 - RNA, 20 nt, Neisseria meningitidis Z2491
ggcaucgguuucuucuucgu

SEQ ID NO: 3366202 - RNA, 21 nt, Neisseria meningitidis Z2491
ggcaugaacuugggccacuuu

SEQ ID NO: 3366203 - RNA, 14 nt, Neisseria meningitidis Z2491
ggcauuaaaauuug

SEQ ID NO: 3366204 - RNA, 14 nt, Neisseria meningitidis Z2491
ggcauuugcacacg

SEQ ID NO: 3366205 - RNA, 18 nt, Neisseria meningitidis Z2491
ggcauuuucaacagcagg

SEQ ID NO: 3366206 - RNA, 20 nt, Neisseria meningitidis Z2491
ggcauuuuccguugccugcg

SEQ ID NO: 3366207 - RNA, 14 nt, Neisseria meningitidis Z2491
ggcauuuugcugcc

SEQ ID NO: 3366208 - RNA, 20 nt, Neisseria meningitidis Z2491
ggcauuuugcugccggcagg

SEQ ID NO: 3366209 - RNA, 19 nt, Neisseria meningitidis Z2491
ggcauuuugucauuuggaa

SEQ ID NO: 3366210 - RNA, 22 nt, Neisseria meningitidis Z2491
ggcauuuuuuacacaauuccca

SEQ ID NO: 3366211 - RNA, 14 nt, Neisseria meningitidis Z2491
ggccaauuugcuuu

SEQ ID NO: 3366212 - RNA, 13 nt, Neisseria meningitidis Z2491
ggccacgccgacu

SEQ ID NO: 3366213 - RNA, 20 nt, Neisseria meningitidis Z2491
ggccacgccgacugccgccg

SEQ ID NO: 3366214 - RNA, 15 nt, Neisseria meningitidis Z2491
ggccaguuuguucag

SEQ ID NO: 3366215 - RNA, 21 nt, Neisseria meningitidis Z2491
ggccauucccucaaaaacaga

SEQ ID NO: 3366216 - RNA, 23 nt, Neisseria meningitidis Z2491
ggccauucccucaaaaacagaaa

SEQ ID NO: 3366217 - RNA, 16 nt, Neisseria meningitidis Z2491
ggccgcgcccgcaccg

SEQ ID NO: 3366218 - RNA, 21 nt, Neisseria meningitidis Z2491
ggccgguagugauggcaagcu

SEQ ID NO: 3366219 - RNA, 20 nt, Neisseria meningitidis Z2491
ggccgucugaaacacuguuc

SEQ ID NO: 3366220 - RNA, 21 nt, Neisseria meningitidis Z2491
ggccugcccugccaaaacuca

SEQ ID NO: 3366221 - RNA, 14 nt, Neisseria meningitidis Z2491
ggccuuuuugcuuu

SEQ ID NO: 3366222 - RNA, 16 nt, Neisseria meningitidis Z2491
ggcgaagccggcggcg

SEQ ID NO: 3366223 - RNA, 18 nt, Neisseria meningitidis Z2491
ggcgacagccgcucgcgu

SEQ ID NO: 3366224 - RNA, 24 nt, Neisseria meningitidis Z2491
ggcgacagccgcucgcguauccag

SEQ ID NO: 3366225 - RNA, 16 nt, Neisseria meningitidis Z2491
ggcgaccgccgccgca

SEQ ID NO: 3366226 - RNA, 16 nt, Neisseria meningitidis Z2491
ggcgacgaagccgcag

SEQ ID NO: 3366227 - RNA, 15 nt, Neisseria meningitidis Z2491
ggcgacguauuugcc

SEQ ID NO: 3366228 - RNA, 22 nt, Neisseria meningitidis Z2491
ggcgaggaagaugucgggggcg

SEQ ID NO: 3366229 - RNA, 14 nt, Neisseria meningitidis Z2491
ggcgauaugcuuca

SEQ ID NO: 3366230 - RNA, 15 nt, Neisseria meningitidis Z2491
ggcgauggcgcggcg

SEQ ID NO: 3366231 - RNA, 20 nt, Neisseria meningitidis Z2491
ggcgauuaucgggaaaaaua

SEQ ID NO: 3366232 - RNA, 14 nt, Neisseria meningitidis Z2491
ggcgcaccccgaca

SEQ ID NO: 3366233 - RNA, 19 nt, Neisseria meningitidis Z2491
ggcgcgaacggagccagcc

SEQ ID NO: 3366234 - RNA, 22 nt, Neisseria meningitidis Z2491
ggcgcgaacggagccagcccgc

SEQ ID NO: 3366235 - RNA, 14 nt, Neisseria meningitidis Z2491
ggcgcggcgcggcg

SEQ ID NO: 3366236 - RNA, 12 nt, Neisseria meningitidis Z2491
ggcgcggcuggu

SEQ ID NO: 3366237 - RNA, 13 nt, Neisseria meningitidis Z2491
ggcgcgguuggcg

SEQ ID NO: 3366238 - RNA, 16 nt, Neisseria meningitidis Z2491
ggcgcgguuggcggcg

SEQ ID NO: 3366239 - RNA, 17 nt, Neisseria meningitidis Z2491
ggcgcguaucggcggca

SEQ ID NO: 3366240 - RNA, 14 nt, Neisseria meningitidis Z2491
ggcggaaccugcug

SEQ ID NO: 3366241 - RNA, 12 nt, Neisseria meningitidis Z2491
ggcggacgcauc

SEQ ID NO: 3366242 - RNA, 22 nt, Neisseria meningitidis Z2491
ggcggacugcuguugcaaagcc

SEQ ID NO: 3366243 - RNA, 13 nt, Neisseria meningitidis Z2491
ggcggagcgguuu

SEQ ID NO: 3366244 - RNA, 16 nt, Neisseria meningitidis Z2491
ggguucagacggcauc

SEQ ID NO: 3366245 - RNA, 18 nt, Neisseria meningitidis Z2491
ggguucagauguggugga

SEQ ID NO: 3366246 - RNA, 15 nt, Neisseria meningitidis Z2491
ggguucggacggcau

SEQ ID NO: 3366247 - RNA, 16 nt, Neisseria meningitidis Z2491
ggguucggacggcauu

SEQ ID NO: 3366248 - RNA, 20 nt, Neisseria meningitidis Z2491
ggguucuguaucauacagaa

SEQ ID NO: 3366249 - RNA, 18 nt, Neisseria meningitidis Z2491
ggguuguucgugccggca

SEQ ID NO: 3366250 - RNA, 18 nt, Neisseria meningitidis Z2491
ggguuuaucagaaaugac

SEQ ID NO: 3366251 - RNA, 16 nt, Neisseria meningitidis Z2491
ggguuucagacggcau

SEQ ID NO: 3366252 - RNA, 17 nt, Neisseria meningitidis Z2491
ggguuucagacggcauu

SEQ ID NO: 3366253 - RNA, 16 nt, Neisseria meningitidis Z2491
ggguuuggaaugcgcg

SEQ ID NO: 3366254 - RNA, 18 nt, Neisseria meningitidis Z2491
gguaaagauguagaccca

SEQ ID NO: 3366255 - RNA, 17 nt, Neisseria meningitidis Z2491
gguaaccacgacgcaga

SEQ ID NO: 3366256 - RNA, 15 nt, Neisseria meningitidis Z2491
gguaacggcaauauu

SEQ ID NO: 3366257 - RNA, 18 nt, Neisseria meningitidis Z2491
gguaacucuaaaccguca

SEQ ID NO: 3366258 - RNA, 16 nt, Neisseria meningitidis Z2491
gguaacuuccaaaccg

SEQ ID NO: 3366259 - RNA, 22 nt, Neisseria meningitidis Z2491
gguagagcgcaaccuugccaag

SEQ ID NO: 3366260 - RNA, 19 nt, Neisseria meningitidis Z2491
gguagggcuguucgccgac

SEQ ID NO: 3366261 - RNA, 20 nt, Neisseria meningitidis Z2491
gguaucgccguuuugcagug

SEQ ID NO: 3366262 - RNA, 20 nt, Neisseria meningitidis Z2491
gguaucgggcauaaaauuug

SEQ ID NO: 3366263 - RNA, 19 nt, Neisseria meningitidis Z2491
gguaucugcauuauuuggg

SEQ ID NO: 3366264 - RNA, 23 nt, Neisseria meningitidis Z2491
gguauucuuucgcuugugaaaau

SEQ ID NO: 3366265 - RNA, 18 nt, Neisseria meningitidis Z2491
gguauuuggguagaauua

SEQ ID NO: 3366266 - RNA, 17 nt, Neisseria meningitidis Z2491
ggucaaaaucggcauuc

SEQ ID NO: 3366267 - RNA, 15 nt, Neisseria meningitidis Z2491
ggucagcccggcggu

SEQ ID NO: 3366268 - RNA, 21 nt, Neisseria meningitidis Z2491
ggucauuuccgauaaauuccu

SEQ ID NO: 3366269 - RNA, 21 nt, Neisseria meningitidis Z2491
gguccaaaacggcggcagccu

SEQ ID NO: 3366270 - RNA, 20 nt, Neisseria meningitidis Z2491
ggucgaaccauugcgaacug

SEQ ID NO: 3366271 - RNA, 16 nt, Neisseria meningitidis Z2491
ggucgccgauuucgag

SEQ ID NO: 3366272 - RNA, 21 nt, Neisseria meningitidis Z2491
ggucgugcagccugcucggcc

SEQ ID NO: 3366273 - RNA, 13 nt, Neisseria meningitidis Z2491
ggucguggcaacu

SEQ ID NO: 3366274 - RNA, 20 nt, Neisseria meningitidis Z2491
ggucucauugguaaacaguu

SEQ ID NO: 3366275 - RNA, 14 nt, Neisseria meningitidis Z2491
ggucugucggugcg

SEQ ID NO: 3366276 - RNA, 13 nt, Neisseria meningitidis Z2491
ggucuucagcuug

SEQ ID NO: 3366277 - RNA, 19 nt, Neisseria meningitidis Z2491
ggucuuuucuaaaauaugc

SEQ ID NO: 3366278 - RNA, 15 nt, Neisseria meningitidis Z2491
ggugaaaaaugaaaa

SEQ ID NO: 3366279 - RNA, 19 nt, Neisseria meningitidis Z2491
ggugaaaaaugaaaaaugc

SEQ ID NO: 3366280 - RNA, 17 nt, Neisseria meningitidis Z2491
ggugaacacuucuucgg

SEQ ID NO: 3366281 - RNA, 14 nt, Neisseria meningitidis Z2491
ggugagggagaggg

SEQ ID NO: 3366282 - RNA, 14 nt, Neisseria meningitidis Z2491
ggugauggagcugu

SEQ ID NO: 3366283 - RNA, 17 nt, Neisseria meningitidis Z2491
ggugauuucuguggaga

SEQ ID NO: 3366284 - RNA, 20 nt, Neisseria meningitidis Z2491
ggugcggaaacguaucggau

SEQ ID NO: 3366285 - RNA, 15 nt, Neisseria meningitidis Z2491
ggugcugcugccgcc

SEQ ID NO: 3366286 - RNA, 22 nt, Neisseria meningitidis Z2491
ggugcuucagcaccuuagagaa

SEQ ID NO: 3366287 - RNA, 14 nt, Neisseria meningitidis Z2491
gguguccguggagg

SEQ ID NO: 3366288 - RNA, 19 nt, Neisseria meningitidis Z2491
ggugugcauccgacaggca

SEQ ID NO: 3366289 - RNA, 13 nt, Neisseria meningitidis Z2491
gguguuguagccu

SEQ ID NO: 3366290 - RNA, 17 nt, Neisseria meningitidis Z2491
gguuaagaaaaccugca

SEQ ID NO: 3366291 - RNA, 15 nt, Neisseria meningitidis Z2491
gguuacuaaaauuuu

SEQ ID NO: 3366292 - RNA, 12 nt, Neisseria meningitidis Z2491
gguuaugcccuu

SEQ ID NO: 3366293 - RNA, 14 nt, Neisseria meningitidis Z2491
gguucagacggcau

SEQ ID NO: 3366294 - RNA, 16 nt, Neisseria meningitidis Z2491
gguucagguacugcuc

SEQ ID NO: 3366295 - RNA, 14 nt, Neisseria meningitidis Z2491
gguucggacggcau

SEQ ID NO: 3366296 - RNA, 16 nt, Neisseria meningitidis Z2491
gguucggauauuuccg

SEQ ID NO: 3366297 - RNA, 20 nt, Neisseria meningitidis Z2491
gguucggcuuggaaugcuug

SEQ ID NO: 3366298 - RNA, 19 nt, Neisseria meningitidis Z2491
gguugaaguccauggaaac

SEQ ID NO: 3366299 - RNA, 22 nt, Neisseria meningitidis Z2491
gguugaaguccauggaaaccaa

SEQ ID NO: 3366300 - RNA, 20 nt, Neisseria meningitidis Z2491
gguugaggucgcgaguucga

SEQ ID NO: 3366301 - RNA, 16 nt, Neisseria meningitidis Z2491
gguugaucauuucagg

SEQ ID NO: 3366302 - RNA, 13 nt, Neisseria meningitidis Z2491
gguugcggugcug

SEQ ID NO: 3366303 - RNA, 18 nt, Neisseria meningitidis Z2491
gguugcguaucaaaaaau

SEQ ID NO: 3366304 - RNA, 15 nt, Neisseria meningitidis Z2491
gguugucugaaaacu

SEQ ID NO: 3366305 - RNA, 16 nt, Neisseria meningitidis Z2491
gguuguucagaaaauc

SEQ ID NO: 3366306 - RNA, 13 nt, Neisseria meningitidis Z2491
gguuguuggaaaa

SEQ ID NO: 3366307 - RNA, 20 nt, Neisseria meningitidis Z2491
gguuuaaaguuaauccacua

SEQ ID NO: 3366308 - RNA, 13 nt, Neisseria meningitidis Z2491
gguuuaauccgcc

SEQ ID NO: 3366309 - RNA, 23 nt, Neisseria meningitidis Z2491
gguuuauuugagcaaaugccguc

SEQ ID NO: 3366310 - RNA, 16 nt, Neisseria meningitidis Z2491
gguuucagacggcauu

SEQ ID NO: 3366311 - RNA, 14 nt, Neisseria meningitidis Z2491
gguuugacagcgca

SEQ ID NO: 3366312 - RNA, 21 nt, Neisseria meningitidis Z2491
gguuugccgcugacgaaacca

SEQ ID NO: 3366313 - RNA, 14 nt, Neisseria meningitidis Z2491
gguuuuaacaaugu

SEQ ID NO: 3366314 - RNA, 21 nt, Neisseria meningitidis Z2491
gguuuuccccuguaaacagau

SEQ ID NO: 3366315 - RNA, 22 nt, Neisseria meningitidis Z2491
gguuuuccucgauuugaaaucu

SEQ ID NO: 3366316 - RNA, 19 nt, Neisseria meningitidis Z2491
gguuuuguuuuuccaaacg

SEQ ID NO: 3366317 - RNA, 20 nt, Neisseria meningitidis Z2491
guaaaaaugccgucugaaaa

SEQ ID NO: 3366318 - RNA, 15 nt, Neisseria meningitidis Z2491
guaaaaucucaagaa

SEQ ID NO: 3366319 - RNA, 17 nt, Neisseria meningitidis Z2491
guaaacagauaaaacca

SEQ ID NO: 3366320 - RNA, 18 nt, Neisseria meningitidis Z2491
guaaacagauaaaaccaa

SEQ ID NO: 3366321 - RNA, 16 nt, Neisseria meningitidis Z2491
guaaaccgccagccug

SEQ ID NO: 3366322 - RNA, 20 nt, Neisseria meningitidis Z2491
guaaagcggcaaugccgucu

SEQ ID NO: 3366323 - RNA, 19 nt, Neisseria meningitidis Z2491
guaaagugcggugaaaucu

SEQ ID NO: 3366324 - RNA, 20 nt, Neisseria meningitidis Z2491
guaaauuguccauuuuucug

SEQ ID NO: 3366325 - RNA, 20 nt, Neisseria meningitidis Z2491
guaacaauaugcggcaggcc

SEQ ID NO: 3366326 - RNA, 22 nt, Neisseria meningitidis Z2491
guaacaauaugcggcaggccaa

SEQ ID NO: 3366327 - RNA, 20 nt, Neisseria meningitidis Z2491
guaacgggcgagaugacggc

SEQ ID NO: 3366328 - RNA, 20 nt, Neisseria meningitidis Z2491
guaacuuuugagccgucauu

SEQ ID NO: 3366329 - RNA, 18 nt, Neisseria meningitidis Z2491
guaaucauaauaggcugu

SEQ ID NO: 3366330 - RNA, 21 nt, Neisseria meningitidis Z2491
guaauccugaaugcccauuug

SEQ ID NO: 3366331 - RNA, 22 nt, Neisseria meningitidis Z2491
guaaucgccuuacggauggcau

SEQ ID NO: 3366332 - RNA, 21 nt, Neisseria meningitidis Z2491
guaaugcaaaaaguccuucac

SEQ ID NO: 3366333 - RNA, 14 nt, Neisseria meningitidis Z2491
guaauuaccgaaac

SEQ ID NO: 3366334 - RNA, 14 nt, Neisseria meningitidis Z2491
guaauuaggcuccu

SEQ ID NO: 3366335 - RNA, 19 nt, Neisseria meningitidis Z2491
guaauuuauccgaaauaac

SEQ ID NO: 3366336 - RNA, 21 nt, Neisseria meningitidis Z2491
guaauuuauccgaaauaacaa

SEQ ID NO: 3366337 - RNA, 23 nt, Neisseria meningitidis Z2491
guaauuuugaacaucuugugcca

SEQ ID NO: 3366338 - RNA, 12 nt, Neisseria meningitidis Z2491
guacaaaaugcc

SEQ ID NO: 3366339 - RNA, 21 nt, Neisseria meningitidis Z2491
guacaaaaugccgucugaagc

SEQ ID NO: 3366340 - RNA, 23 nt, Neisseria meningitidis Z2491
guacaaauaguacggcaaggcaa

SEQ ID NO: 3366341 - RNA, 23 nt, Neisseria meningitidis Z2491
guacagguuugagccguauuuuu

SEQ ID NO: 3366342 - RNA, 21 nt, Neisseria meningitidis Z2491
guacauuuugguuguucagaa

SEQ ID NO: 3366343 - RNA, 13 nt, Neisseria meningitidis Z2491
guaccaaaaccgu

SEQ ID NO: 3366344 - RNA, 22 nt, Neisseria meningitidis Z2491
guacccccauaugguguugaug

SEQ ID NO: 3366345 - RNA, 20 nt, Neisseria meningitidis Z2491
gucgcaaaucggcuucagac

SEQ ID NO: 3366346 - RNA, 13 nt, Neisseria meningitidis Z2491
gucgcagcugcuc

SEQ ID NO: 3366347 - RNA, 23 nt, Neisseria meningitidis Z2491
gucgcccaagccgacuuuuucca

SEQ ID NO: 3366348 - RNA, 17 nt, Neisseria meningitidis Z2491
gucgccgagcagauuga

SEQ ID NO: 3366349 - RNA, 15 nt, Neisseria meningitidis Z2491
gucggacaaaaugcc

SEQ ID NO: 3366350 - RNA, 16 nt, Neisseria meningitidis Z2491
gucggacaaaaugccu

SEQ ID NO: 3366351 - RNA, 13 nt, Neisseria meningitidis Z2491
gucggaguggcag

SEQ ID NO: 3366352 - RNA, 14 nt, Neisseria meningitidis Z2491
gucggcgacggcgu

SEQ ID NO: 3366353 - RNA, 19 nt, Neisseria meningitidis Z2491
gucggucaaguggggggaa

SEQ ID NO: 3366354 - RNA, 18 nt, Neisseria meningitidis Z2491
gucgguuucaucgccgua

SEQ ID NO: 3366355 - RNA, 12 nt, Neisseria meningitidis Z2491
gucguacagaua

SEQ ID NO: 3366356 - RNA, 19 nt, Neisseria meningitidis Z2491
gucguacagauaguugcgg

SEQ ID NO: 3366357 - RNA, 15 nt, Neisseria meningitidis Z2491
gucguaggcuuuuuc

SEQ ID NO: 3366358 - RNA, 15 nt, Neisseria meningitidis Z2491
gucguugugcggcaa

SEQ ID NO: 3366359 - RNA, 17 nt, Neisseria meningitidis Z2491
gucguuuuuuuccugcc

SEQ ID NO: 3366360 - RNA, 15 nt, Neisseria meningitidis Z2491
gucuaagaaaaccac

SEQ ID NO: 3366361 - RNA, 17 nt, Neisseria meningitidis Z2491
gucuaagccgguauaaa

SEQ ID NO: 3366362 - RNA, 15 nt, Neisseria meningitidis Z2491
gucuaugaaucggcu

SEQ ID NO: 3366363 - RNA, 18 nt, Neisseria meningitidis Z2491
gucuaugaaucggcuggg

SEQ ID NO: 3366364 - RNA, 21 nt, Neisseria meningitidis Z2491
gucucauccuguuauuuucac

SEQ ID NO: 3366365 - RNA, 17 nt, Neisseria meningitidis Z2491
gucuccauuucugcgca

SEQ ID NO: 3366366 - RNA, 15 nt, Neisseria meningitidis Z2491
gucugaaaacagcaa

SEQ ID NO: 3366367 - RNA, 18 nt, Neisseria meningitidis Z2491
gucugaaaaccuuucaga

SEQ ID NO: 3366368 - RNA, 22 nt, Neisseria meningitidis Z2491
gucugaaaagaugccugcuucg

SEQ ID NO: 3366369 - RNA, 22 nt, Neisseria meningitidis Z2491
gucugaaacccgauguuuucaa

SEQ ID NO: 3366370 - RNA, 13 nt, Neisseria meningitidis Z2491
gucugaaaccuga

SEQ ID NO: 3366371 - RNA, 20 nt, Neisseria meningitidis Z2491
gucugaaacguugugcuguu

SEQ ID NO: 3366372 - RNA, 13 nt, Neisseria meningitidis Z2491
gucugaaacguuu

SEQ ID NO: 3366373 - RNA, 14 nt, Neisseria meningitidis Z2491
gucugaaacguuuc

SEQ ID NO: 3366374 - RNA, 15 nt, Neisseria meningitidis Z2491
gucugaaaggcuuca

SEQ ID NO: 3366375 - RNA, 23 nt, Neisseria meningitidis Z2491
gucugaaaggcuucagacggcau

SEQ ID NO: 3366376 - RNA, 22 nt, Neisseria meningitidis Z2491
gucugaaauguucagacggcau

SEQ ID NO: 3366377 - RNA, 18 nt, Neisseria meningitidis Z2491
gucugaagcccugccugc

SEQ ID NO: 3366378 - RNA, 14 nt, Neisseria meningitidis Z2491
gucugaagccuuca

SEQ ID NO: 3366379 - RNA, 14 nt, Neisseria meningitidis Z2491
gucugaaggcuuca

SEQ ID NO: 3366380 - RNA, 20 nt, Neisseria meningitidis Z2491
gucugaaggcuugagcguuc

SEQ ID NO: 3366381 - RNA, 20 nt, Neisseria meningitidis Z2491
gucugccaacccuugugcuu

SEQ ID NO: 3366382 - RNA, 18 nt, Neisseria meningitidis Z2491
gucugccaaggauagaga

SEQ ID NO: 3366383 - RNA, 13 nt, Neisseria meningitidis Z2491
gucugccgcccga

SEQ ID NO: 3366384 - RNA, 15 nt, Neisseria meningitidis Z2491
gucugcggcucgccg

SEQ ID NO: 3366385 - RNA, 16 nt, Neisseria meningitidis Z2491
gucuguaccgcaucuu

SEQ ID NO: 3366386 - RNA, 18 nt, Neisseria meningitidis Z2491
gucuucgacgaaggcuau

SEQ ID NO: 3366387 - RNA, 15 nt, Neisseria meningitidis Z2491
gucuucgggcagggu

SEQ ID NO: 3366388 - RNA, 23 nt, Neisseria meningitidis Z2491
gucuuucaauauacugcucgcca

SEQ ID NO: 3366389 - RNA, 18 nt, Neisseria meningitidis Z2491
gucuuuuccuuccaaaag

SEQ ID NO: 3366390 - RNA, 18 nt, Neisseria meningitidis Z2491
gucuuuuuuauucaaugu

SEQ ID NO: 3366391 - RNA, 15 nt, Neisseria meningitidis Z2491
gugagggagagggca

SEQ ID NO: 3366392 - RNA, 21 nt, Neisseria meningitidis Z2491
gugaugauguccgacugggca

SEQ ID NO: 3366393 - RNA, 22 nt, Neisseria meningitidis Z2491
gugcagguuuuuuugauucaau

SEQ ID NO: 3366394 - RNA, 17 nt, Neisseria meningitidis Z2491
gugcauccgacaggcaa

SEQ ID NO: 3366395 - RNA, 17 nt, Neisseria meningitidis Z2491
gugcccacggggugcgg

SEQ ID NO: 3366396 - RNA, 23 nt, Neisseria meningitidis Z2491
gugccgccaaagugccaaaugua

SEQ ID NO: 3366397 - RNA, 14 nt, Neisseria meningitidis Z2491
gugccucuucccaa

SEQ ID NO: 3366398 - RNA, 20 nt, Neisseria meningitidis Z2491
gugcgaccguaugcaaaaac

SEQ ID NO: 3366399 - RNA, 22 nt, Neisseria meningitidis Z2491
gugcgaccguaugcaaaaacaa

SEQ ID NO: 3366400 - RNA, 15 nt, Neisseria meningitidis Z2491
gugcgcguacugcuu

SEQ ID NO: 3366401 - RNA, 13 nt, Neisseria meningitidis Z2491
gugcggcccugcg

SEQ ID NO: 3366402 - RNA, 16 nt, Neisseria meningitidis Z2491
gugcuguuucagacgg

SEQ ID NO: 3366403 - RNA, 23 nt, Neisseria meningitidis Z2491
gugcuguuucagacggcauuuuu

SEQ ID NO: 3366404 - RNA, 18 nt, Neisseria meningitidis Z2491
gugcuugagcaccuuaga

SEQ ID NO: 3366405 - RNA, 13 nt, Neisseria meningitidis Z2491
gugcuuuggcuuc

SEQ ID NO: 3366406 - RNA, 15 nt, Neisseria meningitidis Z2491
guggagauuuggaga

SEQ ID NO: 3366407 - RNA, 15 nt, Neisseria meningitidis Z2491
guggagcaugaguuc

SEQ ID NO: 3366408 - RNA, 14 nt, Neisseria meningitidis Z2491
guggagggacagcg

SEQ ID NO: 3366409 - RNA, 17 nt, Neisseria meningitidis Z2491
guggauuaaauuuaaau

SEQ ID NO: 3366410 - RNA, 14 nt, Neisseria meningitidis Z2491
guggauuaacaaaa

SEQ ID NO: 3366411 - RNA, 20 nt, Neisseria meningitidis Z2491
guggauuauaguggauuaaa

SEQ ID NO: 3366412 - RNA, 16 nt, Neisseria meningitidis Z2491
guggcaacuuccagcg

SEQ ID NO: 3366413 - RNA, 15 nt, Neisseria meningitidis Z2491
guggcaguacauuuu

SEQ ID NO: 3366414 - RNA, 21 nt, Neisseria meningitidis Z2491
guggccacgccgacugccgcc

SEQ ID NO: 3366415 - RNA, 15 nt, Neisseria meningitidis Z2491
guggcgaagccggcg

SEQ ID NO: 3366416 - RNA, 16 nt, Neisseria meningitidis Z2491
guggcugcccaaccga

SEQ ID NO: 3366417 - RNA, 13 nt, Neisseria meningitidis Z2491
gugggaauccaga

SEQ ID NO: 3366418 - RNA, 17 nt, Neisseria meningitidis Z2491
gugggaauccagaaucu

SEQ ID NO: 3366419 - RNA, 15 nt, Neisseria meningitidis Z2491
gugggaaucuggaaa

SEQ ID NO: 3366420 - RNA, 22 nt, Neisseria meningitidis Z2491
gugggaaugacgggauuugaga

SEQ ID NO: 3366421 - RNA, 16 nt, Neisseria meningitidis Z2491
gugggcauuaucagua

SEQ ID NO: 3366422 - RNA, 19 nt, Neisseria meningitidis Z2491
guggguaacgacgaccauc

SEQ ID NO: 3366423 - RNA, 20 nt, Neisseria meningitidis Z2491
guggucaggcccuguuuguu

SEQ ID NO: 3366424 - RNA, 20 nt, Neisseria meningitidis Z2491
guggugggaauguauuagaa

SEQ ID NO: 3366425 - RNA, 22 nt, Neisseria meningitidis Z2491
guguacggugaacacuucuucg

SEQ ID NO: 3366426 - RNA, 14 nt, Neisseria meningitidis Z2491
gugucagacggcau

SEQ ID NO: 3366427 - RNA, 20 nt, Neisseria meningitidis Z2491
gugucaggaugucugccuga

SEQ ID NO: 3366428 - RNA, 18 nt, Neisseria meningitidis Z2491
gugugcauccgacaggca

SEQ ID NO: 3366429 - RNA, 13 nt, Neisseria meningitidis Z2491
gugugcgguucgg

SEQ ID NO: 3366430 - RNA, 20 nt, Neisseria meningitidis Z2491
guguggcgguuauugugcuu

SEQ ID NO: 3366431 - RNA, 21 nt, Neisseria meningitidis Z2491
guguuauaauccgcgccgcac

SEQ ID NO: 3366432 - RNA, 18 nt, Neisseria meningitidis Z2491
guguucauuauaguggau

SEQ ID NO: 3366433 - RNA, 16 nt, Neisseria meningitidis Z2491
guguugcccugauucg

SEQ ID NO: 3366434 - RNA, 17 nt, Neisseria meningitidis Z2491
guguuucaauauggugc

SEQ ID NO: 3366435 - RNA, 18 nt, Neisseria meningitidis Z2491
guuaaaucgaaauucgca

SEQ ID NO: 3366436 - RNA, 22 nt, Neisseria meningitidis Z2491
guuaacgcguuaccgguuugua

SEQ ID NO: 3366437 - RNA, 14 nt, Neisseria meningitidis Z2491
guuaagaaaaccug

SEQ ID NO: 3366438 - RNA, 20 nt, Neisseria meningitidis Z2491
guuaaguauuucuauuuuuu

SEQ ID NO: 3366439 - RNA, 18 nt, Neisseria meningitidis Z2491
guuaauccgcuauaacag

SEQ ID NO: 3366440 - RNA, 14 nt, Neisseria meningitidis Z2491
guuaauuaaaauac

SEQ ID NO: 3366441 - RNA, 12 nt, Neisseria meningitidis Z2491
guuacagaaauu

SEQ ID NO: 3366442 - RNA, 19 nt, Neisseria meningitidis Z2491
guuacgccccucccaaaua

SEQ ID NO: 3366443 - RNA, 12 nt, Neisseria meningitidis Z2491
guuacuaaaauu

SEQ ID NO: 3366444 - RNA, 17 nt, Neisseria meningitidis Z2491
guuaggguaauuuaucc

SEQ ID NO: 3366445 - RNA, 16 nt, Neisseria meningitidis Z2491
guuauggggauuuauu

SEQ ID NO: 3366446 - RNA, 14 nt, Neisseria meningitidis Z2491
guuucuguuuuuuc

SEQ ID NO: 3366447 - RNA, 20 nt, Neisseria meningitidis Z2491
guuucuucaguuguuuuacu

SEQ ID NO: 3366448 - RNA, 21 nt, Neisseria meningitidis Z2491
guuugaaacauaaaaugccgu

SEQ ID NO: 3366449 - RNA, 21 nt, Neisseria meningitidis Z2491
guuugagaaugaaaaugccgu

SEQ ID NO: 3366450 - RNA, 21 nt, Neisseria meningitidis Z2491
guuugauauacaaaaugccgu

SEQ ID NO: 3366451 - RNA, 12 nt, Neisseria meningitidis Z2491
guuugaugaaac

SEQ ID NO: 3366452 - RNA, 23 nt, Neisseria meningitidis Z2491
guuugauggcgaaguagaagcag

SEQ ID NO: 3366453 - RNA, 16 nt, Neisseria meningitidis Z2491
guuugcagauaaauuu

SEQ ID NO: 3366454 - RNA, 16 nt, Neisseria meningitidis Z2491
guuugcauucugcgga

SEQ ID NO: 3366455 - RNA, 19 nt, Neisseria meningitidis Z2491
guuugccgaguuuuuggua

SEQ ID NO: 3366456 - RNA, 17 nt, Neisseria meningitidis Z2491
guuugccgccauaugca

SEQ ID NO: 3366457 - RNA, 16 nt, Neisseria meningitidis Z2491
guuugccgcguucgug

SEQ ID NO: 3366458 - RNA, 18 nt, Neisseria meningitidis Z2491
guuugccugauccaaacc

SEQ ID NO: 3366459 - RNA, 21 nt, Neisseria meningitidis Z2491
guuugcggcggcaaauuccgu

SEQ ID NO: 3366460 - RNA, 20 nt, Neisseria meningitidis Z2491
guuuggaauggaaaugccgu

SEQ ID NO: 3366461 - RNA, 15 nt, Neisseria meningitidis Z2491
guuuggauaugccgu

SEQ ID NO: 3366462 - RNA, 23 nt, Neisseria meningitidis Z2491
guuuggaugccgucugaaacggc

SEQ ID NO: 3366463 - RNA, 20 nt, Neisseria meningitidis Z2491
guuuggaugcguuucagagc

SEQ ID NO: 3366464 - RNA, 18 nt, Neisseria meningitidis Z2491
guuuggcgggaaugccga

SEQ ID NO: 3366465 - RNA, 22 nt, Neisseria meningitidis Z2491
guuugggcaacacaaaugccgu

SEQ ID NO: 3366466 - RNA, 20 nt, Neisseria meningitidis Z2491
guuugguaaucaguuuuuuc

SEQ ID NO: 3366467 - RNA, 22 nt, Neisseria meningitidis Z2491
guuugguaaucaguuuuuucag

SEQ ID NO: 3366468 - RNA, 18 nt, Neisseria meningitidis Z2491
guuuuacccgauaaguuu

SEQ ID NO: 3366469 - RNA, 20 nt, Neisseria meningitidis Z2491
guuuuacccgauaaguuucc

SEQ ID NO: 3366470 - RNA, 18 nt, Neisseria meningitidis Z2491
guuuuaggcaauugaaaa

SEQ ID NO: 3366471 - RNA, 23 nt, Neisseria meningitidis Z2491
guuuuaggcaauugaaaaauuuu

SEQ ID NO: 3366472 - RNA, 22 nt, Neisseria meningitidis Z2491
guuuuaggcaauugaaaauuuu

SEQ ID NO: 3366473 - RNA, 14 nt, Neisseria meningitidis Z2491
guuuuauaguggau

SEQ ID NO: 3366474 - RNA, 12 nt, Neisseria meningitidis Z2491
guuuuauauucu

SEQ ID NO: 3366475 - RNA, 20 nt, Neisseria meningitidis Z2491
guuuuauccgauaaguuucc

SEQ ID NO: 3366476 - RNA, 14 nt, Neisseria meningitidis Z2491
guuuuauuacgcaa

SEQ ID NO: 3366477 - RNA, 22 nt, Neisseria meningitidis Z2491
guuuuauuacgcaauggcaaaa

SEQ ID NO: 3366478 - RNA, 21 nt, Neisseria meningitidis Z2491
guuuuauuuuuuggcuuugaa

SEQ ID NO: 3366479 - RNA, 14 nt, Neisseria meningitidis Z2491
guuuucaagccuuc

SEQ ID NO: 3366480 - RNA, 15 nt, Neisseria meningitidis Z2491
guuuucaagccuucc

SEQ ID NO: 3366481 - RNA, 15 nt, Neisseria meningitidis Z2491
guuuucagacggcau

SEQ ID NO: 3366482 - RNA, 16 nt, Neisseria meningitidis Z2491
guuuucagacggcauu

SEQ ID NO: 3366483 - RNA, 20 nt, Neisseria meningitidis Z2491
guuuucaugguguuuccuaa

SEQ ID NO: 3366484 - RNA, 16 nt, Neisseria meningitidis Z2491
guuuuccccuguaaac

SEQ ID NO: 3366485 - RNA, 19 nt, Neisseria meningitidis Z2491
guuuuccuuucugacaaaa

SEQ ID NO: 3366486 - RNA, 19 nt, Neisseria meningitidis Z2491
guuuugcagauucaacgca

SEQ ID NO: 3366487 - RNA, 18 nt, Neisseria meningitidis Z2491
guuuuggcugaaaauaau

SEQ ID NO: 3366488 - RNA, 13 nt, Neisseria meningitidis Z2491
guuuuucaaagcc

SEQ ID NO: 3366489 - RNA, 13 nt, Neisseria meningitidis Z2491
guuuuuugaguuu

SEQ ID NO: 3366490 - RNA, 12 nt, Neisseria meningitidis Z2491
uaaaaaacaaac

SEQ ID NO: 3366491 - RNA, 17 nt, Neisseria meningitidis Z2491
uaaaaaacgccguccga

SEQ ID NO: 3366492 - RNA, 13 nt, Neisseria meningitidis Z2491
uaaaaaauacauu

SEQ ID NO: 3366493 - RNA, 12 nt, Neisseria meningitidis Z2491
uaaaaaauagaa

SEQ ID NO: 3366494 - RNA, 13 nt, Neisseria meningitidis Z2491
uaaaaaauagaaa

SEQ ID NO: 3366495 - RNA, 17 nt, Neisseria meningitidis Z2491
uaaaaaauccaaaaaua

SEQ ID NO: 3366496 - RNA, 12 nt, Neisseria meningitidis Z2491
uaaaaaaugccg

SEQ ID NO: 3366497 - RNA, 20 nt, Neisseria meningitidis Z2491
uaaaaacaaaaaaucaaaaa

SEQ ID NO: 3366498 - RNA, 23 nt, Neisseria meningitidis Z2491
uaaaaacaaaaaaucaaaaacag

SEQ ID NO: 3366499 - RNA, 14 nt, Neisseria meningitidis Z2491
uaaaaacaaaauag

SEQ ID NO: 3366500 - RNA, 15 nt, Neisseria meningitidis Z2491
uaaaaacaaaauagu

SEQ ID NO: 3366501 - RNA, 13 nt, Neisseria meningitidis Z2491
uaaaaauacauau

SEQ ID NO: 3366502 - RNA, 16 nt, Neisseria meningitidis Z2491
uaaaaaugccgucuga

SEQ ID NO: 3366503 - RNA, 23 nt, Neisseria meningitidis Z2491
uaaaaaugccgucugaaaaaccu

SEQ ID NO: 3366504 - RNA, 12 nt, Neisseria meningitidis Z2491
uaaaaauuuaau

SEQ ID NO: 3366505 - RNA, 11 nt, Neisseria meningitidis Z2491
uaaaacaaaaa

SEQ ID NO: 3366506 - RNA, 14 nt, Neisseria meningitidis Z2491
uaaaacuuaaaauu

SEQ ID NO: 3366507 - RNA, 20 nt, Neisseria meningitidis Z2491
uaaaagacccgucauucccg

SEQ ID NO: 3366508 - RNA, 21 nt, Neisseria meningitidis Z2491
uaaaagacccgucauucccgc

SEQ ID NO: 3366509 - RNA, 21 nt, Neisseria meningitidis Z2491
uaaaagcaucuuguuuuucaa

SEQ ID NO: 3366510 - RNA, 21 nt, Neisseria meningitidis Z2491
uaaaagggaacggcaucggac

SEQ ID NO: 3366511 - RNA, 20 nt, Neisseria meningitidis Z2491
uaaaaggucuagauucccgc

SEQ ID NO: 3366512 - RNA, 23 nt, Neisseria meningitidis Z2491
uaaaaggucuuuucuaaaauaug

SEQ ID NO: 3366513 - RNA, 21 nt, Neisseria meningitidis Z2491
uaaaauacgacccuuauccca

SEQ ID NO: 3366514 - RNA, 23 nt, Neisseria meningitidis Z2491
uaaaaucuauaguggauuaacaa

SEQ ID NO: 3366515 - RNA, 20 nt, Neisseria meningitidis Z2491
uaaaauuccguuauucccgc

SEQ ID NO: 3366516 - RNA, 18 nt, Neisseria meningitidis Z2491
uaaaauucgucauuccca

SEQ ID NO: 3366517 - RNA, 20 nt, Neisseria meningitidis Z2491
uaaaauucgucauucccacg

SEQ ID NO: 3366518 - RNA, 19 nt, Neisseria meningitidis Z2491
uaaaauucuagauuccugc

SEQ ID NO: 3366519 - RNA, 20 nt, Neisseria meningitidis Z2491
uaaaauuucaucauucccac

SEQ ID NO: 3366520 - RNA, 21 nt, Neisseria meningitidis Z2491
uaaaauuuuaugcucaaucuc

SEQ ID NO: 3366521 - RNA, 13 nt, Neisseria meningitidis Z2491
uaaacaaaaaaca

SEQ ID NO: 3366522 - RNA, 22 nt, Neisseria meningitidis Z2491
uaaacaaggucucggcauagcu

SEQ ID NO: 3366523 - RNA, 17 nt, Neisseria meningitidis Z2491
uaaacacggggagcaag

SEQ ID NO: 3366524 - RNA, 23 nt, Neisseria meningitidis Z2491
uaaacauuaucugacaggaaauu

SEQ ID NO: 3366525 - RNA, 15 nt, Neisseria meningitidis Z2491
uaaaccaaaaugccc

SEQ ID NO: 3366526 - RNA, 17 nt, Neisseria meningitidis Z2491
uaaaccaguacagcguu

SEQ ID NO: 3366527 - RNA, 17 nt, Neisseria meningitidis Z2491
uaaaccaguacgguguu

SEQ ID NO: 3366528 - RNA, 20 nt, Neisseria meningitidis Z2491
uaaaccaguacgguguugcc

SEQ ID NO: 3366529 - RNA, 19 nt, Neisseria meningitidis Z2491
uaaacccccgucauucccg

SEQ ID NO: 3366530 - RNA, 18 nt, Neisseria meningitidis Z2491
uaaacgguauucauaccu

SEQ ID NO: 3366531 - RNA, 15 nt, Neisseria meningitidis Z2491
uaaacucuuaaaaca

SEQ ID NO: 3366532 - RNA, 19 nt, Neisseria meningitidis Z2491
uaaacuucgguuuuuuccg

SEQ ID NO: 3366533 - RNA, 19 nt, Neisseria meningitidis Z2491
uaaacuucuaacaaauaau

SEQ ID NO: 3366534 - RNA, 13 nt, Neisseria meningitidis Z2491
uaaagauaaaucu

SEQ ID NO: 3366535 - RNA, 14 nt, Neisseria meningitidis Z2491
uaaagauacaagaa

SEQ ID NO: 3366536 - RNA, 13 nt, Neisseria meningitidis Z2491
uaaagcaauuuau

SEQ ID NO: 3366537 - RNA, 17 nt, Neisseria meningitidis Z2491
uaaagcggcaaugccgu

SEQ ID NO: 3366538 - RNA, 16 nt, Neisseria meningitidis Z2491
uaaaggcuucagacgg

SEQ ID NO: 3366539 - RNA, 19 nt, Neisseria meningitidis Z2491
uaaaggggugcguuuuauu

SEQ ID NO: 3366540 - RNA, 22 nt, Neisseria meningitidis Z2491
uaaaguccggcauaaauccuuc

SEQ ID NO: 3366541 - RNA, 18 nt, Neisseria meningitidis Z2491
uaaagugcggugaaaucu

SEQ ID NO: 3366542 - RNA, 15 nt, Neisseria meningitidis Z2491
uaaaguuaauccacu

SEQ ID NO: 3366543 - RNA, 19 nt, Neisseria meningitidis Z2491
uaaaguuaggguaauuuau

SEQ ID NO: 3366544 - RNA, 22 nt, Neisseria meningitidis Z2491
uaaauaaggcaaaauugcugca

SEQ ID NO: 3366545 - RNA, 13 nt, Neisseria meningitidis Z2491
uaaauacccauac

SEQ ID NO: 3366546 - RNA, 13 nt, Neisseria meningitidis Z2491
uaaaucaacagca

SEQ ID NO: 3366547 - RNA, 19 nt, Neisseria meningitidis Z2491
uacaaacaucugauuuuuc

SEQ ID NO: 3366548 - RNA, 21 nt, Neisseria meningitidis Z2491
uacaaacaucugauuuuucuu

SEQ ID NO: 3366549 - RNA, 16 nt, Neisseria meningitidis Z2491
uacaaaugccgucuga

SEQ ID NO: 3366550 - RNA, 13 nt, Neisseria meningitidis Z2491
uacaaccaaugcg

SEQ ID NO: 3366551 - RNA, 15 nt, Neisseria meningitidis Z2491
uacaagaacuuuauc

SEQ ID NO: 3366552 - RNA, 15 nt, Neisseria meningitidis Z2491
uacaaggcagcaccg

SEQ ID NO: 3366553 - RNA, 15 nt, Neisseria meningitidis Z2491
uacacaaaaaagcca

SEQ ID NO: 3366554 - RNA, 14 nt, Neisseria meningitidis Z2491
uacacagccaaaaa

SEQ ID NO: 3366555 - RNA, 19 nt, Neisseria meningitidis Z2491
uacacagccaaaaaaaagc

SEQ ID NO: 3366556 - RNA, 22 nt, Neisseria meningitidis Z2491
uacacagccaaaaaaaagccgu

SEQ ID NO: 3366557 - RNA, 18 nt, Neisseria meningitidis Z2491
uacacguccauacccaau

SEQ ID NO: 3366558 - RNA, 23 nt, Neisseria meningitidis Z2491
uacacuguaaucucaaaucccgu

SEQ ID NO: 3366559 - RNA, 13 nt, Neisseria meningitidis Z2491
uacacuuaaaaau

SEQ ID NO: 3366560 - RNA, 19 nt, Neisseria meningitidis Z2491
uacagauaguacugcaagg

SEQ ID NO: 3366561 - RNA, 23 nt, Neisseria meningitidis Z2491
uacauauugagaccuuugcaaua

SEQ ID NO: 3366562 - RNA, 18 nt, Neisseria meningitidis Z2491
uacaucaucuuauuuauu

SEQ ID NO: 3366563 - RNA, 14 nt, Neisseria meningitidis Z2491
uacauccaauaauc

SEQ ID NO: 3366564 - RNA, 15 nt, Neisseria meningitidis Z2491
uacauccaauaaucc

SEQ ID NO: 3366565 - RNA, 18 nt, Neisseria meningitidis Z2491
uacauuccgucauuccca

SEQ ID NO: 3366566 - RNA, 17 nt, Neisseria meningitidis Z2491
uacauuuuugauauuuu

SEQ ID NO: 3366567 - RNA, 14 nt, Neisseria meningitidis Z2491
uaccaacugagcua

SEQ ID NO: 3366568 - RNA, 14 nt, Neisseria meningitidis Z2491
uaccagaaaaaaca

SEQ ID NO: 3366569 - RNA, 13 nt, Neisseria meningitidis Z2491
uaccaucuucuuc

SEQ ID NO: 3366570 - RNA, 22 nt, Neisseria meningitidis Z2491
uaccauuguuucugaagccagc

SEQ ID NO: 3366571 - RNA, 20 nt, Neisseria meningitidis Z2491
uacccaaaaggaagucaugc

SEQ ID NO: 3366572 - RNA, 15 nt, Neisseria meningitidis Z2491
uacccaaacuuccaa

SEQ ID NO: 3366573 - RNA, 16 nt, Neisseria meningitidis Z2491
uacccaaacuuccaaa

SEQ ID NO: 3366574 - RNA, 11 nt, Neisseria meningitidis Z2491
uacccaaauac

SEQ ID NO: 3366575 - RNA, 16 nt, Neisseria meningitidis Z2491
uacccaaugacugccc

SEQ ID NO: 3366576 - RNA, 22 nt, Neisseria meningitidis Z2491
uacccaaugcgccgauuuuccg

SEQ ID NO: 3366577 - RNA, 23 nt, Neisseria meningitidis Z2491
uacccggcugucgucauuuccaa

SEQ ID NO: 3366578 - RNA, 23 nt, Neisseria meningitidis Z2491
uaccgagccuaaugcuuucgcuu

SEQ ID NO: 3366579 - RNA, 19 nt, Neisseria meningitidis Z2491
uaccgccccgaaggacaga

SEQ ID NO: 3366580 - RNA, 18 nt, Neisseria meningitidis Z2491
uaccgccccuaaaaugcc

SEQ ID NO: 3366581 - RNA, 19 nt, Neisseria meningitidis Z2491
uaccgccccuaaaaugccc

SEQ ID NO: 3366582 - RNA, 18 nt, Neisseria meningitidis Z2491
uaccgccuucaucaaaau

SEQ ID NO: 3366583 - RNA, 19 nt, Neisseria meningitidis Z2491
uaccggucagaaucgccuc

SEQ ID NO: 3366584 - RNA, 22 nt, Neisseria meningitidis Z2491
uaccgguuuaaauuuaauucac

SEQ ID NO: 3366585 - RNA, 18 nt, Neisseria meningitidis Z2491
uaccgucaaauucuuuuu

SEQ ID NO: 3366586 - RNA, 13 nt, Neisseria meningitidis Z2491
uaccgucugaaac

SEQ ID NO: 3366587 - RNA, 17 nt, Neisseria meningitidis Z2491
uaccgucugaaaccugc

SEQ ID NO: 3366588 - RNA, 18 nt, Neisseria meningitidis Z2491
uaccguuucagacggcau

SEQ ID NO: 3366589 - RNA, 20 nt, Neisseria meningitidis Z2491
uaccguuucagacggcauuu

SEQ ID NO: 3366590 - RNA, 15 nt, Neisseria meningitidis Z2491
uaccucgccuugccg

SEQ ID NO: 3366591 - RNA, 23 nt, Neisseria meningitidis Z2491
uaccucgccuugccguacuauuu

SEQ ID NO: 3366592 - RNA, 19 nt, Neisseria meningitidis Z2491
uaccugcccgacugugccc

SEQ ID NO: 3366593 - RNA, 21 nt, Neisseria meningitidis Z2491
uacgaacaggacaaaaauccu

SEQ ID NO: 3366594 - RNA, 19 nt, Neisseria meningitidis Z2491
uacgacucgcuugcuggua

SEQ ID NO: 3366595 - RNA, 18 nt, Neisseria meningitidis Z2491
uacgauuacuuauuuauc

SEQ ID NO: 3366596 - RNA, 12 nt, Neisseria meningitidis Z2491
uacgcagcaguu

SEQ ID NO: 3366597 - RNA, 20 nt, Neisseria meningitidis Z2491
uacgcccacaaauccugcug

SEQ ID NO: 3366598 - RNA, 22 nt, Neisseria meningitidis Z2491
uacgcccacaaauccugcugcu

SEQ ID NO: 3366599 - RNA, 23 nt, Neisseria meningitidis Z2491
uacgcccgcagccggggcaggcg

SEQ ID NO: 3366600 - RNA, 19 nt, Neisseria meningitidis Z2491
uacgcucggcguuuuucag

SEQ ID NO: 3366601 - RNA, 16 nt, Neisseria meningitidis Z2491
uacggaaccaauucac

SEQ ID NO: 3366602 - RNA, 17 nt, Neisseria meningitidis Z2491
uacggaaccaauucacu

SEQ ID NO: 3366603 - RNA, 17 nt, Neisseria meningitidis Z2491
uacggaaucgauucacu

SEQ ID NO: 3366604 - RNA, 13 nt, Neisseria meningitidis Z2491
uacggcaaggcga

SEQ ID NO: 3366605 - RNA, 17 nt, Neisseria meningitidis Z2491
uacggcaaggcgaggca

SEQ ID NO: 3366606 - RNA, 13 nt, Neisseria meningitidis Z2491
uacggcggcauuc

SEQ ID NO: 3366607 - RNA, 19 nt, Neisseria meningitidis Z2491
uacggggaggaaaguccgg

SEQ ID NO: 3366608 - RNA, 19 nt, Neisseria meningitidis Z2491
uacggugucagacggcauu

SEQ ID NO: 3366609 - RNA, 14 nt, Neisseria meningitidis Z2491
uacguuuuucucgu

SEQ ID NO: 3366610 - RNA, 23 nt, Neisseria meningitidis Z2491
uacuacgcggcugaaaaaaugcc

SEQ ID NO: 3366611 - RNA, 14 nt, Neisseria meningitidis Z2491
uacuaucuguacug

SEQ ID NO: 3366612 - RNA, 13 nt, Neisseria meningitidis Z2491
uacucauuuuucg

SEQ ID NO: 3366613 - RNA, 15 nt, Neisseria meningitidis Z2491
uacuccuguuuuuaa

SEQ ID NO: 3366614 - RNA, 22 nt, Neisseria meningitidis Z2491
uacucugcggacuuaagaaaca

SEQ ID NO: 3366615 - RNA, 22 nt, Neisseria meningitidis Z2491
uacugccgcaaacggcaggcaa

SEQ ID NO: 3366616 - RNA, 20 nt, Neisseria meningitidis Z2491
uacugcugcggcucugaaac

SEQ ID NO: 3366617 - RNA, 10 nt, Neisseria meningitidis Z2491
uacuggauuc

SEQ ID NO: 3366618 - RNA, 22 nt, Neisseria meningitidis Z2491
uacugguuuuuguuaauccgcu

SEQ ID NO: 3366619 - RNA, 14 nt, Neisseria meningitidis Z2491
uacuuauaucguca

SEQ ID NO: 3366620 - RNA, 15 nt, Neisseria meningitidis Z2491
uacuucauuaaagug

SEQ ID NO: 3366621 - RNA, 16 nt, Neisseria meningitidis Z2491
uacuucauuuuuucaa

SEQ ID NO: 3366622 - RNA, 13 nt, Neisseria meningitidis Z2491
uacuuggcaaaau

SEQ ID NO: 3366623 - RNA, 20 nt, Neisseria meningitidis Z2491
uagaaaaucaaaaaaaaacc

SEQ ID NO: 3366624 - RNA, 11 nt, Neisseria meningitidis Z2491
uagaaaaugcc

SEQ ID NO: 3366625 - RNA, 22 nt, Neisseria meningitidis Z2491
uagaaacgcaaagcugcaagaa

SEQ ID NO: 3366626 - RNA, 23 nt, Neisseria meningitidis Z2491
uagaaacgcaaagcugcaagaau

SEQ ID NO: 3366627 - RNA, 18 nt, Neisseria meningitidis Z2491
uagaaacucaaagcugca

SEQ ID NO: 3366628 - RNA, 23 nt, Neisseria meningitidis Z2491
uagaaaugacugaaacucaaaaa

SEQ ID NO: 3366629 - RNA, 16 nt, Neisseria meningitidis Z2491
uagaaaugccgucuga

SEQ ID NO: 3366630 - RNA, 18 nt, Neisseria meningitidis Z2491
uagaaccucuaaacuuuc

SEQ ID NO: 3366631 - RNA, 20 nt, Neisseria meningitidis Z2491
uagaacguggaaucuaaaga

SEQ ID NO: 3366632 - RNA, 14 nt, Neisseria meningitidis Z2491
uagaagccaaaaua

SEQ ID NO: 3366633 - RNA, 16 nt, Neisseria meningitidis Z2491
uagaagccaaaauauc

SEQ ID NO: 3366634 - RNA, 13 nt, Neisseria meningitidis Z2491
uagaaucuuuccg

SEQ ID NO: 3366635 - RNA, 20 nt, Neisseria meningitidis Z2491
uagaauuuauacccucucaa

SEQ ID NO: 3366636 - RNA, 15 nt, Neisseria meningitidis Z2491
uagacauucaaugcu

SEQ ID NO: 3366637 - RNA, 23 nt, Neisseria meningitidis Z2491
uagacauucaaugcuaaggcaau

SEQ ID NO: 3366638 - RNA, 18 nt, Neisseria meningitidis Z2491
uagaguuucaaaauuuau

SEQ ID NO: 3366639 - RNA, 16 nt, Neisseria meningitidis Z2491
uagauauuuagcauuu

SEQ ID NO: 3366640 - RNA, 15 nt, Neisseria meningitidis Z2491
uagaugcuccaaucu

SEQ ID NO: 3366641 - RNA, 19 nt, Neisseria meningitidis Z2491
uagauggggaggcgcggcc

SEQ ID NO: 3366642 - RNA, 15 nt, Neisseria meningitidis Z2491
uagauucccacuucc

SEQ ID NO: 3366643 - RNA, 17 nt, Neisseria meningitidis Z2491
uagauucccguuuucac

SEQ ID NO: 3366644 - RNA, 19 nt, Neisseria meningitidis Z2491
uagcaaaauaaaaugccgu

SEQ ID NO: 3366645 - RNA, 17 nt, Neisseria meningitidis Z2491
uagcaacugaaccguca

SEQ ID NO: 3366646 - RNA, 22 nt, Neisseria meningitidis Z2491
uagcaacugaaccgucauuccc

SEQ ID NO: 3366647 - RNA, 20 nt, Neisseria meningitidis Z2491
uagcagcccaguugguuuga

SEQ ID NO: 3366648 - RNA, 14 nt, Neisseria meningitidis Z2491
uaugccgccugccu

SEQ ID NO: 3366649 - RNA, 15 nt, Neisseria meningitidis Z2491
uaugccgucugaaac

SEQ ID NO: 3366650 - RNA, 20 nt, Neisseria meningitidis Z2491
uaugccgucugaagccuuca

SEQ ID NO: 3366651 - RNA, 14 nt, Neisseria meningitidis Z2491
uaugccuuuuucaa

SEQ ID NO: 3366652 - RNA, 15 nt, Neisseria meningitidis Z2491
uaugccuuuuucaaa

SEQ ID NO: 3366653 - RNA, 21 nt, Neisseria meningitidis Z2491
uaugcggcuugggcgacggcg

SEQ ID NO: 3366654 - RNA, 17 nt, Neisseria meningitidis Z2491
uaugcguucaaaugccg

SEQ ID NO: 3366655 - RNA, 18 nt, Neisseria meningitidis Z2491
uaugcguucaaaugccgu

SEQ ID NO: 3366656 - RNA, 21 nt, Neisseria meningitidis Z2491
uaugcucaaucucauuuucaa

SEQ ID NO: 3366657 - RNA, 21 nt, Neisseria meningitidis Z2491
uaugcucaaucuuauuuucaa

SEQ ID NO: 3366658 - RNA, 14 nt, Neisseria meningitidis Z2491
uauggcugucuuug

SEQ ID NO: 3366659 - RNA, 19 nt, Neisseria meningitidis Z2491
uauguauaguaauaaauua

SEQ ID NO: 3366660 - RNA, 14 nt, Neisseria meningitidis Z2491
uaugucguaaagcg

SEQ ID NO: 3366661 - RNA, 13 nt, Neisseria meningitidis Z2491
uauguucaggguu

SEQ ID NO: 3366662 - RNA, 15 nt, Neisseria meningitidis Z2491
uauguuuaaucagcu

SEQ ID NO: 3366663 - RNA, 21 nt, Neisseria meningitidis Z2491
uauuaaaaaccggauuuauuu

SEQ ID NO: 3366664 - RNA, 15 nt, Neisseria meningitidis Z2491
uauuaagaaaaacag

SEQ ID NO: 3366665 - RNA, 19 nt, Neisseria meningitidis Z2491
uauuaagugaguaaaaaca

SEQ ID NO: 3366666 - RNA, 22 nt, Neisseria meningitidis Z2491
uauuaagugaguaaaaacaauu

SEQ ID NO: 3366667 - RNA, 13 nt, Neisseria meningitidis Z2491
uauuaaucagcgc

SEQ ID NO: 3366668 - RNA, 18 nt, Neisseria meningitidis Z2491
uauuaaugauuaucauaa

SEQ ID NO: 3366669 - RNA, 19 nt, Neisseria meningitidis Z2491
uauuaaugauuaucauaaa

SEQ ID NO: 3366670 - RNA, 21 nt, Neisseria meningitidis Z2491
uauuaccgguauuuuuuucuu

SEQ ID NO: 3366671 - RNA, 22 nt, Neisseria meningitidis Z2491
uauuaccgguauuuuuuucuua

SEQ ID NO: 3366672 - RNA, 20 nt, Neisseria meningitidis Z2491
uauuacgaacaggacaaaaa

SEQ ID NO: 3366673 - RNA, 21 nt, Neisseria meningitidis Z2491
uauuacgaacaggacaaaaau

SEQ ID NO: 3366674 - RNA, 14 nt, Neisseria meningitidis Z2491
uauuagaaaugacu

SEQ ID NO: 3366675 - RNA, 16 nt, Neisseria meningitidis Z2491
uauuagaaaugacuga

SEQ ID NO: 3366676 - RNA, 21 nt, Neisseria meningitidis Z2491
uauuagaaccgaacacagaca

SEQ ID NO: 3366677 - RNA, 22 nt, Neisseria meningitidis Z2491
uauuagaaccgaacacagacau

SEQ ID NO: 3366678 - RNA, 15 nt, Neisseria meningitidis Z2491
uauuaggaagguuuu

SEQ ID NO: 3366679 - RNA, 15 nt, Neisseria meningitidis Z2491
uauuauguauauaau

SEQ ID NO: 3366680 - RNA, 21 nt, Neisseria meningitidis Z2491
uauucaaagauuaucugaaag

SEQ ID NO: 3366681 - RNA, 20 nt, Neisseria meningitidis Z2491
uauucaagcaaaucuaaaua

SEQ ID NO: 3366682 - RNA, 15 nt, Neisseria meningitidis Z2491
uauucaauugacaaa

SEQ ID NO: 3366683 - RNA, 16 nt, Neisseria meningitidis Z2491
uauucagguaaaacaa

SEQ ID NO: 3366684 - RNA, 23 nt, Neisseria meningitidis Z2491
uauucagguaaaacaaagacauc

SEQ ID NO: 3366685 - RNA, 16 nt, Neisseria meningitidis Z2491
uauucauacacagcca

SEQ ID NO: 3366686 - RNA, 20 nt, Neisseria meningitidis Z2491
uauuccccucggggucuuug

SEQ ID NO: 3366687 - RNA, 22 nt, Neisseria meningitidis Z2491
uauucccguccggcaaacauca

SEQ ID NO: 3366688 - RNA, 15 nt, Neisseria meningitidis Z2491
uauucgaccagcucc

SEQ ID NO: 3366689 - RNA, 22 nt, Neisseria meningitidis Z2491
uauucgaccagcucccaauccc

SEQ ID NO: 3366690 - RNA, 14 nt, Neisseria meningitidis Z2491
uauucugcaaaaau

SEQ ID NO: 3366691 - RNA, 21 nt, Neisseria meningitidis Z2491
uauugaagauggcugaaauug

SEQ ID NO: 3366692 - RNA, 17 nt, Neisseria meningitidis Z2491
uauugcacuaaaacuaa

SEQ ID NO: 3366693 - RNA, 22 nt, Neisseria meningitidis Z2491
uauugcccaacagcagcauaac

SEQ ID NO: 3366694 - RNA, 19 nt, Neisseria meningitidis Z2491
uauugcuguuguucuaagg

SEQ ID NO: 3366695 - RNA, 18 nt, Neisseria meningitidis Z2491
uauuggucaacucuucca

SEQ ID NO: 3366696 - RNA, 18 nt, Neisseria meningitidis Z2491
uauuuaaagcaucagcac

SEQ ID NO: 3366697 - RNA, 22 nt, Neisseria meningitidis Z2491
uauuuaaagcaucagcacacuu

SEQ ID NO: 3366698 - RNA, 14 nt, Neisseria meningitidis Z2491
uauuuaaauaaaau

SEQ ID NO: 3366699 - RNA, 16 nt, Neisseria meningitidis Z2491
uauuuaccagaaaaaa

SEQ ID NO: 3366700 - RNA, 21 nt, Neisseria meningitidis Z2491
uauuuaccagaaaaaacagaa

SEQ ID NO: 3366701 - RNA, 19 nt, Neisseria meningitidis Z2491
uauuuacguuuauuuacga

SEQ ID NO: 3366702 - RNA, 16 nt, Neisseria meningitidis Z2491
uauuuagaauaaauuu

SEQ ID NO: 3366703 - RNA, 11 nt, Neisseria meningitidis Z2491
uauuuaugaac

SEQ ID NO: 3366704 - RNA, 13 nt, Neisseria meningitidis Z2491
uauuuauuuugaa

SEQ ID NO: 3366705 - RNA, 23 nt, Neisseria meningitidis Z2491
uauuucccggcaaacuauaucua

SEQ ID NO: 3366706 - RNA, 19 nt, Neisseria meningitidis Z2491
uauuucccgucugcccauc

SEQ ID NO: 3366707 - RNA, 15 nt, Neisseria meningitidis Z2491
uauuucuauuuuuua

SEQ ID NO: 3366708 - RNA, 22 nt, Neisseria meningitidis Z2491
uauuugagugcggcaagcagcg

SEQ ID NO: 3366709 - RNA, 20 nt, Neisseria meningitidis Z2491
uauuugccgcguaugcguuc

SEQ ID NO: 3366710 - RNA, 16 nt, Neisseria meningitidis Z2491
uauuugccggucggcu

SEQ ID NO: 3366711 - RNA, 17 nt, Neisseria meningitidis Z2491
uauuuguucgauauuuu

SEQ ID NO: 3366712 - RNA, 18 nt, Neisseria meningitidis Z2491
uauuuguucgauauuuuu

SEQ ID NO: 3366713 - RNA, 20 nt, Neisseria meningitidis Z2491
uauuuuacagcggauuaaaa

SEQ ID NO: 3366714 - RNA, 21 nt, Neisseria meningitidis Z2491
uauuuuacagcggauuaaaau

SEQ ID NO: 3366715 - RNA, 18 nt, Neisseria meningitidis Z2491
uauuuucacaaaaacaga

SEQ ID NO: 3366716 - RNA, 22 nt, Neisseria meningitidis Z2491
uauuuucagauggccuuuacuc

SEQ ID NO: 3366717 - RNA, 16 nt, Neisseria meningitidis Z2491
uauuuuccauaaaaua

SEQ ID NO: 3366718 - RNA, 17 nt, Neisseria meningitidis Z2491
uauuuuccauaaaauac

SEQ ID NO: 3366719 - RNA, 12 nt, Neisseria meningitidis Z2491
uauuuucccuca

SEQ ID NO: 3366720 - RNA, 16 nt, Neisseria meningitidis Z2491
uauuuucgccccaaau

SEQ ID NO: 3366721 - RNA, 14 nt, Neisseria meningitidis Z2491
uauuuugaaaaugg

SEQ ID NO: 3366722 - RNA, 22 nt, Neisseria meningitidis Z2491
uauuuugcaagaauggcaaaau

SEQ ID NO: 3366723 - RNA, 18 nt, Neisseria meningitidis Z2491
uauuuuucugaaaaauuu

SEQ ID NO: 3366724 - RNA, 14 nt, Neisseria meningitidis Z2491
uauuuuugcccgac

SEQ ID NO: 3366725 - RNA, 13 nt, Neisseria meningitidis Z2491
ucaaaaaaaaacc

SEQ ID NO: 3366726 - RNA, 10 nt, Neisseria meningitidis Z2491
ucaaaaacag

SEQ ID NO: 3366727 - RNA, 15 nt, Neisseria meningitidis Z2491
ucaaaaacagaaaac

SEQ ID NO: 3366728 - RNA, 15 nt, Neisseria meningitidis Z2491
ucaaaaacagaaaau

SEQ ID NO: 3366729 - RNA, 19 nt, Neisseria meningitidis Z2491
ucaaaaaccugcuuguuuu

SEQ ID NO: 3366730 - RNA, 15 nt, Neisseria meningitidis Z2491
ucaaaaacgggcuuu

SEQ ID NO: 3366731 - RNA, 21 nt, Neisseria meningitidis Z2491
ucaaaaccgcaccgggcuuca

SEQ ID NO: 3366732 - RNA, 15 nt, Neisseria meningitidis Z2491
ucaaaagccguguga

SEQ ID NO: 3366733 - RNA, 23 nt, Neisseria meningitidis Z2491
ucaaaagccgugugaaaauuuaa

SEQ ID NO: 3366734 - RNA, 15 nt, Neisseria meningitidis Z2491
ucaaaagguucaaac

SEQ ID NO: 3366735 - RNA, 13 nt, Neisseria meningitidis Z2491
ucaaaaucagaaa

SEQ ID NO: 3366736 - RNA, 17 nt, Neisseria meningitidis Z2491
ucaaaaucagaaaccua

SEQ ID NO: 3366737 - RNA, 15 nt, Neisseria meningitidis Z2491
ucaaaaucaucccaa

SEQ ID NO: 3366738 - RNA, 15 nt, Neisseria meningitidis Z2491
ucaaaaucggcauuc

SEQ ID NO: 3366739 - RNA, 15 nt, Neisseria meningitidis Z2491
ucaaaaugacacaaa

SEQ ID NO: 3366740 - RNA, 13 nt, Neisseria meningitidis Z2491
ucaaaaugcaaaa

SEQ ID NO: 3366741 - RNA, 15 nt, Neisseria meningitidis Z2491
ucaaaaugcaaaacu

SEQ ID NO: 3366742 - RNA, 22 nt, Neisseria meningitidis Z2491
ucaaacaagaaaugauacgcga

SEQ ID NO: 3366743 - RNA, 13 nt, Neisseria meningitidis Z2491
ucaaacaucugcc

SEQ ID NO: 3366744 - RNA, 23 nt, Neisseria meningitidis Z2491
ucaaacccuccgccucugccagc

SEQ ID NO: 3366745 - RNA, 21 nt, Neisseria meningitidis Z2491
ucaaacgguacaggaaaguag

SEQ ID NO: 3366746 - RNA, 22 nt, Neisseria meningitidis Z2491
ucaaacucacccugcaaggcgg

SEQ ID NO: 3366747 - RNA, 19 nt, Neisseria meningitidis Z2491
ucaaagagaacaauucucu

SEQ ID NO: 3366748 - RNA, 20 nt, Neisseria meningitidis Z2491
ucaaagauuaucugaaaguu

SEQ ID NO: 3366749 - RNA, 22 nt, Neisseria meningitidis Z2491
ucagauugauaaaagcacaaau

SEQ ID NO: 3366750 - RNA, 22 nt, Neisseria meningitidis Z2491
ucagauuuuggagcaguaaaau

SEQ ID NO: 3366751 - RNA, 18 nt, Neisseria meningitidis Z2491
ucagcaccuuagagaauc

SEQ ID NO: 3366752 - RNA, 18 nt, Neisseria meningitidis Z2491
ucagcacggggauuuucg

SEQ ID NO: 3366753 - RNA, 22 nt, Neisseria meningitidis Z2491
ucagcaggggauugccgccccu

SEQ ID NO: 3366754 - RNA, 16 nt, Neisseria meningitidis Z2491
ucagcaguauagugaa

SEQ ID NO: 3366755 - RNA, 21 nt, Neisseria meningitidis Z2491
ucagccaucuacaaaauaauc

SEQ ID NO: 3366756 - RNA, 16 nt, Neisseria meningitidis Z2491
ucagcccgaaauaggc

SEQ ID NO: 3366757 - RNA, 23 nt, Neisseria meningitidis Z2491
ucagcgcaaugcgccugcggcug

SEQ ID NO: 3366758 - RNA, 23 nt, Neisseria meningitidis Z2491
ucagcggcaaaaccgaugcagaa

SEQ ID NO: 3366759 - RNA, 15 nt, Neisseria meningitidis Z2491
ucagcuguuuucagc

SEQ ID NO: 3366760 - RNA, 15 nt, Neisseria meningitidis Z2491
ucaggaacaucagca

SEQ ID NO: 3366761 - RNA, 14 nt, Neisseria meningitidis Z2491
ucaggaaugcaaac

SEQ ID NO: 3366762 - RNA, 14 nt, Neisseria meningitidis Z2491
ucaggacaaggcga

SEQ ID NO: 3366763 - RNA, 15 nt, Neisseria meningitidis Z2491
ucaggacaaggcgac

SEQ ID NO: 3366764 - RNA, 21 nt, Neisseria meningitidis Z2491
ucaggacaaggcgacgaagcc

SEQ ID NO: 3366765 - RNA, 23 nt, Neisseria meningitidis Z2491
ucaggacaaggcgacgaagccgc

SEQ ID NO: 3366766 - RNA, 20 nt, Neisseria meningitidis Z2491
ucaggacucgaacaccaauu

SEQ ID NO: 3366767 - RNA, 17 nt, Neisseria meningitidis Z2491
ucaggaugucugccuga

SEQ ID NO: 3366768 - RNA, 15 nt, Neisseria meningitidis Z2491
ucaggauguuuucgg

SEQ ID NO: 3366769 - RNA, 19 nt, Neisseria meningitidis Z2491
ucaggcacaaacaaggcga

SEQ ID NO: 3366770 - RNA, 14 nt, Neisseria meningitidis Z2491
ucaggcacgaagcc

SEQ ID NO: 3366771 - RNA, 19 nt, Neisseria meningitidis Z2491
ucaggcggcguucuucuuc

SEQ ID NO: 3366772 - RNA, 18 nt, Neisseria meningitidis Z2491
ucaggcugccuuauguau

SEQ ID NO: 3366773 - RNA, 19 nt, Neisseria meningitidis Z2491
ucaggcuuuuucgccagca

SEQ ID NO: 3366774 - RNA, 17 nt, Neisseria meningitidis Z2491
ucaggcuuuuuugacga

SEQ ID NO: 3366775 - RNA, 19 nt, Neisseria meningitidis Z2491
ucagggcugcaaaauuuau

SEQ ID NO: 3366776 - RNA, 22 nt, Neisseria meningitidis Z2491
ucaggggauuauuuauuuugaa

SEQ ID NO: 3366777 - RNA, 16 nt, Neisseria meningitidis Z2491
ucaggguaaacagggc

SEQ ID NO: 3366778 - RNA, 24 nt, Neisseria meningitidis Z2491
ucaggguaaacagggcugcgccuu

SEQ ID NO: 3366779 - RNA, 15 nt, Neisseria meningitidis Z2491
ucaggguguuugccg

SEQ ID NO: 3366780 - RNA, 24 nt, Neisseria meningitidis Z2491
ucagguggcuuugcgcacucacuu

SEQ ID NO: 3366781 - RNA, 19 nt, Neisseria meningitidis Z2491
ucagguuugugucccauug

SEQ ID NO: 3366782 - RNA, 22 nt, Neisseria meningitidis Z2491
ucaguacggcguugccucgccu

SEQ ID NO: 3366783 - RNA, 21 nt, Neisseria meningitidis Z2491
ucaguauuuuacaaucagaau

SEQ ID NO: 3366784 - RNA, 18 nt, Neisseria meningitidis Z2491
ucagucggacaaaaugcc

SEQ ID NO: 3366785 - RNA, 23 nt, Neisseria meningitidis Z2491
ucaguugguagagcgcaaccuug

SEQ ID NO: 3366786 - RNA, 13 nt, Neisseria meningitidis Z2491
ucaguuuuuucag

SEQ ID NO: 3366787 - RNA, 22 nt, Neisseria meningitidis Z2491
ucauaaaaucuauuauucgcua

SEQ ID NO: 3366788 - RNA, 22 nt, Neisseria meningitidis Z2491
ucauaaguuucccgaaauucca

SEQ ID NO: 3366789 - RNA, 17 nt, Neisseria meningitidis Z2491
ucauacauagcaggcau

SEQ ID NO: 3366790 - RNA, 20 nt, Neisseria meningitidis Z2491
ucauacguuuugguugcgcc

SEQ ID NO: 3366791 - RNA, 21 nt, Neisseria meningitidis Z2491
ucauacguuuugguugcgccg

SEQ ID NO: 3366792 - RNA, 15 nt, Neisseria meningitidis Z2491
ucauagaaaucagcg

SEQ ID NO: 3366793 - RNA, 13 nt, Neisseria meningitidis Z2491
ucauagacgguuu

SEQ ID NO: 3366794 - RNA, 18 nt, Neisseria meningitidis Z2491
ucauauucacuaaauugc

SEQ ID NO: 3366795 - RNA, 20 nt, Neisseria meningitidis Z2491
ucaucaucggcguaauaaua

SEQ ID NO: 3366796 - RNA, 14 nt, Neisseria meningitidis Z2491
ucaucauucccaca

SEQ ID NO: 3366797 - RNA, 16 nt, Neisseria meningitidis Z2491
ucauccaccagcccgc

SEQ ID NO: 3366798 - RNA, 15 nt, Neisseria meningitidis Z2491
ucaucccaaacaucg

SEQ ID NO: 3366799 - RNA, 19 nt, Neisseria meningitidis Z2491
ucaucgccguaaccgacga

SEQ ID NO: 3366800 - RNA, 13 nt, Neisseria meningitidis Z2491
ucaucgcgcugcc

SEQ ID NO: 3366801 - RNA, 18 nt, Neisseria meningitidis Z2491
ucaucggcaaucagucau

SEQ ID NO: 3366802 - RNA, 13 nt, Neisseria meningitidis Z2491
ucaucucuucuau

SEQ ID NO: 3366803 - RNA, 13 nt, Neisseria meningitidis Z2491
ucaugcccaaaag

SEQ ID NO: 3366804 - RNA, 18 nt, Neisseria meningitidis Z2491
ucauguaguagcgcgcca

SEQ ID NO: 3366805 - RNA, 14 nt, Neisseria meningitidis Z2491
ucauguuauuauuu

SEQ ID NO: 3366806 - RNA, 19 nt, Neisseria meningitidis Z2491
ucauguuauuauuuuccau

SEQ ID NO: 3366807 - RNA, 20 nt, Neisseria meningitidis Z2491
ucauguuauuauuuuccaua

SEQ ID NO: 3366808 - RNA, 15 nt, Neisseria meningitidis Z2491
ucauucccacaaaga

SEQ ID NO: 3366809 - RNA, 11 nt, Neisseria meningitidis Z2491
ucauucccacg

SEQ ID NO: 3366810 - RNA, 16 nt, Neisseria meningitidis Z2491
ucauucccacgaaagu

SEQ ID NO: 3366811 - RNA, 18 nt, Neisseria meningitidis Z2491
ucauucccgccacuuucc

SEQ ID NO: 3366812 - RNA, 23 nt, Neisseria meningitidis Z2491
ucauuccgcgcaggcggaaauua

SEQ ID NO: 3366813 - RNA, 17 nt, Neisseria meningitidis Z2491
ucauuccuacgaaccua

SEQ ID NO: 3366814 - RNA, 23 nt, Neisseria meningitidis Z2491
ucauuccucaaaaacagaaaacc

SEQ ID NO: 3366815 - RNA, 22 nt, Neisseria meningitidis Z2491
ucauuccuguaaaaacaaaaaa

SEQ ID NO: 3366816 - RNA, 17 nt, Neisseria meningitidis Z2491
ucauucucgcgaaagcg

SEQ ID NO: 3366817 - RNA, 18 nt, Neisseria meningitidis Z2491
ucauugcauggacauucu

SEQ ID NO: 3366818 - RNA, 19 nt, Neisseria meningitidis Z2491
ucauugcuuacaauccgcu

SEQ ID NO: 3366819 - RNA, 21 nt, Neisseria meningitidis Z2491
ucauugguaaacaguuucagc

SEQ ID NO: 3366820 - RNA, 16 nt, Neisseria meningitidis Z2491
ucauuucugauaaacc

SEQ ID NO: 3366821 - RNA, 16 nt, Neisseria meningitidis Z2491
ucauuucugauaaauu

SEQ ID NO: 3366822 - RNA, 20 nt, Neisseria meningitidis Z2491
ucauuucuggauucccacuu

SEQ ID NO: 3366823 - RNA, 16 nt, Neisseria meningitidis Z2491
ucauuuucaaaaugca

SEQ ID NO: 3366824 - RNA, 14 nt, Neisseria meningitidis Z2491
ucauuuuuggcuug

SEQ ID NO: 3366825 - RNA, 15 nt, Neisseria meningitidis Z2491
ucauuuuuggcuuga

SEQ ID NO: 3366826 - RNA, 22 nt, Neisseria meningitidis Z2491
uccaaaaauacgcguaagcgga

SEQ ID NO: 3366827 - RNA, 23 nt, Neisseria meningitidis Z2491
uccaaaacggcggcagccugaaa

SEQ ID NO: 3366828 - RNA, 16 nt, Neisseria meningitidis Z2491
uccaaacaaaaaugcc

SEQ ID NO: 3366829 - RNA, 21 nt, Neisseria meningitidis Z2491
uccaaaccuuugagcuggauu

SEQ ID NO: 3366830 - RNA, 17 nt, Neisseria meningitidis Z2491
uccaaacuuccgaugug

SEQ ID NO: 3366831 - RNA, 22 nt, Neisseria meningitidis Z2491
uccaaacuuguccgcacggaaa

SEQ ID NO: 3366832 - RNA, 12 nt, Neisseria meningitidis Z2491
uccaaagagaaa

SEQ ID NO: 3366833 - RNA, 21 nt, Neisseria meningitidis Z2491
uccaaagagaaagaacccaaa

SEQ ID NO: 3366834 - RNA, 21 nt, Neisseria meningitidis Z2491
uccaaaggagcaauuaaauuu

SEQ ID NO: 3366835 - RNA, 20 nt, Neisseria meningitidis Z2491
uccaaagucagggcggacgc

SEQ ID NO: 3366836 - RNA, 17 nt, Neisseria meningitidis Z2491
uccaacccuccgccgca

SEQ ID NO: 3366837 - RNA, 18 nt, Neisseria meningitidis Z2491
uccaaccuucccgcgcca

SEQ ID NO: 3366838 - RNA, 14 nt, Neisseria meningitidis Z2491
uccaacuuggcaac

SEQ ID NO: 3366839 - RNA, 13 nt, Neisseria meningitidis Z2491
uccaaggcacggu

SEQ ID NO: 3366840 - RNA, 19 nt, Neisseria meningitidis Z2491
uccaaguuccaauacauuu

SEQ ID NO: 3366841 - RNA, 19 nt, Neisseria meningitidis Z2491
uccaaguuuuuuagauaag

SEQ ID NO: 3366842 - RNA, 16 nt, Neisseria meningitidis Z2491
uccacaaaagauacac

SEQ ID NO: 3366843 - RNA, 19 nt, Neisseria meningitidis Z2491
uccacaauucaauuaaaua

SEQ ID NO: 3366844 - RNA, 16 nt, Neisseria meningitidis Z2491
uccacagagauuguuu

SEQ ID NO: 3366845 - RNA, 19 nt, Neisseria meningitidis Z2491
uccacagccgcaaaagcca

SEQ ID NO: 3366846 - RNA, 17 nt, Neisseria meningitidis Z2491
uccacauuuggaaaugu

SEQ ID NO: 3366847 - RNA, 18 nt, Neisseria meningitidis Z2491
uccacgcaaucaagaaga

SEQ ID NO: 3366848 - RNA, 17 nt, Neisseria meningitidis Z2491
uccacggacacccgaua

SEQ ID NO: 3366849 - RNA, 15 nt, Neisseria meningitidis Z2491
uccguaccgcgcgcc

SEQ ID NO: 3366850 - RNA, 19 nt, Neisseria meningitidis Z2491
uccguaucggcauauguuu

SEQ ID NO: 3366851 - RNA, 15 nt, Neisseria meningitidis Z2491
uccguauggauggau

SEQ ID NO: 3366852 - RNA, 18 nt, Neisseria meningitidis Z2491
uccgucaggcacgaagcc

SEQ ID NO: 3366853 - RNA, 14 nt, Neisseria meningitidis Z2491
uccgucauucccac

SEQ ID NO: 3366854 - RNA, 15 nt, Neisseria meningitidis Z2491
uccgucauucccacg

SEQ ID NO: 3366855 - RNA, 23 nt, Neisseria meningitidis Z2491
uccgugucaggaugucugccuga

SEQ ID NO: 3366856 - RNA, 18 nt, Neisseria meningitidis Z2491
uccguuaucccauaaaaa

SEQ ID NO: 3366857 - RNA, 16 nt, Neisseria meningitidis Z2491
uccuacaaggacaaaa

SEQ ID NO: 3366858 - RNA, 21 nt, Neisseria meningitidis Z2491
uccuacuuuuugcucaauauu

SEQ ID NO: 3366859 - RNA, 22 nt, Neisseria meningitidis Z2491
uccucaaaaacagaaaaccaaa

SEQ ID NO: 3366860 - RNA, 21 nt, Neisseria meningitidis Z2491
uccucacugccgccaauccug

SEQ ID NO: 3366861 - RNA, 16 nt, Neisseria meningitidis Z2491
uccucaucguucaaca

SEQ ID NO: 3366862 - RNA, 20 nt, Neisseria meningitidis Z2491
uccucaucguucaacagcag

SEQ ID NO: 3366863 - RNA, 22 nt, Neisseria meningitidis Z2491
uccucaucguucaacagcagcg

SEQ ID NO: 3366864 - RNA, 16 nt, Neisseria meningitidis Z2491
uccuccacuaaaaaau

SEQ ID NO: 3366865 - RNA, 16 nt, Neisseria meningitidis Z2491
uccucccuccccccgu

SEQ ID NO: 3366866 - RNA, 14 nt, Neisseria meningitidis Z2491
uccuccgcaaacac

SEQ ID NO: 3366867 - RNA, 16 nt, Neisseria meningitidis Z2491
uccuccgucaaaacau

SEQ ID NO: 3366868 - RNA, 18 nt, Neisseria meningitidis Z2491
uccucgauuugaaaucug

SEQ ID NO: 3366869 - RNA, 14 nt, Neisseria meningitidis Z2491
uccucuuucaucau

SEQ ID NO: 3366870 - RNA, 16 nt, Neisseria meningitidis Z2491
uccucuuucaucauau

SEQ ID NO: 3366871 - RNA, 15 nt, Neisseria meningitidis Z2491
uccugacaaauuccc

SEQ ID NO: 3366872 - RNA, 23 nt, Neisseria meningitidis Z2491
uccugacggacacgcccucaaac

SEQ ID NO: 3366873 - RNA, 12 nt, Neisseria meningitidis Z2491
uccugauuuaaa

SEQ ID NO: 3366874 - RNA, 15 nt, Neisseria meningitidis Z2491
uccugauuuaaauuu

SEQ ID NO: 3366875 - RNA, 22 nt, Neisseria meningitidis Z2491
uccugauuuaaauuuaauccgc

SEQ ID NO: 3366876 - RNA, 21 nt, Neisseria meningitidis Z2491
uccugauuuuuguuaaucacu

SEQ ID NO: 3366877 - RNA, 22 nt, Neisseria meningitidis Z2491
uccugauuuuuguuaauccacu

SEQ ID NO: 3366878 - RNA, 18 nt, Neisseria meningitidis Z2491
uccugcagguagcggcug

SEQ ID NO: 3366879 - RNA, 19 nt, Neisseria meningitidis Z2491
uccugccaaugccuuuucc

SEQ ID NO: 3366880 - RNA, 20 nt, Neisseria meningitidis Z2491
uccugcugcugguuuuucgg

SEQ ID NO: 3366881 - RNA, 23 nt, Neisseria meningitidis Z2491
uccugcuuauugcacuaaaacua

SEQ ID NO: 3366882 - RNA, 16 nt, Neisseria meningitidis Z2491
uccugugguuuuucgg

SEQ ID NO: 3366883 - RNA, 15 nt, Neisseria meningitidis Z2491
uccuguuauuuucac

SEQ ID NO: 3366884 - RNA, 14 nt, Neisseria meningitidis Z2491
uccuguuuucagac

SEQ ID NO: 3366885 - RNA, 13 nt, Neisseria meningitidis Z2491
uccuguuuuuaac

SEQ ID NO: 3366886 - RNA, 13 nt, Neisseria meningitidis Z2491
uccuuaaaaaagg

SEQ ID NO: 3366887 - RNA, 13 nt, Neisseria meningitidis Z2491
uccuucagcucuc

SEQ ID NO: 3366888 - RNA, 12 nt, Neisseria meningitidis Z2491
uccuuccaucac

SEQ ID NO: 3366889 - RNA, 14 nt, Neisseria meningitidis Z2491
uccuucugaaauau

SEQ ID NO: 3366890 - RNA, 17 nt, Neisseria meningitidis Z2491
uccuuucccucccgaca

SEQ ID NO: 3366891 - RNA, 12 nt, Neisseria meningitidis Z2491
uccuuucugaca

SEQ ID NO: 3366892 - RNA, 13 nt, Neisseria meningitidis Z2491
uccuuuuuaaagg

SEQ ID NO: 3366893 - RNA, 14 nt, Neisseria meningitidis Z2491
ucgaaacuuaaaaa

SEQ ID NO: 3366894 - RNA, 18 nt, Neisseria meningitidis Z2491
ucgaaauauugccagccc

SEQ ID NO: 3366895 - RNA, 13 nt, Neisseria meningitidis Z2491
ucgaaaugccguc

SEQ ID NO: 3366896 - RNA, 16 nt, Neisseria meningitidis Z2491
ucgaaaugccgucuga

SEQ ID NO: 3366897 - RNA, 20 nt, Neisseria meningitidis Z2491
ucgaacaccaauuccgguuc

SEQ ID NO: 3366898 - RNA, 21 nt, Neisseria meningitidis Z2491
ucgaagaagugggucagcccc

SEQ ID NO: 3366899 - RNA, 12 nt, Neisseria meningitidis Z2491
ucgacagcagcc

SEQ ID NO: 3366900 - RNA, 17 nt, Neisseria meningitidis Z2491
ucgaccugcuguuugag

SEQ ID NO: 3366901 - RNA, 18 nt, Neisseria meningitidis Z2491
ucgagacucguuucccgc

SEQ ID NO: 3366902 - RNA, 15 nt, Neisseria meningitidis Z2491
ucgagacucguuuuc

SEQ ID NO: 3366903 - RNA, 16 nt, Neisseria meningitidis Z2491
ucgagccaugcgugcc

SEQ ID NO: 3366904 - RNA, 19 nt, Neisseria meningitidis Z2491
ucgagcugccuuuuaccuu

SEQ ID NO: 3366905 - RNA, 14 nt, Neisseria meningitidis Z2491
ucgaggaugucgga

SEQ ID NO: 3366906 - RNA, 16 nt, Neisseria meningitidis Z2491
ucgaguaaaacgguuu

SEQ ID NO: 3366907 - RNA, 18 nt, Neisseria meningitidis Z2491
ucgauauccgacugugcc

SEQ ID NO: 3366908 - RNA, 13 nt, Neisseria meningitidis Z2491
ucgauaucgccuc

SEQ ID NO: 3366909 - RNA, 17 nt, Neisseria meningitidis Z2491
ucgauaugaaaagaccg

SEQ ID NO: 3366910 - RNA, 17 nt, Neisseria meningitidis Z2491
ucgaugccguucaauuc

SEQ ID NO: 3366911 - RNA, 20 nt, Neisseria meningitidis Z2491
ucgaugcgguugaucauuuc

SEQ ID NO: 3366912 - RNA, 16 nt, Neisseria meningitidis Z2491
ucgaugcguuccugcc

SEQ ID NO: 3366913 - RNA, 18 nt, Neisseria meningitidis Z2491
ucgaugugguagagaaaa

SEQ ID NO: 3366914 - RNA, 17 nt, Neisseria meningitidis Z2491
ucgauguuuuugucuuu

SEQ ID NO: 3366915 - RNA, 15 nt, Neisseria meningitidis Z2491
ucgcaagccaagaua

SEQ ID NO: 3366916 - RNA, 17 nt, Neisseria meningitidis Z2491
ucgcacauuuuuuucau

SEQ ID NO: 3366917 - RNA, 21 nt, Neisseria meningitidis Z2491
ucgcacauuuuuuucauaccc

SEQ ID NO: 3366918 - RNA, 16 nt, Neisseria meningitidis Z2491
ucgcacucugaaagcc

SEQ ID NO: 3366919 - RNA, 15 nt, Neisseria meningitidis Z2491
ucgcagcaguauuag

SEQ ID NO: 3366920 - RNA, 22 nt, Neisseria meningitidis Z2491
ucgcaucggcggcguauuugcu

SEQ ID NO: 3366921 - RNA, 19 nt, Neisseria meningitidis Z2491
ucgccaggcguauauggcu

SEQ ID NO: 3366922 - RNA, 18 nt, Neisseria meningitidis Z2491
ucgccauaaucugcggca

SEQ ID NO: 3366923 - RNA, 13 nt, Neisseria meningitidis Z2491
ucgccccaaauac

SEQ ID NO: 3366924 - RNA, 18 nt, Neisseria meningitidis Z2491
ucgccgaacgccaucacg

SEQ ID NO: 3366925 - RNA, 16 nt, Neisseria meningitidis Z2491
ucgccgccuuguccug

SEQ ID NO: 3366926 - RNA, 21 nt, Neisseria meningitidis Z2491
ucgccgcgcuggucggcagua

SEQ ID NO: 3366927 - RNA, 12 nt, Neisseria meningitidis Z2491
ucgccgcuucuu

SEQ ID NO: 3366928 - RNA, 20 nt, Neisseria meningitidis Z2491
ucgccgguuucaucggcacg

SEQ ID NO: 3366929 - RNA, 13 nt, Neisseria meningitidis Z2491
ucgccuuaaaaaa

SEQ ID NO: 3366930 - RNA, 13 nt, Neisseria meningitidis Z2491
ucgccuuguccug

SEQ ID NO: 3366931 - RNA, 13 nt, Neisseria meningitidis Z2491
ucgcgaaagcggg

SEQ ID NO: 3366932 - RNA, 14 nt, Neisseria meningitidis Z2491
ucgcgcccaaggcu

SEQ ID NO: 3366933 - RNA, 18 nt, Neisseria meningitidis Z2491
ucgcgcgaaugugcgccg

SEQ ID NO: 3366934 - RNA, 20 nt, Neisseria meningitidis Z2491
ucgcgguuguggaaggcggg

SEQ ID NO: 3366935 - RNA, 16 nt, Neisseria meningitidis Z2491
ucgcguaccaaaaccg

SEQ ID NO: 3366936 - RNA, 15 nt, Neisseria meningitidis Z2491
ucgcucaaauucugu

SEQ ID NO: 3366937 - RNA, 17 nt, Neisseria meningitidis Z2491
ucgcuucggauaaauuu

SEQ ID NO: 3366938 - RNA, 16 nt, Neisseria meningitidis Z2491
ucgcuugauuuucggc

SEQ ID NO: 3366939 - RNA, 21 nt, Neisseria meningitidis Z2491
ucggaaaugacugaaacucaa

SEQ ID NO: 3366940 - RNA, 22 nt, Neisseria meningitidis Z2491
ucggaaaugaucaggcggauuu

SEQ ID NO: 3366941 - RNA, 14 nt, Neisseria meningitidis Z2491
ucggaacagcauca

SEQ ID NO: 3366942 - RNA, 14 nt, Neisseria meningitidis Z2491
ucggacaagggaaa

SEQ ID NO: 3366943 - RNA, 16 nt, Neisseria meningitidis Z2491
ucggacacgcccgacu

SEQ ID NO: 3366944 - RNA, 23 nt, Neisseria meningitidis Z2491
ucggacauuugacuugaaggcgu

SEQ ID NO: 3366945 - RNA, 12 nt, Neisseria meningitidis Z2491
ucggagcaagac

SEQ ID NO: 3366946 - RNA, 21 nt, Neisseria meningitidis Z2491
ucggagugauuaucaccaccc

SEQ ID NO: 3366947 - RNA, 16 nt, Neisseria meningitidis Z2491
ucggauaaauuuugca

SEQ ID NO: 3366948 - RNA, 20 nt, Neisseria meningitidis Z2491
ucggcaaucauuucugucug

SEQ ID NO: 3366949 - RNA, 11 nt, Neisseria meningitidis Z2491
ucggcaaugcc

SEQ ID NO: 3366950 - RNA, 21 nt, Neisseria meningitidis Z2491
ucggcaauuugacacuucaca

SEQ ID NO: 3366951 - RNA, 22 nt, Neisseria meningitidis Z2491
ucugaagccuucagacggcaua

SEQ ID NO: 3366952 - RNA, 17 nt, Neisseria meningitidis Z2491
ucugaagcgguucagac

SEQ ID NO: 3366953 - RNA, 17 nt, Neisseria meningitidis Z2491
ucugacaaaaaugccgu

SEQ ID NO: 3366954 - RNA, 17 nt, Neisseria meningitidis Z2491
ucugacaaaacgcccuu

SEQ ID NO: 3366955 - RNA, 16 nt, Neisseria meningitidis Z2491
ucugacagcauuucca

SEQ ID NO: 3366956 - RNA, 22 nt, Neisseria meningitidis Z2491
ucugagaccuuugcaaaaauaa

SEQ ID NO: 3366957 - RNA, 16 nt, Neisseria meningitidis Z2491
ucugauagccgcccaa

SEQ ID NO: 3366958 - RNA, 17 nt, Neisseria meningitidis Z2491
ucugauuuuaaggcggu

SEQ ID NO: 3366959 - RNA, 12 nt, Neisseria meningitidis Z2491
ucugauuuugau

SEQ ID NO: 3366960 - RNA, 17 nt, Neisseria meningitidis Z2491
ucugauuuugguuuucu

SEQ ID NO: 3366961 - RNA, 18 nt, Neisseria meningitidis Z2491
ucugauuuugguuuucug

SEQ ID NO: 3366962 - RNA, 18 nt, Neisseria meningitidis Z2491
ucugauuuuguuuuugag

SEQ ID NO: 3366963 - RNA, 20 nt, Neisseria meningitidis Z2491
ucugauuuuguuuuugagag

SEQ ID NO: 3366964 - RNA, 21 nt, Neisseria meningitidis Z2491
ucugauuuuuccuacuuuuug

SEQ ID NO: 3366965 - RNA, 19 nt, Neisseria meningitidis Z2491
ucugauuuuucuuuuauuu

SEQ ID NO: 3366966 - RNA, 23 nt, Neisseria meningitidis Z2491
ucugauuuuucuuuuauuuucaa

SEQ ID NO: 3366967 - RNA, 17 nt, Neisseria meningitidis Z2491
ucugcagcuucgucgcc

SEQ ID NO: 3366968 - RNA, 18 nt, Neisseria meningitidis Z2491
ucugcauauaggcaagca

SEQ ID NO: 3366969 - RNA, 17 nt, Neisseria meningitidis Z2491
ucugcaucgccgcuuca

SEQ ID NO: 3366970 - RNA, 21 nt, Neisseria meningitidis Z2491
ucugccccguuuuacccucuc

SEQ ID NO: 3366971 - RNA, 21 nt, Neisseria meningitidis Z2491
ucugccgccgccuugugccug

SEQ ID NO: 3366972 - RNA, 17 nt, Neisseria meningitidis Z2491
ucugccgucauucccgc

SEQ ID NO: 3366973 - RNA, 18 nt, Neisseria meningitidis Z2491
ucugccugauacagccac

SEQ ID NO: 3366974 - RNA, 15 nt, Neisseria meningitidis Z2491
ucugcgaaacagaca

SEQ ID NO: 3366975 - RNA, 22 nt, Neisseria meningitidis Z2491
ucugcgaaagcgggaaugccga

SEQ ID NO: 3366976 - RNA, 18 nt, Neisseria meningitidis Z2491
ucugcggcucgccgccuu

SEQ ID NO: 3366977 - RNA, 19 nt, Neisseria meningitidis Z2491
ucugcggcuucgucgccuu

SEQ ID NO: 3366978 - RNA, 13 nt, Neisseria meningitidis Z2491
ucugcugccaucu

SEQ ID NO: 3366979 - RNA, 15 nt, Neisseria meningitidis Z2491
ucugcugccaucuca

SEQ ID NO: 3366980 - RNA, 18 nt, Neisseria meningitidis Z2491
ucuggaaaccaaaaaaca

SEQ ID NO: 3366981 - RNA, 14 nt, Neisseria meningitidis Z2491
ucuggauucccacu

SEQ ID NO: 3366982 - RNA, 15 nt, Neisseria meningitidis Z2491
ucuggggaauaaucu

SEQ ID NO: 3366983 - RNA, 12 nt, Neisseria meningitidis Z2491
ucuguaaagaaa

SEQ ID NO: 3366984 - RNA, 16 nt, Neisseria meningitidis Z2491
ucuguauuuguauagu

SEQ ID NO: 3366985 - RNA, 21 nt, Neisseria meningitidis Z2491
ucugucgucagcgauacaucu

SEQ ID NO: 3366986 - RNA, 16 nt, Neisseria meningitidis Z2491
ucuguuucgguuuucu

SEQ ID NO: 3366987 - RNA, 16 nt, Neisseria meningitidis Z2491
ucuguuucuuuuugcu

SEQ ID NO: 3366988 - RNA, 22 nt, Neisseria meningitidis Z2491
ucuguuuggcuuuuuucuguuu

SEQ ID NO: 3366989 - RNA, 18 nt, Neisseria meningitidis Z2491
ucuguuuuuccgacaaau

SEQ ID NO: 3366990 - RNA, 22 nt, Neisseria meningitidis Z2491
ucuguuuuuccgacaaauuccu

SEQ ID NO: 3366991 - RNA, 18 nt, Neisseria meningitidis Z2491
ucuguuuuugugggaaug

SEQ ID NO: 3366992 - RNA, 12 nt, Neisseria meningitidis Z2491
ucuguuuuuucc

SEQ ID NO: 3366993 - RNA, 20 nt, Neisseria meningitidis Z2491
ucuguuuuuuccgauaaauu

SEQ ID NO: 3366994 - RNA, 23 nt, Neisseria meningitidis Z2491
ucuguuuuuuccgauaaauuccu

SEQ ID NO: 3366995 - RNA, 23 nt, Neisseria meningitidis Z2491
ucuguuuuuuccgguaaauuccu

SEQ ID NO: 3366996 - RNA, 14 nt, Neisseria meningitidis Z2491
ucuuaagaugaagu

SEQ ID NO: 3366997 - RNA, 16 nt, Neisseria meningitidis Z2491
ucuuacgucauucuuu

SEQ ID NO: 3366998 - RNA, 15 nt, Neisseria meningitidis Z2491
ucuuaugccuauuuu

SEQ ID NO: 3366999 - RNA, 22 nt, Neisseria meningitidis Z2491
ucuucaaaaucaucccaaacau

SEQ ID NO: 3367000 - RNA, 20 nt, Neisseria meningitidis Z2491
ucuucaaauuccaacucgac

SEQ ID NO: 3367001 - RNA, 13 nt, Neisseria meningitidis Z2491
ucuucaacaccug

SEQ ID NO: 3367002 - RNA, 14 nt, Neisseria meningitidis Z2491
ucuucaauuccugc

SEQ ID NO: 3367003 - RNA, 15 nt, Neisseria meningitidis Z2491
ucuucaauuccugcg

SEQ ID NO: 3367004 - RNA, 17 nt, Neisseria meningitidis Z2491
ucuucauacgacucaaa

SEQ ID NO: 3367005 - RNA, 21 nt, Neisseria meningitidis Z2491
ucuucauacgacucaaaauca

SEQ ID NO: 3367006 - RNA, 19 nt, Neisseria meningitidis Z2491
ucuucauguucgugcauca

SEQ ID NO: 3367007 - RNA, 12 nt, Neisseria meningitidis Z2491
ucuucauuccgc

SEQ ID NO: 3367008 - RNA, 13 nt, Neisseria meningitidis Z2491
ucuuccgguucga

SEQ ID NO: 3367009 - RNA, 19 nt, Neisseria meningitidis Z2491
ucuuccgucaaaaaugccu

SEQ ID NO: 3367010 - RNA, 18 nt, Neisseria meningitidis Z2491
ucuuccgugucaggaugu

SEQ ID NO: 3367011 - RNA, 23 nt, Neisseria meningitidis Z2491
ucuuccuaaccgaaaaaauaauu

SEQ ID NO: 3367012 - RNA, 14 nt, Neisseria meningitidis Z2491
ucuuccugacggac

SEQ ID NO: 3367013 - RNA, 16 nt, Neisseria meningitidis Z2491
ucuuccugcggcauuu

SEQ ID NO: 3367014 - RNA, 13 nt, Neisseria meningitidis Z2491
ucuuccuucugaa

SEQ ID NO: 3367015 - RNA, 21 nt, Neisseria meningitidis Z2491
ucuucgaggaacaaaaugccg

SEQ ID NO: 3367016 - RNA, 22 nt, Neisseria meningitidis Z2491
ucuucgagggcauacaaaucau

SEQ ID NO: 3367017 - RNA, 21 nt, Neisseria meningitidis Z2491
ucuucggcgcgcauauugccc

SEQ ID NO: 3367018 - RNA, 16 nt, Neisseria meningitidis Z2491
ucuucgucuuuuccuu

SEQ ID NO: 3367019 - RNA, 11 nt, Neisseria meningitidis Z2491
ucuucuaaaaa

SEQ ID NO: 3367020 - RNA, 15 nt, Neisseria meningitidis Z2491
ucuucuaaaaauaca

SEQ ID NO: 3367021 - RNA, 20 nt, Neisseria meningitidis Z2491
ucuucuaguguugcaaucac

SEQ ID NO: 3367022 - RNA, 21 nt, Neisseria meningitidis Z2491
ucuucuucgacguugccuucu

SEQ ID NO: 3367023 - RNA, 13 nt, Neisseria meningitidis Z2491
ucuucuucgucuu

SEQ ID NO: 3367024 - RNA, 13 nt, Neisseria meningitidis Z2491
ucuucuuuccauc

SEQ ID NO: 3367025 - RNA, 19 nt, Neisseria meningitidis Z2491
ucuugaaacccgucauucc

SEQ ID NO: 3367026 - RNA, 23 nt, Neisseria meningitidis Z2491
ucuugaggcauugaaauuccaga

SEQ ID NO: 3367027 - RNA, 20 nt, Neisseria meningitidis Z2491
ucuugaguuucagucauucc

SEQ ID NO: 3367028 - RNA, 18 nt, Neisseria meningitidis Z2491
ucuugauaguauucuauu

SEQ ID NO: 3367029 - RNA, 16 nt, Neisseria meningitidis Z2491
ucuugcaaaauagaaa

SEQ ID NO: 3367030 - RNA, 19 nt, Neisseria meningitidis Z2491
ucuugcaaaauagaaaacc

SEQ ID NO: 3367031 - RNA, 16 nt, Neisseria meningitidis Z2491
ucuugcaaaccccuca

SEQ ID NO: 3367032 - RNA, 18 nt, Neisseria meningitidis Z2491
ucuugccauucucacaaa

SEQ ID NO: 3367033 - RNA, 19 nt, Neisseria meningitidis Z2491
ucuuguacguggccuuuuc

SEQ ID NO: 3367034 - RNA, 13 nt, Neisseria meningitidis Z2491
ucuuguuuuucaa

SEQ ID NO: 3367035 - RNA, 14 nt, Neisseria meningitidis Z2491
ucuuguuuuucaau

SEQ ID NO: 3367036 - RNA, 23 nt, Neisseria meningitidis Z2491
ucuuuaaacuucgguuuuuuccg

SEQ ID NO: 3367037 - RNA, 13 nt, Neisseria meningitidis Z2491
ucuuuaaauuuaa

SEQ ID NO: 3367038 - RNA, 15 nt, Neisseria meningitidis Z2491
ucuuuaaauuuaaaa

SEQ ID NO: 3367039 - RNA, 12 nt, Neisseria meningitidis Z2491
ucuuuauuuaaa

SEQ ID NO: 3367040 - RNA, 16 nt, Neisseria meningitidis Z2491
ucuuucaacagccgcu

SEQ ID NO: 3367041 - RNA, 18 nt, Neisseria meningitidis Z2491
ucuuucaacggcacggcg

SEQ ID NO: 3367042 - RNA, 18 nt, Neisseria meningitidis Z2491
ucuuucagcaauaaaaua

SEQ ID NO: 3367043 - RNA, 19 nt, Neisseria meningitidis Z2491
ucuuucaucauaugcauca

SEQ ID NO: 3367044 - RNA, 15 nt, Neisseria meningitidis Z2491
ucuuuccauccauca

SEQ ID NO: 3367045 - RNA, 19 nt, Neisseria meningitidis Z2491
ucuuucgccgccuguuccc

SEQ ID NO: 3367046 - RNA, 16 nt, Neisseria meningitidis Z2491
ucuuucgggcugcccu

SEQ ID NO: 3367047 - RNA, 20 nt, Neisseria meningitidis Z2491
ucuuucgggucgagucccag

SEQ ID NO: 3367048 - RNA, 18 nt, Neisseria meningitidis Z2491
ucuuugacaaaauccagu

SEQ ID NO: 3367049 - RNA, 20 nt, Neisseria meningitidis Z2491
ucuuuggcaaccgucaguac

SEQ ID NO: 3367050 - RNA, 14 nt, Neisseria meningitidis Z2491
ucuuuggcgugcau

SEQ ID NO: 3367051 - RNA, 23 nt, Neisseria meningitidis Z2491
ucuuuuaaccauacuucauuaaa

SEQ ID NO: 3367052 - RNA, 21 nt, Neisseria meningitidis Z2491
ugacacauagccggcgauauu

SEQ ID NO: 3367053 - RNA, 14 nt, Neisseria meningitidis Z2491
ugacagcaggaugu

SEQ ID NO: 3367054 - RNA, 14 nt, Neisseria meningitidis Z2491
ugacagcauuucca

SEQ ID NO: 3367055 - RNA, 15 nt, Neisseria meningitidis Z2491
ugacagcauuuccac

SEQ ID NO: 3367056 - RNA, 17 nt, Neisseria meningitidis Z2491
ugacagcauuuccacau

SEQ ID NO: 3367057 - RNA, 19 nt, Neisseria meningitidis Z2491
ugacauuaagauguuuuuc

SEQ ID NO: 3367058 - RNA, 20 nt, Neisseria meningitidis Z2491
ugaccgacccauucugacaa

SEQ ID NO: 3367059 - RNA, 15 nt, Neisseria meningitidis Z2491
ugaccuccagcacca

SEQ ID NO: 3367060 - RNA, 16 nt, Neisseria meningitidis Z2491
ugacgaagcuauccgc

SEQ ID NO: 3367061 - RNA, 17 nt, Neisseria meningitidis Z2491
ugacgaagcuauccgca

SEQ ID NO: 3367062 - RNA, 13 nt, Neisseria meningitidis Z2491
ugacgcauaaaaa

SEQ ID NO: 3367063 - RNA, 20 nt, Neisseria meningitidis Z2491
ugacggaaacucaaaaaacc

SEQ ID NO: 3367064 - RNA, 14 nt, Neisseria meningitidis Z2491
ugacggauuuuagg

SEQ ID NO: 3367065 - RNA, 20 nt, Neisseria meningitidis Z2491
ugacggcgggcaggcggcug

SEQ ID NO: 3367066 - RNA, 14 nt, Neisseria meningitidis Z2491
ugacggucaggaag

SEQ ID NO: 3367067 - RNA, 21 nt, Neisseria meningitidis Z2491
ugacuaaccgaaaauaauugc

SEQ ID NO: 3367068 - RNA, 22 nt, Neisseria meningitidis Z2491
ugacuaaccgaaaauaauugcc

SEQ ID NO: 3367069 - RNA, 15 nt, Neisseria meningitidis Z2491
ugacuauuuuuuaau

SEQ ID NO: 3367070 - RNA, 16 nt, Neisseria meningitidis Z2491
ugacuauuuuuuaauc

SEQ ID NO: 3367071 - RNA, 12 nt, Neisseria meningitidis Z2491
ugacugaaacuc

SEQ ID NO: 3367072 - RNA, 18 nt, Neisseria meningitidis Z2491
ugacugaaacucaaaaaa

SEQ ID NO: 3367073 - RNA, 20 nt, Neisseria meningitidis Z2491
ugacugaaacucaaaaaacc

SEQ ID NO: 3367074 - RNA, 12 nt, Neisseria meningitidis Z2491
ugacugaaauuc

SEQ ID NO: 3367075 - RNA, 18 nt, Neisseria meningitidis Z2491
ugacugaaauucaaaaaa

SEQ ID NO: 3367076 - RNA, 17 nt, Neisseria meningitidis Z2491
ugacuguccgagacaga

SEQ ID NO: 3367077 - RNA, 21 nt, Neisseria meningitidis Z2491
ugacuguccgagacagaaccc

SEQ ID NO: 3367078 - RNA, 21 nt, Neisseria meningitidis Z2491
ugacuuucaggguguuugccg

SEQ ID NO: 3367079 - RNA, 17 nt, Neisseria meningitidis Z2491
ugacuuuggaacaaaaa

SEQ ID NO: 3367080 - RNA, 18 nt, Neisseria meningitidis Z2491
ugacuuuggaacaaaaaa

SEQ ID NO: 3367081 - RNA, 19 nt, Neisseria meningitidis Z2491
ugagaacaagccuguuuuc

SEQ ID NO: 3367082 - RNA, 14 nt, Neisseria meningitidis Z2491
ugagaacuucagac

SEQ ID NO: 3367083 - RNA, 15 nt, Neisseria meningitidis Z2491
ugagaauggcaagau

SEQ ID NO: 3367084 - RNA, 18 nt, Neisseria meningitidis Z2491
ugagaccuuugcaaaaau

SEQ ID NO: 3367085 - RNA, 15 nt, Neisseria meningitidis Z2491
ugagaccuuugcaau

SEQ ID NO: 3367086 - RNA, 21 nt, Neisseria meningitidis Z2491
ugagcaaaaaguaggagaaau

SEQ ID NO: 3367087 - RNA, 13 nt, Neisseria meningitidis Z2491
ugagcaaaugccg

SEQ ID NO: 3367088 - RNA, 20 nt, Neisseria meningitidis Z2491
ugagcaaaugccuuauccag

SEQ ID NO: 3367089 - RNA, 20 nt, Neisseria meningitidis Z2491
ugagcauagacgguguaaac

SEQ ID NO: 3367090 - RNA, 22 nt, Neisseria meningitidis Z2491
ugagccguauuuuuuaaccaac

SEQ ID NO: 3367091 - RNA, 18 nt, Neisseria meningitidis Z2491
ugagcgacgaccauuucc

SEQ ID NO: 3367092 - RNA, 11 nt, Neisseria meningitidis Z2491
ugagcggacgu

SEQ ID NO: 3367093 - RNA, 11 nt, Neisseria meningitidis Z2491
ugagcuaaggc

SEQ ID NO: 3367094 - RNA, 14 nt, Neisseria meningitidis Z2491
ugagcuaaggcggg

SEQ ID NO: 3367095 - RNA, 17 nt, Neisseria meningitidis Z2491
ugagcuggauuuucgca

SEQ ID NO: 3367096 - RNA, 19 nt, Neisseria meningitidis Z2491
ugagcuucgcgacgguauu

SEQ ID NO: 3367097 - RNA, 17 nt, Neisseria meningitidis Z2491
ugagggcuucuuugacg

SEQ ID NO: 3367098 - RNA, 22 nt, Neisseria meningitidis Z2491
ugaggucgaacugccugccuuc

SEQ ID NO: 3367099 - RNA, 15 nt, Neisseria meningitidis Z2491
ugaggucgucugaaa

SEQ ID NO: 3367100 - RNA, 22 nt, Neisseria meningitidis Z2491
ugaguagcggugugcgccgccg

SEQ ID NO: 3367101 - RNA, 15 nt, Neisseria meningitidis Z2491
ugaguugauaauaug

SEQ ID NO: 3367102 - RNA, 20 nt, Neisseria meningitidis Z2491
ugaguuucagucauucccga

SEQ ID NO: 3367103 - RNA, 14 nt, Neisseria meningitidis Z2491
ugaguuucggucau

SEQ ID NO: 3367104 - RNA, 18 nt, Neisseria meningitidis Z2491
ugauaaccgucaaauuga

SEQ ID NO: 3367105 - RNA, 13 nt, Neisseria meningitidis Z2491
ugauaauaugaaa

SEQ ID NO: 3367106 - RNA, 20 nt, Neisseria meningitidis Z2491
ugauacgggcggcucucaaa

SEQ ID NO: 3367107 - RNA, 20 nt, Neisseria meningitidis Z2491
ugauagccgcccaaugccgu

SEQ ID NO: 3367108 - RNA, 18 nt, Neisseria meningitidis Z2491
ugauauacaaaaugccgu

SEQ ID NO: 3367109 - RNA, 22 nt, Neisseria meningitidis Z2491
ugauauucccugucuuucaaua

SEQ ID NO: 3367110 - RNA, 23 nt, Neisseria meningitidis Z2491
ugauauucccugucuuucaauau

SEQ ID NO: 3367111 - RNA, 17 nt, Neisseria meningitidis Z2491
ugaucaaaaccgcaccg

SEQ ID NO: 3367112 - RNA, 19 nt, Neisseria meningitidis Z2491
ugaucgauaccgagugcca

SEQ ID NO: 3367113 - RNA, 23 nt, Neisseria meningitidis Z2491
ugaugacgcgcgccccaguagaa

SEQ ID NO: 3367114 - RNA, 17 nt, Neisseria meningitidis Z2491
ugaugaugucgaaggcg

SEQ ID NO: 3367115 - RNA, 12 nt, Neisseria meningitidis Z2491
ugaugcacuggu

SEQ ID NO: 3367116 - RNA, 20 nt, Neisseria meningitidis Z2491
ugaugccccaauaccaacac

SEQ ID NO: 3367117 - RNA, 13 nt, Neisseria meningitidis Z2491
ugaugccgucuga

SEQ ID NO: 3367118 - RNA, 19 nt, Neisseria meningitidis Z2491
ugauggcugaugacggcag

SEQ ID NO: 3367119 - RNA, 21 nt, Neisseria meningitidis Z2491
ugauggcugaugacggcagcc

SEQ ID NO: 3367120 - RNA, 18 nt, Neisseria meningitidis Z2491
ugaugggcugaaauagaa

SEQ ID NO: 3367121 - RNA, 16 nt, Neisseria meningitidis Z2491
ugauguguuucaacac

SEQ ID NO: 3367122 - RNA, 16 nt, Neisseria meningitidis Z2491
ugauuaucauaaaauc

SEQ ID NO: 3367123 - RNA, 21 nt, Neisseria meningitidis Z2491
ugauuaucauaaaaucuauua

SEQ ID NO: 3367124 - RNA, 20 nt, Neisseria meningitidis Z2491
ugauucauaaaauauuugca

SEQ ID NO: 3367125 - RNA, 19 nt, Neisseria meningitidis Z2491
ugauucccgagaaaacaga

SEQ ID NO: 3367126 - RNA, 16 nt, Neisseria meningitidis Z2491
ugauugaccgaaaaau

SEQ ID NO: 3367127 - RNA, 19 nt, Neisseria meningitidis Z2491
ugauugacuauuuuuuaau

SEQ ID NO: 3367128 - RNA, 22 nt, Neisseria meningitidis Z2491
ugauugguuuauuugaauccgc

SEQ ID NO: 3367129 - RNA, 13 nt, Neisseria meningitidis Z2491
ugauuguuuuuca

SEQ ID NO: 3367130 - RNA, 12 nt, Neisseria meningitidis Z2491
ugauuuaaauuu

SEQ ID NO: 3367131 - RNA, 14 nt, Neisseria meningitidis Z2491
ugauuuaaggaaug

SEQ ID NO: 3367132 - RNA, 22 nt, Neisseria meningitidis Z2491
ugauuuggguuucagacggcau

SEQ ID NO: 3367133 - RNA, 21 nt, Neisseria meningitidis Z2491
ugauuuuucgggaugaacgau

SEQ ID NO: 3367134 - RNA, 12 nt, Neisseria meningitidis Z2491
ugauuuuucuuu

SEQ ID NO: 3367135 - RNA, 15 nt, Neisseria meningitidis Z2491
ugauuuuuucaacac

SEQ ID NO: 3367136 - RNA, 19 nt, Neisseria meningitidis Z2491
ugauuuuuucaacaccaaa

SEQ ID NO: 3367137 - RNA, 12 nt, Neisseria meningitidis Z2491
ugcaaaauagaa

SEQ ID NO: 3367138 - RNA, 17 nt, Neisseria meningitidis Z2491
ugcaaaauagaaaaccg

SEQ ID NO: 3367139 - RNA, 19 nt, Neisseria meningitidis Z2491
ugcaaaauagaaaaccgaa

SEQ ID NO: 3367140 - RNA, 22 nt, Neisseria meningitidis Z2491
ugcaaaauuuauccgaaacaac

SEQ ID NO: 3367141 - RNA, 19 nt, Neisseria meningitidis Z2491
ugcaaaccccucaacacac

SEQ ID NO: 3367142 - RNA, 14 nt, Neisseria meningitidis Z2491
ugcaaaccggcguu

SEQ ID NO: 3367143 - RNA, 14 nt, Neisseria meningitidis Z2491
ugcaaagaaaaaca

SEQ ID NO: 3367144 - RNA, 20 nt, Neisseria meningitidis Z2491
ugcaaaggucucauccuguu

SEQ ID NO: 3367145 - RNA, 18 nt, Neisseria meningitidis Z2491
ugcaaauaauugaaauca

SEQ ID NO: 3367146 - RNA, 19 nt, Neisseria meningitidis Z2491
ugcaaauaauugaaaucaa

SEQ ID NO: 3367147 - RNA, 16 nt, Neisseria meningitidis Z2491
ugcaacacuaguguau

SEQ ID NO: 3367148 - RNA, 14 nt, Neisseria meningitidis Z2491
ugcaacguuuuacc

SEQ ID NO: 3367149 - RNA, 14 nt, Neisseria meningitidis Z2491
ugcaacugaaacca

SEQ ID NO: 3367150 - RNA, 19 nt, Neisseria meningitidis Z2491
ugcaagaauuuaucggaaa

SEQ ID NO: 3367151 - RNA, 12 nt, Neisseria meningitidis Z2491
ugcaagcagcag

SEQ ID NO: 3367152 - RNA, 18 nt, Neisseria meningitidis Z2491
ugcaagcaguugaaauca

SEQ ID NO: 3367153 - RNA, 23 nt, Neisseria meningitidis Z2491
ugcuuucgcgagaacgacgggau

SEQ ID NO: 3367154 - RNA, 15 nt, Neisseria meningitidis Z2491
ugcuuucgcugccgc

SEQ ID NO: 3367155 - RNA, 20 nt, Neisseria meningitidis Z2491
ugcuuucgcugccgccgccc

SEQ ID NO: 3367156 - RNA, 12 nt, Neisseria meningitidis Z2491
ugcuuucgcuuu

SEQ ID NO: 3367157 - RNA, 13 nt, Neisseria meningitidis Z2491
ugcuuugcgcgcc

SEQ ID NO: 3367158 - RNA, 21 nt, Neisseria meningitidis Z2491
ugcuuuggcagcacaggcaag

SEQ ID NO: 3367159 - RNA, 13 nt, Neisseria meningitidis Z2491
ugcuuuggcuucg

SEQ ID NO: 3367160 - RNA, 14 nt, Neisseria meningitidis Z2491
ugcuuugguaaaaa

SEQ ID NO: 3367161 - RNA, 21 nt, Neisseria meningitidis Z2491
ugcuuuggucgcugccuuuga

SEQ ID NO: 3367162 - RNA, 15 nt, Neisseria meningitidis Z2491
uggaaaccaaaaaac

SEQ ID NO: 3367163 - RNA, 16 nt, Neisseria meningitidis Z2491
uggaaaccaaaaaaca

SEQ ID NO: 3367164 - RNA, 16 nt, Neisseria meningitidis Z2491
uggaaaggcaaaugcc

SEQ ID NO: 3367165 - RNA, 22 nt, Neisseria meningitidis Z2491
uggaaaguggguguagcguggg

SEQ ID NO: 3367166 - RNA, 20 nt, Neisseria meningitidis Z2491
uggaaaugccgucugaagcc

SEQ ID NO: 3367167 - RNA, 22 nt, Neisseria meningitidis Z2491
uggaaauuaucggucagcucuu

SEQ ID NO: 3367168 - RNA, 22 nt, Neisseria meningitidis Z2491
uggaacaaagaaagcagaaaua

SEQ ID NO: 3367169 - RNA, 11 nt, Neisseria meningitidis Z2491
uggaacagaaa

SEQ ID NO: 3367170 - RNA, 17 nt, Neisseria meningitidis Z2491
uggaacagaaagcaaaa

SEQ ID NO: 3367171 - RNA, 19 nt, Neisseria meningitidis Z2491
uggaacgcgucaaccuuaa

SEQ ID NO: 3367172 - RNA, 16 nt, Neisseria meningitidis Z2491
uggaaggcgggcaggc

SEQ ID NO: 3367173 - RNA, 13 nt, Neisseria meningitidis Z2491
uggaauaugaaua

SEQ ID NO: 3367174 - RNA, 14 nt, Neisseria meningitidis Z2491
uggaaucuaagaaa

SEQ ID NO: 3367175 - RNA, 14 nt, Neisseria meningitidis Z2491
uggaauuuauuggu

SEQ ID NO: 3367176 - RNA, 14 nt, Neisseria meningitidis Z2491
uggaccucaggccg

SEQ ID NO: 3367177 - RNA, 17 nt, Neisseria meningitidis Z2491
uggauaaaaccgcucac

SEQ ID NO: 3367178 - RNA, 19 nt, Neisseria meningitidis Z2491
uggauagcgagacggcauc

SEQ ID NO: 3367179 - RNA, 20 nt, Neisseria meningitidis Z2491
uggauauugccguuuuccuu

SEQ ID NO: 3367180 - RNA, 22 nt, Neisseria meningitidis Z2491
uggaugaacaauccauacaucu

SEQ ID NO: 3367181 - RNA, 12 nt, Neisseria meningitidis Z2491
uggaugaauucg

SEQ ID NO: 3367182 - RNA, 14 nt, Neisseria meningitidis Z2491
uggauuaaauuuaa

SEQ ID NO: 3367183 - RNA, 18 nt, Neisseria meningitidis Z2491
uggauuaaauuuaaacca

SEQ ID NO: 3367184 - RNA, 14 nt, Neisseria meningitidis Z2491
uggauuaaauuuau

SEQ ID NO: 3367185 - RNA, 22 nt, Neisseria meningitidis Z2491
uggauuaacaaaaaucaggaca

SEQ ID NO: 3367186 - RNA, 21 nt, Neisseria meningitidis Z2491
uggauuaacuuuaaaccagua

SEQ ID NO: 3367187 - RNA, 22 nt, Neisseria meningitidis Z2491
uggauuauaguggauuaaauuu

SEQ ID NO: 3367188 - RNA, 11 nt, Neisseria meningitidis Z2491
uggauucccac

SEQ ID NO: 3367189 - RNA, 12 nt, Neisseria meningitidis Z2491
uggauucccacu

SEQ ID NO: 3367190 - RNA, 18 nt, Neisseria meningitidis Z2491
uggauucgucauucccgc

SEQ ID NO: 3367191 - RNA, 19 nt, Neisseria meningitidis Z2491
uggcaaauugaaaugccgu

SEQ ID NO: 3367192 - RNA, 17 nt, Neisseria meningitidis Z2491
uggcaaccaaaaccgac

SEQ ID NO: 3367193 - RNA, 15 nt, Neisseria meningitidis Z2491
uggcaacuuccagcg

SEQ ID NO: 3367194 - RNA, 16 nt, Neisseria meningitidis Z2491
uggcaauuuuuuaaau

SEQ ID NO: 3367195 - RNA, 12 nt, Neisseria meningitidis Z2491
uggcagcaaaac

SEQ ID NO: 3367196 - RNA, 15 nt, Neisseria meningitidis Z2491
uggcagcagaugaag

SEQ ID NO: 3367197 - RNA, 22 nt, Neisseria meningitidis Z2491
uggcaguggcaauuuuuuaaau

SEQ ID NO: 3367198 - RNA, 21 nt, Neisseria meningitidis Z2491
uggccgaccauuucuuccagc

SEQ ID NO: 3367199 - RNA, 17 nt, Neisseria meningitidis Z2491
uggccgcuuucaacagg

SEQ ID NO: 3367200 - RNA, 19 nt, Neisseria meningitidis Z2491
uggccgcuuucaacagguu

SEQ ID NO: 3367201 - RNA, 23 nt, Neisseria meningitidis Z2491
uggccggaaaccguauauuuccc

SEQ ID NO: 3367202 - RNA, 15 nt, Neisseria meningitidis Z2491
uggccuuuucuuccu

SEQ ID NO: 3367203 - RNA, 16 nt, Neisseria meningitidis Z2491
uggcgcauuuuuaugc

SEQ ID NO: 3367204 - RNA, 20 nt, Neisseria meningitidis Z2491
uggcgcgcgaggcgugccuu

SEQ ID NO: 3367205 - RNA, 13 nt, Neisseria meningitidis Z2491
uggcggcaacaua

SEQ ID NO: 3367206 - RNA, 18 nt, Neisseria meningitidis Z2491
uggcggcaucccacggga

SEQ ID NO: 3367207 - RNA, 14 nt, Neisseria meningitidis Z2491
uggcggcuccuccg

SEQ ID NO: 3367208 - RNA, 18 nt, Neisseria meningitidis Z2491
uggcggcugaccgcgccg

SEQ ID NO: 3367209 - RNA, 15 nt, Neisseria meningitidis Z2491
uggcgggaagccagg

SEQ ID NO: 3367210 - RNA, 13 nt, Neisseria meningitidis Z2491
uggcgggaaugcc

SEQ ID NO: 3367211 - RNA, 16 nt, Neisseria meningitidis Z2491
uggcgugcgaacaacc

SEQ ID NO: 3367212 - RNA, 17 nt, Neisseria meningitidis Z2491
uggcuaacguacaaaug

SEQ ID NO: 3367213 - RNA, 15 nt, Neisseria meningitidis Z2491
uggcugaugacggca

SEQ ID NO: 3367214 - RNA, 21 nt, Neisseria meningitidis Z2491
uggcugcuuuggcagcacagg

SEQ ID NO: 3367215 - RNA, 20 nt, Neisseria meningitidis Z2491
uggcuguguuucaauauggu

SEQ ID NO: 3367216 - RNA, 16 nt, Neisseria meningitidis Z2491
uggcuuccuuuuuaaa

SEQ ID NO: 3367217 - RNA, 15 nt, Neisseria meningitidis Z2491
uggcuuugaagccga

SEQ ID NO: 3367218 - RNA, 20 nt, Neisseria meningitidis Z2491
uggcuuugcgcacucacuuu

SEQ ID NO: 3367219 - RNA, 17 nt, Neisseria meningitidis Z2491
ugggaaagauuugcaau

SEQ ID NO: 3367220 - RNA, 13 nt, Neisseria meningitidis Z2491
ugggaaaugccgu

SEQ ID NO: 3367221 - RNA, 19 nt, Neisseria meningitidis Z2491
ugggaaucuagaaauuuaa

SEQ ID NO: 3367222 - RNA, 14 nt, Neisseria meningitidis Z2491
ugggaaucuagaau

SEQ ID NO: 3367223 - RNA, 14 nt, Neisseria meningitidis Z2491
ugggaaugacggag

SEQ ID NO: 3367224 - RNA, 16 nt, Neisseria meningitidis Z2491
ugggaaugacgggauu

SEQ ID NO: 3367225 - RNA, 20 nt, Neisseria meningitidis Z2491
ugggaaugacguggugcagg

SEQ ID NO: 3367226 - RNA, 17 nt, Neisseria meningitidis Z2491
ugggauauuuucuuccg

SEQ ID NO: 3367227 - RNA, 18 nt, Neisseria meningitidis Z2491
ugggauggcgggaaauaa

SEQ ID NO: 3367228 - RNA, 16 nt, Neisseria meningitidis Z2491
ugggcgaccagccucc

SEQ ID NO: 3367229 - RNA, 16 nt, Neisseria meningitidis Z2491
ugggcuuaaugccagu

SEQ ID NO: 3367230 - RNA, 18 nt, Neisseria meningitidis Z2491
uggggauuuauucuguug

SEQ ID NO: 3367231 - RNA, 19 nt, Neisseria meningitidis Z2491
uggggauuuauugggaaua

SEQ ID NO: 3367232 - RNA, 21 nt, Neisseria meningitidis Z2491
uggggauuuauugggaauaau

SEQ ID NO: 3367233 - RNA, 13 nt, Neisseria meningitidis Z2491
uggggcgaaaaca

SEQ ID NO: 3367234 - RNA, 21 nt, Neisseria meningitidis Z2491
uggguaagucuggaguccugc

SEQ ID NO: 3367235 - RNA, 12 nt, Neisseria meningitidis Z2491
ugggugguuuuc

SEQ ID NO: 3367236 - RNA, 24 nt, Neisseria meningitidis Z2491
uggguucggggaacugccaugugc

SEQ ID NO: 3367237 - RNA, 14 nt, Neisseria meningitidis Z2491
uggguuuucuguuc

SEQ ID NO: 3367238 - RNA, 18 nt, Neisseria meningitidis Z2491
ugguaaaacgccaauuug

SEQ ID NO: 3367239 - RNA, 19 nt, Neisseria meningitidis Z2491
ugguaaugucggcauuuuc

SEQ ID NO: 3367240 - RNA, 17 nt, Neisseria meningitidis Z2491
uggucaaccaauuuguu

SEQ ID NO: 3367241 - RNA, 15 nt, Neisseria meningitidis Z2491
uggucaacucuucca

SEQ ID NO: 3367242 - RNA, 19 nt, Neisseria meningitidis Z2491
uggucaauacacaagguua

SEQ ID NO: 3367243 - RNA, 19 nt, Neisseria meningitidis Z2491
uggucggaguggcagccua

SEQ ID NO: 3367244 - RNA, 22 nt, Neisseria meningitidis Z2491
uggugcagguuucugugcggau

SEQ ID NO: 3367245 - RNA, 13 nt, Neisseria meningitidis Z2491
uggugcuaaaaca

SEQ ID NO: 3367246 - RNA, 19 nt, Neisseria meningitidis Z2491
uggugcugauaacauacuu

SEQ ID NO: 3367247 - RNA, 13 nt, Neisseria meningitidis Z2491
ugguguuugcaga

SEQ ID NO: 3367248 - RNA, 17 nt, Neisseria meningitidis Z2491
ugguucagacggcauuu

SEQ ID NO: 3367249 - RNA, 12 nt, Neisseria meningitidis Z2491
ugguucggcuug

SEQ ID NO: 3367250 - RNA, 20 nt, Neisseria meningitidis Z2491
ugguucugacggucugcaaa

SEQ ID NO: 3367251 - RNA, 20 nt, Neisseria meningitidis Z2491
ugguuguucagaaaauccgc

SEQ ID NO: 3367252 - RNA, 15 nt, Neisseria meningitidis Z2491
ugguuuaaauuuaau

SEQ ID NO: 3367253 - RNA, 19 nt, Neisseria meningitidis Z2491
ugguuuauuugaauccgcg

SEQ ID NO: 3367254 - RNA, 20 nt, Neisseria meningitidis Z2491
ugguuugaaccagggauuuu

SEQ ID NO: 3367255 - RNA, 22 nt, Neisseria meningitidis Z2491
uguuucaacaccgccgccaaca

SEQ ID NO: 3367256 - RNA, 15 nt, Neisseria meningitidis Z2491
uguuucagacggcau

SEQ ID NO: 3367257 - RNA, 15 nt, Neisseria meningitidis Z2491
uguuucagacggccu

SEQ ID NO: 3367258 - RNA, 16 nt, Neisseria meningitidis Z2491
uguuucggauaaauuc

SEQ ID NO: 3367259 - RNA, 16 nt, Neisseria meningitidis Z2491
uguuucggauaaauuu

SEQ ID NO: 3367260 - RNA, 20 nt, Neisseria meningitidis Z2491
uguuucggcgcaucccgcaa

SEQ ID NO: 3367261 - RNA, 14 nt, Neisseria meningitidis Z2491
uguuucgggcaaaa

SEQ ID NO: 3367262 - RNA, 20 nt, Neisseria meningitidis Z2491
uguuucgggcaaaagccagc

SEQ ID NO: 3367263 - RNA, 20 nt, Neisseria meningitidis Z2491
uguuugaauggaaaugccgu

SEQ ID NO: 3367264 - RNA, 21 nt, Neisseria meningitidis Z2491
uguuugaguccgaccgccgcc

SEQ ID NO: 3367265 - RNA, 22 nt, Neisseria meningitidis Z2491
uguuugcaguauccggcaagaa

SEQ ID NO: 3367266 - RNA, 23 nt, Neisseria meningitidis Z2491
uguuugcuuagaagccuugcgcc

SEQ ID NO: 3367267 - RNA, 15 nt, Neisseria meningitidis Z2491
uguuuggauaugccg

SEQ ID NO: 3367268 - RNA, 17 nt, Neisseria meningitidis Z2491
uguuuuauuuuuuggcu

SEQ ID NO: 3367269 - RNA, 23 nt, Neisseria meningitidis Z2491
uguuuucaaguuccagacggcau

SEQ ID NO: 3367270 - RNA, 23 nt, Neisseria meningitidis Z2491
uguuuuccugcccaaauccagca

SEQ ID NO: 3367271 - RNA, 22 nt, Neisseria meningitidis Z2491
uguuuuucagagaaauggcagu

SEQ ID NO: 3367272 - RNA, 13 nt, Neisseria meningitidis Z2491
uguuuuuccacaa

SEQ ID NO: 3367273 - RNA, 21 nt, Neisseria meningitidis Z2491
uguuuuuccgacaaauuccua

SEQ ID NO: 3367274 - RNA, 23 nt, Neisseria meningitidis Z2491
uguuuuugagggaaugacgggau

SEQ ID NO: 3367275 - RNA, 22 nt, Neisseria meningitidis Z2491
uguuuuugcguucagacggcau

SEQ ID NO: 3367276 - RNA, 22 nt, Neisseria meningitidis Z2491
uguuuuuuccgauaaauuccua

SEQ ID NO: 3367277 - RNA, 14 nt, Neisseria meningitidis Z2491
uuaaaaaacaaaca

SEQ ID NO: 3367278 - RNA, 15 nt, Neisseria meningitidis Z2491
uuaaaaauaccuaaa

SEQ ID NO: 3367279 - RNA, 18 nt, Neisseria meningitidis Z2491
uuaaaaauuccuguuuuu

SEQ ID NO: 3367280 - RNA, 12 nt, Neisseria meningitidis Z2491
uuaaaacaaaaa

SEQ ID NO: 3367281 - RNA, 14 nt, Neisseria meningitidis Z2491
uuaaaacaaaaaug

SEQ ID NO: 3367282 - RNA, 18 nt, Neisseria meningitidis Z2491
uuaaaauaaaaccgauaa

SEQ ID NO: 3367283 - RNA, 15 nt, Neisseria meningitidis Z2491
uuaaaauuuggcugu

SEQ ID NO: 3367284 - RNA, 23 nt, Neisseria meningitidis Z2491
uuaaacuauaguggauuaacaaa

SEQ ID NO: 3367285 - RNA, 18 nt, Neisseria meningitidis Z2491
uuaaacucuuaaaacacg

SEQ ID NO: 3367286 - RNA, 12 nt, Neisseria meningitidis Z2491
uuaaaguuucag

SEQ ID NO: 3367287 - RNA, 15 nt, Neisseria meningitidis Z2491
uuaaauuuaaaccag

SEQ ID NO: 3367288 - RNA, 20 nt, Neisseria meningitidis Z2491
uuaaauuuaaaccaguacag

SEQ ID NO: 3367289 - RNA, 19 nt, Neisseria meningitidis Z2491
uuaaauuuaaaccaguacg

SEQ ID NO: 3367290 - RNA, 14 nt, Neisseria meningitidis Z2491
uuaaauuuaauccg

SEQ ID NO: 3367291 - RNA, 17 nt, Neisseria meningitidis Z2491
uuaaauuuuuaaaaccg

SEQ ID NO: 3367292 - RNA, 12 nt, Neisseria meningitidis Z2491
uuaacaaaaauc

SEQ ID NO: 3367293 - RNA, 18 nt, Neisseria meningitidis Z2491
uuaacaaaaaucaggaca

SEQ ID NO: 3367294 - RNA, 19 nt, Neisseria meningitidis Z2491
uuaacaaaaaucaggacaa

SEQ ID NO: 3367295 - RNA, 21 nt, Neisseria meningitidis Z2491
uuaacaaaaaucaggacaagg

SEQ ID NO: 3367296 - RNA, 23 nt, Neisseria meningitidis Z2491
uuaacaaugcccgcaaucugaaa

SEQ ID NO: 3367297 - RNA, 17 nt, Neisseria meningitidis Z2491
uuaacagacuauuuuug

SEQ ID NO: 3367298 - RNA, 15 nt, Neisseria meningitidis Z2491
uuaaccguaucaaac

SEQ ID NO: 3367299 - RNA, 13 nt, Neisseria meningitidis Z2491
uuaaccugcaaaa

SEQ ID NO: 3367300 - RNA, 20 nt, Neisseria meningitidis Z2491
uuaaccugcaaaacaucguu

SEQ ID NO: 3367301 - RNA, 20 nt, Neisseria meningitidis Z2491
uuaacuuuaaaccaguacgg

SEQ ID NO: 3367302 - RNA, 22 nt, Neisseria meningitidis Z2491
uuaauaauguguugauuaaaua

SEQ ID NO: 3367303 - RNA, 18 nt, Neisseria meningitidis Z2491
uuaauauacuuggcaaaa

SEQ ID NO: 3367304 - RNA, 18 nt, Neisseria meningitidis Z2491
uuaauccacuauaaaaaa

SEQ ID NO: 3367305 - RNA, 18 nt, Neisseria meningitidis Z2491
uuaauccacuauaaaaac

SEQ ID NO: 3367306 - RNA, 14 nt, Neisseria meningitidis Z2491
uuaauccacuauau

SEQ ID NO: 3367307 - RNA, 17 nt, Neisseria meningitidis Z2491
uuaaucccgucauuccc

SEQ ID NO: 3367308 - RNA, 23 nt, Neisseria meningitidis Z2491
uuaauccgcuauaauuuauugaa

SEQ ID NO: 3367309 - RNA, 13 nt, Neisseria meningitidis Z2491
uuacacaaauaua

SEQ ID NO: 3367310 - RNA, 18 nt, Neisseria meningitidis Z2491
uuacacuuugggcuucga

SEQ ID NO: 3367311 - RNA, 21 nt, Neisseria meningitidis Z2491
uuaccaaguuucagacggcau

SEQ ID NO: 3367312 - RNA, 17 nt, Neisseria meningitidis Z2491
uuacccgauaaguuucc

SEQ ID NO: 3367313 - RNA, 16 nt, Neisseria meningitidis Z2491
uuaccguucaauuuca

SEQ ID NO: 3367314 - RNA, 17 nt, Neisseria meningitidis Z2491
uuaccuugaggucuuug

SEQ ID NO: 3367315 - RNA, 20 nt, Neisseria meningitidis Z2491
uuacgaacaaugcaaaaaca

SEQ ID NO: 3367316 - RNA, 19 nt, Neisseria meningitidis Z2491
uuacgccccucccaaauaa

SEQ ID NO: 3367317 - RNA, 11 nt, Neisseria meningitidis Z2491
uuacuaaaauu

SEQ ID NO: 3367318 - RNA, 14 nt, Neisseria meningitidis Z2491
uuacuaaaauuuua

SEQ ID NO: 3367319 - RNA, 21 nt, Neisseria meningitidis Z2491
uuacuaaaauuuuaugcucaa

SEQ ID NO: 3367320 - RNA, 22 nt, Neisseria meningitidis Z2491
uuacucauucaauccucaacuu

SEQ ID NO: 3367321 - RNA, 13 nt, Neisseria meningitidis Z2491
uuacuguuguucu

SEQ ID NO: 3367322 - RNA, 14 nt, Neisseria meningitidis Z2491
uuagaaaugacuga

SEQ ID NO: 3367323 - RNA, 19 nt, Neisseria meningitidis Z2491
uuagaaaugacugaaacuc

SEQ ID NO: 3367324 - RNA, 13 nt, Neisseria meningitidis Z2491
uuagaacaacagu

SEQ ID NO: 3367325 - RNA, 18 nt, Neisseria meningitidis Z2491
uuagaaugaauagucagg

SEQ ID NO: 3367326 - RNA, 20 nt, Neisseria meningitidis Z2491
uuagaguuucaaaauuuauu

SEQ ID NO: 3367327 - RNA, 21 nt, Neisseria meningitidis Z2491
uuagauuccacguucuagauu

SEQ ID NO: 3367328 - RNA, 23 nt, Neisseria meningitidis Z2491
uuagauuccacguucuagauucc

SEQ ID NO: 3367329 - RNA, 21 nt, Neisseria meningitidis Z2491
uuagauugcaggcauuuaucg

SEQ ID NO: 3367330 - RNA, 17 nt, Neisseria meningitidis Z2491
uuagccuuuuguuuugg

SEQ ID NO: 3367331 - RNA, 17 nt, Neisseria meningitidis Z2491
uuagcggagcaguuuuu

SEQ ID NO: 3367332 - RNA, 23 nt, Neisseria meningitidis Z2491
uuaggcaauugaaaauuuuuugg

SEQ ID NO: 3367333 - RNA, 15 nt, Neisseria meningitidis Z2491
uuagguugcggucau

SEQ ID NO: 3367334 - RNA, 18 nt, Neisseria meningitidis Z2491
uuagugguuggaacagau

SEQ ID NO: 3367335 - RNA, 15 nt, Neisseria meningitidis Z2491
uuauaaacaaaaaac

SEQ ID NO: 3367336 - RNA, 20 nt, Neisseria meningitidis Z2491
uuauaaacaaaaaacagcaa

SEQ ID NO: 3367337 - RNA, 11 nt, Neisseria meningitidis Z2491
uuauacacacg

SEQ ID NO: 3367338 - RNA, 15 nt, Neisseria meningitidis Z2491
uuauaccauaaauuu

SEQ ID NO: 3367339 - RNA, 20 nt, Neisseria meningitidis Z2491
uuauaccauaaauuuuaaau

SEQ ID NO: 3367340 - RNA, 13 nt, Neisseria meningitidis Z2491
uuauacuggcaaa

SEQ ID NO: 3367341 - RNA, 18 nt, Neisseria meningitidis Z2491
uuauagugauuaacaaaa

SEQ ID NO: 3367342 - RNA, 11 nt, Neisseria meningitidis Z2491
uuauaguggau

SEQ ID NO: 3367343 - RNA, 14 nt, Neisseria meningitidis Z2491
uuauaguggauuaa

SEQ ID NO: 3367344 - RNA, 18 nt, Neisseria meningitidis Z2491
uuauaguggauuaacaaa

SEQ ID NO: 3367345 - RNA, 15 nt, Neisseria meningitidis Z2491
uuauauggcggauuu

SEQ ID NO: 3367346 - RNA, 12 nt, Neisseria meningitidis Z2491
uuauauucugau

SEQ ID NO: 3367347 - RNA, 15 nt, Neisseria meningitidis Z2491
uuaucagaaaugacg

SEQ ID NO: 3367348 - RNA, 17 nt, Neisseria meningitidis Z2491
uuaucaggagcaacaga

SEQ ID NO: 3367349 - RNA, 21 nt, Neisseria meningitidis Z2491
uuaucagggcugcaaaauuua

SEQ ID NO: 3367350 - RNA, 20 nt, Neisseria meningitidis Z2491
uuaucauaaaaucuauuauu

SEQ ID NO: 3367351 - RNA, 17 nt, Neisseria meningitidis Z2491
uuaucaucgauguuuuu

SEQ ID NO: 3367352 - RNA, 16 nt, Neisseria meningitidis Z2491
uuauccauacaagaac

SEQ ID NO: 3367353 - RNA, 15 nt, Neisseria meningitidis Z2491
uuauccauauccaaa

SEQ ID NO: 3367354 - RNA, 21 nt, Neisseria meningitidis Z2491
uuauccaucccauauuccaca

SEQ ID NO: 3367355 - RNA, 14 nt, Neisseria meningitidis Z2491
uuaucccauaaaaa

SEQ ID NO: 3367356 - RNA, 18 nt, Neisseria meningitidis Z2491
uucccaauucuccccuac

SEQ ID NO: 3367357 - RNA, 22 nt, Neisseria meningitidis Z2491
uucccacaaucauugcgggaau

SEQ ID NO: 3367358 - RNA, 20 nt, Neisseria meningitidis Z2491
uucccacgaaagugggaauc

SEQ ID NO: 3367359 - RNA, 20 nt, Neisseria meningitidis Z2491
uucccacggaagugggaauc

SEQ ID NO: 3367360 - RNA, 20 nt, Neisseria meningitidis Z2491
uucccccgaagaugggaauc

SEQ ID NO: 3367361 - RNA, 21 nt, Neisseria meningitidis Z2491
uuccccgguauaaaaaagauu

SEQ ID NO: 3367362 - RNA, 15 nt, Neisseria meningitidis Z2491
uucccgaaauuccaa

SEQ ID NO: 3367363 - RNA, 13 nt, Neisseria meningitidis Z2491
uucccgcaaaagc

SEQ ID NO: 3367364 - RNA, 16 nt, Neisseria meningitidis Z2491
uucccgcaaaagcggg

SEQ ID NO: 3367365 - RNA, 16 nt, Neisseria meningitidis Z2491
uucccgcgaaagcgga

SEQ ID NO: 3367366 - RNA, 20 nt, Neisseria meningitidis Z2491
uucccgcgaaagcgggaauc

SEQ ID NO: 3367367 - RNA, 14 nt, Neisseria meningitidis Z2491
uucccgugcaggcg

SEQ ID NO: 3367368 - RNA, 20 nt, Neisseria meningitidis Z2491
uucccgugcaggcgggaauc

SEQ ID NO: 3367369 - RNA, 20 nt, Neisseria meningitidis Z2491
uucccguuucagacggcauu

SEQ ID NO: 3367370 - RNA, 18 nt, Neisseria meningitidis Z2491
uucccucaaaaacagaaa

SEQ ID NO: 3367371 - RNA, 20 nt, Neisseria meningitidis Z2491
uucccucaaaaacagaaaac

SEQ ID NO: 3367372 - RNA, 16 nt, Neisseria meningitidis Z2491
uucccucgaaagcggg

SEQ ID NO: 3367373 - RNA, 13 nt, Neisseria meningitidis Z2491
uucccuucccucc

SEQ ID NO: 3367374 - RNA, 19 nt, Neisseria meningitidis Z2491
uucccuugcaaauaauuga

SEQ ID NO: 3367375 - RNA, 22 nt, Neisseria meningitidis Z2491
uucccuugcaagcaguugaaau

SEQ ID NO: 3367376 - RNA, 14 nt, Neisseria meningitidis Z2491
uuccgaagcgguuu

SEQ ID NO: 3367377 - RNA, 18 nt, Neisseria meningitidis Z2491
uuccgacaaauuccuaaa

SEQ ID NO: 3367378 - RNA, 23 nt, Neisseria meningitidis Z2491
uuccgacagccuacuugcccgcc

SEQ ID NO: 3367379 - RNA, 23 nt, Neisseria meningitidis Z2491
uuccgacaggucgggguggucuu

SEQ ID NO: 3367380 - RNA, 22 nt, Neisseria meningitidis Z2491
uuccgauaaauucuugaggcau

SEQ ID NO: 3367381 - RNA, 19 nt, Neisseria meningitidis Z2491
uuccgauaaauucuugcaa

SEQ ID NO: 3367382 - RNA, 19 nt, Neisseria meningitidis Z2491
uuccgauaaauucuugccg

SEQ ID NO: 3367383 - RNA, 22 nt, Neisseria meningitidis Z2491
uuccgauaaggcaagcguucac

SEQ ID NO: 3367384 - RNA, 22 nt, Neisseria meningitidis Z2491
uuccgauacgcucggcguuuuu

SEQ ID NO: 3367385 - RNA, 14 nt, Neisseria meningitidis Z2491
uuccgcaaacgccu

SEQ ID NO: 3367386 - RNA, 21 nt, Neisseria meningitidis Z2491
uuccgcccgaacggaaauaag

SEQ ID NO: 3367387 - RNA, 14 nt, Neisseria meningitidis Z2491
uuccgcuucuucca

SEQ ID NO: 3367388 - RNA, 17 nt, Neisseria meningitidis Z2491
uuccgcuucuuccagca

SEQ ID NO: 3367389 - RNA, 20 nt, Neisseria meningitidis Z2491
uuccguacuaucuguacugu

SEQ ID NO: 3367390 - RNA, 17 nt, Neisseria meningitidis Z2491
uuccgucaaaaaugccu

SEQ ID NO: 3367391 - RNA, 19 nt, Neisseria meningitidis Z2491
uuccguguccugcuggcag

SEQ ID NO: 3367392 - RNA, 23 nt, Neisseria meningitidis Z2491
uuccguucggaacacaaaaaacu

SEQ ID NO: 3367393 - RNA, 18 nt, Neisseria meningitidis Z2491
uuccguuuuugcgggaag

SEQ ID NO: 3367394 - RNA, 18 nt, Neisseria meningitidis Z2491
uuccuaaaacuuaaaauu

SEQ ID NO: 3367395 - RNA, 19 nt, Neisseria meningitidis Z2491
uuccuaaaacuuaaaauuu

SEQ ID NO: 3367396 - RNA, 16 nt, Neisseria meningitidis Z2491
uuccuaaccgaaaaaa

SEQ ID NO: 3367397 - RNA, 20 nt, Neisseria meningitidis Z2491
uuccuaaccgaaaaaauaau

SEQ ID NO: 3367398 - RNA, 22 nt, Neisseria meningitidis Z2491
uuccuaaucgguuuguauguuu

SEQ ID NO: 3367399 - RNA, 12 nt, Neisseria meningitidis Z2491
uuccuacuuuuu

SEQ ID NO: 3367400 - RNA, 17 nt, Neisseria meningitidis Z2491
uuccuacuuuuugcuca

SEQ ID NO: 3367401 - RNA, 16 nt, Neisseria meningitidis Z2491
uuccuccacuaaaaaa

SEQ ID NO: 3367402 - RNA, 17 nt, Neisseria meningitidis Z2491
uuccuccgcaaacacca

SEQ ID NO: 3367403 - RNA, 14 nt, Neisseria meningitidis Z2491
uuccucgauuugaa

SEQ ID NO: 3367404 - RNA, 14 nt, Neisseria meningitidis Z2491
uuccugccagacuu

SEQ ID NO: 3367405 - RNA, 19 nt, Neisseria meningitidis Z2491
uuccuguaaaaacaaaaaa

SEQ ID NO: 3367406 - RNA, 22 nt, Neisseria meningitidis Z2491
uuccuguaaaaacaaaaaauca

SEQ ID NO: 3367407 - RNA, 23 nt, Neisseria meningitidis Z2491
uuccuuauaaggcagggagcgga

SEQ ID NO: 3367408 - RNA, 18 nt, Neisseria meningitidis Z2491
uuccuuuaaacucuuaaa

SEQ ID NO: 3367409 - RNA, 21 nt, Neisseria meningitidis Z2491
uuccuuucugacaaaaaugcc

SEQ ID NO: 3367410 - RNA, 20 nt, Neisseria meningitidis Z2491
uuccuuuuuaaagguuugca

SEQ ID NO: 3367411 - RNA, 19 nt, Neisseria meningitidis Z2491
uucgacgcgcuugaugucg

SEQ ID NO: 3367412 - RNA, 15 nt, Neisseria meningitidis Z2491
uucgcaaucuucaaa

SEQ ID NO: 3367413 - RNA, 21 nt, Neisseria meningitidis Z2491
uucgcacgcaugaagccgucu

SEQ ID NO: 3367414 - RNA, 21 nt, Neisseria meningitidis Z2491
uucgcaucguaaaaaugccgu

SEQ ID NO: 3367415 - RNA, 16 nt, Neisseria meningitidis Z2491
uucgccccaaauaccu

SEQ ID NO: 3367416 - RNA, 18 nt, Neisseria meningitidis Z2491
uucgccgacuuugguuuc

SEQ ID NO: 3367417 - RNA, 22 nt, Neisseria meningitidis Z2491
uucgccgccuguuccccguugc

SEQ ID NO: 3367418 - RNA, 20 nt, Neisseria meningitidis Z2491
uucgccuuaaaaaacaaaca

SEQ ID NO: 3367419 - RNA, 16 nt, Neisseria meningitidis Z2491
uucgcggggaugccgg

SEQ ID NO: 3367420 - RNA, 14 nt, Neisseria meningitidis Z2491
uucgcugacgguau

SEQ ID NO: 3367421 - RNA, 16 nt, Neisseria meningitidis Z2491
uucgcugccgccgccc

SEQ ID NO: 3367422 - RNA, 12 nt, Neisseria meningitidis Z2491
uucggacggcau

SEQ ID NO: 3367423 - RNA, 13 nt, Neisseria meningitidis Z2491
uucggacggcauu

SEQ ID NO: 3367424 - RNA, 17 nt, Neisseria meningitidis Z2491
uucggacggcauuuuug

SEQ ID NO: 3367425 - RNA, 23 nt, Neisseria meningitidis Z2491
uucggagcaagaccaaacagaac

SEQ ID NO: 3367426 - RNA, 14 nt, Neisseria meningitidis Z2491
uucggauauuuccg

SEQ ID NO: 3367427 - RNA, 19 nt, Neisseria meningitidis Z2491
uucggaucaacguuucuau

SEQ ID NO: 3367428 - RNA, 23 nt, Neisseria meningitidis Z2491
uucggcaaaauccgcaaacggca

SEQ ID NO: 3367429 - RNA, 22 nt, Neisseria meningitidis Z2491
uucggcaaggucguauuucgcu

SEQ ID NO: 3367430 - RNA, 13 nt, Neisseria meningitidis Z2491
uucggcacaagau

SEQ ID NO: 3367431 - RNA, 12 nt, Neisseria meningitidis Z2491
uucggcgcggcu

SEQ ID NO: 3367432 - RNA, 19 nt, Neisseria meningitidis Z2491
uucggcuugguuuugcuuc

SEQ ID NO: 3367433 - RNA, 16 nt, Neisseria meningitidis Z2491
uucgggcaaaagccag

SEQ ID NO: 3367434 - RNA, 14 nt, Neisseria meningitidis Z2491
uucguaauuuuucu

SEQ ID NO: 3367435 - RNA, 19 nt, Neisseria meningitidis Z2491
uucguauauucugcaaaaa

SEQ ID NO: 3367436 - RNA, 12 nt, Neisseria meningitidis Z2491
uucguccuugcu

SEQ ID NO: 3367437 - RNA, 22 nt, Neisseria meningitidis Z2491
uucgugauucccgagaaaacag

SEQ ID NO: 3367438 - RNA, 13 nt, Neisseria meningitidis Z2491
uucgugcagauaa

SEQ ID NO: 3367439 - RNA, 14 nt, Neisseria meningitidis Z2491
uucgugcaucauca

SEQ ID NO: 3367440 - RNA, 12 nt, Neisseria meningitidis Z2491
uucgugggaaug

SEQ ID NO: 3367441 - RNA, 23 nt, Neisseria meningitidis Z2491
uucguuuuugggauggcgggaaa

SEQ ID NO: 3367442 - RNA, 20 nt, Neisseria meningitidis Z2491
uucuaacaaauaauguucaa

SEQ ID NO: 3367443 - RNA, 16 nt, Neisseria meningitidis Z2491
uucuacccaaauaccc

SEQ ID NO: 3367444 - RNA, 20 nt, Neisseria meningitidis Z2491
uucuacccaaauacccccuu

SEQ ID NO: 3367445 - RNA, 14 nt, Neisseria meningitidis Z2491
uucuauaaagccua

SEQ ID NO: 3367446 - RNA, 22 nt, Neisseria meningitidis Z2491
uucuauaaagccuaaauacaaa

SEQ ID NO: 3367447 - RNA, 18 nt, Neisseria meningitidis Z2491
uucucacaaaaacagaaa

SEQ ID NO: 3367448 - RNA, 22 nt, Neisseria meningitidis Z2491
uucucacaaaaacagaaauuca

SEQ ID NO: 3367449 - RNA, 20 nt, Neisseria meningitidis Z2491
uucucacgcaggcuuuugag

SEQ ID NO: 3367450 - RNA, 17 nt, Neisseria meningitidis Z2491
uucucaugaucuucuua

SEQ ID NO: 3367451 - RNA, 12 nt, Neisseria meningitidis Z2491
uucucuguuuuu

SEQ ID NO: 3367452 - RNA, 14 nt, Neisseria meningitidis Z2491
uucucuuugagcua

SEQ ID NO: 3367453 - RNA, 13 nt, Neisseria meningitidis Z2491
uucugaaaaauau

SEQ ID NO: 3367454 - RNA, 16 nt, Neisseria meningitidis Z2491
uucugaauaaacuucu

SEQ ID NO: 3367455 - RNA, 23 nt, Neisseria meningitidis Z2491
uucugaauugcuugagaugguca

SEQ ID NO: 3367456 - RNA, 14 nt, Neisseria meningitidis Z2491
uugccugcaaugca

SEQ ID NO: 3367457 - RNA, 14 nt, Neisseria meningitidis Z2491
uugccuuaucccga

SEQ ID NO: 3367458 - RNA, 23 nt, Neisseria meningitidis Z2491
uugcgcagccugcagcagagcug

SEQ ID NO: 3367459 - RNA, 14 nt, Neisseria meningitidis Z2491
uugcgccacggcau

SEQ ID NO: 3367460 - RNA, 15 nt, Neisseria meningitidis Z2491
uugcgccacggcaua

SEQ ID NO: 3367461 - RNA, 15 nt, Neisseria meningitidis Z2491
uugcgccgacagcag

SEQ ID NO: 3367462 - RNA, 16 nt, Neisseria meningitidis Z2491
uugcgccgguacccaa

SEQ ID NO: 3367463 - RNA, 19 nt, Neisseria meningitidis Z2491
uugcgccgguacccaaacu

SEQ ID NO: 3367464 - RNA, 21 nt, Neisseria meningitidis Z2491
uugcgcggcaggucgaaauau

SEQ ID NO: 3367465 - RNA, 14 nt, Neisseria meningitidis Z2491
uugcggaaucaaac

SEQ ID NO: 3367466 - RNA, 16 nt, Neisseria meningitidis Z2491
uugcggcaaauuuaca

SEQ ID NO: 3367467 - RNA, 12 nt, Neisseria meningitidis Z2491
uugcggcggcaa

SEQ ID NO: 3367468 - RNA, 18 nt, Neisseria meningitidis Z2491
uugcgggaaugacggcag

SEQ ID NO: 3367469 - RNA, 20 nt, Neisseria meningitidis Z2491
uugcguaauuccggcagccu

SEQ ID NO: 3367470 - RNA, 20 nt, Neisseria meningitidis Z2491
uugcguaggaugccuagaug

SEQ ID NO: 3367471 - RNA, 14 nt, Neisseria meningitidis Z2491
uugcucaauauuag

SEQ ID NO: 3367472 - RNA, 23 nt, Neisseria meningitidis Z2491
uugcucaauauuaggaagguuuu

SEQ ID NO: 3367473 - RNA, 19 nt, Neisseria meningitidis Z2491
uugcuccugauaaaugccg

SEQ ID NO: 3367474 - RNA, 22 nt, Neisseria meningitidis Z2491
uugcugcaucacguucugaaaa

SEQ ID NO: 3367475 - RNA, 14 nt, Neisseria meningitidis Z2491
uugcugccgugaug

SEQ ID NO: 3367476 - RNA, 21 nt, Neisseria meningitidis Z2491
uugcuggaagcauugaccacu

SEQ ID NO: 3367477 - RNA, 21 nt, Neisseria meningitidis Z2491
uugcuguuuuugguuuucuau

SEQ ID NO: 3367478 - RNA, 17 nt, Neisseria meningitidis Z2491
uugcuugagauggucaa

SEQ ID NO: 3367479 - RNA, 15 nt, Neisseria meningitidis Z2491
uugcuugcgcggcau

SEQ ID NO: 3367480 - RNA, 22 nt, Neisseria meningitidis Z2491
uugcuuuguaagaguucguccc

SEQ ID NO: 3367481 - RNA, 17 nt, Neisseria meningitidis Z2491
uugcuuuucauuucuag

SEQ ID NO: 3367482 - RNA, 15 nt, Neisseria meningitidis Z2491
uuggaacaaaaaaua

SEQ ID NO: 3367483 - RNA, 13 nt, Neisseria meningitidis Z2491
uuggacaaaucga

SEQ ID NO: 3367484 - RNA, 14 nt, Neisseria meningitidis Z2491
uuggacggcggauu

SEQ ID NO: 3367485 - RNA, 17 nt, Neisseria meningitidis Z2491
uuggauuugucuucaaa

SEQ ID NO: 3367486 - RNA, 17 nt, Neisseria meningitidis Z2491
uuggcagcacaggcaag

SEQ ID NO: 3367487 - RNA, 15 nt, Neisseria meningitidis Z2491
uuggcauaaccgcuu

SEQ ID NO: 3367488 - RNA, 21 nt, Neisseria meningitidis Z2491
uuggcaucgcgcacuugagcc

SEQ ID NO: 3367489 - RNA, 13 nt, Neisseria meningitidis Z2491
uuggcggcauuuu

SEQ ID NO: 3367490 - RNA, 22 nt, Neisseria meningitidis Z2491
uuggcgguagguuugcaggaau

SEQ ID NO: 3367491 - RNA, 22 nt, Neisseria meningitidis Z2491
uuggcguaaaacgguguggaga

SEQ ID NO: 3367492 - RNA, 16 nt, Neisseria meningitidis Z2491
uuggcuguuuucuguu

SEQ ID NO: 3367493 - RNA, 14 nt, Neisseria meningitidis Z2491
uugggaaaugccgu

SEQ ID NO: 3367494 - RNA, 11 nt, Neisseria meningitidis Z2491
uugggaaucaa

SEQ ID NO: 3367495 - RNA, 18 nt, Neisseria meningitidis Z2491
uugggcgauggcgcggcg

SEQ ID NO: 3367496 - RNA, 22 nt, Neisseria meningitidis Z2491
uugggcggcggcaauauucaaa

SEQ ID NO: 3367497 - RNA, 22 nt, Neisseria meningitidis Z2491
uugggcucaaugaaaauuuggu

SEQ ID NO: 3367498 - RNA, 18 nt, Neisseria meningitidis Z2491
uuggggauuuauucuguu

SEQ ID NO: 3367499 - RNA, 15 nt, Neisseria meningitidis Z2491
uuggggcaaagcggc

SEQ ID NO: 3367500 - RNA, 15 nt, Neisseria meningitidis Z2491
uuggggcgaaaacag

SEQ ID NO: 3367501 - RNA, 13 nt, Neisseria meningitidis Z2491
uuggguagaauua

SEQ ID NO: 3367502 - RNA, 15 nt, Neisseria meningitidis Z2491
uuggguuuucuguuc

SEQ ID NO: 3367503 - RNA, 13 nt, Neisseria meningitidis Z2491
uugguaaaaaaau

SEQ ID NO: 3367504 - RNA, 12 nt, Neisseria meningitidis Z2491
uugguaaucagu

SEQ ID NO: 3367505 - RNA, 23 nt, Neisseria meningitidis Z2491
uugguauauuuuuucuaaauguu

SEQ ID NO: 3367506 - RNA, 22 nt, Neisseria meningitidis Z2491
uugguuccgugauaaagcggcu

SEQ ID NO: 3367507 - RNA, 20 nt, Neisseria meningitidis Z2491
uugguugucaggugcgguaa

SEQ ID NO: 3367508 - RNA, 22 nt, Neisseria meningitidis Z2491
uugguuuauuuuugggaaguaa

SEQ ID NO: 3367509 - RNA, 18 nt, Neisseria meningitidis Z2491
uugguuugaaagagaaaa

SEQ ID NO: 3367510 - RNA, 20 nt, Neisseria meningitidis Z2491
uugguuugaaccagggauuu

SEQ ID NO: 3367511 - RNA, 22 nt, Neisseria meningitidis Z2491
uugguuuuauaguggauuaaca

SEQ ID NO: 3367512 - RNA, 22 nt, Neisseria meningitidis Z2491
uuguaaaggaaguuuugucaaa

SEQ ID NO: 3367513 - RNA, 18 nt, Neisseria meningitidis Z2491
uuguaccggguacuguug

SEQ ID NO: 3367514 - RNA, 14 nt, Neisseria meningitidis Z2491
uuguacggcagcca

SEQ ID NO: 3367515 - RNA, 17 nt, Neisseria meningitidis Z2491
uuguacguggccuuuuc

SEQ ID NO: 3367516 - RNA, 19 nt, Neisseria meningitidis Z2491
uuguacugucugcggcuuu

SEQ ID NO: 3367517 - RNA, 16 nt, Neisseria meningitidis Z2491
uuguauuuuuauuauu

SEQ ID NO: 3367518 - RNA, 23 nt, Neisseria meningitidis Z2491
uuguccauuuuucugaugaucag

SEQ ID NO: 3367519 - RNA, 19 nt, Neisseria meningitidis Z2491
uugucggcuuuugacagca

SEQ ID NO: 3367520 - RNA, 20 nt, Neisseria meningitidis Z2491
uugugaaaauaacgggauuu

SEQ ID NO: 3367521 - RNA, 18 nt, Neisseria meningitidis Z2491
uugugaucgacugcagua

SEQ ID NO: 3367522 - RNA, 16 nt, Neisseria meningitidis Z2491
uugugccagcucuuga

SEQ ID NO: 3367523 - RNA, 18 nt, Neisseria meningitidis Z2491
uugugccugcuccauugu

SEQ ID NO: 3367524 - RNA, 22 nt, Neisseria meningitidis Z2491
uugugcggcaaaacgccuucuu

SEQ ID NO: 3367525 - RNA, 18 nt, Neisseria meningitidis Z2491
uugugggaauccagaccu

SEQ ID NO: 3367526 - RNA, 17 nt, Neisseria meningitidis Z2491
uuguuaaguauuucuau

SEQ ID NO: 3367527 - RNA, 22 nt, Neisseria meningitidis Z2491
uuguuaauccacuauaaaaggu

SEQ ID NO: 3367528 - RNA, 21 nt, Neisseria meningitidis Z2491
uuguuaauccacuauaugaau

SEQ ID NO: 3367529 - RNA, 13 nt, Neisseria meningitidis Z2491
uuguucaaauauc

SEQ ID NO: 3367530 - RNA, 15 nt, Neisseria meningitidis Z2491
uuguucagacggcau

SEQ ID NO: 3367531 - RNA, 21 nt, Neisseria meningitidis Z2491
uuguuggaaaaguacaaaaug

SEQ ID NO: 3367532 - RNA, 11 nt, Neisseria meningitidis Z2491
uuguuguauuc

SEQ ID NO: 3367533 - RNA, 22 nt, Neisseria meningitidis Z2491
uuguuuacggucagaaaauuuc

SEQ ID NO: 3367534 - RNA, 23 nt, Neisseria meningitidis Z2491
uuguuucggagguuaacgcguua

SEQ ID NO: 3367535 - RNA, 21 nt, Neisseria meningitidis Z2491
uuguuuucggguaagcccuaa

SEQ ID NO: 3367536 - RNA, 12 nt, Neisseria meningitidis Z2491
uuguuuuuccaa

SEQ ID NO: 3367537 - RNA, 23 nt, Neisseria meningitidis Z2491
uuuaaaaccccgauagaaaaugc

SEQ ID NO: 3367538 - RNA, 19 nt, Neisseria meningitidis Z2491
uuuaaaaggggcuguacua

SEQ ID NO: 3367539 - RNA, 18 nt, Neisseria meningitidis Z2491
uuuaaacacuucuucauu

SEQ ID NO: 3367540 - RNA, 19 nt, Neisseria meningitidis Z2491
uuuaaaguuaauccacuau

SEQ ID NO: 3367541 - RNA, 11 nt, Neisseria meningitidis Z2491
uuuaaauuuaa

SEQ ID NO: 3367542 - RNA, 12 nt, Neisseria meningitidis Z2491
uuuaacaaugua

SEQ ID NO: 3367543 - RNA, 17 nt, Neisseria meningitidis Z2491
uuuaacuugucaagaaa

SEQ ID NO: 3367544 - RNA, 22 nt, Neisseria meningitidis Z2491
uuuaaucagucggacaaaaugc

SEQ ID NO: 3367545 - RNA, 12 nt, Neisseria meningitidis Z2491
uuuaaucauguu

SEQ ID NO: 3367546 - RNA, 19 nt, Neisseria meningitidis Z2491
uuuaauuaagauccuccca

SEQ ID NO: 3367547 - RNA, 21 nt, Neisseria meningitidis Z2491
uuuaauuucaauacgcaaacu

SEQ ID NO: 3367548 - RNA, 13 nt, Neisseria meningitidis Z2491
uuuaauuuuguca

SEQ ID NO: 3367549 - RNA, 19 nt, Neisseria meningitidis Z2491
uuuacagcggauuaaaaua

SEQ ID NO: 3367550 - RNA, 13 nt, Neisseria meningitidis Z2491
uuuaccagaaaaa

SEQ ID NO: 3367551 - RNA, 16 nt, Neisseria meningitidis Z2491
uuuaccagaaaaaaca

SEQ ID NO: 3367552 - RNA, 15 nt, Neisseria meningitidis Z2491
uuuacccgauaaguu

SEQ ID NO: 3367553 - RNA, 22 nt, Neisseria meningitidis Z2491
uuuaccguuccgcgccgcaaac

SEQ ID NO: 3367554 - RNA, 22 nt, Neisseria meningitidis Z2491
uuuacgauaugcaaaugcacgg

SEQ ID NO: 3367555 - RNA, 18 nt, Neisseria meningitidis Z2491
uuuacgauuacuuauuua

SEQ ID NO: 3367556 - RNA, 14 nt, Neisseria meningitidis Z2491
uuuacggcauaugc

SEQ ID NO: 3367557 - RNA, 17 nt, Neisseria meningitidis Z2491
uuuacggucagaaaauu

SEQ ID NO: 3367558 - RNA, 23 nt, Neisseria meningitidis Z2491
uuuacggucagaaaauuucuuga

SEQ ID NO: 3367559 - RNA, 16 nt, Neisseria meningitidis Z2491
uuuagaaaaaauauac

SEQ ID NO: 3367560 - RNA, 19 nt, Neisseria meningitidis Z2491
uuuagaaacaacugaaacc

SEQ ID NO: 3367561 - RNA, 21 nt, Neisseria meningitidis Z2491
uuuagacagcaucgccgccgu

SEQ ID NO: 3367562 - RNA, 16 nt, Neisseria meningitidis Z2491
uuuagauugcaggcau

SEQ ID NO: 3367563 - RNA, 21 nt, Neisseria meningitidis Z2491
uuuagcggagcaguuuuucaa

SEQ ID NO: 3367564 - RNA, 14 nt, Neisseria meningitidis Z2491
uuuagcuuuuucuu

SEQ ID NO: 3367565 - RNA, 15 nt, Neisseria meningitidis Z2491
uuuagguuuuuguuu

SEQ ID NO: 3367566 - RNA, 17 nt, Neisseria meningitidis Z2491
uuuaguuucggucauuu

SEQ ID NO: 3367567 - RNA, 15 nt, Neisseria meningitidis Z2491
uuuauaaacaaaaaa

SEQ ID NO: 3367568 - RNA, 19 nt, Neisseria meningitidis Z2491
uuuauagugauuaacaaaa

SEQ ID NO: 3367569 - RNA, 20 nt, Neisseria meningitidis Z2491
uuuauaguggauuaacaaaa

SEQ ID NO: 3367570 - RNA, 22 nt, Neisseria meningitidis Z2491
uuuauaguggauuaacaaaaac

SEQ ID NO: 3367571 - RNA, 22 nt, Neisseria meningitidis Z2491
uuuauaguggauuaacaaaaau

SEQ ID NO: 3367572 - RNA, 13 nt, Neisseria meningitidis Z2491
uuuauauucugau

SEQ ID NO: 3367573 - RNA, 14 nt, Neisseria meningitidis Z2491
uuuaucagaaauga

SEQ ID NO: 3367574 - RNA, 19 nt, Neisseria meningitidis Z2491
uuuauccgaaacaacaaaa

SEQ ID NO: 3367575 - RNA, 15 nt, Neisseria meningitidis Z2491
uuuauccgauaaguu

SEQ ID NO: 3367576 - RNA, 16 nt, Neisseria meningitidis Z2491
uuuaucggaaaagcag

SEQ ID NO: 3367577 - RNA, 22 nt, Neisseria meningitidis Z2491
uuuaucggaaaugacugaaacu

SEQ ID NO: 3367578 - RNA, 24 nt, Neisseria meningitidis Z2491
uuuaucuguauaguggauuaaauu

SEQ ID NO: 3367579 - RNA, 10 nt, Neisseria meningitidis Z2491
uuuaucuuuc

SEQ ID NO: 3367580 - RNA, 13 nt, Neisseria meningitidis Z2491
uuuaugaaauaca

SEQ ID NO: 3367581 - RNA, 13 nt, Neisseria meningitidis Z2491
uuuauguuucaaa

SEQ ID NO: 3367582 - RNA, 12 nt, Neisseria meningitidis Z2491
uuuauuauguau

SEQ ID NO: 3367583 - RNA, 16 nt, Neisseria meningitidis Z2491
uuuauuccgaaauauc

SEQ ID NO: 3367584 - RNA, 14 nt, Neisseria meningitidis Z2491
uuuauuuaaauaaa

SEQ ID NO: 3367585 - RNA, 17 nt, Neisseria meningitidis Z2491
uuuauuuaaauaaagau

SEQ ID NO: 3367586 - RNA, 23 nt, Neisseria meningitidis Z2491
uuuauuuacgauaugcaaaugca

SEQ ID NO: 3367587 - RNA, 20 nt, Neisseria meningitidis Z2491
uuuauuugagauuuugaauc

SEQ ID NO: 3367588 - RNA, 12 nt, Neisseria meningitidis Z2491
uuucaaaaugca

SEQ ID NO: 3367589 - RNA, 14 nt, Neisseria meningitidis Z2491
uuucaaaaugcaaa

SEQ ID NO: 3367590 - RNA, 20 nt, Neisseria meningitidis Z2491
uuucaaaauuuauucuaaau

SEQ ID NO: 3367591 - RNA, 20 nt, Neisseria meningitidis Z2491
uuucaaguuccagacggcau

SEQ ID NO: 3367592 - RNA, 15 nt, Neisseria meningitidis Z2491
uuucacaaaaacaga

SEQ ID NO: 3367593 - RNA, 17 nt, Neisseria meningitidis Z2491
uuucacaaaaacagaaa

SEQ ID NO: 3367594 - RNA, 13 nt, Neisseria meningitidis Z2491
uuucacggcggca

SEQ ID NO: 3367595 - RNA, 16 nt, Neisseria meningitidis Z2491
uuucacgggaaugacg

SEQ ID NO: 3367596 - RNA, 14 nt, Neisseria meningitidis Z2491
uuucacuuccaacu

SEQ ID NO: 3367597 - RNA, 11 nt, Neisseria meningitidis Z2491
uuucagacggc

SEQ ID NO: 3367598 - RNA, 23 nt, Neisseria meningitidis Z2491
uuucagacggcaucaaaaugaca

SEQ ID NO: 3367599 - RNA, 16 nt, Neisseria meningitidis Z2491
uuucagacggcauuga

SEQ ID NO: 3367600 - RNA, 15 nt, Neisseria meningitidis Z2491
uuucagacggcauuu

SEQ ID NO: 3367601 - RNA, 18 nt, Neisseria meningitidis Z2491
uuucagacggcauuuccc

SEQ ID NO: 3367602 - RNA, 19 nt, Neisseria meningitidis Z2491
uuucagacggcauuucccg

SEQ ID NO: 3367603 - RNA, 22 nt, Neisseria meningitidis Z2491
uuucagacggcauuucggcagu

SEQ ID NO: 3367604 - RNA, 18 nt, Neisseria meningitidis Z2491
uuucagacggcauuucuu

SEQ ID NO: 3367605 - RNA, 21 nt, Neisseria meningitidis Z2491
uuucagacggcauuucuuaug

SEQ ID NO: 3367606 - RNA, 19 nt, Neisseria meningitidis Z2491
uuucagacggcauuuuuuu

SEQ ID NO: 3367607 - RNA, 13 nt, Neisseria meningitidis Z2491
uuucagacggccu

SEQ ID NO: 3367608 - RNA, 15 nt, Neisseria meningitidis Z2491
uuucagacggccuuu

SEQ ID NO: 3367609 - RNA, 21 nt, Neisseria meningitidis Z2491
uuucagacggcguuuuuguuu

SEQ ID NO: 3367610 - RNA, 11 nt, Neisseria meningitidis Z2491
uuucagacggu

SEQ ID NO: 3367611 - RNA, 14 nt, Neisseria meningitidis Z2491
uuucagauuauuua

SEQ ID NO: 3367612 - RNA, 17 nt, Neisseria meningitidis Z2491
uuucagcccgagauaac

SEQ ID NO: 3367613 - RNA, 18 nt, Neisseria meningitidis Z2491
uuucaggaauuugcggca

SEQ ID NO: 3367614 - RNA, 22 nt, Neisseria meningitidis Z2491
uuucagucugucgccgucggcu

SEQ ID NO: 3367615 - RNA, 22 nt, Neisseria meningitidis Z2491
uuucaguuugaaagcaaagccu

SEQ ID NO: 3367616 - RNA, 15 nt, Neisseria meningitidis Z2491
uuucaucauaugcau

SEQ ID NO: 3367617 - RNA, 15 nt, Neisseria meningitidis Z2491
uuucauuucuagauu

SEQ ID NO: 3367618 - RNA, 17 nt, Neisseria meningitidis Z2491
uuucauuucuagauucc

SEQ ID NO: 3367619 - RNA, 22 nt, Neisseria meningitidis Z2491
uuucauuucuagauucccacuu

SEQ ID NO: 3367620 - RNA, 21 nt, Neisseria meningitidis Z2491
uuucauuucuggauucccacu

SEQ ID NO: 3367621 - RNA, 19 nt, Neisseria meningitidis Z2491
uuuccaaaccugagacucc

SEQ ID NO: 3367622 - RNA, 19 nt, Neisseria meningitidis Z2491
uuuccaaacguuuuuccaa

SEQ ID NO: 3367623 - RNA, 22 nt, Neisseria meningitidis Z2491
uuuccaaacguuuuuccaaacc

SEQ ID NO: 3367624 - RNA, 19 nt, Neisseria meningitidis Z2491
uuuccaaagugauuuccgc

SEQ ID NO: 3367625 - RNA, 15 nt, Neisseria meningitidis Z2491
uuuccaaauauaaaa

SEQ ID NO: 3367626 - RNA, 22 nt, Neisseria meningitidis Z2491
uuuccaauacaacaaaaugccg

SEQ ID NO: 3367627 - RNA, 23 nt, Neisseria meningitidis Z2491
uuuccaauacaacaaaaugccgc

SEQ ID NO: 3367628 - RNA, 13 nt, Neisseria meningitidis Z2491
uuuccacaaaaaa

SEQ ID NO: 3367629 - RNA, 15 nt, Neisseria meningitidis Z2491
uuuccacaaaaaaca

SEQ ID NO: 3367630 - RNA, 17 nt, Neisseria meningitidis Z2491
uuucccgaaauuccaac

SEQ ID NO: 3367631 - RNA, 16 nt, Neisseria meningitidis Z2491
uuucccucagccaucu

SEQ ID NO: 3367632 - RNA, 13 nt, Neisseria meningitidis Z2491
uuuccgauaaauu

SEQ ID NO: 3367633 - RNA, 18 nt, Neisseria meningitidis Z2491
uuuccgauaaauuccuaa

SEQ ID NO: 3367634 - RNA, 22 nt, Neisseria meningitidis Z2491
uuuccgauaaauucuugcaacu

SEQ ID NO: 3367635 - RNA, 15 nt, Neisseria meningitidis Z2491
uuuccgauagauucc

SEQ ID NO: 3367636 - RNA, 20 nt, Neisseria meningitidis Z2491
uuuccgcaccgacagaccua

SEQ ID NO: 3367637 - RNA, 20 nt, Neisseria meningitidis Z2491
uuuccgccggaaagguaucg

SEQ ID NO: 3367638 - RNA, 22 nt, Neisseria meningitidis Z2491
uuuccgcgccgauguuuuccug

SEQ ID NO: 3367639 - RNA, 23 nt, Neisseria meningitidis Z2491
uuuccgcuugaaacaucugccgu

SEQ ID NO: 3367640 - RNA, 20 nt, Neisseria meningitidis Z2491
uuuccguugucggaacagca

SEQ ID NO: 3367641 - RNA, 15 nt, Neisseria meningitidis Z2491
uuuccucacugccgc

SEQ ID NO: 3367642 - RNA, 13 nt, Neisseria meningitidis Z2491
uuuccucuuucaa

SEQ ID NO: 3367643 - RNA, 15 nt, Neisseria meningitidis Z2491
uuuccuugcaacccc

SEQ ID NO: 3367644 - RNA, 21 nt, Neisseria meningitidis Z2491
uuucgcaaccguugcagccau

SEQ ID NO: 3367645 - RNA, 15 nt, Neisseria meningitidis Z2491
uuucgcugccgccgc

SEQ ID NO: 3367646 - RNA, 18 nt, Neisseria meningitidis Z2491
uuucgcuugugaaaauau

SEQ ID NO: 3367647 - RNA, 13 nt, Neisseria meningitidis Z2491
uuucggauaaauu

SEQ ID NO: 3367648 - RNA, 20 nt, Neisseria meningitidis Z2491
uuucggguuucagacggcau

SEQ ID NO: 3367649 - RNA, 11 nt, Neisseria meningitidis Z2491
uuucuaaaaua

SEQ ID NO: 3367650 - RNA, 17 nt, Neisseria meningitidis Z2491
uuucuagggaaaugccc

SEQ ID NO: 3367651 - RNA, 17 nt, Neisseria meningitidis Z2491
uuucuauuugauuuuca

SEQ ID NO: 3367652 - RNA, 13 nt, Neisseria meningitidis Z2491
uuucuauuuuaca

SEQ ID NO: 3367653 - RNA, 14 nt, Neisseria meningitidis Z2491
uuucugaaaaauuu

SEQ ID NO: 3367654 - RNA, 15 nt, Neisseria meningitidis Z2491
uuucugaaaaauuua

SEQ ID NO: 3367655 - RNA, 21 nt, Neisseria meningitidis Z2491
uuucugaugaucaguaaaaaa

SEQ ID NO: 3367656 - RNA, 11 nt, Neisseria meningitidis Z2491
uuucugauuuu

SEQ ID NO: 3367657 - RNA, 13 nt, Neisseria meningitidis Z2491
uuucugauuuuga

SEQ ID NO: 3367658 - RNA, 20 nt, Neisseria meningitidis Z2491
uuuuccgauaaauuccuaaa

SEQ ID NO: 3367659 - RNA, 23 nt, Neisseria meningitidis Z2491
uuuuccgcccgaacggaaauaag

SEQ ID NO: 3367660 - RNA, 15 nt, Neisseria meningitidis Z2491
uuuuccuacuuuuug

SEQ ID NO: 3367661 - RNA, 18 nt, Neisseria meningitidis Z2491
uuuuccucgauuugaaau

SEQ ID NO: 3367662 - RNA, 15 nt, Neisseria meningitidis Z2491
uuuucgauaugaaaa

SEQ ID NO: 3367663 - RNA, 13 nt, Neisseria meningitidis Z2491
uuuucgccagcau

SEQ ID NO: 3367664 - RNA, 13 nt, Neisseria meningitidis Z2491
uuuucgccuauca

SEQ ID NO: 3367665 - RNA, 18 nt, Neisseria meningitidis Z2491
uuuucgcgcaccagcaaa

SEQ ID NO: 3367666 - RNA, 17 nt, Neisseria meningitidis Z2491
uuuucguuaucccaaca

SEQ ID NO: 3367667 - RNA, 13 nt, Neisseria meningitidis Z2491
uuuucuaaauguu

SEQ ID NO: 3367668 - RNA, 22 nt, Neisseria meningitidis Z2491
uuuucucaaaguuauuaaguga

SEQ ID NO: 3367669 - RNA, 10 nt, Neisseria meningitidis Z2491
uuuucucuau

SEQ ID NO: 3367670 - RNA, 17 nt, Neisseria meningitidis Z2491
uuuucugaaaaauuuau

SEQ ID NO: 3367671 - RNA, 15 nt, Neisseria meningitidis Z2491
uuuucugcucuucgc

SEQ ID NO: 3367672 - RNA, 23 nt, Neisseria meningitidis Z2491
uuuucuuaugccuauuuuuuaau

SEQ ID NO: 3367673 - RNA, 13 nt, Neisseria meningitidis Z2491
uuuucuuuuugau

SEQ ID NO: 3367674 - RNA, 11 nt, Neisseria meningitidis Z2491
uuuugacaaaa

SEQ ID NO: 3367675 - RNA, 14 nt, Neisseria meningitidis Z2491
uuuugacaaaauca

SEQ ID NO: 3367676 - RNA, 21 nt, Neisseria meningitidis Z2491
uuuugcagcccugauaaaaaa

SEQ ID NO: 3367677 - RNA, 12 nt, Neisseria meningitidis Z2491
uuuugcagguag

SEQ ID NO: 3367678 - RNA, 19 nt, Neisseria meningitidis Z2491
uuuugcauuuugaaaauga

SEQ ID NO: 3367679 - RNA, 14 nt, Neisseria meningitidis Z2491
uuuugccagcgggu

SEQ ID NO: 3367680 - RNA, 22 nt, Neisseria meningitidis Z2491
uuuugccguauccauaccaaac

SEQ ID NO: 3367681 - RNA, 10 nt, Neisseria meningitidis Z2491
uuuugcgcca

SEQ ID NO: 3367682 - RNA, 20 nt, Neisseria meningitidis Z2491
uuuugcgggaaugacggcag

SEQ ID NO: 3367683 - RNA, 11 nt, Neisseria meningitidis Z2491
uuuugcugccg

SEQ ID NO: 3367684 - RNA, 13 nt, Neisseria meningitidis Z2491
uuuugguuuucua

SEQ ID NO: 3367685 - RNA, 16 nt, Neisseria meningitidis Z2491
uuuuguuaauccacua

SEQ ID NO: 3367686 - RNA, 16 nt, Neisseria meningitidis Z2491
uuuuguuuuuccaaac

SEQ ID NO: 3367687 - RNA, 22 nt, Neisseria meningitidis Z2491
uuuuuaauccacaguuuuucca

SEQ ID NO: 3367688 - RNA, 15 nt, Neisseria meningitidis Z2491
uuuuuaauuucuucu

SEQ ID NO: 3367689 - RNA, 23 nt, Neisseria meningitidis Z2491
uuuuuacgcgugauuugccgcca

SEQ ID NO: 3367690 - RNA, 16 nt, Neisseria meningitidis Z2491
uuuuuauucaauguca

SEQ ID NO: 3367691 - RNA, 12 nt, Neisseria meningitidis Z2491
uuuuucaaagcc

SEQ ID NO: 3367692 - RNA, 13 nt, Neisseria meningitidis Z2491
uuuuucagcggcg

SEQ ID NO: 3367693 - RNA, 15 nt, Neisseria meningitidis Z2491
uuuuuccacaaaaga

SEQ ID NO: 3367694 - RNA, 15 nt, Neisseria meningitidis Z2491
uuuuuccaguuugaa

SEQ ID NO: 3367695 - RNA, 17 nt, Neisseria meningitidis Z2491
uuuuuccgacaaauucc

SEQ ID NO: 3367696 - RNA, 18 nt, Neisseria meningitidis Z2491
uuuuuccgacaaauuccu

SEQ ID NO: 3367697 - RNA, 19 nt, Neisseria meningitidis Z2491
uuuuuccgacaaauuccua

SEQ ID NO: 3367698 - RNA, 17 nt, Neisseria meningitidis Z2491
uuuuuccgauaaauucc

SEQ ID NO: 3367699 - RNA, 19 nt, Neisseria meningitidis Z2491
uuuuuccgauaaauuccua

SEQ ID NO: 3367700 - RNA, 18 nt, Neisseria meningitidis Z2491
uuuuuccgauaaauucuu

SEQ ID NO: 3367701 - RNA, 22 nt, Neisseria meningitidis Z2491
uuuuucggcacaagaugcccca

SEQ ID NO: 3367702 - RNA, 13 nt, Neisseria meningitidis Z2491
uuuuugaaugccu

SEQ ID NO: 3367703 - RNA, 13 nt, Neisseria meningitidis Z2491
uuuuugccuguuc

SEQ ID NO: 3367704 - RNA, 22 nt, Neisseria meningitidis Z2491
uuuuugggaaguaaccccuucc

SEQ ID NO: 3367705 - RNA, 18 nt, Neisseria meningitidis Z2491
uuuuugggcggucaggcu

SEQ ID NO: 3367706 - RNA, 15 nt, Neisseria meningitidis Z2491
uuuuugguguuugca

SEQ ID NO: 3367707 - RNA, 22 nt, Neisseria meningitidis Z2491
uuuuuuagggaaacguuuguuu

SEQ ID NO: 3367708 - RNA, 14 nt, Neisseria meningitidis Z2491
uuuuuucauaccca

SEQ ID NO: 3367709 - RNA, 20 nt, Neisseria meningitidis Z2491
acauagcguguauuuuggua

SEQ ID NO: 3367710 - RNA, 20 nt, Neisseria meningitidis Z2491
acauagguuacuaaaauuuu

SEQ ID NO: 3367711 - RNA, 22 nt, Neisseria meningitidis Z2491
acauaugccgucugaaaacagg

SEQ ID NO: 3367712 - RNA, 21 nt, Neisseria meningitidis Z2491
acauauugagaccuuugcaau

SEQ ID NO: 3367713 - RNA, 21 nt, Neisseria meningitidis Z2491
acaucaaguuaccggucuaaa

SEQ ID NO: 3367714 - RNA, 21 nt, Neisseria meningitidis Z2491
acaucacggucuuuuugcuuu

SEQ ID NO: 3367715 - RNA, 22 nt, Neisseria meningitidis Z2491
acaucaggcggcguucuucuuc

SEQ ID NO: 3367716 - RNA, 17 nt, Neisseria meningitidis Z2491
acaucaggggcgguaau

SEQ ID NO: 3367717 - RNA, 16 nt, Neisseria meningitidis Z2491
acaucgacacccgccc

SEQ ID NO: 3367718 - RNA, 18 nt, Neisseria meningitidis Z2491
acaucguacugguuuaaa

SEQ ID NO: 3367719 - RNA, 13 nt, Neisseria meningitidis Z2491
acaucgucugcaa

SEQ ID NO: 3367720 - RNA, 20 nt, Neisseria meningitidis Z2491
acaucguuuuuuuagggaaa

SEQ ID NO: 3367721 - RNA, 17 nt, Neisseria meningitidis Z2491
acaucugauuuuucuuu

SEQ ID NO: 3367722 - RNA, 23 nt, Neisseria meningitidis Z2491
acaugacauuaagauguuuuucc

SEQ ID NO: 3367723 - RNA, 13 nt, Neisseria meningitidis Z2491
acaugcaagcaua

SEQ ID NO: 3367724 - RNA, 21 nt, Neisseria meningitidis Z2491
acaugccaccgucauucccgc

SEQ ID NO: 3367725 - RNA, 14 nt, Neisseria meningitidis Z2491
acauucaaugcuaa

SEQ ID NO: 3367726 - RNA, 22 nt, Neisseria meningitidis Z2491
acauuccaucaacaaaaugccg

SEQ ID NO: 3367727 - RNA, 16 nt, Neisseria meningitidis Z2491
acauucuccguuucag

SEQ ID NO: 3367728 - RNA, 21 nt, Neisseria meningitidis Z2491
acauucucuuggucaaaaugu

SEQ ID NO: 3367729 - RNA, 21 nt, Neisseria meningitidis Z2491
acauugcguucagacggcauu

SEQ ID NO: 3367730 - RNA, 13 nt, Neisseria meningitidis Z2491
acauuuaucagga

SEQ ID NO: 3367731 - RNA, 18 nt, Neisseria meningitidis Z2491
acauuuucuauuugauuu

SEQ ID NO: 3367732 - RNA, 21 nt, Neisseria meningitidis Z2491
acauuuucuugcuguuggaaa

SEQ ID NO: 3367733 - RNA, 16 nt, Neisseria meningitidis Z2491
acauuuugcucauuca

SEQ ID NO: 3367734 - RNA, 15 nt, Neisseria meningitidis Z2491
accaaaaaacaacag

SEQ ID NO: 3367735 - RNA, 13 nt, Neisseria meningitidis Z2491
accaaaaacagaa

SEQ ID NO: 3367736 - RNA, 14 nt, Neisseria meningitidis Z2491
accaaaaacagaaa

SEQ ID NO: 3367737 - RNA, 19 nt, Neisseria meningitidis Z2491
accaaaaacagaaaccuaa

SEQ ID NO: 3367738 - RNA, 12 nt, Neisseria meningitidis Z2491
accaaaaacagc

SEQ ID NO: 3367739 - RNA, 16 nt, Neisseria meningitidis Z2491
accaaaaacagcaacc

SEQ ID NO: 3367740 - RNA, 19 nt, Neisseria meningitidis Z2491
accaaaaacagcaaccuga

SEQ ID NO: 3367741 - RNA, 18 nt, Neisseria meningitidis Z2491
accaaaacagaaaccuaa

SEQ ID NO: 3367742 - RNA, 13 nt, Neisseria meningitidis Z2491
accaaaagccaaa

SEQ ID NO: 3367743 - RNA, 12 nt, Neisseria meningitidis Z2491
accaaaaugccc

SEQ ID NO: 3367744 - RNA, 20 nt, Neisseria meningitidis Z2491
accaaaaugcccgccagucc

SEQ ID NO: 3367745 - RNA, 12 nt, Neisseria meningitidis Z2491
accaaacggcau

SEQ ID NO: 3367746 - RNA, 16 nt, Neisseria meningitidis Z2491
accaaagcauuuuucg

SEQ ID NO: 3367747 - RNA, 23 nt, Neisseria meningitidis Z2491
accaaaucggcuuucagacggca

SEQ ID NO: 3367748 - RNA, 19 nt, Neisseria meningitidis Z2491
accaaauuauugccagcau

SEQ ID NO: 3367749 - RNA, 15 nt, Neisseria meningitidis Z2491
accaaccggguauuc

SEQ ID NO: 3367750 - RNA, 13 nt, Neisseria meningitidis Z2491
accaacugcucga

SEQ ID NO: 3367751 - RNA, 15 nt, Neisseria meningitidis Z2491
accaagcccaauccc

SEQ ID NO: 3367752 - RNA, 17 nt, Neisseria meningitidis Z2491
accaagcccaaucccgc

SEQ ID NO: 3367753 - RNA, 17 nt, Neisseria meningitidis Z2491
accacccguguggauca

SEQ ID NO: 3367754 - RNA, 17 nt, Neisseria meningitidis Z2491
accacgucauucccacg

SEQ ID NO: 3367755 - RNA, 12 nt, Neisseria meningitidis Z2491
accacguccacc

SEQ ID NO: 3367756 - RNA, 14 nt, Neisseria meningitidis Z2491
accacuguugccac

SEQ ID NO: 3367757 - RNA, 17 nt, Neisseria meningitidis Z2491
accacuguugccacaau

SEQ ID NO: 3367758 - RNA, 14 nt, Neisseria meningitidis Z2491
accagaaaaaacag

SEQ ID NO: 3367759 - RNA, 15 nt, Neisseria meningitidis Z2491
accagaccgaugccg

SEQ ID NO: 3367760 - RNA, 14 nt, Neisseria meningitidis Z2491
accagcagugccgc

SEQ ID NO: 3367761 - RNA, 16 nt, Neisseria meningitidis Z2491
accagcccgccgcgcc

SEQ ID NO: 3367762 - RNA, 18 nt, Neisseria meningitidis Z2491
accaguacagcguugccu

SEQ ID NO: 3367763 - RNA, 14 nt, Neisseria meningitidis Z2491
accagucuugcgag

SEQ ID NO: 3367764 - RNA, 16 nt, Neisseria meningitidis Z2491
accaguuugaccaugc

SEQ ID NO: 3367765 - RNA, 15 nt, Neisseria meningitidis Z2491
accauaaauuuuaaa

SEQ ID NO: 3367766 - RNA, 16 nt, Neisseria meningitidis Z2491
accauaccgccuucau

SEQ ID NO: 3367767 - RNA, 18 nt, Neisseria meningitidis Z2491
accaucggcaaaguuauu

SEQ ID NO: 3367768 - RNA, 18 nt, Neisseria meningitidis Z2491
accaucuacauaaacagg

SEQ ID NO: 3367769 - RNA, 21 nt, Neisseria meningitidis Z2491
accaucuacauaaacaggcgc

SEQ ID NO: 3367770 - RNA, 14 nt, Neisseria meningitidis Z2491
accaucucuaagau

SEQ ID NO: 3367771 - RNA, 12 nt, Neisseria meningitidis Z2491
accauuguuucc

SEQ ID NO: 3367772 - RNA, 16 nt, Neisseria meningitidis Z2491
accauuguuuccgcuu

SEQ ID NO: 3367773 - RNA, 14 nt, Neisseria meningitidis Z2491
accauuucuuuggc

SEQ ID NO: 3367774 - RNA, 13 nt, Neisseria meningitidis Z2491
acccaaaaggaag

SEQ ID NO: 3367775 - RNA, 22 nt, Neisseria meningitidis Z2491
acccaaaaucggccauucccuc

SEQ ID NO: 3367776 - RNA, 20 nt, Neisseria meningitidis Z2491
acccaaaccgucauucccgc

SEQ ID NO: 3367777 - RNA, 19 nt, Neisseria meningitidis Z2491
acccaacaggguuccgaaa

SEQ ID NO: 3367778 - RNA, 14 nt, Neisseria meningitidis Z2491
acccaaugacugcc

SEQ ID NO: 3367779 - RNA, 16 nt, Neisseria meningitidis Z2491
acccaugccauacugc

SEQ ID NO: 3367780 - RNA, 20 nt, Neisseria meningitidis Z2491
acccauucugacaaggccga

SEQ ID NO: 3367781 - RNA, 17 nt, Neisseria meningitidis Z2491
acccccgucauucccgc

SEQ ID NO: 3367782 - RNA, 17 nt, Neisseria meningitidis Z2491
acccccgucauucccuc

SEQ ID NO: 3367783 - RNA, 22 nt, Neisseria meningitidis Z2491
accccgauuuguccgacacaau

SEQ ID NO: 3367784 - RNA, 18 nt, Neisseria meningitidis Z2491
accccguucccuguacca

SEQ ID NO: 3367785 - RNA, 22 nt, Neisseria meningitidis Z2491
accccguucccuguaccagcaa

SEQ ID NO: 3367786 - RNA, 23 nt, Neisseria meningitidis Z2491
accccuaaaggcuucagacggca

SEQ ID NO: 3367787 - RNA, 17 nt, Neisseria meningitidis Z2491
acccgaaucacaaacau

SEQ ID NO: 3367788 - RNA, 19 nt, Neisseria meningitidis Z2491
acccgaaucacaaacaucg

SEQ ID NO: 3367789 - RNA, 20 nt, Neisseria meningitidis Z2491
acccgcaaccaaaaucauca

SEQ ID NO: 3367790 - RNA, 21 nt, Neisseria meningitidis Z2491
acccgguccaacuucaauagu

SEQ ID NO: 3367791 - RNA, 17 nt, Neisseria meningitidis Z2491
acccuaccauuguuucu

SEQ ID NO: 3367792 - RNA, 20 nt, Neisseria meningitidis Z2491
acccucuccccgacccuccc

SEQ ID NO: 3367793 - RNA, 17 nt, Neisseria meningitidis Z2491
acccugccgucauuccc

SEQ ID NO: 3367794 - RNA, 20 nt, Neisseria meningitidis Z2491
acccugccgucugaaaccgg

SEQ ID NO: 3367795 - RNA, 20 nt, Neisseria meningitidis Z2491
acccugucgccgucauuccc

SEQ ID NO: 3367796 - RNA, 20 nt, Neisseria meningitidis Z2491
acccuuaucccaauauuaag

SEQ ID NO: 3367797 - RNA, 18 nt, Neisseria meningitidis Z2491
acccuugugcuucuucga

SEQ ID NO: 3367798 - RNA, 16 nt, Neisseria meningitidis Z2491
acccuuugggcguuca

SEQ ID NO: 3367799 - RNA, 13 nt, Neisseria meningitidis Z2491
accgaaacggcgc

SEQ ID NO: 3367800 - RNA, 12 nt, Neisseria meningitidis Z2491
accgaaaugccg

SEQ ID NO: 3367801 - RNA, 16 nt, Neisseria meningitidis Z2491
accgaaaugccgucau

SEQ ID NO: 3367802 - RNA, 19 nt, Neisseria meningitidis Z2491
accgaaugccacacgcagg

SEQ ID NO: 3367803 - RNA, 17 nt, Neisseria meningitidis Z2491
accgacaauacggcggc

SEQ ID NO: 3367804 - RNA, 20 nt, Neisseria meningitidis Z2491
accgaugccgucauucccgc

SEQ ID NO: 3367805 - RNA, 15 nt, Neisseria meningitidis Z2491
accgaugggcuucau

SEQ ID NO: 3367806 - RNA, 15 nt, Neisseria meningitidis Z2491
accgauucacuuggu

SEQ ID NO: 3367807 - RNA, 19 nt, Neisseria meningitidis Z2491
accgauucacuuggugcuu

SEQ ID NO: 3367808 - RNA, 20 nt, Neisseria meningitidis Z2491
accgauucacuuggugcuug

SEQ ID NO: 3367809 - RNA, 14 nt, Neisseria meningitidis Z2491
accgcagccgaacc

SEQ ID NO: 3367810 - RNA, 12 nt, Neisseria meningitidis Z2491
acgccuucuucg

SEQ ID NO: 3367811 - RNA, 16 nt, Neisseria meningitidis Z2491
acgcgaaaaugccguc

SEQ ID NO: 3367812 - RNA, 20 nt, Neisseria meningitidis Z2491
acgcgcccaucgucuagagg

SEQ ID NO: 3367813 - RNA, 12 nt, Neisseria meningitidis Z2491
acgcgccuucau

SEQ ID NO: 3367814 - RNA, 18 nt, Neisseria meningitidis Z2491
acgcgcgccguccaaaaa

SEQ ID NO: 3367815 - RNA, 12 nt, Neisseria meningitidis Z2491
acgcgcgggaau

SEQ ID NO: 3367816 - RNA, 20 nt, Neisseria meningitidis Z2491
acgcgcugcgccuaugcaau

SEQ ID NO: 3367817 - RNA, 15 nt, Neisseria meningitidis Z2491
acgcgcugcggcauc

SEQ ID NO: 3367818 - RNA, 17 nt, Neisseria meningitidis Z2491
acgcgguagggcaguuc

SEQ ID NO: 3367819 - RNA, 22 nt, Neisseria meningitidis Z2491
acgcguagccugccaaaaucga

SEQ ID NO: 3367820 - RNA, 14 nt, Neisseria meningitidis Z2491
acgcgugcaggcgc

SEQ ID NO: 3367821 - RNA, 13 nt, Neisseria meningitidis Z2491
acgcuaccgcaua

SEQ ID NO: 3367822 - RNA, 20 nt, Neisseria meningitidis Z2491
acgcuccagcuccggccaaa

SEQ ID NO: 3367823 - RNA, 16 nt, Neisseria meningitidis Z2491
acgcuccccauauaga

SEQ ID NO: 3367824 - RNA, 15 nt, Neisseria meningitidis Z2491
acgcuguaccgguuu

SEQ ID NO: 3367825 - RNA, 15 nt, Neisseria meningitidis Z2491
acgcuucagacggca

SEQ ID NO: 3367826 - RNA, 15 nt, Neisseria meningitidis Z2491
acggaaacucaaaaa

SEQ ID NO: 3367827 - RNA, 16 nt, Neisseria meningitidis Z2491
acggaaacucaaaaaa

SEQ ID NO: 3367828 - RNA, 22 nt, Neisseria meningitidis Z2491
acggaaacuuaucggauaaaac

SEQ ID NO: 3367829 - RNA, 17 nt, Neisseria meningitidis Z2491
acggacgcaggugcaga

SEQ ID NO: 3367830 - RNA, 13 nt, Neisseria meningitidis Z2491
acggacggcggca

SEQ ID NO: 3367831 - RNA, 22 nt, Neisseria meningitidis Z2491
acggacuagauucccgccugcg

SEQ ID NO: 3367832 - RNA, 14 nt, Neisseria meningitidis Z2491
acggagauuuuguu

SEQ ID NO: 3367833 - RNA, 22 nt, Neisseria meningitidis Z2491
acggagccagcccgcugccgaa

SEQ ID NO: 3367834 - RNA, 16 nt, Neisseria meningitidis Z2491
acggauuguuuggaaa

SEQ ID NO: 3367835 - RNA, 19 nt, Neisseria meningitidis Z2491
acggauuguuuggaaaugu

SEQ ID NO: 3367836 - RNA, 15 nt, Neisseria meningitidis Z2491
acggcaaaaacagaa

SEQ ID NO: 3367837 - RNA, 14 nt, Neisseria meningitidis Z2491
acggcaaacugcgu

SEQ ID NO: 3367838 - RNA, 15 nt, Neisseria meningitidis Z2491
acggcaacaaaaugc

SEQ ID NO: 3367839 - RNA, 18 nt, Neisseria meningitidis Z2491
acggcaaggcgaggcaac

SEQ ID NO: 3367840 - RNA, 13 nt, Neisseria meningitidis Z2491
acggcacaaacgc

SEQ ID NO: 3367841 - RNA, 20 nt, Neisseria meningitidis Z2491
acggcacggcgcaggcaaac

SEQ ID NO: 3367842 - RNA, 22 nt, Neisseria meningitidis Z2491
acggcauaucccgacagaacag

SEQ ID NO: 3367843 - RNA, 13 nt, Neisseria meningitidis Z2491
acggcauauguuu

SEQ ID NO: 3367844 - RNA, 15 nt, Neisseria meningitidis Z2491
acggcaucaaaauga

SEQ ID NO: 3367845 - RNA, 17 nt, Neisseria meningitidis Z2491
acggcauuuccggcauc

SEQ ID NO: 3367846 - RNA, 18 nt, Neisseria meningitidis Z2491
acggcauuucggcaguuu

SEQ ID NO: 3367847 - RNA, 23 nt, Neisseria meningitidis Z2491
acggcauuucggcaguuuucaac

SEQ ID NO: 3367848 - RNA, 18 nt, Neisseria meningitidis Z2491
acggcauuucuuauguuu

SEQ ID NO: 3367849 - RNA, 21 nt, Neisseria meningitidis Z2491
acggcauuucuuauguuuaau

SEQ ID NO: 3367850 - RNA, 14 nt, Neisseria meningitidis Z2491
acggcauuugaccc

SEQ ID NO: 3367851 - RNA, 21 nt, Neisseria meningitidis Z2491
acggcauuuucaacagcagga

SEQ ID NO: 3367852 - RNA, 16 nt, Neisseria meningitidis Z2491
acggcauuuucgcaac

SEQ ID NO: 3367853 - RNA, 19 nt, Neisseria meningitidis Z2491
acggcauuuucgcaaccgu

SEQ ID NO: 3367854 - RNA, 22 nt, Neisseria meningitidis Z2491
acggcauuuugccgacaggcuc

SEQ ID NO: 3367855 - RNA, 20 nt, Neisseria meningitidis Z2491
acggcauuuuguugccgucg

SEQ ID NO: 3367856 - RNA, 13 nt, Neisseria meningitidis Z2491
acggcauuuuuaa

SEQ ID NO: 3367857 - RNA, 22 nt, Neisseria meningitidis Z2491
acggcauuuuuacaaggcagca

SEQ ID NO: 3367858 - RNA, 18 nt, Neisseria meningitidis Z2491
acggcauuuuuauugcuu

SEQ ID NO: 3367859 - RNA, 21 nt, Neisseria meningitidis Z2491
acggcauuuuuauugcuucau

SEQ ID NO: 3367860 - RNA, 16 nt, Neisseria meningitidis Z2491
acggcgcaggcaaacg

SEQ ID NO: 3367861 - RNA, 17 nt, Neisseria meningitidis Z2491
acggcgcaggcaaacgc

SEQ ID NO: 3367862 - RNA, 13 nt, Neisseria meningitidis Z2491
acggcggaaaggu

SEQ ID NO: 3367863 - RNA, 22 nt, Neisseria meningitidis Z2491
acggcggaagggguaaauccuc

SEQ ID NO: 3367864 - RNA, 15 nt, Neisseria meningitidis Z2491
acggcggcaacagaa

SEQ ID NO: 3367865 - RNA, 16 nt, Neisseria meningitidis Z2491
acggcgggggggauuu

SEQ ID NO: 3367866 - RNA, 21 nt, Neisseria meningitidis Z2491
acggcguaauccgccugcgcc

SEQ ID NO: 3367867 - RNA, 18 nt, Neisseria meningitidis Z2491
acggcguucaacauccgc

SEQ ID NO: 3367868 - RNA, 22 nt, Neisseria meningitidis Z2491
acggcguucaacauccgcagac

SEQ ID NO: 3367869 - RNA, 17 nt, Neisseria meningitidis Z2491
acggcguugccucgccu

SEQ ID NO: 3367870 - RNA, 20 nt, Neisseria meningitidis Z2491
acggcguuuuuuauauggcg

SEQ ID NO: 3367871 - RNA, 23 nt, Neisseria meningitidis Z2491
acggcucaucaugcggaagaagu

SEQ ID NO: 3367872 - RNA, 14 nt, Neisseria meningitidis Z2491
acgggaaugacgaa

SEQ ID NO: 3367873 - RNA, 20 nt, Neisseria meningitidis Z2491
acgggaaugacgaaagguug

SEQ ID NO: 3367874 - RNA, 18 nt, Neisseria meningitidis Z2491
acgggacgggcagacagu

SEQ ID NO: 3367875 - RNA, 15 nt, Neisseria meningitidis Z2491
acgggaggaccucaa

SEQ ID NO: 3367876 - RNA, 19 nt, Neisseria meningitidis Z2491
acgggaggaccucaaacga

SEQ ID NO: 3367877 - RNA, 19 nt, Neisseria meningitidis Z2491
acgggauuugagauugcgg

SEQ ID NO: 3367878 - RNA, 15 nt, Neisseria meningitidis Z2491
acgggcaauuuucaa

SEQ ID NO: 3367879 - RNA, 17 nt, Neisseria meningitidis Z2491
acgggccguuuuuacug

SEQ ID NO: 3367880 - RNA, 18 nt, Neisseria meningitidis Z2491
acggggcuggauucccgc

SEQ ID NO: 3367881 - RNA, 15 nt, Neisseria meningitidis Z2491
acggguucagacggc

SEQ ID NO: 3367882 - RNA, 17 nt, Neisseria meningitidis Z2491
acggguucggacggcau

SEQ ID NO: 3367883 - RNA, 18 nt, Neisseria meningitidis Z2491
acggguuucagacggcau

SEQ ID NO: 3367884 - RNA, 20 nt, Neisseria meningitidis Z2491
acggguuugccgcugacgaa

SEQ ID NO: 3367885 - RNA, 15 nt, Neisseria meningitidis Z2491
acgguaaacacgggg

SEQ ID NO: 3367886 - RNA, 15 nt, Neisseria meningitidis Z2491
acgguacaggaaagu

SEQ ID NO: 3367887 - RNA, 16 nt, Neisseria meningitidis Z2491
acgguauaaaccaaaa

SEQ ID NO: 3367888 - RNA, 22 nt, Neisseria meningitidis Z2491
acgguaucgccguuuugcagug

SEQ ID NO: 3367889 - RNA, 18 nt, Neisseria meningitidis Z2491
acggucgaaacuuuccac

SEQ ID NO: 3367890 - RNA, 19 nt, Neisseria meningitidis Z2491
acggucggggguuucuguu

SEQ ID NO: 3367891 - RNA, 15 nt, Neisseria meningitidis Z2491
acgguuacacaaaua

SEQ ID NO: 3367892 - RNA, 16 nt, Neisseria meningitidis Z2491
acgguucguccagcag

SEQ ID NO: 3367893 - RNA, 21 nt, Neisseria meningitidis Z2491
acgguugugccguguuucauc

SEQ ID NO: 3367894 - RNA, 17 nt, Neisseria meningitidis Z2491
acgguuugaaacggaca

SEQ ID NO: 3367895 - RNA, 23 nt, Neisseria meningitidis Z2491
acgguuugagcgcgucaaacaga

SEQ ID NO: 3367896 - RNA, 11 nt, Neisseria meningitidis Z2491
acguaaaaaac

SEQ ID NO: 3367897 - RNA, 19 nt, Neisseria meningitidis Z2491
acguaaaaucuauagugga

SEQ ID NO: 3367898 - RNA, 14 nt, Neisseria meningitidis Z2491
acgucauucccacg

SEQ ID NO: 3367899 - RNA, 18 nt, Neisseria meningitidis Z2491
acguccaaaugccgcaaa

SEQ ID NO: 3367900 - RNA, 17 nt, Neisseria meningitidis Z2491
acguccgccauuuccaa

SEQ ID NO: 3367901 - RNA, 18 nt, Neisseria meningitidis Z2491
acguccgccauuuccaaa

SEQ ID NO: 3367902 - RNA, 19 nt, Neisseria meningitidis Z2491
acgucggcgcggacgauuu

SEQ ID NO: 3367903 - RNA, 14 nt, Neisseria meningitidis Z2491
acgucguacagaua

SEQ ID NO: 3367904 - RNA, 23 nt, Neisseria meningitidis Z2491
acgugcaauacacuguuuccaag

SEQ ID NO: 3367905 - RNA, 13 nt, Neisseria meningitidis Z2491
acguggucggcgu

SEQ ID NO: 3367906 - RNA, 20 nt, Neisseria meningitidis Z2491
acguucaaacccuccgccuc

SEQ ID NO: 3367907 - RNA, 14 nt, Neisseria meningitidis Z2491
acguugccuucuuc

SEQ ID NO: 3367908 - RNA, 16 nt, Neisseria meningitidis Z2491
acguuuuuccaaaccu

SEQ ID NO: 3367909 - RNA, 17 nt, Neisseria meningitidis Z2491
acuaaaaaauccaaaaa

SEQ ID NO: 3367910 - RNA, 18 nt, Neisseria meningitidis Z2491
acuaaaaaauccaaaaau

SEQ ID NO: 3367911 - RNA, 14 nt, Neisseria meningitidis Z2491
agaaaacgccgucu

SEQ ID NO: 3367912 - RNA, 18 nt, Neisseria meningitidis Z2491
agaaaacgccgucugaaa

SEQ ID NO: 3367913 - RNA, 19 nt, Neisseria meningitidis Z2491
agaaaacgccgucugaaau

SEQ ID NO: 3367914 - RNA, 23 nt, Neisseria meningitidis Z2491
agaaaacgccgucugaaauuuca

SEQ ID NO: 3367915 - RNA, 14 nt, Neisseria meningitidis Z2491
agaaaaucggacgg

SEQ ID NO: 3367916 - RNA, 21 nt, Neisseria meningitidis Z2491
agaaaauuucuugauuuuucu

SEQ ID NO: 3367917 - RNA, 19 nt, Neisseria meningitidis Z2491
agaaaccacccugccguca

SEQ ID NO: 3367918 - RNA, 14 nt, Neisseria meningitidis Z2491
agaaacccaaaauc

SEQ ID NO: 3367919 - RNA, 18 nt, Neisseria meningitidis Z2491
agaaaccgcucugccguc

SEQ ID NO: 3367920 - RNA, 19 nt, Neisseria meningitidis Z2491
agaaaccuaaaaucccguc

SEQ ID NO: 3367921 - RNA, 14 nt, Neisseria meningitidis Z2491
agaaaccuaaaauu

SEQ ID NO: 3367922 - RNA, 19 nt, Neisseria meningitidis Z2491
agaaaccucaaaucccguc

SEQ ID NO: 3367923 - RNA, 18 nt, Neisseria meningitidis Z2491
agaaagaacccaaaccgu

SEQ ID NO: 3367924 - RNA, 17 nt, Neisseria meningitidis Z2491
agaaagcaaaaccgccg

SEQ ID NO: 3367925 - RNA, 15 nt, Neisseria meningitidis Z2491
agaaaucagaaaagu

SEQ ID NO: 3367926 - RNA, 14 nt, Neisseria meningitidis Z2491
agaaaugacugaaa

SEQ ID NO: 3367927 - RNA, 16 nt, Neisseria meningitidis Z2491
agaaaugccgucugaa

SEQ ID NO: 3367928 - RNA, 14 nt, Neisseria meningitidis Z2491
agaaauguaaauuu

SEQ ID NO: 3367929 - RNA, 13 nt, Neisseria meningitidis Z2491
agaacaacaguaa

SEQ ID NO: 3367930 - RNA, 15 nt, Neisseria meningitidis Z2491
agaacaauucucuaa

SEQ ID NO: 3367931 - RNA, 13 nt, Neisseria meningitidis Z2491
agaacagaaaacc

SEQ ID NO: 3367932 - RNA, 14 nt, Neisseria meningitidis Z2491
agaaccgaacacag

SEQ ID NO: 3367933 - RNA, 17 nt, Neisseria meningitidis Z2491
agaaccgaacacagaca

SEQ ID NO: 3367934 - RNA, 18 nt, Neisseria meningitidis Z2491
agaaccggauucccgccu

SEQ ID NO: 3367935 - RNA, 12 nt, Neisseria meningitidis Z2491
agaacgguuucu

SEQ ID NO: 3367936 - RNA, 22 nt, Neisseria meningitidis Z2491
agaagauuuuuguuuaucuuuc

SEQ ID NO: 3367937 - RNA, 13 nt, Neisseria meningitidis Z2491
agaagccaaaaua

SEQ ID NO: 3367938 - RNA, 22 nt, Neisseria meningitidis Z2491
agaaguuacucgaaacuuaaaa

SEQ ID NO: 3367939 - RNA, 16 nt, Neisseria meningitidis Z2491
agaaguuucugcaacc

SEQ ID NO: 3367940 - RNA, 16 nt, Neisseria meningitidis Z2491
agaauaaugaaaaugu

SEQ ID NO: 3367941 - RNA, 23 nt, Neisseria meningitidis Z2491
agaauacugccuguaaaaccaag

SEQ ID NO: 3367942 - RNA, 13 nt, Neisseria meningitidis Z2491
agaaucaaauauu

SEQ ID NO: 3367943 - RNA, 17 nt, Neisseria meningitidis Z2491
agaaucaaauauuaaaa

SEQ ID NO: 3367944 - RNA, 19 nt, Neisseria meningitidis Z2491
agaaucucguuauuuccac

SEQ ID NO: 3367945 - RNA, 16 nt, Neisseria meningitidis Z2491
agaaugaaggaauuug

SEQ ID NO: 3367946 - RNA, 20 nt, Neisseria meningitidis Z2491
agaaugaauagucaggcugc

SEQ ID NO: 3367947 - RNA, 13 nt, Neisseria meningitidis Z2491
agaauuuaucaga

SEQ ID NO: 3367948 - RNA, 15 nt, Neisseria meningitidis Z2491
agaauuuaucagaaa

SEQ ID NO: 3367949 - RNA, 19 nt, Neisseria meningitidis Z2491
agaauuuaucagaaaugac

SEQ ID NO: 3367950 - RNA, 19 nt, Neisseria meningitidis Z2491
agacaaaugccgucugaaa

SEQ ID NO: 3367951 - RNA, 19 nt, Neisseria meningitidis Z2491
agacaaccgacaauacggc

SEQ ID NO: 3367952 - RNA, 23 nt, Neisseria meningitidis Z2491
agacaaucagaucggcaaacccu

SEQ ID NO: 3367953 - RNA, 18 nt, Neisseria meningitidis Z2491
agacagcccucuugccuu

SEQ ID NO: 3367954 - RNA, 12 nt, Neisseria meningitidis Z2491
agacaguacaaa

SEQ ID NO: 3367955 - RNA, 13 nt, Neisseria meningitidis Z2491
agacaguacaaau

SEQ ID NO: 3367956 - RNA, 23 nt, Neisseria meningitidis Z2491
agacaucucgaauuuuuuccaua

SEQ ID NO: 3367957 - RNA, 16 nt, Neisseria meningitidis Z2491
agacauuaaaaaauac

SEQ ID NO: 3367958 - RNA, 14 nt, Neisseria meningitidis Z2491
agacauucaaugcu

SEQ ID NO: 3367959 - RNA, 17 nt, Neisseria meningitidis Z2491
agacauucaaugcuaag

SEQ ID NO: 3367960 - RNA, 22 nt, Neisseria meningitidis Z2491
agacauucaaugcuaaggcaau

SEQ ID NO: 3367961 - RNA, 14 nt, Neisseria meningitidis Z2491
agaccaaacagaac

SEQ ID NO: 3367962 - RNA, 19 nt, Neisseria meningitidis Z2491
agaccauuggacagcggca

SEQ ID NO: 3367963 - RNA, 17 nt, Neisseria meningitidis Z2491
agaccgaauuuaaucaa

SEQ ID NO: 3367964 - RNA, 16 nt, Neisseria meningitidis Z2491
agaccgucuaaacggu

SEQ ID NO: 3367965 - RNA, 13 nt, Neisseria meningitidis Z2491
agaccgucugaac

SEQ ID NO: 3367966 - RNA, 19 nt, Neisseria meningitidis Z2491
agaccuucgggcagcggca

SEQ ID NO: 3367967 - RNA, 21 nt, Neisseria meningitidis Z2491
agaccuucggguaacggcaau

SEQ ID NO: 3367968 - RNA, 19 nt, Neisseria meningitidis Z2491
agacgacagagcgccgucu

SEQ ID NO: 3367969 - RNA, 10 nt, Neisseria meningitidis Z2491
agacggcauc

SEQ ID NO: 3367970 - RNA, 10 nt, Neisseria meningitidis Z2491
agacggcauu

SEQ ID NO: 3367971 - RNA, 23 nt, Neisseria meningitidis Z2491
agacggcauugcggcuccgguuu

SEQ ID NO: 3367972 - RNA, 14 nt, Neisseria meningitidis Z2491
agacggcauuucau

SEQ ID NO: 3367973 - RNA, 14 nt, Neisseria meningitidis Z2491
agacggcauuuccc

SEQ ID NO: 3367974 - RNA, 22 nt, Neisseria meningitidis Z2491
agacggcauuucggcaguuuuc

SEQ ID NO: 3367975 - RNA, 15 nt, Neisseria meningitidis Z2491
agacggcauuugacu

SEQ ID NO: 3367976 - RNA, 15 nt, Neisseria meningitidis Z2491
agacggcauuuucaa

SEQ ID NO: 3367977 - RNA, 18 nt, Neisseria meningitidis Z2491
agacggcauuuuccuugc

SEQ ID NO: 3367978 - RNA, 15 nt, Neisseria meningitidis Z2491
agacggcauuuucua

SEQ ID NO: 3367979 - RNA, 15 nt, Neisseria meningitidis Z2491
agacggcauuuugau

SEQ ID NO: 3367980 - RNA, 20 nt, Neisseria meningitidis Z2491
agacggcauuuugauugccg

SEQ ID NO: 3367981 - RNA, 18 nt, Neisseria meningitidis Z2491
agacggcauuuugucauu

SEQ ID NO: 3367982 - RNA, 22 nt, Neisseria meningitidis Z2491
agacggcauuuuguugccgucg

SEQ ID NO: 3367983 - RNA, 23 nt, Neisseria meningitidis Z2491
agacggcauuuuuacaaggcagc

SEQ ID NO: 3367984 - RNA, 23 nt, Neisseria meningitidis Z2491
agacggcauuuuucauuuuucac

SEQ ID NO: 3367985 - RNA, 15 nt, Neisseria meningitidis Z2491
agacggcauuuuuuc

SEQ ID NO: 3367986 - RNA, 14 nt, Neisseria meningitidis Z2491
agacggccaaacac

SEQ ID NO: 3367987 - RNA, 14 nt, Neisseria meningitidis Z2491
agacggccuuugga

SEQ ID NO: 3367988 - RNA, 12 nt, Neisseria meningitidis Z2491
agacgguacaaa

SEQ ID NO: 3367989 - RNA, 13 nt, Neisseria meningitidis Z2491
agacuccggauuc

SEQ ID NO: 3367990 - RNA, 20 nt, Neisseria meningitidis Z2491
agagaaucguucucuuugag

SEQ ID NO: 3367991 - RNA, 19 nt, Neisseria meningitidis Z2491
agaggcugucuuuggauuu

SEQ ID NO: 3367992 - RNA, 14 nt, Neisseria meningitidis Z2491
agaggcuuucagac

SEQ ID NO: 3367993 - RNA, 16 nt, Neisseria meningitidis Z2491
agagggaaucuagaaa

SEQ ID NO: 3367994 - RNA, 18 nt, Neisseria meningitidis Z2491
agagguucuagauucccg

SEQ ID NO: 3367995 - RNA, 15 nt, Neisseria meningitidis Z2491
agaguugcgggaaug

SEQ ID NO: 3367996 - RNA, 17 nt, Neisseria meningitidis Z2491
agauaaaaauaccgucu

SEQ ID NO: 3367997 - RNA, 12 nt, Neisseria meningitidis Z2491
agauaaaaccaa

SEQ ID NO: 3367998 - RNA, 18 nt, Neisseria meningitidis Z2491
agauaaaaccaaccgggu

SEQ ID NO: 3367999 - RNA, 14 nt, Neisseria meningitidis Z2491
agauaaauuucaga

SEQ ID NO: 3368000 - RNA, 15 nt, Neisseria meningitidis Z2491
agauaaauuucagau

SEQ ID NO: 3368001 - RNA, 15 nt, Neisseria meningitidis Z2491
agauaaguguuggac

SEQ ID NO: 3368002 - RNA, 17 nt, Neisseria meningitidis Z2491
agauacaagaacuuuau

SEQ ID NO: 3368003 - RNA, 17 nt, Neisseria meningitidis Z2491
agauagucgccgagcag

SEQ ID NO: 3368004 - RNA, 14 nt, Neisseria meningitidis Z2491
agauauaacuuuaa

SEQ ID NO: 3368005 - RNA, 15 nt, Neisseria meningitidis Z2491
agauauagauuuccc

SEQ ID NO: 3368006 - RNA, 23 nt, Neisseria meningitidis Z2491
agauauaguggauuaacaaaaac

SEQ ID NO: 3368007 - RNA, 14 nt, Neisseria meningitidis Z2491
agauauuguucaga

SEQ ID NO: 3368008 - RNA, 15 nt, Neisseria meningitidis Z2491
agaugccgucugaaa

SEQ ID NO: 3368009 - RNA, 19 nt, Neisseria meningitidis Z2491
agaugccgucugaaacggc

SEQ ID NO: 3368010 - RNA, 19 nt, Neisseria meningitidis Z2491
agaugcguauuaaaccaaa

SEQ ID NO: 3368011 - RNA, 14 nt, Neisseria meningitidis Z2491
agauggggaggcgc

SEQ ID NO: 3368012 - RNA, 20 nt, Neisseria meningitidis Z2491
agauggucaauacacaaggu

SEQ ID NO: 3368013 - RNA, 20 nt, Neisseria meningitidis Z2491
agccucgucauuuccacaaa

SEQ ID NO: 3368014 - RNA, 19 nt, Neisseria meningitidis Z2491
agccugcccaucgccucuu

SEQ ID NO: 3368015 - RNA, 21 nt, Neisseria meningitidis Z2491
agccugcucggccugcccugc

SEQ ID NO: 3368016 - RNA, 20 nt, Neisseria meningitidis Z2491
agccuguuggccgcuuucaa

SEQ ID NO: 3368017 - RNA, 22 nt, Neisseria meningitidis Z2491
agccuguuggccgcuuucaaaa

SEQ ID NO: 3368018 - RNA, 14 nt, Neisseria meningitidis Z2491
agccuucagacggc

SEQ ID NO: 3368019 - RNA, 15 nt, Neisseria meningitidis Z2491
agccuucagacggca

SEQ ID NO: 3368020 - RNA, 17 nt, Neisseria meningitidis Z2491
agccuucauccgcaacg

SEQ ID NO: 3368021 - RNA, 22 nt, Neisseria meningitidis Z2491
agccuucuucuaaaaauacaua

SEQ ID NO: 3368022 - RNA, 23 nt, Neisseria meningitidis Z2491
agcgaugucguugucaaccaaaa

SEQ ID NO: 3368023 - RNA, 17 nt, Neisseria meningitidis Z2491
agcgcaaccuugccaag

SEQ ID NO: 3368024 - RNA, 23 nt, Neisseria meningitidis Z2491
agcgcaaccuugccaagguugag

SEQ ID NO: 3368025 - RNA, 12 nt, Neisseria meningitidis Z2491
agcggaaaucca

SEQ ID NO: 3368026 - RNA, 21 nt, Neisseria meningitidis Z2491
agcggaauacggcaacaucau

SEQ ID NO: 3368027 - RNA, 17 nt, Neisseria meningitidis Z2491
agcggacgauuucccug

SEQ ID NO: 3368028 - RNA, 13 nt, Neisseria meningitidis Z2491
agcggcagagcaa

SEQ ID NO: 3368029 - RNA, 17 nt, Neisseria meningitidis Z2491
agcggcagagcaaguca

SEQ ID NO: 3368030 - RNA, 19 nt, Neisseria meningitidis Z2491
agcggcguuugaacagccu

SEQ ID NO: 3368031 - RNA, 20 nt, Neisseria meningitidis Z2491
agcggcugggcaugcagcau

SEQ ID NO: 3368032 - RNA, 18 nt, Neisseria meningitidis Z2491
agcgggaaucuagaaucu

SEQ ID NO: 3368033 - RNA, 23 nt, Neisseria meningitidis Z2491
agcguauuucuagggaaaugccc

SEQ ID NO: 3368034 - RNA, 14 nt, Neisseria meningitidis Z2491
agcguggauuuuuu

SEQ ID NO: 3368035 - RNA, 23 nt, Neisseria meningitidis Z2491
agcguguuccgcaucgucgggaa

SEQ ID NO: 3368036 - RNA, 22 nt, Neisseria meningitidis Z2491
agcguucagacggcauuuuuga

SEQ ID NO: 3368037 - RNA, 15 nt, Neisseria meningitidis Z2491
agcguucugccgacu

SEQ ID NO: 3368038 - RNA, 21 nt, Neisseria meningitidis Z2491
agcguucugccgacugccaag

SEQ ID NO: 3368039 - RNA, 20 nt, Neisseria meningitidis Z2491
agcuaaaaucccguuauuuu

SEQ ID NO: 3368040 - RNA, 22 nt, Neisseria meningitidis Z2491
agcuaaggcgaggcaacgcugu

SEQ ID NO: 3368041 - RNA, 23 nt, Neisseria meningitidis Z2491
agcuauccgcacagaaaccugca

SEQ ID NO: 3368042 - RNA, 19 nt, Neisseria meningitidis Z2491
agcucagacggcauuuguc

SEQ ID NO: 3368043 - RNA, 17 nt, Neisseria meningitidis Z2491
agcucaguugguagagc

SEQ ID NO: 3368044 - RNA, 13 nt, Neisseria meningitidis Z2491
agcucccaauccc

SEQ ID NO: 3368045 - RNA, 15 nt, Neisseria meningitidis Z2491
agcuccgaaccgaaa

SEQ ID NO: 3368046 - RNA, 15 nt, Neisseria meningitidis Z2491
agcuccggccaaaaa

SEQ ID NO: 3368047 - RNA, 16 nt, Neisseria meningitidis Z2491
agcuccggccaaaaaa

SEQ ID NO: 3368048 - RNA, 19 nt, Neisseria meningitidis Z2491
agcuccggccaaaaaaacg

SEQ ID NO: 3368049 - RNA, 20 nt, Neisseria meningitidis Z2491
agcuccggccaaaaaaacgu

SEQ ID NO: 3368050 - RNA, 19 nt, Neisseria meningitidis Z2491
agcucuguucgaccacaua

SEQ ID NO: 3368051 - RNA, 22 nt, Neisseria meningitidis Z2491
agcugcaagaauuuaucaaaaa

SEQ ID NO: 3368052 - RNA, 14 nt, Neisseria meningitidis Z2491
agcuggauuuucgc

SEQ ID NO: 3368053 - RNA, 19 nt, Neisseria meningitidis Z2491
agcugguagggauacaaau

SEQ ID NO: 3368054 - RNA, 24 nt, Neisseria meningitidis Z2491
agcuucauaccccacugccagccg

SEQ ID NO: 3368055 - RNA, 23 nt, Neisseria meningitidis Z2491
agcuucgcgacgguauugauguc

SEQ ID NO: 3368056 - RNA, 13 nt, Neisseria meningitidis Z2491
agcuucgucauuc

SEQ ID NO: 3368057 - RNA, 22 nt, Neisseria meningitidis Z2491
agcuugguaaugucggcauuuu

SEQ ID NO: 3368058 - RNA, 22 nt, Neisseria meningitidis Z2491
agcuuuagagauucuggauucc

SEQ ID NO: 3368059 - RNA, 20 nt, Neisseria meningitidis Z2491
agcuuuugcgccacggcaua

SEQ ID NO: 3368060 - RNA, 14 nt, Neisseria meningitidis Z2491
aggaaaugccgucu

SEQ ID NO: 3368061 - RNA, 21 nt, Neisseria meningitidis Z2491
aggaaauuuccaaauauaaaa

SEQ ID NO: 3368062 - RNA, 23 nt, Neisseria meningitidis Z2491
aggaaauuuccaaauauaaaaaa

SEQ ID NO: 3368063 - RNA, 20 nt, Neisseria meningitidis Z2491
aggaaucggguuucagacgg

SEQ ID NO: 3368064 - RNA, 17 nt, Neisseria meningitidis Z2491
aggaaugcccgaaccgu

SEQ ID NO: 3368065 - RNA, 14 nt, Neisseria meningitidis Z2491
aggacaaaaauccu

SEQ ID NO: 3368066 - RNA, 11 nt, Neisseria meningitidis Z2491
aggacaaagcg

SEQ ID NO: 3368067 - RNA, 20 nt, Neisseria meningitidis Z2491
aggacaaaguuggcaaggaa

SEQ ID NO: 3368068 - RNA, 18 nt, Neisseria meningitidis Z2491
aggacaaggcgacgaagc

SEQ ID NO: 3368069 - RNA, 15 nt, Neisseria meningitidis Z2491
aggacgggcagggca

SEQ ID NO: 3368070 - RNA, 14 nt, Neisseria meningitidis Z2491
aggagcaacagaaa

SEQ ID NO: 3368071 - RNA, 16 nt, Neisseria meningitidis Z2491
aggagcaauuaaauuu

SEQ ID NO: 3368072 - RNA, 15 nt, Neisseria meningitidis Z2491
aggagguauuugggg

SEQ ID NO: 3368073 - RNA, 23 nt, Neisseria meningitidis Z2491
aggagugaauguucgccaacaau

SEQ ID NO: 3368074 - RNA, 20 nt, Neisseria meningitidis Z2491
aggaguuugaugccgucuga

SEQ ID NO: 3368075 - RNA, 16 nt, Neisseria meningitidis Z2491
aggauaugaucgacgg

SEQ ID NO: 3368076 - RNA, 19 nt, Neisseria meningitidis Z2491
aggaugccguuucagacgg

SEQ ID NO: 3368077 - RNA, 23 nt, Neisseria meningitidis Z2491
aggaugccguuucagacggcauc

SEQ ID NO: 3368078 - RNA, 17 nt, Neisseria meningitidis Z2491
aggaugggguuucagau

SEQ ID NO: 3368079 - RNA, 14 nt, Neisseria meningitidis Z2491
aggaugucugccug

SEQ ID NO: 3368080 - RNA, 23 nt, Neisseria meningitidis Z2491
aggcaacaccguacugguuuaaa

SEQ ID NO: 3368081 - RNA, 20 nt, Neisseria meningitidis Z2491
aggcaacccgcuuuaugguu

SEQ ID NO: 3368082 - RNA, 19 nt, Neisseria meningitidis Z2491
aggcaacgccguacugguu

SEQ ID NO: 3368083 - RNA, 23 nt, Neisseria meningitidis Z2491
aggcaacgccguacugguuuuug

SEQ ID NO: 3368084 - RNA, 14 nt, Neisseria meningitidis Z2491
aggcaagcagcucg

SEQ ID NO: 3368085 - RNA, 17 nt, Neisseria meningitidis Z2491
aggcaagcagcucggca

SEQ ID NO: 3368086 - RNA, 21 nt, Neisseria meningitidis Z2491
aggcaagcagcucggcaauuu

SEQ ID NO: 3368087 - RNA, 21 nt, Neisseria meningitidis Z2491
aggcaagcguucacgccagca

SEQ ID NO: 3368088 - RNA, 14 nt, Neisseria meningitidis Z2491
aggcaaggcaacau

SEQ ID NO: 3368089 - RNA, 18 nt, Neisseria meningitidis Z2491
aggcaauaauaaacgcca

SEQ ID NO: 3368090 - RNA, 18 nt, Neisseria meningitidis Z2491
aggcaauccacgcaauca

SEQ ID NO: 3368091 - RNA, 17 nt, Neisseria meningitidis Z2491
aggcacgaagcccucag

SEQ ID NO: 3368092 - RNA, 22 nt, Neisseria meningitidis Z2491
aggcacgaagcccucagcuaug

SEQ ID NO: 3368093 - RNA, 16 nt, Neisseria meningitidis Z2491
aggcacgguaaaccgc

SEQ ID NO: 3368094 - RNA, 13 nt, Neisseria meningitidis Z2491
aggcagaaaucca

SEQ ID NO: 3368095 - RNA, 20 nt, Neisseria meningitidis Z2491
aggcagcaacgacagcagca

SEQ ID NO: 3368096 - RNA, 23 nt, Neisseria meningitidis Z2491
aggcagcaacgacagcagcagcc

SEQ ID NO: 3368097 - RNA, 23 nt, Neisseria meningitidis Z2491
aggcaggguaaugacccacgcca

SEQ ID NO: 3368098 - RNA, 20 nt, Neisseria meningitidis Z2491
aggcauacggggaggaaagu

SEQ ID NO: 3368099 - RNA, 21 nt, Neisseria meningitidis Z2491
aggcauugaaauuccagauuc

SEQ ID NO: 3368100 - RNA, 23 nt, Neisseria meningitidis Z2491
aggcauuuaucggauaaaacaga

SEQ ID NO: 3368101 - RNA, 12 nt, Neisseria meningitidis Z2491
aggccaguuugu

SEQ ID NO: 3368102 - RNA, 12 nt, Neisseria meningitidis Z2491
aggcgacgguuu

SEQ ID NO: 3368103 - RNA, 14 nt, Neisseria meningitidis Z2491
aggcgagccaacgc

SEQ ID NO: 3368104 - RNA, 14 nt, Neisseria meningitidis Z2491
aggcgagcuucgcc

SEQ ID NO: 3368105 - RNA, 17 nt, Neisseria meningitidis Z2491
aggcgaggcaacaccgu

SEQ ID NO: 3368106 - RNA, 20 nt, Neisseria meningitidis Z2491
aggcggaaucgaaccgccga

SEQ ID NO: 3368107 - RNA, 23 nt, Neisseria meningitidis Z2491
aggcggauuugaaguuucuccac

SEQ ID NO: 3368108 - RNA, 21 nt, Neisseria meningitidis Z2491
aggcggcgagccgcagacggu

SEQ ID NO: 3368109 - RNA, 16 nt, Neisseria meningitidis Z2491
aggcggcguucuucuu

SEQ ID NO: 3368110 - RNA, 15 nt, Neisseria meningitidis Z2491
aggcgggaauccaga

SEQ ID NO: 3368111 - RNA, 15 nt, Neisseria meningitidis Z2491
aggcgggaauccagg

SEQ ID NO: 3368112 - RNA, 20 nt, Neisseria meningitidis Z2491
aggcgggaaucuagaccuua

SEQ ID NO: 3368113 - RNA, 18 nt, Neisseria meningitidis Z2491
aguggcgggguuucaacc

SEQ ID NO: 3368114 - RNA, 14 nt, Neisseria meningitidis Z2491
agugggaauccaga

SEQ ID NO: 3368115 - RNA, 22 nt, Neisseria meningitidis Z2491
aguguaucggugucaaaacaag

SEQ ID NO: 3368116 - RNA, 14 nt, Neisseria meningitidis Z2491
aguguuucagacgg

SEQ ID NO: 3368117 - RNA, 15 nt, Neisseria meningitidis Z2491
aguguuucagacggc

SEQ ID NO: 3368118 - RNA, 16 nt, Neisseria meningitidis Z2491
aguguuucagacggcc

SEQ ID NO: 3368119 - RNA, 19 nt, Neisseria meningitidis Z2491
aguuacucgaaacuuaaaa

SEQ ID NO: 3368120 - RNA, 15 nt, Neisseria meningitidis Z2491
aguuaggguaauuua

SEQ ID NO: 3368121 - RNA, 23 nt, Neisseria meningitidis Z2491
aguuauuaagugaguaaaaacaa

SEQ ID NO: 3368122 - RNA, 19 nt, Neisseria meningitidis Z2491
aguuauucggaucaacguu

SEQ ID NO: 3368123 - RNA, 19 nt, Neisseria meningitidis Z2491
aguucauucgacagcagcc

SEQ ID NO: 3368124 - RNA, 16 nt, Neisseria meningitidis Z2491
aguuccgcaaacgccu

SEQ ID NO: 3368125 - RNA, 18 nt, Neisseria meningitidis Z2491
aguuccuccacuaaaaaa

SEQ ID NO: 3368126 - RNA, 22 nt, Neisseria meningitidis Z2491
aguucgggaucggagagacugu

SEQ ID NO: 3368127 - RNA, 15 nt, Neisseria meningitidis Z2491
aguucgguuucaacg

SEQ ID NO: 3368128 - RNA, 22 nt, Neisseria meningitidis Z2491
aguucgucgaaacggcaaaaca

SEQ ID NO: 3368129 - RNA, 20 nt, Neisseria meningitidis Z2491
aguucuacacccaaauccgc

SEQ ID NO: 3368130 - RNA, 14 nt, Neisseria meningitidis Z2491
aguugauuaaaaca

SEQ ID NO: 3368131 - RNA, 16 nt, Neisseria meningitidis Z2491
aguugauuaaaacaaa

SEQ ID NO: 3368132 - RNA, 19 nt, Neisseria meningitidis Z2491
aguugccgucaaagaacac

SEQ ID NO: 3368133 - RNA, 16 nt, Neisseria meningitidis Z2491
aguuggcaaggaaugc

SEQ ID NO: 3368134 - RNA, 16 nt, Neisseria meningitidis Z2491
aguugguuuugacaua

SEQ ID NO: 3368135 - RNA, 15 nt, Neisseria meningitidis Z2491
aguuucagacggcau

SEQ ID NO: 3368136 - RNA, 14 nt, Neisseria meningitidis Z2491
aguuucagucauuc

SEQ ID NO: 3368137 - RNA, 14 nt, Neisseria meningitidis Z2491
aguuucagucauuu

SEQ ID NO: 3368138 - RNA, 17 nt, Neisseria meningitidis Z2491
aguuuccaauacaacaa

SEQ ID NO: 3368139 - RNA, 19 nt, Neisseria meningitidis Z2491
aguuuccaauacaacaaaa

SEQ ID NO: 3368140 - RNA, 17 nt, Neisseria meningitidis Z2491
aguuucggucauuuccg

SEQ ID NO: 3368141 - RNA, 18 nt, Neisseria meningitidis Z2491
aguuucggucauuuccga

SEQ ID NO: 3368142 - RNA, 14 nt, Neisseria meningitidis Z2491
aguuugaaaucaac

SEQ ID NO: 3368143 - RNA, 16 nt, Neisseria meningitidis Z2491
aguuugaugccgucug

SEQ ID NO: 3368144 - RNA, 15 nt, Neisseria meningitidis Z2491
aguuugaugccgugu

SEQ ID NO: 3368145 - RNA, 21 nt, Neisseria meningitidis Z2491
aguuugccgacccgaaucaca

SEQ ID NO: 3368146 - RNA, 20 nt, Neisseria meningitidis Z2491
aguuuguuguucaaauaaau

SEQ ID NO: 3368147 - RNA, 13 nt, Neisseria meningitidis Z2491
aguuuuccuuugg

SEQ ID NO: 3368148 - RNA, 20 nt, Neisseria meningitidis Z2491
aguuuuuccaguuugaaauc

SEQ ID NO: 3368149 - RNA, 22 nt, Neisseria meningitidis Z2491
aguuuuucgguuuugaugguuu

SEQ ID NO: 3368150 - RNA, 15 nt, Neisseria meningitidis Z2491
aguuuuugucuuggu

SEQ ID NO: 3368151 - RNA, 22 nt, Neisseria meningitidis Z2491
aguuuuuuauccggcuuuccau

SEQ ID NO: 3368152 - RNA, 13 nt, Neisseria meningitidis Z2491
aguuuuuugacuu

SEQ ID NO: 3368153 - RNA, 15 nt, Neisseria meningitidis Z2491
aguuuuuugccuucg

SEQ ID NO: 3368154 - RNA, 20 nt, Neisseria meningitidis Z2491
aguuuuuuguguuccgaacg

SEQ ID NO: 3368155 - RNA, 16 nt, Neisseria meningitidis Z2491
aguuuuuuuugcaaag

SEQ ID NO: 3368156 - RNA, 15 nt, Neisseria meningitidis Z2491
auaaaaaacgccguc

SEQ ID NO: 3368157 - RNA, 18 nt, Neisseria meningitidis Z2491
auaaaaaacgccguccga

SEQ ID NO: 3368158 - RNA, 12 nt, Neisseria meningitidis Z2491
auaaaacagaaa

SEQ ID NO: 3368159 - RNA, 15 nt, Neisseria meningitidis Z2491
auaaaagacauugcc

SEQ ID NO: 3368160 - RNA, 22 nt, Neisseria meningitidis Z2491
auaaaagacauugccaaauaga

SEQ ID NO: 3368161 - RNA, 17 nt, Neisseria meningitidis Z2491
auaaaaggucuuuucua

SEQ ID NO: 3368162 - RNA, 16 nt, Neisseria meningitidis Z2491
auaaaauaugccgucu

SEQ ID NO: 3368163 - RNA, 23 nt, Neisseria meningitidis Z2491
auaaaauccgguucauuucaggc

SEQ ID NO: 3368164 - RNA, 14 nt, Neisseria meningitidis Z2491
auaaaaugccgucu

SEQ ID NO: 3368165 - RNA, 14 nt, Neisseria meningitidis Z2491
auaaaauuggaaau

SEQ ID NO: 3368166 - RNA, 15 nt, Neisseria meningitidis Z2491
auaaaauuuggcugu

SEQ ID NO: 3368167 - RNA, 14 nt, Neisseria meningitidis Z2491
auaaacaaaauaaa

SEQ ID NO: 3368168 - RNA, 20 nt, Neisseria meningitidis Z2491
auaaacagcacgauacacaa

SEQ ID NO: 3368169 - RNA, 21 nt, Neisseria meningitidis Z2491
auaaacccccgucauucccgc

SEQ ID NO: 3368170 - RNA, 21 nt, Neisseria meningitidis Z2491
auaaacgccgcagcaaaauau

SEQ ID NO: 3368171 - RNA, 23 nt, Neisseria meningitidis Z2491
auaaacgccgcagcaaaauaugg

SEQ ID NO: 3368172 - RNA, 20 nt, Neisseria meningitidis Z2491
auaaacucauugagcuauuu

SEQ ID NO: 3368173 - RNA, 18 nt, Neisseria meningitidis Z2491
auaaagauacaagaacuu

SEQ ID NO: 3368174 - RNA, 19 nt, Neisseria meningitidis Z2491
auaaagauacaagaacuuu

SEQ ID NO: 3368175 - RNA, 16 nt, Neisseria meningitidis Z2491
auaaagccuaaauaca

SEQ ID NO: 3368176 - RNA, 17 nt, Neisseria meningitidis Z2491
auaaagccuaaauacaa

SEQ ID NO: 3368177 - RNA, 18 nt, Neisseria meningitidis Z2491
auaaaucaacagcagaau

SEQ ID NO: 3368178 - RNA, 13 nt, Neisseria meningitidis Z2491
auaaaugccgucu

SEQ ID NO: 3368179 - RNA, 21 nt, Neisseria meningitidis Z2491
auaaauuccuaaaacuuaaaa

SEQ ID NO: 3368180 - RNA, 20 nt, Neisseria meningitidis Z2491
auaaauuccugcugcuuuuc

SEQ ID NO: 3368181 - RNA, 20 nt, Neisseria meningitidis Z2491
auaaauuccuguugcuuuuc

SEQ ID NO: 3368182 - RNA, 21 nt, Neisseria meningitidis Z2491
auaaauuccuguuguuuuuug

SEQ ID NO: 3368183 - RNA, 14 nt, Neisseria meningitidis Z2491
auaaauucugaaac

SEQ ID NO: 3368184 - RNA, 18 nt, Neisseria meningitidis Z2491
auaaauucuugcaacuuu

SEQ ID NO: 3368185 - RNA, 23 nt, Neisseria meningitidis Z2491
auaaauuucagauagcugaacug

SEQ ID NO: 3368186 - RNA, 14 nt, Neisseria meningitidis Z2491
auaaauuuuugccg

SEQ ID NO: 3368187 - RNA, 17 nt, Neisseria meningitidis Z2491
auaaauuuuugccgugu

SEQ ID NO: 3368188 - RNA, 12 nt, Neisseria meningitidis Z2491
auaacagcaacc

SEQ ID NO: 3368189 - RNA, 21 nt, Neisseria meningitidis Z2491
auaacauacuuuguuucaaaa

SEQ ID NO: 3368190 - RNA, 19 nt, Neisseria meningitidis Z2491
auaaccgccuucuuugccg

SEQ ID NO: 3368191 - RNA, 19 nt, Neisseria meningitidis Z2491
auaacgacuguaaagauaa

SEQ ID NO: 3368192 - RNA, 21 nt, Neisseria meningitidis Z2491
auaacgacuguaaagauaaau

SEQ ID NO: 3368193 - RNA, 22 nt, Neisseria meningitidis Z2491
auaacgccgccguccaucacga

SEQ ID NO: 3368194 - RNA, 16 nt, Neisseria meningitidis Z2491
auaacgggauuucagc

SEQ ID NO: 3368195 - RNA, 23 nt, Neisseria meningitidis Z2491
auaacuagggaaauucaaauuaa

SEQ ID NO: 3368196 - RNA, 16 nt, Neisseria meningitidis Z2491
auaacuuccugauuga

SEQ ID NO: 3368197 - RNA, 22 nt, Neisseria meningitidis Z2491
auaaggcgcguccaacacgcag

SEQ ID NO: 3368198 - RNA, 13 nt, Neisseria meningitidis Z2491
auaagguaaguuu

SEQ ID NO: 3368199 - RNA, 17 nt, Neisseria meningitidis Z2491
auaagguuugagcaguu

SEQ ID NO: 3368200 - RNA, 19 nt, Neisseria meningitidis Z2491
auaagucugcgaaacagac

SEQ ID NO: 3368201 - RNA, 20 nt, Neisseria meningitidis Z2491
auaaguuucccgaaauucca

SEQ ID NO: 3368202 - RNA, 23 nt, Neisseria meningitidis Z2491
auaaguuuccgcaccgacagacc

SEQ ID NO: 3368203 - RNA, 14 nt, Neisseria meningitidis Z2491
auaauaauccuuca

SEQ ID NO: 3368204 - RNA, 21 nt, Neisseria meningitidis Z2491
auaaucaaacucacccugcaa

SEQ ID NO: 3368205 - RNA, 20 nt, Neisseria meningitidis Z2491
auaaucagcccgaaauaacu

SEQ ID NO: 3368206 - RNA, 15 nt, Neisseria meningitidis Z2491
auaaucaguuugcuu

SEQ ID NO: 3368207 - RNA, 13 nt, Neisseria meningitidis Z2491
auaauccaagauu

SEQ ID NO: 3368208 - RNA, 16 nt, Neisseria meningitidis Z2491
auaauccaagauuuca

SEQ ID NO: 3368209 - RNA, 19 nt, Neisseria meningitidis Z2491
auaauccaagauuucauca

SEQ ID NO: 3368210 - RNA, 23 nt, Neisseria meningitidis Z2491
auaaucugcggcaguuuuucuuu

SEQ ID NO: 3368211 - RNA, 17 nt, Neisseria meningitidis Z2491
auaaugaaaugccgucu

SEQ ID NO: 3368212 - RNA, 22 nt, Neisseria meningitidis Z2491
auaaugcgguguaucuuuuugc

SEQ ID NO: 3368213 - RNA, 21 nt, Neisseria meningitidis Z2491
auaauuugucggcuuuugaca

SEQ ID NO: 3368214 - RNA, 22 nt, Neisseria meningitidis Z2491
auaugcuaucuuuauuuaaaua

SEQ ID NO: 3368215 - RNA, 20 nt, Neisseria meningitidis Z2491
auaugcuucaaggcgcggca

SEQ ID NO: 3368216 - RNA, 14 nt, Neisseria meningitidis Z2491
auauggaaaaaucu

SEQ ID NO: 3368217 - RNA, 15 nt, Neisseria meningitidis Z2491
auauggaaaaaucug

SEQ ID NO: 3368218 - RNA, 20 nt, Neisseria meningitidis Z2491
auauggaaaaaucuguggau

SEQ ID NO: 3368219 - RNA, 16 nt, Neisseria meningitidis Z2491
auauggcggauuaaaa

SEQ ID NO: 3368220 - RNA, 19 nt, Neisseria meningitidis Z2491
auauggcguugacaaacau

SEQ ID NO: 3368221 - RNA, 23 nt, Neisseria meningitidis Z2491
auauggcugcuuugguaaaaaaa

SEQ ID NO: 3368222 - RNA, 16 nt, Neisseria meningitidis Z2491
auaugguguugaugcc

SEQ ID NO: 3368223 - RNA, 19 nt, Neisseria meningitidis Z2491
auaugguucagacggcauu

SEQ ID NO: 3368224 - RNA, 11 nt, Neisseria meningitidis Z2491
auauguuuuac

SEQ ID NO: 3368225 - RNA, 17 nt, Neisseria meningitidis Z2491
auauuaagaaaaacagc

SEQ ID NO: 3368226 - RNA, 20 nt, Neisseria meningitidis Z2491
auauuaaugauuaucauaaa

SEQ ID NO: 3368227 - RNA, 15 nt, Neisseria meningitidis Z2491
auauucaaagauuau

SEQ ID NO: 3368228 - RNA, 18 nt, Neisseria meningitidis Z2491
auauucaauugacaaaaa

SEQ ID NO: 3368229 - RNA, 20 nt, Neisseria meningitidis Z2491
auauucaauugacaaaaacu

SEQ ID NO: 3368230 - RNA, 22 nt, Neisseria meningitidis Z2491
auauucacuaaauugcauuuuu

SEQ ID NO: 3368231 - RNA, 13 nt, Neisseria meningitidis Z2491
auauucagguaaa

SEQ ID NO: 3368232 - RNA, 14 nt, Neisseria meningitidis Z2491
auauucagguaaaa

SEQ ID NO: 3368233 - RNA, 18 nt, Neisseria meningitidis Z2491
auauucagguaaaacaaa

SEQ ID NO: 3368234 - RNA, 21 nt, Neisseria meningitidis Z2491
auauuccgccgauguaaaccu

SEQ ID NO: 3368235 - RNA, 17 nt, Neisseria meningitidis Z2491
auauucgaccagcuccc

SEQ ID NO: 3368236 - RNA, 15 nt, Neisseria meningitidis Z2491
auauucugauuuaaa

SEQ ID NO: 3368237 - RNA, 18 nt, Neisseria meningitidis Z2491
auauugauacugccgucg

SEQ ID NO: 3368238 - RNA, 12 nt, Neisseria meningitidis Z2491
auauugcggcuu

SEQ ID NO: 3368239 - RNA, 15 nt, Neisseria meningitidis Z2491
auauuguuauuuuua

SEQ ID NO: 3368240 - RNA, 22 nt, Neisseria meningitidis Z2491
auauuuugacuuuggaacaaaa

SEQ ID NO: 3368241 - RNA, 16 nt, Neisseria meningitidis Z2491
aucaaaaaacaacaau

SEQ ID NO: 3368242 - RNA, 12 nt, Neisseria meningitidis Z2491
aucaaaaaauaa

SEQ ID NO: 3368243 - RNA, 14 nt, Neisseria meningitidis Z2491
aucaaaaaauaaag

SEQ ID NO: 3368244 - RNA, 14 nt, Neisseria meningitidis Z2491
aucaaaaacacaaa

SEQ ID NO: 3368245 - RNA, 13 nt, Neisseria meningitidis Z2491
aucaaaaccagcc

SEQ ID NO: 3368246 - RNA, 17 nt, Neisseria meningitidis Z2491
aucaaaccauauggaaa

SEQ ID NO: 3368247 - RNA, 20 nt, Neisseria meningitidis Z2491
aucaaagucaucaccgcagc

SEQ ID NO: 3368248 - RNA, 12 nt, Neisseria meningitidis Z2491
aucaaauauuaa

SEQ ID NO: 3368249 - RNA, 13 nt, Neisseria meningitidis Z2491
aucaaauauuaaa

SEQ ID NO: 3368250 - RNA, 14 nt, Neisseria meningitidis Z2491
aucaaauauuaaaa

SEQ ID NO: 3368251 - RNA, 17 nt, Neisseria meningitidis Z2491
aucaacagauuacuaaa

SEQ ID NO: 3368252 - RNA, 12 nt, Neisseria meningitidis Z2491
aucaacagcaga

SEQ ID NO: 3368253 - RNA, 14 nt, Neisseria meningitidis Z2491
aucaacgcgggaau

SEQ ID NO: 3368254 - RNA, 19 nt, Neisseria meningitidis Z2491
aucaacgcgggaauagcuc

SEQ ID NO: 3368255 - RNA, 21 nt, Neisseria meningitidis Z2491
aucaacgcgggaauagcucag

SEQ ID NO: 3368256 - RNA, 15 nt, Neisseria meningitidis Z2491
aucaaugugccucuu

SEQ ID NO: 3368257 - RNA, 14 nt, Neisseria meningitidis Z2491
aucaauuaaaaaca

SEQ ID NO: 3368258 - RNA, 15 nt, Neisseria meningitidis Z2491
aucaauuaaaaacaa

SEQ ID NO: 3368259 - RNA, 16 nt, Neisseria meningitidis Z2491
aucaauuaaaaacaaa

SEQ ID NO: 3368260 - RNA, 18 nt, Neisseria meningitidis Z2491
aucacaauauagccgccc

SEQ ID NO: 3368261 - RNA, 20 nt, Neisseria meningitidis Z2491
aucaccgucgccauaaucag

SEQ ID NO: 3368262 - RNA, 19 nt, Neisseria meningitidis Z2491
aucacguccgccauuucca

SEQ ID NO: 3368263 - RNA, 20 nt, Neisseria meningitidis Z2491
aucacguccgccauuuccaa

SEQ ID NO: 3368264 - RNA, 12 nt, Neisseria meningitidis Z2491
aucacguucuga

SEQ ID NO: 3368265 - RNA, 20 nt, Neisseria meningitidis Z2491
aucacuauaccaaacggcau

SEQ ID NO: 3368266 - RNA, 11 nt, Neisseria meningitidis Z2491
aucagaaauga

SEQ ID NO: 3368267 - RNA, 16 nt, Neisseria meningitidis Z2491
aucagaaaugacugaa

SEQ ID NO: 3368268 - RNA, 17 nt, Neisseria meningitidis Z2491
aucagaaaugacugaaa

SEQ ID NO: 3368269 - RNA, 19 nt, Neisseria meningitidis Z2491
aucagaaaugacugaaauu

SEQ ID NO: 3368270 - RNA, 13 nt, Neisseria meningitidis Z2491
aucagaucggcaa

SEQ ID NO: 3368271 - RNA, 17 nt, Neisseria meningitidis Z2491
aucagaucggcaaaccc

SEQ ID NO: 3368272 - RNA, 18 nt, Neisseria meningitidis Z2491
aucagauugauaaaagca

SEQ ID NO: 3368273 - RNA, 20 nt, Neisseria meningitidis Z2491
aucagauugauaaaagcaca

SEQ ID NO: 3368274 - RNA, 13 nt, Neisseria meningitidis Z2491
aucagcacaaaug

SEQ ID NO: 3368275 - RNA, 14 nt, Neisseria meningitidis Z2491
aucagcacaaaugc

SEQ ID NO: 3368276 - RNA, 18 nt, Neisseria meningitidis Z2491
aucagcacaaaugccaaa

SEQ ID NO: 3368277 - RNA, 18 nt, Neisseria meningitidis Z2491
aucagccaaaccgcagca

SEQ ID NO: 3368278 - RNA, 23 nt, Neisseria meningitidis Z2491
aucagcuucauaccccacugcca

SEQ ID NO: 3368279 - RNA, 13 nt, Neisseria meningitidis Z2491
aucaggaaaacag

SEQ ID NO: 3368280 - RNA, 17 nt, Neisseria meningitidis Z2491
aucaggaacaucagcac

SEQ ID NO: 3368281 - RNA, 22 nt, Neisseria meningitidis Z2491
aucaggaacaucagcaccacug

SEQ ID NO: 3368282 - RNA, 14 nt, Neisseria meningitidis Z2491
aucaggacaaggcg

SEQ ID NO: 3368283 - RNA, 17 nt, Neisseria meningitidis Z2491
aucaggacaaggcggcg

SEQ ID NO: 3368284 - RNA, 20 nt, Neisseria meningitidis Z2491
aucaggcguuuccaaaguga

SEQ ID NO: 3368285 - RNA, 13 nt, Neisseria meningitidis Z2491
aucagggccuuga

SEQ ID NO: 3368286 - RNA, 14 nt, Neisseria meningitidis Z2491
aucagguuaucacu

SEQ ID NO: 3368287 - RNA, 14 nt, Neisseria meningitidis Z2491
aucaguuuccaguu

SEQ ID NO: 3368288 - RNA, 21 nt, Neisseria meningitidis Z2491
aucaucggaaacagcauccuu

SEQ ID NO: 3368289 - RNA, 18 nt, Neisseria meningitidis Z2491
aucaucggcguaauaaua

SEQ ID NO: 3368290 - RNA, 14 nt, Neisseria meningitidis Z2491
aucaugcggaagaa

SEQ ID NO: 3368291 - RNA, 23 nt, Neisseria meningitidis Z2491
aucauugcauggacauucucuug

SEQ ID NO: 3368292 - RNA, 21 nt, Neisseria meningitidis Z2491
aucauugcgggaauagcucag

SEQ ID NO: 3368293 - RNA, 13 nt, Neisseria meningitidis Z2491
auccaaaaauacg

SEQ ID NO: 3368294 - RNA, 14 nt, Neisseria meningitidis Z2491
auccaaaaauacgc

SEQ ID NO: 3368295 - RNA, 22 nt, Neisseria meningitidis Z2491
auccaaggcaucauggcacgca

SEQ ID NO: 3368296 - RNA, 19 nt, Neisseria meningitidis Z2491
auccacagagauuguuucc

SEQ ID NO: 3368297 - RNA, 15 nt, Neisseria meningitidis Z2491
auccacaguuuuucc

SEQ ID NO: 3368298 - RNA, 16 nt, Neisseria meningitidis Z2491
auccacaguuuuucca

SEQ ID NO: 3368299 - RNA, 19 nt, Neisseria meningitidis Z2491
auccacgauauuacgaaca

SEQ ID NO: 3368300 - RNA, 14 nt, Neisseria meningitidis Z2491
auccacgcucaaac

SEQ ID NO: 3368301 - RNA, 16 nt, Neisseria meningitidis Z2491
auccacuauaaaaggu

SEQ ID NO: 3368302 - RNA, 19 nt, Neisseria meningitidis Z2491
auccacuauaacagcaacc

SEQ ID NO: 3368303 - RNA, 14 nt, Neisseria meningitidis Z2491
auccacuauaauga

SEQ ID NO: 3368304 - RNA, 13 nt, Neisseria meningitidis Z2491
auccacuauauga

SEQ ID NO: 3368305 - RNA, 16 nt, Neisseria meningitidis Z2491
auccagaaaaucggac

SEQ ID NO: 3368306 - RNA, 13 nt, Neisseria meningitidis Z2491
auccagaaagugg

SEQ ID NO: 3368307 - RNA, 15 nt, Neisseria meningitidis Z2491
auccagacauucaau

SEQ ID NO: 3368308 - RNA, 17 nt, Neisseria meningitidis Z2491
auccagcaaacgguauu

SEQ ID NO: 3368309 - RNA, 21 nt, Neisseria meningitidis Z2491
auccagguucguugaguuucg

SEQ ID NO: 3368310 - RNA, 22 nt, Neisseria meningitidis Z2491
auccagugcguugaguuucagc

SEQ ID NO: 3368311 - RNA, 16 nt, Neisseria meningitidis Z2491
auccauagauaaauuu

SEQ ID NO: 3368312 - RNA, 13 nt, Neisseria meningitidis Z2491
auccauauccaaa

SEQ ID NO: 3368313 - RNA, 13 nt, Neisseria meningitidis Z2491
auccauugccgau

SEQ ID NO: 3368314 - RNA, 19 nt, Neisseria meningitidis Z2491
aucccaaacaucgcucaaa

SEQ ID NO: 3368315 - RNA, 11 nt, Neisseria meningitidis Z2491
aucccaacaag

SEQ ID NO: 3368316 - RNA, 22 nt, Neisseria meningitidis Z2491
aucucguuauuuccacaaaaaa

SEQ ID NO: 3368317 - RNA, 22 nt, Neisseria meningitidis Z2491
aucugacaggaaauuuccaaau

SEQ ID NO: 3368318 - RNA, 21 nt, Neisseria meningitidis Z2491
aucugcagccgucauucccgc

SEQ ID NO: 3368319 - RNA, 22 nt, Neisseria meningitidis Z2491
aucugcaugaaaucgccaaaca

SEQ ID NO: 3368320 - RNA, 20 nt, Neisseria meningitidis Z2491
aucugccgcaauucguuuuc

SEQ ID NO: 3368321 - RNA, 14 nt, Neisseria meningitidis Z2491
aucuggaaaccaaa

SEQ ID NO: 3368322 - RNA, 16 nt, Neisseria meningitidis Z2491
aucuggaaaccaaaaa

SEQ ID NO: 3368323 - RNA, 14 nt, Neisseria meningitidis Z2491
aucuggauucccgc

SEQ ID NO: 3368324 - RNA, 13 nt, Neisseria meningitidis Z2491
aucugugaaaauc

SEQ ID NO: 3368325 - RNA, 15 nt, Neisseria meningitidis Z2491
aucuuauccauccca

SEQ ID NO: 3368326 - RNA, 19 nt, Neisseria meningitidis Z2491
aucuuauccaucccauauu

SEQ ID NO: 3368327 - RNA, 19 nt, Neisseria meningitidis Z2491
aucuuauuuauuuuuucuc

SEQ ID NO: 3368328 - RNA, 12 nt, Neisseria meningitidis Z2491
aucuuauuuuca

SEQ ID NO: 3368329 - RNA, 16 nt, Neisseria meningitidis Z2491
aucuucgaggaacaaa

SEQ ID NO: 3368330 - RNA, 14 nt, Neisseria meningitidis Z2491
aucuugccauucuc

SEQ ID NO: 3368331 - RNA, 19 nt, Neisseria meningitidis Z2491
aucuugugccagcucuuga

SEQ ID NO: 3368332 - RNA, 13 nt, Neisseria meningitidis Z2491
aucuuguuuuuca

SEQ ID NO: 3368333 - RNA, 14 nt, Neisseria meningitidis Z2491
aucuuuagacugcu

SEQ ID NO: 3368334 - RNA, 18 nt, Neisseria meningitidis Z2491
aucuuuauuuaaauaaaa

SEQ ID NO: 3368335 - RNA, 16 nt, Neisseria meningitidis Z2491
aucuuucagacggcau

SEQ ID NO: 3368336 - RNA, 21 nt, Neisseria meningitidis Z2491
aucuuugaauauugccgccgc

SEQ ID NO: 3368337 - RNA, 13 nt, Neisseria meningitidis Z2491
aucuuuuuugaau

SEQ ID NO: 3368338 - RNA, 15 nt, Neisseria meningitidis Z2491
augaaaaaugccguc

SEQ ID NO: 3368339 - RNA, 14 nt, Neisseria meningitidis Z2491
augaaaaugccguc

SEQ ID NO: 3368340 - RNA, 16 nt, Neisseria meningitidis Z2491
augaaaaugugcauuu

SEQ ID NO: 3368341 - RNA, 17 nt, Neisseria meningitidis Z2491
augaacaauccauacau

SEQ ID NO: 3368342 - RNA, 22 nt, Neisseria meningitidis Z2491
augaacgauuugaaccauuucc

SEQ ID NO: 3368343 - RNA, 20 nt, Neisseria meningitidis Z2491
augacaaaauuaaaguuuca

SEQ ID NO: 3368344 - RNA, 18 nt, Neisseria meningitidis Z2491
augacaagacgacaggcg

SEQ ID NO: 3368345 - RNA, 16 nt, Neisseria meningitidis Z2491
augacaagcuacggcu

SEQ ID NO: 3368346 - RNA, 21 nt, Neisseria meningitidis Z2491
augacacaaagccuucuucua

SEQ ID NO: 3368347 - RNA, 17 nt, Neisseria meningitidis Z2491
augacauuaagauguuu

SEQ ID NO: 3368348 - RNA, 23 nt, Neisseria meningitidis Z2491
augacauuaagauguuuuuccac

SEQ ID NO: 3368349 - RNA, 20 nt, Neisseria meningitidis Z2491
augacccacgccaaaccgau

SEQ ID NO: 3368350 - RNA, 22 nt, Neisseria meningitidis Z2491
augacgaaggaaguaacgggcg

SEQ ID NO: 3368351 - RNA, 13 nt, Neisseria meningitidis Z2491
augacgaauuuca

SEQ ID NO: 3368352 - RNA, 15 nt, Neisseria meningitidis Z2491
augacgaauuucagg

SEQ ID NO: 3368353 - RNA, 17 nt, Neisseria meningitidis Z2491
augacgagucagaaguu

SEQ ID NO: 3368354 - RNA, 16 nt, Neisseria meningitidis Z2491
augacgaugaaaagau

SEQ ID NO: 3368355 - RNA, 20 nt, Neisseria meningitidis Z2491
augacggaaacucaaaaaac

SEQ ID NO: 3368356 - RNA, 15 nt, Neisseria meningitidis Z2491
augacugaaacucaa

SEQ ID NO: 3368357 - RNA, 17 nt, Neisseria meningitidis Z2491
augacugaaacucaaaa

SEQ ID NO: 3368358 - RNA, 18 nt, Neisseria meningitidis Z2491
augacugaaacucaaaaa

SEQ ID NO: 3368359 - RNA, 19 nt, Neisseria meningitidis Z2491
augagauugagcauaaaau

SEQ ID NO: 3368360 - RNA, 16 nt, Neisseria meningitidis Z2491
augaucaguaaaaaac

SEQ ID NO: 3368361 - RNA, 20 nt, Neisseria meningitidis Z2491
augaugacggucaggaagau

SEQ ID NO: 3368362 - RNA, 11 nt, Neisseria meningitidis Z2491
augaugcccuc

SEQ ID NO: 3368363 - RNA, 17 nt, Neisseria meningitidis Z2491
augaugggcugaaauag

SEQ ID NO: 3368364 - RNA, 16 nt, Neisseria meningitidis Z2491
augauguguuucaaca

SEQ ID NO: 3368365 - RNA, 17 nt, Neisseria meningitidis Z2491
augauguguuucaacac

SEQ ID NO: 3368366 - RNA, 17 nt, Neisseria meningitidis Z2491
augauucauaaaauauu

SEQ ID NO: 3368367 - RNA, 20 nt, Neisseria meningitidis Z2491
augauucauaaaauauuugc

SEQ ID NO: 3368368 - RNA, 19 nt, Neisseria meningitidis Z2491
augauucgcuuuuguggau

SEQ ID NO: 3368369 - RNA, 18 nt, Neisseria meningitidis Z2491
augauugacuauuuuuua

SEQ ID NO: 3368370 - RNA, 16 nt, Neisseria meningitidis Z2491
augauuuggguuucag

SEQ ID NO: 3368371 - RNA, 20 nt, Neisseria meningitidis Z2491
augauuuggguuucagacgg

SEQ ID NO: 3368372 - RNA, 13 nt, Neisseria meningitidis Z2491
augcaaaaacauc

SEQ ID NO: 3368373 - RNA, 19 nt, Neisseria meningitidis Z2491
augcaccugcauaaucagu

SEQ ID NO: 3368374 - RNA, 21 nt, Neisseria meningitidis Z2491
augcacuacuucauuuuuuca

SEQ ID NO: 3368375 - RNA, 21 nt, Neisseria meningitidis Z2491
augcaguugaguuugaugaaa

SEQ ID NO: 3368376 - RNA, 13 nt, Neisseria meningitidis Z2491
augcaugauuauc

SEQ ID NO: 3368377 - RNA, 17 nt, Neisseria meningitidis Z2491
augccaaaggcagugcc

SEQ ID NO: 3368378 - RNA, 18 nt, Neisseria meningitidis Z2491
augccauacugccugccg

SEQ ID NO: 3368379 - RNA, 14 nt, Neisseria meningitidis Z2491
augcccacaaucug

SEQ ID NO: 3368380 - RNA, 18 nt, Neisseria meningitidis Z2491
augcccauccgccuuccg

SEQ ID NO: 3368381 - RNA, 20 nt, Neisseria meningitidis Z2491
augccccacauaaacagcac

SEQ ID NO: 3368382 - RNA, 16 nt, Neisseria meningitidis Z2491
augcccgcaaucugaa

SEQ ID NO: 3368383 - RNA, 20 nt, Neisseria meningitidis Z2491
augcccgccaguccuaccca

SEQ ID NO: 3368384 - RNA, 22 nt, Neisseria meningitidis Z2491
augcccuuucuuuaugcuuuuu

SEQ ID NO: 3368385 - RNA, 14 nt, Neisseria meningitidis Z2491
augccgagcaaaau

SEQ ID NO: 3368386 - RNA, 16 nt, Neisseria meningitidis Z2491
augccgaggguuuggg

SEQ ID NO: 3368387 - RNA, 16 nt, Neisseria meningitidis Z2491
augccgcaauuucaaa

SEQ ID NO: 3368388 - RNA, 17 nt, Neisseria meningitidis Z2491
augccgccgcaacugcc

SEQ ID NO: 3368389 - RNA, 14 nt, Neisseria meningitidis Z2491
augccgucauuccc

SEQ ID NO: 3368390 - RNA, 22 nt, Neisseria meningitidis Z2491
augccgucauucccgcgaacgc

SEQ ID NO: 3368391 - RNA, 20 nt, Neisseria meningitidis Z2491
augccguccgaacagcucag

SEQ ID NO: 3368392 - RNA, 19 nt, Neisseria meningitidis Z2491
augccguccgaaccgcaaa

SEQ ID NO: 3368393 - RNA, 22 nt, Neisseria meningitidis Z2491
augccguccgaaccgcaaaugc

SEQ ID NO: 3368394 - RNA, 14 nt, Neisseria meningitidis Z2491
augccgucugaaaa

SEQ ID NO: 3368395 - RNA, 22 nt, Neisseria meningitidis Z2491
augccgucugaaaacaguucag

SEQ ID NO: 3368396 - RNA, 17 nt, Neisseria meningitidis Z2491
augccgucugaaaccgu

SEQ ID NO: 3368397 - RNA, 21 nt, Neisseria meningitidis Z2491
augccgucugaaaccuguuuc

SEQ ID NO: 3368398 - RNA, 14 nt, Neisseria meningitidis Z2491
augccgucugaaag

SEQ ID NO: 3368399 - RNA, 18 nt, Neisseria meningitidis Z2491
augccgucugaaaggcuu

SEQ ID NO: 3368400 - RNA, 14 nt, Neisseria meningitidis Z2491
augccgucugaaau

SEQ ID NO: 3368401 - RNA, 20 nt, Neisseria meningitidis Z2491
augccgucugaaauguucgu

SEQ ID NO: 3368402 - RNA, 18 nt, Neisseria meningitidis Z2491
augccgucugaacccgcc

SEQ ID NO: 3368403 - RNA, 20 nt, Neisseria meningitidis Z2491
augccgucugaacgcuucag

SEQ ID NO: 3368404 - RNA, 14 nt, Neisseria meningitidis Z2491
augccgucugaaga

SEQ ID NO: 3368405 - RNA, 20 nt, Neisseria meningitidis Z2491
augccgucugaaggcuucag

SEQ ID NO: 3368406 - RNA, 19 nt, Neisseria meningitidis Z2491
augccgucugauauaguua

SEQ ID NO: 3368407 - RNA, 19 nt, Neisseria meningitidis Z2491
augccguuucagacggcau

SEQ ID NO: 3368408 - RNA, 19 nt, Neisseria meningitidis Z2491
augccuauuuuuuaaucau

SEQ ID NO: 3368409 - RNA, 21 nt, Neisseria meningitidis Z2491
augccugcuucggcggagagg

SEQ ID NO: 3368410 - RNA, 16 nt, Neisseria meningitidis Z2491
augccuuuuucaaacg

SEQ ID NO: 3368411 - RNA, 15 nt, Neisseria meningitidis Z2491
augcgaaaugccguc

SEQ ID NO: 3368412 - RNA, 17 nt, Neisseria meningitidis Z2491
augcggacggcuuggau

SEQ ID NO: 3368413 - RNA, 17 nt, Neisseria meningitidis Z2491
augcggccgcgcccgca

SEQ ID NO: 3368414 - RNA, 22 nt, Neisseria meningitidis Z2491
augcggcgggcuuggaaaucuu

SEQ ID NO: 3368415 - RNA, 18 nt, Neisseria meningitidis Z2491
augcgggaacuugauuca

SEQ ID NO: 3368416 - RNA, 21 nt, Neisseria meningitidis Z2491
augcgggugauggagcugugu

SEQ ID NO: 3368417 - RNA, 21 nt, Neisseria meningitidis Z2491
auuauaccauaaauuuuaaau

SEQ ID NO: 3368418 - RNA, 18 nt, Neisseria meningitidis Z2491
auuauaguggauuaaauu

SEQ ID NO: 3368419 - RNA, 18 nt, Neisseria meningitidis Z2491
auuauauuuguccaugau

SEQ ID NO: 3368420 - RNA, 16 nt, Neisseria meningitidis Z2491
auuaucugaaaguuug

SEQ ID NO: 3368421 - RNA, 16 nt, Neisseria meningitidis Z2491
auuaucugacaggaaa

SEQ ID NO: 3368422 - RNA, 22 nt, Neisseria meningitidis Z2491
auuaucugacaggaaauuucca

SEQ ID NO: 3368423 - RNA, 23 nt, Neisseria meningitidis Z2491
auuaucugacaggaaauuuccaa

SEQ ID NO: 3368424 - RNA, 23 nt, Neisseria meningitidis Z2491
auuaugacaagacgacaggcggc

SEQ ID NO: 3368425 - RNA, 15 nt, Neisseria meningitidis Z2491
auuauugccagcauu

SEQ ID NO: 3368426 - RNA, 22 nt, Neisseria meningitidis Z2491
auuauuuucacaaaaacagaaa

SEQ ID NO: 3368427 - RNA, 17 nt, Neisseria meningitidis Z2491
auuauuuuuuagaggcu

SEQ ID NO: 3368428 - RNA, 17 nt, Neisseria meningitidis Z2491
auucaaaaaccugcuug

SEQ ID NO: 3368429 - RNA, 20 nt, Neisseria meningitidis Z2491
auucaaaaaccugcuuguuu

SEQ ID NO: 3368430 - RNA, 17 nt, Neisseria meningitidis Z2491
auucaaaagccguguga

SEQ ID NO: 3368431 - RNA, 22 nt, Neisseria meningitidis Z2491
auucaaacgguuuuuucugcca

SEQ ID NO: 3368432 - RNA, 20 nt, Neisseria meningitidis Z2491
auucaaauuaaguuagaguu

SEQ ID NO: 3368433 - RNA, 16 nt, Neisseria meningitidis Z2491
auucaagcagcaauac

SEQ ID NO: 3368434 - RNA, 21 nt, Neisseria meningitidis Z2491
auucaaucggugucuuuccgc

SEQ ID NO: 3368435 - RNA, 14 nt, Neisseria meningitidis Z2491
auucaaugcuaagg

SEQ ID NO: 3368436 - RNA, 17 nt, Neisseria meningitidis Z2491
auucaaugcuaaggcaa

SEQ ID NO: 3368437 - RNA, 18 nt, Neisseria meningitidis Z2491
auucaauuaaauaccguc

SEQ ID NO: 3368438 - RNA, 16 nt, Neisseria meningitidis Z2491
auucaauuuaaacacu

SEQ ID NO: 3368439 - RNA, 19 nt, Neisseria meningitidis Z2491
auucaauuuaaacacuucu

SEQ ID NO: 3368440 - RNA, 19 nt, Neisseria meningitidis Z2491
auucacuaaauugcauuuu

SEQ ID NO: 3368441 - RNA, 21 nt, Neisseria meningitidis Z2491
auucacuaaauugcauuuuua

SEQ ID NO: 3368442 - RNA, 18 nt, Neisseria meningitidis Z2491
auucacuauacugcugaa

SEQ ID NO: 3368443 - RNA, 22 nt, Neisseria meningitidis Z2491
auucacuuggugcuugagcacc

SEQ ID NO: 3368444 - RNA, 14 nt, Neisseria meningitidis Z2491
auucagacggcauc

SEQ ID NO: 3368445 - RNA, 18 nt, Neisseria meningitidis Z2491
auucauaaaauauuugca

SEQ ID NO: 3368446 - RNA, 16 nt, Neisseria meningitidis Z2491
auucauacacagccaa

SEQ ID NO: 3368447 - RNA, 23 nt, Neisseria meningitidis Z2491
auucauacacagccaaaaaaaag

SEQ ID NO: 3368448 - RNA, 21 nt, Neisseria meningitidis Z2491
auucauacugugggaaacuuu

SEQ ID NO: 3368449 - RNA, 16 nt, Neisseria meningitidis Z2491
auucauagcaaaauaa

SEQ ID NO: 3368450 - RNA, 14 nt, Neisseria meningitidis Z2491
auucaucacauaaa

SEQ ID NO: 3368451 - RNA, 17 nt, Neisseria meningitidis Z2491
auucaucgcgcugccgu

SEQ ID NO: 3368452 - RNA, 20 nt, Neisseria meningitidis Z2491
auuccaacucgacauuuucc

SEQ ID NO: 3368453 - RNA, 21 nt, Neisseria meningitidis Z2491
auuccaacucgacauuuucca

SEQ ID NO: 3368454 - RNA, 16 nt, Neisseria meningitidis Z2491
auuccacguucuagau

SEQ ID NO: 3368455 - RNA, 15 nt, Neisseria meningitidis Z2491
auuccagauucccgc

SEQ ID NO: 3368456 - RNA, 15 nt, Neisseria meningitidis Z2491
auucccacaaccuuu

SEQ ID NO: 3368457 - RNA, 16 nt, Neisseria meningitidis Z2491
auucccaccguuuccc

SEQ ID NO: 3368458 - RNA, 20 nt, Neisseria meningitidis Z2491
auucccacgaaagugggaau

SEQ ID NO: 3368459 - RNA, 21 nt, Neisseria meningitidis Z2491
auucccacgaaagugggaauc

SEQ ID NO: 3368460 - RNA, 20 nt, Neisseria meningitidis Z2491
auucccacuuuugugggaau

SEQ ID NO: 3368461 - RNA, 20 nt, Neisseria meningitidis Z2491
auuccccggcaucacggcuu

SEQ ID NO: 3368462 - RNA, 16 nt, Neisseria meningitidis Z2491
auuccccucggggucu

SEQ ID NO: 3368463 - RNA, 20 nt, Neisseria meningitidis Z2491
auucccgcaaaagcgggaau

SEQ ID NO: 3368464 - RNA, 20 nt, Neisseria meningitidis Z2491
auucccgcaaaagcgggagu

SEQ ID NO: 3368465 - RNA, 22 nt, Neisseria meningitidis Z2491
auucccgccacacccccgucau

SEQ ID NO: 3368466 - RNA, 12 nt, Neisseria meningitidis Z2491
auucccgccugc

SEQ ID NO: 3368467 - RNA, 20 nt, Neisseria meningitidis Z2491
auucccgccuucgcgggaau

SEQ ID NO: 3368468 - RNA, 14 nt, Neisseria meningitidis Z2491
auucccgcgaaaaa

SEQ ID NO: 3368469 - RNA, 19 nt, Neisseria meningitidis Z2491
auucccgcgaaaaauagaa

SEQ ID NO: 3368470 - RNA, 20 nt, Neisseria meningitidis Z2491
auucccgcgaaagcggaaau

SEQ ID NO: 3368471 - RNA, 20 nt, Neisseria meningitidis Z2491
auucccgcgaacgcgggaau

SEQ ID NO: 3368472 - RNA, 16 nt, Neisseria meningitidis Z2491
auucccgcgagaacag

SEQ ID NO: 3368473 - RNA, 16 nt, Neisseria meningitidis Z2491
auucccgcgcagauga

SEQ ID NO: 3368474 - RNA, 23 nt, Neisseria meningitidis Z2491
auucccgcgcaggcagaaaucca

SEQ ID NO: 3368475 - RNA, 20 nt, Neisseria meningitidis Z2491
auucccgcucaggcgggaau

SEQ ID NO: 3368476 - RNA, 20 nt, Neisseria meningitidis Z2491
auucccgcuuucgcgggaau

SEQ ID NO: 3368477 - RNA, 20 nt, Neisseria meningitidis Z2491
auucccgcuuucgcggggau

SEQ ID NO: 3368478 - RNA, 20 nt, Neisseria meningitidis Z2491
auucccgcuuuugcgggaau

SEQ ID NO: 3368479 - RNA, 20 nt, Neisseria meningitidis Z2491
auucccguccggcaaacauc

SEQ ID NO: 3368480 - RNA, 23 nt, Neisseria meningitidis Z2491
auucccguccggcaaacaucacg

SEQ ID NO: 3368481 - RNA, 20 nt, Neisseria meningitidis Z2491
auucccgugaaaacgggaau

SEQ ID NO: 3368482 - RNA, 16 nt, Neisseria meningitidis Z2491
auucccgugguuuuuc

SEQ ID NO: 3368483 - RNA, 20 nt, Neisseria meningitidis Z2491
auucccguuuucacgggaau

SEQ ID NO: 3368484 - RNA, 20 nt, Neisseria meningitidis Z2491
auucccguuuuuacgggaau

SEQ ID NO: 3368485 - RNA, 15 nt, Neisseria meningitidis Z2491
auucccucaaaaaca

SEQ ID NO: 3368486 - RNA, 19 nt, Neisseria meningitidis Z2491
auucccucaaaaacagaaa

SEQ ID NO: 3368487 - RNA, 20 nt, Neisseria meningitidis Z2491
auucccucgaaagcgggaau

SEQ ID NO: 3368488 - RNA, 14 nt, Neisseria meningitidis Z2491
auucccucucccgu

SEQ ID NO: 3368489 - RNA, 14 nt, Neisseria meningitidis Z2491
auucccuucccucc

SEQ ID NO: 3368490 - RNA, 23 nt, Neisseria meningitidis Z2491
auuccgcacugcggguuuugccg

SEQ ID NO: 3368491 - RNA, 19 nt, Neisseria meningitidis Z2491
auuccgcgcaggcggaaau

SEQ ID NO: 3368492 - RNA, 19 nt, Neisseria meningitidis Z2491
auuccguuaucccauaaaa

SEQ ID NO: 3368493 - RNA, 14 nt, Neisseria meningitidis Z2491
auuccucaaaaaca

SEQ ID NO: 3368494 - RNA, 17 nt, Neisseria meningitidis Z2491
auuccugcgcgaacagc

SEQ ID NO: 3368495 - RNA, 19 nt, Neisseria meningitidis Z2491
auuccuguugcuuuucauu

SEQ ID NO: 3368496 - RNA, 17 nt, Neisseria meningitidis Z2491
auugaaaaauuuuuggc

SEQ ID NO: 3368497 - RNA, 17 nt, Neisseria meningitidis Z2491
auugaaaauuuuuuggc

SEQ ID NO: 3368498 - RNA, 18 nt, Neisseria meningitidis Z2491
auugaagcgucccaaaua

SEQ ID NO: 3368499 - RNA, 21 nt, Neisseria meningitidis Z2491
auugacgcguguucggacuuu

SEQ ID NO: 3368500 - RNA, 20 nt, Neisseria meningitidis Z2491
auugacggacggcggcagau

SEQ ID NO: 3368501 - RNA, 17 nt, Neisseria meningitidis Z2491
auugacguaguuuacug

SEQ ID NO: 3368502 - RNA, 13 nt, Neisseria meningitidis Z2491
auugacuauuuuu

SEQ ID NO: 3368503 - RNA, 13 nt, Neisseria meningitidis Z2491
auugaucaaaacc

SEQ ID NO: 3368504 - RNA, 13 nt, Neisseria meningitidis Z2491
auugauuuuuaug

SEQ ID NO: 3368505 - RNA, 14 nt, Neisseria meningitidis Z2491
auugccaaauagaa

SEQ ID NO: 3368506 - RNA, 17 nt, Neisseria meningitidis Z2491
auugccacgccgaaccc

SEQ ID NO: 3368507 - RNA, 15 nt, Neisseria meningitidis Z2491
auugcccaacagcag

SEQ ID NO: 3368508 - RNA, 15 nt, Neisseria meningitidis Z2491
auugccgcaaucgcc

SEQ ID NO: 3368509 - RNA, 15 nt, Neisseria meningitidis Z2491
auugccguuuuccuu

SEQ ID NO: 3368510 - RNA, 18 nt, Neisseria meningitidis Z2491
auugccucuauuuaaaaa

SEQ ID NO: 3368511 - RNA, 13 nt, Neisseria meningitidis Z2491
auugccuguucuu

SEQ ID NO: 3368512 - RNA, 19 nt, Neisseria meningitidis Z2491
auugcgaacugccugcaac

SEQ ID NO: 3368513 - RNA, 16 nt, Neisseria meningitidis Z2491
auugcgggaauagcuc

SEQ ID NO: 3368514 - RNA, 16 nt, Neisseria meningitidis Z2491
auugcguucagacggc

SEQ ID NO: 3368515 - RNA, 22 nt, Neisseria meningitidis Z2491
auugcugccgugaugccccaau

SEQ ID NO: 3368516 - RNA, 14 nt, Neisseria meningitidis Z2491
auugcuuauuuguu

SEQ ID NO: 3368517 - RNA, 16 nt, Neisseria meningitidis Z2491
auuggauucagacggc

SEQ ID NO: 3368518 - RNA, 20 nt, Neisseria meningitidis Z2491
auuggauuuggcuuaaaaau

SEQ ID NO: 3368519 - RNA, 23 nt, Neisseria meningitidis Z2491
auuggcgguagguuugcaggaau

SEQ ID NO: 3368520 - RNA, 14 nt, Neisseria meningitidis Z2491
auuggggcaaagcg

SEQ ID NO: 3368521 - RNA, 16 nt, Neisseria meningitidis Z2491
auugguaugggauuua

SEQ ID NO: 3368522 - RNA, 14 nt, Neisseria meningitidis Z2491
auuguauauuggca

SEQ ID NO: 3368523 - RNA, 15 nt, Neisseria meningitidis Z2491
auuguccauuuuucu

SEQ ID NO: 3368524 - RNA, 17 nt, Neisseria meningitidis Z2491
auugucccugugcgccg

SEQ ID NO: 3368525 - RNA, 17 nt, Neisseria meningitidis Z2491
auuguuaaguauuucua

SEQ ID NO: 3368526 - RNA, 16 nt, Neisseria meningitidis Z2491
auuguuuagcuuuuuc

SEQ ID NO: 3368527 - RNA, 20 nt, Neisseria meningitidis Z2491
auuguuuguuuuuuucaggc

SEQ ID NO: 3368528 - RNA, 21 nt, Neisseria meningitidis Z2491
auuuaaaaauuccuguuuuua

SEQ ID NO: 3368529 - RNA, 20 nt, Neisseria meningitidis Z2491
auuuaaaagggaacggcauc

SEQ ID NO: 3368530 - RNA, 19 nt, Neisseria meningitidis Z2491
auuuaaacagcaauccauu

SEQ ID NO: 3368531 - RNA, 16 nt, Neisseria meningitidis Z2491
auuuaaaccaguacag

SEQ ID NO: 3368532 - RNA, 16 nt, Neisseria meningitidis Z2491
auuuaaauaaaauuua

SEQ ID NO: 3368533 - RNA, 16 nt, Neisseria meningitidis Z2491
auuuaaaucaguacgg

SEQ ID NO: 3368534 - RNA, 14 nt, Neisseria meningitidis Z2491
auuuaauccacuau

SEQ ID NO: 3368535 - RNA, 20 nt, Neisseria meningitidis Z2491
auuuaauccacuauaaucca

SEQ ID NO: 3368536 - RNA, 20 nt, Neisseria meningitidis Z2491
auuuaauccacuauaucggu

SEQ ID NO: 3368537 - RNA, 17 nt, Neisseria meningitidis Z2491
auuuaccagaaaaaaca

SEQ ID NO: 3368538 - RNA, 16 nt, Neisseria meningitidis Z2491
auuuagaaaaaauaua

SEQ ID NO: 3368539 - RNA, 16 nt, Neisseria meningitidis Z2491
auuuauaaacaaaaaa

SEQ ID NO: 3368540 - RNA, 18 nt, Neisseria meningitidis Z2491
auuuauacccucucaaac

SEQ ID NO: 3368541 - RNA, 11 nt, Neisseria meningitidis Z2491
auuuauagugg

SEQ ID NO: 3368542 - RNA, 19 nt, Neisseria meningitidis Z2491
auuuauaguggauuaacaa

SEQ ID NO: 3368543 - RNA, 21 nt, Neisseria meningitidis Z2491
auuuauaguggauuaacaaaa

SEQ ID NO: 3368544 - RNA, 16 nt, Neisseria meningitidis Z2491
auuuaucagaaaugac

SEQ ID NO: 3368545 - RNA, 17 nt, Neisseria meningitidis Z2491
auuuauccgaaauaaca

SEQ ID NO: 3368546 - RNA, 23 nt, Neisseria meningitidis Z2491
auuuauccgaaaucacagcaacu

SEQ ID NO: 3368547 - RNA, 23 nt, Neisseria meningitidis Z2491
auuuauccgaagcgacaacaauc

SEQ ID NO: 3368548 - RNA, 13 nt, Neisseria meningitidis Z2491
auuuaucggaaaa

SEQ ID NO: 3368549 - RNA, 14 nt, Neisseria meningitidis Z2491
auuuaucggaaaaa

SEQ ID NO: 3368550 - RNA, 17 nt, Neisseria meningitidis Z2491
auuuaucggaaaaaacc

SEQ ID NO: 3368551 - RNA, 15 nt, Neisseria meningitidis Z2491
auuuaucggaaaaac

SEQ ID NO: 3368552 - RNA, 19 nt, Neisseria meningitidis Z2491
auuuaucggaaaugacuga

SEQ ID NO: 3368553 - RNA, 20 nt, Neisseria meningitidis Z2491
auuuaucggauaaaacagaa

SEQ ID NO: 3368554 - RNA, 20 nt, Neisseria meningitidis Z2491
auuuaucgggaaugacugaa

SEQ ID NO: 3368555 - RNA, 18 nt, Neisseria meningitidis Z2491
auuuauucuguuguggaa

SEQ ID NO: 3368556 - RNA, 20 nt, Neisseria meningitidis Z2491
auuuauugggaauaauggaa

SEQ ID NO: 3368557 - RNA, 18 nt, Neisseria meningitidis Z2491
auuuauuuuagaaugaau

SEQ ID NO: 3368558 - RNA, 19 nt, Neisseria meningitidis Z2491
auuuauuuuagaaugaaua

SEQ ID NO: 3368559 - RNA, 21 nt, Neisseria meningitidis Z2491
auuucaacugauuguuuuuca

SEQ ID NO: 3368560 - RNA, 16 nt, Neisseria meningitidis Z2491
auuucaauacgcaaac

SEQ ID NO: 3368561 - RNA, 12 nt, Neisseria meningitidis Z2491
auuucagacggc

SEQ ID NO: 3368562 - RNA, 18 nt, Neisseria meningitidis Z2491
auuucagacggcauuuga

SEQ ID NO: 3368563 - RNA, 13 nt, Neisseria meningitidis Z2491
auuucauuuuuca

SEQ ID NO: 3368564 - RNA, 17 nt, Neisseria meningitidis Z2491
auuucauuuuucauauc

SEQ ID NO: 3368565 - RNA, 16 nt, Neisseria meningitidis Z2491
auuuccaaauauaaaa

SEQ ID NO: 3368566 - RNA, 16 nt, Neisseria meningitidis Z2491
auuuccacaaaaaaca

SEQ ID NO: 3368567 - RNA, 19 nt, Neisseria meningitidis Z2491
auuuccacaaaaaacagaa

SEQ ID NO: 3368568 - RNA, 23 nt, Neisseria meningitidis Z2491
auuuccacaucguucaaaccguc

SEQ ID NO: 3368569 - RNA, 21 nt, Neisseria meningitidis Z2491
auuucguuaacagacuauuuu

SEQ ID NO: 3368570 - RNA, 15 nt, Neisseria meningitidis Z2491
auuucuaauuuuuau

SEQ ID NO: 3368571 - RNA, 18 nt, Neisseria meningitidis Z2491
auuucuagggaaaugccc

SEQ ID NO: 3368572 - RNA, 14 nt, Neisseria meningitidis Z2491
auuucuauuuuuua

SEQ ID NO: 3368573 - RNA, 22 nt, Neisseria meningitidis Z2491
auuucuccgccagccuuucaac

SEQ ID NO: 3368574 - RNA, 23 nt, Neisseria meningitidis Z2491
auuucuccgucgggauucagaug

SEQ ID NO: 3368575 - RNA, 22 nt, Neisseria meningitidis Z2491
auuucugauaaacccccgucau

SEQ ID NO: 3368576 - RNA, 19 nt, Neisseria meningitidis Z2491
auuucuggauucccacuuu

SEQ ID NO: 3368577 - RNA, 14 nt, Neisseria meningitidis Z2491
auuucuguuuuucc

SEQ ID NO: 3368578 - RNA, 15 nt, Neisseria meningitidis Z2491
auuucuguuuuuccg

SEQ ID NO: 3368579 - RNA, 13 nt, Neisseria meningitidis Z2491
auuucuuauguuu

SEQ ID NO: 3368580 - RNA, 12 nt, Neisseria meningitidis Z2491
auuucuugauuu

SEQ ID NO: 3368581 - RNA, 16 nt, Neisseria meningitidis Z2491
auuucuugauuuuucu

SEQ ID NO: 3368582 - RNA, 15 nt, Neisseria meningitidis Z2491
auuugaaccauuucc

SEQ ID NO: 3368583 - RNA, 19 nt, Neisseria meningitidis Z2491
auuugaauccgcguguugu

SEQ ID NO: 3368584 - RNA, 16 nt, Neisseria meningitidis Z2491
auuugacgcauaaaaa

SEQ ID NO: 3368585 - RNA, 22 nt, Neisseria meningitidis Z2491
auuugacuugaaggcguguuug

SEQ ID NO: 3368586 - RNA, 15 nt, Neisseria meningitidis Z2491
auuugagccgcacgc

SEQ ID NO: 3368587 - RNA, 20 nt, Neisseria meningitidis Z2491
auuugaguuuugguauuuuu

SEQ ID NO: 3368588 - RNA, 19 nt, Neisseria meningitidis Z2491
auuugaugcguuucgguuu

SEQ ID NO: 3368589 - RNA, 13 nt, Neisseria meningitidis Z2491
auuugcgccgccc

SEQ ID NO: 3368590 - RNA, 21 nt, Neisseria meningitidis Z2491
auuuggguuucagacggcauu

SEQ ID NO: 3368591 - RNA, 23 nt, Neisseria meningitidis Z2491
auuuguccauucggcuuaaaccu

SEQ ID NO: 3368592 - RNA, 21 nt, Neisseria meningitidis Z2491
auuuguccgacacaaugaaag

SEQ ID NO: 3368593 - RNA, 11 nt, Neisseria meningitidis Z2491
auuugucggca

SEQ ID NO: 3368594 - RNA, 12 nt, Neisseria meningitidis Z2491
auuugucggcaa

SEQ ID NO: 3368595 - RNA, 19 nt, Neisseria meningitidis Z2491
auuuguuccaauuccugua

SEQ ID NO: 3368596 - RNA, 16 nt, Neisseria meningitidis Z2491
auuuguucgauauuuu

SEQ ID NO: 3368597 - RNA, 19 nt, Neisseria meningitidis Z2491
auuuguucgauauuuuuga

SEQ ID NO: 3368598 - RNA, 13 nt, Neisseria meningitidis Z2491
auuuuaaauaaau

SEQ ID NO: 3368599 - RNA, 20 nt, Neisseria meningitidis Z2491
auuuuaagcuguugagacgg

SEQ ID NO: 3368600 - RNA, 18 nt, Neisseria meningitidis Z2491
auuuuagauggcgggaau

SEQ ID NO: 3368601 - RNA, 15 nt, Neisseria meningitidis Z2491
auuuuagguuuuugu

SEQ ID NO: 3368602 - RNA, 22 nt, Neisseria meningitidis Z2491
auuuuauaguggauuaaauuua

SEQ ID NO: 3368603 - RNA, 14 nt, Neisseria meningitidis Z2491
auuuuauaugggau

SEQ ID NO: 3368604 - RNA, 14 nt, Neisseria meningitidis Z2491
auuuuaugcucaau

SEQ ID NO: 3368605 - RNA, 16 nt, Neisseria meningitidis Z2491
auuuuauguuucaaac

SEQ ID NO: 3368606 - RNA, 15 nt, Neisseria meningitidis Z2491
auuuuauugauucaa

SEQ ID NO: 3368607 - RNA, 16 nt, Neisseria meningitidis Z2491
auuuucaaacauuacu

SEQ ID NO: 3368608 - RNA, 17 nt, Neisseria meningitidis Z2491
auuuucacaaaaacaga

SEQ ID NO: 3368609 - RNA, 23 nt, Neisseria meningitidis Z2491
auuuuccgcgccgauguuuuccu

SEQ ID NO: 3368610 - RNA, 18 nt, Neisseria meningitidis Z2491
auuuuccguugccugcga

SEQ ID NO: 3368611 - RNA, 18 nt, Neisseria meningitidis Z2491
auuuucgccccaaauacc

SEQ ID NO: 3368612 - RNA, 19 nt, Neisseria meningitidis Z2491
auuuucgccccaaauaccu

SEQ ID NO: 3368613 - RNA, 21 nt, Neisseria meningitidis Z2491
auuuucggcggcguguuugaa

SEQ ID NO: 3368614 - RNA, 11 nt, Neisseria meningitidis Z2491
auuuucuuccg

SEQ ID NO: 3368615 - RNA, 23 nt, Neisseria meningitidis Z2491
auuuugaaaaugagauugagcau

SEQ ID NO: 3368616 - RNA, 19 nt, Neisseria meningitidis Z2491
auuuugaaacucuaauccc

SEQ ID NO: 3368617 - RNA, 19 nt, Neisseria meningitidis Z2491
auuuugacuuuggaacaaa

SEQ ID NO: 3368618 - RNA, 22 nt, Neisseria meningitidis Z2491
auuuugacuuuggaacaaaaaa

SEQ ID NO: 3368619 - RNA, 10 nt, Neisseria meningitidis Z2491
auuuugauuu

SEQ ID NO: 3368620 - RNA, 20 nt, Neisseria meningitidis Z2491
auuuugcaaaggucucaaau

SEQ ID NO: 3368621 - RNA, 20 nt, Neisseria meningitidis Z2491
auuuugcggcuugccgccgc

SEQ ID NO: 3368622 - RNA, 20 nt, Neisseria meningitidis Z2491
auuuuggagcaguaaaauuu

SEQ ID NO: 3368623 - RNA, 22 nt, Neisseria meningitidis Z2491
auuuuggagcaguaaaauuuau

SEQ ID NO: 3368624 - RNA, 16 nt, Neisseria meningitidis Z2491
auuuugguagcugccg

SEQ ID NO: 3368625 - RNA, 16 nt, Neisseria meningitidis Z2491
auuuugucauucccgc

SEQ ID NO: 3368626 - RNA, 22 nt, Neisseria meningitidis Z2491
auuuuguuuuugagagaaugaa

SEQ ID NO: 3368627 - RNA, 13 nt, Neisseria meningitidis Z2491
auuuuuaaaaccg

SEQ ID NO: 3368628 - RNA, 23 nt, Neisseria meningitidis Z2491
auuuuuaugccacuuggucagaa

SEQ ID NO: 3368629 - RNA, 21 nt, Neisseria meningitidis Z2491
auuuuuaugcgucaaauuucg

SEQ ID NO: 3368630 - RNA, 15 nt, Neisseria meningitidis Z2491
auuuuuauugcuuca

SEQ ID NO: 3368631 - RNA, 19 nt, Neisseria meningitidis Z2491
auuuuucaccgugauuuua

SEQ ID NO: 3368632 - RNA, 15 nt, Neisseria meningitidis Z2491
auuuuucauaucauu

SEQ ID NO: 3368633 - RNA, 15 nt, Neisseria meningitidis Z2491
auuuuuccagcuuga

SEQ ID NO: 3368634 - RNA, 17 nt, Neisseria meningitidis Z2491
auuuuucugaaaaauuu

SEQ ID NO: 3368635 - RNA, 18 nt, Neisseria meningitidis Z2491
auuuuucugaaaaauuua

SEQ ID NO: 3368636 - RNA, 12 nt, Neisseria meningitidis Z2491
auuuuugcaaag

SEQ ID NO: 3368637 - RNA, 15 nt, Neisseria meningitidis Z2491
auuuuugggaaguaa

SEQ ID NO: 3368638 - RNA, 22 nt, Neisseria meningitidis Z2491
auuuuuguuaauccacuauaaa

SEQ ID NO: 3368639 - RNA, 18 nt, Neisseria meningitidis Z2491
auuuuuguuuaucuuuca

SEQ ID NO: 3368640 - RNA, 17 nt, Neisseria meningitidis Z2491
auuuuuucuaaauguuc

SEQ ID NO: 3368641 - RNA, 12 nt, Neisseria meningitidis Z2491
auuuuuucugcc

SEQ ID NO: 3368642 - RNA, 15 nt, Neisseria meningitidis Z2491
auuuuuugaauuuca

SEQ ID NO: 3368643 - RNA, 23 nt, Neisseria meningitidis Z2491
auuuuuugaauuucauuuuucau

SEQ ID NO: 3368644 - RNA, 13 nt, Neisseria meningitidis Z2491
auuuuuuggcuuu

SEQ ID NO: 3368645 - RNA, 22 nt, Neisseria meningitidis Z2491
auuuuuuggcuuugaagccgag

SEQ ID NO: 3368646 - RNA, 16 nt, Neisseria meningitidis Z2491
auuuuuuuauuuaaac

SEQ ID NO: 3368647 - RNA, 21 nt, Neisseria meningitidis Z2491
auuuuuuuauuuaaagcauca

SEQ ID NO: 3368648 - RNA, 13 nt, Neisseria meningitidis Z2491
auuuuuuucauac

SEQ ID NO: 3368649 - RNA, 22 nt, Neisseria meningitidis Z2491
auuuuuuuguugcggaaaucuu

SEQ ID NO: 3368650 - RNA, 14 nt, Neisseria meningitidis Z2491
caaaaaaaccgaaa

SEQ ID NO: 3368651 - RNA, 14 nt, Neisseria meningitidis Z2491
caaaaaacaacaau

SEQ ID NO: 3368652 - RNA, 17 nt, Neisseria meningitidis Z2491
caaaaaacaacaggaau

SEQ ID NO: 3368653 - RNA, 13 nt, Neisseria meningitidis Z2491
caaaaaacacaac

SEQ ID NO: 3368654 - RNA, 14 nt, Neisseria meningitidis Z2491
caaaaaacagcaac

SEQ ID NO: 3368655 - RNA, 18 nt, Neisseria meningitidis Z2491
caaaaaaccggauucccg

SEQ ID NO: 3368656 - RNA, 18 nt, Neisseria meningitidis Z2491
caaaaaaccguauucccg

SEQ ID NO: 3368657 - RNA, 19 nt, Neisseria meningitidis Z2491
caaaaaaccguauucccgc

SEQ ID NO: 3368658 - RNA, 18 nt, Neisseria meningitidis Z2491
caaaaaacuggauuccca

SEQ ID NO: 3368659 - RNA, 18 nt, Neisseria meningitidis Z2491
caaaaaaugccgucugaa

SEQ ID NO: 3368660 - RNA, 13 nt, Neisseria meningitidis Z2491
caaaaacaaaaaa

SEQ ID NO: 3368661 - RNA, 14 nt, Neisseria meningitidis Z2491
caaaaacaaaaaaa

SEQ ID NO: 3368662 - RNA, 13 nt, Neisseria meningitidis Z2491
caaaaacacaaaa

SEQ ID NO: 3368663 - RNA, 15 nt, Neisseria meningitidis Z2491
caaaaacacaaaacu

SEQ ID NO: 3368664 - RNA, 13 nt, Neisseria meningitidis Z2491
caaaaacagaaaa

SEQ ID NO: 3368665 - RNA, 14 nt, Neisseria meningitidis Z2491
caaaaacagaaaac

SEQ ID NO: 3368666 - RNA, 19 nt, Neisseria meningitidis Z2491
caaaaacagaaaaccaaaa

SEQ ID NO: 3368667 - RNA, 21 nt, Neisseria meningitidis Z2491
caaaaacagaaaaccaaaaac

SEQ ID NO: 3368668 - RNA, 15 nt, Neisseria meningitidis Z2491
caaaaacagaaaccu

SEQ ID NO: 3368669 - RNA, 19 nt, Neisseria meningitidis Z2491
caaaaacagaaaccuaaaa

SEQ ID NO: 3368670 - RNA, 21 nt, Neisseria meningitidis Z2491
caaaaacagaaaccuaaaauu

SEQ ID NO: 3368671 - RNA, 20 nt, Neisseria meningitidis Z2491
caaaaacagaaaccugaaaa

SEQ ID NO: 3368672 - RNA, 21 nt, Neisseria meningitidis Z2491
caaaaacagaaaccugaaaac

SEQ ID NO: 3368673 - RNA, 16 nt, Neisseria meningitidis Z2491
caaaaacagaaauccc

SEQ ID NO: 3368674 - RNA, 21 nt, Neisseria meningitidis Z2491
caaaaacagaaauucaaaaac

SEQ ID NO: 3368675 - RNA, 19 nt, Neisseria meningitidis Z2491
caaaaacagaauccauaau

SEQ ID NO: 3368676 - RNA, 18 nt, Neisseria meningitidis Z2491
caaaaacagcaaccugaa

SEQ ID NO: 3368677 - RNA, 19 nt, Neisseria meningitidis Z2491
caaaaacagcaaccugaaa

SEQ ID NO: 3368678 - RNA, 22 nt, Neisseria meningitidis Z2491
caaaaacagcaaccugaaauuc

SEQ ID NO: 3368679 - RNA, 23 nt, Neisseria meningitidis Z2491
caaaaaccggcucaauauauugg

SEQ ID NO: 3368680 - RNA, 18 nt, Neisseria meningitidis Z2491
caaaaacggcacggcgca

SEQ ID NO: 3368681 - RNA, 19 nt, Neisseria meningitidis Z2491
caaaaacggcacggcgcag

SEQ ID NO: 3368682 - RNA, 17 nt, Neisseria meningitidis Z2491
caaaaauaccgucugaa

SEQ ID NO: 3368683 - RNA, 20 nt, Neisseria meningitidis Z2491
caaaaauaccgucugaaacc

SEQ ID NO: 3368684 - RNA, 20 nt, Neisseria meningitidis Z2491
caaaaauacgcguaagcgga

SEQ ID NO: 3368685 - RNA, 21 nt, Neisseria meningitidis Z2491
caaaaauacgcguaagcggag

SEQ ID NO: 3368686 - RNA, 12 nt, Neisseria meningitidis Z2491
caaaaaucagga

SEQ ID NO: 3368687 - RNA, 16 nt, Neisseria meningitidis Z2491
caaaaaugccgucuga

SEQ ID NO: 3368688 - RNA, 17 nt, Neisseria meningitidis Z2491
caaaaaugccgucugaa

SEQ ID NO: 3368689 - RNA, 21 nt, Neisseria meningitidis Z2491
caaaaaugccgucugaagccu

SEQ ID NO: 3368690 - RNA, 18 nt, Neisseria meningitidis Z2491
caaaacagaaaccuaaaa

SEQ ID NO: 3368691 - RNA, 20 nt, Neisseria meningitidis Z2491
caaaacagaaaccuaaaauu

SEQ ID NO: 3368692 - RNA, 22 nt, Neisseria meningitidis Z2491
caaaaccgaugcagaacggcgg

SEQ ID NO: 3368693 - RNA, 20 nt, Neisseria meningitidis Z2491
caaaacggcggcagccugaa

SEQ ID NO: 3368694 - RNA, 21 nt, Neisseria meningitidis Z2491
caaaacggcggcagccugaaa

SEQ ID NO: 3368695 - RNA, 12 nt, Neisseria meningitidis Z2491
caaaacuuuucu

SEQ ID NO: 3368696 - RNA, 15 nt, Neisseria meningitidis Z2491
caaaacuuuucugau

SEQ ID NO: 3368697 - RNA, 22 nt, Neisseria meningitidis Z2491
caaaacuuuucugauuuuuccu

SEQ ID NO: 3368698 - RNA, 23 nt, Neisseria meningitidis Z2491
caaaucggcuuucagacggcauu

SEQ ID NO: 3368699 - RNA, 15 nt, Neisseria meningitidis Z2491
caaaucuggauuccc

SEQ ID NO: 3368700 - RNA, 17 nt, Neisseria meningitidis Z2491
caaaucuggauucccgc

SEQ ID NO: 3368701 - RNA, 16 nt, Neisseria meningitidis Z2491
caaaucuugcaaaccc

SEQ ID NO: 3368702 - RNA, 17 nt, Neisseria meningitidis Z2491
caaaugaugggcugaaa

SEQ ID NO: 3368703 - RNA, 18 nt, Neisseria meningitidis Z2491
caaaugaugggcugaaau

SEQ ID NO: 3368704 - RNA, 20 nt, Neisseria meningitidis Z2491
caaaugcacgguuacacaaa

SEQ ID NO: 3368705 - RNA, 21 nt, Neisseria meningitidis Z2491
caaaugcacgguuacacaaau

SEQ ID NO: 3368706 - RNA, 13 nt, Neisseria meningitidis Z2491
caaaugcagaaua

SEQ ID NO: 3368707 - RNA, 12 nt, Neisseria meningitidis Z2491
caaaugccgcca

SEQ ID NO: 3368708 - RNA, 13 nt, Neisseria meningitidis Z2491
caaaugccgccag

SEQ ID NO: 3368709 - RNA, 13 nt, Neisseria meningitidis Z2491
caaaugccgucug

SEQ ID NO: 3368710 - RNA, 21 nt, Neisseria meningitidis Z2491
caaaugccgucugaaaacagc

SEQ ID NO: 3368711 - RNA, 23 nt, Neisseria meningitidis Z2491
caaaugccgucugaaaacagcaa

SEQ ID NO: 3368712 - RNA, 24 nt, Neisseria meningitidis Z2491
caaaugccgucugaaaacagcaaa

SEQ ID NO: 3368713 - RNA, 23 nt, Neisseria meningitidis Z2491
caaaugccgucugaaaggcuuca

SEQ ID NO: 3368714 - RNA, 16 nt, Neisseria meningitidis Z2491
caaaugccgucugaag

SEQ ID NO: 3368715 - RNA, 20 nt, Neisseria meningitidis Z2491
caaaugcgccuuugccgccu

SEQ ID NO: 3368716 - RNA, 14 nt, Neisseria meningitidis Z2491
caaauuaaaauaaa

SEQ ID NO: 3368717 - RNA, 22 nt, Neisseria meningitidis Z2491
caaauuauaccauaaauuuuaa

SEQ ID NO: 3368718 - RNA, 23 nt, Neisseria meningitidis Z2491
caaauuccaacucgacauuuucc

SEQ ID NO: 3368719 - RNA, 23 nt, Neisseria meningitidis Z2491
caaauuccagcaaugcgucuucc

SEQ ID NO: 3368720 - RNA, 16 nt, Neisseria meningitidis Z2491
caaauuccgucagcac

SEQ ID NO: 3368721 - RNA, 13 nt, Neisseria meningitidis Z2491
caaauuccuaaaa

SEQ ID NO: 3368722 - RNA, 15 nt, Neisseria meningitidis Z2491
caaauuccuaaaacu

SEQ ID NO: 3368723 - RNA, 19 nt, Neisseria meningitidis Z2491
caaauugaaaugccgucug

SEQ ID NO: 3368724 - RNA, 21 nt, Neisseria meningitidis Z2491
caaauugaaaugccgucugaa

SEQ ID NO: 3368725 - RNA, 22 nt, Neisseria meningitidis Z2491
caaauugaaaugccgucugaaa

SEQ ID NO: 3368726 - RNA, 16 nt, Neisseria meningitidis Z2491
caaauugauuuuuagc

SEQ ID NO: 3368727 - RNA, 13 nt, Neisseria meningitidis Z2491
caaauuuacagcu

SEQ ID NO: 3368728 - RNA, 11 nt, Neisseria meningitidis Z2491
caaauuucagu

SEQ ID NO: 3368729 - RNA, 14 nt, Neisseria meningitidis Z2491
caaauuuuugauuu

SEQ ID NO: 3368730 - RNA, 17 nt, Neisseria meningitidis Z2491
caaauuuuugauuucua

SEQ ID NO: 3368731 - RNA, 15 nt, Neisseria meningitidis Z2491
caacaaacaggacag

SEQ ID NO: 3368732 - RNA, 14 nt, Neisseria meningitidis Z2491
caacaaauuuuuga

SEQ ID NO: 3368733 - RNA, 22 nt, Neisseria meningitidis Z2491
caacacgcagccgagcagcagu

SEQ ID NO: 3368734 - RNA, 23 nt, Neisseria meningitidis Z2491
caacacgcagccgagcagcaguc

SEQ ID NO: 3368735 - RNA, 20 nt, Neisseria meningitidis Z2491
caacacgcccuuccacgcgc

SEQ ID NO: 3368736 - RNA, 20 nt, Neisseria meningitidis Z2491
caacacgucggcagucugua

SEQ ID NO: 3368737 - RNA, 12 nt, Neisseria meningitidis Z2491
caacagacggcg

SEQ ID NO: 3368738 - RNA, 20 nt, Neisseria meningitidis Z2491
caacagauugucaaaauaca

SEQ ID NO: 3368739 - RNA, 21 nt, Neisseria meningitidis Z2491
caacagauugucaaaauacau

SEQ ID NO: 3368740 - RNA, 21 nt, Neisseria meningitidis Z2491
caacaggguuccgaaaucauc

SEQ ID NO: 3368741 - RNA, 15 nt, Neisseria meningitidis Z2491
caacagguucaaaca

SEQ ID NO: 3368742 - RNA, 17 nt, Neisseria meningitidis Z2491
caacagguucaaacaca

SEQ ID NO: 3368743 - RNA, 20 nt, Neisseria meningitidis Z2491
caacaguaauauucaaaggu

SEQ ID NO: 3368744 - RNA, 17 nt, Neisseria meningitidis Z2491
caacauaaccgaaaccu

SEQ ID NO: 3368745 - RNA, 19 nt, Neisseria meningitidis Z2491
caacaucagcucgggcuga

SEQ ID NO: 3368746 - RNA, 22 nt, Neisseria meningitidis Z2491
caacaugccaccgucauucccg

SEQ ID NO: 3368747 - RNA, 23 nt, Neisseria meningitidis Z2491
caacaugccaccgucauucccgc

SEQ ID NO: 3368748 - RNA, 20 nt, Neisseria meningitidis Z2491
caacauuccgucauucccgu

SEQ ID NO: 3368749 - RNA, 23 nt, Neisseria meningitidis Z2491
caaccaaaaaaucugauaagcaa

SEQ ID NO: 3368750 - RNA, 12 nt, Neisseria meningitidis Z2491
caaccaaaaccg

SEQ ID NO: 3368751 - RNA, 18 nt, Neisseria meningitidis Z2491
caaccaaaaucaucacgc

SEQ ID NO: 3368752 - RNA, 18 nt, Neisseria meningitidis Z2491
caacccguaugccgccug

SEQ ID NO: 3368753 - RNA, 14 nt, Neisseria meningitidis Z2491
caacccuccgccgc

SEQ ID NO: 3368754 - RNA, 19 nt, Neisseria meningitidis Z2491
caaccgacaauacggcggc

SEQ ID NO: 3368755 - RNA, 17 nt, Neisseria meningitidis Z2491
caaccgcccagccgaau

SEQ ID NO: 3368756 - RNA, 16 nt, Neisseria meningitidis Z2491
caaccgcccuauauuu

SEQ ID NO: 3368757 - RNA, 20 nt, Neisseria meningitidis Z2491
caaccggguauucauacaca

SEQ ID NO: 3368758 - RNA, 16 nt, Neisseria meningitidis Z2491
caaccgguccuuccau

SEQ ID NO: 3368759 - RNA, 17 nt, Neisseria meningitidis Z2491
caaccuguuuuucaaag

SEQ ID NO: 3368760 - RNA, 18 nt, Neisseria meningitidis Z2491
caacgaaacacucggccu

SEQ ID NO: 3368761 - RNA, 19 nt, Neisseria meningitidis Z2491
caacgaaccuggauucccg

SEQ ID NO: 3368762 - RNA, 14 nt, Neisseria meningitidis Z2491
caacgacagcagca

SEQ ID NO: 3368763 - RNA, 15 nt, Neisseria meningitidis Z2491
caacgacagcagcag

SEQ ID NO: 3368764 - RNA, 17 nt, Neisseria meningitidis Z2491
caacgcacuggauuccc

SEQ ID NO: 3368765 - RNA, 18 nt, Neisseria meningitidis Z2491
caacgcacuggauucccg

SEQ ID NO: 3368766 - RNA, 18 nt, Neisseria meningitidis Z2491
caacgccggggcaaacau

SEQ ID NO: 3368767 - RNA, 13 nt, Neisseria meningitidis Z2491
caacgccguaccg

SEQ ID NO: 3368768 - RNA, 20 nt, Neisseria meningitidis Z2491
caacgccgugcgguuuuuuu

SEQ ID NO: 3368769 - RNA, 14 nt, Neisseria meningitidis Z2491
caacgcgcaaaccc

SEQ ID NO: 3368770 - RNA, 23 nt, Neisseria meningitidis Z2491
caacgcgcaucgcgcccaaggcu

SEQ ID NO: 3368771 - RNA, 16 nt, Neisseria meningitidis Z2491
caacgcgggaauagcu

SEQ ID NO: 3368772 - RNA, 13 nt, Neisseria meningitidis Z2491
caacgcuguaccg

SEQ ID NO: 3368773 - RNA, 20 nt, Neisseria meningitidis Z2491
caacgggaggaccucaaacg

SEQ ID NO: 3368774 - RNA, 20 nt, Neisseria meningitidis Z2491
caacguucagggauucaacc

SEQ ID NO: 3368775 - RNA, 18 nt, Neisseria meningitidis Z2491
caacguuucuauuuuccc

SEQ ID NO: 3368776 - RNA, 20 nt, Neisseria meningitidis Z2491
caacucuccgucauucccac

SEQ ID NO: 3368777 - RNA, 20 nt, Neisseria meningitidis Z2491
caacucuccgucauucccgc

SEQ ID NO: 3368778 - RNA, 12 nt, Neisseria meningitidis Z2491
caacugaaacca

SEQ ID NO: 3368779 - RNA, 12 nt, Neisseria meningitidis Z2491
caacugaaaccg

SEQ ID NO: 3368780 - RNA, 13 nt, Neisseria meningitidis Z2491
caacugaaaccgc

SEQ ID NO: 3368781 - RNA, 19 nt, Neisseria meningitidis Z2491
caacugaaccgucauuccc

SEQ ID NO: 3368782 - RNA, 23 nt, Neisseria meningitidis Z2491
caacugaccgacccauucugaca

SEQ ID NO: 3368783 - RNA, 23 nt, Neisseria meningitidis Z2491
caacugauuguuuuucagagaaa

SEQ ID NO: 3368784 - RNA, 22 nt, Neisseria meningitidis Z2491
caacuuacgcaacccuaaaaac

SEQ ID NO: 3368785 - RNA, 23 nt, Neisseria meningitidis Z2491
caacuuauugcggcuuuuucugc

SEQ ID NO: 3368786 - RNA, 15 nt, Neisseria meningitidis Z2491
caacuucaauagugg

SEQ ID NO: 3368787 - RNA, 16 nt, Neisseria meningitidis Z2491
caacuuccagcgcgaa

SEQ ID NO: 3368788 - RNA, 14 nt, Neisseria meningitidis Z2491
caacuuccgcccgg

SEQ ID NO: 3368789 - RNA, 17 nt, Neisseria meningitidis Z2491
caacuuugcguuucuag

SEQ ID NO: 3368790 - RNA, 19 nt, Neisseria meningitidis Z2491
caagaacaggcggcggcau

SEQ ID NO: 3368791 - RNA, 19 nt, Neisseria meningitidis Z2491
caagaacuuuauccccagc

SEQ ID NO: 3368792 - RNA, 12 nt, Neisseria meningitidis Z2491
caagaagcggcg

SEQ ID NO: 3368793 - RNA, 15 nt, Neisseria meningitidis Z2491
caagaagcggcggca

SEQ ID NO: 3368794 - RNA, 21 nt, Neisseria meningitidis Z2491
caagaagcggcggcaucccag

SEQ ID NO: 3368795 - RNA, 15 nt, Neisseria meningitidis Z2491
caagaauuuuuauag

SEQ ID NO: 3368796 - RNA, 21 nt, Neisseria meningitidis Z2491
caagacaaucaaagucaucac

SEQ ID NO: 3368797 - RNA, 18 nt, Neisseria meningitidis Z2491
caagacaggcggauggcg

SEQ ID NO: 3368798 - RNA, 19 nt, Neisseria meningitidis Z2491
caagacuuuuucgcgcacc

SEQ ID NO: 3368799 - RNA, 20 nt, Neisseria meningitidis Z2491
cacaaagccuucuucuaaaa

SEQ ID NO: 3368800 - RNA, 17 nt, Neisseria meningitidis Z2491
cacaaaugccaaaggca

SEQ ID NO: 3368801 - RNA, 14 nt, Neisseria meningitidis Z2491
cacaacacgcaaaa

SEQ ID NO: 3368802 - RNA, 19 nt, Neisseria meningitidis Z2491
cacaacuuuucccauuauc

SEQ ID NO: 3368803 - RNA, 22 nt, Neisseria meningitidis Z2491
cacaagcccgcacauuccauca

SEQ ID NO: 3368804 - RNA, 16 nt, Neisseria meningitidis Z2491
cacaaggcggcggcag

SEQ ID NO: 3368805 - RNA, 16 nt, Neisseria meningitidis Z2491
cacaagguuauuuucu

SEQ ID NO: 3368806 - RNA, 19 nt, Neisseria meningitidis Z2491
cacaagguuauuuucuuga

SEQ ID NO: 3368807 - RNA, 21 nt, Neisseria meningitidis Z2491
cacaauucccaccguuuccca

SEQ ID NO: 3368808 - RNA, 18 nt, Neisseria meningitidis Z2491
cacacaccggcaaacacc

SEQ ID NO: 3368809 - RNA, 17 nt, Neisseria meningitidis Z2491
cacacccaugccauacu

SEQ ID NO: 3368810 - RNA, 16 nt, Neisseria meningitidis Z2491
cacacgaacugccucc

SEQ ID NO: 3368811 - RNA, 23 nt, Neisseria meningitidis Z2491
cacacgguuuucacaucuuuaga

SEQ ID NO: 3368812 - RNA, 21 nt, Neisseria meningitidis Z2491
cacacucuucgucauucccgu

SEQ ID NO: 3368813 - RNA, 17 nt, Neisseria meningitidis Z2491
cacagauaccgucugaa

SEQ ID NO: 3368814 - RNA, 16 nt, Neisseria meningitidis Z2491
cacagccaaaaaaaag

SEQ ID NO: 3368815 - RNA, 23 nt, Neisseria meningitidis Z2491
cacagccaaaaaaaagccguccg

SEQ ID NO: 3368816 - RNA, 22 nt, Neisseria meningitidis Z2491
cacagccuauuuuucugaaaaa

SEQ ID NO: 3368817 - RNA, 20 nt, Neisseria meningitidis Z2491
cacaggaaaaaugcuuaauc

SEQ ID NO: 3368818 - RNA, 13 nt, Neisseria meningitidis Z2491
cacauaaacagca

SEQ ID NO: 3368819 - RNA, 14 nt, Neisseria meningitidis Z2491
cacauaauucaaau

SEQ ID NO: 3368820 - RNA, 23 nt, Neisseria meningitidis Z2491
cacaucgucugcaagcagcaggc

SEQ ID NO: 3368821 - RNA, 17 nt, Neisseria meningitidis Z2491
cacaucguucaaaccgu

SEQ ID NO: 3368822 - RNA, 15 nt, Neisseria meningitidis Z2491
caccaauucuucaaa

SEQ ID NO: 3368823 - RNA, 16 nt, Neisseria meningitidis Z2491
caccaauucuucaaau

SEQ ID NO: 3368824 - RNA, 12 nt, Neisseria meningitidis Z2491
caccagcaucug

SEQ ID NO: 3368825 - RNA, 13 nt, Neisseria meningitidis Z2491
caccagcaucuga

SEQ ID NO: 3368826 - RNA, 14 nt, Neisseria meningitidis Z2491
caccagcccgccgc

SEQ ID NO: 3368827 - RNA, 15 nt, Neisseria meningitidis Z2491
caccagcccgccgcg

SEQ ID NO: 3368828 - RNA, 17 nt, Neisseria meningitidis Z2491
caccagcccgccgcgcc

SEQ ID NO: 3368829 - RNA, 18 nt, Neisseria meningitidis Z2491
caccauccucaucaacgc

SEQ ID NO: 3368830 - RNA, 13 nt, Neisseria meningitidis Z2491
cacccucaauucu

SEQ ID NO: 3368831 - RNA, 19 nt, Neisseria meningitidis Z2491
caccgacauuucauugccg

SEQ ID NO: 3368832 - RNA, 18 nt, Neisseria meningitidis Z2491
caccgaucaggcuuucac

SEQ ID NO: 3368833 - RNA, 22 nt, Neisseria meningitidis Z2491
caccgccaucaggaaugcaaac

SEQ ID NO: 3368834 - RNA, 14 nt, Neisseria meningitidis Z2491
caccgccgccguaa

SEQ ID NO: 3368835 - RNA, 19 nt, Neisseria meningitidis Z2491
caccgccgcuccgcaaaca

SEQ ID NO: 3368836 - RNA, 20 nt, Neisseria meningitidis Z2491
caccgccgcuccgcaaacaa

SEQ ID NO: 3368837 - RNA, 22 nt, Neisseria meningitidis Z2491
caccgcuuuguccaaaucggca

SEQ ID NO: 3368838 - RNA, 21 nt, Neisseria meningitidis Z2491
caccguacugguuuaaauuua

SEQ ID NO: 3368839 - RNA, 18 nt, Neisseria meningitidis Z2491
caccguuauggaaauguc

SEQ ID NO: 3368840 - RNA, 13 nt, Neisseria meningitidis Z2491
caccguucagccc

SEQ ID NO: 3368841 - RNA, 16 nt, Neisseria meningitidis Z2491
caccugcauaaucagu

SEQ ID NO: 3368842 - RNA, 13 nt, Neisseria meningitidis Z2491
caccuuagagaau

SEQ ID NO: 3368843 - RNA, 21 nt, Neisseria meningitidis Z2491
caccuuagagaaucguucucu

SEQ ID NO: 3368844 - RNA, 22 nt, Neisseria meningitidis Z2491
caccuuugggcucaaugaaaau

SEQ ID NO: 3368845 - RNA, 21 nt, Neisseria meningitidis Z2491
cacgaaagugggaauccagaa

SEQ ID NO: 3368846 - RNA, 14 nt, Neisseria meningitidis Z2491
cacgaacccacauc

SEQ ID NO: 3368847 - RNA, 13 nt, Neisseria meningitidis Z2491
cacgaacugccuc

SEQ ID NO: 3368848 - RNA, 21 nt, Neisseria meningitidis Z2491
cacgaagcccucagcuaugcc

SEQ ID NO: 3368849 - RNA, 15 nt, Neisseria meningitidis Z2491
cacgaaucuuaucca

SEQ ID NO: 3368850 - RNA, 17 nt, Neisseria meningitidis Z2491
cacgaaucuuauccaca

SEQ ID NO: 3368851 - RNA, 22 nt, Neisseria meningitidis Z2491
cacgauauuacgaacaaugcaa

SEQ ID NO: 3368852 - RNA, 13 nt, Neisseria meningitidis Z2491
cacgcaauaccaa

SEQ ID NO: 3368853 - RNA, 16 nt, Neisseria meningitidis Z2491
cacgccaaaccgaugg

SEQ ID NO: 3368854 - RNA, 14 nt, Neisseria meningitidis Z2491
cacgcccaagcggu

SEQ ID NO: 3368855 - RNA, 22 nt, Neisseria meningitidis Z2491
cacgccgaacccgacuucugac

SEQ ID NO: 3368856 - RNA, 21 nt, Neisseria meningitidis Z2491
cacgccgccgcgccccaagcc

SEQ ID NO: 3368857 - RNA, 21 nt, Neisseria meningitidis Z2491
cacgcgcccaucgucuagagg

SEQ ID NO: 3368858 - RNA, 22 nt, Neisseria meningitidis Z2491
cacgcgguuuugcguccaaccc

SEQ ID NO: 3368859 - RNA, 21 nt, Neisseria meningitidis Z2491
cacgcuucugaugccgucugu

SEQ ID NO: 3368860 - RNA, 12 nt, Neisseria meningitidis Z2491
cacggcaaaaau

SEQ ID NO: 3368861 - RNA, 14 nt, Neisseria meningitidis Z2491
cacggcgcaggcaa

SEQ ID NO: 3368862 - RNA, 16 nt, Neisseria meningitidis Z2491
cacggcuuucgcgccg

SEQ ID NO: 3368863 - RNA, 22 nt, Neisseria meningitidis Z2491
cacggcuuugucgguaaaaaug

SEQ ID NO: 3368864 - RNA, 17 nt, Neisseria meningitidis Z2491
cacggugugcaggcugc

SEQ ID NO: 3368865 - RNA, 24 nt, Neisseria meningitidis Z2491
cacggugugcaggcugccgcacaa

SEQ ID NO: 3368866 - RNA, 13 nt, Neisseria meningitidis Z2491
cacgguuuuccuc

SEQ ID NO: 3368867 - RNA, 23 nt, Neisseria meningitidis Z2491
cacgucauuccuacgaaccuaca

SEQ ID NO: 3368868 - RNA, 23 nt, Neisseria meningitidis Z2491
cacguccgccauuuccaaaccca

SEQ ID NO: 3368869 - RNA, 22 nt, Neisseria meningitidis Z2491
cacgucguaggcuuuuuccaau

SEQ ID NO: 3368870 - RNA, 17 nt, Neisseria meningitidis Z2491
cacgucuaucauggcgc

SEQ ID NO: 3368871 - RNA, 12 nt, Neisseria meningitidis Z2491
cacuaaaaaauc

SEQ ID NO: 3368872 - RNA, 16 nt, Neisseria meningitidis Z2491
cacuacuucauuuuuu

SEQ ID NO: 3368873 - RNA, 19 nt, Neisseria meningitidis Z2491
cacuagccaaaaaaaccga

SEQ ID NO: 3368874 - RNA, 15 nt, Neisseria meningitidis Z2491
cacuaguguauuagu

SEQ ID NO: 3368875 - RNA, 20 nt, Neisseria meningitidis Z2491
cacuauaaaaggucuuuucu

SEQ ID NO: 3368876 - RNA, 20 nt, Neisseria meningitidis Z2491
cacuauaauccaccauauuu

SEQ ID NO: 3368877 - RNA, 14 nt, Neisseria meningitidis Z2491
cacuauaauuuauu

SEQ ID NO: 3368878 - RNA, 14 nt, Neisseria meningitidis Z2491
cacuauacugcuga

SEQ ID NO: 3368879 - RNA, 20 nt, Neisseria meningitidis Z2491
cacuauaucgucauucccgc

SEQ ID NO: 3368880 - RNA, 20 nt, Neisseria meningitidis Z2491
cacuauauuaaggcugcggc

SEQ ID NO: 3368881 - RNA, 22 nt, Neisseria meningitidis Z2491
cacuaucauauagauuuuuaug

SEQ ID NO: 3368882 - RNA, 12 nt, Neisseria meningitidis Z2491
cacucacuuuaa

SEQ ID NO: 3368883 - RNA, 13 nt, Neisseria meningitidis Z2491
cacugucucggca

SEQ ID NO: 3368884 - RNA, 17 nt, Neisseria meningitidis Z2491
cacuguuuccaagccgc

SEQ ID NO: 3368885 - RNA, 12 nt, Neisseria meningitidis Z2491
cacuuaaaaaua

SEQ ID NO: 3368886 - RNA, 16 nt, Neisseria meningitidis Z2491
cacuuaaaaauaccua

SEQ ID NO: 3368887 - RNA, 17 nt, Neisseria meningitidis Z2491
cacuucaaccgcgaugu

SEQ ID NO: 3368888 - RNA, 20 nt, Neisseria meningitidis Z2491
cacuuccagcgcaccuccau

SEQ ID NO: 3368889 - RNA, 15 nt, Neisseria meningitidis Z2491
cacuuccgugggaau

SEQ ID NO: 3368890 - RNA, 22 nt, Neisseria meningitidis Z2491
cacuugaaauccgaauccaagg

SEQ ID NO: 3368891 - RNA, 17 nt, Neisseria meningitidis Z2491
cacuuggaauaugaaua

SEQ ID NO: 3368892 - RNA, 19 nt, Neisseria meningitidis Z2491
cacuuggaauaugaauacg

SEQ ID NO: 3368893 - RNA, 15 nt, Neisseria meningitidis Z2491
cacuuucauucacac

SEQ ID NO: 3368894 - RNA, 16 nt, Neisseria meningitidis Z2491
cacuuucgugggaaug

SEQ ID NO: 3368895 - RNA, 21 nt, Neisseria meningitidis Z2491
cacuuugcggcagauacaaca

SEQ ID NO: 3368896 - RNA, 23 nt, Neisseria meningitidis Z2491
cagaaaaacaaugccgucugaua

SEQ ID NO: 3368897 - RNA, 21 nt, Neisseria meningitidis Z2491
cagaaaaaggguuugacagcg

SEQ ID NO: 3368898 - RNA, 15 nt, Neisseria meningitidis Z2491
cagaaaaccaaaaac

SEQ ID NO: 3368899 - RNA, 16 nt, Neisseria meningitidis Z2491
cagaaaaccaaaaaca

SEQ ID NO: 3368900 - RNA, 14 nt, Neisseria meningitidis Z2491
cagcauacggaugu

SEQ ID NO: 3368901 - RNA, 16 nt, Neisseria meningitidis Z2491
cagcauauagccgagc

SEQ ID NO: 3368902 - RNA, 15 nt, Neisseria meningitidis Z2491
cagcaucgcagauuc

SEQ ID NO: 3368903 - RNA, 16 nt, Neisseria meningitidis Z2491
cagcaucgcagauucg

SEQ ID NO: 3368904 - RNA, 13 nt, Neisseria meningitidis Z2491
cagcauuaauaua

SEQ ID NO: 3368905 - RNA, 16 nt, Neisseria meningitidis Z2491
cagcauuaauauacuu

SEQ ID NO: 3368906 - RNA, 14 nt, Neisseria meningitidis Z2491
cagccacaacacgc

SEQ ID NO: 3368907 - RNA, 18 nt, Neisseria meningitidis Z2491
cagccaccacguccaccu

SEQ ID NO: 3368908 - RNA, 14 nt, Neisseria meningitidis Z2491
cagccaccagcggu

SEQ ID NO: 3368909 - RNA, 19 nt, Neisseria meningitidis Z2491
cagccaguccggacgguca

SEQ ID NO: 3368910 - RNA, 12 nt, Neisseria meningitidis Z2491
cagccauauuuu

SEQ ID NO: 3368911 - RNA, 13 nt, Neisseria meningitidis Z2491
cagccauauuuuu

SEQ ID NO: 3368912 - RNA, 16 nt, Neisseria meningitidis Z2491
cagcccauuacggcaa

SEQ ID NO: 3368913 - RNA, 13 nt, Neisseria meningitidis Z2491
cagcccgaaauag

SEQ ID NO: 3368914 - RNA, 15 nt, Neisseria meningitidis Z2491
cagcccgccgcgccc

SEQ ID NO: 3368915 - RNA, 17 nt, Neisseria meningitidis Z2491
cagccgaaaacagcuga

SEQ ID NO: 3368916 - RNA, 18 nt, Neisseria meningitidis Z2491
cagccgaaugauucauaa

SEQ ID NO: 3368917 - RNA, 16 nt, Neisseria meningitidis Z2491
cagccgcuucaccgac

SEQ ID NO: 3368918 - RNA, 19 nt, Neisseria meningitidis Z2491
cagccgcuucaccgacacc

SEQ ID NO: 3368919 - RNA, 15 nt, Neisseria meningitidis Z2491
cagccuauuuuucug

SEQ ID NO: 3368920 - RNA, 22 nt, Neisseria meningitidis Z2491
cagccuauuuuucugaaaaauu

SEQ ID NO: 3368921 - RNA, 16 nt, Neisseria meningitidis Z2491
cagccugccgcugaug

SEQ ID NO: 3368922 - RNA, 23 nt, Neisseria meningitidis Z2491
cagccugccgcugaugaugaugg

SEQ ID NO: 3368923 - RNA, 16 nt, Neisseria meningitidis Z2491
cagcgaagacaggcag

SEQ ID NO: 3368924 - RNA, 18 nt, Neisseria meningitidis Z2491
cagcgacacccucaauuc

SEQ ID NO: 3368925 - RNA, 15 nt, Neisseria meningitidis Z2491
cagcgaguuuuucgc

SEQ ID NO: 3368926 - RNA, 18 nt, Neisseria meningitidis Z2491
cagcgcgaugucgcugcc

SEQ ID NO: 3368927 - RNA, 18 nt, Neisseria meningitidis Z2491
cagcgugaaaccuuugau

SEQ ID NO: 3368928 - RNA, 23 nt, Neisseria meningitidis Z2491
cagcgugcggacguucaaacccu

SEQ ID NO: 3368929 - RNA, 16 nt, Neisseria meningitidis Z2491
cagcguuggcucgccu

SEQ ID NO: 3368930 - RNA, 17 nt, Neisseria meningitidis Z2491
cagcguuggcucgccuu

SEQ ID NO: 3368931 - RNA, 14 nt, Neisseria meningitidis Z2491
cagcuccggccaaa

SEQ ID NO: 3368932 - RNA, 14 nt, Neisseria meningitidis Z2491
cagcugaaaacagc

SEQ ID NO: 3368933 - RNA, 19 nt, Neisseria meningitidis Z2491
cagcugaaaacagcugaaa

SEQ ID NO: 3368934 - RNA, 17 nt, Neisseria meningitidis Z2491
cagcuguacgcugaugu

SEQ ID NO: 3368935 - RNA, 17 nt, Neisseria meningitidis Z2491
cagcuguuuucggcugu

SEQ ID NO: 3368936 - RNA, 15 nt, Neisseria meningitidis Z2491
cagcuucgucgccuu

SEQ ID NO: 3368937 - RNA, 17 nt, Neisseria meningitidis Z2491
cagcuugagaacggaug

SEQ ID NO: 3368938 - RNA, 16 nt, Neisseria meningitidis Z2491
cagcuugagauuucgc

SEQ ID NO: 3368939 - RNA, 20 nt, Neisseria meningitidis Z2491
cagcuuuugcgccacggcau

SEQ ID NO: 3368940 - RNA, 21 nt, Neisseria meningitidis Z2491
cagcuuuugcgccacggcaua

SEQ ID NO: 3368941 - RNA, 23 nt, Neisseria meningitidis Z2491
caggaaaacagcgaguuuuucgc

SEQ ID NO: 3368942 - RNA, 23 nt, Neisseria meningitidis Z2491
caggaacgggccguuuuuacugg

SEQ ID NO: 3368943 - RNA, 18 nt, Neisseria meningitidis Z2491
caggaauccggagucuca

SEQ ID NO: 3368944 - RNA, 21 nt, Neisseria meningitidis Z2491
caggaauuuaucggaaaaaca

SEQ ID NO: 3368945 - RNA, 12 nt, Neisseria meningitidis Z2491
caggacaaaaau

SEQ ID NO: 3368946 - RNA, 18 nt, Neisseria meningitidis Z2491
caggacaaaaauccugcu

SEQ ID NO: 3368947 - RNA, 14 nt, Neisseria meningitidis Z2491
caggacaaggcgac

SEQ ID NO: 3368948 - RNA, 16 nt, Neisseria meningitidis Z2491
caggacgacacauaaa

SEQ ID NO: 3368949 - RNA, 17 nt, Neisseria meningitidis Z2491
caggacggcuuugaaca

SEQ ID NO: 3368950 - RNA, 14 nt, Neisseria meningitidis Z2491
caggauuuucaaau

SEQ ID NO: 3368951 - RNA, 20 nt, Neisseria meningitidis Z2491
caggcaaaaaaaauaaccgc

SEQ ID NO: 3368952 - RNA, 21 nt, Neisseria meningitidis Z2491
caggcaaaaaaaauaaccgcu

SEQ ID NO: 3368953 - RNA, 22 nt, Neisseria meningitidis Z2491
caggcaaaugcugucugaaacc

SEQ ID NO: 3368954 - RNA, 19 nt, Neisseria meningitidis Z2491
caggcacgcgcugcggcau

SEQ ID NO: 3368955 - RNA, 18 nt, Neisseria meningitidis Z2491
caggcagcagaucgaccg

SEQ ID NO: 3368956 - RNA, 16 nt, Neisseria meningitidis Z2491
caggcagccuaaaaca

SEQ ID NO: 3368957 - RNA, 18 nt, Neisseria meningitidis Z2491
caggcagggaaacgccuu

SEQ ID NO: 3368958 - RNA, 13 nt, Neisseria meningitidis Z2491
caggcaguuugau

SEQ ID NO: 3368959 - RNA, 19 nt, Neisseria meningitidis Z2491
caggcaguuugauaggcaa

SEQ ID NO: 3368960 - RNA, 12 nt, Neisseria meningitidis Z2491
caggcauuauuu

SEQ ID NO: 3368961 - RNA, 13 nt, Neisseria meningitidis Z2491
caggccaaacccc

SEQ ID NO: 3368962 - RNA, 16 nt, Neisseria meningitidis Z2491
caggcccaaaacaaau

SEQ ID NO: 3368963 - RNA, 12 nt, Neisseria meningitidis Z2491
caggcggcggca

SEQ ID NO: 3368964 - RNA, 13 nt, Neisseria meningitidis Z2491
caggcggcggcau

SEQ ID NO: 3368965 - RNA, 15 nt, Neisseria meningitidis Z2491
caggcgggaauccaa

SEQ ID NO: 3368966 - RNA, 22 nt, Neisseria meningitidis Z2491
caggcgggaauccagacauuca

SEQ ID NO: 3368967 - RNA, 19 nt, Neisseria meningitidis Z2491
caggcgggaauccagacca

SEQ ID NO: 3368968 - RNA, 14 nt, Neisseria meningitidis Z2491
caggcgggaauccg

SEQ ID NO: 3368969 - RNA, 14 nt, Neisseria meningitidis Z2491
caggcgggaaucua

SEQ ID NO: 3368970 - RNA, 18 nt, Neisseria meningitidis Z2491
caggcgggaaucuagaca

SEQ ID NO: 3368971 - RNA, 16 nt, Neisseria meningitidis Z2491
caggcuucagacggca

SEQ ID NO: 3368972 - RNA, 14 nt, Neisseria meningitidis Z2491
caggcuuuuuucug

SEQ ID NO: 3368973 - RNA, 16 nt, Neisseria meningitidis Z2491
caggcuuuuuugacga

SEQ ID NO: 3368974 - RNA, 17 nt, Neisseria meningitidis Z2491
caggcuuuuuugacgaa

SEQ ID NO: 3368975 - RNA, 16 nt, Neisseria meningitidis Z2491
cagggaaagcagcagc

SEQ ID NO: 3368976 - RNA, 17 nt, Neisseria meningitidis Z2491
cagggaaagcagcagcc

SEQ ID NO: 3368977 - RNA, 18 nt, Neisseria meningitidis Z2491
cagggcaaguuugccgcc

SEQ ID NO: 3368978 - RNA, 13 nt, Neisseria meningitidis Z2491
cagggcagggcau

SEQ ID NO: 3368979 - RNA, 14 nt, Neisseria meningitidis Z2491
cagggcugcaaaau

SEQ ID NO: 3368980 - RNA, 23 nt, Neisseria meningitidis Z2491
cagggcugcgccuuaugugcggc

SEQ ID NO: 3368981 - RNA, 17 nt, Neisseria meningitidis Z2491
caggggauugccgcccc

SEQ ID NO: 3368982 - RNA, 15 nt, Neisseria meningitidis Z2491
caggguuaagaaaac

SEQ ID NO: 3368983 - RNA, 17 nt, Neisseria meningitidis Z2491
caggguuaagaaaaccu

SEQ ID NO: 3368984 - RNA, 14 nt, Neisseria meningitidis Z2491
caggguuaaggcuu

SEQ ID NO: 3368985 - RNA, 18 nt, Neisseria meningitidis Z2491
cagguaacuuccaaaccg

SEQ ID NO: 3368986 - RNA, 16 nt, Neisseria meningitidis Z2491
cagguagcggcugagg

SEQ ID NO: 3368987 - RNA, 14 nt, Neisseria meningitidis Z2491
caggugcagauguu

SEQ ID NO: 3368988 - RNA, 20 nt, Neisseria meningitidis Z2491
cagguuuucgucuauuuucg

SEQ ID NO: 3368989 - RNA, 18 nt, Neisseria meningitidis Z2491
cagguuuuguuuuuccaa

SEQ ID NO: 3368990 - RNA, 18 nt, Neisseria meningitidis Z2491
cagguuuuuauagaauua

SEQ ID NO: 3368991 - RNA, 23 nt, Neisseria meningitidis Z2491
cagguuuuuauagaauuauccac

SEQ ID NO: 3368992 - RNA, 15 nt, Neisseria meningitidis Z2491
caguacaaauaguac

SEQ ID NO: 3368993 - RNA, 19 nt, Neisseria meningitidis Z2491
caguacggcguugccucgc

SEQ ID NO: 3368994 - RNA, 23 nt, Neisseria meningitidis Z2491
caguauagugaauuaaauuuaaa

SEQ ID NO: 3368995 - RNA, 16 nt, Neisseria meningitidis Z2491
caguccacauuuggaa

SEQ ID NO: 3368996 - RNA, 15 nt, Neisseria meningitidis Z2491
caguccuacccaaaa

SEQ ID NO: 3368997 - RNA, 13 nt, Neisseria meningitidis Z2491
caguccuuaucug

SEQ ID NO: 3368998 - RNA, 20 nt, Neisseria meningitidis Z2491
cagucugucgccgucggcuu

SEQ ID NO: 3368999 - RNA, 21 nt, Neisseria meningitidis Z2491
cagucuuccaacccuccgccg

SEQ ID NO: 3369000 - RNA, 19 nt, Neisseria meningitidis Z2491
cagugccgcaccaccagcc

SEQ ID NO: 3369001 - RNA, 21 nt, Neisseria meningitidis Z2491
cagugccgcaccaccagccac

SEQ ID NO: 3369002 - RNA, 17 nt, Neisseria meningitidis Z2491
caucggcguaauaauau

SEQ ID NO: 3369003 - RNA, 15 nt, Neisseria meningitidis Z2491
caucgggccggcuuc

SEQ ID NO: 3369004 - RNA, 15 nt, Neisseria meningitidis Z2491
caucguaugaaacaa

SEQ ID NO: 3369005 - RNA, 21 nt, Neisseria meningitidis Z2491
caucguauuggggcaaagcgg

SEQ ID NO: 3369006 - RNA, 17 nt, Neisseria meningitidis Z2491
caucguccaaccuuccc

SEQ ID NO: 3369007 - RNA, 21 nt, Neisseria meningitidis Z2491
caucguccacuucaaccgcga

SEQ ID NO: 3369008 - RNA, 23 nt, Neisseria meningitidis Z2491
caucguccuccaccgucauuccc

SEQ ID NO: 3369009 - RNA, 12 nt, Neisseria meningitidis Z2491
caucgucuagag

SEQ ID NO: 3369010 - RNA, 16 nt, Neisseria meningitidis Z2491
caucguuacaaauuua

SEQ ID NO: 3369011 - RNA, 15 nt, Neisseria meningitidis Z2491
caucguuuuuuuagg

SEQ ID NO: 3369012 - RNA, 21 nt, Neisseria meningitidis Z2491
caucuacaaaauaaucuuccu

SEQ ID NO: 3369013 - RNA, 19 nt, Neisseria meningitidis Z2491
caucucuaagauuuacagc

SEQ ID NO: 3369014 - RNA, 14 nt, Neisseria meningitidis Z2491
caucugauuuuucu

SEQ ID NO: 3369015 - RNA, 22 nt, Neisseria meningitidis Z2491
caucuuauuuauuuuuucucaa

SEQ ID NO: 3369016 - RNA, 13 nt, Neisseria meningitidis Z2491
caucuucaaagga

SEQ ID NO: 3369017 - RNA, 14 nt, Neisseria meningitidis Z2491
caucuucaaaggaa

SEQ ID NO: 3369018 - RNA, 23 nt, Neisseria meningitidis Z2491
caucuucgaggaacaaaaugccg

SEQ ID NO: 3369019 - RNA, 23 nt, Neisseria meningitidis Z2491
caucuucuucaacaccugcagau

SEQ ID NO: 3369020 - RNA, 18 nt, Neisseria meningitidis Z2491
caucuuuagacugcuucc

SEQ ID NO: 3369021 - RNA, 14 nt, Neisseria meningitidis Z2491
caugauggcaacga

SEQ ID NO: 3369022 - RNA, 16 nt, Neisseria meningitidis Z2491
caugcaccugcauaau

SEQ ID NO: 3369023 - RNA, 17 nt, Neisseria meningitidis Z2491
caugccauacugccugc

SEQ ID NO: 3369024 - RNA, 20 nt, Neisseria meningitidis Z2491
caugccauggauuauauuug

SEQ ID NO: 3369025 - RNA, 20 nt, Neisseria meningitidis Z2491
caugccgcuugaccgcagcc

SEQ ID NO: 3369026 - RNA, 22 nt, Neisseria meningitidis Z2491
caugcgugcccgguuggaaggc

SEQ ID NO: 3369027 - RNA, 21 nt, Neisseria meningitidis Z2491
caugcuuaaacagcacugccu

SEQ ID NO: 3369028 - RNA, 23 nt, Neisseria meningitidis Z2491
caugcuuaaacagcacugccucu

SEQ ID NO: 3369029 - RNA, 17 nt, Neisseria meningitidis Z2491
cauggacauucucuugg

SEQ ID NO: 3369030 - RNA, 21 nt, Neisseria meningitidis Z2491
cauggacauucucuuggucaa

SEQ ID NO: 3369031 - RNA, 15 nt, Neisseria meningitidis Z2491
cauggcgacaaucuc

SEQ ID NO: 3369032 - RNA, 17 nt, Neisseria meningitidis Z2491
cauggcguucaacacgu

SEQ ID NO: 3369033 - RNA, 23 nt, Neisseria meningitidis Z2491
cauggcuucuuugcuggaagcau

SEQ ID NO: 3369034 - RNA, 22 nt, Neisseria meningitidis Z2491
caugucggguucggauauuucc

SEQ ID NO: 3369035 - RNA, 23 nt, Neisseria meningitidis Z2491
caugucggguucggauauuuccg

SEQ ID NO: 3369036 - RNA, 13 nt, Neisseria meningitidis Z2491
cauuaaaaaauac

SEQ ID NO: 3369037 - RNA, 12 nt, Neisseria meningitidis Z2491
cauuaaaauucu

SEQ ID NO: 3369038 - RNA, 19 nt, Neisseria meningitidis Z2491
cauuaaagugccauuuaaa

SEQ ID NO: 3369039 - RNA, 20 nt, Neisseria meningitidis Z2491
cauuaagauguuuuuccaca

SEQ ID NO: 3369040 - RNA, 21 nt, Neisseria meningitidis Z2491
cauuacugaaauggguaaguc

SEQ ID NO: 3369041 - RNA, 16 nt, Neisseria meningitidis Z2491
cauuaucaguauuuuc

SEQ ID NO: 3369042 - RNA, 18 nt, Neisseria meningitidis Z2491
cauuaucaguauuuucua

SEQ ID NO: 3369043 - RNA, 23 nt, Neisseria meningitidis Z2491
cauuauuuuucauuuuuggcuug

SEQ ID NO: 3369044 - RNA, 12 nt, Neisseria meningitidis Z2491
cauucaaugcua

SEQ ID NO: 3369045 - RNA, 18 nt, Neisseria meningitidis Z2491
cauucaaugcuaaggcaa

SEQ ID NO: 3369046 - RNA, 20 nt, Neisseria meningitidis Z2491
cauucaaugcuaaggcaauu

SEQ ID NO: 3369047 - RNA, 22 nt, Neisseria meningitidis Z2491
cauucccacgaaagugggaauc

SEQ ID NO: 3369048 - RNA, 21 nt, Neisseria meningitidis Z2491
cauucccacggaagugggaau

SEQ ID NO: 3369049 - RNA, 15 nt, Neisseria meningitidis Z2491
cauucccgauaaauu

SEQ ID NO: 3369050 - RNA, 18 nt, Neisseria meningitidis Z2491
cauucccgcaaaaacaaa

SEQ ID NO: 3369051 - RNA, 19 nt, Neisseria meningitidis Z2491
cauucccgcaaaaacaaaa

SEQ ID NO: 3369052 - RNA, 21 nt, Neisseria meningitidis Z2491
cauucccgcaaaaacaaaaaa

SEQ ID NO: 3369053 - RNA, 14 nt, Neisseria meningitidis Z2491
cauucccgcaaaag

SEQ ID NO: 3369054 - RNA, 14 nt, Neisseria meningitidis Z2491
cauucccgcgcagg

SEQ ID NO: 3369055 - RNA, 18 nt, Neisseria meningitidis Z2491
cauucccucaaaaacaga

SEQ ID NO: 3369056 - RNA, 13 nt, Neisseria meningitidis Z2491
cauuccgcgcagg

SEQ ID NO: 3369057 - RNA, 13 nt, Neisseria meningitidis Z2491
cauuccgucauuc

SEQ ID NO: 3369058 - RNA, 22 nt, Neisseria meningitidis Z2491
cauuccguuaucccauaaaaac

SEQ ID NO: 3369059 - RNA, 21 nt, Neisseria meningitidis Z2491
cauuccuacaaggacaaaaaa

SEQ ID NO: 3369060 - RNA, 17 nt, Neisseria meningitidis Z2491
cauuccuguaaaaacaa

SEQ ID NO: 3369061 - RNA, 19 nt, Neisseria meningitidis Z2491
cauucucacaaaaacagaa

SEQ ID NO: 3369062 - RNA, 15 nt, Neisseria meningitidis Z2491
cauucuccguuucag

SEQ ID NO: 3369063 - RNA, 23 nt, Neisseria meningitidis Z2491
cauucugcggauucugccaaacg

SEQ ID NO: 3369064 - RNA, 16 nt, Neisseria meningitidis Z2491
cauucuugcaaaauag

SEQ ID NO: 3369065 - RNA, 13 nt, Neisseria meningitidis Z2491
cauugccacgccg

SEQ ID NO: 3369066 - RNA, 15 nt, Neisseria meningitidis Z2491
cauugcgaacugccu

SEQ ID NO: 3369067 - RNA, 18 nt, Neisseria meningitidis Z2491
cauugcgggaauagcuca

SEQ ID NO: 3369068 - RNA, 20 nt, Neisseria meningitidis Z2491
cauuggaagaagauuuuugu

SEQ ID NO: 3369069 - RNA, 18 nt, Neisseria meningitidis Z2491
cauuguccgagcaggacg

SEQ ID NO: 3369070 - RNA, 15 nt, Neisseria meningitidis Z2491
cauuguuguuuuuug

SEQ ID NO: 3369071 - RNA, 23 nt, Neisseria meningitidis Z2491
cauuuauaguggauuaacaaaaa

SEQ ID NO: 3369072 - RNA, 18 nt, Neisseria meningitidis Z2491
cauuuaucggaaaagcag

SEQ ID NO: 3369073 - RNA, 22 nt, Neisseria meningitidis Z2491
cauuuaucgggagcaacagaaa

SEQ ID NO: 3369074 - RNA, 14 nt, Neisseria meningitidis Z2491
cauuucaggacgga

SEQ ID NO: 3369075 - RNA, 19 nt, Neisseria meningitidis Z2491
cauuucauuauccgcccgu

SEQ ID NO: 3369076 - RNA, 18 nt, Neisseria meningitidis Z2491
cauuucauuuauuucuug

SEQ ID NO: 3369077 - RNA, 13 nt, Neisseria meningitidis Z2491
cauuuccaauuuu

SEQ ID NO: 3369078 - RNA, 15 nt, Neisseria meningitidis Z2491
cauuuccacaaaaaa

SEQ ID NO: 3369079 - RNA, 19 nt, Neisseria meningitidis Z2491
cauuuccgauaaauuccug

SEQ ID NO: 3369080 - RNA, 17 nt, Neisseria meningitidis Z2491
cauuuccgauaaauucu

SEQ ID NO: 3369081 - RNA, 18 nt, Neisseria meningitidis Z2491
cauuuccgauaaauucuu

SEQ ID NO: 3369082 - RNA, 16 nt, Neisseria meningitidis Z2491
cauuucuaauuuuuau

SEQ ID NO: 3369083 - RNA, 18 nt, Neisseria meningitidis Z2491
cauuucuagauucccacu

SEQ ID NO: 3369084 - RNA, 20 nt, Neisseria meningitidis Z2491
cauuucuagauucccacuuu

SEQ ID NO: 3369085 - RNA, 23 nt, Neisseria meningitidis Z2491
cauuucuagauucccacuuuugu

SEQ ID NO: 3369086 - RNA, 10 nt, Neisseria meningitidis Z2491
cauuucugau

SEQ ID NO: 3369087 - RNA, 22 nt, Neisseria meningitidis Z2491
cauuucugauaaacccccguca

SEQ ID NO: 3369088 - RNA, 17 nt, Neisseria meningitidis Z2491
cauuucuggauucccac

SEQ ID NO: 3369089 - RNA, 20 nt, Neisseria meningitidis Z2491
cauuucuggauucccacuuu

SEQ ID NO: 3369090 - RNA, 23 nt, Neisseria meningitidis Z2491
cauuucuggauucccacuuuugu

SEQ ID NO: 3369091 - RNA, 17 nt, Neisseria meningitidis Z2491
cauuucuuccugacgga

SEQ ID NO: 3369092 - RNA, 20 nt, Neisseria meningitidis Z2491
cauuugacuugaaggcgugu

SEQ ID NO: 3369093 - RNA, 19 nt, Neisseria meningitidis Z2491
cauuugacuuucagggugu

SEQ ID NO: 3369094 - RNA, 19 nt, Neisseria meningitidis Z2491
ccgagcaucaaggaauuca

SEQ ID NO: 3369095 - RNA, 23 nt, Neisseria meningitidis Z2491
ccgaggauaaaaaaugccgucug

SEQ ID NO: 3369096 - RNA, 18 nt, Neisseria meningitidis Z2491
ccgaggcgcgugaauuug

SEQ ID NO: 3369097 - RNA, 19 nt, Neisseria meningitidis Z2491
ccgauaagguuuauuugag

SEQ ID NO: 3369098 - RNA, 23 nt, Neisseria meningitidis Z2491
ccgauacgcucggcguuuuucag

SEQ ID NO: 3369099 - RNA, 15 nt, Neisseria meningitidis Z2491
ccgauguucugucuc

SEQ ID NO: 3369100 - RNA, 18 nt, Neisseria meningitidis Z2491
ccgauguugccacacaca

SEQ ID NO: 3369101 - RNA, 23 nt, Neisseria meningitidis Z2491
ccgauuaacguauucaagcagca

SEQ ID NO: 3369102 - RNA, 16 nt, Neisseria meningitidis Z2491
ccgcaaaaacaaaaaa

SEQ ID NO: 3369103 - RNA, 11 nt, Neisseria meningitidis Z2491
ccgcaaaagcg

SEQ ID NO: 3369104 - RNA, 16 nt, Neisseria meningitidis Z2491
ccgcaaaagcgggagu

SEQ ID NO: 3369105 - RNA, 12 nt, Neisseria meningitidis Z2491
ccgcaaacaaaa

SEQ ID NO: 3369106 - RNA, 13 nt, Neisseria meningitidis Z2491
ccgcaaacaaaau

SEQ ID NO: 3369107 - RNA, 11 nt, Neisseria meningitidis Z2491
ccgcaaaccuu

SEQ ID NO: 3369108 - RNA, 14 nt, Neisseria meningitidis Z2491
ccgcaaacggcagc

SEQ ID NO: 3369109 - RNA, 18 nt, Neisseria meningitidis Z2491
ccgcaaagccgccgccga

SEQ ID NO: 3369110 - RNA, 18 nt, Neisseria meningitidis Z2491
ccgcaaagucauauuaau

SEQ ID NO: 3369111 - RNA, 20 nt, Neisseria meningitidis Z2491
ccgcaacgguuuuaccgcuu

SEQ ID NO: 3369112 - RNA, 22 nt, Neisseria meningitidis Z2491
ccgcaacucuccgucauucccg

SEQ ID NO: 3369113 - RNA, 21 nt, Neisseria meningitidis Z2491
ccgcacaaaccgcgcaucgcc

SEQ ID NO: 3369114 - RNA, 17 nt, Neisseria meningitidis Z2491
ccgcacacgaacugccu

SEQ ID NO: 3369115 - RNA, 14 nt, Neisseria meningitidis Z2491
ccgcacagaaaccu

SEQ ID NO: 3369116 - RNA, 15 nt, Neisseria meningitidis Z2491
ccgcacccccgacca

SEQ ID NO: 3369117 - RNA, 21 nt, Neisseria meningitidis Z2491
ccgcacggucaacgccgugcg

SEQ ID NO: 3369118 - RNA, 15 nt, Neisseria meningitidis Z2491
ccgcagcaaaauaug

SEQ ID NO: 3369119 - RNA, 13 nt, Neisseria meningitidis Z2491
ccgcagccgccau

SEQ ID NO: 3369120 - RNA, 21 nt, Neisseria meningitidis Z2491
ccgcauauuccggugcgaccg

SEQ ID NO: 3369121 - RNA, 19 nt, Neisseria meningitidis Z2491
ccgcauugccgcaaucgcc

SEQ ID NO: 3369122 - RNA, 13 nt, Neisseria meningitidis Z2491
ccgccaaacccuc

SEQ ID NO: 3369123 - RNA, 15 nt, Neisseria meningitidis Z2491
ccgccaaagugccaa

SEQ ID NO: 3369124 - RNA, 19 nt, Neisseria meningitidis Z2491
ccgccaaccguuccaacgc

SEQ ID NO: 3369125 - RNA, 16 nt, Neisseria meningitidis Z2491
ccgccaaugccgucug

SEQ ID NO: 3369126 - RNA, 17 nt, Neisseria meningitidis Z2491
ccgccaguccuacccaa

SEQ ID NO: 3369127 - RNA, 13 nt, Neisseria meningitidis Z2491
ccgccaucaggaa

SEQ ID NO: 3369128 - RNA, 15 nt, Neisseria meningitidis Z2491
ccgccauccagcaaa

SEQ ID NO: 3369129 - RNA, 13 nt, Neisseria meningitidis Z2491
ccgcccagccgaa

SEQ ID NO: 3369130 - RNA, 22 nt, Neisseria meningitidis Z2491
ccgccccuuggcggcuccuccg

SEQ ID NO: 3369131 - RNA, 14 nt, Neisseria meningitidis Z2491
ccgcccgggccggc

SEQ ID NO: 3369132 - RNA, 22 nt, Neisseria meningitidis Z2491
ccgcccuauauuugccggucgg

SEQ ID NO: 3369133 - RNA, 18 nt, Neisseria meningitidis Z2491
ccgccgacaucccccagc

SEQ ID NO: 3369134 - RNA, 13 nt, Neisseria meningitidis Z2491
ccgccgcgcccca

SEQ ID NO: 3369135 - RNA, 19 nt, Neisseria meningitidis Z2491
ccgccggaagcgcaccgcc

SEQ ID NO: 3369136 - RNA, 21 nt, Neisseria meningitidis Z2491
ccgccggaagcgcaccgccgc

SEQ ID NO: 3369137 - RNA, 17 nt, Neisseria meningitidis Z2491
ccgccguaaccagcccc

SEQ ID NO: 3369138 - RNA, 23 nt, Neisseria meningitidis Z2491
ccgccguaaccgcacccccgacc

SEQ ID NO: 3369139 - RNA, 16 nt, Neisseria meningitidis Z2491
ccgccuaucacuucca

SEQ ID NO: 3369140 - RNA, 21 nt, Neisseria meningitidis Z2491
ccgccugaacauuucagacgg

SEQ ID NO: 3369141 - RNA, 20 nt, Neisseria meningitidis Z2491
ccgccugaugauuuuuucaa

SEQ ID NO: 3369142 - RNA, 22 nt, Neisseria meningitidis Z2491
ccgcgauaaggcgcguccaaca

SEQ ID NO: 3369143 - RNA, 16 nt, Neisseria meningitidis Z2491
ccgcgcacgccaucgg

SEQ ID NO: 3369144 - RNA, 17 nt, Neisseria meningitidis Z2491
ccgcgccaauuccuuca

SEQ ID NO: 3369145 - RNA, 20 nt, Neisseria meningitidis Z2491
ccgcgccaauuccuucaugg

SEQ ID NO: 3369146 - RNA, 15 nt, Neisseria meningitidis Z2491
ccgcgcgucagcccg

SEQ ID NO: 3369147 - RNA, 13 nt, Neisseria meningitidis Z2491
ccgcgcuguguug

SEQ ID NO: 3369148 - RNA, 16 nt, Neisseria meningitidis Z2491
ccgcguaugcguucaa

SEQ ID NO: 3369149 - RNA, 14 nt, Neisseria meningitidis Z2491
ccgcguguccgcgc

SEQ ID NO: 3369150 - RNA, 20 nt, Neisseria meningitidis Z2491
ccgcuauauauucugauuua

SEQ ID NO: 3369151 - RNA, 18 nt, Neisseria meningitidis Z2491
ccgcuauauuccaccauc

SEQ ID NO: 3369152 - RNA, 22 nt, Neisseria meningitidis Z2491
ccgcugccgaaaccaaaagcca

SEQ ID NO: 3369153 - RNA, 16 nt, Neisseria meningitidis Z2491
ccgcuguauuugcgcc

SEQ ID NO: 3369154 - RNA, 12 nt, Neisseria meningitidis Z2491
ccgcuucuucca

SEQ ID NO: 3369155 - RNA, 17 nt, Neisseria meningitidis Z2491
ccgcuucuuucgccgcc

SEQ ID NO: 3369156 - RNA, 19 nt, Neisseria meningitidis Z2491
ccgcuugaccgcagccgaa

SEQ ID NO: 3369157 - RNA, 20 nt, Neisseria meningitidis Z2491
ccgcuugacgcuaccgcaua

SEQ ID NO: 3369158 - RNA, 19 nt, Neisseria meningitidis Z2491
ccgcuuucacgggaaugac

SEQ ID NO: 3369159 - RNA, 11 nt, Neisseria meningitidis Z2491
ccggacuuuca

SEQ ID NO: 3369160 - RNA, 16 nt, Neisseria meningitidis Z2491
ccggauacggaugucc

SEQ ID NO: 3369161 - RNA, 21 nt, Neisseria meningitidis Z2491
ccggcaauauugcuccugacg

SEQ ID NO: 3369162 - RNA, 19 nt, Neisseria meningitidis Z2491
ccggcauaaauccuucacc

SEQ ID NO: 3369163 - RNA, 18 nt, Neisseria meningitidis Z2491
ccggccuuaaggcggcug

SEQ ID NO: 3369164 - RNA, 19 nt, Neisseria meningitidis Z2491
ccggcggcaacaaugccgu

SEQ ID NO: 3369165 - RNA, 23 nt, Neisseria meningitidis Z2491
ccggcuccgguucguuuugcaac

SEQ ID NO: 3369166 - RNA, 18 nt, Neisseria meningitidis Z2491
ccggcugaacauuccguu

SEQ ID NO: 3369167 - RNA, 19 nt, Neisseria meningitidis Z2491
ccggcuguguuuaucuuuu

SEQ ID NO: 3369168 - RNA, 15 nt, Neisseria meningitidis Z2491
ccggcuuuccaugcu

SEQ ID NO: 3369169 - RNA, 18 nt, Neisseria meningitidis Z2491
ccgggcuccgcaggguag

SEQ ID NO: 3369170 - RNA, 17 nt, Neisseria meningitidis Z2491
ccgggcugcuuuuuagg

SEQ ID NO: 3369171 - RNA, 22 nt, Neisseria meningitidis Z2491
ccgguacagcguuggcucgccu

SEQ ID NO: 3369172 - RNA, 19 nt, Neisseria meningitidis Z2491
ccgguacccaaacuuccaa

SEQ ID NO: 3369173 - RNA, 19 nt, Neisseria meningitidis Z2491
ccggucagaaucgccuccg

SEQ ID NO: 3369174 - RNA, 16 nt, Neisseria meningitidis Z2491
ccgguccguucaguuu

SEQ ID NO: 3369175 - RNA, 15 nt, Neisseria meningitidis Z2491
ccggucuuggcagca

SEQ ID NO: 3369176 - RNA, 22 nt, Neisseria meningitidis Z2491
ccggugugcauccgacaggcaa

SEQ ID NO: 3369177 - RNA, 16 nt, Neisseria meningitidis Z2491
ccgguuggaaggcggc

SEQ ID NO: 3369178 - RNA, 20 nt, Neisseria meningitidis Z2491
ccgguuggaaggcggcggca

SEQ ID NO: 3369179 - RNA, 22 nt, Neisseria meningitidis Z2491
ccgguuuguauuugaugcguuu

SEQ ID NO: 3369180 - RNA, 20 nt, Neisseria meningitidis Z2491
ccguacugguuuuuguuaau

SEQ ID NO: 3369181 - RNA, 17 nt, Neisseria meningitidis Z2491
ccguaucauacauagca

SEQ ID NO: 3369182 - RNA, 17 nt, Neisseria meningitidis Z2491
ccguaucccaguugugc

SEQ ID NO: 3369183 - RNA, 16 nt, Neisseria meningitidis Z2491
ccguaucgaugccguu

SEQ ID NO: 3369184 - RNA, 13 nt, Neisseria meningitidis Z2491
ccguaugccgccu

SEQ ID NO: 3369185 - RNA, 19 nt, Neisseria meningitidis Z2491
ccguaugcgaaucugcugc

SEQ ID NO: 3369186 - RNA, 21 nt, Neisseria meningitidis Z2491
ccguauuugucuuccgccaaa

SEQ ID NO: 3369187 - RNA, 14 nt, Neisseria meningitidis Z2491
ccgucaaaacaucg

SEQ ID NO: 3369188 - RNA, 19 nt, Neisseria meningitidis Z2491
ccgucaaacagaaaaacaa

SEQ ID NO: 3369189 - RNA, 18 nt, Neisseria meningitidis Z2491
ccgucagcacggggauuu

SEQ ID NO: 3369190 - RNA, 21 nt, Neisseria meningitidis Z2491
ccgucaggcacgaagcccuca

SEQ ID NO: 3369191 - RNA, 13 nt, Neisseria meningitidis Z2491
ccgucauucccgc

SEQ ID NO: 3369192 - RNA, 18 nt, Neisseria meningitidis Z2491
ccgucauucccgcgcagg

SEQ ID NO: 3369193 - RNA, 21 nt, Neisseria meningitidis Z2491
ccgucauuccucaaaaacaga

SEQ ID NO: 3369194 - RNA, 14 nt, Neisseria meningitidis Z2491
ccgucauuccugua

SEQ ID NO: 3369195 - RNA, 17 nt, Neisseria meningitidis Z2491
ccuguaaaaacaaaaaa

SEQ ID NO: 3369196 - RNA, 20 nt, Neisseria meningitidis Z2491
ccuguaaacagauaaaacca

SEQ ID NO: 3369197 - RNA, 21 nt, Neisseria meningitidis Z2491
ccuguaccguuucagacggca

SEQ ID NO: 3369198 - RNA, 16 nt, Neisseria meningitidis Z2491
ccuguccaaagccucg

SEQ ID NO: 3369199 - RNA, 17 nt, Neisseria meningitidis Z2491
ccugucccccaccgccg

SEQ ID NO: 3369200 - RNA, 16 nt, Neisseria meningitidis Z2491
ccugugcggcggacau

SEQ ID NO: 3369201 - RNA, 21 nt, Neisseria meningitidis Z2491
ccuguguccuuauuucugcuu

SEQ ID NO: 3369202 - RNA, 17 nt, Neisseria meningitidis Z2491
ccuguguuuauugagaa

SEQ ID NO: 3369203 - RNA, 19 nt, Neisseria meningitidis Z2491
ccuguguuuggguuucggc

SEQ ID NO: 3369204 - RNA, 22 nt, Neisseria meningitidis Z2491
ccuguugcuuuucauuucuaga

SEQ ID NO: 3369205 - RNA, 15 nt, Neisseria meningitidis Z2491
ccuguuuaaauucau

SEQ ID NO: 3369206 - RNA, 15 nt, Neisseria meningitidis Z2491
ccuguuucgcuguuu

SEQ ID NO: 3369207 - RNA, 16 nt, Neisseria meningitidis Z2491
ccuguuuuuaaccuua

SEQ ID NO: 3369208 - RNA, 12 nt, Neisseria meningitidis Z2491
ccuguuuuucaa

SEQ ID NO: 3369209 - RNA, 16 nt, Neisseria meningitidis Z2491
ccuguuuuucaaagcc

SEQ ID NO: 3369210 - RNA, 18 nt, Neisseria meningitidis Z2491
ccuguuuuucaaagccca

SEQ ID NO: 3369211 - RNA, 14 nt, Neisseria meningitidis Z2491
ccuuaauccuccac

SEQ ID NO: 3369212 - RNA, 22 nt, Neisseria meningitidis Z2491
ccuuaccgaccaccacuuuuuu

SEQ ID NO: 3369213 - RNA, 23 nt, Neisseria meningitidis Z2491
ccuuacggauggcauagccgcgu

SEQ ID NO: 3369214 - RNA, 12 nt, Neisseria meningitidis Z2491
ccuuagcucaaa

SEQ ID NO: 3369215 - RNA, 18 nt, Neisseria meningitidis Z2491
ccuuaucccaauauuaag

SEQ ID NO: 3369216 - RNA, 17 nt, Neisseria meningitidis Z2491
ccuuaugccuuuuucaa

SEQ ID NO: 3369217 - RNA, 19 nt, Neisseria meningitidis Z2491
ccuuaugccuuuuucaaac

SEQ ID NO: 3369218 - RNA, 15 nt, Neisseria meningitidis Z2491
ccuucagcucucccu

SEQ ID NO: 3369219 - RNA, 13 nt, Neisseria meningitidis Z2491
ccuucauccgcaa

SEQ ID NO: 3369220 - RNA, 18 nt, Neisseria meningitidis Z2491
ccuucauggcguucaaca

SEQ ID NO: 3369221 - RNA, 21 nt, Neisseria meningitidis Z2491
ccuuccgcauaauaaaaauaa

SEQ ID NO: 3369222 - RNA, 20 nt, Neisseria meningitidis Z2491
ccuuccgcuucuuccagcaa

SEQ ID NO: 3369223 - RNA, 22 nt, Neisseria meningitidis Z2491
ccuucgggcagcggcaauauuc

SEQ ID NO: 3369224 - RNA, 12 nt, Neisseria meningitidis Z2491
ccuucguagucg

SEQ ID NO: 3369225 - RNA, 16 nt, Neisseria meningitidis Z2491
ccuugcaaaucaggca

SEQ ID NO: 3369226 - RNA, 13 nt, Neisseria meningitidis Z2491
ccuugcaacccca

SEQ ID NO: 3369227 - RNA, 19 nt, Neisseria meningitidis Z2491
ccuugcaagcaguugaaau

SEQ ID NO: 3369228 - RNA, 13 nt, Neisseria meningitidis Z2491
ccuuguaaaaaug

SEQ ID NO: 3369229 - RNA, 15 nt, Neisseria meningitidis Z2491
ccuugugcuucuucg

SEQ ID NO: 3369230 - RNA, 16 nt, Neisseria meningitidis Z2491
ccuuguuuuuucaggc

SEQ ID NO: 3369231 - RNA, 15 nt, Neisseria meningitidis Z2491
ccuuuaugcuguuug

SEQ ID NO: 3369232 - RNA, 16 nt, Neisseria meningitidis Z2491
ccuuucaacacgcccu

SEQ ID NO: 3369233 - RNA, 15 nt, Neisseria meningitidis Z2491
ccuuucagacggcau

SEQ ID NO: 3369234 - RNA, 22 nt, Neisseria meningitidis Z2491
ccuuucagacggcaucaaaaug

SEQ ID NO: 3369235 - RNA, 21 nt, Neisseria meningitidis Z2491
ccuuucagacggcauuguuuc

SEQ ID NO: 3369236 - RNA, 21 nt, Neisseria meningitidis Z2491
ccuuucagacggcauuuuaug

SEQ ID NO: 3369237 - RNA, 22 nt, Neisseria meningitidis Z2491
ccuuucagacggcauuuuuaua

SEQ ID NO: 3369238 - RNA, 21 nt, Neisseria meningitidis Z2491
ccuuucagacggcauuuuuuu

SEQ ID NO: 3369239 - RNA, 20 nt, Neisseria meningitidis Z2491
ccuuuccgccgucauucccg

SEQ ID NO: 3369240 - RNA, 16 nt, Neisseria meningitidis Z2491
ccuuuccucuuucauc

SEQ ID NO: 3369241 - RNA, 16 nt, Neisseria meningitidis Z2491
ccuuucgucauucccg

SEQ ID NO: 3369242 - RNA, 14 nt, Neisseria meningitidis Z2491
ccuuugcaaaaccg

SEQ ID NO: 3369243 - RNA, 16 nt, Neisseria meningitidis Z2491
ccuuugcaauaacaua

SEQ ID NO: 3369244 - RNA, 16 nt, Neisseria meningitidis Z2491
ccuuugccaccaauac

SEQ ID NO: 3369245 - RNA, 19 nt, Neisseria meningitidis Z2491
ccuuugggcgacggcaaua

SEQ ID NO: 3369246 - RNA, 19 nt, Neisseria meningitidis Z2491
ccuuugggcggcggcaaua

SEQ ID NO: 3369247 - RNA, 22 nt, Neisseria meningitidis Z2491
ccuuugggcggcggcaauauuc

SEQ ID NO: 3369248 - RNA, 21 nt, Neisseria meningitidis Z2491
ccuuuuaccuugaggucuuug

SEQ ID NO: 3369249 - RNA, 12 nt, Neisseria meningitidis Z2491
ccuuuuuaaagg

SEQ ID NO: 3369250 - RNA, 12 nt, Neisseria meningitidis Z2491
cgaaaaaauaau

SEQ ID NO: 3369251 - RNA, 12 nt, Neisseria meningitidis Z2491
cgaaaaccugug

SEQ ID NO: 3369252 - RNA, 16 nt, Neisseria meningitidis Z2491
cgaaaaugccgucuga

SEQ ID NO: 3369253 - RNA, 18 nt, Neisseria meningitidis Z2491
cgaaacacucggccucca

SEQ ID NO: 3369254 - RNA, 18 nt, Neisseria meningitidis Z2491
cgaaacagaaacccaaaa

SEQ ID NO: 3369255 - RNA, 21 nt, Neisseria meningitidis Z2491
cgaaacagacauugcuaaaac

SEQ ID NO: 3369256 - RNA, 13 nt, Neisseria meningitidis Z2491
cgaaaccaaaagc

SEQ ID NO: 3369257 - RNA, 15 nt, Neisseria meningitidis Z2491
cgaaaccaaaagcca

SEQ ID NO: 3369258 - RNA, 16 nt, Neisseria meningitidis Z2491
cgaaaccaaaagccaa

SEQ ID NO: 3369259 - RNA, 18 nt, Neisseria meningitidis Z2491
cgaaacggcaaaacaggu

SEQ ID NO: 3369260 - RNA, 23 nt, Neisseria meningitidis Z2491
cgaaagauacagcguauugagca

SEQ ID NO: 3369261 - RNA, 15 nt, Neisseria meningitidis Z2491
cgaaagcgggaaucc

SEQ ID NO: 3369262 - RNA, 23 nt, Neisseria meningitidis Z2491
cgaaagcgggaauccggaagcga

SEQ ID NO: 3369263 - RNA, 16 nt, Neisseria meningitidis Z2491
cgaaagcgggaaucua

SEQ ID NO: 3369264 - RNA, 17 nt, Neisseria meningitidis Z2491
cgaaagguugcgggaau

SEQ ID NO: 3369265 - RNA, 19 nt, Neisseria meningitidis Z2491
cgaaagguugcgggaaucc

SEQ ID NO: 3369266 - RNA, 15 nt, Neisseria meningitidis Z2491
cgaaagugggaaucc

SEQ ID NO: 3369267 - RNA, 16 nt, Neisseria meningitidis Z2491
cgaaagugggaaucca

SEQ ID NO: 3369268 - RNA, 16 nt, Neisseria meningitidis Z2491
cgaaagugggaaucua

SEQ ID NO: 3369269 - RNA, 14 nt, Neisseria meningitidis Z2491
cgaaauaucggcaa

SEQ ID NO: 3369270 - RNA, 15 nt, Neisseria meningitidis Z2491
cgaaaucauccacag

SEQ ID NO: 3369271 - RNA, 20 nt, Neisseria meningitidis Z2491
cgaaaugccgucauucccgc

SEQ ID NO: 3369272 - RNA, 22 nt, Neisseria meningitidis Z2491
cgaaauuuuagguuucugauuu

SEQ ID NO: 3369273 - RNA, 17 nt, Neisseria meningitidis Z2491
cgaacaaugcaaaaaca

SEQ ID NO: 3369274 - RNA, 19 nt, Neisseria meningitidis Z2491
cgaacaaugcaaaaacauc

SEQ ID NO: 3369275 - RNA, 14 nt, Neisseria meningitidis Z2491
cgaacaccagugcg

SEQ ID NO: 3369276 - RNA, 16 nt, Neisseria meningitidis Z2491
cgaacaggacaaaaau

SEQ ID NO: 3369277 - RNA, 21 nt, Neisseria meningitidis Z2491
cgaaccaaauaaacaaggucu

SEQ ID NO: 3369278 - RNA, 19 nt, Neisseria meningitidis Z2491
cgaacccguuuggcaaggu

SEQ ID NO: 3369279 - RNA, 17 nt, Neisseria meningitidis Z2491
cgaaccgaaacggcgca

SEQ ID NO: 3369280 - RNA, 17 nt, Neisseria meningitidis Z2491
cgaaccgucauucccgc

SEQ ID NO: 3369281 - RNA, 16 nt, Neisseria meningitidis Z2491
cgaacggagccagccc

SEQ ID NO: 3369282 - RNA, 16 nt, Neisseria meningitidis Z2491
cgaacugccugcaacg

SEQ ID NO: 3369283 - RNA, 23 nt, Neisseria meningitidis Z2491
cgaagacuuuaaucauguugccg

SEQ ID NO: 3369284 - RNA, 16 nt, Neisseria meningitidis Z2491
cgaagauauagauuuc

SEQ ID NO: 3369285 - RNA, 16 nt, Neisseria meningitidis Z2491
cgaagaugggaauccg

SEQ ID NO: 3369286 - RNA, 14 nt, Neisseria meningitidis Z2491
cgaagccgaagaca

SEQ ID NO: 3369287 - RNA, 15 nt, Neisseria meningitidis Z2491
cgaagccgcagacag

SEQ ID NO: 3369288 - RNA, 14 nt, Neisseria meningitidis Z2491
cgaagcgguuuugu

SEQ ID NO: 3369289 - RNA, 12 nt, Neisseria meningitidis Z2491
cgaagcugcaga

SEQ ID NO: 3369290 - RNA, 15 nt, Neisseria meningitidis Z2491
cgaagcugcagacag

SEQ ID NO: 3369291 - RNA, 16 nt, Neisseria meningitidis Z2491
cgaaggcgaccgccug

SEQ ID NO: 3369292 - RNA, 15 nt, Neisseria meningitidis Z2491
cgaagggaaacuggu

SEQ ID NO: 3369293 - RNA, 13 nt, Neisseria meningitidis Z2491
cgaaguuuaaaga

SEQ ID NO: 3369294 - RNA, 17 nt, Neisseria meningitidis Z2491
cgaaguuucagacggca

SEQ ID NO: 3369295 - RNA, 19 nt, Neisseria meningitidis Z2491
cgaauaaaaaauauggauc

SEQ ID NO: 3369296 - RNA, 21 nt, Neisseria meningitidis Z2491
cgaauauauaguggcuuaaau

SEQ ID NO: 3369297 - RNA, 19 nt, Neisseria meningitidis Z2491
cgcaauccgcccucucauu

SEQ ID NO: 3369298 - RNA, 21 nt, Neisseria meningitidis Z2491
cgcaauccgcccucucauuug

SEQ ID NO: 3369299 - RNA, 19 nt, Neisseria meningitidis Z2491
cgcaaucgaaaaagccgcc

SEQ ID NO: 3369300 - RNA, 17 nt, Neisseria meningitidis Z2491
cgcaaucuucaaacgau

SEQ ID NO: 3369301 - RNA, 15 nt, Neisseria meningitidis Z2491
cgcaaugccgucuga

SEQ ID NO: 3369302 - RNA, 13 nt, Neisseria meningitidis Z2491
cgcaauucguuuu

SEQ ID NO: 3369303 - RNA, 12 nt, Neisseria meningitidis Z2491
cgcacaagcccu

SEQ ID NO: 3369304 - RNA, 13 nt, Neisseria meningitidis Z2491
cgcacaagcccua

SEQ ID NO: 3369305 - RNA, 13 nt, Neisseria meningitidis Z2491
cgcacccaaacgg

SEQ ID NO: 3369306 - RNA, 13 nt, Neisseria meningitidis Z2491
cgcaccccgaccg

SEQ ID NO: 3369307 - RNA, 21 nt, Neisseria meningitidis Z2491
cgcaccccgaccgacacccug

SEQ ID NO: 3369308 - RNA, 22 nt, Neisseria meningitidis Z2491
cgcaccccgaccgacacccuga

SEQ ID NO: 3369309 - RNA, 17 nt, Neisseria meningitidis Z2491
cgcaccguuuuccaccg

SEQ ID NO: 3369310 - RNA, 14 nt, Neisseria meningitidis Z2491
cgcacgcaugaagc

SEQ ID NO: 3369311 - RNA, 21 nt, Neisseria meningitidis Z2491
cgcacucugaaagccagcggg

SEQ ID NO: 3369312 - RNA, 16 nt, Neisseria meningitidis Z2491
cgcacuggauucccgc

SEQ ID NO: 3369313 - RNA, 15 nt, Neisseria meningitidis Z2491
cgcagacaguacaga

SEQ ID NO: 3369314 - RNA, 18 nt, Neisseria meningitidis Z2491
cgcagaccguccacaagc

SEQ ID NO: 3369315 - RNA, 21 nt, Neisseria meningitidis Z2491
cgcagaccguccacaagccgc

SEQ ID NO: 3369316 - RNA, 21 nt, Neisseria meningitidis Z2491
cgcagcaaaauauggcugacu

SEQ ID NO: 3369317 - RNA, 20 nt, Neisseria meningitidis Z2491
cgcagcaguauuagaaccga

SEQ ID NO: 3369318 - RNA, 18 nt, Neisseria meningitidis Z2491
cgcaggcgggaauacaaa

SEQ ID NO: 3369319 - RNA, 22 nt, Neisseria meningitidis Z2491
cgcaggcgggaauacaaacauc

SEQ ID NO: 3369320 - RNA, 18 nt, Neisseria meningitidis Z2491
cgcaggcgguggcgagcc

SEQ ID NO: 3369321 - RNA, 21 nt, Neisseria meningitidis Z2491
cgcaggcuuuugaggcugccg

SEQ ID NO: 3369322 - RNA, 16 nt, Neisseria meningitidis Z2491
cgcaggugcagauguu

SEQ ID NO: 3369323 - RNA, 19 nt, Neisseria meningitidis Z2491
cgcaguuuuucgauguggu

SEQ ID NO: 3369324 - RNA, 17 nt, Neisseria meningitidis Z2491
cgcauaaccguaaccca

SEQ ID NO: 3369325 - RNA, 18 nt, Neisseria meningitidis Z2491
cgcauaguuuccggcaag

SEQ ID NO: 3369326 - RNA, 22 nt, Neisseria meningitidis Z2491
cgcaucguaaaaaugccgucug

SEQ ID NO: 3369327 - RNA, 19 nt, Neisseria meningitidis Z2491
cgcauggcuucuuugcugg

SEQ ID NO: 3369328 - RNA, 15 nt, Neisseria meningitidis Z2491
cgcauucagacggca

SEQ ID NO: 3369329 - RNA, 16 nt, Neisseria meningitidis Z2491
cgcauucagacggcau

SEQ ID NO: 3369330 - RNA, 17 nt, Neisseria meningitidis Z2491
cgcauucagacggcauc

SEQ ID NO: 3369331 - RNA, 22 nt, Neisseria meningitidis Z2491
cgcauugccgcaaucgccgguc

SEQ ID NO: 3369332 - RNA, 13 nt, Neisseria meningitidis Z2491
cgcauuguuggaa

SEQ ID NO: 3369333 - RNA, 14 nt, Neisseria meningitidis Z2491
cgcauuuuuaugcg

SEQ ID NO: 3369334 - RNA, 18 nt, Neisseria meningitidis Z2491
cgcauuuuuucugccauu

SEQ ID NO: 3369335 - RNA, 19 nt, Neisseria meningitidis Z2491
cgccaaacccaaccaagaa

SEQ ID NO: 3369336 - RNA, 14 nt, Neisseria meningitidis Z2491
cgccaaggcuuuca

SEQ ID NO: 3369337 - RNA, 17 nt, Neisseria meningitidis Z2491
cgccaaggcuuucagau

SEQ ID NO: 3369338 - RNA, 16 nt, Neisseria meningitidis Z2491
cgccacgccauuuguu

SEQ ID NO: 3369339 - RNA, 13 nt, Neisseria meningitidis Z2491
cgccacggcauaa

SEQ ID NO: 3369340 - RNA, 19 nt, Neisseria meningitidis Z2491
cgccacggcuuucgcgccg

SEQ ID NO: 3369341 - RNA, 15 nt, Neisseria meningitidis Z2491
cgccacuucgcgccg

SEQ ID NO: 3369342 - RNA, 12 nt, Neisseria meningitidis Z2491
cgccacuuuccg

SEQ ID NO: 3369343 - RNA, 21 nt, Neisseria meningitidis Z2491
cgccagacaggcuuuuuucug

SEQ ID NO: 3369344 - RNA, 18 nt, Neisseria meningitidis Z2491
cgccagcaacauuuccug

SEQ ID NO: 3369345 - RNA, 18 nt, Neisseria meningitidis Z2491
cgccagcaaucagggccu

SEQ ID NO: 3369346 - RNA, 17 nt, Neisseria meningitidis Z2491
cgccauaaucagcccga

SEQ ID NO: 3369347 - RNA, 14 nt, Neisseria meningitidis Z2491
cgccauaaugccca

SEQ ID NO: 3369348 - RNA, 18 nt, Neisseria meningitidis Z2491
cgccauauagacauuuuu

SEQ ID NO: 3369349 - RNA, 23 nt, Neisseria meningitidis Z2491
cgccauaugcaggucgugcgccg

SEQ ID NO: 3369350 - RNA, 18 nt, Neisseria meningitidis Z2491
cgccauauucgcacgcau

SEQ ID NO: 3369351 - RNA, 20 nt, Neisseria meningitidis Z2491
cgccaucaacauuugcgcag

SEQ ID NO: 3369352 - RNA, 17 nt, Neisseria meningitidis Z2491
cgccaucacguccgcca

SEQ ID NO: 3369353 - RNA, 17 nt, Neisseria meningitidis Z2491
cgccauccagcaaacgg

SEQ ID NO: 3369354 - RNA, 21 nt, Neisseria meningitidis Z2491
cgccauuggaagaagauuuuu

SEQ ID NO: 3369355 - RNA, 14 nt, Neisseria meningitidis Z2491
cgccauuuccaaac

SEQ ID NO: 3369356 - RNA, 18 nt, Neisseria meningitidis Z2491
cgcccaaccgugcggcac

SEQ ID NO: 3369357 - RNA, 16 nt, Neisseria meningitidis Z2491
cgcccagagccgcgac

SEQ ID NO: 3369358 - RNA, 13 nt, Neisseria meningitidis Z2491
cgcccagcagccc

SEQ ID NO: 3369359 - RNA, 20 nt, Neisseria meningitidis Z2491
cgcccaucgguuugacgcag

SEQ ID NO: 3369360 - RNA, 11 nt, Neisseria meningitidis Z2491
cgccccgccga

SEQ ID NO: 3369361 - RNA, 23 nt, Neisseria meningitidis Z2491
cgcccguuaccagcagugccgca

SEQ ID NO: 3369362 - RNA, 19 nt, Neisseria meningitidis Z2491
cgccgaacccgacuucuga

SEQ ID NO: 3369363 - RNA, 17 nt, Neisseria meningitidis Z2491
cgccgaacgagccguaa

SEQ ID NO: 3369364 - RNA, 14 nt, Neisseria meningitidis Z2491
cgccgacagcagcu

SEQ ID NO: 3369365 - RNA, 20 nt, Neisseria meningitidis Z2491
cgccgacugccgccgcgccu

SEQ ID NO: 3369366 - RNA, 13 nt, Neisseria meningitidis Z2491
cgccgaucugccc

SEQ ID NO: 3369367 - RNA, 16 nt, Neisseria meningitidis Z2491
cgccgauguuuuccug

SEQ ID NO: 3369368 - RNA, 18 nt, Neisseria meningitidis Z2491
cgccgccaugucgcgggc

SEQ ID NO: 3369369 - RNA, 20 nt, Neisseria meningitidis Z2491
cgccgccggaaagcugcccc

SEQ ID NO: 3369370 - RNA, 13 nt, Neisseria meningitidis Z2491
cgccgcgccgcuu

SEQ ID NO: 3369371 - RNA, 19 nt, Neisseria meningitidis Z2491
cgccggccuuaaggcggcu

SEQ ID NO: 3369372 - RNA, 21 nt, Neisseria meningitidis Z2491
cgccggggauuuggcugacca

SEQ ID NO: 3369373 - RNA, 23 nt, Neisseria meningitidis Z2491
cgccgguacccaaacuuccaaau

SEQ ID NO: 3369374 - RNA, 19 nt, Neisseria meningitidis Z2491
cgccgucauucccgcaaaa

SEQ ID NO: 3369375 - RNA, 12 nt, Neisseria meningitidis Z2491
cgccgucugaaa

SEQ ID NO: 3369376 - RNA, 15 nt, Neisseria meningitidis Z2491
cgccguuuugcagug

SEQ ID NO: 3369377 - RNA, 13 nt, Neisseria meningitidis Z2491
cgccucaaucgcg

SEQ ID NO: 3369378 - RNA, 20 nt, Neisseria meningitidis Z2491
cgccuccgcaccguuuucca

SEQ ID NO: 3369379 - RNA, 13 nt, Neisseria meningitidis Z2491
cgccucgccgaac

SEQ ID NO: 3369380 - RNA, 23 nt, Neisseria meningitidis Z2491
cgccugaacauuucagacggcau

SEQ ID NO: 3369381 - RNA, 15 nt, Neisseria meningitidis Z2491
cgccugagcaaaugc

SEQ ID NO: 3369382 - RNA, 21 nt, Neisseria meningitidis Z2491
cgccugcgcgggaaugacgau

SEQ ID NO: 3369383 - RNA, 16 nt, Neisseria meningitidis Z2491
cgccuuaaaaaacaaa

SEQ ID NO: 3369384 - RNA, 18 nt, Neisseria meningitidis Z2491
cgccuuacggauggcaua

SEQ ID NO: 3369385 - RNA, 19 nt, Neisseria meningitidis Z2491
cgccuuacggauggcauag

SEQ ID NO: 3369386 - RNA, 15 nt, Neisseria meningitidis Z2491
cgccuuccgcuucuu

SEQ ID NO: 3369387 - RNA, 23 nt, Neisseria meningitidis Z2491
cgccuuugccaccaauaccgccu

SEQ ID NO: 3369388 - RNA, 20 nt, Neisseria meningitidis Z2491
cgcgaaagcgggaaucuagu

SEQ ID NO: 3369389 - RNA, 23 nt, Neisseria meningitidis Z2491
cgcgaggcgugccuugccuucaa

SEQ ID NO: 3369390 - RNA, 14 nt, Neisseria meningitidis Z2491
cgcgaguucgagac

SEQ ID NO: 3369391 - RNA, 14 nt, Neisseria meningitidis Z2491
cgcgauaaggcgcg

SEQ ID NO: 3369392 - RNA, 17 nt, Neisseria meningitidis Z2491
cgcgaugucgcugccca

SEQ ID NO: 3369393 - RNA, 19 nt, Neisseria meningitidis Z2491
cgcgauuccggcgcggcgc

SEQ ID NO: 3369394 - RNA, 17 nt, Neisseria meningitidis Z2491
cgcgcaaacccgccuga

SEQ ID NO: 3369395 - RNA, 15 nt, Neisseria meningitidis Z2491
cgcgcaauuccugca

SEQ ID NO: 3369396 - RNA, 13 nt, Neisseria meningitidis Z2491
cgcgcaccagcaa

SEQ ID NO: 3369397 - RNA, 23 nt, Neisseria meningitidis Z2491
cgcgcaggcgggaaucuagaccu

SEQ ID NO: 3369398 - RNA, 20 nt, Neisseria meningitidis Z2491
cggcaucgguuucuucuucg

SEQ ID NO: 3369399 - RNA, 13 nt, Neisseria meningitidis Z2491
cggcaucuuccuu

SEQ ID NO: 3369400 - RNA, 17 nt, Neisseria meningitidis Z2491
cggcauucugcacgccg

SEQ ID NO: 3369401 - RNA, 14 nt, Neisseria meningitidis Z2491
cggcauuucauuau

SEQ ID NO: 3369402 - RNA, 14 nt, Neisseria meningitidis Z2491
cggcauuuccuuua

SEQ ID NO: 3369403 - RNA, 20 nt, Neisseria meningitidis Z2491
cggcauuuucaacagcagga

SEQ ID NO: 3369404 - RNA, 13 nt, Neisseria meningitidis Z2491
cggcauuuuccuu

SEQ ID NO: 3369405 - RNA, 14 nt, Neisseria meningitidis Z2491
cggcauuuuccuug

SEQ ID NO: 3369406 - RNA, 20 nt, Neisseria meningitidis Z2491
cggcauuuuuacaaggcagc

SEQ ID NO: 3369407 - RNA, 20 nt, Neisseria meningitidis Z2491
cggcauuuuuauugcuucau

SEQ ID NO: 3369408 - RNA, 21 nt, Neisseria meningitidis Z2491
cggcauuuuugaggauuauuc

SEQ ID NO: 3369409 - RNA, 22 nt, Neisseria meningitidis Z2491
cggcauuuuuuauccucggcag

SEQ ID NO: 3369410 - RNA, 14 nt, Neisseria meningitidis Z2491
cggcauuuuuucac

SEQ ID NO: 3369411 - RNA, 17 nt, Neisseria meningitidis Z2491
cggccaaaaaaacguca

SEQ ID NO: 3369412 - RNA, 19 nt, Neisseria meningitidis Z2491
cggccaaaaaaacgucauc

SEQ ID NO: 3369413 - RNA, 22 nt, Neisseria meningitidis Z2491
cggcccgaauugcgccgacagc

SEQ ID NO: 3369414 - RNA, 15 nt, Neisseria meningitidis Z2491
cggccggaaaaccuu

SEQ ID NO: 3369415 - RNA, 16 nt, Neisseria meningitidis Z2491
cggccugcccugccaa

SEQ ID NO: 3369416 - RNA, 13 nt, Neisseria meningitidis Z2491
cggcgagccgcag

SEQ ID NO: 3369417 - RNA, 14 nt, Neisseria meningitidis Z2491
cggcgcaaccgccg

SEQ ID NO: 3369418 - RNA, 12 nt, Neisseria meningitidis Z2491
cggcgcaggcaa

SEQ ID NO: 3369419 - RNA, 18 nt, Neisseria meningitidis Z2491
cggcgcaguuaccgccca

SEQ ID NO: 3369420 - RNA, 12 nt, Neisseria meningitidis Z2491
cggcgcgggcgu

SEQ ID NO: 3369421 - RNA, 18 nt, Neisseria meningitidis Z2491
cggcgcguaucggcggca

SEQ ID NO: 3369422 - RNA, 18 nt, Neisseria meningitidis Z2491
cggcggcaaauuccguca

SEQ ID NO: 3369423 - RNA, 21 nt, Neisseria meningitidis Z2491
cggcggcaaauuccgucagca

SEQ ID NO: 3369424 - RNA, 23 nt, Neisseria meningitidis Z2491
cggcggcaacagaaauaaaagca

SEQ ID NO: 3369425 - RNA, 19 nt, Neisseria meningitidis Z2491
cggcggcaauaauggcaac

SEQ ID NO: 3369426 - RNA, 17 nt, Neisseria meningitidis Z2491
cggcggcgagcaggguu

SEQ ID NO: 3369427 - RNA, 14 nt, Neisseria meningitidis Z2491
cggcggcgcgggcg

SEQ ID NO: 3369428 - RNA, 10 nt, Neisseria meningitidis Z2491
cggcggcggc

SEQ ID NO: 3369429 - RNA, 15 nt, Neisseria meningitidis Z2491
cggcggcggcaggca

SEQ ID NO: 3369430 - RNA, 18 nt, Neisseria meningitidis Z2491
cggcggcgguuuccugca

SEQ ID NO: 3369431 - RNA, 17 nt, Neisseria meningitidis Z2491
cggcgggacgcgcgcca

SEQ ID NO: 3369432 - RNA, 14 nt, Neisseria meningitidis Z2491
cggcgggcaggcgg

SEQ ID NO: 3369433 - RNA, 16 nt, Neisseria meningitidis Z2491
cggcguuggcucgccu

SEQ ID NO: 3369434 - RNA, 15 nt, Neisseria meningitidis Z2491
cggcuacuccugcug

SEQ ID NO: 3369435 - RNA, 17 nt, Neisseria meningitidis Z2491
cggcuacuccugcugcg

SEQ ID NO: 3369436 - RNA, 13 nt, Neisseria meningitidis Z2491
cggcucgccgccu

SEQ ID NO: 3369437 - RNA, 21 nt, Neisseria meningitidis Z2491
cggcugaaaaaaugccgucug

SEQ ID NO: 3369438 - RNA, 19 nt, Neisseria meningitidis Z2491
cggcugccguaccggucag

SEQ ID NO: 3369439 - RNA, 19 nt, Neisseria meningitidis Z2491
cggcugcgggcgcguuuga

SEQ ID NO: 3369440 - RNA, 19 nt, Neisseria meningitidis Z2491
cggcugcugccuuggcgga

SEQ ID NO: 3369441 - RNA, 16 nt, Neisseria meningitidis Z2491
cggcugucgucauuuc

SEQ ID NO: 3369442 - RNA, 14 nt, Neisseria meningitidis Z2491
cggcuucgcgggcu

SEQ ID NO: 3369443 - RNA, 16 nt, Neisseria meningitidis Z2491
cggcuucgcgggcugc

SEQ ID NO: 3369444 - RNA, 15 nt, Neisseria meningitidis Z2491
cggcuugccgccgcc

SEQ ID NO: 3369445 - RNA, 16 nt, Neisseria meningitidis Z2491
cggcuuucagacggca

SEQ ID NO: 3369446 - RNA, 19 nt, Neisseria meningitidis Z2491
cgggaagccagggcggauu

SEQ ID NO: 3369447 - RNA, 15 nt, Neisseria meningitidis Z2491
cgggaauacaaacau

SEQ ID NO: 3369448 - RNA, 23 nt, Neisseria meningitidis Z2491
cgggaauacaaacaucugauuuu

SEQ ID NO: 3369449 - RNA, 12 nt, Neisseria meningitidis Z2491
cgggaauccaga

SEQ ID NO: 3369450 - RNA, 16 nt, Neisseria meningitidis Z2491
cgggaauccagacauu

SEQ ID NO: 3369451 - RNA, 12 nt, Neisseria meningitidis Z2491
cgggaauccagg

SEQ ID NO: 3369452 - RNA, 15 nt, Neisseria meningitidis Z2491
cgggaauccaggacg

SEQ ID NO: 3369453 - RNA, 19 nt, Neisseria meningitidis Z2491
cgggaauccggaaacgaaa

SEQ ID NO: 3369454 - RNA, 18 nt, Neisseria meningitidis Z2491
cgggaauccgguuuuuug

SEQ ID NO: 3369455 - RNA, 13 nt, Neisseria meningitidis Z2491
cgggaaucuagaa

SEQ ID NO: 3369456 - RNA, 17 nt, Neisseria meningitidis Z2491
cgggaaucuagaaauga

SEQ ID NO: 3369457 - RNA, 16 nt, Neisseria meningitidis Z2491
cgggaaucuagaccuu

SEQ ID NO: 3369458 - RNA, 22 nt, Neisseria meningitidis Z2491
cgggaaugacaaaauuaaaguu

SEQ ID NO: 3369459 - RNA, 21 nt, Neisseria meningitidis Z2491
cgggaaugacggcagagcggu

SEQ ID NO: 3369460 - RNA, 19 nt, Neisseria meningitidis Z2491
cgggacuuugcggcugugc

SEQ ID NO: 3369461 - RNA, 20 nt, Neisseria meningitidis Z2491
cgggacuuugcggcugugca

SEQ ID NO: 3369462 - RNA, 14 nt, Neisseria meningitidis Z2491
cgggauuuuaaagu

SEQ ID NO: 3369463 - RNA, 14 nt, Neisseria meningitidis Z2491
cgggcaaaagccag

SEQ ID NO: 3369464 - RNA, 12 nt, Neisseria meningitidis Z2491
cgggcaacggca

SEQ ID NO: 3369465 - RNA, 19 nt, Neisseria meningitidis Z2491
cgggcaacucgauuuccgc

SEQ ID NO: 3369466 - RNA, 21 nt, Neisseria meningitidis Z2491
cgggcaggcccaaaacaaaua

SEQ ID NO: 3369467 - RNA, 14 nt, Neisseria meningitidis Z2491
cgggcaggcggcug

SEQ ID NO: 3369468 - RNA, 12 nt, Neisseria meningitidis Z2491
cgggcaggcuga

SEQ ID NO: 3369469 - RNA, 18 nt, Neisseria meningitidis Z2491
cgggcagucuuccaaccc

SEQ ID NO: 3369470 - RNA, 22 nt, Neisseria meningitidis Z2491
cgggcccauugacaacgcagcc

SEQ ID NO: 3369471 - RNA, 16 nt, Neisseria meningitidis Z2491
cgggcggugcgcggca

SEQ ID NO: 3369472 - RNA, 21 nt, Neisseria meningitidis Z2491
cgggcguucagauuccugccg

SEQ ID NO: 3369473 - RNA, 23 nt, Neisseria meningitidis Z2491
cgggcguucgucuaagaaaacca

SEQ ID NO: 3369474 - RNA, 20 nt, Neisseria meningitidis Z2491
cgggcugcgucgcgggcggg

SEQ ID NO: 3369475 - RNA, 19 nt, Neisseria meningitidis Z2491
cggggaauuaugaugcgga

SEQ ID NO: 3369476 - RNA, 20 nt, Neisseria meningitidis Z2491
cggggauuuggcugaccagu

SEQ ID NO: 3369477 - RNA, 16 nt, Neisseria meningitidis Z2491
cggggguuuggcggga

SEQ ID NO: 3369478 - RNA, 21 nt, Neisseria meningitidis Z2491
cggggguuuggcgggaaugcc

SEQ ID NO: 3369479 - RNA, 22 nt, Neisseria meningitidis Z2491
cggggucaagcgcggaaguggg

SEQ ID NO: 3369480 - RNA, 15 nt, Neisseria meningitidis Z2491
cgggguugcgcggca

SEQ ID NO: 3369481 - RNA, 17 nt, Neisseria meningitidis Z2491
cgggguugcgcggcagg

SEQ ID NO: 3369482 - RNA, 12 nt, Neisseria meningitidis Z2491
cggguaacggca

SEQ ID NO: 3369483 - RNA, 16 nt, Neisseria meningitidis Z2491
cggguucagacggcau

SEQ ID NO: 3369484 - RNA, 17 nt, Neisseria meningitidis Z2491
cggguucagacggcauc

SEQ ID NO: 3369485 - RNA, 18 nt, Neisseria meningitidis Z2491
cggguucagacggcauca

SEQ ID NO: 3369486 - RNA, 17 nt, Neisseria meningitidis Z2491
cggguucggacggcauu

SEQ ID NO: 3369487 - RNA, 18 nt, Neisseria meningitidis Z2491
cggguucggauauuuccg

SEQ ID NO: 3369488 - RNA, 13 nt, Neisseria meningitidis Z2491
cggguuucagacg

SEQ ID NO: 3369489 - RNA, 18 nt, Neisseria meningitidis Z2491
cggguuucagacggcauu

SEQ ID NO: 3369490 - RNA, 15 nt, Neisseria meningitidis Z2491
cggguuuucgauuuc

SEQ ID NO: 3369491 - RNA, 20 nt, Neisseria meningitidis Z2491
cgguaaccacgacgcagacc

SEQ ID NO: 3369492 - RNA, 16 nt, Neisseria meningitidis Z2491
cgguaauuuccgacca

SEQ ID NO: 3369493 - RNA, 21 nt, Neisseria meningitidis Z2491
cgguacauccaauaauccgcc

SEQ ID NO: 3369494 - RNA, 15 nt, Neisseria meningitidis Z2491
cgguauaaaccaaaa

SEQ ID NO: 3369495 - RNA, 18 nt, Neisseria meningitidis Z2491
cgguaucaggcaguuuga

SEQ ID NO: 3369496 - RNA, 20 nt, Neisseria meningitidis Z2491
cggucaacccguaugccgcc

SEQ ID NO: 3369497 - RNA, 15 nt, Neisseria meningitidis Z2491
cgguccaacuucaau

SEQ ID NO: 3369498 - RNA, 19 nt, Neisseria meningitidis Z2491
cgguccaacuucaauagug

SEQ ID NO: 3369499 - RNA, 19 nt, Neisseria meningitidis Z2491
cggucgaaacuuuccaccg

SEQ ID NO: 3369500 - RNA, 16 nt, Neisseria meningitidis Z2491
cgugcgguguucagca

SEQ ID NO: 3369501 - RNA, 22 nt, Neisseria meningitidis Z2491
cguggaaucuaagaaaccguuu

SEQ ID NO: 3369502 - RNA, 21 nt, Neisseria meningitidis Z2491
cguggauagcgagacggcauc

SEQ ID NO: 3369503 - RNA, 16 nt, Neisseria meningitidis Z2491
cguggcaacuuccagc

SEQ ID NO: 3369504 - RNA, 12 nt, Neisseria meningitidis Z2491
cgugggaaugac

SEQ ID NO: 3369505 - RNA, 15 nt, Neisseria meningitidis Z2491
cgugugaaaauuuaa

SEQ ID NO: 3369506 - RNA, 16 nt, Neisseria meningitidis Z2491
cguguggaaaaagucc

SEQ ID NO: 3369507 - RNA, 16 nt, Neisseria meningitidis Z2491
cguguuuguuucagac

SEQ ID NO: 3369508 - RNA, 19 nt, Neisseria meningitidis Z2491
cguuaacgauacggcggca

SEQ ID NO: 3369509 - RNA, 16 nt, Neisseria meningitidis Z2491
cguuaagcgcggauac

SEQ ID NO: 3369510 - RNA, 15 nt, Neisseria meningitidis Z2491
cguuacaaauuuaaa

SEQ ID NO: 3369511 - RNA, 15 nt, Neisseria meningitidis Z2491
cuauaaaauuggaaa

SEQ ID NO: 3369512 - RNA, 13 nt, Neisseria meningitidis Z2491
cuauaacagcaac

SEQ ID NO: 3369513 - RNA, 15 nt, Neisseria meningitidis Z2491
cuauaaugauugacu

SEQ ID NO: 3369514 - RNA, 20 nt, Neisseria meningitidis Z2491
cuauaaugauugacuauuuu

SEQ ID NO: 3369515 - RNA, 20 nt, Neisseria meningitidis Z2491
cuauacaucaucuuauuuau

SEQ ID NO: 3369516 - RNA, 14 nt, Neisseria meningitidis Z2491
cuauaguggauuaa

SEQ ID NO: 3369517 - RNA, 16 nt, Neisseria meningitidis Z2491
cuauaguggauuaaca

SEQ ID NO: 3369518 - RNA, 20 nt, Neisseria meningitidis Z2491
cuauaguggauuaacaaaaa

SEQ ID NO: 3369519 - RNA, 21 nt, Neisseria meningitidis Z2491
cuauaguggauuaacaaaaac

SEQ ID NO: 3369520 - RNA, 21 nt, Neisseria meningitidis Z2491
cuauaguggauuaacaaaaau

SEQ ID NO: 3369521 - RNA, 18 nt, Neisseria meningitidis Z2491
cuauauauaguugauuaa

SEQ ID NO: 3369522 - RNA, 14 nt, Neisseria meningitidis Z2491
cuauauauucugau

SEQ ID NO: 3369523 - RNA, 17 nt, Neisseria meningitidis Z2491
cuauaucgguugaaacu

SEQ ID NO: 3369524 - RNA, 18 nt, Neisseria meningitidis Z2491
cuauaucgucauucccgc

SEQ ID NO: 3369525 - RNA, 13 nt, Neisseria meningitidis Z2491
cuauaucuauacu

SEQ ID NO: 3369526 - RNA, 21 nt, Neisseria meningitidis Z2491
cuauaugaaucgucauucccg

SEQ ID NO: 3369527 - RNA, 23 nt, Neisseria meningitidis Z2491
cuauaugaguguaucggugucaa

SEQ ID NO: 3369528 - RNA, 16 nt, Neisseria meningitidis Z2491
cuauauuuucgcaaga

SEQ ID NO: 3369529 - RNA, 20 nt, Neisseria meningitidis Z2491
cuaucauauagauuuuuaug

SEQ ID NO: 3369530 - RNA, 15 nt, Neisseria meningitidis Z2491
cuauccauuccugcg

SEQ ID NO: 3369531 - RNA, 23 nt, Neisseria meningitidis Z2491
cuaugccgagcaaaaucagcaca

SEQ ID NO: 3369532 - RNA, 19 nt, Neisseria meningitidis Z2491
cuaugccugccgaccccga

SEQ ID NO: 3369533 - RNA, 18 nt, Neisseria meningitidis Z2491
cuaugcggcaaaaccgga

SEQ ID NO: 3369534 - RNA, 21 nt, Neisseria meningitidis Z2491
cuauuuguucgauauuuuuga

SEQ ID NO: 3369535 - RNA, 13 nt, Neisseria meningitidis Z2491
cuauuuuacagcg

SEQ ID NO: 3369536 - RNA, 17 nt, Neisseria meningitidis Z2491
cuauuuuugugaaaaua

SEQ ID NO: 3369537 - RNA, 12 nt, Neisseria meningitidis Z2491
cuauuuuuuaau

SEQ ID NO: 3369538 - RNA, 19 nt, Neisseria meningitidis Z2491
cucaaaaaacuggauuccc

SEQ ID NO: 3369539 - RNA, 17 nt, Neisseria meningitidis Z2491
cucaaaaaaugccgucu

SEQ ID NO: 3369540 - RNA, 23 nt, Neisseria meningitidis Z2491
cucaaaaacagaaaaccaaaauc

SEQ ID NO: 3369541 - RNA, 21 nt, Neisseria meningitidis Z2491
cucaaaaagcuggauucccac

SEQ ID NO: 3369542 - RNA, 15 nt, Neisseria meningitidis Z2491
cucaaacuuucagau

SEQ ID NO: 3369543 - RNA, 12 nt, Neisseria meningitidis Z2491
cucaaagcugca

SEQ ID NO: 3369544 - RNA, 18 nt, Neisseria meningitidis Z2491
cucaaaguuauuaaguga

SEQ ID NO: 3369545 - RNA, 20 nt, Neisseria meningitidis Z2491
cucaaaucccgucauucccg

SEQ ID NO: 3369546 - RNA, 21 nt, Neisseria meningitidis Z2491
cucaaaucccgucauucccgc

SEQ ID NO: 3369547 - RNA, 14 nt, Neisseria meningitidis Z2491
cucaacacaccauc

SEQ ID NO: 3369548 - RNA, 20 nt, Neisseria meningitidis Z2491
cucaacgaaccuggauuccc

SEQ ID NO: 3369549 - RNA, 18 nt, Neisseria meningitidis Z2491
cucaacgcacuggauucc

SEQ ID NO: 3369550 - RNA, 14 nt, Neisseria meningitidis Z2491
cucaauauuaggaa

SEQ ID NO: 3369551 - RNA, 18 nt, Neisseria meningitidis Z2491
cucaaucccguugccaaa

SEQ ID NO: 3369552 - RNA, 15 nt, Neisseria meningitidis Z2491
cucaaucucauuuuc

SEQ ID NO: 3369553 - RNA, 19 nt, Neisseria meningitidis Z2491
cucacccugcaaggcggcg

SEQ ID NO: 3369554 - RNA, 20 nt, Neisseria meningitidis Z2491
cucacgcaggcuuuugaggc

SEQ ID NO: 3369555 - RNA, 15 nt, Neisseria meningitidis Z2491
cucagcuaugccugc

SEQ ID NO: 3369556 - RNA, 23 nt, Neisseria meningitidis Z2491
cucaguugguagagcgcaaccuu

SEQ ID NO: 3369557 - RNA, 18 nt, Neisseria meningitidis Z2491
cucauaguuuggacggcg

SEQ ID NO: 3369558 - RNA, 18 nt, Neisseria meningitidis Z2491
cucaucaucggcguaaua

SEQ ID NO: 3369559 - RNA, 22 nt, Neisseria meningitidis Z2491
cucaucaucggcguaauaauau

SEQ ID NO: 3369560 - RNA, 15 nt, Neisseria meningitidis Z2491
cucauugguaaacag

SEQ ID NO: 3369561 - RNA, 13 nt, Neisseria meningitidis Z2491
cucauuugccgaa

SEQ ID NO: 3369562 - RNA, 19 nt, Neisseria meningitidis Z2491
cuccaaguuccaauacauu

SEQ ID NO: 3369563 - RNA, 23 nt, Neisseria meningitidis Z2491
cuccacggacacccgauaaucag

SEQ ID NO: 3369564 - RNA, 20 nt, Neisseria meningitidis Z2491
cuccacggugugcaggcugc

SEQ ID NO: 3369565 - RNA, 16 nt, Neisseria meningitidis Z2491
cuccacuaaaaaaucc

SEQ ID NO: 3369566 - RNA, 16 nt, Neisseria meningitidis Z2491
cuccagcaccacaccu

SEQ ID NO: 3369567 - RNA, 14 nt, Neisseria meningitidis Z2491
cuccaucaggccgc

SEQ ID NO: 3369568 - RNA, 13 nt, Neisseria meningitidis Z2491
cucccaaauaaag

SEQ ID NO: 3369569 - RNA, 20 nt, Neisseria meningitidis Z2491
cucccaaucccgauaauaau

SEQ ID NO: 3369570 - RNA, 22 nt, Neisseria meningitidis Z2491
cuccccuacgccaaccucagcc

SEQ ID NO: 3369571 - RNA, 23 nt, Neisseria meningitidis Z2491
cucccgacagccgaaacccaaac

SEQ ID NO: 3369572 - RNA, 15 nt, Neisseria meningitidis Z2491
cuccgcaaacaaaau

SEQ ID NO: 3369573 - RNA, 20 nt, Neisseria meningitidis Z2491
cuccgcaaacaaaaugccgu

SEQ ID NO: 3369574 - RNA, 12 nt, Neisseria meningitidis Z2491
cuccgcaaacac

SEQ ID NO: 3369575 - RNA, 14 nt, Neisseria meningitidis Z2491
cuccgcaaacacca

SEQ ID NO: 3369576 - RNA, 18 nt, Neisseria meningitidis Z2491
cuccgcaaacaccagcau

SEQ ID NO: 3369577 - RNA, 16 nt, Neisseria meningitidis Z2491
cuccgccgucauuccc

SEQ ID NO: 3369578 - RNA, 14 nt, Neisseria meningitidis Z2491
cuccgccucugcca

SEQ ID NO: 3369579 - RNA, 17 nt, Neisseria meningitidis Z2491
cuccgccuguaugcggc

SEQ ID NO: 3369580 - RNA, 14 nt, Neisseria meningitidis Z2491
cuccggauuccugu

SEQ ID NO: 3369581 - RNA, 21 nt, Neisseria meningitidis Z2491
cuccguaaauuguccauuuuu

SEQ ID NO: 3369582 - RNA, 20 nt, Neisseria meningitidis Z2491
cuccguaucggcauauguuu

SEQ ID NO: 3369583 - RNA, 13 nt, Neisseria meningitidis Z2491
cuccugacggcaa

SEQ ID NO: 3369584 - RNA, 16 nt, Neisseria meningitidis Z2491
cuccugauaaaugccg

SEQ ID NO: 3369585 - RNA, 17 nt, Neisseria meningitidis Z2491
cuccugaucuaaaaauu

SEQ ID NO: 3369586 - RNA, 19 nt, Neisseria meningitidis Z2491
cucgauuuuguauccgucg

SEQ ID NO: 3369587 - RNA, 20 nt, Neisseria meningitidis Z2491
cucgccuuucguauccaaau

SEQ ID NO: 3369588 - RNA, 17 nt, Neisseria meningitidis Z2491
cucgcggcucgcccacg

SEQ ID NO: 3369589 - RNA, 23 nt, Neisseria meningitidis Z2491
cucgcuugcugguaacauuaacg

SEQ ID NO: 3369590 - RNA, 15 nt, Neisseria meningitidis Z2491
cucggaaaugacuga

SEQ ID NO: 3369591 - RNA, 14 nt, Neisseria meningitidis Z2491
cucggauuaauccg

SEQ ID NO: 3369592 - RNA, 17 nt, Neisseria meningitidis Z2491
cucggcaauuuccgccg

SEQ ID NO: 3369593 - RNA, 13 nt, Neisseria meningitidis Z2491
cucggccugcccu

SEQ ID NO: 3369594 - RNA, 18 nt, Neisseria meningitidis Z2491
cucggcguuuuucagacg

SEQ ID NO: 3369595 - RNA, 21 nt, Neisseria meningitidis Z2491
cucggcguuuuucagacggcc

SEQ ID NO: 3369596 - RNA, 18 nt, Neisseria meningitidis Z2491
cucgggcugaaucgccaa

SEQ ID NO: 3369597 - RNA, 19 nt, Neisseria meningitidis Z2491
cucgggcugaaucgccaau

SEQ ID NO: 3369598 - RNA, 22 nt, Neisseria meningitidis Z2491
cucguacacguccauacccaau

SEQ ID NO: 3369599 - RNA, 14 nt, Neisseria meningitidis Z2491
cucgucauuuccac

SEQ ID NO: 3369600 - RNA, 16 nt, Neisseria meningitidis Z2491
cucgucauuuccacaa

SEQ ID NO: 3369601 - RNA, 13 nt, Neisseria meningitidis Z2491
cucgucuucggca

SEQ ID NO: 3369602 - RNA, 16 nt, Neisseria meningitidis Z2491
cucguuauuuccacaa

SEQ ID NO: 3369603 - RNA, 17 nt, Neisseria meningitidis Z2491
cucguuauuuccacaaa

SEQ ID NO: 3369604 - RNA, 19 nt, Neisseria meningitidis Z2491
cucguuauuuccacaaaaa

SEQ ID NO: 3369605 - RNA, 14 nt, Neisseria meningitidis Z2491
cucguucggcagcc

SEQ ID NO: 3369606 - RNA, 17 nt, Neisseria meningitidis Z2491
cucguuucccgcuccaa

SEQ ID NO: 3369607 - RNA, 14 nt, Neisseria meningitidis Z2491
cucuaaaccgucau

SEQ ID NO: 3369608 - RNA, 14 nt, Neisseria meningitidis Z2491
cucuaaagcuucag

SEQ ID NO: 3369609 - RNA, 12 nt, Neisseria meningitidis Z2491
cucuauuuaaaa

SEQ ID NO: 3369610 - RNA, 19 nt, Neisseria meningitidis Z2491
cucuauuuaaaaauuccug

SEQ ID NO: 3369611 - RNA, 20 nt, Neisseria meningitidis Z2491
cucuauuuaaaaauuccugu

SEQ ID NO: 3369612 - RNA, 21 nt, Neisseria meningitidis Z2491
cuguauaguggauuaaauuua

SEQ ID NO: 3369613 - RNA, 20 nt, Neisseria meningitidis Z2491
cuguaugccgucugaaaccu

SEQ ID NO: 3369614 - RNA, 18 nt, Neisseria meningitidis Z2491
cugucaaacccuuuuucu

SEQ ID NO: 3369615 - RNA, 19 nt, Neisseria meningitidis Z2491
cugucgccgucauucccgc

SEQ ID NO: 3369616 - RNA, 12 nt, Neisseria meningitidis Z2491
cugucugaaacc

SEQ ID NO: 3369617 - RNA, 15 nt, Neisseria meningitidis Z2491
cugucugaaaccuga

SEQ ID NO: 3369618 - RNA, 13 nt, Neisseria meningitidis Z2491
cugucugcggcuu

SEQ ID NO: 3369619 - RNA, 20 nt, Neisseria meningitidis Z2491
cugugcccacacguuuugca

SEQ ID NO: 3369620 - RNA, 16 nt, Neisseria meningitidis Z2491
cugugccuguuuaaau

SEQ ID NO: 3369621 - RNA, 15 nt, Neisseria meningitidis Z2491
cuguggauaaguaaa

SEQ ID NO: 3369622 - RNA, 13 nt, Neisseria meningitidis Z2491
cugugguuuaacu

SEQ ID NO: 3369623 - RNA, 15 nt, Neisseria meningitidis Z2491
cugugguuugccgag

SEQ ID NO: 3369624 - RNA, 18 nt, Neisseria meningitidis Z2491
cuguguuccgggccgaug

SEQ ID NO: 3369625 - RNA, 15 nt, Neisseria meningitidis Z2491
cuguguugcggauga

SEQ ID NO: 3369626 - RNA, 11 nt, Neisseria meningitidis Z2491
cuguguuucaa

SEQ ID NO: 3369627 - RNA, 17 nt, Neisseria meningitidis Z2491
cuguugaaaaugccguc

SEQ ID NO: 3369628 - RNA, 23 nt, Neisseria meningitidis Z2491
cuguugaaaaugccgucugaaac

SEQ ID NO: 3369629 - RNA, 16 nt, Neisseria meningitidis Z2491
cuguugcacaaacaga

SEQ ID NO: 3369630 - RNA, 23 nt, Neisseria meningitidis Z2491
cuguugcacaaacagauuuuuug

SEQ ID NO: 3369631 - RNA, 11 nt, Neisseria meningitidis Z2491
cuguugcagau

SEQ ID NO: 3369632 - RNA, 19 nt, Neisseria meningitidis Z2491
cuguuggccgcuuucaaca

SEQ ID NO: 3369633 - RNA, 16 nt, Neisseria meningitidis Z2491
cuguuucagacggcau

SEQ ID NO: 3369634 - RNA, 22 nt, Neisseria meningitidis Z2491
cuguuucagacggcauuuuugu

SEQ ID NO: 3369635 - RNA, 24 nt, Neisseria meningitidis Z2491
cuguuuccaagccgcauugucccu

SEQ ID NO: 3369636 - RNA, 18 nt, Neisseria meningitidis Z2491
cuguuucgggcaaaagcc

SEQ ID NO: 3369637 - RNA, 23 nt, Neisseria meningitidis Z2491
cuguuucggguuucagacggcau

SEQ ID NO: 3369638 - RNA, 21 nt, Neisseria meningitidis Z2491
cuguuucgguuuucuauuuug

SEQ ID NO: 3369639 - RNA, 22 nt, Neisseria meningitidis Z2491
cuguuugaauggaaaugccguc

SEQ ID NO: 3369640 - RNA, 12 nt, Neisseria meningitidis Z2491
cuguuuggcuuu

SEQ ID NO: 3369641 - RNA, 18 nt, Neisseria meningitidis Z2491
cuguuuggcuuuuuucug

SEQ ID NO: 3369642 - RNA, 17 nt, Neisseria meningitidis Z2491
cuguuuuugagggaaug

SEQ ID NO: 3369643 - RNA, 13 nt, Neisseria meningitidis Z2491
cuuaaaaaacaaa

SEQ ID NO: 3369644 - RNA, 23 nt, Neisseria meningitidis Z2491
cuuaaaaaacaaacaggcagccu

SEQ ID NO: 3369645 - RNA, 13 nt, Neisseria meningitidis Z2491
cuuaaaaaacaac

SEQ ID NO: 3369646 - RNA, 14 nt, Neisseria meningitidis Z2491
cuuaaaaaacaacu

SEQ ID NO: 3369647 - RNA, 12 nt, Neisseria meningitidis Z2491
cuuaaaauuccg

SEQ ID NO: 3369648 - RNA, 17 nt, Neisseria meningitidis Z2491
cuuaaaauugccaacac

SEQ ID NO: 3369649 - RNA, 13 nt, Neisseria meningitidis Z2491
cuuaaaauuucau

SEQ ID NO: 3369650 - RNA, 21 nt, Neisseria meningitidis Z2491
cuuaaaauuucaucauuccca

SEQ ID NO: 3369651 - RNA, 13 nt, Neisseria meningitidis Z2491
cuuaaacagcacu

SEQ ID NO: 3369652 - RNA, 16 nt, Neisseria meningitidis Z2491
cuuaaaccuuauccau

SEQ ID NO: 3369653 - RNA, 22 nt, Neisseria meningitidis Z2491
cuuaacagggaaagcagcagcc

SEQ ID NO: 3369654 - RNA, 12 nt, Neisseria meningitidis Z2491
cuuaaggcggcu

SEQ ID NO: 3369655 - RNA, 20 nt, Neisseria meningitidis Z2491
cuuacaauccgcuuuuuaaa

SEQ ID NO: 3369656 - RNA, 22 nt, Neisseria meningitidis Z2491
cuuacaauccgcuuuuuaaaca

SEQ ID NO: 3369657 - RNA, 19 nt, Neisseria meningitidis Z2491
cuuacucguucggcagccu

SEQ ID NO: 3369658 - RNA, 13 nt, Neisseria meningitidis Z2491
cuuagcucaaaga

SEQ ID NO: 3369659 - RNA, 14 nt, Neisseria meningitidis Z2491
cuuagcucaaagag

SEQ ID NO: 3369660 - RNA, 17 nt, Neisseria meningitidis Z2491
cuuagcucaaagagaac

SEQ ID NO: 3369661 - RNA, 22 nt, Neisseria meningitidis Z2491
cuuauacacacgguuuucacau

SEQ ID NO: 3369662 - RNA, 20 nt, Neisseria meningitidis Z2491
cuuauagucugagacggcgg

SEQ ID NO: 3369663 - RNA, 11 nt, Neisseria meningitidis Z2491
cuuauaucguc

SEQ ID NO: 3369664 - RNA, 14 nt, Neisseria meningitidis Z2491
cuuauccauaucca

SEQ ID NO: 3369665 - RNA, 22 nt, Neisseria meningitidis Z2491
cuuaucggcaaaaaaaucgcug

SEQ ID NO: 3369666 - RNA, 14 nt, Neisseria meningitidis Z2491
cuuaugccuauuuu

SEQ ID NO: 3369667 - RNA, 15 nt, Neisseria meningitidis Z2491
cuuaugccuauuuuu

SEQ ID NO: 3369668 - RNA, 17 nt, Neisseria meningitidis Z2491
cuuaugccuuuuucaaa

SEQ ID NO: 3369669 - RNA, 16 nt, Neisseria meningitidis Z2491
cuuaugcuguugcaca

SEQ ID NO: 3369670 - RNA, 19 nt, Neisseria meningitidis Z2491
cuuauguauaguaauaaau

SEQ ID NO: 3369671 - RNA, 23 nt, Neisseria meningitidis Z2491
cuuauguauaguaauaaauuaau

SEQ ID NO: 3369672 - RNA, 15 nt, Neisseria meningitidis Z2491
cuuauuuucaaaaug

SEQ ID NO: 3369673 - RNA, 17 nt, Neisseria meningitidis Z2491
cuucaaaccccuucaaa

SEQ ID NO: 3369674 - RNA, 17 nt, Neisseria meningitidis Z2491
cuucaaaggaaacauag

SEQ ID NO: 3369675 - RNA, 23 nt, Neisseria meningitidis Z2491
cuucaaaggaaacauagccuuca

SEQ ID NO: 3369676 - RNA, 20 nt, Neisseria meningitidis Z2491
cuucaaaucguuuugcgcca

SEQ ID NO: 3369677 - RNA, 16 nt, Neisseria meningitidis Z2491
cuucacgaguccaaga

SEQ ID NO: 3369678 - RNA, 12 nt, Neisseria meningitidis Z2491
cuucagacggca

SEQ ID NO: 3369679 - RNA, 20 nt, Neisseria meningitidis Z2491
cuucagacggcauuuuguuu

SEQ ID NO: 3369680 - RNA, 17 nt, Neisseria meningitidis Z2491
cuucagcaccuuagaga

SEQ ID NO: 3369681 - RNA, 19 nt, Neisseria meningitidis Z2491
cuucagcucucccucuuua

SEQ ID NO: 3369682 - RNA, 21 nt, Neisseria meningitidis Z2491
cuucagcucucccucuuuaaa

SEQ ID NO: 3369683 - RNA, 16 nt, Neisseria meningitidis Z2491
cuucaucaaaauccgg

SEQ ID NO: 3369684 - RNA, 19 nt, Neisseria meningitidis Z2491
cuucaucucgccaaucuca

SEQ ID NO: 3369685 - RNA, 15 nt, Neisseria meningitidis Z2491
cuucaugcggcgggc

SEQ ID NO: 3369686 - RNA, 20 nt, Neisseria meningitidis Z2491
cuucauuccgcgcaggcgga

SEQ ID NO: 3369687 - RNA, 18 nt, Neisseria meningitidis Z2491
cuuccaaaagcgucauca

SEQ ID NO: 3369688 - RNA, 11 nt, Neisseria meningitidis Z2491
cuuccaaaccg

SEQ ID NO: 3369689 - RNA, 21 nt, Neisseria meningitidis Z2491
cuuccaaagcugcaguugggc

SEQ ID NO: 3369690 - RNA, 19 nt, Neisseria meningitidis Z2491
cuuccaacccuccgccgca

SEQ ID NO: 3369691 - RNA, 21 nt, Neisseria meningitidis Z2491
cuuccaaggcacgguaaaccg

SEQ ID NO: 3369692 - RNA, 21 nt, Neisseria meningitidis Z2491
cuuccagaccagccgccucca

SEQ ID NO: 3369693 - RNA, 15 nt, Neisseria meningitidis Z2491
cuuccagcgcaccuc

SEQ ID NO: 3369694 - RNA, 22 nt, Neisseria meningitidis Z2491
cuuccaguugcgggccuuuggc

SEQ ID NO: 3369695 - RNA, 17 nt, Neisseria meningitidis Z2491
cuuccauuugagccgca

SEQ ID NO: 3369696 - RNA, 18 nt, Neisseria meningitidis Z2491
cuucccgcaaaaacggaa

SEQ ID NO: 3369697 - RNA, 14 nt, Neisseria meningitidis Z2491
cuucccgcgccaau

SEQ ID NO: 3369698 - RNA, 12 nt, Neisseria meningitidis Z2491
cuucccucccga

SEQ ID NO: 3369699 - RNA, 20 nt, Neisseria meningitidis Z2491
cuuccgaaauauuacccaac

SEQ ID NO: 3369700 - RNA, 15 nt, Neisseria meningitidis Z2491
cuuccgaggcggcuu

SEQ ID NO: 3369701 - RNA, 14 nt, Neisseria meningitidis Z2491
cuuccgcaggcucc

SEQ ID NO: 3369702 - RNA, 15 nt, Neisseria meningitidis Z2491
cuuccgcuucuucca

SEQ ID NO: 3369703 - RNA, 23 nt, Neisseria meningitidis Z2491
cuuccgugucaggaugucugccu

SEQ ID NO: 3369704 - RNA, 19 nt, Neisseria meningitidis Z2491
cuuccguguguauagugga

SEQ ID NO: 3369705 - RNA, 13 nt, Neisseria meningitidis Z2491
cuuccuuuuuaaa

SEQ ID NO: 3369706 - RNA, 14 nt, Neisseria meningitidis Z2491
cuucgacgaaggcu

SEQ ID NO: 3369707 - RNA, 22 nt, Neisseria meningitidis Z2491
cuucgauguguucgcauuuugc

SEQ ID NO: 3369708 - RNA, 14 nt, Neisseria meningitidis Z2491
cuucgauugccaag

SEQ ID NO: 3369709 - RNA, 18 nt, Neisseria meningitidis Z2491
cuucgccgaccagcggcg

SEQ ID NO: 3369710 - RNA, 16 nt, Neisseria meningitidis Z2491
cuucgccgagucggcg

SEQ ID NO: 3369711 - RNA, 13 nt, Neisseria meningitidis Z2491
cuucgcgggacau

SEQ ID NO: 3369712 - RNA, 16 nt, Neisseria meningitidis Z2491
cuucgcucugcgcgcu

SEQ ID NO: 3369713 - RNA, 12 nt, Neisseria meningitidis Z2491
cuuuuuaaucca

SEQ ID NO: 3369714 - RNA, 12 nt, Neisseria meningitidis Z2491
cuuuuucagacg

SEQ ID NO: 3369715 - RNA, 12 nt, Neisseria meningitidis Z2491
cuuuuuccagca

SEQ ID NO: 3369716 - RNA, 10 nt, Neisseria meningitidis Z2491
cuuuuuccug

SEQ ID NO: 3369717 - RNA, 21 nt, Neisseria meningitidis Z2491
cuuuuugcaggaucuuaucca

SEQ ID NO: 3369718 - RNA, 19 nt, Neisseria meningitidis Z2491
cuuuuugcgccagcggcac

SEQ ID NO: 3369719 - RNA, 13 nt, Neisseria meningitidis Z2491
cuuuuugcucaau

SEQ ID NO: 3369720 - RNA, 18 nt, Neisseria meningitidis Z2491
cuuuuuggcgcauuuuuu

SEQ ID NO: 3369721 - RNA, 17 nt, Neisseria meningitidis Z2491
gaaaaaaugccgucuga

SEQ ID NO: 3369722 - RNA, 18 nt, Neisseria meningitidis Z2491
gaaaaaaugccgucugaa

SEQ ID NO: 3369723 - RNA, 20 nt, Neisseria meningitidis Z2491
gaaaaacagcaaucaaaaua

SEQ ID NO: 3369724 - RNA, 22 nt, Neisseria meningitidis Z2491
gaaaaaucuguggauaaacauu

SEQ ID NO: 3369725 - RNA, 15 nt, Neisseria meningitidis Z2491
gaaaacagaaaccua

SEQ ID NO: 3369726 - RNA, 12 nt, Neisseria meningitidis Z2491
gaaaacagaaag

SEQ ID NO: 3369727 - RNA, 16 nt, Neisseria meningitidis Z2491
gaaaaccaaaaucaga

SEQ ID NO: 3369728 - RNA, 14 nt, Neisseria meningitidis Z2491
gaaaaccuguguuu

SEQ ID NO: 3369729 - RNA, 15 nt, Neisseria meningitidis Z2491
gaaaaccuuucagac

SEQ ID NO: 3369730 - RNA, 16 nt, Neisseria meningitidis Z2491
gaaaacgccgucugaa

SEQ ID NO: 3369731 - RNA, 17 nt, Neisseria meningitidis Z2491
gaaaacgccgucugaaa

SEQ ID NO: 3369732 - RNA, 23 nt, Neisseria meningitidis Z2491
gaaaacgcuguuuuuuguugccu

SEQ ID NO: 3369733 - RNA, 18 nt, Neisseria meningitidis Z2491
gaaaacgggaaucuagaa

SEQ ID NO: 3369734 - RNA, 21 nt, Neisseria meningitidis Z2491
gaaaagcaagacguagcgugg

SEQ ID NO: 3369735 - RNA, 15 nt, Neisseria meningitidis Z2491
gaaaaggucgucuga

SEQ ID NO: 3369736 - RNA, 21 nt, Neisseria meningitidis Z2491
gaaaaguacaaaaugccgucu

SEQ ID NO: 3369737 - RNA, 18 nt, Neisseria meningitidis Z2491
gaaaagugcgguaaauuu

SEQ ID NO: 3369738 - RNA, 19 nt, Neisseria meningitidis Z2491
gaaaagugcgguaaauuuu

SEQ ID NO: 3369739 - RNA, 14 nt, Neisseria meningitidis Z2491
gaaaauaccguuga

SEQ ID NO: 3369740 - RNA, 17 nt, Neisseria meningitidis Z2491
gaaaauacggacgggaa

SEQ ID NO: 3369741 - RNA, 19 nt, Neisseria meningitidis Z2491
gaaaaucaaaaaaaaaccu

SEQ ID NO: 3369742 - RNA, 19 nt, Neisseria meningitidis Z2491
gaaaaucuugccauucuca

SEQ ID NO: 3369743 - RNA, 15 nt, Neisseria meningitidis Z2491
gaaaaugccgucuga

SEQ ID NO: 3369744 - RNA, 17 nt, Neisseria meningitidis Z2491
gaaaaugccgucugaaa

SEQ ID NO: 3369745 - RNA, 22 nt, Neisseria meningitidis Z2491
gaaaauuuaaaaggucuagauu

SEQ ID NO: 3369746 - RNA, 18 nt, Neisseria meningitidis Z2491
gaaaauuucuugauuuuu

SEQ ID NO: 3369747 - RNA, 19 nt, Neisseria meningitidis Z2491
gaaaauuucuugauuuuuc

SEQ ID NO: 3369748 - RNA, 17 nt, Neisseria meningitidis Z2491
gaaaauuugguaaugca

SEQ ID NO: 3369749 - RNA, 19 nt, Neisseria meningitidis Z2491
gaaacaaagcuuuaaacua

SEQ ID NO: 3369750 - RNA, 21 nt, Neisseria meningitidis Z2491
gaaacaacaaaaccuauccgc

SEQ ID NO: 3369751 - RNA, 18 nt, Neisseria meningitidis Z2491
gaaacagaucgguuuccc

SEQ ID NO: 3369752 - RNA, 21 nt, Neisseria meningitidis Z2491
gaaacagguuucagacggcau

SEQ ID NO: 3369753 - RNA, 22 nt, Neisseria meningitidis Z2491
gaaacaucauuggcaacuauua

SEQ ID NO: 3369754 - RNA, 14 nt, Neisseria meningitidis Z2491
gaaaccaaaagcca

SEQ ID NO: 3369755 - RNA, 19 nt, Neisseria meningitidis Z2491
gaaaccaaaagccaaaaaa

SEQ ID NO: 3369756 - RNA, 21 nt, Neisseria meningitidis Z2491
gaaaccaaaucggcuuucaga

SEQ ID NO: 3369757 - RNA, 22 nt, Neisseria meningitidis Z2491
gaaaccacacccguuaaggcag

SEQ ID NO: 3369758 - RNA, 15 nt, Neisseria meningitidis Z2491
gaaacccaaacacag

SEQ ID NO: 3369759 - RNA, 18 nt, Neisseria meningitidis Z2491
gaaacccgauguuuucaa

SEQ ID NO: 3369760 - RNA, 19 nt, Neisseria meningitidis Z2491
gaaacccgucauucccacg

SEQ ID NO: 3369761 - RNA, 21 nt, Neisseria meningitidis Z2491
gaaaccggcuucagacggcau

SEQ ID NO: 3369762 - RNA, 23 nt, Neisseria meningitidis Z2491
gaaaccguauauuucccgucugc

SEQ ID NO: 3369763 - RNA, 16 nt, Neisseria meningitidis Z2491
gaaaccugaaaacaga

SEQ ID NO: 3369764 - RNA, 18 nt, Neisseria meningitidis Z2491
gaaaccugaaaacagaaa

SEQ ID NO: 3369765 - RNA, 15 nt, Neisseria meningitidis Z2491
gaaaccugcaacguu

SEQ ID NO: 3369766 - RNA, 22 nt, Neisseria meningitidis Z2491
gaaaccuguaccguuucagacg

SEQ ID NO: 3369767 - RNA, 20 nt, Neisseria meningitidis Z2491
gaaacggagauucccguuuc

SEQ ID NO: 3369768 - RNA, 22 nt, Neisseria meningitidis Z2491
gaaacggcauccuugaucugcg

SEQ ID NO: 3369769 - RNA, 22 nt, Neisseria meningitidis Z2491
gaaacguguaccgucaaauucu

SEQ ID NO: 3369770 - RNA, 18 nt, Neisseria meningitidis Z2491
gaaacucaaaaagcugga

SEQ ID NO: 3369771 - RNA, 16 nt, Neisseria meningitidis Z2491
gaaacucaaagcugca

SEQ ID NO: 3369772 - RNA, 19 nt, Neisseria meningitidis Z2491
gaaacucaacgaaccugga

SEQ ID NO: 3369773 - RNA, 16 nt, Neisseria meningitidis Z2491
gaaacucuaaucccgu

SEQ ID NO: 3369774 - RNA, 17 nt, Neisseria meningitidis Z2491
gaaacugguaucugcau

SEQ ID NO: 3369775 - RNA, 16 nt, Neisseria meningitidis Z2491
gaaacuuuaaucccgu

SEQ ID NO: 3369776 - RNA, 12 nt, Neisseria meningitidis Z2491
gaaagcaaagcc

SEQ ID NO: 3369777 - RNA, 15 nt, Neisseria meningitidis Z2491
gaaagcagaaauaag

SEQ ID NO: 3369778 - RNA, 17 nt, Neisseria meningitidis Z2491
gaaagcagaaauaagga

SEQ ID NO: 3369779 - RNA, 19 nt, Neisseria meningitidis Z2491
gaaagccuuucagacggca

SEQ ID NO: 3369780 - RNA, 20 nt, Neisseria meningitidis Z2491
gaaagccuuucagacggcau

SEQ ID NO: 3369781 - RNA, 15 nt, Neisseria meningitidis Z2491
gaaagcggaaaucca

SEQ ID NO: 3369782 - RNA, 14 nt, Neisseria meningitidis Z2491
gaaagcgggaaucu

SEQ ID NO: 3369783 - RNA, 18 nt, Neisseria meningitidis Z2491
gaaaggcuuucagacggc

SEQ ID NO: 3369784 - RNA, 19 nt, Neisseria meningitidis Z2491
gaaaggcuuucagacggca

SEQ ID NO: 3369785 - RNA, 15 nt, Neisseria meningitidis Z2491
gaaaggcuuuuucag

SEQ ID NO: 3369786 - RNA, 18 nt, Neisseria meningitidis Z2491
gaaaggcuuuuucagacg

SEQ ID NO: 3369787 - RNA, 21 nt, Neisseria meningitidis Z2491
gaaagguugugggaauccaga

SEQ ID NO: 3369788 - RNA, 20 nt, Neisseria meningitidis Z2491
gaaagguuuucagacggcau

SEQ ID NO: 3369789 - RNA, 20 nt, Neisseria meningitidis Z2491
gaaaguaugugcgccgaggu

SEQ ID NO: 3369790 - RNA, 20 nt, Neisseria meningitidis Z2491
gaaagugauuuugucggcaa

SEQ ID NO: 3369791 - RNA, 13 nt, Neisseria meningitidis Z2491
gaaaguggaauug

SEQ ID NO: 3369792 - RNA, 14 nt, Neisseria meningitidis Z2491
gaaagugggaaucc

SEQ ID NO: 3369793 - RNA, 17 nt, Neisseria meningitidis Z2491
gaaagugggaauccaga

SEQ ID NO: 3369794 - RNA, 21 nt, Neisseria meningitidis Z2491
gaaaguuuagagguucuagau

SEQ ID NO: 3369795 - RNA, 20 nt, Neisseria meningitidis Z2491
gaaaguuugaaguucuagau

SEQ ID NO: 3369796 - RNA, 16 nt, Neisseria meningitidis Z2491
gaaaguuugccgaccc

SEQ ID NO: 3369797 - RNA, 14 nt, Neisseria meningitidis Z2491
gaaauaacucauca

SEQ ID NO: 3369798 - RNA, 15 nt, Neisseria meningitidis Z2491
gaaauaacucaucau

SEQ ID NO: 3369799 - RNA, 18 nt, Neisseria meningitidis Z2491
gaaauaagcgguuuuccc

SEQ ID NO: 3369800 - RNA, 21 nt, Neisseria meningitidis Z2491
gaaauaagcgguuuuccccug

SEQ ID NO: 3369801 - RNA, 17 nt, Neisseria meningitidis Z2491
gaaauaaggauauagag

SEQ ID NO: 3369802 - RNA, 17 nt, Neisseria meningitidis Z2491
gaaauacgauaaaguug

SEQ ID NO: 3369803 - RNA, 13 nt, Neisseria meningitidis Z2491
gaaauaggcugcc

SEQ ID NO: 3369804 - RNA, 13 nt, Neisseria meningitidis Z2491
gaaauaucgucau

SEQ ID NO: 3369805 - RNA, 21 nt, Neisseria meningitidis Z2491
gaaauaugguucagacggcau

SEQ ID NO: 3369806 - RNA, 21 nt, Neisseria meningitidis Z2491
gaaaucaauccuuccugauga

SEQ ID NO: 3369807 - RNA, 15 nt, Neisseria meningitidis Z2491
gaaaucauccacagc

SEQ ID NO: 3369808 - RNA, 16 nt, Neisseria meningitidis Z2491
gaaaucccaaacccuc

SEQ ID NO: 3369809 - RNA, 18 nt, Neisseria meningitidis Z2491
gaaauccuauuuucagau

SEQ ID NO: 3369810 - RNA, 21 nt, Neisseria meningitidis Z2491
gaaaugaaaaacgacgagaau

SEQ ID NO: 3369811 - RNA, 23 nt, Neisseria meningitidis Z2491
gaaaugaaaaacgacgagaauuu

SEQ ID NO: 3369812 - RNA, 19 nt, Neisseria meningitidis Z2491
gaaaugacggaaacucaaa

SEQ ID NO: 3369813 - RNA, 22 nt, Neisseria meningitidis Z2491
gaaaugacggaaacucaaaaaa

SEQ ID NO: 3369814 - RNA, 13 nt, Neisseria meningitidis Z2491
gaauacuucuucu

SEQ ID NO: 3369815 - RNA, 16 nt, Neisseria meningitidis Z2491
gaauacuucuucugua

SEQ ID NO: 3369816 - RNA, 11 nt, Neisseria meningitidis Z2491
gaauagcucag

SEQ ID NO: 3369817 - RNA, 15 nt, Neisseria meningitidis Z2491
gaauaggacaaaugc

SEQ ID NO: 3369818 - RNA, 16 nt, Neisseria meningitidis Z2491
gaauagucaggcugcc

SEQ ID NO: 3369819 - RNA, 19 nt, Neisseria meningitidis Z2491
gaauauuacuguuguucua

SEQ ID NO: 3369820 - RNA, 14 nt, Neisseria meningitidis Z2491
gaauauugccgucg

SEQ ID NO: 3369821 - RNA, 14 nt, Neisseria meningitidis Z2491
gaaucaaauauuaa

SEQ ID NO: 3369822 - RNA, 20 nt, Neisseria meningitidis Z2491
gaaucaaauauuaaaaaccg

SEQ ID NO: 3369823 - RNA, 12 nt, Neisseria meningitidis Z2491
gaaucacaauau

SEQ ID NO: 3369824 - RNA, 18 nt, Neisseria meningitidis Z2491
gaaucacuuggucuuugc

SEQ ID NO: 3369825 - RNA, 16 nt, Neisseria meningitidis Z2491
gaauccagacauucaa

SEQ ID NO: 3369826 - RNA, 21 nt, Neisseria meningitidis Z2491
gaauccggagucucagggcug

SEQ ID NO: 3369827 - RNA, 18 nt, Neisseria meningitidis Z2491
gaaucgaguacgcgggca

SEQ ID NO: 3369828 - RNA, 15 nt, Neisseria meningitidis Z2491
gaaucgccuccgcac

SEQ ID NO: 3369829 - RNA, 17 nt, Neisseria meningitidis Z2491
gaaucggguuucagacg

SEQ ID NO: 3369830 - RNA, 21 nt, Neisseria meningitidis Z2491
gaaucggguuucagacggcau

SEQ ID NO: 3369831 - RNA, 15 nt, Neisseria meningitidis Z2491
gaaucguucucuuug

SEQ ID NO: 3369832 - RNA, 17 nt, Neisseria meningitidis Z2491
gaaucuagaaacgcaaa

SEQ ID NO: 3369833 - RNA, 15 nt, Neisseria meningitidis Z2491
gaaucuagaaacuca

SEQ ID NO: 3369834 - RNA, 21 nt, Neisseria meningitidis Z2491
gaaucuagaaacucaaagcug

SEQ ID NO: 3369835 - RNA, 15 nt, Neisseria meningitidis Z2491
gaaucuagaaaugaa

SEQ ID NO: 3369836 - RNA, 23 nt, Neisseria meningitidis Z2491
gaaucuagacauucaaugcuaag

SEQ ID NO: 3369837 - RNA, 14 nt, Neisseria meningitidis Z2491
gaaucucuaaagcu

SEQ ID NO: 3369838 - RNA, 19 nt, Neisseria meningitidis Z2491
gaaucuggaaaccaaaaaa

SEQ ID NO: 3369839 - RNA, 23 nt, Neisseria meningitidis Z2491
gaaucuucuuuugugguuuuaac

SEQ ID NO: 3369840 - RNA, 14 nt, Neisseria meningitidis Z2491
gaaugacgaaauuu

SEQ ID NO: 3369841 - RNA, 22 nt, Neisseria meningitidis Z2491
gaaugacggcggaaggguuuug

SEQ ID NO: 3369842 - RNA, 21 nt, Neisseria meningitidis Z2491
gaaugacguggugcagguuuc

SEQ ID NO: 3369843 - RNA, 14 nt, Neisseria meningitidis Z2491
gaaugacguggugu

SEQ ID NO: 3369844 - RNA, 17 nt, Neisseria meningitidis Z2491
gaaugacugaaacucaa

SEQ ID NO: 3369845 - RNA, 21 nt, Neisseria meningitidis Z2491
gaaugacuguccgagacagaa

SEQ ID NO: 3369846 - RNA, 14 nt, Neisseria meningitidis Z2491
gaaugccacacgca

SEQ ID NO: 3369847 - RNA, 20 nt, Neisseria meningitidis Z2491
gaaugccgcaaaugccgucu

SEQ ID NO: 3369848 - RNA, 21 nt, Neisseria meningitidis Z2491
gaaugccuuucucuguuuuuc

SEQ ID NO: 3369849 - RNA, 17 nt, Neisseria meningitidis Z2491
gaauggaaaugccgucu

SEQ ID NO: 3369850 - RNA, 18 nt, Neisseria meningitidis Z2491
gaauguagguucguggga

SEQ ID NO: 3369851 - RNA, 17 nt, Neisseria meningitidis Z2491
gaaugucuagauucccg

SEQ ID NO: 3369852 - RNA, 15 nt, Neisseria meningitidis Z2491
gaauuaaaugcuaaa

SEQ ID NO: 3369853 - RNA, 17 nt, Neisseria meningitidis Z2491
gaauuaaaugcuaaaua

SEQ ID NO: 3369854 - RNA, 14 nt, Neisseria meningitidis Z2491
gaauuaacaaaaau

SEQ ID NO: 3369855 - RNA, 15 nt, Neisseria meningitidis Z2491
gaauuuauacccucu

SEQ ID NO: 3369856 - RNA, 13 nt, Neisseria meningitidis Z2491
gaauuuaucagaa

SEQ ID NO: 3369857 - RNA, 17 nt, Neisseria meningitidis Z2491
gaauuuauccgaaacaa

SEQ ID NO: 3369858 - RNA, 19 nt, Neisseria meningitidis Z2491
gaauuucuguuuuugugag

SEQ ID NO: 3369859 - RNA, 22 nt, Neisseria meningitidis Z2491
gaauuugcggcaaauuuacagc

SEQ ID NO: 3369860 - RNA, 12 nt, Neisseria meningitidis Z2491
gaauuuugcaaa

SEQ ID NO: 3369861 - RNA, 19 nt, Neisseria meningitidis Z2491
gacaaaaauaccgucugaa

SEQ ID NO: 3369862 - RNA, 22 nt, Neisseria meningitidis Z2491
gacaaaaauaccgucugaaacc

SEQ ID NO: 3369863 - RNA, 16 nt, Neisseria meningitidis Z2491
gacaaaauccaguucg

SEQ ID NO: 3369864 - RNA, 16 nt, Neisseria meningitidis Z2491
gacaaaugccgccagc

SEQ ID NO: 3369865 - RNA, 19 nt, Neisseria meningitidis Z2491
gacaaaugccgccagccac

SEQ ID NO: 3369866 - RNA, 21 nt, Neisseria meningitidis Z2491
gacaagacgacaggcggcgga

SEQ ID NO: 3369867 - RNA, 17 nt, Neisseria meningitidis Z2491
gacaaggcgacaaagcc

SEQ ID NO: 3369868 - RNA, 15 nt, Neisseria meningitidis Z2491
gacaaggcggcgagc

SEQ ID NO: 3369869 - RNA, 16 nt, Neisseria meningitidis Z2491
gacaauacggcggcgg

SEQ ID NO: 3369870 - RNA, 17 nt, Neisseria meningitidis Z2491
gacaauacggcggcggc

SEQ ID NO: 3369871 - RNA, 22 nt, Neisseria meningitidis Z2491
gacaauacggcggcggcaggca

SEQ ID NO: 3369872 - RNA, 22 nt, Neisseria meningitidis Z2491
gacaaucagaucggcaaacccu

SEQ ID NO: 3369873 - RNA, 14 nt, Neisseria meningitidis Z2491
gacaaucaggccgg

SEQ ID NO: 3369874 - RNA, 22 nt, Neisseria meningitidis Z2491
gacaauggagcaggcacaaggc

SEQ ID NO: 3369875 - RNA, 22 nt, Neisseria meningitidis Z2491
gacacagguauuguucagcgac

SEQ ID NO: 3369876 - RNA, 15 nt, Neisseria meningitidis Z2491
gacacauagccggcg

SEQ ID NO: 3369877 - RNA, 15 nt, Neisseria meningitidis Z2491
gacacgguucugcac

SEQ ID NO: 3369878 - RNA, 23 nt, Neisseria meningitidis Z2491
gacagaccuagauucccgccugc

SEQ ID NO: 3369879 - RNA, 11 nt, Neisseria meningitidis Z2491
gacagacggcc

SEQ ID NO: 3369880 - RNA, 13 nt, Neisseria meningitidis Z2491
gacagcagcagcc

SEQ ID NO: 3369881 - RNA, 15 nt, Neisseria meningitidis Z2491
gacagcagcagcccg

SEQ ID NO: 3369882 - RNA, 14 nt, Neisseria meningitidis Z2491
gacagcaucgccgc

SEQ ID NO: 3369883 - RNA, 12 nt, Neisseria meningitidis Z2491
gacagcauuucc

SEQ ID NO: 3369884 - RNA, 15 nt, Neisseria meningitidis Z2491
gacagcauuuccaca

SEQ ID NO: 3369885 - RNA, 21 nt, Neisseria meningitidis Z2491
gacaggaaauuuccaaauaua

SEQ ID NO: 3369886 - RNA, 19 nt, Neisseria meningitidis Z2491
gacaggcuccguaucggca

SEQ ID NO: 3369887 - RNA, 18 nt, Neisseria meningitidis Z2491
gacaguuuggagauauug

SEQ ID NO: 3369888 - RNA, 18 nt, Neisseria meningitidis Z2491
gacauagcguguauuuug

SEQ ID NO: 3369889 - RNA, 21 nt, Neisseria meningitidis Z2491
gacauuaagauguuuuuccac

SEQ ID NO: 3369890 - RNA, 19 nt, Neisseria meningitidis Z2491
gacauucgcguucggcuuu

SEQ ID NO: 3369891 - RNA, 22 nt, Neisseria meningitidis Z2491
gacauucucuuggucaaaaugu

SEQ ID NO: 3369892 - RNA, 13 nt, Neisseria meningitidis Z2491
gaccaaacagaac

SEQ ID NO: 3369893 - RNA, 22 nt, Neisseria meningitidis Z2491
gaccacgaccagugcgccggca

SEQ ID NO: 3369894 - RNA, 18 nt, Neisseria meningitidis Z2491
gaccagagcggcauuucg

SEQ ID NO: 3369895 - RNA, 13 nt, Neisseria meningitidis Z2491
gaccagccgccuc

SEQ ID NO: 3369896 - RNA, 18 nt, Neisseria meningitidis Z2491
gaccagccgccuccauca

SEQ ID NO: 3369897 - RNA, 14 nt, Neisseria meningitidis Z2491
gaccauaaagagca

SEQ ID NO: 3369898 - RNA, 15 nt, Neisseria meningitidis Z2491
gaccauaaagagcag

SEQ ID NO: 3369899 - RNA, 15 nt, Neisseria meningitidis Z2491
gaccauuucuuccag

SEQ ID NO: 3369900 - RNA, 23 nt, Neisseria meningitidis Z2491
gacccaccaaacaugggcuaaaa

SEQ ID NO: 3369901 - RNA, 19 nt, Neisseria meningitidis Z2491
gacccauucugacaaggcc

SEQ ID NO: 3369902 - RNA, 21 nt, Neisseria meningitidis Z2491
gacccucccccacaggggagg

SEQ ID NO: 3369903 - RNA, 19 nt, Neisseria meningitidis Z2491
gaccgaagcauaagccgcc

SEQ ID NO: 3369904 - RNA, 21 nt, Neisseria meningitidis Z2491
gaccgccgccgcaaccgccga

SEQ ID NO: 3369905 - RNA, 22 nt, Neisseria meningitidis Z2491
gaccgccugcgcgcggacggau

SEQ ID NO: 3369906 - RNA, 13 nt, Neisseria meningitidis Z2491
gaccuccagcacc

SEQ ID NO: 3369907 - RNA, 20 nt, Neisseria meningitidis Z2491
gaccuuagaacaacaguaau

SEQ ID NO: 3369908 - RNA, 19 nt, Neisseria meningitidis Z2491
gaccuucggguaacggcaa

SEQ ID NO: 3369909 - RNA, 19 nt, Neisseria meningitidis Z2491
gaccuuugggcggcggcaa

SEQ ID NO: 3369910 - RNA, 21 nt, Neisseria meningitidis Z2491
gacgaagaaauagccgccgcc

SEQ ID NO: 3369911 - RNA, 15 nt, Neisseria meningitidis Z2491
gacgaaggcaagggu

SEQ ID NO: 3369912 - RNA, 16 nt, Neisseria meningitidis Z2491
gacgacaggcggcgga

SEQ ID NO: 3369913 - RNA, 22 nt, Neisseria meningitidis Z2491
gacgagaauuuaucagaaauga

SEQ ID NO: 3369914 - RNA, 11 nt, Neisseria meningitidis Z2491
gacgaugaaaa

SEQ ID NO: 3369915 - RNA, 13 nt, Neisseria meningitidis Z2491
gaguucgggcggg

SEQ ID NO: 3369916 - RNA, 17 nt, Neisseria meningitidis Z2491
gaguuuucagacggcau

SEQ ID NO: 3369917 - RNA, 19 nt, Neisseria meningitidis Z2491
gaguuuuugguaggcaagu

SEQ ID NO: 3369918 - RNA, 19 nt, Neisseria meningitidis Z2491
gauaaaaaaugccgucuga

SEQ ID NO: 3369919 - RNA, 21 nt, Neisseria meningitidis Z2491
gauaaaacgguuucuucagau

SEQ ID NO: 3369920 - RNA, 24 nt, Neisseria meningitidis Z2491
gauaaaugccgcaauuucaaaucc

SEQ ID NO: 3369921 - RNA, 20 nt, Neisseria meningitidis Z2491
gauaagcuguuugcgcuguu

SEQ ID NO: 3369922 - RNA, 13 nt, Neisseria meningitidis Z2491
gauaaguuuccgu

SEQ ID NO: 3369923 - RNA, 14 nt, Neisseria meningitidis Z2491
gauaaguuuccgug

SEQ ID NO: 3369924 - RNA, 20 nt, Neisseria meningitidis Z2491
gauaaugcccacaaucugaa

SEQ ID NO: 3369925 - RNA, 12 nt, Neisseria meningitidis Z2491
gauaauuuuuug

SEQ ID NO: 3369926 - RNA, 16 nt, Neisseria meningitidis Z2491
gauacaagaacuuuau

SEQ ID NO: 3369927 - RNA, 12 nt, Neisseria meningitidis Z2491
gauacacaaaaa

SEQ ID NO: 3369928 - RNA, 13 nt, Neisseria meningitidis Z2491
gauacacaaaaaa

SEQ ID NO: 3369929 - RNA, 16 nt, Neisseria meningitidis Z2491
gauacacacaccggca

SEQ ID NO: 3369930 - RNA, 12 nt, Neisseria meningitidis Z2491
gauaccgucuga

SEQ ID NO: 3369931 - RNA, 17 nt, Neisseria meningitidis Z2491
gauaccgucugaacacg

SEQ ID NO: 3369932 - RNA, 19 nt, Neisseria meningitidis Z2491
gauaccugcaaugccgucu

SEQ ID NO: 3369933 - RNA, 18 nt, Neisseria meningitidis Z2491
gauacgcgacaauaaaga

SEQ ID NO: 3369934 - RNA, 17 nt, Neisseria meningitidis Z2491
gauacggugucuucaau

SEQ ID NO: 3369935 - RNA, 13 nt, Neisseria meningitidis Z2491
gauacugccgucg

SEQ ID NO: 3369936 - RNA, 14 nt, Neisseria meningitidis Z2491
gauaguugcgguaa

SEQ ID NO: 3369937 - RNA, 16 nt, Neisseria meningitidis Z2491
gauauagguuuccgug

SEQ ID NO: 3369938 - RNA, 19 nt, Neisseria meningitidis Z2491
gauauaguggauuaaauuu

SEQ ID NO: 3369939 - RNA, 12 nt, Neisseria meningitidis Z2491
gauauaguuaca

SEQ ID NO: 3369940 - RNA, 15 nt, Neisseria meningitidis Z2491
gauauccgacugugc

SEQ ID NO: 3369941 - RNA, 17 nt, Neisseria meningitidis Z2491
gauauccgacugugccg

SEQ ID NO: 3369942 - RNA, 18 nt, Neisseria meningitidis Z2491
gauauucagguaaaacaa

SEQ ID NO: 3369943 - RNA, 23 nt, Neisseria meningitidis Z2491
gaucaccgucgccauaaucagcc

SEQ ID NO: 3369944 - RNA, 14 nt, Neisseria meningitidis Z2491
gaucaggcggauuu

SEQ ID NO: 3369945 - RNA, 19 nt, Neisseria meningitidis Z2491
gaucauaccuaccgccuau

SEQ ID NO: 3369946 - RNA, 16 nt, Neisseria meningitidis Z2491
gaucugcccguauuug

SEQ ID NO: 3369947 - RNA, 15 nt, Neisseria meningitidis Z2491
gaucuuauccauccc

SEQ ID NO: 3369948 - RNA, 16 nt, Neisseria meningitidis Z2491
gaugaaacgaugacgg

SEQ ID NO: 3369949 - RNA, 22 nt, Neisseria meningitidis Z2491
gaugaggcggaacgcgucuucc

SEQ ID NO: 3369950 - RNA, 20 nt, Neisseria meningitidis Z2491
gaugaguccgaggcugugga

SEQ ID NO: 3369951 - RNA, 16 nt, Neisseria meningitidis Z2491
gaugaugcggaaaucg

SEQ ID NO: 3369952 - RNA, 19 nt, Neisseria meningitidis Z2491
gaugauguccgacugggca

SEQ ID NO: 3369953 - RNA, 17 nt, Neisseria meningitidis Z2491
gaugauuuuuucaacac

SEQ ID NO: 3369954 - RNA, 22 nt, Neisseria meningitidis Z2491
gaugcacugcgcgaugcauauc

SEQ ID NO: 3369955 - RNA, 20 nt, Neisseria meningitidis Z2491
gaugcaugagguuagcggau

SEQ ID NO: 3369956 - RNA, 22 nt, Neisseria meningitidis Z2491
gaugccccacgccgauaccgau

SEQ ID NO: 3369957 - RNA, 23 nt, Neisseria meningitidis Z2491
gaugccggaaauaccgacggcgu

SEQ ID NO: 3369958 - RNA, 14 nt, Neisseria meningitidis Z2491
gaugccgguaaaga

SEQ ID NO: 3369959 - RNA, 20 nt, Neisseria meningitidis Z2491
gaugccgucauucccgcgca

SEQ ID NO: 3369960 - RNA, 12 nt, Neisseria meningitidis Z2491
gaugccgucuga

SEQ ID NO: 3369961 - RNA, 12 nt, Neisseria meningitidis Z2491
gaugccgucugu

SEQ ID NO: 3369962 - RNA, 20 nt, Neisseria meningitidis Z2491
gaugccguuucagacggcau

SEQ ID NO: 3369963 - RNA, 17 nt, Neisseria meningitidis Z2491
gaugcggacggcuugga

SEQ ID NO: 3369964 - RNA, 18 nt, Neisseria meningitidis Z2491
gaugcgggaacuugauuc

SEQ ID NO: 3369965 - RNA, 17 nt, Neisseria meningitidis Z2491
gauggaugaacaaucca

SEQ ID NO: 3369966 - RNA, 22 nt, Neisseria meningitidis Z2491
gauggcgcgcuguuucuucaaa

SEQ ID NO: 3369967 - RNA, 21 nt, Neisseria meningitidis Z2491
gauggcgggaaauaaaacaaa

SEQ ID NO: 3369968 - RNA, 13 nt, Neisseria meningitidis Z2491
gauggcugaaauu

SEQ ID NO: 3369969 - RNA, 20 nt, Neisseria meningitidis Z2491
gauggcugcuuuggcagcac

SEQ ID NO: 3369970 - RNA, 18 nt, Neisseria meningitidis Z2491
gauggggaggcgcggcca

SEQ ID NO: 3369971 - RNA, 15 nt, Neisseria meningitidis Z2491
gaugguuuugccgcu

SEQ ID NO: 3369972 - RNA, 17 nt, Neisseria meningitidis Z2491
gauguccugaccgcgcu

SEQ ID NO: 3369973 - RNA, 18 nt, Neisseria meningitidis Z2491
gaugugguagagaaaauu

SEQ ID NO: 3369974 - RNA, 12 nt, Neisseria meningitidis Z2491
gauguuuugccu

SEQ ID NO: 3369975 - RNA, 20 nt, Neisseria meningitidis Z2491
gauguuuuugcguucagacg

SEQ ID NO: 3369976 - RNA, 17 nt, Neisseria meningitidis Z2491
gauuaaaacaaaaauga

SEQ ID NO: 3369977 - RNA, 12 nt, Neisseria meningitidis Z2491
gauuaaauuuaa

SEQ ID NO: 3369978 - RNA, 14 nt, Neisseria meningitidis Z2491
gauuaaauuuaaau

SEQ ID NO: 3369979 - RNA, 15 nt, Neisseria meningitidis Z2491
gauuaacaaaaauca

SEQ ID NO: 3369980 - RNA, 20 nt, Neisseria meningitidis Z2491
gauuaacggcggaaccugcu

SEQ ID NO: 3369981 - RNA, 20 nt, Neisseria meningitidis Z2491
gauuaauuccggaaucagac

SEQ ID NO: 3369982 - RNA, 17 nt, Neisseria meningitidis Z2491
gauuacagaaaccuaaa

SEQ ID NO: 3369983 - RNA, 21 nt, Neisseria meningitidis Z2491
gauuagguugguuugaaagag

SEQ ID NO: 3369984 - RNA, 15 nt, Neisseria meningitidis Z2491
gauuauccgaaaguu

SEQ ID NO: 3369985 - RNA, 18 nt, Neisseria meningitidis Z2491
gauuaucgggaaaaauag

SEQ ID NO: 3369986 - RNA, 20 nt, Neisseria meningitidis Z2491
gauuaucgggaaaaauagaa

SEQ ID NO: 3369987 - RNA, 21 nt, Neisseria meningitidis Z2491
gauucaauaggauaggcugcu

SEQ ID NO: 3369988 - RNA, 17 nt, Neisseria meningitidis Z2491
gauuccacguucuagau

SEQ ID NO: 3369989 - RNA, 20 nt, Neisseria meningitidis Z2491
gauucccgagaaaacagaaa

SEQ ID NO: 3369990 - RNA, 15 nt, Neisseria meningitidis Z2491
gauucccgccugcgc

SEQ ID NO: 3369991 - RNA, 20 nt, Neisseria meningitidis Z2491
gauucccgcguucgcgggaa

SEQ ID NO: 3369992 - RNA, 21 nt, Neisseria meningitidis Z2491
gauucccguuucagacggcau

SEQ ID NO: 3369993 - RNA, 20 nt, Neisseria meningitidis Z2491
gauuccguuguauaguggau

SEQ ID NO: 3369994 - RNA, 20 nt, Neisseria meningitidis Z2491
gauuccuacgaaaacaggaa

SEQ ID NO: 3369995 - RNA, 20 nt, Neisseria meningitidis Z2491
gauucgccuuaaaaaacaaa

SEQ ID NO: 3369996 - RNA, 14 nt, Neisseria meningitidis Z2491
gauucgcuuuugug

SEQ ID NO: 3369997 - RNA, 19 nt, Neisseria meningitidis Z2491
gauucgucauucccgcgca

SEQ ID NO: 3369998 - RNA, 23 nt, Neisseria meningitidis Z2491
gauucucaugaucuucuuaccca

SEQ ID NO: 3369999 - RNA, 21 nt, Neisseria meningitidis Z2491
gauucucuaaggugcugaagc

SEQ ID NO: 3370000 - RNA, 16 nt, Neisseria meningitidis Z2491
gauucugccaaacggc

SEQ ID NO: 3370001 - RNA, 16 nt, Neisseria meningitidis Z2491
gauucuggauucccac

SEQ ID NO: 3370002 - RNA, 18 nt, Neisseria meningitidis Z2491
gauugaccgaaaaauaau

SEQ ID NO: 3370003 - RNA, 15 nt, Neisseria meningitidis Z2491
gauugacuauuuuuu

SEQ ID NO: 3370004 - RNA, 21 nt, Neisseria meningitidis Z2491
gauugacuauuuuuuaaucau

SEQ ID NO: 3370005 - RNA, 19 nt, Neisseria meningitidis Z2491
gauugcgacauuuaucagg

SEQ ID NO: 3370006 - RNA, 14 nt, Neisseria meningitidis Z2491
gauuguuuggaaau

SEQ ID NO: 3370007 - RNA, 14 nt, Neisseria meningitidis Z2491
gauuuaaauuuaau

SEQ ID NO: 3370008 - RNA, 18 nt, Neisseria meningitidis Z2491
gauuuaaauuuaauccac

SEQ ID NO: 3370009 - RNA, 13 nt, Neisseria meningitidis Z2491
gauuuauucuguu

SEQ ID NO: 3370010 - RNA, 19 nt, Neisseria meningitidis Z2491
gauuuauugggaauaaugg

SEQ ID NO: 3370011 - RNA, 19 nt, Neisseria meningitidis Z2491
gauuuccucuuucaacggc

SEQ ID NO: 3370012 - RNA, 17 nt, Neisseria meningitidis Z2491
gauuugaaccauuucca

SEQ ID NO: 3370013 - RNA, 17 nt, Neisseria meningitidis Z2491
gauuugaacgacgguau

SEQ ID NO: 3370014 - RNA, 18 nt, Neisseria meningitidis Z2491
gauuugaaguuucuccac

SEQ ID NO: 3370015 - RNA, 18 nt, Neisseria meningitidis Z2491
gauuugagauugcggcau

SEQ ID NO: 3370016 - RNA, 16 nt, Neisseria meningitidis Z2491
gcacauuuuuuucaua

SEQ ID NO: 3370017 - RNA, 19 nt, Neisseria meningitidis Z2491
gcaccaaguaaaucgguuc

SEQ ID NO: 3370018 - RNA, 19 nt, Neisseria meningitidis Z2491
gcaccaagugaaucgguuc

SEQ ID NO: 3370019 - RNA, 14 nt, Neisseria meningitidis Z2491
gcaccaauucuuca

SEQ ID NO: 3370020 - RNA, 20 nt, Neisseria meningitidis Z2491
gcaccgccgccccuuaugcc

SEQ ID NO: 3370021 - RNA, 13 nt, Neisseria meningitidis Z2491
gcaccgggcuuca

SEQ ID NO: 3370022 - RNA, 13 nt, Neisseria meningitidis Z2491
gcaccguuuucaa

SEQ ID NO: 3370023 - RNA, 16 nt, Neisseria meningitidis Z2491
gcaccugacgcuccag

SEQ ID NO: 3370024 - RNA, 19 nt, Neisseria meningitidis Z2491
gcaccugacgcuccagcuc

SEQ ID NO: 3370025 - RNA, 19 nt, Neisseria meningitidis Z2491
gcaccuuagagaaucguuc

SEQ ID NO: 3370026 - RNA, 20 nt, Neisseria meningitidis Z2491
gcacgaaucuuauccacaga

SEQ ID NO: 3370027 - RNA, 20 nt, Neisseria meningitidis Z2491
gcacgauacacaaaaaagcc

SEQ ID NO: 3370028 - RNA, 19 nt, Neisseria meningitidis Z2491
gcacgcaugaagccgucuu

SEQ ID NO: 3370029 - RNA, 12 nt, Neisseria meningitidis Z2491
gcacgccgacuu

SEQ ID NO: 3370030 - RNA, 17 nt, Neisseria meningitidis Z2491
gcacgcgcuucaaaucg

SEQ ID NO: 3370031 - RNA, 23 nt, Neisseria meningitidis Z2491
gcacggcguucaacauccgcaga

SEQ ID NO: 3370032 - RNA, 24 nt, Neisseria meningitidis Z2491
gcacggcguucaacauccgcagac

SEQ ID NO: 3370033 - RNA, 18 nt, Neisseria meningitidis Z2491
gcacgguguacauugugg

SEQ ID NO: 3370034 - RNA, 18 nt, Neisseria meningitidis Z2491
gcacuacuucauuuuuuc

SEQ ID NO: 3370035 - RNA, 13 nt, Neisseria meningitidis Z2491
gcacuagccaaaa

SEQ ID NO: 3370036 - RNA, 17 nt, Neisseria meningitidis Z2491
gcacuagccaaaaaaac

SEQ ID NO: 3370037 - RNA, 14 nt, Neisseria meningitidis Z2491
gcacugaucagaca

SEQ ID NO: 3370038 - RNA, 20 nt, Neisseria meningitidis Z2491
gcacugccucuuuucagaca

SEQ ID NO: 3370039 - RNA, 11 nt, Neisseria meningitidis Z2491
gcacuuagccu

SEQ ID NO: 3370040 - RNA, 16 nt, Neisseria meningitidis Z2491
gcacuucaaguccgaa

SEQ ID NO: 3370041 - RNA, 20 nt, Neisseria meningitidis Z2491
gcacuugccgcauaaaucaa

SEQ ID NO: 3370042 - RNA, 14 nt, Neisseria meningitidis Z2491
gcagaaaaaggguu

SEQ ID NO: 3370043 - RNA, 19 nt, Neisseria meningitidis Z2491
gcagacaaaccguccccuu

SEQ ID NO: 3370044 - RNA, 12 nt, Neisseria meningitidis Z2491
gcagacaguaca

SEQ ID NO: 3370045 - RNA, 16 nt, Neisseria meningitidis Z2491
gcagacaguacaaaua

SEQ ID NO: 3370046 - RNA, 17 nt, Neisseria meningitidis Z2491
gcagacaguacaaauag

SEQ ID NO: 3370047 - RNA, 21 nt, Neisseria meningitidis Z2491
gcagauacaacaaacaggaca

SEQ ID NO: 3370048 - RNA, 20 nt, Neisseria meningitidis Z2491
gcagauagucgccgagcaga

SEQ ID NO: 3370049 - RNA, 21 nt, Neisseria meningitidis Z2491
gcagaugaagcugcaacugaa

SEQ ID NO: 3370050 - RNA, 17 nt, Neisseria meningitidis Z2491
gcagcaacgacagcagc

SEQ ID NO: 3370051 - RNA, 18 nt, Neisseria meningitidis Z2491
gcagcaauacgcaaaaca

SEQ ID NO: 3370052 - RNA, 14 nt, Neisseria meningitidis Z2491
gcagcacaggcaag

SEQ ID NO: 3370053 - RNA, 17 nt, Neisseria meningitidis Z2491
gcagcacaucgucugca

SEQ ID NO: 3370054 - RNA, 20 nt, Neisseria meningitidis Z2491
gcagcacaucgucugcaagc

SEQ ID NO: 3370055 - RNA, 22 nt, Neisseria meningitidis Z2491
gcagcaccguuuaaaacagcau

SEQ ID NO: 3370056 - RNA, 15 nt, Neisseria meningitidis Z2491
gcagcauaacaccuu

SEQ ID NO: 3370057 - RNA, 13 nt, Neisseria meningitidis Z2491
gcagccagcaucg

SEQ ID NO: 3370058 - RNA, 16 nt, Neisseria meningitidis Z2491
gcagccagcaucgcag

SEQ ID NO: 3370059 - RNA, 13 nt, Neisseria meningitidis Z2491
gcagcccucccca

SEQ ID NO: 3370060 - RNA, 17 nt, Neisseria meningitidis Z2491
gcagcccugauaaaaaa

SEQ ID NO: 3370061 - RNA, 11 nt, Neisseria meningitidis Z2491
gcagccgagca

SEQ ID NO: 3370062 - RNA, 13 nt, Neisseria meningitidis Z2491
gcagccgagcagc

SEQ ID NO: 3370063 - RNA, 18 nt, Neisseria meningitidis Z2491
gcagccgccauaucgucc

SEQ ID NO: 3370064 - RNA, 17 nt, Neisseria meningitidis Z2491
gcagccggggcaggcgg

SEQ ID NO: 3370065 - RNA, 13 nt, Neisseria meningitidis Z2491
gcagccugcagca

SEQ ID NO: 3370066 - RNA, 23 nt, Neisseria meningitidis Z2491
gcagccugcagcagagcugugca

SEQ ID NO: 3370067 - RNA, 22 nt, Neisseria meningitidis Z2491
gcagccuuaacagggaaagcag

SEQ ID NO: 3370068 - RNA, 20 nt, Neisseria meningitidis Z2491
gcagcgcgcccgacaaaucg

SEQ ID NO: 3370069 - RNA, 22 nt, Neisseria meningitidis Z2491
gcagcgcguuuucauccaccag

SEQ ID NO: 3370070 - RNA, 21 nt, Neisseria meningitidis Z2491
gcagcggaaaugguccgaacg

SEQ ID NO: 3370071 - RNA, 22 nt, Neisseria meningitidis Z2491
gcagcgugaugauguccgacug

SEQ ID NO: 3370072 - RNA, 22 nt, Neisseria meningitidis Z2491
gcagcuccgaaccgaaacggcg

SEQ ID NO: 3370073 - RNA, 22 nt, Neisseria meningitidis Z2491
gcagcugcucagacuaucggua

SEQ ID NO: 3370074 - RNA, 19 nt, Neisseria meningitidis Z2491
gcagcuuugaguucgucaa

SEQ ID NO: 3370075 - RNA, 21 nt, Neisseria meningitidis Z2491
gcagcuuuugcgccacggcau

SEQ ID NO: 3370076 - RNA, 15 nt, Neisseria meningitidis Z2491
gcaggaacacggcgg

SEQ ID NO: 3370077 - RNA, 14 nt, Neisseria meningitidis Z2491
gcaggacggggcgg

SEQ ID NO: 3370078 - RNA, 16 nt, Neisseria meningitidis Z2491
gcaggacggggcggcu

SEQ ID NO: 3370079 - RNA, 18 nt, Neisseria meningitidis Z2491
gcaggaugcugcggaugg

SEQ ID NO: 3370080 - RNA, 16 nt, Neisseria meningitidis Z2491
gcaggcaaaaaaaaua

SEQ ID NO: 3370081 - RNA, 15 nt, Neisseria meningitidis Z2491
gcaggcaaacgcgau

SEQ ID NO: 3370082 - RNA, 12 nt, Neisseria meningitidis Z2491
gcaggcaaauac

SEQ ID NO: 3370083 - RNA, 19 nt, Neisseria meningitidis Z2491
gcaggcacaccgacggaau

SEQ ID NO: 3370084 - RNA, 17 nt, Neisseria meningitidis Z2491
gcaggccaaaccccauu

SEQ ID NO: 3370085 - RNA, 14 nt, Neisseria meningitidis Z2491
gcaggcgggaaucc

SEQ ID NO: 3370086 - RNA, 17 nt, Neisseria meningitidis Z2491
gcaggcgggaauccaga

SEQ ID NO: 3370087 - RNA, 17 nt, Neisseria meningitidis Z2491
gcaggcgggaauccagg

SEQ ID NO: 3370088 - RNA, 17 nt, Neisseria meningitidis Z2491
gcaggcgggaauccagu

SEQ ID NO: 3370089 - RNA, 16 nt, Neisseria meningitidis Z2491
gcaggcgggaaucuag

SEQ ID NO: 3370090 - RNA, 18 nt, Neisseria meningitidis Z2491
gcaggcgggaaucuagac

SEQ ID NO: 3370091 - RNA, 17 nt, Neisseria meningitidis Z2491
gcaggcuacggcuugcu

SEQ ID NO: 3370092 - RNA, 15 nt, Neisseria meningitidis Z2491
gcaggcugccgcaca

SEQ ID NO: 3370093 - RNA, 22 nt, Neisseria meningitidis Z2491
gcaggcuuuugaggcugccguc

SEQ ID NO: 3370094 - RNA, 20 nt, Neisseria meningitidis Z2491
gcagggcaaguuugccgccu

SEQ ID NO: 3370095 - RNA, 14 nt, Neisseria meningitidis Z2491
gcagggucauggcu

SEQ ID NO: 3370096 - RNA, 20 nt, Neisseria meningitidis Z2491
gcagguagcggcugagggcu

SEQ ID NO: 3370097 - RNA, 13 nt, Neisseria meningitidis Z2491
gcaggucgacggc

SEQ ID NO: 3370098 - RNA, 19 nt, Neisseria meningitidis Z2491
gcagguuuuguuuuuccaa

SEQ ID NO: 3370099 - RNA, 19 nt, Neisseria meningitidis Z2491
gcagguuuuuuugauucaa

SEQ ID NO: 3370100 - RNA, 15 nt, Neisseria meningitidis Z2491
gcaguaacuucaaac

SEQ ID NO: 3370101 - RNA, 14 nt, Neisseria meningitidis Z2491
gcaguaaugccgcc

SEQ ID NO: 3370102 - RNA, 22 nt, Neisseria meningitidis Z2491
gcaguauccggcaagaauuuuu

SEQ ID NO: 3370103 - RNA, 22 nt, Neisseria meningitidis Z2491
gcaguccuuaucugauaucgga

SEQ ID NO: 3370104 - RNA, 17 nt, Neisseria meningitidis Z2491
gcagucuuccaacccuc

SEQ ID NO: 3370105 - RNA, 12 nt, Neisseria meningitidis Z2491
gcaguuccaaag

SEQ ID NO: 3370106 - RNA, 18 nt, Neisseria meningitidis Z2491
gcaguucggacaaaccgu

SEQ ID NO: 3370107 - RNA, 20 nt, Neisseria meningitidis Z2491
gcaguucguugcuuuccagu

SEQ ID NO: 3370108 - RNA, 22 nt, Neisseria meningitidis Z2491
gcaguugggcgauggcgcggcg

SEQ ID NO: 3370109 - RNA, 13 nt, Neisseria meningitidis Z2491
gcauaaaauuuua

SEQ ID NO: 3370110 - RNA, 16 nt, Neisseria meningitidis Z2491
gcauaaauccuucacc

SEQ ID NO: 3370111 - RNA, 17 nt, Neisseria meningitidis Z2491
gcauaaauccuucacca

SEQ ID NO: 3370112 - RNA, 17 nt, Neisseria meningitidis Z2491
gcauaaucaauuaaaaa

SEQ ID NO: 3370113 - RNA, 21 nt, Neisseria meningitidis Z2491
gcauaaucaauuaaaaacaaa

SEQ ID NO: 3370114 - RNA, 20 nt, Neisseria meningitidis Z2491
gcauacggcugauuuccggg

SEQ ID NO: 3370115 - RNA, 20 nt, Neisseria meningitidis Z2491
gcauacgguuuuccgccuga

SEQ ID NO: 3370116 - RNA, 21 nt, Neisseria meningitidis Z2491
gcauacucugcggacuuaaga

SEQ ID NO: 3370117 - RNA, 22 nt, Neisseria meningitidis Z2491
gcccucaaacgguaccugauga

SEQ ID NO: 3370118 - RNA, 21 nt, Neisseria meningitidis Z2491
gcccucagcuaugccugccga

SEQ ID NO: 3370119 - RNA, 23 nt, Neisseria meningitidis Z2491
gcccuccccagauuaucacgauu

SEQ ID NO: 3370120 - RNA, 22 nt, Neisseria meningitidis Z2491
gcccuguguuuauugagaaugc

SEQ ID NO: 3370121 - RNA, 16 nt, Neisseria meningitidis Z2491
gcccuguugcgcuguu

SEQ ID NO: 3370122 - RNA, 17 nt, Neisseria meningitidis Z2491
gcccuuucagacggcau

SEQ ID NO: 3370123 - RNA, 21 nt, Neisseria meningitidis Z2491
gcccuuucagacggcauuuua

SEQ ID NO: 3370124 - RNA, 14 nt, Neisseria meningitidis Z2491
gccgaaacccaaac

SEQ ID NO: 3370125 - RNA, 18 nt, Neisseria meningitidis Z2491
gccgaaaggggucugacg

SEQ ID NO: 3370126 - RNA, 15 nt, Neisseria meningitidis Z2491
gccgaaauagucuga

SEQ ID NO: 3370127 - RNA, 13 nt, Neisseria meningitidis Z2491
gccgaaauccuga

SEQ ID NO: 3370128 - RNA, 20 nt, Neisseria meningitidis Z2491
gccgaauauccccagugcga

SEQ ID NO: 3370129 - RNA, 12 nt, Neisseria meningitidis Z2491
gccgacaaaacc

SEQ ID NO: 3370130 - RNA, 13 nt, Neisseria meningitidis Z2491
gccgacagcagcu

SEQ ID NO: 3370131 - RNA, 15 nt, Neisseria meningitidis Z2491
gccgacaucccccag

SEQ ID NO: 3370132 - RNA, 17 nt, Neisseria meningitidis Z2491
gccgacugccgccgcgc

SEQ ID NO: 3370133 - RNA, 18 nt, Neisseria meningitidis Z2491
gccgacuucgauugccaa

SEQ ID NO: 3370134 - RNA, 19 nt, Neisseria meningitidis Z2491
gccgacuuugccguauuuc

SEQ ID NO: 3370135 - RNA, 15 nt, Neisseria meningitidis Z2491
gccgacuuuuuccag

SEQ ID NO: 3370136 - RNA, 23 nt, Neisseria meningitidis Z2491
gccgagcagcagucccaucccgc

SEQ ID NO: 3370137 - RNA, 15 nt, Neisseria meningitidis Z2491
gccgauauagagucc

SEQ ID NO: 3370138 - RNA, 18 nt, Neisseria meningitidis Z2491
gccgaugaguccgaggcu

SEQ ID NO: 3370139 - RNA, 15 nt, Neisseria meningitidis Z2491
gccgaugggcaaggc

SEQ ID NO: 3370140 - RNA, 16 nt, Neisseria meningitidis Z2491
gccgauguaaaccuaa

SEQ ID NO: 3370141 - RNA, 13 nt, Neisseria meningitidis Z2491
gccgauguccuga

SEQ ID NO: 3370142 - RNA, 14 nt, Neisseria meningitidis Z2491
gccgauguccugac

SEQ ID NO: 3370143 - RNA, 13 nt, Neisseria meningitidis Z2491
gccgauuucuucg

SEQ ID NO: 3370144 - RNA, 14 nt, Neisseria meningitidis Z2491
gccgcaaacggcag

SEQ ID NO: 3370145 - RNA, 14 nt, Neisseria meningitidis Z2491
gccgcaaccucaaa

SEQ ID NO: 3370146 - RNA, 22 nt, Neisseria meningitidis Z2491
gccgcaaugccgucugaaggcu

SEQ ID NO: 3370147 - RNA, 14 nt, Neisseria meningitidis Z2491
gccgcaauuucaaa

SEQ ID NO: 3370148 - RNA, 20 nt, Neisseria meningitidis Z2491
gccgcagacaguacaaauag

SEQ ID NO: 3370149 - RNA, 20 nt, Neisseria meningitidis Z2491
gccgcagacgguacaaauag

SEQ ID NO: 3370150 - RNA, 16 nt, Neisseria meningitidis Z2491
gccgcagucaucaggc

SEQ ID NO: 3370151 - RNA, 21 nt, Neisseria meningitidis Z2491
gccgcauuaaaauucuagauu

SEQ ID NO: 3370152 - RNA, 15 nt, Neisseria meningitidis Z2491
gccgcauugucccug

SEQ ID NO: 3370153 - RNA, 17 nt, Neisseria meningitidis Z2491
gccgccacaagucuucg

SEQ ID NO: 3370154 - RNA, 23 nt, Neisseria meningitidis Z2491
gccgcccgucccgaugccgcaac

SEQ ID NO: 3370155 - RNA, 18 nt, Neisseria meningitidis Z2491
gccgccgaaagucgagcc

SEQ ID NO: 3370156 - RNA, 14 nt, Neisseria meningitidis Z2491
gccgccgaugacga

SEQ ID NO: 3370157 - RNA, 12 nt, Neisseria meningitidis Z2491
gccgccgcaacc

SEQ ID NO: 3370158 - RNA, 22 nt, Neisseria meningitidis Z2491
gccgccgccaugucgcgggcgg

SEQ ID NO: 3370159 - RNA, 14 nt, Neisseria meningitidis Z2491
gccgccgcccgggc

SEQ ID NO: 3370160 - RNA, 15 nt, Neisseria meningitidis Z2491
gccgccgcccgggcc

SEQ ID NO: 3370161 - RNA, 16 nt, Neisseria meningitidis Z2491
gccgccguaaccgcac

SEQ ID NO: 3370162 - RNA, 22 nt, Neisseria meningitidis Z2491
gccgccguaaccgcacccccga

SEQ ID NO: 3370163 - RNA, 14 nt, Neisseria meningitidis Z2491
gccgccuccgaagc

SEQ ID NO: 3370164 - RNA, 23 nt, Neisseria meningitidis Z2491
gccgccugaacauuucagacggc

SEQ ID NO: 3370165 - RNA, 20 nt, Neisseria meningitidis Z2491
gccgccugccuguuuuucuu

SEQ ID NO: 3370166 - RNA, 14 nt, Neisseria meningitidis Z2491
gccgccuuuuucca

SEQ ID NO: 3370167 - RNA, 21 nt, Neisseria meningitidis Z2491
gccgcgauuccggcgcggcgc

SEQ ID NO: 3370168 - RNA, 13 nt, Neisseria meningitidis Z2491
gccgcgccgccgg

SEQ ID NO: 3370169 - RNA, 21 nt, Neisseria meningitidis Z2491
gccgcguaugcguucaaaugc

SEQ ID NO: 3370170 - RNA, 23 nt, Neisseria meningitidis Z2491
gccgcucgcguauccagccgcca

SEQ ID NO: 3370171 - RNA, 17 nt, Neisseria meningitidis Z2491
gccgcuguauuugcgcc

SEQ ID NO: 3370172 - RNA, 19 nt, Neisseria meningitidis Z2491
gccgcuguauuugcgccgc

SEQ ID NO: 3370173 - RNA, 20 nt, Neisseria meningitidis Z2491
gccggaaauaccgacggcgu

SEQ ID NO: 3370174 - RNA, 22 nt, Neisseria meningitidis Z2491
gccggcauuucugcgaaagcgg

SEQ ID NO: 3370175 - RNA, 15 nt, Neisseria meningitidis Z2491
gccggccaacaucag

SEQ ID NO: 3370176 - RNA, 19 nt, Neisseria meningitidis Z2491
gccggccuuaaggcggcug

SEQ ID NO: 3370177 - RNA, 20 nt, Neisseria meningitidis Z2491
gccggccuuaaggcggcugu

SEQ ID NO: 3370178 - RNA, 21 nt, Neisseria meningitidis Z2491
gccgggaaggcggggcgguca

SEQ ID NO: 3370179 - RNA, 20 nt, Neisseria meningitidis Z2491
gccgggcgcgguaacgcgac

SEQ ID NO: 3370180 - RNA, 14 nt, Neisseria meningitidis Z2491
gccggggcaggcgg

SEQ ID NO: 3370181 - RNA, 18 nt, Neisseria meningitidis Z2491
gccgggguuuaucagaaa

SEQ ID NO: 3370182 - RNA, 23 nt, Neisseria meningitidis Z2491
gccgguaacguauucgccguacu

SEQ ID NO: 3370183 - RNA, 16 nt, Neisseria meningitidis Z2491
gccggucaggacggcu

SEQ ID NO: 3370184 - RNA, 15 nt, Neisseria meningitidis Z2491
gccggucguguggaa

SEQ ID NO: 3370185 - RNA, 16 nt, Neisseria meningitidis Z2491
gccggucguguggaaa

SEQ ID NO: 3370186 - RNA, 15 nt, Neisseria meningitidis Z2491
gccgguugcggugcu

SEQ ID NO: 3370187 - RNA, 18 nt, Neisseria meningitidis Z2491
gccgguuuucagacggca

SEQ ID NO: 3370188 - RNA, 13 nt, Neisseria meningitidis Z2491
gccguaaccgcac

SEQ ID NO: 3370189 - RNA, 14 nt, Neisseria meningitidis Z2491
gccguacugguuua

SEQ ID NO: 3370190 - RNA, 15 nt, Neisseria meningitidis Z2491
gccguacugguuuaa

SEQ ID NO: 3370191 - RNA, 18 nt, Neisseria meningitidis Z2491
gccguacugguuuuuguu

SEQ ID NO: 3370192 - RNA, 18 nt, Neisseria meningitidis Z2491
gccguauccauugccgau

SEQ ID NO: 3370193 - RNA, 20 nt, Neisseria meningitidis Z2491
gccguauccauugccgauac

SEQ ID NO: 3370194 - RNA, 15 nt, Neisseria meningitidis Z2491
gccguaucgccgacg

SEQ ID NO: 3370195 - RNA, 19 nt, Neisseria meningitidis Z2491
gccguauucccguccggca

SEQ ID NO: 3370196 - RNA, 16 nt, Neisseria meningitidis Z2491
gccgucauucccgcgc

SEQ ID NO: 3370197 - RNA, 22 nt, Neisseria meningitidis Z2491
gccgucauucccgcgcaggcgg

SEQ ID NO: 3370198 - RNA, 23 nt, Neisseria meningitidis Z2491
gccgucauugagcagcacaucgu

SEQ ID NO: 3370199 - RNA, 11 nt, Neisseria meningitidis Z2491
gccgucugaaa

SEQ ID NO: 3370200 - RNA, 17 nt, Neisseria meningitidis Z2491
gccgucugaaacggcau

SEQ ID NO: 3370201 - RNA, 13 nt, Neisseria meningitidis Z2491
gccgucugaaauu

SEQ ID NO: 3370202 - RNA, 23 nt, Neisseria meningitidis Z2491
gccgucugaacccguuuucaggu

SEQ ID NO: 3370203 - RNA, 23 nt, Neisseria meningitidis Z2491
gccgucugaacgcuucagacggc

SEQ ID NO: 3370204 - RNA, 12 nt, Neisseria meningitidis Z2491
gccgucugaagc

SEQ ID NO: 3370205 - RNA, 14 nt, Neisseria meningitidis Z2491
gccgucugaagccc

SEQ ID NO: 3370206 - RNA, 20 nt, Neisseria meningitidis Z2491
gccgucugaagcgagcagcu

SEQ ID NO: 3370207 - RNA, 18 nt, Neisseria meningitidis Z2491
gccgucugaagcguauuu

SEQ ID NO: 3370208 - RNA, 21 nt, Neisseria meningitidis Z2491
gccgucugaaggcuucagacg

SEQ ID NO: 3370209 - RNA, 23 nt, Neisseria meningitidis Z2491
gccgucugaaggcuucagacggc

SEQ ID NO: 3370210 - RNA, 16 nt, Neisseria meningitidis Z2491
gccgucugaaggcuug

SEQ ID NO: 3370211 - RNA, 15 nt, Neisseria meningitidis Z2491
gccgucugauauagu

SEQ ID NO: 3370212 - RNA, 23 nt, Neisseria meningitidis Z2491
gccgugaugccccaauaccaaca

SEQ ID NO: 3370213 - RNA, 14 nt, Neisseria meningitidis Z2491
gccgugccggcggc

SEQ ID NO: 3370214 - RNA, 15 nt, Neisseria meningitidis Z2491
gccgugccggcggcg

SEQ ID NO: 3370215 - RNA, 15 nt, Neisseria meningitidis Z2491
gccgugugccggaug

SEQ ID NO: 3370216 - RNA, 20 nt, Neisseria meningitidis Z2491
gccguguuggguucuagauu

SEQ ID NO: 3370217 - RNA, 20 nt, Neisseria meningitidis Z2491
gccguguuucaaggcggcgg

SEQ ID NO: 3370218 - RNA, 13 nt, Neisseria meningitidis Z2491
gcgcgggaaugac

SEQ ID NO: 3370219 - RNA, 18 nt, Neisseria meningitidis Z2491
gcgcgggaaugacggcag

SEQ ID NO: 3370220 - RNA, 13 nt, Neisseria meningitidis Z2491
gcgcgggaaugau

SEQ ID NO: 3370221 - RNA, 22 nt, Neisseria meningitidis Z2491
gcgcgggugaugccgacguaca

SEQ ID NO: 3370222 - RNA, 17 nt, Neisseria meningitidis Z2491
gcgcgguuggcggcggc

SEQ ID NO: 3370223 - RNA, 19 nt, Neisseria meningitidis Z2491
gcgcgguuggcggcggcga

SEQ ID NO: 3370224 - RNA, 13 nt, Neisseria meningitidis Z2491
gcggaaaccugca

SEQ ID NO: 3370225 - RNA, 22 nt, Neisseria meningitidis Z2491
gcggaacgcgucuuccgucugc

SEQ ID NO: 3370226 - RNA, 22 nt, Neisseria meningitidis Z2491
gcggaaguacucauuuuucguc

SEQ ID NO: 3370227 - RNA, 19 nt, Neisseria meningitidis Z2491
gcggaauacggcaacauca

SEQ ID NO: 3370228 - RNA, 14 nt, Neisseria meningitidis Z2491
gcggacagugcagc

SEQ ID NO: 3370229 - RNA, 13 nt, Neisseria meningitidis Z2491
gcggacggcggca

SEQ ID NO: 3370230 - RNA, 12 nt, Neisseria meningitidis Z2491
gcggagaacaag

SEQ ID NO: 3370231 - RNA, 21 nt, Neisseria meningitidis Z2491
gcggagaacaagguuccgaua

SEQ ID NO: 3370232 - RNA, 17 nt, Neisseria meningitidis Z2491
gcggauggaggacaaag

SEQ ID NO: 3370233 - RNA, 21 nt, Neisseria meningitidis Z2491
gcggauuguucggaucggcag

SEQ ID NO: 3370234 - RNA, 21 nt, Neisseria meningitidis Z2491
gcggauuugaaguuucuccac

SEQ ID NO: 3370235 - RNA, 19 nt, Neisseria meningitidis Z2491
gcggcaaauuccgucagca

SEQ ID NO: 3370236 - RNA, 15 nt, Neisseria meningitidis Z2491
gcggcaauauucaaa

SEQ ID NO: 3370237 - RNA, 16 nt, Neisseria meningitidis Z2491
gcggcacuugccgcau

SEQ ID NO: 3370238 - RNA, 22 nt, Neisseria meningitidis Z2491
gcggcagggucggcgacggcgu

SEQ ID NO: 3370239 - RNA, 22 nt, Neisseria meningitidis Z2491
gcggcauuuugccgcgauuccg

SEQ ID NO: 3370240 - RNA, 18 nt, Neisseria meningitidis Z2491
gcggcgggacgcgcgcca

SEQ ID NO: 3370241 - RNA, 14 nt, Neisseria meningitidis Z2491
gcggcgggcggcuc

SEQ ID NO: 3370242 - RNA, 16 nt, Neisseria meningitidis Z2491
gcggcgguuuccugca

SEQ ID NO: 3370243 - RNA, 23 nt, Neisseria meningitidis Z2491
gcggcuaaggcgcaaaccuuaaa

SEQ ID NO: 3370244 - RNA, 20 nt, Neisseria meningitidis Z2491
gcggcuacuccugcugcggc

SEQ ID NO: 3370245 - RNA, 13 nt, Neisseria meningitidis Z2491
gcggcucgcccac

SEQ ID NO: 3370246 - RNA, 15 nt, Neisseria meningitidis Z2491
gcggcucgccgccuu

SEQ ID NO: 3370247 - RNA, 15 nt, Neisseria meningitidis Z2491
gcggcugaauguguu

SEQ ID NO: 3370248 - RNA, 18 nt, Neisseria meningitidis Z2491
gcggcugccgaccgcgca

SEQ ID NO: 3370249 - RNA, 18 nt, Neisseria meningitidis Z2491
gcggcugguuuccgggcg

SEQ ID NO: 3370250 - RNA, 16 nt, Neisseria meningitidis Z2491
gcggcuugggcgacgg

SEQ ID NO: 3370251 - RNA, 13 nt, Neisseria meningitidis Z2491
gcgggaauccagu

SEQ ID NO: 3370252 - RNA, 19 nt, Neisseria meningitidis Z2491
gcgggaaucuagaaacuca

SEQ ID NO: 3370253 - RNA, 19 nt, Neisseria meningitidis Z2491
gcgggaaucuagaaaugaa

SEQ ID NO: 3370254 - RNA, 21 nt, Neisseria meningitidis Z2491
gcgggaaucuagaacguggaa

SEQ ID NO: 3370255 - RNA, 21 nt, Neisseria meningitidis Z2491
gcgggaaucuagacauucaau

SEQ ID NO: 3370256 - RNA, 20 nt, Neisseria meningitidis Z2491
gcgggaaucuagaccuuaga

SEQ ID NO: 3370257 - RNA, 18 nt, Neisseria meningitidis Z2491
gcgggaaucuaggucugu

SEQ ID NO: 3370258 - RNA, 19 nt, Neisseria meningitidis Z2491
gcgggaaucuaggucuuua

SEQ ID NO: 3370259 - RNA, 22 nt, Neisseria meningitidis Z2491
gcgggaaugaugggguuuuuaa

SEQ ID NO: 3370260 - RNA, 18 nt, Neisseria meningitidis Z2491
gcgggagucuggcggcau

SEQ ID NO: 3370261 - RNA, 15 nt, Neisseria meningitidis Z2491
gcgggcaggcggcug

SEQ ID NO: 3370262 - RNA, 16 nt, Neisseria meningitidis Z2491
gcgggcaggcggcugc

SEQ ID NO: 3370263 - RNA, 18 nt, Neisseria meningitidis Z2491
gcgggccuuuggcggcgg

SEQ ID NO: 3370264 - RNA, 20 nt, Neisseria meningitidis Z2491
gcgggcggugcgcggcagcu

SEQ ID NO: 3370265 - RNA, 15 nt, Neisseria meningitidis Z2491
gcgggcguuccacaa

SEQ ID NO: 3370266 - RNA, 15 nt, Neisseria meningitidis Z2491
gcggggauucugucc

SEQ ID NO: 3370267 - RNA, 15 nt, Neisseria meningitidis Z2491
gcgggugaugccgac

SEQ ID NO: 3370268 - RNA, 19 nt, Neisseria meningitidis Z2491
gcggguuuggaaugcgcga

SEQ ID NO: 3370269 - RNA, 15 nt, Neisseria meningitidis Z2491
gcgguaacgcgacgg

SEQ ID NO: 3370270 - RNA, 19 nt, Neisseria meningitidis Z2491
gcgguacggcaacuuuuuu

SEQ ID NO: 3370271 - RNA, 17 nt, Neisseria meningitidis Z2491
gcgguccaaaacggcgg

SEQ ID NO: 3370272 - RNA, 19 nt, Neisseria meningitidis Z2491
gcggucgauguggcugaug

SEQ ID NO: 3370273 - RNA, 19 nt, Neisseria meningitidis Z2491
gcggucgcaucggcggcgu

SEQ ID NO: 3370274 - RNA, 17 nt, Neisseria meningitidis Z2491
gcggucguguucuucau

SEQ ID NO: 3370275 - RNA, 22 nt, Neisseria meningitidis Z2491
gcggugucggacaccagcgcga

SEQ ID NO: 3370276 - RNA, 17 nt, Neisseria meningitidis Z2491
gcggugugcgccgccgg

SEQ ID NO: 3370277 - RNA, 19 nt, Neisseria meningitidis Z2491
gcggugugcgccgccggug

SEQ ID NO: 3370278 - RNA, 21 nt, Neisseria meningitidis Z2491
gcgguucagacggcauuuuua

SEQ ID NO: 3370279 - RNA, 14 nt, Neisseria meningitidis Z2491
gcgguuggcggcgg

SEQ ID NO: 3370280 - RNA, 14 nt, Neisseria meningitidis Z2491
gcguaaagcgguuu

SEQ ID NO: 3370281 - RNA, 17 nt, Neisseria meningitidis Z2491
gcguaauuccggcagcc

SEQ ID NO: 3370282 - RNA, 13 nt, Neisseria meningitidis Z2491
gcguaggcggcgg

SEQ ID NO: 3370283 - RNA, 14 nt, Neisseria meningitidis Z2491
gcguaggcggcggc

SEQ ID NO: 3370284 - RNA, 16 nt, Neisseria meningitidis Z2491
gcguaucaaaaaauaa

SEQ ID NO: 3370285 - RNA, 18 nt, Neisseria meningitidis Z2491
gcguauccagccgccauc

SEQ ID NO: 3370286 - RNA, 21 nt, Neisseria meningitidis Z2491
gcguauugagcgacgaccauu

SEQ ID NO: 3370287 - RNA, 18 nt, Neisseria meningitidis Z2491
gcgucaaacagacggaau

SEQ ID NO: 3370288 - RNA, 18 nt, Neisseria meningitidis Z2491
gcgucaucaaggcgacgg

SEQ ID NO: 3370289 - RNA, 20 nt, Neisseria meningitidis Z2491
gcgucauucccgcaaaagcg

SEQ ID NO: 3370290 - RNA, 22 nt, Neisseria meningitidis Z2491
gcgucccaaauauuggcgggcg

SEQ ID NO: 3370291 - RNA, 22 nt, Neisseria meningitidis Z2491
gcguccgcgauaaggcgcgucc

SEQ ID NO: 3370292 - RNA, 23 nt, Neisseria meningitidis Z2491
gcgucggagaaaaacaaguuuuc

SEQ ID NO: 3370293 - RNA, 19 nt, Neisseria meningitidis Z2491
gcgugacgaaaauuuaucc

SEQ ID NO: 3370294 - RNA, 14 nt, Neisseria meningitidis Z2491
gcgugcaggcgcau

SEQ ID NO: 3370295 - RNA, 15 nt, Neisseria meningitidis Z2491
gcgugccggucagga

SEQ ID NO: 3370296 - RNA, 20 nt, Neisseria meningitidis Z2491
gcgugggucggguucaacau

SEQ ID NO: 3370297 - RNA, 15 nt, Neisseria meningitidis Z2491
gcguguauuuuggua

SEQ ID NO: 3370298 - RNA, 15 nt, Neisseria meningitidis Z2491
gcguguuuguguucg

SEQ ID NO: 3370299 - RNA, 19 nt, Neisseria meningitidis Z2491
gcguuaacggucaacccgu

SEQ ID NO: 3370300 - RNA, 21 nt, Neisseria meningitidis Z2491
gcguuaccaauaacggcugcu

SEQ ID NO: 3370301 - RNA, 23 nt, Neisseria meningitidis Z2491
gcguuaccucgccuugccguacu

SEQ ID NO: 3370302 - RNA, 15 nt, Neisseria meningitidis Z2491
gcguuacuuugcguu

SEQ ID NO: 3370303 - RNA, 16 nt, Neisseria meningitidis Z2491
gcguucaaaugccguc

SEQ ID NO: 3370304 - RNA, 17 nt, Neisseria meningitidis Z2491
gcguucaaaugccgucu

SEQ ID NO: 3370305 - RNA, 20 nt, Neisseria meningitidis Z2491
gcguucaacauccgcagacg

SEQ ID NO: 3370306 - RNA, 24 nt, Neisseria meningitidis Z2491
gcguucaccaucuacauaaacagg

SEQ ID NO: 3370307 - RNA, 15 nt, Neisseria meningitidis Z2491
gcguucagacggcau

SEQ ID NO: 3370308 - RNA, 19 nt, Neisseria meningitidis Z2491
gcguuccaaauauuuccug

SEQ ID NO: 3370309 - RNA, 18 nt, Neisseria meningitidis Z2491
gcguuccacaaauccgcc

SEQ ID NO: 3370310 - RNA, 19 nt, Neisseria meningitidis Z2491
gcguucgucuaagaaaacc

SEQ ID NO: 3370311 - RNA, 13 nt, Neisseria meningitidis Z2491
gcguugaguuuca

SEQ ID NO: 3370312 - RNA, 20 nt, Neisseria meningitidis Z2491
gcguugaguuucagcuauuu

SEQ ID NO: 3370313 - RNA, 18 nt, Neisseria meningitidis Z2491
gcguugccucgccuugcc

SEQ ID NO: 3370314 - RNA, 20 nt, Neisseria meningitidis Z2491
gcguuucagagcauugcgca

SEQ ID NO: 3370315 - RNA, 11 nt, Neisseria meningitidis Z2491
gcguuuuucag

SEQ ID NO: 3370316 - RNA, 14 nt, Neisseria meningitidis Z2491
gcguuuuucagacg

SEQ ID NO: 3370317 - RNA, 12 nt, Neisseria meningitidis Z2491
gcguuuuucggg

SEQ ID NO: 3370318 - RNA, 17 nt, Neisseria meningitidis Z2491
gcuaaaacaacugcaau

SEQ ID NO: 3370319 - RNA, 16 nt, Neisseria meningitidis Z2491
gcuaaaaucccauuau

SEQ ID NO: 3370320 - RNA, 17 nt, Neisseria meningitidis Z2491
gcuaaagcaauuuaucg

SEQ ID NO: 3370321 - RNA, 17 nt, Neisseria meningitidis Z2491
gcuaacguacaaaugcc

SEQ ID NO: 3370322 - RNA, 17 nt, Neisseria meningitidis Z2491
gcuaaggcaauuuaucg

SEQ ID NO: 3370323 - RNA, 14 nt, Neisseria meningitidis Z2491
gcuacggcuugcua

SEQ ID NO: 3370324 - RNA, 17 nt, Neisseria meningitidis Z2491
gcuauccgcacagaaac

SEQ ID NO: 3370325 - RNA, 14 nt, Neisseria meningitidis Z2491
gcucaaacagcagg

SEQ ID NO: 3370326 - RNA, 18 nt, Neisseria meningitidis Z2491
gcucaaucccguugccaa

SEQ ID NO: 3370327 - RNA, 21 nt, Neisseria meningitidis Z2491
gcucagcccgaaauaggcugc

SEQ ID NO: 3370328 - RNA, 17 nt, Neisseria meningitidis Z2491
gcucauaguuuggacgg

SEQ ID NO: 3370329 - RNA, 17 nt, Neisseria meningitidis Z2491
gcuccaaucuaccguuu

SEQ ID NO: 3370330 - RNA, 16 nt, Neisseria meningitidis Z2491
gcuccauugucugaua

SEQ ID NO: 3370331 - RNA, 15 nt, Neisseria meningitidis Z2491
gcuccgcaaacaaaa

SEQ ID NO: 3370332 - RNA, 22 nt, Neisseria meningitidis Z2491
gcuccgccgucauucccgcgca

SEQ ID NO: 3370333 - RNA, 14 nt, Neisseria meningitidis Z2491
gcuccugacggcaa

SEQ ID NO: 3370334 - RNA, 18 nt, Neisseria meningitidis Z2491
gcuccugacggcaaacug

SEQ ID NO: 3370335 - RNA, 19 nt, Neisseria meningitidis Z2491
gcucgagcggcaggucuuc

SEQ ID NO: 3370336 - RNA, 13 nt, Neisseria meningitidis Z2491
gcucucaaaauau

SEQ ID NO: 3370337 - RNA, 16 nt, Neisseria meningitidis Z2491
gcugaaaaaaugccgu

SEQ ID NO: 3370338 - RNA, 10 nt, Neisseria meningitidis Z2491
gcugaaacuc

SEQ ID NO: 3370339 - RNA, 13 nt, Neisseria meningitidis Z2491
gcugaaauagaaa

SEQ ID NO: 3370340 - RNA, 16 nt, Neisseria meningitidis Z2491
gcugaaauagaaaaua

SEQ ID NO: 3370341 - RNA, 20 nt, Neisseria meningitidis Z2491
gcugaagcccacccuaccau

SEQ ID NO: 3370342 - RNA, 17 nt, Neisseria meningitidis Z2491
gcugacaaucggcucgc

SEQ ID NO: 3370343 - RNA, 14 nt, Neisseria meningitidis Z2491
gcugacguaaaaaa

SEQ ID NO: 3370344 - RNA, 17 nt, Neisseria meningitidis Z2491
gcugacguaaaaaacua

SEQ ID NO: 3370345 - RNA, 14 nt, Neisseria meningitidis Z2491
gcugaugacggcag

SEQ ID NO: 3370346 - RNA, 17 nt, Neisseria meningitidis Z2491
gcugauguauucuucca

SEQ ID NO: 3370347 - RNA, 22 nt, Neisseria meningitidis Z2491
gcugcaaaaauuuauuuagaaa

SEQ ID NO: 3370348 - RNA, 15 nt, Neisseria meningitidis Z2491
gcugcaguugggcga

SEQ ID NO: 3370349 - RNA, 14 nt, Neisseria meningitidis Z2491
gcugccgccccauu

SEQ ID NO: 3370350 - RNA, 20 nt, Neisseria meningitidis Z2491
gcugccgucauugagcagca

SEQ ID NO: 3370351 - RNA, 15 nt, Neisseria meningitidis Z2491
gcugcgcccaaagcg

SEQ ID NO: 3370352 - RNA, 15 nt, Neisseria meningitidis Z2491
gcugcgccuaugcaa

SEQ ID NO: 3370353 - RNA, 14 nt, Neisseria meningitidis Z2491
gcugcgggaaugac

SEQ ID NO: 3370354 - RNA, 15 nt, Neisseria meningitidis Z2491
gcugcgggccaucac

SEQ ID NO: 3370355 - RNA, 21 nt, Neisseria meningitidis Z2491
gcugcgggcgcguuugauuug

SEQ ID NO: 3370356 - RNA, 15 nt, Neisseria meningitidis Z2491
gcugcuguauuuuuc

SEQ ID NO: 3370357 - RNA, 16 nt, Neisseria meningitidis Z2491
gcugcuuugguaaaaa

SEQ ID NO: 3370358 - RNA, 18 nt, Neisseria meningitidis Z2491
gcugcuuugguaaaaaaa

SEQ ID NO: 3370359 - RNA, 21 nt, Neisseria meningitidis Z2491
gcuggaagcauugaccacuuc

SEQ ID NO: 3370360 - RNA, 22 nt, Neisseria meningitidis Z2491
gcugggauauugauacugccgu

SEQ ID NO: 3370361 - RNA, 13 nt, Neisseria meningitidis Z2491
gcugggcaugcag

SEQ ID NO: 3370362 - RNA, 13 nt, Neisseria meningitidis Z2491
gcugguaucuuua

SEQ ID NO: 3370363 - RNA, 12 nt, Neisseria meningitidis Z2491
gcuguacagguu

SEQ ID NO: 3370364 - RNA, 24 nt, Neisseria meningitidis Z2491
gcugucguugugcggcaaaacgcc

SEQ ID NO: 3370365 - RNA, 15 nt, Neisseria meningitidis Z2491
gcugucugaaaccug

SEQ ID NO: 3370366 - RNA, 21 nt, Neisseria meningitidis Z2491
gcuguguuugaauauuccgcc

SEQ ID NO: 3370367 - RNA, 15 nt, Neisseria meningitidis Z2491
gcuguucgcggcgug

SEQ ID NO: 3370368 - RNA, 18 nt, Neisseria meningitidis Z2491
gcuguugaaaaugccguc

SEQ ID NO: 3370369 - RNA, 17 nt, Neisseria meningitidis Z2491
gcuguuucagacggcau

SEQ ID NO: 3370370 - RNA, 18 nt, Neisseria meningitidis Z2491
gcuguuucagacggcauu

SEQ ID NO: 3370371 - RNA, 13 nt, Neisseria meningitidis Z2491
gcuguuugagccu

SEQ ID NO: 3370372 - RNA, 13 nt, Neisseria meningitidis Z2491
gcuguuuucuguu

SEQ ID NO: 3370373 - RNA, 22 nt, Neisseria meningitidis Z2491
gcuuaaaaaacaacugauucaa

SEQ ID NO: 3370374 - RNA, 17 nt, Neisseria meningitidis Z2491
gcuuaaacagcacugcc

SEQ ID NO: 3370375 - RNA, 16 nt, Neisseria meningitidis Z2491
gcuuaaaccuuaucca

SEQ ID NO: 3370376 - RNA, 19 nt, Neisseria meningitidis Z2491
gcuuacccgcuuuuuucag

SEQ ID NO: 3370377 - RNA, 19 nt, Neisseria meningitidis Z2491
gcuuaccgaccaacugcuc

SEQ ID NO: 3370378 - RNA, 22 nt, Neisseria meningitidis Z2491
gcuuagaccuaacguggguuug

SEQ ID NO: 3370379 - RNA, 16 nt, Neisseria meningitidis Z2491
gcuucaacagacggcg

SEQ ID NO: 3370380 - RNA, 21 nt, Neisseria meningitidis Z2491
gcuucaauaccuugagccaag

SEQ ID NO: 3370381 - RNA, 20 nt, Neisseria meningitidis Z2491
gcuucacaacuuccgcccgg

SEQ ID NO: 3370382 - RNA, 15 nt, Neisseria meningitidis Z2491
gcuucagacggcauu

SEQ ID NO: 3370383 - RNA, 16 nt, Neisseria meningitidis Z2491
gcuucagacggcauuu

SEQ ID NO: 3370384 - RNA, 14 nt, Neisseria meningitidis Z2491
gcuucagacgguau

SEQ ID NO: 3370385 - RNA, 23 nt, Neisseria meningitidis Z2491
gcuucagcaccuuagagaaucgu

SEQ ID NO: 3370386 - RNA, 21 nt, Neisseria meningitidis Z2491
gcuucauaccccacugccagc

SEQ ID NO: 3370387 - RNA, 12 nt, Neisseria meningitidis Z2491
gcuucaucuuua

SEQ ID NO: 3370388 - RNA, 17 nt, Neisseria meningitidis Z2491
gcuuccagaccagccgc

SEQ ID NO: 3370389 - RNA, 21 nt, Neisseria meningitidis Z2491
gcuuccagaccagccgccucc

SEQ ID NO: 3370390 - RNA, 23 nt, Neisseria meningitidis Z2491
gcuuccauaccguuuggcggcau

SEQ ID NO: 3370391 - RNA, 14 nt, Neisseria meningitidis Z2491
gcuuccucgugcca

SEQ ID NO: 3370392 - RNA, 18 nt, Neisseria meningitidis Z2491
gcuucgcacucugaaagc

SEQ ID NO: 3370393 - RNA, 15 nt, Neisseria meningitidis Z2491
gcuucgcgacgguau

SEQ ID NO: 3370394 - RNA, 13 nt, Neisseria meningitidis Z2491
gcuucggauaaau

SEQ ID NO: 3370395 - RNA, 17 nt, Neisseria meningitidis Z2491
gcuucggauaaauuuuu

SEQ ID NO: 3370396 - RNA, 18 nt, Neisseria meningitidis Z2491
gcuucggauaaauuuuug

SEQ ID NO: 3370397 - RNA, 16 nt, Neisseria meningitidis Z2491
gcuucgguuguauuuu

SEQ ID NO: 3370398 - RNA, 13 nt, Neisseria meningitidis Z2491
gcuucuuccagca

SEQ ID NO: 3370399 - RNA, 20 nt, Neisseria meningitidis Z2491
gcuucuuccagcaauuucug

SEQ ID NO: 3370400 - RNA, 19 nt, Neisseria meningitidis Z2491
gcuucuuccucgacagaca

SEQ ID NO: 3370401 - RNA, 18 nt, Neisseria meningitidis Z2491
gcuucuuugacggcgggc

SEQ ID NO: 3370402 - RNA, 20 nt, Neisseria meningitidis Z2491
gcuucuuugacggcgggcag

SEQ ID NO: 3370403 - RNA, 17 nt, Neisseria meningitidis Z2491
gcuugccgccgccaugu

SEQ ID NO: 3370404 - RNA, 17 nt, Neisseria meningitidis Z2491
gcuugguuuugcuucca

SEQ ID NO: 3370405 - RNA, 14 nt, Neisseria meningitidis Z2491
gcuuuauaguggau

SEQ ID NO: 3370406 - RNA, 13 nt, Neisseria meningitidis Z2491
gcuuucaccgaca

SEQ ID NO: 3370407 - RNA, 15 nt, Neisseria meningitidis Z2491
gcuuucagacggcau

SEQ ID NO: 3370408 - RNA, 17 nt, Neisseria meningitidis Z2491
gcuuucgcugccgccgc

SEQ ID NO: 3370409 - RNA, 12 nt, Neisseria meningitidis Z2491
gcuuucggggaa

SEQ ID NO: 3370410 - RNA, 20 nt, Neisseria meningitidis Z2491
gcuuugcgcgccuuuuuguu

SEQ ID NO: 3370411 - RNA, 14 nt, Neisseria meningitidis Z2491
gcuuuguaagaguu

SEQ ID NO: 3370412 - RNA, 16 nt, Neisseria meningitidis Z2491
gcuuuucauuucuaga

SEQ ID NO: 3370413 - RNA, 14 nt, Neisseria meningitidis Z2491
gcuuuucauuucug

SEQ ID NO: 3370414 - RNA, 19 nt, Neisseria meningitidis Z2491
gcuuuugaggcugccguca

SEQ ID NO: 3370415 - RNA, 15 nt, Neisseria meningitidis Z2491
gcuuuugaguuucgg

SEQ ID NO: 3370416 - RNA, 18 nt, Neisseria meningitidis Z2491
gcuuuuggcggcuuuuuu

SEQ ID NO: 3370417 - RNA, 23 nt, Neisseria meningitidis Z2491
gcuuuuuaaacaacaaauuuuug

SEQ ID NO: 3370418 - RNA, 15 nt, Neisseria meningitidis Z2491
gcuuuuuaauccaca

SEQ ID NO: 3370419 - RNA, 19 nt, Neisseria meningitidis Z2491
gcuuuuucuuuuaaccaua

SEQ ID NO: 3370420 - RNA, 21 nt, Neisseria meningitidis Z2491
gcuuuuuucagauuauuuauu

SEQ ID NO: 3370421 - RNA, 12 nt, Neisseria meningitidis Z2491
ggcaaacccgaa

SEQ ID NO: 3370422 - RNA, 20 nt, Neisseria meningitidis Z2491
ggcaaaugcugucugaaacc

SEQ ID NO: 3370423 - RNA, 13 nt, Neisseria meningitidis Z2491
ggcaaauuucagu

SEQ ID NO: 3370424 - RNA, 17 nt, Neisseria meningitidis Z2491
ggcaacaaaaugccguc

SEQ ID NO: 3370425 - RNA, 19 nt, Neisseria meningitidis Z2491
ggcaacaucauagaaauca

SEQ ID NO: 3370426 - RNA, 18 nt, Neisseria meningitidis Z2491
ggcaaggcgccggcggcu

SEQ ID NO: 3370427 - RNA, 15 nt, Neisseria meningitidis Z2491
ggcaaguguccggca

SEQ ID NO: 3370428 - RNA, 17 nt, Neisseria meningitidis Z2491
ggcaaguguccggcagc

SEQ ID NO: 3370429 - RNA, 18 nt, Neisseria meningitidis Z2491
ggcaaguguccggcagcc

SEQ ID NO: 3370430 - RNA, 23 nt, Neisseria meningitidis Z2491
ggcaaguuccaagauggcgagcg

SEQ ID NO: 3370431 - RNA, 16 nt, Neisseria meningitidis Z2491
ggcaauaauaaacgcc

SEQ ID NO: 3370432 - RNA, 18 nt, Neisseria meningitidis Z2491
ggcaauaauggcaaccaa

SEQ ID NO: 3370433 - RNA, 18 nt, Neisseria meningitidis Z2491
ggcaauauucaaagauua

SEQ ID NO: 3370434 - RNA, 16 nt, Neisseria meningitidis Z2491
ggcaauauucuuugaa

SEQ ID NO: 3370435 - RNA, 17 nt, Neisseria meningitidis Z2491
ggcaauccgcucuucgg

SEQ ID NO: 3370436 - RNA, 11 nt, Neisseria meningitidis Z2491
ggcaaugccgu

SEQ ID NO: 3370437 - RNA, 16 nt, Neisseria meningitidis Z2491
ggcacaaggcggcggc

SEQ ID NO: 3370438 - RNA, 21 nt, Neisseria meningitidis Z2491
ggcacaggcucaaacagcagg

SEQ ID NO: 3370439 - RNA, 16 nt, Neisseria meningitidis Z2491
ggcaccaauucuucaa

SEQ ID NO: 3370440 - RNA, 17 nt, Neisseria meningitidis Z2491
ggcacuuugcggcagau

SEQ ID NO: 3370441 - RNA, 18 nt, Neisseria meningitidis Z2491
ggcagagcggauucuguu

SEQ ID NO: 3370442 - RNA, 22 nt, Neisseria meningitidis Z2491
ggcagauguauuguccgccguc

SEQ ID NO: 3370443 - RNA, 13 nt, Neisseria meningitidis Z2491
ggcagcacaggca

SEQ ID NO: 3370444 - RNA, 14 nt, Neisseria meningitidis Z2491
ggcagcacaggcaa

SEQ ID NO: 3370445 - RNA, 16 nt, Neisseria meningitidis Z2491
ggcagccaccucgccg

SEQ ID NO: 3370446 - RNA, 17 nt, Neisseria meningitidis Z2491
ggcagccaccucgccgc

SEQ ID NO: 3370447 - RNA, 18 nt, Neisseria meningitidis Z2491
ggcagcggcaucgcgguc

SEQ ID NO: 3370448 - RNA, 21 nt, Neisseria meningitidis Z2491
ggcagcguggagggacagcgu

SEQ ID NO: 3370449 - RNA, 20 nt, Neisseria meningitidis Z2491
ggcaggcagugcaugaauuu

SEQ ID NO: 3370450 - RNA, 18 nt, Neisseria meningitidis Z2491
ggcagguaaaaaauagaa

SEQ ID NO: 3370451 - RNA, 16 nt, Neisseria meningitidis Z2491
ggcaggucuucgggca

SEQ ID NO: 3370452 - RNA, 17 nt, Neisseria meningitidis Z2491
ggcaguaaugccgccgc

SEQ ID NO: 3370453 - RNA, 12 nt, Neisseria meningitidis Z2491
ggcaguaucaau

SEQ ID NO: 3370454 - RNA, 22 nt, Neisseria meningitidis Z2491
ggcagucccguuugaaaacaau

SEQ ID NO: 3370455 - RNA, 13 nt, Neisseria meningitidis Z2491
ggcaguuccaaag

SEQ ID NO: 3370456 - RNA, 17 nt, Neisseria meningitidis Z2491
ggcaguuccaaagccuu

SEQ ID NO: 3370457 - RNA, 14 nt, Neisseria meningitidis Z2491
ggcaguugggaauc

SEQ ID NO: 3370458 - RNA, 13 nt, Neisseria meningitidis Z2491
ggcaguuuccaau

SEQ ID NO: 3370459 - RNA, 22 nt, Neisseria meningitidis Z2491
ggcaucgcgcacuugagccgca

SEQ ID NO: 3370460 - RNA, 23 nt, Neisseria meningitidis Z2491
ggcaucugcugcgucaaaccagc

SEQ ID NO: 3370461 - RNA, 19 nt, Neisseria meningitidis Z2491
ggcauggccgaccauuucu

SEQ ID NO: 3370462 - RNA, 19 nt, Neisseria meningitidis Z2491
ggcauucugcacgccgacu

SEQ ID NO: 3370463 - RNA, 14 nt, Neisseria meningitidis Z2491
ggcauugaaauucc

SEQ ID NO: 3370464 - RNA, 21 nt, Neisseria meningitidis Z2491
ggcauuggguuuucuguuccu

SEQ ID NO: 3370465 - RNA, 19 nt, Neisseria meningitidis Z2491
ggcauuucugcgaaagcgg

SEQ ID NO: 3370466 - RNA, 16 nt, Neisseria meningitidis Z2491
ggcauuuuagauuugg

SEQ ID NO: 3370467 - RNA, 19 nt, Neisseria meningitidis Z2491
ggcauuuucaacagcagga

SEQ ID NO: 3370468 - RNA, 18 nt, Neisseria meningitidis Z2491
ggcauuuucuauuuuaca

SEQ ID NO: 3370469 - RNA, 15 nt, Neisseria meningitidis Z2491
ggcauuuuguuugcg

SEQ ID NO: 3370470 - RNA, 17 nt, Neisseria meningitidis Z2491
ggcauuuuuuacacaau

SEQ ID NO: 3370471 - RNA, 20 nt, Neisseria meningitidis Z2491
ggcauuuuuuuaccaaagca

SEQ ID NO: 3370472 - RNA, 14 nt, Neisseria meningitidis Z2491
ggcauuuuuuucgg

SEQ ID NO: 3370473 - RNA, 21 nt, Neisseria meningitidis Z2491
ggccggaaaaccuugccgccc

SEQ ID NO: 3370474 - RNA, 22 nt, Neisseria meningitidis Z2491
ggccggaaaccguauauuuccc

SEQ ID NO: 3370475 - RNA, 23 nt, Neisseria meningitidis Z2491
ggccggcgcagcuccucccuccc

SEQ ID NO: 3370476 - RNA, 16 nt, Neisseria meningitidis Z2491
ggccuuuggcggcggc

SEQ ID NO: 3370477 - RNA, 13 nt, Neisseria meningitidis Z2491
ggcgaccgccugc

SEQ ID NO: 3370478 - RNA, 15 nt, Neisseria meningitidis Z2491
ggcgacggcaauauu

SEQ ID NO: 3370479 - RNA, 22 nt, Neisseria meningitidis Z2491
ggcgacgguggugcguuugugu

SEQ ID NO: 3370480 - RNA, 19 nt, Neisseria meningitidis Z2491
ggcgagccaauagccgccg

SEQ ID NO: 3370481 - RNA, 22 nt, Neisseria meningitidis Z2491
ggcgagccaauagccgccggug

SEQ ID NO: 3370482 - RNA, 22 nt, Neisseria meningitidis Z2491
ggcgaguccgcgcgaauagcug

SEQ ID NO: 3370483 - RNA, 17 nt, Neisseria meningitidis Z2491
ggcgauggcgcggcgca

SEQ ID NO: 3370484 - RNA, 14 nt, Neisseria meningitidis Z2491
ggcgcaaaccuuaa

SEQ ID NO: 3370485 - RNA, 15 nt, Neisseria meningitidis Z2491
ggcgcacuuagccug

SEQ ID NO: 3370486 - RNA, 15 nt, Neisseria meningitidis Z2491
ggcgcaucccgcaaa

SEQ ID NO: 3370487 - RNA, 12 nt, Neisseria meningitidis Z2491
ggcgccggcggc

SEQ ID NO: 3370488 - RNA, 16 nt, Neisseria meningitidis Z2491
ggcgcgccgcuguauu

SEQ ID NO: 3370489 - RNA, 17 nt, Neisseria meningitidis Z2491
ggcgcggcugccgaccg

SEQ ID NO: 3370490 - RNA, 11 nt, Neisseria meningitidis Z2491
ggcgcggcugg

SEQ ID NO: 3370491 - RNA, 19 nt, Neisseria meningitidis Z2491
ggcgcgguuggcggcggcg

SEQ ID NO: 3370492 - RNA, 18 nt, Neisseria meningitidis Z2491
ggcggacauaaaccguuu

SEQ ID NO: 3370493 - RNA, 19 nt, Neisseria meningitidis Z2491
ggcggauuucuccgucggg

SEQ ID NO: 3370494 - RNA, 20 nt, Neisseria meningitidis Z2491
ggcggcaaauuccgucagca

SEQ ID NO: 3370495 - RNA, 17 nt, Neisseria meningitidis Z2491
ggcggcaacaaugccgu

SEQ ID NO: 3370496 - RNA, 17 nt, Neisseria meningitidis Z2491
ggcggccugguugaugu

SEQ ID NO: 3370497 - RNA, 19 nt, Neisseria meningitidis Z2491
ggcggcgaagccgcagaca

SEQ ID NO: 3370498 - RNA, 19 nt, Neisseria meningitidis Z2491
ggcggcgagcaggguuugc

SEQ ID NO: 3370499 - RNA, 13 nt, Neisseria meningitidis Z2491
ggcggcgagccgc

SEQ ID NO: 3370500 - RNA, 14 nt, Neisseria meningitidis Z2491
ggcggcgagccgca

SEQ ID NO: 3370501 - RNA, 15 nt, Neisseria meningitidis Z2491
ggcggcggcaauauu

SEQ ID NO: 3370502 - RNA, 12 nt, Neisseria meningitidis Z2491
ggcggcggcaga

SEQ ID NO: 3370503 - RNA, 14 nt, Neisseria meningitidis Z2491
ggcggcgguuuccu

SEQ ID NO: 3370504 - RNA, 22 nt, Neisseria meningitidis Z2491
ggcggcuacuccugcugcggcg

SEQ ID NO: 3370505 - RNA, 16 nt, Neisseria meningitidis Z2491
ggcggcugcgggcgcg

SEQ ID NO: 3370506 - RNA, 19 nt, Neisseria meningitidis Z2491
ggcgggaagccagggcgga

SEQ ID NO: 3370507 - RNA, 23 nt, Neisseria meningitidis Z2491
ggcgggaauccagaaaguggaau

SEQ ID NO: 3370508 - RNA, 18 nt, Neisseria meningitidis Z2491
ggcgggcguuccacaaau

SEQ ID NO: 3370509 - RNA, 16 nt, Neisseria meningitidis Z2491
ggcgguagccguagcg

SEQ ID NO: 3370510 - RNA, 16 nt, Neisseria meningitidis Z2491
ggcguaggcggcggcg

SEQ ID NO: 3370511 - RNA, 17 nt, Neisseria meningitidis Z2491
ggcgugccgaugagucc

SEQ ID NO: 3370512 - RNA, 14 nt, Neisseria meningitidis Z2491
ggcguggcuggauu

SEQ ID NO: 3370513 - RNA, 22 nt, Neisseria meningitidis Z2491
ggcguuaauaaaaguaccgcag

SEQ ID NO: 3370514 - RNA, 17 nt, Neisseria meningitidis Z2491
ggcguuuuucagacggc

SEQ ID NO: 3370515 - RNA, 18 nt, Neisseria meningitidis Z2491
ggcguuuuucagacggcc

SEQ ID NO: 3370516 - RNA, 19 nt, Neisseria meningitidis Z2491
ggcuacuccugcugcggcg

SEQ ID NO: 3370517 - RNA, 18 nt, Neisseria meningitidis Z2491
ggcuccuccgucaaaaca

SEQ ID NO: 3370518 - RNA, 20 nt, Neisseria meningitidis Z2491
ggcuccuucgggcgcuugga

SEQ ID NO: 3370519 - RNA, 19 nt, Neisseria meningitidis Z2491
ggcucguuuaauuaaaacu

SEQ ID NO: 3370520 - RNA, 13 nt, Neisseria meningitidis Z2491
ggcucucaaaaua

SEQ ID NO: 3370521 - RNA, 13 nt, Neisseria meningitidis Z2491
ggcucugauauuc

SEQ ID NO: 3370522 - RNA, 19 nt, Neisseria meningitidis Z2491
ggucuaaccauggcauacu

SEQ ID NO: 3370523 - RNA, 23 nt, Neisseria meningitidis Z2491
ggucucuuccuaaccgaaaaaau

SEQ ID NO: 3370524 - RNA, 16 nt, Neisseria meningitidis Z2491
ggucuucgacgaaggc

SEQ ID NO: 3370525 - RNA, 16 nt, Neisseria meningitidis Z2491
ggucuucuuuggcuuu

SEQ ID NO: 3370526 - RNA, 16 nt, Neisseria meningitidis Z2491
ggugaacacuucuucg

SEQ ID NO: 3370527 - RNA, 22 nt, Neisseria meningitidis Z2491
ggugcagauguucggcaagauc

SEQ ID NO: 3370528 - RNA, 17 nt, Neisseria meningitidis Z2491
ggugcgguaagggcgca

SEQ ID NO: 3370529 - RNA, 17 nt, Neisseria meningitidis Z2491
ggugcguuuuauuggag

SEQ ID NO: 3370530 - RNA, 13 nt, Neisseria meningitidis Z2491
ggugcuucagcac

SEQ ID NO: 3370531 - RNA, 19 nt, Neisseria meningitidis Z2491
gguggcgaagccggcggcg

SEQ ID NO: 3370532 - RNA, 15 nt, Neisseria meningitidis Z2491
ggugugcaggcugcc

SEQ ID NO: 3370533 - RNA, 23 nt, Neisseria meningitidis Z2491
ggugugccgcugauuuggaauuu

SEQ ID NO: 3370534 - RNA, 15 nt, Neisseria meningitidis Z2491
gguguuugcagauaa

SEQ ID NO: 3370535 - RNA, 23 nt, Neisseria meningitidis Z2491
gguuaacggccgggcgcgguaac

SEQ ID NO: 3370536 - RNA, 20 nt, Neisseria meningitidis Z2491
gguucaaacuuuauccguua

SEQ ID NO: 3370537 - RNA, 13 nt, Neisseria meningitidis Z2491
gguucaaauaugg

SEQ ID NO: 3370538 - RNA, 17 nt, Neisseria meningitidis Z2491
gguucaaauauggugga

SEQ ID NO: 3370539 - RNA, 13 nt, Neisseria meningitidis Z2491
gguucagacggca

SEQ ID NO: 3370540 - RNA, 15 nt, Neisseria meningitidis Z2491
gguucagacggcauu

SEQ ID NO: 3370541 - RNA, 20 nt, Neisseria meningitidis Z2491
gguuccguacuaucuguacu

SEQ ID NO: 3370542 - RNA, 15 nt, Neisseria meningitidis Z2491
gguucggacggcauu

SEQ ID NO: 3370543 - RNA, 15 nt, Neisseria meningitidis Z2491
gguucggcuuggaau

SEQ ID NO: 3370544 - RNA, 15 nt, Neisseria meningitidis Z2491
gguucugauuuuguu

SEQ ID NO: 3370545 - RNA, 19 nt, Neisseria meningitidis Z2491
gguugaugcgguaauggau

SEQ ID NO: 3370546 - RNA, 16 nt, Neisseria meningitidis Z2491
gguuggaaggcggcgg

SEQ ID NO: 3370547 - RNA, 17 nt, Neisseria meningitidis Z2491
gguuggaaggcggcggc

SEQ ID NO: 3370548 - RNA, 13 nt, Neisseria meningitidis Z2491
gguuguuaccgcg

SEQ ID NO: 3370549 - RNA, 12 nt, Neisseria meningitidis Z2491
gguuuaucagaa

SEQ ID NO: 3370550 - RNA, 15 nt, Neisseria meningitidis Z2491
gguuuccgggcggug

SEQ ID NO: 3370551 - RNA, 15 nt, Neisseria meningitidis Z2491
gguuucuugagauuu

SEQ ID NO: 3370552 - RNA, 23 nt, Neisseria meningitidis Z2491
gguuugagcaguuuuuugacuug

SEQ ID NO: 3370553 - RNA, 14 nt, Neisseria meningitidis Z2491
gguuugcggcggca

SEQ ID NO: 3370554 - RNA, 12 nt, Neisseria meningitidis Z2491
gguuuuaacaau

SEQ ID NO: 3370555 - RNA, 18 nt, Neisseria meningitidis Z2491
gguuuucagacggcauuu

SEQ ID NO: 3370556 - RNA, 19 nt, Neisseria meningitidis Z2491
gguuuuccucgauuugaaa

SEQ ID NO: 3370557 - RNA, 13 nt, Neisseria meningitidis Z2491
gguuuuuugaguu

SEQ ID NO: 3370558 - RNA, 12 nt, Neisseria meningitidis Z2491
guaaaaaacuau

SEQ ID NO: 3370559 - RNA, 15 nt, Neisseria meningitidis Z2491
guaaaaaacuauaaa

SEQ ID NO: 3370560 - RNA, 17 nt, Neisseria meningitidis Z2491
guaaaaacaaaaaauca

SEQ ID NO: 3370561 - RNA, 15 nt, Neisseria meningitidis Z2491
guaaaaaugccgucu

SEQ ID NO: 3370562 - RNA, 17 nt, Neisseria meningitidis Z2491
guaaaaaugccgucuga

SEQ ID NO: 3370563 - RNA, 18 nt, Neisseria meningitidis Z2491
guaaaaaugccgucugaa

SEQ ID NO: 3370564 - RNA, 18 nt, Neisseria meningitidis Z2491
guaaaacgccaauuugua

SEQ ID NO: 3370565 - RNA, 16 nt, Neisseria meningitidis Z2491
guaaaacgguuucuug

SEQ ID NO: 3370566 - RNA, 19 nt, Neisseria meningitidis Z2491
guaaaaucaaguuuauccu

SEQ ID NO: 3370567 - RNA, 17 nt, Neisseria meningitidis Z2491
guaaagcgugcggcggu

SEQ ID NO: 3370568 - RNA, 15 nt, Neisseria meningitidis Z2491
guaaccgacgaaggc

SEQ ID NO: 3370569 - RNA, 13 nt, Neisseria meningitidis Z2491
guaacggauaaag

SEQ ID NO: 3370570 - RNA, 21 nt, Neisseria meningitidis Z2491
guaacgggcgagaugacggcu

SEQ ID NO: 3370571 - RNA, 15 nt, Neisseria meningitidis Z2491
guaacucuaaaccgu

SEQ ID NO: 3370572 - RNA, 18 nt, Neisseria meningitidis Z2491
guaagccuucauccgcaa

SEQ ID NO: 3370573 - RNA, 20 nt, Neisseria meningitidis Z2491
guaagcggagguugacggcu

SEQ ID NO: 3370574 - RNA, 17 nt, Neisseria meningitidis Z2491
guaauauucaaagguua

SEQ ID NO: 3370575 - RNA, 17 nt, Neisseria meningitidis Z2491
guaaucuugaaacccgu

SEQ ID NO: 3370576 - RNA, 21 nt, Neisseria meningitidis Z2491
guaaugacaugguuugcaguc

SEQ ID NO: 3370577 - RNA, 19 nt, Neisseria meningitidis Z2491
guaaugacccacgccaaac

SEQ ID NO: 3370578 - RNA, 16 nt, Neisseria meningitidis Z2491
guaauuccggcagccu

SEQ ID NO: 3370579 - RNA, 22 nt, Neisseria meningitidis Z2491
guaauuuccgaccaacucccag

SEQ ID NO: 3370580 - RNA, 11 nt, Neisseria meningitidis Z2491
guaauuuugaa

SEQ ID NO: 3370581 - RNA, 17 nt, Neisseria meningitidis Z2491
guacaaaugccgucuga

SEQ ID NO: 3370582 - RNA, 19 nt, Neisseria meningitidis Z2491
guacaaaugccgucugaaa

SEQ ID NO: 3370583 - RNA, 11 nt, Neisseria meningitidis Z2491
guacaggaaag

SEQ ID NO: 3370584 - RNA, 23 nt, Neisseria meningitidis Z2491
guacaggaaaguaguuucccugu

SEQ ID NO: 3370585 - RNA, 18 nt, Neisseria meningitidis Z2491
guaccaaccguccacaca

SEQ ID NO: 3370586 - RNA, 19 nt, Neisseria meningitidis Z2491
guaccgacggguuugcuuu

SEQ ID NO: 3370587 - RNA, 21 nt, Neisseria meningitidis Z2491
guaccgcagccuauuauuuuc

SEQ ID NO: 3370588 - RNA, 15 nt, Neisseria meningitidis Z2491
guaccgcaucuucaa

SEQ ID NO: 3370589 - RNA, 20 nt, Neisseria meningitidis Z2491
guaccggcaaugaaaaccga

SEQ ID NO: 3370590 - RNA, 18 nt, Neisseria meningitidis Z2491
guacuauuuguacugucu

SEQ ID NO: 3370591 - RNA, 16 nt, Neisseria meningitidis Z2491
guacuccuguuuuuaa

SEQ ID NO: 3370592 - RNA, 19 nt, Neisseria meningitidis Z2491
guacugguuuaaauuuagu

SEQ ID NO: 3370593 - RNA, 16 nt, Neisseria meningitidis Z2491
guacugguuuuuguua

SEQ ID NO: 3370594 - RNA, 16 nt, Neisseria meningitidis Z2491
guacugucugcagcuu

SEQ ID NO: 3370595 - RNA, 23 nt, Neisseria meningitidis Z2491
guagcguggauagcgagacggca

SEQ ID NO: 3370596 - RNA, 22 nt, Neisseria meningitidis Z2491
guaggcggcggcgguuuccugc

SEQ ID NO: 3370597 - RNA, 17 nt, Neisseria meningitidis Z2491
guaggcguaggucagcc

SEQ ID NO: 3370598 - RNA, 22 nt, Neisseria meningitidis Z2491
guaggcguugcccaagucguau

SEQ ID NO: 3370599 - RNA, 22 nt, Neisseria meningitidis Z2491
guauaaagauacaagaacuuua

SEQ ID NO: 3370600 - RNA, 17 nt, Neisseria meningitidis Z2491
guauauuucccgucugc

SEQ ID NO: 3370601 - RNA, 16 nt, Neisseria meningitidis Z2491
guaucaaaaaauaaag

SEQ ID NO: 3370602 - RNA, 13 nt, Neisseria meningitidis Z2491
guaucacaacaca

SEQ ID NO: 3370603 - RNA, 15 nt, Neisseria meningitidis Z2491
guaucaggcaucaca

SEQ ID NO: 3370604 - RNA, 19 nt, Neisseria meningitidis Z2491
guaucauacauagcaggca

SEQ ID NO: 3370605 - RNA, 22 nt, Neisseria meningitidis Z2491
guauccaaagucagggcggacg

SEQ ID NO: 3370606 - RNA, 21 nt, Neisseria meningitidis Z2491
guauccagccgccauccagca

SEQ ID NO: 3370607 - RNA, 14 nt, Neisseria meningitidis Z2491
guauccauugccga

SEQ ID NO: 3370608 - RNA, 15 nt, Neisseria meningitidis Z2491
guaucggcagcccgu

SEQ ID NO: 3370609 - RNA, 22 nt, Neisseria meningitidis Z2491
guaucugccccguuuuacccuc

SEQ ID NO: 3370610 - RNA, 17 nt, Neisseria meningitidis Z2491
guaucuuuaaacagcau

SEQ ID NO: 3370611 - RNA, 19 nt, Neisseria meningitidis Z2491
guaugcaaaaacaacccug

SEQ ID NO: 3370612 - RNA, 22 nt, Neisseria meningitidis Z2491
guaugccccacauaaacagcac

SEQ ID NO: 3370613 - RNA, 23 nt, Neisseria meningitidis Z2491
guaugcgaaucugcugcaaaccg

SEQ ID NO: 3370614 - RNA, 21 nt, Neisseria meningitidis Z2491
guaugcguucaaaugccgucu

SEQ ID NO: 3370615 - RNA, 12 nt, Neisseria meningitidis Z2491
guaugugcgccg

SEQ ID NO: 3370616 - RNA, 15 nt, Neisseria meningitidis Z2491
guauuagaaaugacu

SEQ ID NO: 3370617 - RNA, 15 nt, Neisseria meningitidis Z2491
guauucaagcagcaa

SEQ ID NO: 3370618 - RNA, 15 nt, Neisseria meningitidis Z2491
guauucggaggcgca

SEQ ID NO: 3370619 - RNA, 13 nt, Neisseria meningitidis Z2491
guauuuguauagu

SEQ ID NO: 3370620 - RNA, 16 nt, Neisseria meningitidis Z2491
guauuuuuaucuuuua

SEQ ID NO: 3370621 - RNA, 14 nt, Neisseria meningitidis Z2491
guauuuuuauuauu

SEQ ID NO: 3370622 - RNA, 13 nt, Neisseria meningitidis Z2491
gucaaaccagcuu

SEQ ID NO: 3370623 - RNA, 23 nt, Neisseria meningitidis Z2491
gugcccgguuggaaggcggcggc

SEQ ID NO: 3370624 - RNA, 13 nt, Neisseria meningitidis Z2491
gugccgaaauagu

SEQ ID NO: 3370625 - RNA, 16 nt, Neisseria meningitidis Z2491
gugccgaaguuaaauc

SEQ ID NO: 3370626 - RNA, 17 nt, Neisseria meningitidis Z2491
gugccgccaaagugcca

SEQ ID NO: 3370627 - RNA, 17 nt, Neisseria meningitidis Z2491
gugccgcugauuuggaa

SEQ ID NO: 3370628 - RNA, 13 nt, Neisseria meningitidis Z2491
gugccucuuccca

SEQ ID NO: 3370629 - RNA, 14 nt, Neisseria meningitidis Z2491
gugcgccgacuuuu

SEQ ID NO: 3370630 - RNA, 19 nt, Neisseria meningitidis Z2491
gugcgcguuaaaggucagc

SEQ ID NO: 3370631 - RNA, 20 nt, Neisseria meningitidis Z2491
gugcggcaaaacgccuucuu

SEQ ID NO: 3370632 - RNA, 17 nt, Neisseria meningitidis Z2491
gugcggcaucggaaaca

SEQ ID NO: 3370633 - RNA, 20 nt, Neisseria meningitidis Z2491
gugcggucgcaucggcggcg

SEQ ID NO: 3370634 - RNA, 22 nt, Neisseria meningitidis Z2491
gugcguuuguguucgcgcguga

SEQ ID NO: 3370635 - RNA, 18 nt, Neisseria meningitidis Z2491
gugcugcaucggcguauu

SEQ ID NO: 3370636 - RNA, 17 nt, Neisseria meningitidis Z2491
gugcuggcugccgaugu

SEQ ID NO: 3370637 - RNA, 18 nt, Neisseria meningitidis Z2491
gugcugggugguggcaag

SEQ ID NO: 3370638 - RNA, 17 nt, Neisseria meningitidis Z2491
gugcugucgguuucauc

SEQ ID NO: 3370639 - RNA, 12 nt, Neisseria meningitidis Z2491
guggaacagaaa

SEQ ID NO: 3370640 - RNA, 16 nt, Neisseria meningitidis Z2491
guggaagauucggcug

SEQ ID NO: 3370641 - RNA, 12 nt, Neisseria meningitidis Z2491
guggaaggcaac

SEQ ID NO: 3370642 - RNA, 14 nt, Neisseria meningitidis Z2491
guggauauugccgu

SEQ ID NO: 3370643 - RNA, 14 nt, Neisseria meningitidis Z2491
guggauuaaauuua

SEQ ID NO: 3370644 - RNA, 19 nt, Neisseria meningitidis Z2491
guggcgaagccggcggcga

SEQ ID NO: 3370645 - RNA, 13 nt, Neisseria meningitidis Z2491
guggcgacggcaa

SEQ ID NO: 3370646 - RNA, 17 nt, Neisseria meningitidis Z2491
guggcguauccauagau

SEQ ID NO: 3370647 - RNA, 22 nt, Neisseria meningitidis Z2491
guggcuaacguacaaaugccgu

SEQ ID NO: 3370648 - RNA, 16 nt, Neisseria meningitidis Z2491
guggcugaugcggacg

SEQ ID NO: 3370649 - RNA, 18 nt, Neisseria meningitidis Z2491
gugggaaucuagaauccc

SEQ ID NO: 3370650 - RNA, 17 nt, Neisseria meningitidis Z2491
gugggaaucuagaaucu

SEQ ID NO: 3370651 - RNA, 20 nt, Neisseria meningitidis Z2491
gugggaaucuggaaaccaaa

SEQ ID NO: 3370652 - RNA, 11 nt, Neisseria meningitidis Z2491
gugggaaugac

SEQ ID NO: 3370653 - RNA, 15 nt, Neisseria meningitidis Z2491
gugggaaugacggaa

SEQ ID NO: 3370654 - RNA, 21 nt, Neisseria meningitidis Z2491
guggguucgucaaacaacauc

SEQ ID NO: 3370655 - RNA, 16 nt, Neisseria meningitidis Z2491
gugguagagaaaauua

SEQ ID NO: 3370656 - RNA, 14 nt, Neisseria meningitidis Z2491
gugguugaagucca

SEQ ID NO: 3370657 - RNA, 18 nt, Neisseria meningitidis Z2491
guguaacugcaagaacag

SEQ ID NO: 3370658 - RNA, 13 nt, Neisseria meningitidis Z2491
guguaaucgacgg

SEQ ID NO: 3370659 - RNA, 21 nt, Neisseria meningitidis Z2491
guguaccgucaaauucuuuuu

SEQ ID NO: 3370660 - RNA, 12 nt, Neisseria meningitidis Z2491
guguaggcaguu

SEQ ID NO: 3370661 - RNA, 13 nt, Neisseria meningitidis Z2491
guguauaguggau

SEQ ID NO: 3370662 - RNA, 14 nt, Neisseria meningitidis Z2491
guguccguggagga

SEQ ID NO: 3370663 - RNA, 19 nt, Neisseria meningitidis Z2491
guguccugaccuuugcaga

SEQ ID NO: 3370664 - RNA, 13 nt, Neisseria meningitidis Z2491
gugugaaaauuua

SEQ ID NO: 3370665 - RNA, 21 nt, Neisseria meningitidis Z2491
gugugaaauaaaaaaugccgu

SEQ ID NO: 3370666 - RNA, 15 nt, Neisseria meningitidis Z2491
gugugccggaugcgg

SEQ ID NO: 3370667 - RNA, 16 nt, Neisseria meningitidis Z2491
gugugguugaagucca

SEQ ID NO: 3370668 - RNA, 14 nt, Neisseria meningitidis Z2491
guguucgcauuuug

SEQ ID NO: 3370669 - RNA, 16 nt, Neisseria meningitidis Z2491
guguuggguucuagau

SEQ ID NO: 3370670 - RNA, 19 nt, Neisseria meningitidis Z2491
guuaaggcagagauaaaag

SEQ ID NO: 3370671 - RNA, 20 nt, Neisseria meningitidis Z2491
guuaaggcagagauaaaagc

SEQ ID NO: 3370672 - RNA, 16 nt, Neisseria meningitidis Z2491
guuaaguauuucuauu

SEQ ID NO: 3370673 - RNA, 23 nt, Neisseria meningitidis Z2491
guuaauauggcggauuaaaauaa

SEQ ID NO: 3370674 - RNA, 19 nt, Neisseria meningitidis Z2491
guuaaucacuauaccaaac

SEQ ID NO: 3370675 - RNA, 21 nt, Neisseria meningitidis Z2491
guuaauccgcuauaauuuauu

SEQ ID NO: 3370676 - RNA, 20 nt, Neisseria meningitidis Z2491
guuaauccgcuauauauucu

SEQ ID NO: 3370677 - RNA, 18 nt, Neisseria meningitidis Z2491
guuacaaaacucuggucg

SEQ ID NO: 3370678 - RNA, 13 nt, Neisseria meningitidis Z2491
guuacaaauuuaa

SEQ ID NO: 3370679 - RNA, 21 nt, Neisseria meningitidis Z2491
guuacgccccucccaaauaaa

SEQ ID NO: 3370680 - RNA, 15 nt, Neisseria meningitidis Z2491
guuacuaaaauuuua

SEQ ID NO: 3370681 - RNA, 21 nt, Neisseria meningitidis Z2491
guuacuaaaauuuuaugcuca

SEQ ID NO: 3370682 - RNA, 23 nt, Neisseria meningitidis Z2491
guuacuaaaauuuuaugcucaau

SEQ ID NO: 3370683 - RNA, 12 nt, Neisseria meningitidis Z2491
guuaucccaaca

SEQ ID NO: 3370684 - RNA, 14 nt, Neisseria meningitidis Z2491
guuauuauuuucca

SEQ ID NO: 3370685 - RNA, 22 nt, Neisseria meningitidis Z2491
guuauucccgcgagaacagaaa

SEQ ID NO: 3370686 - RNA, 12 nt, Neisseria meningitidis Z2491
guucaaacacau

SEQ ID NO: 3370687 - RNA, 14 nt, Neisseria meningitidis Z2491
guucaaacugcccg

SEQ ID NO: 3370688 - RNA, 22 nt, Neisseria meningitidis Z2491
guucaaauccuccaccauuucu

SEQ ID NO: 3370689 - RNA, 19 nt, Neisseria meningitidis Z2491
guucaaaugccgucugaag

SEQ ID NO: 3370690 - RNA, 20 nt, Neisseria meningitidis Z2491
guucaaaugccgucugaagc

SEQ ID NO: 3370691 - RNA, 16 nt, Neisseria meningitidis Z2491
guucaauugcuuauuu

SEQ ID NO: 3370692 - RNA, 15 nt, Neisseria meningitidis Z2491
guucagaaaauccgc

SEQ ID NO: 3370693 - RNA, 14 nt, Neisseria meningitidis Z2491
guucagacggcauu

SEQ ID NO: 3370694 - RNA, 17 nt, Neisseria meningitidis Z2491
guucagacggcauuuuu

SEQ ID NO: 3370695 - RNA, 18 nt, Neisseria meningitidis Z2491
guucauucgacagcagcc

SEQ ID NO: 3370696 - RNA, 16 nt, Neisseria meningitidis Z2491
guuccaaaagccgccc

SEQ ID NO: 3370697 - RNA, 21 nt, Neisseria meningitidis Z2491
guuccgcaccuuuguguccga

SEQ ID NO: 3370698 - RNA, 18 nt, Neisseria meningitidis Z2491
guuccgcaucgucgggaa

SEQ ID NO: 3370699 - RNA, 23 nt, Neisseria meningitidis Z2491
guuccguacuauuuacacugucu

SEQ ID NO: 3370700 - RNA, 18 nt, Neisseria meningitidis Z2491
guuccuccacuaaaaaau

SEQ ID NO: 3370701 - RNA, 13 nt, Neisseria meningitidis Z2491
guucgauauuuuu

SEQ ID NO: 3370702 - RNA, 14 nt, Neisseria meningitidis Z2491
guucgauauuuuug

SEQ ID NO: 3370703 - RNA, 22 nt, Neisseria meningitidis Z2491
guucgccgacaucuucgaggaa

SEQ ID NO: 3370704 - RNA, 23 nt, Neisseria meningitidis Z2491
guucggaaucacuucgcucugcg

SEQ ID NO: 3370705 - RNA, 17 nt, Neisseria meningitidis Z2491
guucggacggcauuuuu

SEQ ID NO: 3370706 - RNA, 14 nt, Neisseria meningitidis Z2491
guucggauauuucc

SEQ ID NO: 3370707 - RNA, 16 nt, Neisseria meningitidis Z2491
guucggcaaaauccgc

SEQ ID NO: 3370708 - RNA, 19 nt, Neisseria meningitidis Z2491
guucggcaaaauccgcaaa

SEQ ID NO: 3370709 - RNA, 16 nt, Neisseria meningitidis Z2491
guucggcaaacggcag

SEQ ID NO: 3370710 - RNA, 17 nt, Neisseria meningitidis Z2491
guucguaagaaugacgg

SEQ ID NO: 3370711 - RNA, 15 nt, Neisseria meningitidis Z2491
guucguaggaaugac

SEQ ID NO: 3370712 - RNA, 16 nt, Neisseria meningitidis Z2491
guucgucaaccgugaa

SEQ ID NO: 3370713 - RNA, 19 nt, Neisseria meningitidis Z2491
guucguccagcagcaacac

SEQ ID NO: 3370714 - RNA, 18 nt, Neisseria meningitidis Z2491
guucgucuaagaaaacca

SEQ ID NO: 3370715 - RNA, 19 nt, Neisseria meningitidis Z2491
guucgugcaggguuuucuu

SEQ ID NO: 3370716 - RNA, 15 nt, Neisseria meningitidis Z2491
guucgugggaaugac

SEQ ID NO: 3370717 - RNA, 21 nt, Neisseria meningitidis Z2491
guucugcaccgcuucggucgg

SEQ ID NO: 3370718 - RNA, 21 nt, Neisseria meningitidis Z2491
guucugcauauaggcaagcag

SEQ ID NO: 3370719 - RNA, 16 nt, Neisseria meningitidis Z2491
guucuggauucccacu

SEQ ID NO: 3370720 - RNA, 23 nt, Neisseria meningitidis Z2491
guucuucuucgacguugccuucu

SEQ ID NO: 3370721 - RNA, 18 nt, Neisseria meningitidis Z2491
guugaaaacggcaguuuc

SEQ ID NO: 3370722 - RNA, 14 nt, Neisseria meningitidis Z2491
guugaaaaugccgu

SEQ ID NO: 3370723 - RNA, 19 nt, Neisseria meningitidis Z2491
guugagcuaaggcgagaca

SEQ ID NO: 3370724 - RNA, 10 nt, Neisseria meningitidis Z2491
uaaaaaaaug

SEQ ID NO: 3370725 - RNA, 20 nt, Neisseria meningitidis Z2491
uaaaaaaaugccgucugaaa

SEQ ID NO: 3370726 - RNA, 14 nt, Neisseria meningitidis Z2491
uaaaaaacaaacag

SEQ ID NO: 3370727 - RNA, 11 nt, Neisseria meningitidis Z2491
uaaaaaauaga

SEQ ID NO: 3370728 - RNA, 22 nt, Neisseria meningitidis Z2491
uaaaaaauauggaucagacauu

SEQ ID NO: 3370729 - RNA, 16 nt, Neisseria meningitidis Z2491
uaaaaaauccaaaaau

SEQ ID NO: 3370730 - RNA, 15 nt, Neisseria meningitidis Z2491
uaaaaacaauuuuau

SEQ ID NO: 3370731 - RNA, 22 nt, Neisseria meningitidis Z2491
uaaaaaccggauuuauuuuaga

SEQ ID NO: 3370732 - RNA, 22 nt, Neisseria meningitidis Z2491
uaaaaauccaacgcugcaaaaa

SEQ ID NO: 3370733 - RNA, 23 nt, Neisseria meningitidis Z2491
uaaaaauccaacgcugcaaaaau

SEQ ID NO: 3370734 - RNA, 11 nt, Neisseria meningitidis Z2491
uaaaaaucucc

SEQ ID NO: 3370735 - RNA, 11 nt, Neisseria meningitidis Z2491
uaaaaaugccg

SEQ ID NO: 3370736 - RNA, 14 nt, Neisseria meningitidis Z2491
uaaaaaugccgucu

SEQ ID NO: 3370737 - RNA, 18 nt, Neisseria meningitidis Z2491
uaaaaaugccgucugaaa

SEQ ID NO: 3370738 - RNA, 20 nt, Neisseria meningitidis Z2491
uaaaaaugccgucugaaagc

SEQ ID NO: 3370739 - RNA, 19 nt, Neisseria meningitidis Z2491
uaaaaauggaaaaaccggc

SEQ ID NO: 3370740 - RNA, 12 nt, Neisseria meningitidis Z2491
uaaaacaaagac

SEQ ID NO: 3370741 - RNA, 18 nt, Neisseria meningitidis Z2491
uaaaaccaaguagcagac

SEQ ID NO: 3370742 - RNA, 21 nt, Neisseria meningitidis Z2491
uaaaaccauaaggcuuuaagc

SEQ ID NO: 3370743 - RNA, 18 nt, Neisseria meningitidis Z2491
uaaaaccgauaaacaaca

SEQ ID NO: 3370744 - RNA, 19 nt, Neisseria meningitidis Z2491
uaaaaccgauaaacaacac

SEQ ID NO: 3370745 - RNA, 21 nt, Neisseria meningitidis Z2491
uaaaacgcggagaaguaauca

SEQ ID NO: 3370746 - RNA, 13 nt, Neisseria meningitidis Z2491
uaaaacuuaaaau

SEQ ID NO: 3370747 - RNA, 22 nt, Neisseria meningitidis Z2491
uaaaaggucuuuucuaaaauau

SEQ ID NO: 3370748 - RNA, 18 nt, Neisseria meningitidis Z2491
uaaaauaaaaauacuuau

SEQ ID NO: 3370749 - RNA, 21 nt, Neisseria meningitidis Z2491
uaaaaucccccgcaaaugaug

SEQ ID NO: 3370750 - RNA, 20 nt, Neisseria meningitidis Z2491
uaaaauccgguucauuucag

SEQ ID NO: 3370751 - RNA, 21 nt, Neisseria meningitidis Z2491
uaaaauccgguucauuucagg

SEQ ID NO: 3370752 - RNA, 17 nt, Neisseria meningitidis Z2491
uaaaauccgucauuccc

SEQ ID NO: 3370753 - RNA, 9 nt, Neisseria meningitidis Z2491
uaaaaugcc

SEQ ID NO: 3370754 - RNA, 12 nt, Neisseria meningitidis Z2491
uaaaaugcccau

SEQ ID NO: 3370755 - RNA, 22 nt, Neisseria meningitidis Z2491
uaaaaugccgucugaacucagg

SEQ ID NO: 3370756 - RNA, 18 nt, Neisseria meningitidis Z2491
uaaaauuccguuauuccc

SEQ ID NO: 3370757 - RNA, 17 nt, Neisseria meningitidis Z2491
uaaaauucgucauuccc

SEQ ID NO: 3370758 - RNA, 22 nt, Neisseria meningitidis Z2491
uaaaauucgucauucccacgaa

SEQ ID NO: 3370759 - RNA, 11 nt, Neisseria meningitidis Z2491
uaaaauuuauu

SEQ ID NO: 3370760 - RNA, 18 nt, Neisseria meningitidis Z2491
uaaaauuucaucauuccc

SEQ ID NO: 3370761 - RNA, 21 nt, Neisseria meningitidis Z2491
uaaaauuucaucauucccaca

SEQ ID NO: 3370762 - RNA, 22 nt, Neisseria meningitidis Z2491
uaaaauuucaucauucccacaa

SEQ ID NO: 3370763 - RNA, 18 nt, Neisseria meningitidis Z2491
uaaaauuucgucauuccc

SEQ ID NO: 3370764 - RNA, 14 nt, Neisseria meningitidis Z2491
uaaacaaaaaacag

SEQ ID NO: 3370765 - RNA, 17 nt, Neisseria meningitidis Z2491
uaaacaaaauaaacuca

SEQ ID NO: 3370766 - RNA, 22 nt, Neisseria meningitidis Z2491
uaaacaacacgcugccgcccaa

SEQ ID NO: 3370767 - RNA, 22 nt, Neisseria meningitidis Z2491
uaaacacuucuucauuacggau

SEQ ID NO: 3370768 - RNA, 12 nt, Neisseria meningitidis Z2491
uaaacagcacga

SEQ ID NO: 3370769 - RNA, 17 nt, Neisseria meningitidis Z2491
uaaacagcacugccucu

SEQ ID NO: 3370770 - RNA, 13 nt, Neisseria meningitidis Z2491
uaaacaggcacag

SEQ ID NO: 3370771 - RNA, 15 nt, Neisseria meningitidis Z2491
uaaacauuaucugac

SEQ ID NO: 3370772 - RNA, 22 nt, Neisseria meningitidis Z2491
uaaacauuuuugcguauucgcc

SEQ ID NO: 3370773 - RNA, 17 nt, Neisseria meningitidis Z2491
uaaaccaguacggcguu

SEQ ID NO: 3370774 - RNA, 20 nt, Neisseria meningitidis Z2491
uaaacccccgucauucccgc

SEQ ID NO: 3370775 - RNA, 14 nt, Neisseria meningitidis Z2491
uaaaccgaucaaac

SEQ ID NO: 3370776 - RNA, 17 nt, Neisseria meningitidis Z2491
uaaagaaccggauuccc

SEQ ID NO: 3370777 - RNA, 19 nt, Neisseria meningitidis Z2491
uaaagaaccggauucccgc

SEQ ID NO: 3370778 - RNA, 15 nt, Neisseria meningitidis Z2491
uaaagauaaaucuau

SEQ ID NO: 3370779 - RNA, 17 nt, Neisseria meningitidis Z2491
uaaagauacaagaacuu

SEQ ID NO: 3370780 - RNA, 19 nt, Neisseria meningitidis Z2491
uaaagcaauuuaucggaaa

SEQ ID NO: 3370781 - RNA, 21 nt, Neisseria meningitidis Z2491
uaaagcaauuuaucggaaaaa

SEQ ID NO: 3370782 - RNA, 21 nt, Neisseria meningitidis Z2491
uaaagccguccguaagccuuc

SEQ ID NO: 3370783 - RNA, 13 nt, Neisseria meningitidis Z2491
uaaaggaaguuuu

SEQ ID NO: 3370784 - RNA, 19 nt, Neisseria meningitidis Z2491
uaaaguccgauaaaauccg

SEQ ID NO: 3370785 - RNA, 21 nt, Neisseria meningitidis Z2491
uaaagugcggugaaaucuuau

SEQ ID NO: 3370786 - RNA, 13 nt, Neisseria meningitidis Z2491
uaaaguuuguccc

SEQ ID NO: 3370787 - RNA, 14 nt, Neisseria meningitidis Z2491
uaaauaaaauuuaa

SEQ ID NO: 3370788 - RNA, 15 nt, Neisseria meningitidis Z2491
uaaauagcugaaacu

SEQ ID NO: 3370789 - RNA, 19 nt, Neisseria meningitidis Z2491
uaaaucgggucgaaaccgg

SEQ ID NO: 3370790 - RNA, 21 nt, Neisseria meningitidis Z2491
uaaaucgguuccguacuaucu

SEQ ID NO: 3370791 - RNA, 17 nt, Neisseria meningitidis Z2491
uaaaugccgcaauuuca

SEQ ID NO: 3370792 - RNA, 15 nt, Neisseria meningitidis Z2491
uaaaugccgucugaa

SEQ ID NO: 3370793 - RNA, 16 nt, Neisseria meningitidis Z2491
uaaauucaacuuggua

SEQ ID NO: 3370794 - RNA, 23 nt, Neisseria meningitidis Z2491
uaaauuccuaaaacuuaaaauuu

SEQ ID NO: 3370795 - RNA, 19 nt, Neisseria meningitidis Z2491
uaaauucugaaacuuuaau

SEQ ID NO: 3370796 - RNA, 22 nt, Neisseria meningitidis Z2491
uaaauucuugccgcauuaaaau

SEQ ID NO: 3370797 - RNA, 18 nt, Neisseria meningitidis Z2491
uaaauuguccauuuuucu

SEQ ID NO: 3370798 - RNA, 17 nt, Neisseria meningitidis Z2491
uaaauuuaaaagggaac

SEQ ID NO: 3370799 - RNA, 19 nt, Neisseria meningitidis Z2491
uaaauuuaaaccaguacag

SEQ ID NO: 3370800 - RNA, 15 nt, Neisseria meningitidis Z2491
uaaauuuaauccacu

SEQ ID NO: 3370801 - RNA, 17 nt, Neisseria meningitidis Z2491
uaaauuuaauccacuau

SEQ ID NO: 3370802 - RNA, 14 nt, Neisseria meningitidis Z2491
uaaauuuaauucac

SEQ ID NO: 3370803 - RNA, 19 nt, Neisseria meningitidis Z2491
uaaauuuccagauucccgc

SEQ ID NO: 3370804 - RNA, 18 nt, Neisseria meningitidis Z2491
uaaauuuugaaacucuaa

SEQ ID NO: 3370805 - RNA, 16 nt, Neisseria meningitidis Z2491
uaaauuuuuaaaaccg

SEQ ID NO: 3370806 - RNA, 12 nt, Neisseria meningitidis Z2491
uaacaaaaacca

SEQ ID NO: 3370807 - RNA, 15 nt, Neisseria meningitidis Z2491
uaacaaaaaccagua

SEQ ID NO: 3370808 - RNA, 19 nt, Neisseria meningitidis Z2491
uaacaaaaaccaguacagc

SEQ ID NO: 3370809 - RNA, 16 nt, Neisseria meningitidis Z2491
uaacaaaaaucaggac

SEQ ID NO: 3370810 - RNA, 19 nt, Neisseria meningitidis Z2491
uaacaaaaaucaggacaag

SEQ ID NO: 3370811 - RNA, 22 nt, Neisseria meningitidis Z2491
uaacaaugcccgcaaucugaaa

SEQ ID NO: 3370812 - RNA, 23 nt, Neisseria meningitidis Z2491
uaacaaugcccgcaaucugaaau

SEQ ID NO: 3370813 - RNA, 15 nt, Neisseria meningitidis Z2491
uaacagcaacccugu

SEQ ID NO: 3370814 - RNA, 20 nt, Neisseria meningitidis Z2491
uaacagggaaagcagcagcc

SEQ ID NO: 3370815 - RNA, 20 nt, Neisseria meningitidis Z2491
uaacauacuuuguuucaaaa

SEQ ID NO: 3370816 - RNA, 22 nt, Neisseria meningitidis Z2491
uaacauacuuuguuucaaaaug

SEQ ID NO: 3370817 - RNA, 22 nt, Neisseria meningitidis Z2491
uaaccagccccaagccuaucca

SEQ ID NO: 3370818 - RNA, 19 nt, Neisseria meningitidis Z2491
uaaccauacuucauuaaag

SEQ ID NO: 3370819 - RNA, 18 nt, Neisseria meningitidis Z2491
uaacccgacaaaauaccg

SEQ ID NO: 3370820 - RNA, 13 nt, Neisseria meningitidis Z2491
uaaccgaaaaaau

SEQ ID NO: 3370821 - RNA, 14 nt, Neisseria meningitidis Z2491
uaaccgaaaaaaua

SEQ ID NO: 3370822 - RNA, 20 nt, Neisseria meningitidis Z2491
uaaccgaaaauaauugccuu

SEQ ID NO: 3370823 - RNA, 16 nt, Neisseria meningitidis Z2491
uaaccgauggaugaac

SEQ ID NO: 3370824 - RNA, 17 nt, Neisseria meningitidis Z2491
uaaccgcuguuuccguu

SEQ ID NO: 3370825 - RNA, 19 nt, Neisseria meningitidis Z2491
uacccaaaugcagaauaag

SEQ ID NO: 3370826 - RNA, 14 nt, Neisseria meningitidis Z2491
uacccaaggcagua

SEQ ID NO: 3370827 - RNA, 14 nt, Neisseria meningitidis Z2491
uaccccacugccag

SEQ ID NO: 3370828 - RNA, 17 nt, Neisseria meningitidis Z2491
uacccgauaaguuuccg

SEQ ID NO: 3370829 - RNA, 19 nt, Neisseria meningitidis Z2491
uacccucuuggauaaacau

SEQ ID NO: 3370830 - RNA, 15 nt, Neisseria meningitidis Z2491
uaccgaccaccacuu

SEQ ID NO: 3370831 - RNA, 19 nt, Neisseria meningitidis Z2491
uaccgacggcguaauccgc

SEQ ID NO: 3370832 - RNA, 14 nt, Neisseria meningitidis Z2491
uaccgauacauccg

SEQ ID NO: 3370833 - RNA, 17 nt, Neisseria meningitidis Z2491
uaccgauacauccgaau

SEQ ID NO: 3370834 - RNA, 17 nt, Neisseria meningitidis Z2491
uaccgcaaccugaaagg

SEQ ID NO: 3370835 - RNA, 23 nt, Neisseria meningitidis Z2491
uaccgccgccgccaaugccgucu

SEQ ID NO: 3370836 - RNA, 13 nt, Neisseria meningitidis Z2491
uaccgccuuguuc

SEQ ID NO: 3370837 - RNA, 13 nt, Neisseria meningitidis Z2491
uaccgggcaggcu

SEQ ID NO: 3370838 - RNA, 18 nt, Neisseria meningitidis Z2491
uaccgguauuuuuuucuu

SEQ ID NO: 3370839 - RNA, 14 nt, Neisseria meningitidis Z2491
uaccgucugaaacc

SEQ ID NO: 3370840 - RNA, 14 nt, Neisseria meningitidis Z2491
uaccgucugaaagg

SEQ ID NO: 3370841 - RNA, 15 nt, Neisseria meningitidis Z2491
uaccgucugaacacg

SEQ ID NO: 3370842 - RNA, 15 nt, Neisseria meningitidis Z2491
uaccguuauucugcc

SEQ ID NO: 3370843 - RNA, 20 nt, Neisseria meningitidis Z2491
uaccguuauucugccguggg

SEQ ID NO: 3370844 - RNA, 19 nt, Neisseria meningitidis Z2491
uaccguuucagacggcauu

SEQ ID NO: 3370845 - RNA, 23 nt, Neisseria meningitidis Z2491
uaccuccuaauucuacccaaaua

SEQ ID NO: 3370846 - RNA, 17 nt, Neisseria meningitidis Z2491
uaccugaaccuuauagu

SEQ ID NO: 3370847 - RNA, 17 nt, Neisseria meningitidis Z2491
uaccugccguauuuauu

SEQ ID NO: 3370848 - RNA, 20 nt, Neisseria meningitidis Z2491
uacgaaaaaaugccgucuga

SEQ ID NO: 3370849 - RNA, 19 nt, Neisseria meningitidis Z2491
uacgaaacggguucuguau

SEQ ID NO: 3370850 - RNA, 17 nt, Neisseria meningitidis Z2491
uacgaacaaugcaaaaa

SEQ ID NO: 3370851 - RNA, 21 nt, Neisseria meningitidis Z2491
uacgaacaaugcaaaaacauc

SEQ ID NO: 3370852 - RNA, 16 nt, Neisseria meningitidis Z2491
uacgacucaaaaucau

SEQ ID NO: 3370853 - RNA, 21 nt, Neisseria meningitidis Z2491
uacgcaaacuaacuuauacac

SEQ ID NO: 3370854 - RNA, 16 nt, Neisseria meningitidis Z2491
uacgcaauggcaaaac

SEQ ID NO: 3370855 - RNA, 16 nt, Neisseria meningitidis Z2491
uacgcggcugaaaaaa

SEQ ID NO: 3370856 - RNA, 21 nt, Neisseria meningitidis Z2491
uacgcggcugaaaaaaugccg

SEQ ID NO: 3370857 - RNA, 22 nt, Neisseria meningitidis Z2491
uacgcggcugaaaaaaugccgu

SEQ ID NO: 3370858 - RNA, 22 nt, Neisseria meningitidis Z2491
uacggaugucgaguucuuuuaa

SEQ ID NO: 3370859 - RNA, 11 nt, Neisseria meningitidis Z2491
uacggcagcca

SEQ ID NO: 3370860 - RNA, 17 nt, Neisseria meningitidis Z2491
uacggcggcggcaggca

SEQ ID NO: 3370861 - RNA, 17 nt, Neisseria meningitidis Z2491
uacggcguuggcucgcc

SEQ ID NO: 3370862 - RNA, 13 nt, Neisseria meningitidis Z2491
uacggucgcaccg

SEQ ID NO: 3370863 - RNA, 16 nt, Neisseria meningitidis Z2491
uacguggccuuuucuu

SEQ ID NO: 3370864 - RNA, 23 nt, Neisseria meningitidis Z2491
uacuaaaacacagccaaaauauu

SEQ ID NO: 3370865 - RNA, 19 nt, Neisseria meningitidis Z2491
uacuaaaauuuuaugcuca

SEQ ID NO: 3370866 - RNA, 20 nt, Neisseria meningitidis Z2491
uacuacgcggcugaaaaaau

SEQ ID NO: 3370867 - RNA, 17 nt, Neisseria meningitidis Z2491
uacuauuuguacugucu

SEQ ID NO: 3370868 - RNA, 14 nt, Neisseria meningitidis Z2491
uacuccaaaccuuu

SEQ ID NO: 3370869 - RNA, 19 nt, Neisseria meningitidis Z2491
uacuccgcauuguuggaaa

SEQ ID NO: 3370870 - RNA, 23 nt, Neisseria meningitidis Z2491
uacugccgcaaacggcaggcaaa

SEQ ID NO: 3370871 - RNA, 15 nt, Neisseria meningitidis Z2491
uacugccugccgcac

SEQ ID NO: 3370872 - RNA, 23 nt, Neisseria meningitidis Z2491
uacuggaugucgguaaucgccuu

SEQ ID NO: 3370873 - RNA, 12 nt, Neisseria meningitidis Z2491
uacuggauuccc

SEQ ID NO: 3370874 - RNA, 21 nt, Neisseria meningitidis Z2491
uacuggcaaauugaaaugccg

SEQ ID NO: 3370875 - RNA, 21 nt, Neisseria meningitidis Z2491
uacugguuuaaauuuaaucca

SEQ ID NO: 3370876 - RNA, 12 nt, Neisseria meningitidis Z2491
uacugguuuuug

SEQ ID NO: 3370877 - RNA, 19 nt, Neisseria meningitidis Z2491
uacugguuuuuguuaaucc

SEQ ID NO: 3370878 - RNA, 21 nt, Neisseria meningitidis Z2491
uacugguuuuuguuaauccac

SEQ ID NO: 3370879 - RNA, 18 nt, Neisseria meningitidis Z2491
uacugucugcggcucgcc

SEQ ID NO: 3370880 - RNA, 21 nt, Neisseria meningitidis Z2491
uacugucuuauuaaauauuaa

SEQ ID NO: 3370881 - RNA, 22 nt, Neisseria meningitidis Z2491
uacuguuguucuaaggucuaga

SEQ ID NO: 3370882 - RNA, 20 nt, Neisseria meningitidis Z2491
uacuuuauccaccaacuggu

SEQ ID NO: 3370883 - RNA, 21 nt, Neisseria meningitidis Z2491
uagaaaaccgaaacagaaacc

SEQ ID NO: 3370884 - RNA, 16 nt, Neisseria meningitidis Z2491
uagaaaaucaaaaaaa

SEQ ID NO: 3370885 - RNA, 17 nt, Neisseria meningitidis Z2491
uagaaaaugccgucuga

SEQ ID NO: 3370886 - RNA, 23 nt, Neisseria meningitidis Z2491
uagaaacucaaagcugcaagaau

SEQ ID NO: 3370887 - RNA, 19 nt, Neisseria meningitidis Z2491
uagaaaugccgucugaaca

SEQ ID NO: 3370888 - RNA, 17 nt, Neisseria meningitidis Z2491
uagaaccucaaacuuuc

SEQ ID NO: 3370889 - RNA, 19 nt, Neisseria meningitidis Z2491
uagaacguggaaucuaaga

SEQ ID NO: 3370890 - RNA, 14 nt, Neisseria meningitidis Z2491
uagacauucaaugc

SEQ ID NO: 3370891 - RNA, 16 nt, Neisseria meningitidis Z2491
uagacggcauuucauu

SEQ ID NO: 3370892 - RNA, 17 nt, Neisseria meningitidis Z2491
uagagaaucguucucuu

SEQ ID NO: 3370893 - RNA, 18 nt, Neisseria meningitidis Z2491
uagagaaucguucucuuu

SEQ ID NO: 3370894 - RNA, 23 nt, Neisseria meningitidis Z2491
uagagugaccgcgaacaucaucu

SEQ ID NO: 3370895 - RNA, 15 nt, Neisseria meningitidis Z2491
uagauauuuagcauu

SEQ ID NO: 3370896 - RNA, 11 nt, Neisseria meningitidis Z2491
uagauucccac

SEQ ID NO: 3370897 - RNA, 12 nt, Neisseria meningitidis Z2491
uagauucccacu

SEQ ID NO: 3370898 - RNA, 15 nt, Neisseria meningitidis Z2491
uagauugcaggcauu

SEQ ID NO: 3370899 - RNA, 18 nt, Neisseria meningitidis Z2491
uagauuuuuuuauuuaaa

SEQ ID NO: 3370900 - RNA, 17 nt, Neisseria meningitidis Z2491
uagcaaaauaaaaugcc

SEQ ID NO: 3370901 - RNA, 16 nt, Neisseria meningitidis Z2491
uagcaacugcuuucgc

SEQ ID NO: 3370902 - RNA, 15 nt, Neisseria meningitidis Z2491
uagcauuuaauucac

SEQ ID NO: 3370903 - RNA, 12 nt, Neisseria meningitidis Z2491
uagccaaaaaaa

SEQ ID NO: 3370904 - RNA, 14 nt, Neisseria meningitidis Z2491
uagccaaaaaaacc

SEQ ID NO: 3370905 - RNA, 17 nt, Neisseria meningitidis Z2491
uagccgucgccccaaaa

SEQ ID NO: 3370906 - RNA, 14 nt, Neisseria meningitidis Z2491
uagcgagacggcau

SEQ ID NO: 3370907 - RNA, 19 nt, Neisseria meningitidis Z2491
uagcguccgaaaugguuua

SEQ ID NO: 3370908 - RNA, 13 nt, Neisseria meningitidis Z2491
uagcguuuuaauu

SEQ ID NO: 3370909 - RNA, 13 nt, Neisseria meningitidis Z2491
uaggacaaaugcc

SEQ ID NO: 3370910 - RNA, 14 nt, Neisseria meningitidis Z2491
uaggacaaaugccg

SEQ ID NO: 3370911 - RNA, 18 nt, Neisseria meningitidis Z2491
uaggacaaaugccgccag

SEQ ID NO: 3370912 - RNA, 18 nt, Neisseria meningitidis Z2491
uaggagaaaucagaaaag

SEQ ID NO: 3370913 - RNA, 14 nt, Neisseria meningitidis Z2491
uaggauaggcugcu

SEQ ID NO: 3370914 - RNA, 20 nt, Neisseria meningitidis Z2491
uaggauaggucucuuccuaa

SEQ ID NO: 3370915 - RNA, 23 nt, Neisseria meningitidis Z2491
uaggcacgaaucuuauccacaga

SEQ ID NO: 3370916 - RNA, 23 nt, Neisseria meningitidis Z2491
uaggcggcagcgggcgcacuuag

SEQ ID NO: 3370917 - RNA, 16 nt, Neisseria meningitidis Z2491
uaggcgggacggccgc

SEQ ID NO: 3370918 - RNA, 16 nt, Neisseria meningitidis Z2491
uaggcguaggucagcc

SEQ ID NO: 3370919 - RNA, 14 nt, Neisseria meningitidis Z2491
uaggcuuuuuccaa

SEQ ID NO: 3370920 - RNA, 13 nt, Neisseria meningitidis Z2491
uagggacgaaaau

SEQ ID NO: 3370921 - RNA, 23 nt, Neisseria meningitidis Z2491
uaggguaauuuauccgaaauaac

SEQ ID NO: 3370922 - RNA, 14 nt, Neisseria meningitidis Z2491
uagguuacuaaaau

SEQ ID NO: 3370923 - RNA, 18 nt, Neisseria meningitidis Z2491
uagguuucugauuuugau

SEQ ID NO: 3370924 - RNA, 23 nt, Neisseria meningitidis Z2491
uaguacggcaaggcaaggcaaca

SEQ ID NO: 3370925 - RNA, 19 nt, Neisseria meningitidis Z2491
uaguacggcaaggcgaggc

SEQ ID NO: 3370926 - RNA, 13 nt, Neisseria meningitidis Z2491
uaugcgccugcau

SEQ ID NO: 3370927 - RNA, 20 nt, Neisseria meningitidis Z2491
uaugcguucaaaugccgucu

SEQ ID NO: 3370928 - RNA, 11 nt, Neisseria meningitidis Z2491
uaugcuucaag

SEQ ID NO: 3370929 - RNA, 21 nt, Neisseria meningitidis Z2491
uaugcuucggucagguucaaa

SEQ ID NO: 3370930 - RNA, 22 nt, Neisseria meningitidis Z2491
uauggaucagacauuaaaaaau

SEQ ID NO: 3370931 - RNA, 22 nt, Neisseria meningitidis Z2491
uauguagauuuuuuuauuuaaa

SEQ ID NO: 3370932 - RNA, 19 nt, Neisseria meningitidis Z2491
uauguauaaugcccauucc

SEQ ID NO: 3370933 - RNA, 18 nt, Neisseria meningitidis Z2491
uauguauaguaauaaauu

SEQ ID NO: 3370934 - RNA, 17 nt, Neisseria meningitidis Z2491
uaugugcugucagaauu

SEQ ID NO: 3370935 - RNA, 15 nt, Neisseria meningitidis Z2491
uauguuuagcggagc

SEQ ID NO: 3370936 - RNA, 14 nt, Neisseria meningitidis Z2491
uauuaagaaaaaca

SEQ ID NO: 3370937 - RNA, 14 nt, Neisseria meningitidis Z2491
uauuaagugaguaa

SEQ ID NO: 3370938 - RNA, 20 nt, Neisseria meningitidis Z2491
uauuaauuucggaaaugcgu

SEQ ID NO: 3370939 - RNA, 16 nt, Neisseria meningitidis Z2491
uauuaccgguauuuuu

SEQ ID NO: 3370940 - RNA, 21 nt, Neisseria meningitidis Z2491
uauuacgaacaaugcaaaaac

SEQ ID NO: 3370941 - RNA, 23 nt, Neisseria meningitidis Z2491
uauuacgaacaaugcaaaaacau

SEQ ID NO: 3370942 - RNA, 19 nt, Neisseria meningitidis Z2491
uauuacuguuguucuaagg

SEQ ID NO: 3370943 - RNA, 12 nt, Neisseria meningitidis Z2491
uauuauuuucca

SEQ ID NO: 3370944 - RNA, 13 nt, Neisseria meningitidis Z2491
uauuauuuuccau

SEQ ID NO: 3370945 - RNA, 12 nt, Neisseria meningitidis Z2491
uauucaagcaaa

SEQ ID NO: 3370946 - RNA, 14 nt, Neisseria meningitidis Z2491
uauucaauuuaaac

SEQ ID NO: 3370947 - RNA, 16 nt, Neisseria meningitidis Z2491
uauucacuaaauugca

SEQ ID NO: 3370948 - RNA, 19 nt, Neisseria meningitidis Z2491
uauuccaccgaugucggcu

SEQ ID NO: 3370949 - RNA, 20 nt, Neisseria meningitidis Z2491
uauuccggugcgaccguaug

SEQ ID NO: 3370950 - RNA, 16 nt, Neisseria meningitidis Z2491
uauucgaccagcuccc

SEQ ID NO: 3370951 - RNA, 20 nt, Neisseria meningitidis Z2491
uauucgacgcgcuugauguc

SEQ ID NO: 3370952 - RNA, 22 nt, Neisseria meningitidis Z2491
uauucggaggcgcauugugggc

SEQ ID NO: 3370953 - RNA, 12 nt, Neisseria meningitidis Z2491
uauucggaugua

SEQ ID NO: 3370954 - RNA, 18 nt, Neisseria meningitidis Z2491
uauucugauuuaaaacca

SEQ ID NO: 3370955 - RNA, 22 nt, Neisseria meningitidis Z2491
uauucugccgugggugcuuugg

SEQ ID NO: 3370956 - RNA, 18 nt, Neisseria meningitidis Z2491
uauugagaccuuugcaau

SEQ ID NO: 3370957 - RNA, 18 nt, Neisseria meningitidis Z2491
uauugccuuuauugugcu

SEQ ID NO: 3370958 - RNA, 18 nt, Neisseria meningitidis Z2491
uauuuaaaaauuccuguu

SEQ ID NO: 3370959 - RNA, 18 nt, Neisseria meningitidis Z2491
uauuuaaacagcaaucca

SEQ ID NO: 3370960 - RNA, 12 nt, Neisseria meningitidis Z2491
uauuuaaauaaa

SEQ ID NO: 3370961 - RNA, 15 nt, Neisseria meningitidis Z2491
uauuuaaauaaaauu

SEQ ID NO: 3370962 - RNA, 17 nt, Neisseria meningitidis Z2491
uauuuaaauaaagauag

SEQ ID NO: 3370963 - RNA, 18 nt, Neisseria meningitidis Z2491
uauuuaccagaaaaaaca

SEQ ID NO: 3370964 - RNA, 15 nt, Neisseria meningitidis Z2491
uauuuauuuugaaaa

SEQ ID NO: 3370965 - RNA, 16 nt, Neisseria meningitidis Z2491
uauuucccgccauccc

SEQ ID NO: 3370966 - RNA, 14 nt, Neisseria meningitidis Z2491
uauuuccucacugc

SEQ ID NO: 3370967 - RNA, 11 nt, Neisseria meningitidis Z2491
uauuuccugca

SEQ ID NO: 3370968 - RNA, 24 nt, Neisseria meningitidis Z2491
uauuucuagggaaaugcccgacuu

SEQ ID NO: 3370969 - RNA, 12 nt, Neisseria meningitidis Z2491
uauuugaacgau

SEQ ID NO: 3370970 - RNA, 23 nt, Neisseria meningitidis Z2491
uauuugccggucggcuggcugua

SEQ ID NO: 3370971 - RNA, 20 nt, Neisseria meningitidis Z2491
uauuugcgccgcccgaaaau

SEQ ID NO: 3370972 - RNA, 17 nt, Neisseria meningitidis Z2491
uauuuggggcgaaaaca

SEQ ID NO: 3370973 - RNA, 18 nt, Neisseria meningitidis Z2491
uauuuggggcgaaaacag

SEQ ID NO: 3370974 - RNA, 19 nt, Neisseria meningitidis Z2491
uauuuggggcgaaaacagc

SEQ ID NO: 3370975 - RNA, 14 nt, Neisseria meningitidis Z2491
uauuuguacugucu

SEQ ID NO: 3370976 - RNA, 20 nt, Neisseria meningitidis Z2491
uauuuguacugucugcggcu

SEQ ID NO: 3370977 - RNA, 16 nt, Neisseria meningitidis Z2491
uauuuguucaaauauc

SEQ ID NO: 3370978 - RNA, 14 nt, Neisseria meningitidis Z2491
uauuuuagaaugaa

SEQ ID NO: 3370979 - RNA, 12 nt, Neisseria meningitidis Z2491
uauuuucaaaau

SEQ ID NO: 3370980 - RNA, 20 nt, Neisseria meningitidis Z2491
uauuuucacaaaaacagaaa

SEQ ID NO: 3370981 - RNA, 21 nt, Neisseria meningitidis Z2491
uauuuugacuuuggaacaaaa

SEQ ID NO: 3370982 - RNA, 12 nt, Neisseria meningitidis Z2491
uauuuugugcag

SEQ ID NO: 3370983 - RNA, 16 nt, Neisseria meningitidis Z2491
uauuuuugaagacauc

SEQ ID NO: 3370984 - RNA, 12 nt, Neisseria meningitidis Z2491
uauuuuugcaaa

SEQ ID NO: 3370985 - RNA, 17 nt, Neisseria meningitidis Z2491
uauuuuugugaaaauaa

SEQ ID NO: 3370986 - RNA, 14 nt, Neisseria meningitidis Z2491
uauuuuuuaaccaa

SEQ ID NO: 3370987 - RNA, 20 nt, Neisseria meningitidis Z2491
ucaaaaaaccguauucccgc

SEQ ID NO: 3370988 - RNA, 23 nt, Neisseria meningitidis Z2491
ucaaaaaauaaaguaauucggcu

SEQ ID NO: 3370989 - RNA, 10 nt, Neisseria meningitidis Z2491
ucaaaaacac

SEQ ID NO: 3370990 - RNA, 13 nt, Neisseria meningitidis Z2491
ucaaaaacacaaa

SEQ ID NO: 3370991 - RNA, 18 nt, Neisseria meningitidis Z2491
ucaaaaacacaaaacuga

SEQ ID NO: 3370992 - RNA, 19 nt, Neisseria meningitidis Z2491
ucaaaaacacaaaacugaa

SEQ ID NO: 3370993 - RNA, 18 nt, Neisseria meningitidis Z2491
ucaaaaacagaaaaccaa

SEQ ID NO: 3370994 - RNA, 12 nt, Neisseria meningitidis Z2491
ucaaaaaugccu

SEQ ID NO: 3370995 - RNA, 20 nt, Neisseria meningitidis Z2491
ucaaaacaagcgauuauuuu

SEQ ID NO: 3370996 - RNA, 20 nt, Neisseria meningitidis Z2491
ucaaaacaucgacacccgcc

SEQ ID NO: 3370997 - RNA, 16 nt, Neisseria meningitidis Z2491
ucaaaauauuaaucag

SEQ ID NO: 3370998 - RNA, 18 nt, Neisseria meningitidis Z2491
ucaaaaucaucccaaaca

SEQ ID NO: 3370999 - RNA, 15 nt, Neisseria meningitidis Z2491
ucaaaauguucaaua

SEQ ID NO: 3371000 - RNA, 11 nt, Neisseria meningitidis Z2491
ucaaaauuuac

SEQ ID NO: 3371001 - RNA, 12 nt, Neisseria meningitidis Z2491
ucaaacaacauc

SEQ ID NO: 3371002 - RNA, 16 nt, Neisseria meningitidis Z2491
ucaaacaagaaaugau

SEQ ID NO: 3371003 - RNA, 18 nt, Neisseria meningitidis Z2491
ucaaacauuacugaaaug

SEQ ID NO: 3371004 - RNA, 19 nt, Neisseria meningitidis Z2491
ucaaaccauauggaaaaau

SEQ ID NO: 3371005 - RNA, 19 nt, Neisseria meningitidis Z2491
ucaaaccccuucaaaccaa

SEQ ID NO: 3371006 - RNA, 17 nt, Neisseria meningitidis Z2491
ucaaaccgucgccgaac

SEQ ID NO: 3371007 - RNA, 15 nt, Neisseria meningitidis Z2491
ucaaaccucauucaa

SEQ ID NO: 3371008 - RNA, 18 nt, Neisseria meningitidis Z2491
ucaaacucacccugcaag

SEQ ID NO: 3371009 - RNA, 18 nt, Neisseria meningitidis Z2491
ucaaagagaacaauucuc

SEQ ID NO: 3371010 - RNA, 19 nt, Neisseria meningitidis Z2491
ucaaagagaacgauucucu

SEQ ID NO: 3371011 - RNA, 17 nt, Neisseria meningitidis Z2491
ucaaauaaauucugaaa

SEQ ID NO: 3371012 - RNA, 23 nt, Neisseria meningitidis Z2491
ucaaauaaauucugaaacuuuaa

SEQ ID NO: 3371013 - RNA, 14 nt, Neisseria meningitidis Z2491
ucaaauaggcauug

SEQ ID NO: 3371014 - RNA, 17 nt, Neisseria meningitidis Z2491
ucaaaucauauuccagc

SEQ ID NO: 3371015 - RNA, 20 nt, Neisseria meningitidis Z2491
ucaaaucguuuugcgccaaa

SEQ ID NO: 3371016 - RNA, 12 nt, Neisseria meningitidis Z2491
ucaaaugccguc

SEQ ID NO: 3371017 - RNA, 13 nt, Neisseria meningitidis Z2491
ucaaaugccgucu

SEQ ID NO: 3371018 - RNA, 15 nt, Neisseria meningitidis Z2491
ucaaaugccgucuga

SEQ ID NO: 3371019 - RNA, 16 nt, Neisseria meningitidis Z2491
ucaaauucggaagaca

SEQ ID NO: 3371020 - RNA, 16 nt, Neisseria meningitidis Z2491
ucaaauucugaugaaa

SEQ ID NO: 3371021 - RNA, 16 nt, Neisseria meningitidis Z2491
ucaaauucuuuuugca

SEQ ID NO: 3371022 - RNA, 15 nt, Neisseria meningitidis Z2491
ucaacaaaaugccgu

SEQ ID NO: 3371023 - RNA, 18 nt, Neisseria meningitidis Z2491
ucaacacaccauccucau

SEQ ID NO: 3371024 - RNA, 12 nt, Neisseria meningitidis Z2491
ucaacacgcccu

SEQ ID NO: 3371025 - RNA, 18 nt, Neisseria meningitidis Z2491
ucaacagguucaaacaca

SEQ ID NO: 3371026 - RNA, 19 nt, Neisseria meningitidis Z2491
ucaacagguucaaacacau

SEQ ID NO: 3371027 - RNA, 13 nt, Neisseria meningitidis Z2491
ucaaccaaaaaau

SEQ ID NO: 3371028 - RNA, 16 nt, Neisseria meningitidis Z2491
ucagguugaaaaugcc

SEQ ID NO: 3371029 - RNA, 15 nt, Neisseria meningitidis Z2491
ucaguauuuucuauu

SEQ ID NO: 3371030 - RNA, 14 nt, Neisseria meningitidis Z2491
ucagucauucccga

SEQ ID NO: 3371031 - RNA, 19 nt, Neisseria meningitidis Z2491
ucagucauuuccgauaaau

SEQ ID NO: 3371032 - RNA, 21 nt, Neisseria meningitidis Z2491
ucaguuccaaaaccgugcugu

SEQ ID NO: 3371033 - RNA, 23 nt, Neisseria meningitidis Z2491
ucaguuccaucgcgucuucaaaa

SEQ ID NO: 3371034 - RNA, 19 nt, Neisseria meningitidis Z2491
ucaguuucggucauuuccg

SEQ ID NO: 3371035 - RNA, 15 nt, Neisseria meningitidis Z2491
ucauacacagccaaa

SEQ ID NO: 3371036 - RNA, 13 nt, Neisseria meningitidis Z2491
ucauacccaaggc

SEQ ID NO: 3371037 - RNA, 19 nt, Neisseria meningitidis Z2491
ucauaccccacugccagcc

SEQ ID NO: 3371038 - RNA, 17 nt, Neisseria meningitidis Z2491
ucauacgacucaaaauc

SEQ ID NO: 3371039 - RNA, 13 nt, Neisseria meningitidis Z2491
ucauauccggcgc

SEQ ID NO: 3371040 - RNA, 16 nt, Neisseria meningitidis Z2491
ucaucacauaaauccg

SEQ ID NO: 3371041 - RNA, 20 nt, Neisseria meningitidis Z2491
ucaucagauugauaaaagca

SEQ ID NO: 3371042 - RNA, 13 nt, Neisseria meningitidis Z2491
ucaucauucccac

SEQ ID NO: 3371043 - RNA, 12 nt, Neisseria meningitidis Z2491
ucaucauuccua

SEQ ID NO: 3371044 - RNA, 22 nt, Neisseria meningitidis Z2491
ucauccacagccgcaaaagcca

SEQ ID NO: 3371045 - RNA, 13 nt, Neisseria meningitidis Z2491
ucauccaccagcc

SEQ ID NO: 3371046 - RNA, 14 nt, Neisseria meningitidis Z2491
ucauccaccagccc

SEQ ID NO: 3371047 - RNA, 15 nt, Neisseria meningitidis Z2491
ucauccaccagcccg

SEQ ID NO: 3371048 - RNA, 14 nt, Neisseria meningitidis Z2491
ucauccguugcuuc

SEQ ID NO: 3371049 - RNA, 17 nt, Neisseria meningitidis Z2491
ucauccugcuuuaauuc

SEQ ID NO: 3371050 - RNA, 21 nt, Neisseria meningitidis Z2491
ucaucggaaacagcauccuuu

SEQ ID NO: 3371051 - RNA, 20 nt, Neisseria meningitidis Z2491
ucaucguauuuuuaucuuuu

SEQ ID NO: 3371052 - RNA, 15 nt, Neisseria meningitidis Z2491
ucaucuaaauguuua

SEQ ID NO: 3371053 - RNA, 14 nt, Neisseria meningitidis Z2491
ucaucuuauuuauu

SEQ ID NO: 3371054 - RNA, 13 nt, Neisseria meningitidis Z2491
ucaucuuuacuug

SEQ ID NO: 3371055 - RNA, 19 nt, Neisseria meningitidis Z2491
ucaugaucuucuuacccaa

SEQ ID NO: 3371056 - RNA, 20 nt, Neisseria meningitidis Z2491
ucaugcauccgggccgccuu

SEQ ID NO: 3371057 - RNA, 21 nt, Neisseria meningitidis Z2491
ucaugcggcgggcuuggaaau

SEQ ID NO: 3371058 - RNA, 14 nt, Neisseria meningitidis Z2491
ucauguucgugcau

SEQ ID NO: 3371059 - RNA, 17 nt, Neisseria meningitidis Z2491
ucauguucgugcaucau

SEQ ID NO: 3371060 - RNA, 19 nt, Neisseria meningitidis Z2491
ucauguucgugcaucauca

SEQ ID NO: 3371061 - RNA, 23 nt, Neisseria meningitidis Z2491
ucauucccacgaacccacauccc

SEQ ID NO: 3371062 - RNA, 15 nt, Neisseria meningitidis Z2491
ucauucccacggaag

SEQ ID NO: 3371063 - RNA, 17 nt, Neisseria meningitidis Z2491
ucauucccgauaaauug

SEQ ID NO: 3371064 - RNA, 18 nt, Neisseria meningitidis Z2491
ucauucccgcaaaaacaa

SEQ ID NO: 3371065 - RNA, 16 nt, Neisseria meningitidis Z2491
ucauucccgcaaaagc

SEQ ID NO: 3371066 - RNA, 22 nt, Neisseria meningitidis Z2491
ucauucccgcaacucuccguca

SEQ ID NO: 3371067 - RNA, 22 nt, Neisseria meningitidis Z2491
ucauucccgcgaaaaauagaaa

SEQ ID NO: 3371068 - RNA, 20 nt, Neisseria meningitidis Z2491
ucauuccuacgaaccuacau

SEQ ID NO: 3371069 - RNA, 20 nt, Neisseria meningitidis Z2491
ucauuccucaaaaacagaaa

SEQ ID NO: 3371070 - RNA, 17 nt, Neisseria meningitidis Z2491
ucauugagcagcacauc

SEQ ID NO: 3371071 - RNA, 20 nt, Neisseria meningitidis Z2491
ucauugcgggaauagcucag

SEQ ID NO: 3371072 - RNA, 15 nt, Neisseria meningitidis Z2491
ucauuuaucggaaaa

SEQ ID NO: 3371073 - RNA, 14 nt, Neisseria meningitidis Z2491
ucauuuccaauuuu

SEQ ID NO: 3371074 - RNA, 16 nt, Neisseria meningitidis Z2491
ucauuuccgauaaauu

SEQ ID NO: 3371075 - RNA, 17 nt, Neisseria meningitidis Z2491
ucauuuccgauaaauuc

SEQ ID NO: 3371076 - RNA, 18 nt, Neisseria meningitidis Z2491
ucauuuccgauaaauucc

SEQ ID NO: 3371077 - RNA, 19 nt, Neisseria meningitidis Z2491
ucauuuccgauaaauuccu

SEQ ID NO: 3371078 - RNA, 18 nt, Neisseria meningitidis Z2491
ucauuuccgauaaauucu

SEQ ID NO: 3371079 - RNA, 20 nt, Neisseria meningitidis Z2491
ucauuucuagauucccacuu

SEQ ID NO: 3371080 - RNA, 13 nt, Neisseria meningitidis Z2491
ucauuuucaaaau

SEQ ID NO: 3371081 - RNA, 18 nt, Neisseria meningitidis Z2491
ucauuuuuguauaaauuu

SEQ ID NO: 3371082 - RNA, 23 nt, Neisseria meningitidis Z2491
uccaaaaccgugcugucgguuuc

SEQ ID NO: 3371083 - RNA, 21 nt, Neisseria meningitidis Z2491
uccaaacccaaugcuucaacc

SEQ ID NO: 3371084 - RNA, 18 nt, Neisseria meningitidis Z2491
uccaaacguuuuuccaaa

SEQ ID NO: 3371085 - RNA, 22 nt, Neisseria meningitidis Z2491
uccaaagccucgcggcucgccc

SEQ ID NO: 3371086 - RNA, 13 nt, Neisseria meningitidis Z2491
uccaaaucggcaa

SEQ ID NO: 3371087 - RNA, 23 nt, Neisseria meningitidis Z2491
uccaaaugaauguggucguucaa

SEQ ID NO: 3371088 - RNA, 22 nt, Neisseria meningitidis Z2491
uccaaaugccgcaaaugccguc

SEQ ID NO: 3371089 - RNA, 23 nt, Neisseria meningitidis Z2491
uccaacacgcagccgagcagcag

SEQ ID NO: 3371090 - RNA, 16 nt, Neisseria meningitidis Z2491
uccaacgcugcaaaaa

SEQ ID NO: 3371091 - RNA, 17 nt, Neisseria meningitidis Z2491
uccaacucuacggguuu

SEQ ID NO: 3371092 - RNA, 17 nt, Neisseria meningitidis Z2491
uccaagacaggcggaug

SEQ ID NO: 3371093 - RNA, 15 nt, Neisseria meningitidis Z2491
uccaauacaacaaaa

SEQ ID NO: 3371094 - RNA, 16 nt, Neisseria meningitidis Z2491
uccaauacaacaaaau

SEQ ID NO: 3371095 - RNA, 13 nt, Neisseria meningitidis Z2491
uccaauacauuuu

SEQ ID NO: 3371096 - RNA, 21 nt, Neisseria meningitidis Z2491
uccaauacauuuuugauauuu

SEQ ID NO: 3371097 - RNA, 17 nt, Neisseria meningitidis Z2491
uccaauuaaaccccguu

SEQ ID NO: 3371098 - RNA, 16 nt, Neisseria meningitidis Z2491
uccaauucgauggaua

SEQ ID NO: 3371099 - RNA, 13 nt, Neisseria meningitidis Z2491
uccacaaaaaaca

SEQ ID NO: 3371100 - RNA, 16 nt, Neisseria meningitidis Z2491
uccacaccguucagcc

SEQ ID NO: 3371101 - RNA, 18 nt, Neisseria meningitidis Z2491
uccacaccguucagcccg

SEQ ID NO: 3371102 - RNA, 14 nt, Neisseria meningitidis Z2491
uccacaucguucaa

SEQ ID NO: 3371103 - RNA, 16 nt, Neisseria meningitidis Z2491
uccaccauuucuuugg

SEQ ID NO: 3371104 - RNA, 17 nt, Neisseria meningitidis Z2491
uccacccugauuucgcu

SEQ ID NO: 3371105 - RNA, 21 nt, Neisseria meningitidis Z2491
uccaccugaacggcacaaacg

SEQ ID NO: 3371106 - RNA, 19 nt, Neisseria meningitidis Z2491
uccacgauauuacgaacaa

SEQ ID NO: 3371107 - RNA, 15 nt, Neisseria meningitidis Z2491
uccacggacacccga

SEQ ID NO: 3371108 - RNA, 13 nt, Neisseria meningitidis Z2491
uccacuaaaaaau

SEQ ID NO: 3371109 - RNA, 21 nt, Neisseria meningitidis Z2491
uccacuaaaaaauccaaaaau

SEQ ID NO: 3371110 - RNA, 17 nt, Neisseria meningitidis Z2491
uccacuauaacagcaac

SEQ ID NO: 3371111 - RNA, 17 nt, Neisseria meningitidis Z2491
uccacuauaucagacgg

SEQ ID NO: 3371112 - RNA, 14 nt, Neisseria meningitidis Z2491
uccacuauaucguc

SEQ ID NO: 3371113 - RNA, 18 nt, Neisseria meningitidis Z2491
uccacuauaugaguguau

SEQ ID NO: 3371114 - RNA, 14 nt, Neisseria meningitidis Z2491
uccacuuucgccau

SEQ ID NO: 3371115 - RNA, 19 nt, Neisseria meningitidis Z2491
uccagaacguaaaaucuga

SEQ ID NO: 3371116 - RNA, 14 nt, Neisseria meningitidis Z2491
uccagaaucucuaa

SEQ ID NO: 3371117 - RNA, 13 nt, Neisseria meningitidis Z2491
uccagauucccgc

SEQ ID NO: 3371118 - RNA, 23 nt, Neisseria meningitidis Z2491
uccagcagcaacacauugccacc

SEQ ID NO: 3371119 - RNA, 18 nt, Neisseria meningitidis Z2491
uccagcgguuuggucugc

SEQ ID NO: 3371120 - RNA, 22 nt, Neisseria meningitidis Z2491
uccagcgugcggacguucaaac

SEQ ID NO: 3371121 - RNA, 21 nt, Neisseria meningitidis Z2491
uccaguugcgggccuuuggcg

SEQ ID NO: 3371122 - RNA, 20 nt, Neisseria meningitidis Z2491
uccaguuucuugaguuucag

SEQ ID NO: 3371123 - RNA, 15 nt, Neisseria meningitidis Z2491
uccauaauccaagau

SEQ ID NO: 3371124 - RNA, 12 nt, Neisseria meningitidis Z2491
uccauaccaaac

SEQ ID NO: 3371125 - RNA, 15 nt, Neisseria meningitidis Z2491
uccauagauaaauuu

SEQ ID NO: 3371126 - RNA, 14 nt, Neisseria meningitidis Z2491
uccauauccaaacg

SEQ ID NO: 3371127 - RNA, 17 nt, Neisseria meningitidis Z2491
uccauaucuuuaaguga

SEQ ID NO: 3371128 - RNA, 20 nt, Neisseria meningitidis Z2491
uccaucaacaaaaugccguc

SEQ ID NO: 3371129 - RNA, 15 nt, Neisseria meningitidis Z2491
ucgggguucucaucc

SEQ ID NO: 3371130 - RNA, 23 nt, Neisseria meningitidis Z2491
ucggguaacggcaauauucaaaa

SEQ ID NO: 3371131 - RNA, 18 nt, Neisseria meningitidis Z2491
ucggguauccggagagga

SEQ ID NO: 3371132 - RNA, 20 nt, Neisseria meningitidis Z2491
ucgggucgaaaccggcuuug

SEQ ID NO: 3371133 - RNA, 21 nt, Neisseria meningitidis Z2491
ucgguauagugaacuaaauuu

SEQ ID NO: 3371134 - RNA, 18 nt, Neisseria meningitidis Z2491
ucggucauagccagagag

SEQ ID NO: 3371135 - RNA, 22 nt, Neisseria meningitidis Z2491
ucggucauuuccgauaaauucc

SEQ ID NO: 3371136 - RNA, 17 nt, Neisseria meningitidis Z2491
ucgguuccguacuauuu

SEQ ID NO: 3371137 - RNA, 15 nt, Neisseria meningitidis Z2491
ucgguuucgugccuu

SEQ ID NO: 3371138 - RNA, 15 nt, Neisseria meningitidis Z2491
ucgguuuucuauuuu

SEQ ID NO: 3371139 - RNA, 18 nt, Neisseria meningitidis Z2491
ucgguuuucuauuuugca

SEQ ID NO: 3371140 - RNA, 15 nt, Neisseria meningitidis Z2491
ucguaaaaaugccgu

SEQ ID NO: 3371141 - RNA, 22 nt, Neisseria meningitidis Z2491
ucguaaaaaugccgucugaaaa

SEQ ID NO: 3371142 - RNA, 20 nt, Neisseria meningitidis Z2491
ucguacacguccauacccaa

SEQ ID NO: 3371143 - RNA, 21 nt, Neisseria meningitidis Z2491
ucguacacguccauacccaau

SEQ ID NO: 3371144 - RNA, 16 nt, Neisseria meningitidis Z2491
ucguacggcaaggcga

SEQ ID NO: 3371145 - RNA, 16 nt, Neisseria meningitidis Z2491
ucguaggcuuuuucca

SEQ ID NO: 3371146 - RNA, 16 nt, Neisseria meningitidis Z2491
ucguauaacgcggauu

SEQ ID NO: 3371147 - RNA, 15 nt, Neisseria meningitidis Z2491
ucguauccaaaucgc

SEQ ID NO: 3371148 - RNA, 11 nt, Neisseria meningitidis Z2491
ucguaugaaac

SEQ ID NO: 3371149 - RNA, 20 nt, Neisseria meningitidis Z2491
ucguauuuuuaucuuuuaau

SEQ ID NO: 3371150 - RNA, 14 nt, Neisseria meningitidis Z2491
ucgucauucccacg

SEQ ID NO: 3371151 - RNA, 13 nt, Neisseria meningitidis Z2491
ucgucauucccgc

SEQ ID NO: 3371152 - RNA, 21 nt, Neisseria meningitidis Z2491
ucgucauucccgcaaaaacaa

SEQ ID NO: 3371153 - RNA, 13 nt, Neisseria meningitidis Z2491
ucgucauucccgu

SEQ ID NO: 3371154 - RNA, 16 nt, Neisseria meningitidis Z2491
ucguccagcagcaaca

SEQ ID NO: 3371155 - RNA, 23 nt, Neisseria meningitidis Z2491
ucguccagcagcaacacauugcc

SEQ ID NO: 3371156 - RNA, 22 nt, Neisseria meningitidis Z2491
ucguccgacaauuucuccgcca

SEQ ID NO: 3371157 - RNA, 14 nt, Neisseria meningitidis Z2491
ucguccuccaccgu

SEQ ID NO: 3371158 - RNA, 18 nt, Neisseria meningitidis Z2491
ucgucugaaaaauuuuca

SEQ ID NO: 3371159 - RNA, 20 nt, Neisseria meningitidis Z2491
ucgucuuuuccuuccaaaag

SEQ ID NO: 3371160 - RNA, 23 nt, Neisseria meningitidis Z2491
ucguguuugggguggucgaacaa

SEQ ID NO: 3371161 - RNA, 14 nt, Neisseria meningitidis Z2491
ucguuaacagacua

SEQ ID NO: 3371162 - RNA, 18 nt, Neisseria meningitidis Z2491
ucguuaacagacuauuuu

SEQ ID NO: 3371163 - RNA, 16 nt, Neisseria meningitidis Z2491
ucguuacaaauuuaaa

SEQ ID NO: 3371164 - RNA, 14 nt, Neisseria meningitidis Z2491
ucguucggcagccu

SEQ ID NO: 3371165 - RNA, 14 nt, Neisseria meningitidis Z2491
ucguucucuuugag

SEQ ID NO: 3371166 - RNA, 15 nt, Neisseria meningitidis Z2491
ucguuuuucauuucu

SEQ ID NO: 3371167 - RNA, 16 nt, Neisseria meningitidis Z2491
ucuaaaaauccaacgc

SEQ ID NO: 3371168 - RNA, 13 nt, Neisseria meningitidis Z2491
ucuaaacgguauu

SEQ ID NO: 3371169 - RNA, 16 nt, Neisseria meningitidis Z2491
ucuaaacgguauucau

SEQ ID NO: 3371170 - RNA, 23 nt, Neisseria meningitidis Z2491
ucuaaacgguauucauaccuccc

SEQ ID NO: 3371171 - RNA, 15 nt, Neisseria meningitidis Z2491
ucuaaagcuucagcu

SEQ ID NO: 3371172 - RNA, 19 nt, Neisseria meningitidis Z2491
ucuaaauagcguuuuaauu

SEQ ID NO: 3371173 - RNA, 17 nt, Neisseria meningitidis Z2491
ucuaaggugcugaagca

SEQ ID NO: 3371174 - RNA, 20 nt, Neisseria meningitidis Z2491
ucuacaaaauaaucuuccuu

SEQ ID NO: 3371175 - RNA, 12 nt, Neisseria meningitidis Z2491
ucuagaaacuca

SEQ ID NO: 3371176 - RNA, 12 nt, Neisseria meningitidis Z2491
ucuagaaaugaa

SEQ ID NO: 3371177 - RNA, 13 nt, Neisseria meningitidis Z2491
ucuagaaaugaaa

SEQ ID NO: 3371178 - RNA, 16 nt, Neisseria meningitidis Z2491
ucuagaaaugaaaaac

SEQ ID NO: 3371179 - RNA, 21 nt, Neisseria meningitidis Z2491
ucuagaaucccggacuuucag

SEQ ID NO: 3371180 - RNA, 13 nt, Neisseria meningitidis Z2491
ucuagacauucaa

SEQ ID NO: 3371181 - RNA, 19 nt, Neisseria meningitidis Z2491
ucuagacauucaaugcuaa

SEQ ID NO: 3371182 - RNA, 14 nt, Neisseria meningitidis Z2491
ucuagauucccacu

SEQ ID NO: 3371183 - RNA, 16 nt, Neisseria meningitidis Z2491
ucuagauucccacuuu

SEQ ID NO: 3371184 - RNA, 13 nt, Neisseria meningitidis Z2491
ucuagauucccgc

SEQ ID NO: 3371185 - RNA, 20 nt, Neisseria meningitidis Z2491
ucuagugcguugaguuucag

SEQ ID NO: 3371186 - RNA, 20 nt, Neisseria meningitidis Z2491
ucuaguuuuuugaguuucag

SEQ ID NO: 3371187 - RNA, 22 nt, Neisseria meningitidis Z2491
ucuauaaagccuaaauacaaaa

SEQ ID NO: 3371188 - RNA, 13 nt, Neisseria meningitidis Z2491
ucuauguuaugug

SEQ ID NO: 3371189 - RNA, 15 nt, Neisseria meningitidis Z2491
ucuauguuaugugcu

SEQ ID NO: 3371190 - RNA, 19 nt, Neisseria meningitidis Z2491
ucuauuuguucgauauuuu

SEQ ID NO: 3371191 - RNA, 15 nt, Neisseria meningitidis Z2491
ucucaaaaaaugccg

SEQ ID NO: 3371192 - RNA, 15 nt, Neisseria meningitidis Z2491
ucucacacucuucgu

SEQ ID NO: 3371193 - RNA, 22 nt, Neisseria meningitidis Z2491
ucucaugaucuucuuacccaau

SEQ ID NO: 3371194 - RNA, 12 nt, Neisseria meningitidis Z2491
ucucauuuucaa

SEQ ID NO: 3371195 - RNA, 18 nt, Neisseria meningitidis Z2491
ucuccaucaggccgcugg

SEQ ID NO: 3371196 - RNA, 16 nt, Neisseria meningitidis Z2491
ucuccuuuuuuuucua

SEQ ID NO: 3371197 - RNA, 13 nt, Neisseria meningitidis Z2491
ucucgcgcaggcg

SEQ ID NO: 3371198 - RNA, 15 nt, Neisseria meningitidis Z2491
ucucggacuuucaga

SEQ ID NO: 3371199 - RNA, 19 nt, Neisseria meningitidis Z2491
ucucuaaggugcugaagca

SEQ ID NO: 3371200 - RNA, 23 nt, Neisseria meningitidis Z2491
ucucuaaggugcugaagcaccaa

SEQ ID NO: 3371201 - RNA, 13 nt, Neisseria meningitidis Z2491
ucucuauuuguuc

SEQ ID NO: 3371202 - RNA, 20 nt, Neisseria meningitidis Z2491
ucugaaaaauuuaugaaaua

SEQ ID NO: 3371203 - RNA, 14 nt, Neisseria meningitidis Z2491
ucugaaaacagcaa

SEQ ID NO: 3371204 - RNA, 15 nt, Neisseria meningitidis Z2491
ucugaaaacaguuuu

SEQ ID NO: 3371205 - RNA, 18 nt, Neisseria meningitidis Z2491
ucugaaaacaguuuuuua

SEQ ID NO: 3371206 - RNA, 17 nt, Neisseria meningitidis Z2491
ucugaaaaccuuucaga

SEQ ID NO: 3371207 - RNA, 14 nt, Neisseria meningitidis Z2491
ucugaaaagaugcc

SEQ ID NO: 3371208 - RNA, 15 nt, Neisseria meningitidis Z2491
ucugaaaagaugccu

SEQ ID NO: 3371209 - RNA, 19 nt, Neisseria meningitidis Z2491
ucugaaaagucuuucagac

SEQ ID NO: 3371210 - RNA, 16 nt, Neisseria meningitidis Z2491
ucugaaaccaaaucgg

SEQ ID NO: 3371211 - RNA, 12 nt, Neisseria meningitidis Z2491
ucugaaaccuga

SEQ ID NO: 3371212 - RNA, 15 nt, Neisseria meningitidis Z2491
ucugaaaccugcaac

SEQ ID NO: 3371213 - RNA, 18 nt, Neisseria meningitidis Z2491
ucugaaaccuuuuuuuac

SEQ ID NO: 3371214 - RNA, 23 nt, Neisseria meningitidis Z2491
ucugaaaggcuucagacggcauu

SEQ ID NO: 3371215 - RNA, 20 nt, Neisseria meningitidis Z2491
ucugaaaggcuuuuucagac

SEQ ID NO: 3371216 - RNA, 20 nt, Neisseria meningitidis Z2491
ucugaaauccuauuuucaga

SEQ ID NO: 3371217 - RNA, 14 nt, Neisseria meningitidis Z2491
ucugaaauguucag

SEQ ID NO: 3371218 - RNA, 15 nt, Neisseria meningitidis Z2491
ucugaaauguucaga

SEQ ID NO: 3371219 - RNA, 16 nt, Neisseria meningitidis Z2491
ucugaaauguucagac

SEQ ID NO: 3371220 - RNA, 22 nt, Neisseria meningitidis Z2491
ucugaacacauugcguucagac

SEQ ID NO: 3371221 - RNA, 19 nt, Neisseria meningitidis Z2491
ucugaacacggguucagac

SEQ ID NO: 3371222 - RNA, 19 nt, Neisseria meningitidis Z2491
ucugaacaguguuucagac

SEQ ID NO: 3371223 - RNA, 18 nt, Neisseria meningitidis Z2491
ucugaacaucuuucagac

SEQ ID NO: 3371224 - RNA, 22 nt, Neisseria meningitidis Z2491
ucugaacgcuucagacggcauu

SEQ ID NO: 3371225 - RNA, 19 nt, Neisseria meningitidis Z2491
ucugaagccagccccacca

SEQ ID NO: 3371226 - RNA, 14 nt, Neisseria meningitidis Z2491
ucugaagcccuguu

SEQ ID NO: 3371227 - RNA, 22 nt, Neisseria meningitidis Z2491
ucugaagccuucagacggcauu

SEQ ID NO: 3371228 - RNA, 18 nt, Neisseria meningitidis Z2491
ucugaagcguauuucuag

SEQ ID NO: 3371229 - RNA, 16 nt, Neisseria meningitidis Z2491
ucugaaggcuucagac

SEQ ID NO: 3371230 - RNA, 19 nt, Neisseria meningitidis Z2491
ucugaauaaacuucuaaca

SEQ ID NO: 3371231 - RNA, 18 nt, Neisseria meningitidis Z2491
ugaaaccccuaaaggcuu

SEQ ID NO: 3371232 - RNA, 19 nt, Neisseria meningitidis Z2491
ugaaaccccuaaaggcuuc

SEQ ID NO: 3371233 - RNA, 17 nt, Neisseria meningitidis Z2491
ugaaacccgauuccugu

SEQ ID NO: 3371234 - RNA, 18 nt, Neisseria meningitidis Z2491
ugaaaccgcucugccguc

SEQ ID NO: 3371235 - RNA, 21 nt, Neisseria meningitidis Z2491
ugaaaccggcuucagacggca

SEQ ID NO: 3371236 - RNA, 23 nt, Neisseria meningitidis Z2491
ugaaaccucguucggacggcauu

SEQ ID NO: 3371237 - RNA, 12 nt, Neisseria meningitidis Z2491
ugaaacggcauc

SEQ ID NO: 3371238 - RNA, 17 nt, Neisseria meningitidis Z2491
ugaaacggguaguccuu

SEQ ID NO: 3371239 - RNA, 19 nt, Neisseria meningitidis Z2491
ugaaacggugggucaacau

SEQ ID NO: 3371240 - RNA, 20 nt, Neisseria meningitidis Z2491
ugaaacgguuguucaaaucg

SEQ ID NO: 3371241 - RNA, 13 nt, Neisseria meningitidis Z2491
ugaaacucaaaaa

SEQ ID NO: 3371242 - RNA, 17 nt, Neisseria meningitidis Z2491
ugaaacucaaaaaaacu

SEQ ID NO: 3371243 - RNA, 20 nt, Neisseria meningitidis Z2491
ugaaacucaaaaaaacuaga

SEQ ID NO: 3371244 - RNA, 15 nt, Neisseria meningitidis Z2491
ugaaacucaaaaaac

SEQ ID NO: 3371245 - RNA, 14 nt, Neisseria meningitidis Z2491
ugaaacucaauaua

SEQ ID NO: 3371246 - RNA, 15 nt, Neisseria meningitidis Z2491
ugaaacucaauauaa

SEQ ID NO: 3371247 - RNA, 18 nt, Neisseria meningitidis Z2491
ugaaacucaauauaacga

SEQ ID NO: 3371248 - RNA, 13 nt, Neisseria meningitidis Z2491
ugaaagagaaaag

SEQ ID NO: 3371249 - RNA, 22 nt, Neisseria meningitidis Z2491
ugaaagccuuucagacggcauu

SEQ ID NO: 3371250 - RNA, 16 nt, Neisseria meningitidis Z2491
ugaaaggcuucagacg

SEQ ID NO: 3371251 - RNA, 21 nt, Neisseria meningitidis Z2491
ugaaaggcuucagacggcauu

SEQ ID NO: 3371252 - RNA, 20 nt, Neisseria meningitidis Z2491
ugaaaggcuuuuucagacgg

SEQ ID NO: 3371253 - RNA, 20 nt, Neisseria meningitidis Z2491
ugaaagucuuucagacggca

SEQ ID NO: 3371254 - RNA, 20 nt, Neisseria meningitidis Z2491
ugaaaguuacagaaauuuau

SEQ ID NO: 3371255 - RNA, 16 nt, Neisseria meningitidis Z2491
ugaaauaaaaaaugcc

SEQ ID NO: 3371256 - RNA, 23 nt, Neisseria meningitidis Z2491
ugaaauaugguucagacggcauu

SEQ ID NO: 3371257 - RNA, 22 nt, Neisseria meningitidis Z2491
ugaaaucgccaaacauuuugau

SEQ ID NO: 3371258 - RNA, 20 nt, Neisseria meningitidis Z2491
ugaaaucugauuucguaauc

SEQ ID NO: 3371259 - RNA, 13 nt, Neisseria meningitidis Z2491
ugaaaugccgucu

SEQ ID NO: 3371260 - RNA, 15 nt, Neisseria meningitidis Z2491
ugaaaugccgucuga

SEQ ID NO: 3371261 - RNA, 17 nt, Neisseria meningitidis Z2491
ugaaaugccgucugaaa

SEQ ID NO: 3371262 - RNA, 18 nt, Neisseria meningitidis Z2491
ugaaauguucagacggca

SEQ ID NO: 3371263 - RNA, 20 nt, Neisseria meningitidis Z2491
ugaaauguucagacggcauu

SEQ ID NO: 3371264 - RNA, 15 nt, Neisseria meningitidis Z2491
ugaaauucaaaaaac

SEQ ID NO: 3371265 - RNA, 16 nt, Neisseria meningitidis Z2491
ugaaauucaaaaaacc

SEQ ID NO: 3371266 - RNA, 19 nt, Neisseria meningitidis Z2491
ugaaauuccagauucccgc

SEQ ID NO: 3371267 - RNA, 19 nt, Neisseria meningitidis Z2491
ugaaauucgucauucccgc

SEQ ID NO: 3371268 - RNA, 19 nt, Neisseria meningitidis Z2491
ugaaauucuagauucccgc

SEQ ID NO: 3371269 - RNA, 19 nt, Neisseria meningitidis Z2491
ugaaauuucagacggcguu

SEQ ID NO: 3371270 - RNA, 14 nt, Neisseria meningitidis Z2491
ugaacaacaaacua

SEQ ID NO: 3371271 - RNA, 18 nt, Neisseria meningitidis Z2491
ugaacacaggguucggac

SEQ ID NO: 3371272 - RNA, 16 nt, Neisseria meningitidis Z2491
ugaacacauugcguuc

SEQ ID NO: 3371273 - RNA, 17 nt, Neisseria meningitidis Z2491
ugaacacggguucagac

SEQ ID NO: 3371274 - RNA, 21 nt, Neisseria meningitidis Z2491
ugaacacggguucagacggca

SEQ ID NO: 3371275 - RNA, 16 nt, Neisseria meningitidis Z2491
ugaacauaaaugccgu

SEQ ID NO: 3371276 - RNA, 14 nt, Neisseria meningitidis Z2491
ugaacaucuuucag

SEQ ID NO: 3371277 - RNA, 18 nt, Neisseria meningitidis Z2491
ugaacauggacaacagcg

SEQ ID NO: 3371278 - RNA, 18 nt, Neisseria meningitidis Z2491
ugaacauuucagacggca

SEQ ID NO: 3371279 - RNA, 14 nt, Neisseria meningitidis Z2491
ugaaccaaugccgu

SEQ ID NO: 3371280 - RNA, 18 nt, Neisseria meningitidis Z2491
ugaaccagggauuuuuca

SEQ ID NO: 3371281 - RNA, 22 nt, Neisseria meningitidis Z2491
ugaacccuuugggcguucagac

SEQ ID NO: 3371282 - RNA, 18 nt, Neisseria meningitidis Z2491
ugaaccggcacaggcuca

SEQ ID NO: 3371283 - RNA, 17 nt, Neisseria meningitidis Z2491
ugaaccgucauucccac

SEQ ID NO: 3371284 - RNA, 21 nt, Neisseria meningitidis Z2491
ugaacgacgguauaaaccaaa

SEQ ID NO: 3371285 - RNA, 15 nt, Neisseria meningitidis Z2491
ugaacgaguuuucag

SEQ ID NO: 3371286 - RNA, 20 nt, Neisseria meningitidis Z2491
ugaacgcgcgggaauagcuc

SEQ ID NO: 3371287 - RNA, 16 nt, Neisseria meningitidis Z2491
ugaacgcuucagacgg

SEQ ID NO: 3371288 - RNA, 20 nt, Neisseria meningitidis Z2491
ugaacucaggcuucagacgg

SEQ ID NO: 3371289 - RNA, 21 nt, Neisseria meningitidis Z2491
ugaagaaaccguuuuauccga

SEQ ID NO: 3371290 - RNA, 21 nt, Neisseria meningitidis Z2491
ugaagauggcugaaauucaaa

SEQ ID NO: 3371291 - RNA, 19 nt, Neisseria meningitidis Z2491
ugaagcaggcguuuuucag

SEQ ID NO: 3371292 - RNA, 18 nt, Neisseria meningitidis Z2491
ugaagccagccccaccau

SEQ ID NO: 3371293 - RNA, 15 nt, Neisseria meningitidis Z2491
ugaagcccacccuac

SEQ ID NO: 3371294 - RNA, 18 nt, Neisseria meningitidis Z2491
ugaagcccacccuaccau

SEQ ID NO: 3371295 - RNA, 19 nt, Neisseria meningitidis Z2491
ugaagcccacccuaccauu

SEQ ID NO: 3371296 - RNA, 22 nt, Neisseria meningitidis Z2491
ugaagcccuuucagacggcauu

SEQ ID NO: 3371297 - RNA, 20 nt, Neisseria meningitidis Z2491
ugaagccgcuucagacggca

SEQ ID NO: 3371298 - RNA, 16 nt, Neisseria meningitidis Z2491
ugaagccuucagacgg

SEQ ID NO: 3371299 - RNA, 18 nt, Neisseria meningitidis Z2491
ugaagccuucagacggca

SEQ ID NO: 3371300 - RNA, 20 nt, Neisseria meningitidis Z2491
ugaagccuucagacggcaua

SEQ ID NO: 3371301 - RNA, 16 nt, Neisseria meningitidis Z2491
ugaagcucaaaaaacc

SEQ ID NO: 3371302 - RNA, 18 nt, Neisseria meningitidis Z2491
ugaaggcuucagacggca

SEQ ID NO: 3371303 - RNA, 13 nt, Neisseria meningitidis Z2491
ugaaggucgucug

SEQ ID NO: 3371304 - RNA, 17 nt, Neisseria meningitidis Z2491
ugaagucgugaauuaaa

SEQ ID NO: 3371305 - RNA, 20 nt, Neisseria meningitidis Z2491
ugaagucgugaauuaaaugc

SEQ ID NO: 3371306 - RNA, 22 nt, Neisseria meningitidis Z2491
ugaagucgugaauuaaaugcua

SEQ ID NO: 3371307 - RNA, 19 nt, Neisseria meningitidis Z2491
ugaaguucuagauucccgu

SEQ ID NO: 3371308 - RNA, 20 nt, Neisseria meningitidis Z2491
ugaauaaacuucuaacaaau

SEQ ID NO: 3371309 - RNA, 15 nt, Neisseria meningitidis Z2491
ugaauacaucauauu

SEQ ID NO: 3371310 - RNA, 15 nt, Neisseria meningitidis Z2491
ugaauauugccgccg

SEQ ID NO: 3371311 - RNA, 15 nt, Neisseria meningitidis Z2491
ugaaucugacuugcc

SEQ ID NO: 3371312 - RNA, 17 nt, Neisseria meningitidis Z2491
ugaaugaacucgauuuu

SEQ ID NO: 3371313 - RNA, 16 nt, Neisseria meningitidis Z2491
ugaaugcgucggagaa

SEQ ID NO: 3371314 - RNA, 22 nt, Neisseria meningitidis Z2491
ugaaugcgucggagaaaaacaa

SEQ ID NO: 3371315 - RNA, 12 nt, Neisseria meningitidis Z2491
ugaauuaaauuu

SEQ ID NO: 3371316 - RNA, 14 nt, Neisseria meningitidis Z2491
ugaauuaaauuuaa

SEQ ID NO: 3371317 - RNA, 15 nt, Neisseria meningitidis Z2491
ugaauuaaauuuaaa

SEQ ID NO: 3371318 - RNA, 21 nt, Neisseria meningitidis Z2491
ugacaaauucccgccaucuaa

SEQ ID NO: 3371319 - RNA, 16 nt, Neisseria meningitidis Z2491
ugacaacccuguccgc

SEQ ID NO: 3371320 - RNA, 12 nt, Neisseria meningitidis Z2491
ugacaaucggcu

SEQ ID NO: 3371321 - RNA, 13 nt, Neisseria meningitidis Z2491
ugacacaaagccu

SEQ ID NO: 3371322 - RNA, 18 nt, Neisseria meningitidis Z2491
ugacacuucacauuuucu

SEQ ID NO: 3371323 - RNA, 21 nt, Neisseria meningitidis Z2491
ugacacuuuaucugacgcguu

SEQ ID NO: 3371324 - RNA, 13 nt, Neisseria meningitidis Z2491
ugacaggauguag

SEQ ID NO: 3371325 - RNA, 17 nt, Neisseria meningitidis Z2491
ugacaugguuugcaguc

SEQ ID NO: 3371326 - RNA, 17 nt, Neisseria meningitidis Z2491
ugacccacgccaaaccg

SEQ ID NO: 3371327 - RNA, 15 nt, Neisseria meningitidis Z2491
ugaccgaaaaauaau

SEQ ID NO: 3371328 - RNA, 23 nt, Neisseria meningitidis Z2491
ugaccgaagcauaagccgccauc

SEQ ID NO: 3371329 - RNA, 22 nt, Neisseria meningitidis Z2491
ugaccgcagccgaacccaacag

SEQ ID NO: 3371330 - RNA, 14 nt, Neisseria meningitidis Z2491
ugaccgcgcugcuc

SEQ ID NO: 3371331 - RNA, 19 nt, Neisseria meningitidis Z2491
ugaccguguuuccaaggca

SEQ ID NO: 3371332 - RNA, 14 nt, Neisseria meningitidis Z2491
ugcagauaaauuuu

SEQ ID NO: 3371333 - RNA, 21 nt, Neisseria meningitidis Z2491
ugcagcguaccgaagcucugu

SEQ ID NO: 3371334 - RNA, 17 nt, Neisseria meningitidis Z2491
ugcagcuuugaguuucu

SEQ ID NO: 3371335 - RNA, 15 nt, Neisseria meningitidis Z2491
ugcaggcauuuaucg

SEQ ID NO: 3371336 - RNA, 15 nt, Neisseria meningitidis Z2491
ugcaggcugccgcac

SEQ ID NO: 3371337 - RNA, 18 nt, Neisseria meningitidis Z2491
ugcagggugucgcaaggu

SEQ ID NO: 3371338 - RNA, 15 nt, Neisseria meningitidis Z2491
ugcagguagcggcug

SEQ ID NO: 3371339 - RNA, 18 nt, Neisseria meningitidis Z2491
ugcagguuucugugcgga

SEQ ID NO: 3371340 - RNA, 21 nt, Neisseria meningitidis Z2491
ugcaguauccggcaagaauuu

SEQ ID NO: 3371341 - RNA, 22 nt, Neisseria meningitidis Z2491
ugcaguugaguuugaugaaacu

SEQ ID NO: 3371342 - RNA, 19 nt, Neisseria meningitidis Z2491
ugcauaaucaauuaaaaac

SEQ ID NO: 3371343 - RNA, 23 nt, Neisseria meningitidis Z2491
ugcauaaucaguuugcuuuguaa

SEQ ID NO: 3371344 - RNA, 18 nt, Neisseria meningitidis Z2491
ugcauacgguuuuccgcc

SEQ ID NO: 3371345 - RNA, 17 nt, Neisseria meningitidis Z2491
ugcauaucggcaaucac

SEQ ID NO: 3371346 - RNA, 18 nt, Neisseria meningitidis Z2491
ugcaucacgucauuccua

SEQ ID NO: 3371347 - RNA, 16 nt, Neisseria meningitidis Z2491
ugcaucacguucugaa

SEQ ID NO: 3371348 - RNA, 17 nt, Neisseria meningitidis Z2491
ugcaucacguucugaaa

SEQ ID NO: 3371349 - RNA, 22 nt, Neisseria meningitidis Z2491
ugcaucacguucugaaaaauau

SEQ ID NO: 3371350 - RNA, 22 nt, Neisseria meningitidis Z2491
ugcaucagcaguucguucugca

SEQ ID NO: 3371351 - RNA, 15 nt, Neisseria meningitidis Z2491
ugcaucaucacgcug

SEQ ID NO: 3371352 - RNA, 14 nt, Neisseria meningitidis Z2491
ugcaucgaccaguu

SEQ ID NO: 3371353 - RNA, 21 nt, Neisseria meningitidis Z2491
ugcaucgccgcuucaucuuua

SEQ ID NO: 3371354 - RNA, 11 nt, Neisseria meningitidis Z2491
ugcauuuguuc

SEQ ID NO: 3371355 - RNA, 19 nt, Neisseria meningitidis Z2491
ugcauuuuuaauuucuucu

SEQ ID NO: 3371356 - RNA, 23 nt, Neisseria meningitidis Z2491
ugcauuuuuaauuucuucuauca

SEQ ID NO: 3371357 - RNA, 16 nt, Neisseria meningitidis Z2491
ugccaaaccggcauuc

SEQ ID NO: 3371358 - RNA, 23 nt, Neisseria meningitidis Z2491
ugccaacccuugugcuucuucga

SEQ ID NO: 3371359 - RNA, 20 nt, Neisseria meningitidis Z2491
ugccaaugccgucugaaacc

SEQ ID NO: 3371360 - RNA, 15 nt, Neisseria meningitidis Z2491
ugccacauuuguucc

SEQ ID NO: 3371361 - RNA, 19 nt, Neisseria meningitidis Z2491
ugccaccgcgcgccaaggc

SEQ ID NO: 3371362 - RNA, 18 nt, Neisseria meningitidis Z2491
ugccacgccgaacccgac

SEQ ID NO: 3371363 - RNA, 14 nt, Neisseria meningitidis Z2491
ugccagcuccgcca

SEQ ID NO: 3371364 - RNA, 22 nt, Neisseria meningitidis Z2491
ugccauacaaacaggcuucaga

SEQ ID NO: 3371365 - RNA, 19 nt, Neisseria meningitidis Z2491
ugccauggauuauauuugu

SEQ ID NO: 3371366 - RNA, 17 nt, Neisseria meningitidis Z2491
ugccaugugccuuguuu

SEQ ID NO: 3371367 - RNA, 20 nt, Neisseria meningitidis Z2491
ugccauucuugcaaaauaga

SEQ ID NO: 3371368 - RNA, 16 nt, Neisseria meningitidis Z2491
ugcccauagaaaggga

SEQ ID NO: 3371369 - RNA, 18 nt, Neisseria meningitidis Z2491
ugcccauccgccuuccgc

SEQ ID NO: 3371370 - RNA, 20 nt, Neisseria meningitidis Z2491
ugcccauugccacgccgaac

SEQ ID NO: 3371371 - RNA, 17 nt, Neisseria meningitidis Z2491
ugcccauuuguuggaug

SEQ ID NO: 3371372 - RNA, 18 nt, Neisseria meningitidis Z2491
ugccccacauaaacagca

SEQ ID NO: 3371373 - RNA, 14 nt, Neisseria meningitidis Z2491
ugcccgacugugcc

SEQ ID NO: 3371374 - RNA, 23 nt, Neisseria meningitidis Z2491
ugcccgaugccgccaucaguucg

SEQ ID NO: 3371375 - RNA, 19 nt, Neisseria meningitidis Z2491
ugcccgcuuuugaguuucg

SEQ ID NO: 3371376 - RNA, 18 nt, Neisseria meningitidis Z2491
ugcccguggcgacggcaa

SEQ ID NO: 3371377 - RNA, 15 nt, Neisseria meningitidis Z2491
ugccgacgcgcugcu

SEQ ID NO: 3371378 - RNA, 14 nt, Neisseria meningitidis Z2491
ugccgauuucuucg

SEQ ID NO: 3371379 - RNA, 17 nt, Neisseria meningitidis Z2491
ugccgauuucuucgcgg

SEQ ID NO: 3371380 - RNA, 21 nt, Neisseria meningitidis Z2491
ugccgauuucuucgcgggaca

SEQ ID NO: 3371381 - RNA, 18 nt, Neisseria meningitidis Z2491
ugccgcaaacggcaggca

SEQ ID NO: 3371382 - RNA, 16 nt, Neisseria meningitidis Z2491
ugccgcaccaccagcc

SEQ ID NO: 3371383 - RNA, 23 nt, Neisseria meningitidis Z2491
ugccgcaccaccagccacaacac

SEQ ID NO: 3371384 - RNA, 16 nt, Neisseria meningitidis Z2491
ugccgcaccuaaaggg

SEQ ID NO: 3371385 - RNA, 21 nt, Neisseria meningitidis Z2491
ugccgcauaaaucaacagcag

SEQ ID NO: 3371386 - RNA, 14 nt, Neisseria meningitidis Z2491
ugccgccagccacc

SEQ ID NO: 3371387 - RNA, 23 nt, Neisseria meningitidis Z2491
ugccgcccgucccgaugccgcaa

SEQ ID NO: 3371388 - RNA, 23 nt, Neisseria meningitidis Z2491
ugccgccgaaagucgagccaugc

SEQ ID NO: 3371389 - RNA, 19 nt, Neisseria meningitidis Z2491
ugccgccgcaacugccuuu

SEQ ID NO: 3371390 - RNA, 22 nt, Neisseria meningitidis Z2491
ugccgccgccaugucgcgggcg

SEQ ID NO: 3371391 - RNA, 17 nt, Neisseria meningitidis Z2491
ugccgccgcccgggccg

SEQ ID NO: 3371392 - RNA, 16 nt, Neisseria meningitidis Z2491
ugccgccgccuugugc

SEQ ID NO: 3371393 - RNA, 14 nt, Neisseria meningitidis Z2491
ugccgccugccugu

SEQ ID NO: 3371394 - RNA, 18 nt, Neisseria meningitidis Z2491
ugccgccugccuguuuuu

SEQ ID NO: 3371395 - RNA, 20 nt, Neisseria meningitidis Z2491
ugccgcgauucagccauugu

SEQ ID NO: 3371396 - RNA, 21 nt, Neisseria meningitidis Z2491
ugccgcgauuccggcgcggcg

SEQ ID NO: 3371397 - RNA, 20 nt, Neisseria meningitidis Z2491
ugccgcgcuuuauaguggau

SEQ ID NO: 3371398 - RNA, 18 nt, Neisseria meningitidis Z2491
ugccgcguguccgcgcgu

SEQ ID NO: 3371399 - RNA, 21 nt, Neisseria meningitidis Z2491
ugccggaaauaccgacggcgu

SEQ ID NO: 3371400 - RNA, 16 nt, Neisseria meningitidis Z2491
ugccgggguaauccaa

SEQ ID NO: 3371401 - RNA, 17 nt, Neisseria meningitidis Z2491
ugccggucaggacggcu

SEQ ID NO: 3371402 - RNA, 22 nt, Neisseria meningitidis Z2491
ugccguaccggucagaaucgcc

SEQ ID NO: 3371403 - RNA, 13 nt, Neisseria meningitidis Z2491
ugccguacuauuu

SEQ ID NO: 3371404 - RNA, 16 nt, Neisseria meningitidis Z2491
ugccguacuauuugua

SEQ ID NO: 3371405 - RNA, 17 nt, Neisseria meningitidis Z2491
ugccguauuuauuuccg

SEQ ID NO: 3371406 - RNA, 19 nt, Neisseria meningitidis Z2491
ugccgucauugagcagcac

SEQ ID NO: 3371407 - RNA, 14 nt, Neisseria meningitidis Z2491
ugccgucugaaaaa

SEQ ID NO: 3371408 - RNA, 17 nt, Neisseria meningitidis Z2491
ugccgucugaaaagucu

SEQ ID NO: 3371409 - RNA, 17 nt, Neisseria meningitidis Z2491
ugccgucugaaacccga

SEQ ID NO: 3371410 - RNA, 18 nt, Neisseria meningitidis Z2491
ugccgucugaaacccgau

SEQ ID NO: 3371411 - RNA, 23 nt, Neisseria meningitidis Z2491
ugccgucugaaacccggaaaaaa

SEQ ID NO: 3371412 - RNA, 17 nt, Neisseria meningitidis Z2491
ugccgucugaaaccugu

SEQ ID NO: 3371413 - RNA, 20 nt, Neisseria meningitidis Z2491
ugccgucugaaacguuucag

SEQ ID NO: 3371414 - RNA, 16 nt, Neisseria meningitidis Z2491
ugccgucugaaaggcu

SEQ ID NO: 3371415 - RNA, 17 nt, Neisseria meningitidis Z2491
ugccgucugaaagggcu

SEQ ID NO: 3371416 - RNA, 18 nt, Neisseria meningitidis Z2491
ugccgucugaaagguuuu

SEQ ID NO: 3371417 - RNA, 14 nt, Neisseria meningitidis Z2491
ugccgucugaaagu

SEQ ID NO: 3371418 - RNA, 15 nt, Neisseria meningitidis Z2491
ugccgucugaagccu

SEQ ID NO: 3371419 - RNA, 20 nt, Neisseria meningitidis Z2491
ugccgucugagaacuucaga

SEQ ID NO: 3371420 - RNA, 13 nt, Neisseria meningitidis Z2491
ugccguuuuccuu

SEQ ID NO: 3371421 - RNA, 18 nt, Neisseria meningitidis Z2491
ugccguuuuccuuucuga

SEQ ID NO: 3371422 - RNA, 14 nt, Neisseria meningitidis Z2491
ugccuacacaucgu

SEQ ID NO: 3371423 - RNA, 17 nt, Neisseria meningitidis Z2491
ugccuacgccgaugggc

SEQ ID NO: 3371424 - RNA, 18 nt, Neisseria meningitidis Z2491
ugccuacgccgaugggca

SEQ ID NO: 3371425 - RNA, 14 nt, Neisseria meningitidis Z2491
ugccuagaggaaug

SEQ ID NO: 3371426 - RNA, 14 nt, Neisseria meningitidis Z2491
ugccucuucccaau

SEQ ID NO: 3371427 - RNA, 20 nt, Neisseria meningitidis Z2491
ugccucuucccaauucuccc

SEQ ID NO: 3371428 - RNA, 14 nt, Neisseria meningitidis Z2491
ugccucuuuucaga

SEQ ID NO: 3371429 - RNA, 16 nt, Neisseria meningitidis Z2491
ugccugauacagccac

SEQ ID NO: 3371430 - RNA, 16 nt, Neisseria meningitidis Z2491
ugccuguaaaaccaag

SEQ ID NO: 3371431 - RNA, 22 nt, Neisseria meningitidis Z2491
ugccugugcggcggacauaaac

SEQ ID NO: 3371432 - RNA, 14 nt, Neisseria meningitidis Z2491
ugccuguuuuucuu

SEQ ID NO: 3371433 - RNA, 21 nt, Neisseria meningitidis Z2491
uggauaccgucugaacaucgu

SEQ ID NO: 3371434 - RNA, 17 nt, Neisseria meningitidis Z2491
uggauagcgagacggca

SEQ ID NO: 3371435 - RNA, 18 nt, Neisseria meningitidis Z2491
uggauagcgagacggcau

SEQ ID NO: 3371436 - RNA, 19 nt, Neisseria meningitidis Z2491
uggauaugccguauucccg

SEQ ID NO: 3371437 - RNA, 18 nt, Neisseria meningitidis Z2491
uggauauugccguuuucc

SEQ ID NO: 3371438 - RNA, 21 nt, Neisseria meningitidis Z2491
uggauauugccguuuuccuuu

SEQ ID NO: 3371439 - RNA, 21 nt, Neisseria meningitidis Z2491
uggaugaucggagugauuauc

SEQ ID NO: 3371440 - RNA, 15 nt, Neisseria meningitidis Z2491
uggauuaaauuuaaa

SEQ ID NO: 3371441 - RNA, 21 nt, Neisseria meningitidis Z2491
uggauuaaauuuaaaccagua

SEQ ID NO: 3371442 - RNA, 21 nt, Neisseria meningitidis Z2491
uggauuaaauuuaaaucagua

SEQ ID NO: 3371443 - RNA, 15 nt, Neisseria meningitidis Z2491
uggauuaacaaaaac

SEQ ID NO: 3371444 - RNA, 20 nt, Neisseria meningitidis Z2491
uggauuaacaaaaaccagua

SEQ ID NO: 3371445 - RNA, 20 nt, Neisseria meningitidis Z2491
uggauuaacaaaaaccggua

SEQ ID NO: 3371446 - RNA, 15 nt, Neisseria meningitidis Z2491
uggauuaacaaaaau

SEQ ID NO: 3371447 - RNA, 17 nt, Neisseria meningitidis Z2491
uggauuaacaaaaauca

SEQ ID NO: 3371448 - RNA, 21 nt, Neisseria meningitidis Z2491
uggauuaacaaaaaucaggac

SEQ ID NO: 3371449 - RNA, 15 nt, Neisseria meningitidis Z2491
uggauuugucuucaa

SEQ ID NO: 3371450 - RNA, 14 nt, Neisseria meningitidis Z2491
uggauuuuuuuaua

SEQ ID NO: 3371451 - RNA, 14 nt, Neisseria meningitidis Z2491
uggcaaaauuucag

SEQ ID NO: 3371452 - RNA, 16 nt, Neisseria meningitidis Z2491
uggcaaauugaaaugc

SEQ ID NO: 3371453 - RNA, 20 nt, Neisseria meningitidis Z2491
uggcaagcuuuuuaauccac

SEQ ID NO: 3371454 - RNA, 16 nt, Neisseria meningitidis Z2491
uggcaaugucuucaua

SEQ ID NO: 3371455 - RNA, 13 nt, Neisseria meningitidis Z2491
uggcaggcaucua

SEQ ID NO: 3371456 - RNA, 14 nt, Neisseria meningitidis Z2491
uggcaguaauccaa

SEQ ID NO: 3371457 - RNA, 17 nt, Neisseria meningitidis Z2491
uggcaguaauccaaggc

SEQ ID NO: 3371458 - RNA, 12 nt, Neisseria meningitidis Z2491
uggcaucgcgca

SEQ ID NO: 3371459 - RNA, 15 nt, Neisseria meningitidis Z2491
uggcauuuuuaucuu

SEQ ID NO: 3371460 - RNA, 20 nt, Neisseria meningitidis Z2491
uggccuuuacucauucaauc

SEQ ID NO: 3371461 - RNA, 12 nt, Neisseria meningitidis Z2491
uggcgacggcaa

SEQ ID NO: 3371462 - RNA, 17 nt, Neisseria meningitidis Z2491
uggcgagcgauucuucg

SEQ ID NO: 3371463 - RNA, 20 nt, Neisseria meningitidis Z2491
uggcgagcgauucuucgaca

SEQ ID NO: 3371464 - RNA, 12 nt, Neisseria meningitidis Z2491
uggcgcauuuuu

SEQ ID NO: 3371465 - RNA, 23 nt, Neisseria meningitidis Z2491
uggcgggaagccagggcggauug

SEQ ID NO: 3371466 - RNA, 15 nt, Neisseria meningitidis Z2491
uggcgggaaugccga

SEQ ID NO: 3371467 - RNA, 22 nt, Neisseria meningitidis Z2491
uggcguaaaacgguguggagag

SEQ ID NO: 3371468 - RNA, 14 nt, Neisseria meningitidis Z2491
uggcugauaagguu

SEQ ID NO: 3371469 - RNA, 16 nt, Neisseria meningitidis Z2491
uggcugaugacggcag

SEQ ID NO: 3371470 - RNA, 16 nt, Neisseria meningitidis Z2491
uggcuguauuuuaaua

SEQ ID NO: 3371471 - RNA, 21 nt, Neisseria meningitidis Z2491
uggcuuaaauuuaaaccagua

SEQ ID NO: 3371472 - RNA, 23 nt, Neisseria meningitidis Z2491
uggcuucaauauacucaauagga

SEQ ID NO: 3371473 - RNA, 15 nt, Neisseria meningitidis Z2491
uggcuucuaaaaauu

SEQ ID NO: 3371474 - RNA, 17 nt, Neisseria meningitidis Z2491
uggcuuugaagccgagc

SEQ ID NO: 3371475 - RNA, 14 nt, Neisseria meningitidis Z2491
ugggaaacuuuuca

SEQ ID NO: 3371476 - RNA, 12 nt, Neisseria meningitidis Z2491
ugggaaaugccg

SEQ ID NO: 3371477 - RNA, 14 nt, Neisseria meningitidis Z2491
ugggaaaugccguc

SEQ ID NO: 3371478 - RNA, 17 nt, Neisseria meningitidis Z2491
ugggaaaugccgucuga

SEQ ID NO: 3371479 - RNA, 22 nt, Neisseria meningitidis Z2491
ugggaaggauggguuuuagguu

SEQ ID NO: 3371480 - RNA, 12 nt, Neisseria meningitidis Z2491
ugggaauccaga

SEQ ID NO: 3371481 - RNA, 14 nt, Neisseria meningitidis Z2491
ugggaaucuggaaa

SEQ ID NO: 3371482 - RNA, 18 nt, Neisseria meningitidis Z2491
ugggaaucuggaaaccaa

SEQ ID NO: 3371483 - RNA, 18 nt, Neisseria meningitidis Z2491
ugggaaugacaggaugua

SEQ ID NO: 3371484 - RNA, 14 nt, Neisseria meningitidis Z2491
ugggaaugacggca

SEQ ID NO: 3371485 - RNA, 15 nt, Neisseria meningitidis Z2491
ugggacgguucggac

SEQ ID NO: 3371486 - RNA, 23 nt, Neisseria meningitidis Z2491
ugggaugauuuuguucugguugc

SEQ ID NO: 3371487 - RNA, 15 nt, Neisseria meningitidis Z2491
ugggcacguuugagu

SEQ ID NO: 3371488 - RNA, 16 nt, Neisseria meningitidis Z2491
ugggccgccaccgcca

SEQ ID NO: 3371489 - RNA, 20 nt, Neisseria meningitidis Z2491
ugggcguucagacggcauug

SEQ ID NO: 3371490 - RNA, 19 nt, Neisseria meningitidis Z2491
ugggcugaaauagaaaaua

SEQ ID NO: 3371491 - RNA, 14 nt, Neisseria meningitidis Z2491
ugggcugaagccca

SEQ ID NO: 3371492 - RNA, 18 nt, Neisseria meningitidis Z2491
ugggcuucagacggcauc

SEQ ID NO: 3371493 - RNA, 19 nt, Neisseria meningitidis Z2491
ugggcuucagacggcaucg

SEQ ID NO: 3371494 - RNA, 13 nt, Neisseria meningitidis Z2491
ugggcuucaucag

SEQ ID NO: 3371495 - RNA, 22 nt, Neisseria meningitidis Z2491
uggggaaagaucaauaacgguu

SEQ ID NO: 3371496 - RNA, 20 nt, Neisseria meningitidis Z2491
ugggucagccccaugcguuc

SEQ ID NO: 3371497 - RNA, 13 nt, Neisseria meningitidis Z2491
ugguaacauuaac

SEQ ID NO: 3371498 - RNA, 13 nt, Neisseria meningitidis Z2491
ugguaaugcaaaa

SEQ ID NO: 3371499 - RNA, 13 nt, Neisseria meningitidis Z2491
ugguagagaaaau

SEQ ID NO: 3371500 - RNA, 20 nt, Neisseria meningitidis Z2491
ugguagagcgcaaccuugcc

SEQ ID NO: 3371501 - RNA, 18 nt, Neisseria meningitidis Z2491
ugguagggauacaaaucc

SEQ ID NO: 3371502 - RNA, 22 nt, Neisseria meningitidis Z2491
ugguauagaggauuaacaaaaa

SEQ ID NO: 3371503 - RNA, 21 nt, Neisseria meningitidis Z2491
ugguaucugcauuauuuggga

SEQ ID NO: 3371504 - RNA, 20 nt, Neisseria meningitidis Z2491
ugguaucuuuaaacagcaua

SEQ ID NO: 3371505 - RNA, 14 nt, Neisseria meningitidis Z2491
uggucaauacacaa

SEQ ID NO: 3371506 - RNA, 23 nt, Neisseria meningitidis Z2491
uggucggcaaucauuucugucug

SEQ ID NO: 3371507 - RNA, 13 nt, Neisseria meningitidis Z2491
uggucguucaaau

SEQ ID NO: 3371508 - RNA, 14 nt, Neisseria meningitidis Z2491
ugguguuugcagau

SEQ ID NO: 3371509 - RNA, 15 nt, Neisseria meningitidis Z2491
ugguucagacggcau

SEQ ID NO: 3371510 - RNA, 12 nt, Neisseria meningitidis Z2491
ugguugaaaacg

SEQ ID NO: 3371511 - RNA, 22 nt, Neisseria meningitidis Z2491
ugguugaaguccauggaaacca

SEQ ID NO: 3371512 - RNA, 15 nt, Neisseria meningitidis Z2491
ugguuggaacagauu

SEQ ID NO: 3371513 - RNA, 21 nt, Neisseria meningitidis Z2491
ugguuguucagaaaauccgcc

SEQ ID NO: 3371514 - RNA, 14 nt, Neisseria meningitidis Z2491
ugguuuaaauuuaa

SEQ ID NO: 3371515 - RNA, 16 nt, Neisseria meningitidis Z2491
uguaaaaacaaaaaau

SEQ ID NO: 3371516 - RNA, 15 nt, Neisseria meningitidis Z2491
uguaaaaaugccguc

SEQ ID NO: 3371517 - RNA, 15 nt, Neisseria meningitidis Z2491
uguaacuuccacacc

SEQ ID NO: 3371518 - RNA, 22 nt, Neisseria meningitidis Z2491
uguaccaagcccaaucccgcaa

SEQ ID NO: 3371519 - RNA, 18 nt, Neisseria meningitidis Z2491
uguacccgcccgccgccg

SEQ ID NO: 3371520 - RNA, 18 nt, Neisseria meningitidis Z2491
uguacgaauccgccggca

SEQ ID NO: 3371521 - RNA, 11 nt, Neisseria meningitidis Z2491
uguacugguuu

SEQ ID NO: 3371522 - RNA, 19 nt, Neisseria meningitidis Z2491
uguacugguuuaaauuuaa

SEQ ID NO: 3371523 - RNA, 16 nt, Neisseria meningitidis Z2491
uguacugucugcagcu

SEQ ID NO: 3371524 - RNA, 22 nt, Neisseria meningitidis Z2491
uguagauuuuuuuauuuaaaca

SEQ ID NO: 3371525 - RNA, 17 nt, Neisseria meningitidis Z2491
uguaggcguuggcauaa

SEQ ID NO: 3371526 - RNA, 19 nt, Neisseria meningitidis Z2491
uguauaguggauuaaauuu

SEQ ID NO: 3371527 - RNA, 21 nt, Neisseria meningitidis Z2491
uguauaguggauuaaauuuaa

SEQ ID NO: 3371528 - RNA, 12 nt, Neisseria meningitidis Z2491
uguauauaaucc

SEQ ID NO: 3371529 - RNA, 15 nt, Neisseria meningitidis Z2491
uguaucggugucaaa

SEQ ID NO: 3371530 - RNA, 18 nt, Neisseria meningitidis Z2491
uguaugccgucugaaacc

SEQ ID NO: 3371531 - RNA, 22 nt, Neisseria meningitidis Z2491
uguaugcggcuugggcgacggc

SEQ ID NO: 3371532 - RNA, 18 nt, Neisseria meningitidis Z2491
uguauucggaggcgcauu

SEQ ID NO: 3371533 - RNA, 19 nt, Neisseria meningitidis Z2491
uguauugggaugauuuugu

SEQ ID NO: 3371534 - RNA, 20 nt, Neisseria meningitidis Z2491
uuaaaauuuuuauauucaca

SEQ ID NO: 3371535 - RNA, 23 nt, Neisseria meningitidis Z2491
uuaaacagcacugccucuuuuca

SEQ ID NO: 3371536 - RNA, 13 nt, Neisseria meningitidis Z2491
uuaaacucuuaaa

SEQ ID NO: 3371537 - RNA, 21 nt, Neisseria meningitidis Z2491
uuaaaggggugcguuuuauug

SEQ ID NO: 3371538 - RNA, 20 nt, Neisseria meningitidis Z2491
uuaaagugccauuuaaaauc

SEQ ID NO: 3371539 - RNA, 21 nt, Neisseria meningitidis Z2491
uuaaaguuaggguaauuuauc

SEQ ID NO: 3371540 - RNA, 21 nt, Neisseria meningitidis Z2491
uuaaaguuucagaauuuauuu

SEQ ID NO: 3371541 - RNA, 18 nt, Neisseria meningitidis Z2491
uuaaauaaaauuuaauuu

SEQ ID NO: 3371542 - RNA, 18 nt, Neisseria meningitidis Z2491
uuaaauaucugacaaaac

SEQ ID NO: 3371543 - RNA, 13 nt, Neisseria meningitidis Z2491
uuaaauucaacuu

SEQ ID NO: 3371544 - RNA, 19 nt, Neisseria meningitidis Z2491
uuaaauuuaaaucaguacg

SEQ ID NO: 3371545 - RNA, 12 nt, Neisseria meningitidis Z2491
uuaaauuuaauc

SEQ ID NO: 3371546 - RNA, 15 nt, Neisseria meningitidis Z2491
uuaaauuuaauccac

SEQ ID NO: 3371547 - RNA, 20 nt, Neisseria meningitidis Z2491
uuaaauuuaauccacuauaa

SEQ ID NO: 3371548 - RNA, 23 nt, Neisseria meningitidis Z2491
uuaaauuuaauccacuauaauga

SEQ ID NO: 3371549 - RNA, 20 nt, Neisseria meningitidis Z2491
uuaaauuuaauccauuauaa

SEQ ID NO: 3371550 - RNA, 17 nt, Neisseria meningitidis Z2491
uuaaauuuaguucacua

SEQ ID NO: 3371551 - RNA, 14 nt, Neisseria meningitidis Z2491
uuaaccguaucaaa

SEQ ID NO: 3371552 - RNA, 15 nt, Neisseria meningitidis Z2491
uuaagaaaaccugca

SEQ ID NO: 3371553 - RNA, 13 nt, Neisseria meningitidis Z2491
uuaagaaacaaag

SEQ ID NO: 3371554 - RNA, 21 nt, Neisseria meningitidis Z2491
uuaagacguggugcuaaaaca

SEQ ID NO: 3371555 - RNA, 15 nt, Neisseria meningitidis Z2491
uuaagaugaagucgu

SEQ ID NO: 3371556 - RNA, 15 nt, Neisseria meningitidis Z2491
uuaagauguuuuucc

SEQ ID NO: 3371557 - RNA, 18 nt, Neisseria meningitidis Z2491
uuaagcgugacgaaaauu

SEQ ID NO: 3371558 - RNA, 21 nt, Neisseria meningitidis Z2491
uuaaggcuuauuucacuucca

SEQ ID NO: 3371559 - RNA, 20 nt, Neisseria meningitidis Z2491
uuaaggugcgggauagaaug

SEQ ID NO: 3371560 - RNA, 18 nt, Neisseria meningitidis Z2491
uuaauccacaguuuuucc

SEQ ID NO: 3371561 - RNA, 15 nt, Neisseria meningitidis Z2491
uuaauccacuauaaa

SEQ ID NO: 3371562 - RNA, 20 nt, Neisseria meningitidis Z2491
uuaauccacuauaaaaacga

SEQ ID NO: 3371563 - RNA, 22 nt, Neisseria meningitidis Z2491
uuaauccacuauaauacaaaaa

SEQ ID NO: 3371564 - RNA, 23 nt, Neisseria meningitidis Z2491
uuaauccacuauaauuuauugaa

SEQ ID NO: 3371565 - RNA, 17 nt, Neisseria meningitidis Z2491
uuaauccgcuauaauuu

SEQ ID NO: 3371566 - RNA, 22 nt, Neisseria meningitidis Z2491
uuaauccgcuauauauucugau

SEQ ID NO: 3371567 - RNA, 20 nt, Neisseria meningitidis Z2491
uuaauccgcuuccaaaacca

SEQ ID NO: 3371568 - RNA, 22 nt, Neisseria meningitidis Z2491
uuaauccgcuuccaaaaccacu

SEQ ID NO: 3371569 - RNA, 17 nt, Neisseria meningitidis Z2491
uuaaugauuaucauaaa

SEQ ID NO: 3371570 - RNA, 15 nt, Neisseria meningitidis Z2491
uuaaugcgaaaugcc

SEQ ID NO: 3371571 - RNA, 15 nt, Neisseria meningitidis Z2491
uuaauuaagauccuc

SEQ ID NO: 3371572 - RNA, 19 nt, Neisseria meningitidis Z2491
uuaauucggcaauuugaca

SEQ ID NO: 3371573 - RNA, 12 nt, Neisseria meningitidis Z2491
uuaauuucaaua

SEQ ID NO: 3371574 - RNA, 18 nt, Neisseria meningitidis Z2491
uuaauuucggaaaugcgu

SEQ ID NO: 3371575 - RNA, 13 nt, Neisseria meningitidis Z2491
uuacacaauuccc

SEQ ID NO: 3371576 - RNA, 15 nt, Neisseria meningitidis Z2491
uuacacggcgcggcu

SEQ ID NO: 3371577 - RNA, 18 nt, Neisseria meningitidis Z2491
uuacacggcgcggcuuug

SEQ ID NO: 3371578 - RNA, 15 nt, Neisseria meningitidis Z2491
uuacagaaauuuaua

SEQ ID NO: 3371579 - RNA, 20 nt, Neisseria meningitidis Z2491
uuacagcggauuaaaauauc

SEQ ID NO: 3371580 - RNA, 22 nt, Neisseria meningitidis Z2491
uuacauggauuacugucuuauu

SEQ ID NO: 3371581 - RNA, 17 nt, Neisseria meningitidis Z2491
uuacccaaugacugccc

SEQ ID NO: 3371582 - RNA, 19 nt, Neisseria meningitidis Z2491
uuacccgauaaguuuccgc

SEQ ID NO: 3371583 - RNA, 13 nt, Neisseria meningitidis Z2491
uuacccucucccc

SEQ ID NO: 3371584 - RNA, 14 nt, Neisseria meningitidis Z2491
uuacccucuccccg

SEQ ID NO: 3371585 - RNA, 18 nt, Neisseria meningitidis Z2491
uuacccucuccccgaccc

SEQ ID NO: 3371586 - RNA, 17 nt, Neisseria meningitidis Z2491
uuaccugccguauuuau

SEQ ID NO: 3371587 - RNA, 16 nt, Neisseria meningitidis Z2491
uuacgcaauggcaaaa

SEQ ID NO: 3371588 - RNA, 18 nt, Neisseria meningitidis Z2491
uuacgccccucccaaaua

SEQ ID NO: 3371589 - RNA, 19 nt, Neisseria meningitidis Z2491
uuacggucagaaaauuucu

SEQ ID NO: 3371590 - RNA, 21 nt, Neisseria meningitidis Z2491
uuacguucuggauucccacuu

SEQ ID NO: 3371591 - RNA, 17 nt, Neisseria meningitidis Z2491
uuacguuuauuuacgau

SEQ ID NO: 3371592 - RNA, 22 nt, Neisseria meningitidis Z2491
uuacuaaaacacagccaaaaua

SEQ ID NO: 3371593 - RNA, 23 nt, Neisseria meningitidis Z2491
uuacugccgcaaacggcaggcaa

SEQ ID NO: 3371594 - RNA, 13 nt, Neisseria meningitidis Z2491
uuacugucuuauu

SEQ ID NO: 3371595 - RNA, 23 nt, Neisseria meningitidis Z2491
uuagaaaaaauauaccaaaaauu

SEQ ID NO: 3371596 - RNA, 20 nt, Neisseria meningitidis Z2491
uuagauuccacguucuagau

SEQ ID NO: 3371597 - RNA, 17 nt, Neisseria meningitidis Z2491
uuagcauugaaugucua

SEQ ID NO: 3371598 - RNA, 20 nt, Neisseria meningitidis Z2491
uuagcggagcaguuuuucaa

SEQ ID NO: 3371599 - RNA, 17 nt, Neisseria meningitidis Z2491
uuagcugaagcuuuaga

SEQ ID NO: 3371600 - RNA, 16 nt, Neisseria meningitidis Z2491
uuaggguaauuuaucc

SEQ ID NO: 3371601 - RNA, 19 nt, Neisseria meningitidis Z2491
uuaggguucugauuuuguu

SEQ ID NO: 3371602 - RNA, 20 nt, Neisseria meningitidis Z2491
uuaggguucugauuuuguuu

SEQ ID NO: 3371603 - RNA, 23 nt, Neisseria meningitidis Z2491
uuagguugguuugaaagagaaaa

SEQ ID NO: 3371604 - RNA, 12 nt, Neisseria meningitidis Z2491
uuaguuucgguc

SEQ ID NO: 3371605 - RNA, 22 nt, Neisseria meningitidis Z2491
uuauaaaagacauugccaaaua

SEQ ID NO: 3371606 - RNA, 22 nt, Neisseria meningitidis Z2491
uuauacacacgguuuucacauc

SEQ ID NO: 3371607 - RNA, 19 nt, Neisseria meningitidis Z2491
uuauagaauuauccacaga

SEQ ID NO: 3371608 - RNA, 19 nt, Neisseria meningitidis Z2491
uuauaguggauuaacaaaa

SEQ ID NO: 3371609 - RNA, 20 nt, Neisseria meningitidis Z2491
uuauaguggauuaacaaaaa

SEQ ID NO: 3371610 - RNA, 21 nt, Neisseria meningitidis Z2491
uuauaguggauuaacaaaaau

SEQ ID NO: 3371611 - RNA, 22 nt, Neisseria meningitidis Z2491
uuauaguggauuaacaaaaauc

SEQ ID NO: 3371612 - RNA, 23 nt, Neisseria meningitidis Z2491
uuauaguggauuaacaaaaauca

SEQ ID NO: 3371613 - RNA, 18 nt, Neisseria meningitidis Z2491
uuauaugcuaucuuuauu

SEQ ID NO: 3371614 - RNA, 20 nt, Neisseria meningitidis Z2491
uuauauuguuauuuuuauuu

SEQ ID NO: 3371615 - RNA, 21 nt, Neisseria meningitidis Z2491
uuaucacgauugagacaauca

SEQ ID NO: 3371616 - RNA, 15 nt, Neisseria meningitidis Z2491
uuaucagaaaugacu

SEQ ID NO: 3371617 - RNA, 21 nt, Neisseria meningitidis Z2491
uuaucagaugccgucugaaac

SEQ ID NO: 3371618 - RNA, 18 nt, Neisseria meningitidis Z2491
uuaucagggcugcaaaau

SEQ ID NO: 3371619 - RNA, 13 nt, Neisseria meningitidis Z2491
uuaucccaacaag

SEQ ID NO: 3371620 - RNA, 18 nt, Neisseria meningitidis Z2491
uuauccgaaacaacaaaa

SEQ ID NO: 3371621 - RNA, 14 nt, Neisseria meningitidis Z2491
uuauccgaaaucac

SEQ ID NO: 3371622 - RNA, 18 nt, Neisseria meningitidis Z2491
uuauccgcacacgaacug

SEQ ID NO: 3371623 - RNA, 17 nt, Neisseria meningitidis Z2491
uuauccggcuuuccaug

SEQ ID NO: 3371624 - RNA, 15 nt, Neisseria meningitidis Z2491
uuaucggaaaaacag

SEQ ID NO: 3371625 - RNA, 15 nt, Neisseria meningitidis Z2491
uuaucggaaaugacc

SEQ ID NO: 3371626 - RNA, 15 nt, Neisseria meningitidis Z2491
uuaucggaaaugacu

SEQ ID NO: 3371627 - RNA, 14 nt, Neisseria meningitidis Z2491
uuaucggcaaaaaa

SEQ ID NO: 3371628 - RNA, 14 nt, Neisseria meningitidis Z2491
uuaucugaaaguuu

SEQ ID NO: 3371629 - RNA, 13 nt, Neisseria meningitidis Z2491
uuaucuuucagca

SEQ ID NO: 3371630 - RNA, 11 nt, Neisseria meningitidis Z2491
uuaucuuuucu

SEQ ID NO: 3371631 - RNA, 23 nt, Neisseria meningitidis Z2491
uuaugcagauggcguuaccaaua

SEQ ID NO: 3371632 - RNA, 19 nt, Neisseria meningitidis Z2491
uuauguagauuuuuuuauu

SEQ ID NO: 3371633 - RNA, 13 nt, Neisseria meningitidis Z2491
uuauguauauaau

SEQ ID NO: 3371634 - RNA, 13 nt, Neisseria meningitidis Z2491
uuaugugcuguca

SEQ ID NO: 3371635 - RNA, 19 nt, Neisseria meningitidis Z2491
uuccgaaaucauccacagc

SEQ ID NO: 3371636 - RNA, 20 nt, Neisseria meningitidis Z2491
uuccgaaaucauccacagcc

SEQ ID NO: 3371637 - RNA, 13 nt, Neisseria meningitidis Z2491
uuccgaagcgguu

SEQ ID NO: 3371638 - RNA, 16 nt, Neisseria meningitidis Z2491
uuccgaagcgguuuuu

SEQ ID NO: 3371639 - RNA, 19 nt, Neisseria meningitidis Z2491
uuccgacaaauuccuaaaa

SEQ ID NO: 3371640 - RNA, 19 nt, Neisseria meningitidis Z2491
uuccgauaaauuccuaaaa

SEQ ID NO: 3371641 - RNA, 14 nt, Neisseria meningitidis Z2491
uuccgauagauucc

SEQ ID NO: 3371642 - RNA, 19 nt, Neisseria meningitidis Z2491
uuccgcaccgacagaccua

SEQ ID NO: 3371643 - RNA, 21 nt, Neisseria meningitidis Z2491
uuccgcauaagcgcaaaugcg

SEQ ID NO: 3371644 - RNA, 13 nt, Neisseria meningitidis Z2491
uuccgcgcaggcg

SEQ ID NO: 3371645 - RNA, 21 nt, Neisseria meningitidis Z2491
uuccgcgccgauguuuuccug

SEQ ID NO: 3371646 - RNA, 14 nt, Neisseria meningitidis Z2491
uuccgguucgacga

SEQ ID NO: 3371647 - RNA, 22 nt, Neisseria meningitidis Z2491
uuccgucaggcacgaagcccuc

SEQ ID NO: 3371648 - RNA, 13 nt, Neisseria meningitidis Z2491
uuccgugggaaug

SEQ ID NO: 3371649 - RNA, 15 nt, Neisseria meningitidis Z2491
uuccguucggaacac

SEQ ID NO: 3371650 - RNA, 17 nt, Neisseria meningitidis Z2491
uuccuaauauugagcaa

SEQ ID NO: 3371651 - RNA, 21 nt, Neisseria meningitidis Z2491
uuccuaauauugagcaaaaag

SEQ ID NO: 3371652 - RNA, 21 nt, Neisseria meningitidis Z2491
uuccucacugccgccaauccu

SEQ ID NO: 3371653 - RNA, 15 nt, Neisseria meningitidis Z2491
uuccuccgcaaacac

SEQ ID NO: 3371654 - RNA, 21 nt, Neisseria meningitidis Z2491
uuccugauugaccgaaaaaua

SEQ ID NO: 3371655 - RNA, 23 nt, Neisseria meningitidis Z2491
uuccugauugaccgaaaaauaau

SEQ ID NO: 3371656 - RNA, 13 nt, Neisseria meningitidis Z2491
uuccugcagguag

SEQ ID NO: 3371657 - RNA, 14 nt, Neisseria meningitidis Z2491
uuccugccacauuu

SEQ ID NO: 3371658 - RNA, 15 nt, Neisseria meningitidis Z2491
uuccugcgccaaugc

SEQ ID NO: 3371659 - RNA, 13 nt, Neisseria meningitidis Z2491
uuccugcggcauu

SEQ ID NO: 3371660 - RNA, 19 nt, Neisseria meningitidis Z2491
uuccugcuguugaaaaugc

SEQ ID NO: 3371661 - RNA, 23 nt, Neisseria meningitidis Z2491
uuccuguucaaggcgacagccgc

SEQ ID NO: 3371662 - RNA, 12 nt, Neisseria meningitidis Z2491
uuccuucugaaa

SEQ ID NO: 3371663 - RNA, 15 nt, Neisseria meningitidis Z2491
uuccuuucugacaaa

SEQ ID NO: 3371664 - RNA, 13 nt, Neisseria meningitidis Z2491
uuccuuuuuaaag

SEQ ID NO: 3371665 - RNA, 14 nt, Neisseria meningitidis Z2491
uucgaccagcuccc

SEQ ID NO: 3371666 - RNA, 22 nt, Neisseria meningitidis Z2491
uucgacgcccccgcaggcagca

SEQ ID NO: 3371667 - RNA, 23 nt, Neisseria meningitidis Z2491
uucgacguuuuuacgcgugauuu

SEQ ID NO: 3371668 - RNA, 19 nt, Neisseria meningitidis Z2491
uucgaugugguagagaaaa

SEQ ID NO: 3371669 - RNA, 15 nt, Neisseria meningitidis Z2491
uucgauugccaaggu

SEQ ID NO: 3371670 - RNA, 15 nt, Neisseria meningitidis Z2491
uucgauuucuuugcc

SEQ ID NO: 3371671 - RNA, 18 nt, Neisseria meningitidis Z2491
uucgcaaccguugcagcc

SEQ ID NO: 3371672 - RNA, 19 nt, Neisseria meningitidis Z2491
uucgcaaugcugcggaugu

SEQ ID NO: 3371673 - RNA, 15 nt, Neisseria meningitidis Z2491
uucgcaguuggaaca

SEQ ID NO: 3371674 - RNA, 21 nt, Neisseria meningitidis Z2491
uucgcccaauacgaauaaucc

SEQ ID NO: 3371675 - RNA, 17 nt, Neisseria meningitidis Z2491
uucgccuuaaaaaacaa

SEQ ID NO: 3371676 - RNA, 13 nt, Neisseria meningitidis Z2491
uucgcgacgguau

SEQ ID NO: 3371677 - RNA, 19 nt, Neisseria meningitidis Z2491
uucgcgagaacgacgggau

SEQ ID NO: 3371678 - RNA, 16 nt, Neisseria meningitidis Z2491
uucgcgggaaugacgg

SEQ ID NO: 3371679 - RNA, 19 nt, Neisseria meningitidis Z2491
uucgcgggaaugacgggau

SEQ ID NO: 3371680 - RNA, 23 nt, Neisseria meningitidis Z2491
uucgcgguagguauuuugcgccg

SEQ ID NO: 3371681 - RNA, 21 nt, Neisseria meningitidis Z2491
uucgcgguuuuccgcuuuuuu

SEQ ID NO: 3371682 - RNA, 13 nt, Neisseria meningitidis Z2491
uucggaaaugcgu

SEQ ID NO: 3371683 - RNA, 17 nt, Neisseria meningitidis Z2491
uucggaacacaaaaaac

SEQ ID NO: 3371684 - RNA, 22 nt, Neisseria meningitidis Z2491
uucggaagggguuacgccccuc

SEQ ID NO: 3371685 - RNA, 23 nt, Neisseria meningitidis Z2491
uucggacggcauuaaaauuuggc

SEQ ID NO: 3371686 - RNA, 21 nt, Neisseria meningitidis Z2491
uucggaugccugauggcugau

SEQ ID NO: 3371687 - RNA, 17 nt, Neisseria meningitidis Z2491
uucggcaaaauccgcaa

SEQ ID NO: 3371688 - RNA, 13 nt, Neisseria meningitidis Z2491
uucggcaauuuga

SEQ ID NO: 3371689 - RNA, 22 nt, Neisseria meningitidis Z2491
uucggcgcguuuuucaccgccc

SEQ ID NO: 3371690 - RNA, 18 nt, Neisseria meningitidis Z2491
uucggcugucgggaggga

SEQ ID NO: 3371691 - RNA, 21 nt, Neisseria meningitidis Z2491
uucggcuucaacagacggcgu

SEQ ID NO: 3371692 - RNA, 15 nt, Neisseria meningitidis Z2491
uucggcuuggaaugc

SEQ ID NO: 3371693 - RNA, 16 nt, Neisseria meningitidis Z2491
uucgggcaacacgccc

SEQ ID NO: 3371694 - RNA, 21 nt, Neisseria meningitidis Z2491
uucggguaagcccuaauucgu

SEQ ID NO: 3371695 - RNA, 15 nt, Neisseria meningitidis Z2491
uucggucauuuccga

SEQ ID NO: 3371696 - RNA, 21 nt, Neisseria meningitidis Z2491
uucgguuucaacgacuuccag

SEQ ID NO: 3371697 - RNA, 12 nt, Neisseria meningitidis Z2491
uucgguuuucua

SEQ ID NO: 3371698 - RNA, 23 nt, Neisseria meningitidis Z2491
uucgucaugcaccugcauaauca

SEQ ID NO: 3371699 - RNA, 12 nt, Neisseria meningitidis Z2491
uucguccagcag

SEQ ID NO: 3371700 - RNA, 14 nt, Neisseria meningitidis Z2491
uucgucgccuuguc

SEQ ID NO: 3371701 - RNA, 18 nt, Neisseria meningitidis Z2491
uucgucggucagcgguuu

SEQ ID NO: 3371702 - RNA, 16 nt, Neisseria meningitidis Z2491
uucgucgucuuuggca

SEQ ID NO: 3371703 - RNA, 15 nt, Neisseria meningitidis Z2491
uucguguucgucuuu

SEQ ID NO: 3371704 - RNA, 15 nt, Neisseria meningitidis Z2491
uucguucugcauaua

SEQ ID NO: 3371705 - RNA, 15 nt, Neisseria meningitidis Z2491
uucguuuggggauuu

SEQ ID NO: 3371706 - RNA, 13 nt, Neisseria meningitidis Z2491
uucuaaaaauaca

SEQ ID NO: 3371707 - RNA, 18 nt, Neisseria meningitidis Z2491
uucuaaaauaugcagaga

SEQ ID NO: 3371708 - RNA, 23 nt, Neisseria meningitidis Z2491
uucuaaaauaugcagagaccuuu

SEQ ID NO: 3371709 - RNA, 21 nt, Neisseria meningitidis Z2491
uucuaaauagcugaaacucaa

SEQ ID NO: 3371710 - RNA, 17 nt, Neisseria meningitidis Z2491
uucuaacucuauuuccc

SEQ ID NO: 3371711 - RNA, 12 nt, Neisseria meningitidis Z2491
uucuacccaaau

SEQ ID NO: 3371712 - RNA, 15 nt, Neisseria meningitidis Z2491
uucuagauucccgcc

SEQ ID NO: 3371713 - RNA, 18 nt, Neisseria meningitidis Z2491
uucuagauucccgccugc

SEQ ID NO: 3371714 - RNA, 14 nt, Neisseria meningitidis Z2491
uucuagauuccugc

SEQ ID NO: 3371715 - RNA, 16 nt, Neisseria meningitidis Z2491
uucuagauuccugccu

SEQ ID NO: 3371716 - RNA, 17 nt, Neisseria meningitidis Z2491
uucuauaaagccuaaau

SEQ ID NO: 3371717 - RNA, 15 nt, Neisseria meningitidis Z2491
uucuauugccuuuau

SEQ ID NO: 3371718 - RNA, 12 nt, Neisseria meningitidis Z2491
uucuauuuuugu

SEQ ID NO: 3371719 - RNA, 22 nt, Neisseria meningitidis Z2491
uucucauccaauucgauggaua

SEQ ID NO: 3371720 - RNA, 22 nt, Neisseria meningitidis Z2491
uucuccgucgggauucagaugu

SEQ ID NO: 3371721 - RNA, 19 nt, Neisseria meningitidis Z2491
uucucgauauggcaggcau

SEQ ID NO: 3371722 - RNA, 20 nt, Neisseria meningitidis Z2491
uucucuaaggugcugaagca

SEQ ID NO: 3371723 - RNA, 23 nt, Neisseria meningitidis Z2491
uucucuaaggugcugaagcacca

SEQ ID NO: 3371724 - RNA, 14 nt, Neisseria meningitidis Z2491
uucucuuggucaaa

SEQ ID NO: 3371725 - RNA, 19 nt, Neisseria meningitidis Z2491
uucucuuggucaaaauguc

SEQ ID NO: 3371726 - RNA, 17 nt, Neisseria meningitidis Z2491
uucugaaaaauuuauga

SEQ ID NO: 3371727 - RNA, 15 nt, Neisseria meningitidis Z2491
uucugacagcauuuc

SEQ ID NO: 3371728 - RNA, 11 nt, Neisseria meningitidis Z2491
uucugauuuug

SEQ ID NO: 3371729 - RNA, 23 nt, Neisseria meningitidis Z2491
uucugcgcaggcgggaauacaaa

SEQ ID NO: 3371730 - RNA, 23 nt, Neisseria meningitidis Z2491
uucugcugcgaaguaccguuuuu

SEQ ID NO: 3371731 - RNA, 19 nt, Neisseria meningitidis Z2491
uucuguuucgguuuucuau

SEQ ID NO: 3371732 - RNA, 20 nt, Neisseria meningitidis Z2491
uucuguuucgguuuucuauu

SEQ ID NO: 3371733 - RNA, 11 nt, Neisseria meningitidis Z2491
uucuguuuggc

SEQ ID NO: 3371734 - RNA, 17 nt, Neisseria meningitidis Z2491
uucuguuuggcuuuuuc

SEQ ID NO: 3371735 - RNA, 19 nt, Neisseria meningitidis Z2491
uucuguuuggcuuuuuccu

SEQ ID NO: 3371736 - RNA, 17 nt, Neisseria meningitidis Z2491
uugcguucagacggcau

SEQ ID NO: 3371737 - RNA, 22 nt, Neisseria meningitidis Z2491
uugcguuucuagauucccacuu

SEQ ID NO: 3371738 - RNA, 19 nt, Neisseria meningitidis Z2491
uugcuagauauuuagcauu

SEQ ID NO: 3371739 - RNA, 19 nt, Neisseria meningitidis Z2491
uugcucccgauaaaugccg

SEQ ID NO: 3371740 - RNA, 16 nt, Neisseria meningitidis Z2491
uugcuccugacggcaa

SEQ ID NO: 3371741 - RNA, 18 nt, Neisseria meningitidis Z2491
uugcugcuguauuuuucc

SEQ ID NO: 3371742 - RNA, 13 nt, Neisseria meningitidis Z2491
uugcuguuguucu

SEQ ID NO: 3371743 - RNA, 15 nt, Neisseria meningitidis Z2491
uugcuguuuuccuga

SEQ ID NO: 3371744 - RNA, 16 nt, Neisseria meningitidis Z2491
uugcuuauuuguucaa

SEQ ID NO: 3371745 - RNA, 17 nt, Neisseria meningitidis Z2491
uuggaaaaguacaaaau

SEQ ID NO: 3371746 - RNA, 19 nt, Neisseria meningitidis Z2491
uuggaagccucccaauguu

SEQ ID NO: 3371747 - RNA, 12 nt, Neisseria meningitidis Z2491
uuggaauccagu

SEQ ID NO: 3371748 - RNA, 22 nt, Neisseria meningitidis Z2491
uuggacagcggcaauauucaaa

SEQ ID NO: 3371749 - RNA, 23 nt, Neisseria meningitidis Z2491
uuggacggcggauuucagugcug

SEQ ID NO: 3371750 - RNA, 15 nt, Neisseria meningitidis Z2491
uuggagauucuagau

SEQ ID NO: 3371751 - RNA, 16 nt, Neisseria meningitidis Z2491
uuggauuugucuucaa

SEQ ID NO: 3371752 - RNA, 22 nt, Neisseria meningitidis Z2491
uuggcaacaguguauucgacgc

SEQ ID NO: 3371753 - RNA, 15 nt, Neisseria meningitidis Z2491
uuggcaauuuucuuc

SEQ ID NO: 3371754 - RNA, 17 nt, Neisseria meningitidis Z2491
uuggcagcugaagcccc

SEQ ID NO: 3371755 - RNA, 20 nt, Neisseria meningitidis Z2491
uuggcauuuuuaucuuuuuu

SEQ ID NO: 3371756 - RNA, 19 nt, Neisseria meningitidis Z2491
uuggcgaggacgcgugcaa

SEQ ID NO: 3371757 - RNA, 12 nt, Neisseria meningitidis Z2491
uuggcgcauuuu

SEQ ID NO: 3371758 - RNA, 13 nt, Neisseria meningitidis Z2491
uuggcggcggcag

SEQ ID NO: 3371759 - RNA, 21 nt, Neisseria meningitidis Z2491
uuggcggcguguagcguggau

SEQ ID NO: 3371760 - RNA, 16 nt, Neisseria meningitidis Z2491
uuggcuuuuuucuguu

SEQ ID NO: 3371761 - RNA, 12 nt, Neisseria meningitidis Z2491
uugggaaaugcg

SEQ ID NO: 3371762 - RNA, 14 nt, Neisseria meningitidis Z2491
uugggauauuuucu

SEQ ID NO: 3371763 - RNA, 13 nt, Neisseria meningitidis Z2491
uugggcaacacca

SEQ ID NO: 3371764 - RNA, 22 nt, Neisseria meningitidis Z2491
uugggcgacggcaauauucaaa

SEQ ID NO: 3371765 - RNA, 18 nt, Neisseria meningitidis Z2491
uugggcgacggcgaggcu

SEQ ID NO: 3371766 - RNA, 13 nt, Neisseria meningitidis Z2491
uugggcguucaga

SEQ ID NO: 3371767 - RNA, 13 nt, Neisseria meningitidis Z2491
uugggcguucagc

SEQ ID NO: 3371768 - RNA, 19 nt, Neisseria meningitidis Z2491
uuggggaagcguuggacga

SEQ ID NO: 3371769 - RNA, 13 nt, Neisseria meningitidis Z2491
uuggguucuagau

SEQ ID NO: 3371770 - RNA, 18 nt, Neisseria meningitidis Z2491
uugguaacggaaucaccg

SEQ ID NO: 3371771 - RNA, 20 nt, Neisseria meningitidis Z2491
uugguacacgggguagguaa

SEQ ID NO: 3371772 - RNA, 14 nt, Neisseria meningitidis Z2491
uugguagagcgcaa

SEQ ID NO: 3371773 - RNA, 15 nt, Neisseria meningitidis Z2491
uuggucgcugccuuu

SEQ ID NO: 3371774 - RNA, 14 nt, Neisseria meningitidis Z2491
uuggugcuucagca

SEQ ID NO: 3371775 - RNA, 16 nt, Neisseria meningitidis Z2491
uugguuuccagauucc

SEQ ID NO: 3371776 - RNA, 13 nt, Neisseria meningitidis Z2491
uugguuuucaaaa

SEQ ID NO: 3371777 - RNA, 22 nt, Neisseria meningitidis Z2491
uugguuuucaaaacauccgcaa

SEQ ID NO: 3371778 - RNA, 17 nt, Neisseria meningitidis Z2491
uuguauuugaugcguuu

SEQ ID NO: 3371779 - RNA, 15 nt, Neisseria meningitidis Z2491
uuguauuuuuauuau

SEQ ID NO: 3371780 - RNA, 21 nt, Neisseria meningitidis Z2491
uugucaaacgggguugccugc

SEQ ID NO: 3371781 - RNA, 17 nt, Neisseria meningitidis Z2491
uuguccaugauuuuuug

SEQ ID NO: 3371782 - RNA, 19 nt, Neisseria meningitidis Z2491
uugucccacagagcgaaca

SEQ ID NO: 3371783 - RNA, 22 nt, Neisseria meningitidis Z2491
uuguccgguuccgguuguuuuu

SEQ ID NO: 3371784 - RNA, 17 nt, Neisseria meningitidis Z2491
uuguccugauuuaaauu

SEQ ID NO: 3371785 - RNA, 18 nt, Neisseria meningitidis Z2491
uuguccugauuuaaauuu

SEQ ID NO: 3371786 - RNA, 22 nt, Neisseria meningitidis Z2491
uugucgcuucggauaaauuuuu

SEQ ID NO: 3371787 - RNA, 19 nt, Neisseria meningitidis Z2491
uugucgguaaaaauggaaa

SEQ ID NO: 3371788 - RNA, 21 nt, Neisseria meningitidis Z2491
uugugcuguuucagacggcau

SEQ ID NO: 3371789 - RNA, 20 nt, Neisseria meningitidis Z2491
uugugcuucuucgagggcau

SEQ ID NO: 3371790 - RNA, 15 nt, Neisseria meningitidis Z2491
uugugggaauccaga

SEQ ID NO: 3371791 - RNA, 22 nt, Neisseria meningitidis Z2491
uuguguccgaccguuccgaaac

SEQ ID NO: 3371792 - RNA, 18 nt, Neisseria meningitidis Z2491
uuguuaaguauuucuauu

SEQ ID NO: 3371793 - RNA, 13 nt, Neisseria meningitidis Z2491
uuguuaauccacu

SEQ ID NO: 3371794 - RNA, 21 nt, Neisseria meningitidis Z2491
uuguuaauccacuauauuuuc

SEQ ID NO: 3371795 - RNA, 15 nt, Neisseria meningitidis Z2491
uuguuaauucacuau

SEQ ID NO: 3371796 - RNA, 18 nt, Neisseria meningitidis Z2491
uuguuaugaugcguucaa

SEQ ID NO: 3371797 - RNA, 18 nt, Neisseria meningitidis Z2491
uuguucuaaggucuagau

SEQ ID NO: 3371798 - RNA, 19 nt, Neisseria meningitidis Z2491
uuguucuaaggucuagauu

SEQ ID NO: 3371799 - RNA, 18 nt, Neisseria meningitidis Z2491
uuguugucgcuucggaua

SEQ ID NO: 3371800 - RNA, 17 nt, Neisseria meningitidis Z2491
uuguuguucaaauaaau

SEQ ID NO: 3371801 - RNA, 16 nt, Neisseria meningitidis Z2491
uuguuucagacggcau

SEQ ID NO: 3371802 - RNA, 22 nt, Neisseria meningitidis Z2491
uuguuucagacggcauuugacu

SEQ ID NO: 3371803 - RNA, 12 nt, Neisseria meningitidis Z2491
uuguuuggaaau

SEQ ID NO: 3371804 - RNA, 17 nt, Neisseria meningitidis Z2491
uuuaaaaauuccuguuu

SEQ ID NO: 3371805 - RNA, 23 nt, Neisseria meningitidis Z2491
uuuaaaaauuccuguuuuuauag

SEQ ID NO: 3371806 - RNA, 13 nt, Neisseria meningitidis Z2491
uuuaaaacagcau

SEQ ID NO: 3371807 - RNA, 13 nt, Neisseria meningitidis Z2491
uuuaaacaacaaa

SEQ ID NO: 3371808 - RNA, 22 nt, Neisseria meningitidis Z2491
uuuaaacacgggguuuaucuga

SEQ ID NO: 3371809 - RNA, 11 nt, Neisseria meningitidis Z2491
uuuaaauaaau

SEQ ID NO: 3371810 - RNA, 17 nt, Neisseria meningitidis Z2491
uuuaaauuuaauccacu

SEQ ID NO: 3371811 - RNA, 15 nt, Neisseria meningitidis Z2491
uuuaaauuuaauuca

SEQ ID NO: 3371812 - RNA, 16 nt, Neisseria meningitidis Z2491
uuuaagacguggugcu

SEQ ID NO: 3371813 - RNA, 18 nt, Neisseria meningitidis Z2491
uuuaaucaucguauuuuu

SEQ ID NO: 3371814 - RNA, 17 nt, Neisseria meningitidis Z2491
uuuaauucggcaauuug

SEQ ID NO: 3371815 - RNA, 16 nt, Neisseria meningitidis Z2491
uuuacccgauaaguuu

SEQ ID NO: 3371816 - RNA, 14 nt, Neisseria meningitidis Z2491
uuuacccucucccc

SEQ ID NO: 3371817 - RNA, 19 nt, Neisseria meningitidis Z2491
uuuacgauaugcaaaugca

SEQ ID NO: 3371818 - RNA, 14 nt, Neisseria meningitidis Z2491
uuuacguuuauuua

SEQ ID NO: 3371819 - RNA, 13 nt, Neisseria meningitidis Z2491
uuuagaauaaauu

SEQ ID NO: 3371820 - RNA, 19 nt, Neisseria meningitidis Z2491
uuuaggcaauugaaaaauu

SEQ ID NO: 3371821 - RNA, 17 nt, Neisseria meningitidis Z2491
uuuauaaacaaaaaaca

SEQ ID NO: 3371822 - RNA, 16 nt, Neisseria meningitidis Z2491
uuuauacccucucaaa

SEQ ID NO: 3371823 - RNA, 19 nt, Neisseria meningitidis Z2491
uuuauaguggauuaacaaa

SEQ ID NO: 3371824 - RNA, 14 nt, Neisseria meningitidis Z2491
uuuauauucugauu

SEQ ID NO: 3371825 - RNA, 22 nt, Neisseria meningitidis Z2491
uuuaucagggcugcaaaauuua

SEQ ID NO: 3371826 - RNA, 18 nt, Neisseria meningitidis Z2491
uuuauccgaaacaacaaa

SEQ ID NO: 3371827 - RNA, 20 nt, Neisseria meningitidis Z2491
uuuaucgcuguaauaaacag

SEQ ID NO: 3371828 - RNA, 22 nt, Neisseria meningitidis Z2491
uuuaucgggaaugacugaaacu

SEQ ID NO: 3371829 - RNA, 13 nt, Neisseria meningitidis Z2491
uuuaugccuguuc

SEQ ID NO: 3371830 - RNA, 17 nt, Neisseria meningitidis Z2491
uuuaugcgucaaauuuc

SEQ ID NO: 3371831 - RNA, 16 nt, Neisseria meningitidis Z2491
uuuauuggucaacucu

SEQ ID NO: 3371832 - RNA, 16 nt, Neisseria meningitidis Z2491
uuuauuuacguuuauu

SEQ ID NO: 3371833 - RNA, 22 nt, Neisseria meningitidis Z2491
uuuauuuaugaaccgucauucu

SEQ ID NO: 3371834 - RNA, 13 nt, Neisseria meningitidis Z2491
uuuauuuccugaa

SEQ ID NO: 3371835 - RNA, 13 nt, Neisseria meningitidis Z2491
uuuauuugagcaa

SEQ ID NO: 3371836 - RNA, 22 nt, Neisseria meningitidis Z2491
uuuauuuugugcaggcauuauu

SEQ ID NO: 3371837 - RNA, 15 nt, Neisseria meningitidis Z2491
uuuauuuuuucucaa

SEQ ID NO: 3371838 - RNA, 18 nt, Neisseria meningitidis Z2491
uuugaguuucuagauucc

SEQ ID NO: 3371839 - RNA, 20 nt, Neisseria meningitidis Z2491
uuugauauacaaaaugccgu

SEQ ID NO: 3371840 - RNA, 23 nt, Neisseria meningitidis Z2491
uuugauauggcguugacaaacau

SEQ ID NO: 3371841 - RNA, 13 nt, Neisseria meningitidis Z2491
uuugauuucuauu

SEQ ID NO: 3371842 - RNA, 15 nt, Neisseria meningitidis Z2491
uuugcaagaauggca

SEQ ID NO: 3371843 - RNA, 24 nt, Neisseria meningitidis Z2491
uuugcaagaauggcaaaauuucag

SEQ ID NO: 3371844 - RNA, 14 nt, Neisseria meningitidis Z2491
uuugcaauaacaua

SEQ ID NO: 3371845 - RNA, 17 nt, Neisseria meningitidis Z2491
uuugcaauaacauaggu

SEQ ID NO: 3371846 - RNA, 13 nt, Neisseria meningitidis Z2491
uuugcagauaaau

SEQ ID NO: 3371847 - RNA, 16 nt, Neisseria meningitidis Z2491
uuugccgccacaaguc

SEQ ID NO: 3371848 - RNA, 20 nt, Neisseria meningitidis Z2491
uuugccgcguaugcguucaa

SEQ ID NO: 3371849 - RNA, 16 nt, Neisseria meningitidis Z2491
uuugccugauccaaac

SEQ ID NO: 3371850 - RNA, 18 nt, Neisseria meningitidis Z2491
uuugccuguucggucaua

SEQ ID NO: 3371851 - RNA, 16 nt, Neisseria meningitidis Z2491
uuugcgagaaugacgg

SEQ ID NO: 3371852 - RNA, 20 nt, Neisseria meningitidis Z2491
uuugcgauaggauuugccau

SEQ ID NO: 3371853 - RNA, 18 nt, Neisseria meningitidis Z2491
uuugcgccacggcauaac

SEQ ID NO: 3371854 - RNA, 23 nt, Neisseria meningitidis Z2491
uuugcgccagcggcaccaauucu

SEQ ID NO: 3371855 - RNA, 23 nt, Neisseria meningitidis Z2491
uuugcgccgcccgaaaaugucgg

SEQ ID NO: 3371856 - RNA, 24 nt, Neisseria meningitidis Z2491
uuugcgccgcccgaaaaugucggu

SEQ ID NO: 3371857 - RNA, 18 nt, Neisseria meningitidis Z2491
uuugcgccucgccuuuca

SEQ ID NO: 3371858 - RNA, 19 nt, Neisseria meningitidis Z2491
uuugcgcgccuuuuuguuu

SEQ ID NO: 3371859 - RNA, 16 nt, Neisseria meningitidis Z2491
uuugcgcuccauugcc

SEQ ID NO: 3371860 - RNA, 12 nt, Neisseria meningitidis Z2491
uuugcgcuguug

SEQ ID NO: 3371861 - RNA, 16 nt, Neisseria meningitidis Z2491
uuugcggcuugccgcc

SEQ ID NO: 3371862 - RNA, 16 nt, Neisseria meningitidis Z2491
uuugcgggaaugacgg

SEQ ID NO: 3371863 - RNA, 17 nt, Neisseria meningitidis Z2491
uuugcugacguaaaaaa

SEQ ID NO: 3371864 - RNA, 21 nt, Neisseria meningitidis Z2491
uuugcugcuguauuuuuccaa

SEQ ID NO: 3371865 - RNA, 17 nt, Neisseria meningitidis Z2491
uuugcuggaagcauuga

SEQ ID NO: 3371866 - RNA, 14 nt, Neisseria meningitidis Z2491
uuuggaaaugucuu

SEQ ID NO: 3371867 - RNA, 12 nt, Neisseria meningitidis Z2491
uuuggaacaaaa

SEQ ID NO: 3371868 - RNA, 14 nt, Neisseria meningitidis Z2491
uuuggaacaaaaaa

SEQ ID NO: 3371869 - RNA, 15 nt, Neisseria meningitidis Z2491
uuuggagcaguaaaa

SEQ ID NO: 3371870 - RNA, 20 nt, Neisseria meningitidis Z2491
uuuggagcaguaaaauuuau

SEQ ID NO: 3371871 - RNA, 16 nt, Neisseria meningitidis Z2491
uuuggcgcauuuuuuc

SEQ ID NO: 3371872 - RNA, 21 nt, Neisseria meningitidis Z2491
uuuggcgcauuuuuucugcca

SEQ ID NO: 3371873 - RNA, 17 nt, Neisseria meningitidis Z2491
uuuggcuguuuucuguu

SEQ ID NO: 3371874 - RNA, 21 nt, Neisseria meningitidis Z2491
uuuggcuuacccgcuuuuuuc

SEQ ID NO: 3371875 - RNA, 21 nt, Neisseria meningitidis Z2491
uuuggcuucgguuguauuuuu

SEQ ID NO: 3371876 - RNA, 17 nt, Neisseria meningitidis Z2491
uuugggauauuuucuuc

SEQ ID NO: 3371877 - RNA, 13 nt, Neisseria meningitidis Z2491
uuugggcguucag

SEQ ID NO: 3371878 - RNA, 18 nt, Neisseria meningitidis Z2491
uuugggugguuuucugaa

SEQ ID NO: 3371879 - RNA, 19 nt, Neisseria meningitidis Z2491
uuugguaaaaaaaugccgu

SEQ ID NO: 3371880 - RNA, 18 nt, Neisseria meningitidis Z2491
uuugguaaugcaaaaagu

SEQ ID NO: 3371881 - RNA, 14 nt, Neisseria meningitidis Z2491
uuugguauauuuuu

SEQ ID NO: 3371882 - RNA, 17 nt, Neisseria meningitidis Z2491
uuugguuuccagauucc

SEQ ID NO: 3371883 - RNA, 17 nt, Neisseria meningitidis Z2491
uuugguuuucuauuuuu

SEQ ID NO: 3371884 - RNA, 14 nt, Neisseria meningitidis Z2491
uuugguuuucuguu

SEQ ID NO: 3371885 - RNA, 14 nt, Neisseria meningitidis Z2491
uuuguauaguggau

SEQ ID NO: 3371886 - RNA, 19 nt, Neisseria meningitidis Z2491
uuuguccgacacaaugaaa

SEQ ID NO: 3371887 - RNA, 14 nt, Neisseria meningitidis Z2491
uuugucggcuuuug

SEQ ID NO: 3371888 - RNA, 16 nt, Neisseria meningitidis Z2491
uuugugaauccacuau

SEQ ID NO: 3371889 - RNA, 19 nt, Neisseria meningitidis Z2491
uuugugcacucacuuugcu

SEQ ID NO: 3371890 - RNA, 20 nt, Neisseria meningitidis Z2491
uuugugcaggcauuauuuuu

SEQ ID NO: 3371891 - RNA, 15 nt, Neisseria meningitidis Z2491
uuuguugaauuuuau

SEQ ID NO: 3371892 - RNA, 16 nt, Neisseria meningitidis Z2491
uuuuaaaaccguuccu

SEQ ID NO: 3371893 - RNA, 20 nt, Neisseria meningitidis Z2491
uuuuaaaaggggcuguacua

SEQ ID NO: 3371894 - RNA, 21 nt, Neisseria meningitidis Z2491
uuuuaaacaacaaauuuuuga

SEQ ID NO: 3371895 - RNA, 18 nt, Neisseria meningitidis Z2491
uuuuaaccauacuucauu

SEQ ID NO: 3371896 - RNA, 20 nt, Neisseria meningitidis Z2491
uuuuaauuucuucuaucauu

SEQ ID NO: 3371897 - RNA, 16 nt, Neisseria meningitidis Z2491
uuuuacacaauuccca

SEQ ID NO: 3371898 - RNA, 14 nt, Neisseria meningitidis Z2491
uuuuaccgagccua

SEQ ID NO: 3371899 - RNA, 19 nt, Neisseria meningitidis Z2491
uuuuaccgagccuaaugcu

SEQ ID NO: 3371900 - RNA, 19 nt, Neisseria meningitidis Z2491
uuuuaccguucaauuucaa

SEQ ID NO: 3371901 - RNA, 20 nt, Neisseria meningitidis Z2491
uuuuaccguucaauuucaac

SEQ ID NO: 3371902 - RNA, 16 nt, Neisseria meningitidis Z2491
uuuuacguucuagauu

SEQ ID NO: 3371903 - RNA, 21 nt, Neisseria meningitidis Z2491
uuuuaggcaauugaaaaauuu

SEQ ID NO: 3371904 - RNA, 16 nt, Neisseria meningitidis Z2491
uuuuagggaaacguuu

SEQ ID NO: 3371905 - RNA, 22 nt, Neisseria meningitidis Z2491
uuuuauaguggauuaaauuuaa

SEQ ID NO: 3371906 - RNA, 19 nt, Neisseria meningitidis Z2491
uuuuauccgcacacgaacu

SEQ ID NO: 3371907 - RNA, 14 nt, Neisseria meningitidis Z2491
uuuuaucuuuuaau

SEQ ID NO: 3371908 - RNA, 15 nt, Neisseria meningitidis Z2491
uuuuaucuuuuaauu

SEQ ID NO: 3371909 - RNA, 17 nt, Neisseria meningitidis Z2491
uuuuaucuuuuuugaau

SEQ ID NO: 3371910 - RNA, 13 nt, Neisseria meningitidis Z2491
uuuuaugccuguu

SEQ ID NO: 3371911 - RNA, 13 nt, Neisseria meningitidis Z2491
uuuuaugcucaau

SEQ ID NO: 3371912 - RNA, 16 nt, Neisseria meningitidis Z2491
uuuuauuuucaaacau

SEQ ID NO: 3371913 - RNA, 12 nt, Neisseria meningitidis Z2491
uuuucaaaaugc

SEQ ID NO: 3371914 - RNA, 13 nt, Neisseria meningitidis Z2491
uuuucaaaaugca

SEQ ID NO: 3371915 - RNA, 15 nt, Neisseria meningitidis Z2491
uuuucaaaaugcaaa

SEQ ID NO: 3371916 - RNA, 16 nt, Neisseria meningitidis Z2491
uuuucaaaaugcaaaa

SEQ ID NO: 3371917 - RNA, 20 nt, Neisseria meningitidis Z2491
uuuucaaacauuacugaaau

SEQ ID NO: 3371918 - RNA, 15 nt, Neisseria meningitidis Z2491
uuuucacaaaaacag

SEQ ID NO: 3371919 - RNA, 22 nt, Neisseria meningitidis Z2491
uuuucacaaaaacagaaaacca

SEQ ID NO: 3371920 - RNA, 17 nt, Neisseria meningitidis Z2491
uuuucaugguguuuccu

SEQ ID NO: 3371921 - RNA, 19 nt, Neisseria meningitidis Z2491
uuuucaugguguuuccuaa

SEQ ID NO: 3371922 - RNA, 13 nt, Neisseria meningitidis Z2491
uuuucauuucuag

SEQ ID NO: 3371923 - RNA, 12 nt, Neisseria meningitidis Z2491
uuuucauuuuug

SEQ ID NO: 3371924 - RNA, 13 nt, Neisseria meningitidis Z2491
uuuucauuuuugg

SEQ ID NO: 3371925 - RNA, 15 nt, Neisseria meningitidis Z2491
uuuucauuuuuggcu

SEQ ID NO: 3371926 - RNA, 14 nt, Neisseria meningitidis Z2491
uuuuccaguuugaa

SEQ ID NO: 3371927 - RNA, 16 nt, Neisseria meningitidis Z2491
uuuuccaguuugaaau

SEQ ID NO: 3371928 - RNA, 16 nt, Neisseria meningitidis Z2491
uuuuccauaaaauaca

SEQ ID NO: 3371929 - RNA, 19 nt, Neisseria meningitidis Z2491
uuuuccgguaaauuccuaa

SEQ ID NO: 3371930 - RNA, 15 nt, Neisseria meningitidis Z2491
uuuuccguugccugc

SEQ ID NO: 3371931 - RNA, 21 nt, Neisseria meningitidis Z2491
uuuuccuacuuuuugcucaau

SEQ ID NO: 3371932 - RNA, 17 nt, Neisseria meningitidis Z2491
uuuuccugacaaauucc

SEQ ID NO: 3371933 - RNA, 18 nt, Neisseria meningitidis Z2491
uuuuccugacaaauuccc

SEQ ID NO: 3371934 - RNA, 18 nt, Neisseria meningitidis Z2491
uuuuccuuucugacaaaa

SEQ ID NO: 3371935 - RNA, 23 nt, Neisseria meningitidis Z2491
uuuucgcaagacgcguuuugccu

SEQ ID NO: 3371936 - RNA, 19 nt, Neisseria meningitidis Z2491
uuuucggcggcguguuuga

SEQ ID NO: 3371937 - RNA, 16 nt, Neisseria meningitidis Z2491
uuuucuaaaauaugca

SEQ ID NO: 3371938 - RNA, 23 nt, Neisseria meningitidis Z2491
uuuucugaauugcuugagauggu

SEQ ID NO: 3371939 - RNA, 22 nt, Neisseria meningitidis Z2491
cauuuucaaaaugcaaaacuuu

SEQ ID NO: 3371940 - RNA, 21 nt, Neisseria meningitidis Z2491
cauuuugauuguacggcagcc

SEQ ID NO: 3371941 - RNA, 16 nt, Neisseria meningitidis Z2491
cauuuuguuuuuaaga

SEQ ID NO: 3371942 - RNA, 16 nt, Neisseria meningitidis Z2491
cauuuuuaucuuuuuu

SEQ ID NO: 3371943 - RNA, 13 nt, Neisseria meningitidis Z2491
cauuuuuggcuug

SEQ ID NO: 3371944 - RNA, 16 nt, Neisseria meningitidis Z2491
cauuuuuggcuugaca

SEQ ID NO: 3371945 - RNA, 15 nt, Neisseria meningitidis Z2491
cauuuuuuuaccaaa

SEQ ID NO: 3371946 - RNA, 17 nt, Neisseria meningitidis Z2491
cauuuuuuucggguuca

SEQ ID NO: 3371947 - RNA, 17 nt, Neisseria meningitidis Z2491
ccaaaaaaucugauaag

SEQ ID NO: 3371948 - RNA, 14 nt, Neisseria meningitidis Z2491
ccaaaaaauuuuca

SEQ ID NO: 3371949 - RNA, 16 nt, Neisseria meningitidis Z2491
ccaaaaacagaaaccu

SEQ ID NO: 3371950 - RNA, 18 nt, Neisseria meningitidis Z2491
ccaaaaacagaaaccuaa

SEQ ID NO: 3371951 - RNA, 17 nt, Neisseria meningitidis Z2491
ccaaaacagaaaccuaa

SEQ ID NO: 3371952 - RNA, 18 nt, Neisseria meningitidis Z2491
ccaaaacucaaucaaauc

SEQ ID NO: 3371953 - RNA, 13 nt, Neisseria meningitidis Z2491
ccaaaaucagaaa

SEQ ID NO: 3371954 - RNA, 16 nt, Neisseria meningitidis Z2491
ccaaaaucagaaaccu

SEQ ID NO: 3371955 - RNA, 13 nt, Neisseria meningitidis Z2491
ccaaacacagguu

SEQ ID NO: 3371956 - RNA, 15 nt, Neisseria meningitidis Z2491
ccaaacagaacgcaa

SEQ ID NO: 3371957 - RNA, 19 nt, Neisseria meningitidis Z2491
ccaaacagcgcggcggcgu

SEQ ID NO: 3371958 - RNA, 19 nt, Neisseria meningitidis Z2491
ccaaacaucgcucaaauuc

SEQ ID NO: 3371959 - RNA, 14 nt, Neisseria meningitidis Z2491
ccaaacccgcccgc

SEQ ID NO: 3371960 - RNA, 23 nt, Neisseria meningitidis Z2491
ccaaacccucggcauucccgcca

SEQ ID NO: 3371961 - RNA, 17 nt, Neisseria meningitidis Z2491
ccaaaccgccauucccg

SEQ ID NO: 3371962 - RNA, 17 nt, Neisseria meningitidis Z2491
ccaaaccgucauucccg

SEQ ID NO: 3371963 - RNA, 20 nt, Neisseria meningitidis Z2491
ccaaacguuuuuccaaaccu

SEQ ID NO: 3371964 - RNA, 14 nt, Neisseria meningitidis Z2491
ccaaacuuccaaau

SEQ ID NO: 3371965 - RNA, 15 nt, Neisseria meningitidis Z2491
ccaaagagaaagaac

SEQ ID NO: 3371966 - RNA, 23 nt, Neisseria meningitidis Z2491
ccaaagagaaagaacccaaaccg

SEQ ID NO: 3371967 - RNA, 21 nt, Neisseria meningitidis Z2491
ccaaaggcagugccgccaaag

SEQ ID NO: 3371968 - RNA, 17 nt, Neisseria meningitidis Z2491
ccaaaggccuggauucc

SEQ ID NO: 3371969 - RNA, 18 nt, Neisseria meningitidis Z2491
ccaaaggccuggauuccc

SEQ ID NO: 3371970 - RNA, 17 nt, Neisseria meningitidis Z2491
ccaaaggucuggauucc

SEQ ID NO: 3371971 - RNA, 18 nt, Neisseria meningitidis Z2491
ccaaaggucuggauuccc

SEQ ID NO: 3371972 - RNA, 19 nt, Neisseria meningitidis Z2491
ccaaaggucuggauuccca

SEQ ID NO: 3371973 - RNA, 15 nt, Neisseria meningitidis Z2491
ccaaagugccaaaug

SEQ ID NO: 3371974 - RNA, 13 nt, Neisseria meningitidis Z2491
ccaaauaaacaag

SEQ ID NO: 3371975 - RNA, 19 nt, Neisseria meningitidis Z2491
ccaaauaaagucugauucu

SEQ ID NO: 3371976 - RNA, 19 nt, Neisseria meningitidis Z2491
ccaaauaccgccuaauucu

SEQ ID NO: 3371977 - RNA, 12 nt, Neisseria meningitidis Z2491
ccaaauauaaaa

SEQ ID NO: 3371978 - RNA, 16 nt, Neisseria meningitidis Z2491
ccaaauauuuccugca

SEQ ID NO: 3371979 - RNA, 12 nt, Neisseria meningitidis Z2491
ccaaauccgcca

SEQ ID NO: 3371980 - RNA, 17 nt, Neisseria meningitidis Z2491
ccaaaucggcaaugcgc

SEQ ID NO: 3371981 - RNA, 17 nt, Neisseria meningitidis Z2491
ccaaaucggcuuucaga

SEQ ID NO: 3371982 - RNA, 22 nt, Neisseria meningitidis Z2491
ccaaaucggcuuucagacggca

SEQ ID NO: 3371983 - RNA, 20 nt, Neisseria meningitidis Z2491
ccaaaucuugcaaaccccuc

SEQ ID NO: 3371984 - RNA, 23 nt, Neisseria meningitidis Z2491
ccaacacggcaaaaauuuauccg

SEQ ID NO: 3371985 - RNA, 21 nt, Neisseria meningitidis Z2491
ccaaccaagaagcggcggcau

SEQ ID NO: 3371986 - RNA, 15 nt, Neisseria meningitidis Z2491
ccaacccuccgccgc

SEQ ID NO: 3371987 - RNA, 22 nt, Neisseria meningitidis Z2491
ccaacgccgccgacauccccca

SEQ ID NO: 3371988 - RNA, 14 nt, Neisseria meningitidis Z2491
ccaacgccguacug

SEQ ID NO: 3371989 - RNA, 21 nt, Neisseria meningitidis Z2491
ccaacgcgaaggcgaccgccu

SEQ ID NO: 3371990 - RNA, 14 nt, Neisseria meningitidis Z2491
ccaacgcuguacug

SEQ ID NO: 3371991 - RNA, 23 nt, Neisseria meningitidis Z2491
ccaacucggggucaagcgcggaa

SEQ ID NO: 3371992 - RNA, 16 nt, Neisseria meningitidis Z2491
ccaacuggucaaucgu

SEQ ID NO: 3371993 - RNA, 16 nt, Neisseria meningitidis Z2491
ccaagaagcggcggca

SEQ ID NO: 3371994 - RNA, 20 nt, Neisseria meningitidis Z2491
ccaagccgaauugcagcgcg

SEQ ID NO: 3371995 - RNA, 12 nt, Neisseria meningitidis Z2491
ccaaggcagcaa

SEQ ID NO: 3371996 - RNA, 19 nt, Neisseria meningitidis Z2491
ccaaggcaguaaugccgcc

SEQ ID NO: 3371997 - RNA, 23 nt, Neisseria meningitidis Z2491
ccaagggcaggguguuguagccu

SEQ ID NO: 3371998 - RNA, 15 nt, Neisseria meningitidis Z2491
ccaagguugaggucg

SEQ ID NO: 3371999 - RNA, 23 nt, Neisseria meningitidis Z2491
ccaauaccgccuuguucggaauc

SEQ ID NO: 3372000 - RNA, 14 nt, Neisseria meningitidis Z2491
ccaauacggcgaga

SEQ ID NO: 3372001 - RNA, 17 nt, Neisseria meningitidis Z2491
ccaauacggcgguauug

SEQ ID NO: 3372002 - RNA, 20 nt, Neisseria meningitidis Z2491
ccaaugacugcgggcuuugu

SEQ ID NO: 3372003 - RNA, 13 nt, Neisseria meningitidis Z2491
ccaaugccgucug

SEQ ID NO: 3372004 - RNA, 15 nt, Neisseria meningitidis Z2491
ccaaugcuucaacca

SEQ ID NO: 3372005 - RNA, 23 nt, Neisseria meningitidis Z2491
ccaaugcuugggcacguuugagu

SEQ ID NO: 3372006 - RNA, 14 nt, Neisseria meningitidis Z2491
ccacaaaaaacaga

SEQ ID NO: 3372007 - RNA, 14 nt, Neisseria meningitidis Z2491
ccacaaaaaacagc

SEQ ID NO: 3372008 - RNA, 14 nt, Neisseria meningitidis Z2491
ccacaaauccgccu

SEQ ID NO: 3372009 - RNA, 13 nt, Neisseria meningitidis Z2491
ccacaacauuccg

SEQ ID NO: 3372010 - RNA, 21 nt, Neisseria meningitidis Z2491
ccacaagucuucggcaagaug

SEQ ID NO: 3372011 - RNA, 16 nt, Neisseria meningitidis Z2491
ccacaauauccgacca

SEQ ID NO: 3372012 - RNA, 19 nt, Neisseria meningitidis Z2491
ccacaccguucagcccgaa

SEQ ID NO: 3372013 - RNA, 14 nt, Neisseria meningitidis Z2491
ccacaguuuuucca

SEQ ID NO: 3372014 - RNA, 17 nt, Neisseria meningitidis Z2491
ccacaguuuuuccaguu

SEQ ID NO: 3372015 - RNA, 13 nt, Neisseria meningitidis Z2491
ccacauaauucaa

SEQ ID NO: 3372016 - RNA, 22 nt, Neisseria meningitidis Z2491
ccacauugucggauuuguccaa

SEQ ID NO: 3372017 - RNA, 20 nt, Neisseria meningitidis Z2491
ccacauuuggaaauguuuga

SEQ ID NO: 3372018 - RNA, 11 nt, Neisseria meningitidis Z2491
ccaccaacugg

SEQ ID NO: 3372019 - RNA, 19 nt, Neisseria meningitidis Z2491
ccaccauuguuuccgcuuc

SEQ ID NO: 3372020 - RNA, 17 nt, Neisseria meningitidis Z2491
ccaccgccaucaggaau

SEQ ID NO: 3372021 - RNA, 13 nt, Neisseria meningitidis Z2491
ccaccgcgcgcca

SEQ ID NO: 3372022 - RNA, 22 nt, Neisseria meningitidis Z2491
ccaccgugcgcugucaaacccu

SEQ ID NO: 3372023 - RNA, 16 nt, Neisseria meningitidis Z2491
ccaccugaacggcaca

SEQ ID NO: 3372024 - RNA, 23 nt, Neisseria meningitidis Z2491
ccaccugaacggcacaaacgcca

SEQ ID NO: 3372025 - RNA, 21 nt, Neisseria meningitidis Z2491
ccacgccaaaaaugcggccgc

SEQ ID NO: 3372026 - RNA, 14 nt, Neisseria meningitidis Z2491
ccacgccaaaccga

SEQ ID NO: 3372027 - RNA, 20 nt, Neisseria meningitidis Z2491
ccacgccaacguaccgucca

SEQ ID NO: 3372028 - RNA, 18 nt, Neisseria meningitidis Z2491
ccacgccgacugccgccg

SEQ ID NO: 3372029 - RNA, 20 nt, Neisseria meningitidis Z2491
ccacgcucaaacacccccga

SEQ ID NO: 3372030 - RNA, 12 nt, Neisseria meningitidis Z2491
ccacggaagugg

SEQ ID NO: 3372031 - RNA, 23 nt, Neisseria meningitidis Z2491
ccacgucauucccacgaaagugg

SEQ ID NO: 3372032 - RNA, 14 nt, Neisseria meningitidis Z2491
ccacguucuagauu

SEQ ID NO: 3372033 - RNA, 18 nt, Neisseria meningitidis Z2491
ccacguucuagauucccg

SEQ ID NO: 3372034 - RNA, 13 nt, Neisseria meningitidis Z2491
ccacuauaaaauu

SEQ ID NO: 3372035 - RNA, 15 nt, Pseudomonas aeruginosa PA01
aaaaaccaugcgguu

SEQ ID NO: 3372036 - RNA, 16 nt, Pseudomonas aeruginosa PA01
aaaaacccaugcgguu

SEQ ID NO: 3372037 - RNA, 17 nt, Pseudomonas aeruginosa PA01
aaaaacccggcccaggc

SEQ ID NO: 3372038 - RNA, 17 nt, Pseudomonas aeruginosa PA01
aaaaauacuccgcgacg

SEQ ID NO: 3372039 - RNA, 18 nt, Pseudomonas aeruginosa PA01
aaaaccgguuucguggau

SEQ ID NO: 3372040 - RNA, 18 nt, Pseudomonas aeruginosa PA01
aaaacgccacacauccag

SEQ ID NO: 3372041 - RNA, 18 nt, Pseudomonas aeruginosa PA01
aaaacggcaggcaaaaaa

SEQ ID NO: 3372042 - RNA, 18 nt, Pseudomonas aeruginosa PA01
aaaacggggcuccccugg

SEQ ID NO: 3372043 - RNA, 14 nt, Pseudomonas aeruginosa PA01
aaaagaagaaaaac

SEQ ID NO: 3372044 - RNA, 21 nt, Pseudomonas aeruginosa PA01
aaaagcccagguggcaggccu

SEQ ID NO: 3372045 - RNA, 12 nt, Pseudomonas aeruginosa PA01
aaaagcccgcca

SEQ ID NO: 3372046 - RNA, 22 nt, Pseudomonas aeruginosa PA01
aaaaggauuuccgcggccggca

SEQ ID NO: 3372047 - RNA, 13 nt, Pseudomonas aeruginosa PA01
aaaaggggaugcc

SEQ ID NO: 3372048 - RNA, 23 nt, Pseudomonas aeruginosa PA01
aaaagugcccccggcaacacccu

SEQ ID NO: 3372049 - RNA, 14 nt, Pseudomonas aeruginosa PA01
aaaaucaaggauuu

SEQ ID NO: 3372050 - RNA, 19 nt, Pseudomonas aeruginosa PA01
aaaaucaguacucuggcca

SEQ ID NO: 3372051 - RNA, 13 nt, Pseudomonas aeruginosa PA01
aaaaucauccaca

SEQ ID NO: 3372052 - RNA, 20 nt, Pseudomonas aeruginosa PA01
aaacaacgaaguguuacagc

SEQ ID NO: 3372053 - RNA, 12 nt, Pseudomonas aeruginosa PA01
aaacagcuccgg

SEQ ID NO: 3372054 - RNA, 22 nt, Pseudomonas aeruginosa PA01
aaacccgaauagaucugcacca

SEQ ID NO: 3372055 - RNA, 21 nt, Pseudomonas aeruginosa PA01
aaacccgugguccgccagcag

SEQ ID NO: 3372056 - RNA, 23 nt, Pseudomonas aeruginosa PA01
aaacccgugguccgccagcaggc

SEQ ID NO: 3372057 - RNA, 13 nt, Pseudomonas aeruginosa PA01
aaaccgagcacgu

SEQ ID NO: 3372058 - RNA, 15 nt, Pseudomonas aeruginosa PA01
aaaccgaucagcacc

SEQ ID NO: 3372059 - RNA, 17 nt, Pseudomonas aeruginosa PA01
aaaccgaucagcaccgc

SEQ ID NO: 3372060 - RNA, 19 nt, Pseudomonas aeruginosa PA01
aaaccgaucagcaccgcca

SEQ ID NO: 3372061 - RNA, 11 nt, Pseudomonas aeruginosa PA01
aaaccgcggcc

SEQ ID NO: 3372062 - RNA, 15 nt, Pseudomonas aeruginosa PA01
aaaccggccagcgcg

SEQ ID NO: 3372063 - RNA, 22 nt, Pseudomonas aeruginosa PA01
aaaccggcgaugcucagcgccg

SEQ ID NO: 3372064 - RNA, 17 nt, Pseudomonas aeruginosa PA01
aaaccgggaugaagauc

SEQ ID NO: 3372065 - RNA, 23 nt, Pseudomonas aeruginosa PA01
aaaccgguuucguggaugcugau

SEQ ID NO: 3372066 - RNA, 20 nt, Pseudomonas aeruginosa PA01
aaaccuucgguggcgaccag

SEQ ID NO: 3372067 - RNA, 18 nt, Pseudomonas aeruginosa PA01
aaacgccacucgcgacgg

SEQ ID NO: 3372068 - RNA, 18 nt, Pseudomonas aeruginosa PA01
aaacgcccaucuucaggc

SEQ ID NO: 3372069 - RNA, 17 nt, Pseudomonas aeruginosa PA01
aaacgcccggcagaugc

SEQ ID NO: 3372070 - RNA, 23 nt, Pseudomonas aeruginosa PA01
aaacgccgcgaagcccagcgccg

SEQ ID NO: 3372071 - RNA, 16 nt, Pseudomonas aeruginosa PA01
aaacgcgccuccggca

SEQ ID NO: 3372072 - RNA, 22 nt, Pseudomonas aeruginosa PA01
aaacgcgccuccggcagcgucg

SEQ ID NO: 3372073 - RNA, 13 nt, Pseudomonas aeruginosa PA01
aaacgcucggcgu

SEQ ID NO: 3372074 - RNA, 18 nt, Pseudomonas aeruginosa PA01
aaacggcaggccagcagg

SEQ ID NO: 3372075 - RNA, 19 nt, Pseudomonas aeruginosa PA01
aaacggcaggccagcaggu

SEQ ID NO: 3372076 - RNA, 19 nt, Pseudomonas aeruginosa PA01
aaacucacccuggcaccga

SEQ ID NO: 3372077 - RNA, 22 nt, Pseudomonas aeruginosa PA01
aaacucaucaggcugccgagca

SEQ ID NO: 3372078 - RNA, 18 nt, Pseudomonas aeruginosa PA01
aaagaagccgcacuucca

SEQ ID NO: 3372079 - RNA, 20 nt, Pseudomonas aeruginosa PA01
aaagaccgaccaguaccagc

SEQ ID NO: 3372080 - RNA, 22 nt, Pseudomonas aeruginosa PA01
aaagccccgcguucgcggggcu

SEQ ID NO: 3372081 - RNA, 22 nt, Pseudomonas aeruginosa PA01
aaagccccgcuucggcggggcu

SEQ ID NO: 3372082 - RNA, 13 nt, Pseudomonas aeruginosa PA01
aaagccccggcau

SEQ ID NO: 3372083 - RNA, 20 nt, Pseudomonas aeruginosa PA01
aaagccccggcaucgccggg

SEQ ID NO: 3372084 - RNA, 21 nt, Pseudomonas aeruginosa PA01
aaagcccgcacgaggcgggcu

SEQ ID NO: 3372085 - RNA, 20 nt, Pseudomonas aeruginosa PA01
aaagcccggcauucgccggg

SEQ ID NO: 3372086 - RNA, 14 nt, Pseudomonas aeruginosa PA01
aaccagugcaccgc

SEQ ID NO: 3372087 - RNA, 17 nt, Pseudomonas aeruginosa PA01
aacccagacagcccucc

SEQ ID NO: 3372088 - RNA, 13 nt, Pseudomonas aeruginosa PA01
aacccaggcgcug

SEQ ID NO: 3372089 - RNA, 23 nt, Pseudomonas aeruginosa PA01
aacccagguucuggucgccgaca

SEQ ID NO: 3372090 - RNA, 13 nt, Pseudomonas aeruginosa PA01
aacccccugcgcg

SEQ ID NO: 3372091 - RNA, 15 nt, Pseudomonas aeruginosa PA01
aaccccgaacuuccc

SEQ ID NO: 3372092 - RNA, 16 nt, Pseudomonas aeruginosa PA01
aaccccgaacuucccc

SEQ ID NO: 3372093 - RNA, 15 nt, Pseudomonas aeruginosa PA01
aaccccggccuggcg

SEQ ID NO: 3372094 - RNA, 18 nt, Pseudomonas aeruginosa PA01
aaccccggccuggcgccg

SEQ ID NO: 3372095 - RNA, 20 nt, Pseudomonas aeruginosa PA01
aacccgccagcaagacgguc

SEQ ID NO: 3372096 - RNA, 18 nt, Pseudomonas aeruginosa PA01
aacccgcccucguggcgg

SEQ ID NO: 3372097 - RNA, 13 nt, Pseudomonas aeruginosa PA01
aacccgcggcgcg

SEQ ID NO: 3372098 - RNA, 14 nt, Pseudomonas aeruginosa PA01
aacccgcggcgcgc

SEQ ID NO: 3372099 - RNA, 15 nt, Pseudomonas aeruginosa PA01
aacccggccagcccg

SEQ ID NO: 3372100 - RNA, 16 nt, Pseudomonas aeruginosa PA01
aacccggccagcccgg

SEQ ID NO: 3372101 - RNA, 14 nt, Pseudomonas aeruginosa PA01
aacccggccaggcc

SEQ ID NO: 3372102 - RNA, 19 nt, Pseudomonas aeruginosa PA01
aacccggccaggcccucag

SEQ ID NO: 3372103 - RNA, 14 nt, Pseudomonas aeruginosa PA01
aacccggcccaggc

SEQ ID NO: 3372104 - RNA, 14 nt, Pseudomonas aeruginosa PA01
aacccggcgcuggc

SEQ ID NO: 3372105 - RNA, 22 nt, Pseudomonas aeruginosa PA01
aacccgggcccaagccgagcgg

SEQ ID NO: 3372106 - RNA, 21 nt, Pseudomonas aeruginosa PA01
aacccgugguccgccagcagg

SEQ ID NO: 3372107 - RNA, 13 nt, Pseudomonas aeruginosa PA01
aacccucaggucg

SEQ ID NO: 3372108 - RNA, 17 nt, Pseudomonas aeruginosa PA01
aacccucaggucggcgc

SEQ ID NO: 3372109 - RNA, 22 nt, Pseudomonas aeruginosa PA01
aacccugcccagugggccaccg

SEQ ID NO: 3372110 - RNA, 23 nt, Pseudomonas aeruginosa PA01
aacccugcccagugggccaccgg

SEQ ID NO: 3372111 - RNA, 16 nt, Pseudomonas aeruginosa PA01
aacccuuccagccgcc

SEQ ID NO: 3372112 - RNA, 14 nt, Pseudomonas aeruginosa PA01
aaccgaacaggcga

SEQ ID NO: 3372113 - RNA, 18 nt, Pseudomonas aeruginosa PA01
aaccgaagguacugccgc

SEQ ID NO: 3372114 - RNA, 23 nt, Pseudomonas aeruginosa PA01
aaccgagcggucggagguucgaa

SEQ ID NO: 3372115 - RNA, 22 nt, Pseudomonas aeruginosa PA01
aaccgaguuucccggcgcggcc

SEQ ID NO: 3372116 - RNA, 18 nt, Pseudomonas aeruginosa PA01
aaccgauauggcuggcgc

SEQ ID NO: 3372117 - RNA, 22 nt, Pseudomonas aeruginosa PA01
aaccgaucagcaccgccaccag

SEQ ID NO: 3372118 - RNA, 19 nt, Pseudomonas aeruginosa PA01
aaccgauggccagggggcc

SEQ ID NO: 3372119 - RNA, 17 nt, Pseudomonas aeruginosa PA01
aaccgcagacuccggcg

SEQ ID NO: 3372120 - RNA, 22 nt, Pseudomonas aeruginosa PA01
aaccgccaucgauggucaggcu

SEQ ID NO: 3372121 - RNA, 23 nt, Pseudomonas aeruginosa PA01
aaccgccggccucgcugccgccg

SEQ ID NO: 3372122 - RNA, 17 nt, Pseudomonas aeruginosa PA01
aaccgccguagccgucg

SEQ ID NO: 3372123 - RNA, 23 nt, Pseudomonas aeruginosa PA01
aaccgcgaagcgguuagccggcg

SEQ ID NO: 3372124 - RNA, 17 nt, Pseudomonas aeruginosa PA01
aaccgcgagcgguuauu

SEQ ID NO: 3372125 - RNA, 12 nt, Pseudomonas aeruginosa PA01
aaccgcgcucgg

SEQ ID NO: 3372126 - RNA, 14 nt, Pseudomonas aeruginosa PA01
aaccgcggccggcu

SEQ ID NO: 3372127 - RNA, 19 nt, Pseudomonas aeruginosa PA01
aaccgcggcgcccucugcc

SEQ ID NO: 3372128 - RNA, 21 nt, Pseudomonas aeruginosa PA01
aaccgcgggcgaggucgccac

SEQ ID NO: 3372129 - RNA, 13 nt, Pseudomonas aeruginosa PA01
aaccgcucgcggu

SEQ ID NO: 3372130 - RNA, 12 nt, Pseudomonas aeruginosa PA01
aaccgcugcgcg

SEQ ID NO: 3372131 - RNA, 15 nt, Pseudomonas aeruginosa PA01
aaccgcugcgcgguu

SEQ ID NO: 3372132 - RNA, 18 nt, Pseudomonas aeruginosa PA01
aaccggaaaagaagccgc

SEQ ID NO: 3372133 - RNA, 20 nt, Pseudomonas aeruginosa PA01
aaccggacauaucgaucacu

SEQ ID NO: 3372134 - RNA, 18 nt, Pseudomonas aeruginosa PA01
aaccggcaagcuccgcga

SEQ ID NO: 3372135 - RNA, 14 nt, Pseudomonas aeruginosa PA01
aaccggccagcgca

SEQ ID NO: 3372136 - RNA, 15 nt, Pseudomonas aeruginosa PA01
aaccggccagcgcgg

SEQ ID NO: 3372137 - RNA, 14 nt, Pseudomonas aeruginosa PA01
aaccggcgaaccag

SEQ ID NO: 3372138 - RNA, 20 nt, Pseudomonas aeruginosa PA01
aaccggcgaugcucagcgcc

SEQ ID NO: 3372139 - RNA, 18 nt, Pseudomonas aeruginosa PA01
aaccggcguccucggaga

SEQ ID NO: 3372140 - RNA, 19 nt, Pseudomonas aeruginosa PA01
aaccgggaugaagaucauc

SEQ ID NO: 3372141 - RNA, 17 nt, Pseudomonas aeruginosa PA01
aaccgggcaucgccgac

SEQ ID NO: 3372142 - RNA, 19 nt, Pseudomonas aeruginosa PA01
aaccgggcgggacucgccg

SEQ ID NO: 3372143 - RNA, 18 nt, Pseudomonas aeruginosa PA01
aaccggguaccugcucgc

SEQ ID NO: 3372144 - RNA, 21 nt, Pseudomonas aeruginosa PA01
aaccggguaccugcucgcggg

SEQ ID NO: 3372145 - RNA, 23 nt, Pseudomonas aeruginosa PA01
aaccgguuucccucgagcaccgc

SEQ ID NO: 3372146 - RNA, 13 nt, Pseudomonas aeruginosa PA01
aaccgucgcccug

SEQ ID NO: 3372147 - RNA, 22 nt, Pseudomonas aeruginosa PA01
aaccucgccgaucuccuccgcc

SEQ ID NO: 3372148 - RNA, 13 nt, Pseudomonas aeruginosa PA01
aaccugccagaaa

SEQ ID NO: 3372149 - RNA, 18 nt, Pseudomonas aeruginosa PA01
aaccugccagaaaaccca

SEQ ID NO: 3372150 - RNA, 15 nt, Pseudomonas aeruginosa PA01
aaccugccugcgcag

SEQ ID NO: 3372151 - RNA, 19 nt, Pseudomonas aeruginosa PA01
aaccugccugcgcagggcu

SEQ ID NO: 3372152 - RNA, 16 nt, Pseudomonas aeruginosa PA01
aaccugugcugcgcgc

SEQ ID NO: 3372153 - RNA, 20 nt, Pseudomonas aeruginosa PA01
aaccuuagacccacugaaga

SEQ ID NO: 3372154 - RNA, 17 nt, Pseudomonas aeruginosa PA01
aaccuucucccuucagg

SEQ ID NO: 3372155 - RNA, 16 nt, Pseudomonas aeruginosa PA01
aacgaaaaagggcggc

SEQ ID NO: 3372156 - RNA, 19 nt, Pseudomonas aeruginosa PA01
aacgaaaaagggcggccac

SEQ ID NO: 3372157 - RNA, 18 nt, Pseudomonas aeruginosa PA01
aacgaagaagccggcccc

SEQ ID NO: 3372158 - RNA, 15 nt, Pseudomonas aeruginosa PA01
aacgaagugaagcga

SEQ ID NO: 3372159 - RNA, 20 nt, Pseudomonas aeruginosa PA01
aacgaaguguuacagcagga

SEQ ID NO: 3372160 - RNA, 14 nt, Pseudomonas aeruginosa PA01
aacgacagcaccau

SEQ ID NO: 3372161 - RNA, 13 nt, Pseudomonas aeruginosa PA01
aacgacagccccg

SEQ ID NO: 3372162 - RNA, 14 nt, Pseudomonas aeruginosa PA01
aacgacagccccgg

SEQ ID NO: 3372163 - RNA, 18 nt, Pseudomonas aeruginosa PA01
aacgacagccccggcccg

SEQ ID NO: 3372164 - RNA, 16 nt, Pseudomonas aeruginosa PA01
aacgaccacgccugcc

SEQ ID NO: 3372165 - RNA, 20 nt, Pseudomonas aeruginosa PA01
aacgaccgcccaggcugccg

SEQ ID NO: 3372166 - RNA, 13 nt, Pseudomonas aeruginosa PA01
aacgacgaggccu

SEQ ID NO: 3372167 - RNA, 12 nt, Pseudomonas aeruginosa PA01
aacgaggcgacc

SEQ ID NO: 3372168 - RNA, 20 nt, Pseudomonas aeruginosa PA01
aacgaggcgacccgggucag

SEQ ID NO: 3372169 - RNA, 20 nt, Pseudomonas aeruginosa PA01
aacgaggcucggucgcgcgg

SEQ ID NO: 3372170 - RNA, 17 nt, Pseudomonas aeruginosa PA01
aacgauaccgccgccgg

SEQ ID NO: 3372171 - RNA, 23 nt, Pseudomonas aeruginosa PA01
aacgaugccguuguagcugacca

SEQ ID NO: 3372172 - RNA, 16 nt, Pseudomonas aeruginosa PA01
aacgauucgacgcagc

SEQ ID NO: 3372173 - RNA, 20 nt, Pseudomonas aeruginosa PA01
aacgauucgacgcagcgcgc

SEQ ID NO: 3372174 - RNA, 20 nt, Pseudomonas aeruginosa PA01
aacgauugcggcagaagcuu

SEQ ID NO: 3372175 - RNA, 18 nt, Pseudomonas aeruginosa PA01
aacgcagggccggaugcc

SEQ ID NO: 3372176 - RNA, 15 nt, Pseudomonas aeruginosa PA01
aacgccaccagggcc

SEQ ID NO: 3372177 - RNA, 11 nt, Pseudomonas aeruginosa PA01
aacgccaggca

SEQ ID NO: 3372178 - RNA, 11 nt, Pseudomonas aeruginosa PA01
aacgccaggcu

SEQ ID NO: 3372179 - RNA, 12 nt, Pseudomonas aeruginosa PA01
aacgccaggcug

SEQ ID NO: 3372180 - RNA, 14 nt, Pseudomonas aeruginosa PA01
aacgcccgcggcag

SEQ ID NO: 3372181 - RNA, 15 nt, Pseudomonas aeruginosa PA01
aacgcccgcggcagc

SEQ ID NO: 3372182 - RNA, 17 nt, Pseudomonas aeruginosa PA01
aacgcccgcggcagcag

SEQ ID NO: 3372183 - RNA, 18 nt, Pseudomonas aeruginosa PA01
aacgcccgcggcagcagc

SEQ ID NO: 3372184 - RNA, 19 nt, Pseudomonas aeruginosa PA01
aacgcccgcggcagcagcc

SEQ ID NO: 3372185 - RNA, 17 nt, Pseudomonas aeruginosa PA01
aacgcccggcaucugcc

SEQ ID NO: 3372186 - RNA, 11 nt, Pseudomonas aeruginosa PA01
aacgcccggcu

SEQ ID NO: 3372187 - RNA, 22 nt, Pseudomonas aeruginosa PA01
aacgcccggcuuuccucggcca

SEQ ID NO: 3372188 - RNA, 23 nt, Pseudomonas aeruginosa PA01
aacgcccggcuuuccucggccau

SEQ ID NO: 3372189 - RNA, 18 nt, Pseudomonas aeruginosa PA01
aacucggcgccgaucucc

SEQ ID NO: 3372190 - RNA, 22 nt, Pseudomonas aeruginosa PA01
aacucggcgcugccggccaggg

SEQ ID NO: 3372191 - RNA, 23 nt, Pseudomonas aeruginosa PA01
aacucggcgcugccggccagggu

SEQ ID NO: 3372192 - RNA, 13 nt, Pseudomonas aeruginosa PA01
aacucggcggcga

SEQ ID NO: 3372193 - RNA, 17 nt, Pseudomonas aeruginosa PA01
aacucguccggucgcac

SEQ ID NO: 3372194 - RNA, 18 nt, Pseudomonas aeruginosa PA01
aacucgucguccagcggc

SEQ ID NO: 3372195 - RNA, 18 nt, Pseudomonas aeruginosa PA01
aacucgugcuccaccucg

SEQ ID NO: 3372196 - RNA, 12 nt, Pseudomonas aeruginosa PA01
aacucuggcggc

SEQ ID NO: 3372197 - RNA, 13 nt, Pseudomonas aeruginosa PA01
aacucuggcggcg

SEQ ID NO: 3372198 - RNA, 15 nt, Pseudomonas aeruginosa PA01
aacucuugaucccgg

SEQ ID NO: 3372199 - RNA, 18 nt, Pseudomonas aeruginosa PA01
aacugcacguugcugugc

SEQ ID NO: 3372200 - RNA, 20 nt, Pseudomonas aeruginosa PA01
aacugcagggcgucgccggg

SEQ ID NO: 3372201 - RNA, 21 nt, Pseudomonas aeruginosa PA01
aacugcccgcaggggcugccg

SEQ ID NO: 3372202 - RNA, 13 nt, Pseudomonas aeruginosa PA01
aacugcgcaggcu

SEQ ID NO: 3372203 - RNA, 17 nt, Pseudomonas aeruginosa PA01
aacugcgcccccagcgc

SEQ ID NO: 3372204 - RNA, 18 nt, Pseudomonas aeruginosa PA01
aacugcgcccccagcgcc

SEQ ID NO: 3372205 - RNA, 16 nt, Pseudomonas aeruginosa PA01
aacugcgguccggcga

SEQ ID NO: 3372206 - RNA, 16 nt, Pseudomonas aeruginosa PA01
aacugcuucaggcgcg

SEQ ID NO: 3372207 - RNA, 22 nt, Pseudomonas aeruginosa PA01
aacuggauuuccuucggcaccc

SEQ ID NO: 3372208 - RNA, 17 nt, Pseudomonas aeruginosa PA01
aacuggccagcaccagu

SEQ ID NO: 3372209 - RNA, 12 nt, Pseudomonas aeruginosa PA01
aacuggccaggg

SEQ ID NO: 3372210 - RNA, 13 nt, Pseudomonas aeruginosa PA01
aacugggcgagca

SEQ ID NO: 3372211 - RNA, 20 nt, Pseudomonas aeruginosa PA01
aacugggcgagcaucuucuu

SEQ ID NO: 3372212 - RNA, 18 nt, Pseudomonas aeruginosa PA01
aacuggucgcagccgcgc

SEQ ID NO: 3372213 - RNA, 20 nt, Pseudomonas aeruginosa PA01
aacuggucgcagccgcgcaa

SEQ ID NO: 3372214 - RNA, 24 nt, Pseudomonas aeruginosa PA01
aacuggucggggcgcaaggccagc

SEQ ID NO: 3372215 - RNA, 17 nt, Pseudomonas aeruginosa PA01
aacugguuggccgccug

SEQ ID NO: 3372216 - RNA, 21 nt, Pseudomonas aeruginosa PA01
aacugguuggccgccuggcgc

SEQ ID NO: 3372217 - RNA, 13 nt, Pseudomonas aeruginosa PA01
aacugucggcgga

SEQ ID NO: 3372218 - RNA, 14 nt, Pseudomonas aeruginosa PA01
aacuucaggccggc

SEQ ID NO: 3372219 - RNA, 18 nt, Pseudomonas aeruginosa PA01
aacuuccacucgccgacc

SEQ ID NO: 3372220 - RNA, 22 nt, Pseudomonas aeruginosa PA01
aacuucuccagguacagccgca

SEQ ID NO: 3372221 - RNA, 21 nt, Pseudomonas aeruginosa PA01
aacuuggcgcgcagggcaucg

SEQ ID NO: 3372222 - RNA, 16 nt, Pseudomonas aeruginosa PA01
aacuuuaggucugccu

SEQ ID NO: 3372223 - RNA, 15 nt, Pseudomonas aeruginosa PA01
aacuuuuuggaucag

SEQ ID NO: 3372224 - RNA, 23 nt, Pseudomonas aeruginosa PA01
aacuuuuuggaucagaggguuga

SEQ ID NO: 3372225 - RNA, 13 nt, Pseudomonas aeruginosa PA01
aagaaaaggccgc

SEQ ID NO: 3372226 - RNA, 21 nt, Pseudomonas aeruginosa PA01
aagaaaauuuucgaaaauaac

SEQ ID NO: 3372227 - RNA, 14 nt, Pseudomonas aeruginosa PA01
aagaaacaacgaag

SEQ ID NO: 3372228 - RNA, 16 nt, Pseudomonas aeruginosa PA01
aagaaacgguggaggc

SEQ ID NO: 3372229 - RNA, 18 nt, Pseudomonas aeruginosa PA01
aagaaacgguggaggcgu

SEQ ID NO: 3372230 - RNA, 13 nt, Pseudomonas aeruginosa PA01
aagaacggcccgc

SEQ ID NO: 3372231 - RNA, 22 nt, Pseudomonas aeruginosa PA01
aagaacucggcgcugccggcca

SEQ ID NO: 3372232 - RNA, 16 nt, Pseudomonas aeruginosa PA01
aagaagccgaucacca

SEQ ID NO: 3372233 - RNA, 14 nt, Pseudomonas aeruginosa PA01
aagaagccucgcga

SEQ ID NO: 3372234 - RNA, 11 nt, Pseudomonas aeruginosa PA01
aagaaggcgga

SEQ ID NO: 3372235 - RNA, 18 nt, Pseudomonas aeruginosa PA01
aagaaggcguccagggcu

SEQ ID NO: 3372236 - RNA, 16 nt, Pseudomonas aeruginosa PA01
aagaaggcucaccggu

SEQ ID NO: 3372237 - RNA, 16 nt, Pseudomonas aeruginosa PA01
aagaaucgcagccaug

SEQ ID NO: 3372238 - RNA, 21 nt, Pseudomonas aeruginosa PA01
aagacaaaauucucccgcucc

SEQ ID NO: 3372239 - RNA, 13 nt, Pseudomonas aeruginosa PA01
aagacaggccuuu

SEQ ID NO: 3372240 - RNA, 11 nt, Pseudomonas aeruginosa PA01
aagacccugca

SEQ ID NO: 3372241 - RNA, 23 nt, Pseudomonas aeruginosa PA01
aagaccuguugcagagcggccag

SEQ ID NO: 3372242 - RNA, 15 nt, Pseudomonas aeruginosa PA01
aagaccuugaacucg

SEQ ID NO: 3372243 - RNA, 13 nt, Pseudomonas aeruginosa PA01
aagacgaaaaagc

SEQ ID NO: 3372244 - RNA, 19 nt, Pseudomonas aeruginosa PA01
aagacgaaguuggcggccg

SEQ ID NO: 3372245 - RNA, 16 nt, Pseudomonas aeruginosa PA01
aagacggccaggaugu

SEQ ID NO: 3372246 - RNA, 21 nt, Pseudomonas aeruginosa PA01
aagacguacagcgggucggcg

SEQ ID NO: 3372247 - RNA, 22 nt, Pseudomonas aeruginosa PA01
aagacguacagcgggucggcga

SEQ ID NO: 3372248 - RNA, 18 nt, Pseudomonas aeruginosa PA01
aagagagcgccagcgaga

SEQ ID NO: 3372249 - RNA, 22 nt, Pseudomonas aeruginosa PA01
aagagcagcgcggcggcggcca

SEQ ID NO: 3372250 - RNA, 23 nt, Pseudomonas aeruginosa PA01
aagagcagcgcggcggcggccag

SEQ ID NO: 3372251 - RNA, 11 nt, Pseudomonas aeruginosa PA01
aagagcgccgc

SEQ ID NO: 3372252 - RNA, 17 nt, Pseudomonas aeruginosa PA01
aagagcuggcggccgcg

SEQ ID NO: 3372253 - RNA, 21 nt, Pseudomonas aeruginosa PA01
aagaggcccucggcgccgagc

SEQ ID NO: 3372254 - RNA, 23 nt, Pseudomonas aeruginosa PA01
aagaggcccucggcgccgagcau

SEQ ID NO: 3372255 - RNA, 13 nt, Pseudomonas aeruginosa PA01
aagaguaaaugcu

SEQ ID NO: 3372256 - RNA, 15 nt, Pseudomonas aeruginosa PA01
aagaguucgcugaag

SEQ ID NO: 3372257 - RNA, 17 nt, Pseudomonas aeruginosa PA01
aagauccgcuccaggcu

SEQ ID NO: 3372258 - RNA, 18 nt, Pseudomonas aeruginosa PA01
aagaucgccugcuggccg

SEQ ID NO: 3372259 - RNA, 17 nt, Pseudomonas aeruginosa PA01
aagaucucgccauggcg

SEQ ID NO: 3372260 - RNA, 17 nt, Pseudomonas aeruginosa PA01
aagauguucgccgccgc

SEQ ID NO: 3372261 - RNA, 20 nt, Pseudomonas aeruginosa PA01
aagauuccgcugaggaugua

SEQ ID NO: 3372262 - RNA, 14 nt, Pseudomonas aeruginosa PA01
aagcaacggcgaau

SEQ ID NO: 3372263 - RNA, 20 nt, Pseudomonas aeruginosa PA01
aagcaccgacacgcacucau

SEQ ID NO: 3372264 - RNA, 17 nt, Pseudomonas aeruginosa PA01
aagcaccuugagggccu

SEQ ID NO: 3372265 - RNA, 20 nt, Pseudomonas aeruginosa PA01
aagcaccuugagggccuugg

SEQ ID NO: 3372266 - RNA, 17 nt, Pseudomonas aeruginosa PA01
aagcacggcucggcgag

SEQ ID NO: 3372267 - RNA, 16 nt, Pseudomonas aeruginosa PA01
aagcagaaagccccug

SEQ ID NO: 3372268 - RNA, 23 nt, Pseudomonas aeruginosa PA01
aagcagaaagccccugccgcgga

SEQ ID NO: 3372269 - RNA, 17 nt, Pseudomonas aeruginosa PA01
aagcagacguagggcug

SEQ ID NO: 3372270 - RNA, 16 nt, Pseudomonas aeruginosa PA01
aagcagagggucggcg

SEQ ID NO: 3372271 - RNA, 15 nt, Pseudomonas aeruginosa PA01
aagcagcccagcgcu

SEQ ID NO: 3372272 - RNA, 14 nt, Pseudomonas aeruginosa PA01
aagcaggacggcga

SEQ ID NO: 3372273 - RNA, 17 nt, Pseudomonas aeruginosa PA01
aagcaggcggaguagcc

SEQ ID NO: 3372274 - RNA, 21 nt, Pseudomonas aeruginosa PA01
aagcaggcggaguagccggcg

SEQ ID NO: 3372275 - RNA, 13 nt, Pseudomonas aeruginosa PA01
aagcauggccggc

SEQ ID NO: 3372276 - RNA, 18 nt, Pseudomonas aeruginosa PA01
aagcauucuggaugcagc

SEQ ID NO: 3372277 - RNA, 17 nt, Pseudomonas aeruginosa PA01
aagcauuucuucaccac

SEQ ID NO: 3372278 - RNA, 20 nt, Pseudomonas aeruginosa PA01
aagccagcaaacccgggccc

SEQ ID NO: 3372279 - RNA, 12 nt, Pseudomonas aeruginosa PA01
aagccagccagg

SEQ ID NO: 3372280 - RNA, 19 nt, Pseudomonas aeruginosa PA01
aagccagccaugugcuccu

SEQ ID NO: 3372281 - RNA, 17 nt, Pseudomonas aeruginosa PA01
aagccaggaagcggcgg

SEQ ID NO: 3372282 - RNA, 13 nt, Pseudomonas aeruginosa PA01
aagccaggcaccg

SEQ ID NO: 3372283 - RNA, 14 nt, Pseudomonas aeruginosa PA01
aagccaggcaccgg

SEQ ID NO: 3372284 - RNA, 16 nt, Pseudomonas aeruginosa PA01
aagccaggcaccggac

SEQ ID NO: 3372285 - RNA, 20 nt, Pseudomonas aeruginosa PA01
aagcccagcgagccgaucac

SEQ ID NO: 3372286 - RNA, 12 nt, Pseudomonas aeruginosa PA01
aagcccagcgcc

SEQ ID NO: 3372287 - RNA, 14 nt, Pseudomonas aeruginosa PA01
aagcccagcgccug

SEQ ID NO: 3372288 - RNA, 16 nt, Pseudomonas aeruginosa PA01
aagcccaggcgcucgg

SEQ ID NO: 3372289 - RNA, 22 nt, Pseudomonas aeruginosa PA01
aagcccaggcgcucggcggcgc

SEQ ID NO: 3372290 - RNA, 12 nt, Pseudomonas aeruginosa PA01
aagcccaggcug

SEQ ID NO: 3372291 - RNA, 21 nt, Pseudomonas aeruginosa PA01
aagccccagagcccgccgaac

SEQ ID NO: 3372292 - RNA, 16 nt, Pseudomonas aeruginosa PA01
aagcgucgugcgccgg

SEQ ID NO: 3372293 - RNA, 17 nt, Pseudomonas aeruginosa PA01
aagcgucgugcgccggc

SEQ ID NO: 3372294 - RNA, 18 nt, Pseudomonas aeruginosa PA01
aagcgucgugcgccggcc

SEQ ID NO: 3372295 - RNA, 19 nt, Pseudomonas aeruginosa PA01
aagcgucgugcgccggccu

SEQ ID NO: 3372296 - RNA, 18 nt, Pseudomonas aeruginosa PA01
aagcgugggcggccggcc

SEQ ID NO: 3372297 - RNA, 24 nt, Pseudomonas aeruginosa PA01
aagcgugggcggccggccaggucg

SEQ ID NO: 3372298 - RNA, 16 nt, Pseudomonas aeruginosa PA01
aagcguucccccuuuu

SEQ ID NO: 3372299 - RNA, 18 nt, Pseudomonas aeruginosa PA01
aagcguucccccuuuuuc

SEQ ID NO: 3372300 - RNA, 18 nt, Pseudomonas aeruginosa PA01
aagcucaccuugaagccu

SEQ ID NO: 3372301 - RNA, 19 nt, Pseudomonas aeruginosa PA01
aagcucgacgagccgcgac

SEQ ID NO: 3372302 - RNA, 13 nt, Pseudomonas aeruginosa PA01
aagcucgaucacc

SEQ ID NO: 3372303 - RNA, 22 nt, Pseudomonas aeruginosa PA01
aagcucgcgcaagcgcccggcg

SEQ ID NO: 3372304 - RNA, 13 nt, Pseudomonas aeruginosa PA01
aagcucggcagca

SEQ ID NO: 3372305 - RNA, 11 nt, Pseudomonas aeruginosa PA01
aagcucggcgc

SEQ ID NO: 3372306 - RNA, 16 nt, Pseudomonas aeruginosa PA01
aagcucgucacccgcg

SEQ ID NO: 3372307 - RNA, 19 nt, Pseudomonas aeruginosa PA01
aagcucucgccgcgcucgc

SEQ ID NO: 3372308 - RNA, 20 nt, Pseudomonas aeruginosa PA01
aagcucucgccgcgcucgcg

SEQ ID NO: 3372309 - RNA, 14 nt, Pseudomonas aeruginosa PA01
aagcugaagcgccg

SEQ ID NO: 3372310 - RNA, 14 nt, Pseudomonas aeruginosa PA01
aagcugacgaacau

SEQ ID NO: 3372311 - RNA, 22 nt, Pseudomonas aeruginosa PA01
aagcugacgaacaucgccagcg

SEQ ID NO: 3372312 - RNA, 18 nt, Pseudomonas aeruginosa PA01
aagcugccuuccagcagg

SEQ ID NO: 3372313 - RNA, 18 nt, Pseudomonas aeruginosa PA01
aagcuggagcagcagcgc

SEQ ID NO: 3372314 - RNA, 21 nt, Pseudomonas aeruginosa PA01
aagcuguuggccaaccaggaa

SEQ ID NO: 3372315 - RNA, 13 nt, Pseudomonas aeruginosa PA01
aagcuuccagcuu

SEQ ID NO: 3372316 - RNA, 19 nt, Pseudomonas aeruginosa PA01
aagcuucgucgcgcaggcg

SEQ ID NO: 3372317 - RNA, 18 nt, Pseudomonas aeruginosa PA01
aagcuuguugcgcaggcg

SEQ ID NO: 3372318 - RNA, 16 nt, Pseudomonas aeruginosa PA01
aagcuuuuccagcgca

SEQ ID NO: 3372319 - RNA, 21 nt, Pseudomonas aeruginosa PA01
aagcuuuuccagcgcaccgcc

SEQ ID NO: 3372320 - RNA, 18 nt, Pseudomonas aeruginosa PA01
aaggaaucuucggcgccc

SEQ ID NO: 3372321 - RNA, 15 nt, Pseudomonas aeruginosa PA01
aaggacaggucgcgg

SEQ ID NO: 3372322 - RNA, 13 nt, Pseudomonas aeruginosa PA01
aaggaccugcugc

SEQ ID NO: 3372323 - RNA, 18 nt, Pseudomonas aeruginosa PA01
aaggacugugccuggaag

SEQ ID NO: 3372324 - RNA, 17 nt, Pseudomonas aeruginosa PA01
aaggagacucagcgcga

SEQ ID NO: 3372325 - RNA, 17 nt, Pseudomonas aeruginosa PA01
aaggaucgagccagcgc

SEQ ID NO: 3372326 - RNA, 13 nt, Pseudomonas aeruginosa PA01
aaggaucgccgcg

SEQ ID NO: 3372327 - RNA, 14 nt, Pseudomonas aeruginosa PA01
aaggaucgccgcga

SEQ ID NO: 3372328 - RNA, 13 nt, Pseudomonas aeruginosa PA01
aaggaugcgccag

SEQ ID NO: 3372329 - RNA, 15 nt, Pseudomonas aeruginosa PA01
aaggaugcgccagcg

SEQ ID NO: 3372330 - RNA, 23 nt, Pseudomonas aeruginosa PA01
aaggaugggaacgaguugggcga

SEQ ID NO: 3372331 - RNA, 17 nt, Pseudomonas aeruginosa PA01
aaggauuccacccgcuc

SEQ ID NO: 3372332 - RNA, 17 nt, Pseudomonas aeruginosa PA01
aaggauuuccgcggccg

SEQ ID NO: 3372333 - RNA, 15 nt, Pseudomonas aeruginosa PA01
aaggcaacagcccgc

SEQ ID NO: 3372334 - RNA, 22 nt, Pseudomonas aeruginosa PA01
aaggcaacagcccgcgccgcga

SEQ ID NO: 3372335 - RNA, 11 nt, Pseudomonas aeruginosa PA01
aaggcaugccc

SEQ ID NO: 3372336 - RNA, 15 nt, Pseudomonas aeruginosa PA01
aaggccaccagagcc

SEQ ID NO: 3372337 - RNA, 21 nt, Pseudomonas aeruginosa PA01
aaggccaccagagccagccgc

SEQ ID NO: 3372338 - RNA, 19 nt, Pseudomonas aeruginosa PA01
aaggccaccaucgcggcga

SEQ ID NO: 3372339 - RNA, 16 nt, Pseudomonas aeruginosa PA01
aaggccagcucgucgc

SEQ ID NO: 3372340 - RNA, 18 nt, Pseudomonas aeruginosa PA01
aaggccagcucgucgccc

SEQ ID NO: 3372341 - RNA, 10 nt, Pseudomonas aeruginosa PA01
aaggccaggc

SEQ ID NO: 3372342 - RNA, 14 nt, Pseudomonas aeruginosa PA01
aaggccaggccggc

SEQ ID NO: 3372343 - RNA, 12 nt, Pseudomonas aeruginosa PA01
aaggccaggcuc

SEQ ID NO: 3372344 - RNA, 16 nt, Pseudomonas aeruginosa PA01
aaggccaggucgacga

SEQ ID NO: 3372345 - RNA, 20 nt, Pseudomonas aeruginosa PA01
aaggcccggucuagccgggc

SEQ ID NO: 3372346 - RNA, 15 nt, Pseudomonas aeruginosa PA01
aaggccgccacggcg

SEQ ID NO: 3372347 - RNA, 20 nt, Pseudomonas aeruginosa PA01
aaggccggucgcaaccggcc

SEQ ID NO: 3372348 - RNA, 22 nt, Pseudomonas aeruginosa PA01
aaggccggugcgaaccggccuu

SEQ ID NO: 3372349 - RNA, 18 nt, Pseudomonas aeruginosa PA01
aaggccgguugcgaccgg

SEQ ID NO: 3372350 - RNA, 12 nt, Pseudomonas aeruginosa PA01
aaggccucggca

SEQ ID NO: 3372351 - RNA, 13 nt, Pseudomonas aeruginosa PA01
aaggccucgucga

SEQ ID NO: 3372352 - RNA, 21 nt, Pseudomonas aeruginosa PA01
aaggccucgucgaucucgccg

SEQ ID NO: 3372353 - RNA, 16 nt, Pseudomonas aeruginosa PA01
aaggccucgucgcccg

SEQ ID NO: 3372354 - RNA, 13 nt, Pseudomonas aeruginosa PA01
aaggccugacgca

SEQ ID NO: 3372355 - RNA, 20 nt, Pseudomonas aeruginosa PA01
aaggccugacgcaagcgcuc

SEQ ID NO: 3372356 - RNA, 17 nt, Pseudomonas aeruginosa PA01
aaggccugcgcuuccgg

SEQ ID NO: 3372357 - RNA, 20 nt, Pseudomonas aeruginosa PA01
aaggccuggaacaccaggcc

SEQ ID NO: 3372358 - RNA, 12 nt, Pseudomonas aeruginosa PA01
aaggccuggccg

SEQ ID NO: 3372359 - RNA, 22 nt, Pseudomonas aeruginosa PA01
aaggcgaaccacaccaggucgc

SEQ ID NO: 3372360 - RNA, 12 nt, Pseudomonas aeruginosa PA01
aaggcgaucacg

SEQ ID NO: 3372361 - RNA, 22 nt, Pseudomonas aeruginosa PA01
aaggcgaucccguagaccggcu

SEQ ID NO: 3372362 - RNA, 15 nt, Pseudomonas aeruginosa PA01
aaggcgcgcagggcc

SEQ ID NO: 3372363 - RNA, 13 nt, Pseudomonas aeruginosa PA01
aaggcgcuccccu

SEQ ID NO: 3372364 - RNA, 11 nt, Pseudomonas aeruginosa PA01
aaggcgcuggg

SEQ ID NO: 3372365 - RNA, 22 nt, Pseudomonas aeruginosa PA01
aaggcgguguagaccaccagca

SEQ ID NO: 3372366 - RNA, 15 nt, Pseudomonas aeruginosa PA01
aaggcgucgaaggcc

SEQ ID NO: 3372367 - RNA, 18 nt, Pseudomonas aeruginosa PA01
aaggcgucggcuucgccc

SEQ ID NO: 3372368 - RNA, 16 nt, Pseudomonas aeruginosa PA01
aaggcgugggcgccgg

SEQ ID NO: 3372369 - RNA, 17 nt, Pseudomonas aeruginosa PA01
aaggcgugggcgccggc

SEQ ID NO: 3372370 - RNA, 14 nt, Pseudomonas aeruginosa PA01
aaggcugccgggcu

SEQ ID NO: 3372371 - RNA, 22 nt, Pseudomonas aeruginosa PA01
aaggcugccgggcucugguagc

SEQ ID NO: 3372372 - RNA, 14 nt, Pseudomonas aeruginosa PA01
aaggcuucgcgguu

SEQ ID NO: 3372373 - RNA, 19 nt, Pseudomonas aeruginosa PA01
aaggcuucggcggucaggc

SEQ ID NO: 3372374 - RNA, 14 nt, Pseudomonas aeruginosa PA01
aagggaaacaccag

SEQ ID NO: 3372375 - RNA, 19 nt, Pseudomonas aeruginosa PA01
aagggaacccgcggcgcgc

SEQ ID NO: 3372376 - RNA, 16 nt, Pseudomonas aeruginosa PA01
aagggaucgaccgguu

SEQ ID NO: 3372377 - RNA, 17 nt, Pseudomonas aeruginosa PA01
aagggaugccggcggca

SEQ ID NO: 3372378 - RNA, 18 nt, Pseudomonas aeruginosa PA01
aagggcacgugcagcggc

SEQ ID NO: 3372379 - RNA, 14 nt, Pseudomonas aeruginosa PA01
aagggcagcggcga

SEQ ID NO: 3372380 - RNA, 13 nt, Pseudomonas aeruginosa PA01
aagggcgucuggg

SEQ ID NO: 3372381 - RNA, 15 nt, Pseudomonas aeruginosa PA01
aagggcgucugggac

SEQ ID NO: 3372382 - RNA, 18 nt, Pseudomonas aeruginosa PA01
aagggcucagcccaggcg

SEQ ID NO: 3372383 - RNA, 20 nt, Pseudomonas aeruginosa PA01
aagggcucagcccaggcgcc

SEQ ID NO: 3372384 - RNA, 13 nt, Pseudomonas aeruginosa PA01
aagggugucgggg

SEQ ID NO: 3372385 - RNA, 20 nt, Pseudomonas aeruginosa PA01
aaggguuccucucgucaggg

SEQ ID NO: 3372386 - RNA, 20 nt, Pseudomonas aeruginosa PA01
aagguaguccaucaccgcgg

SEQ ID NO: 3372387 - RNA, 15 nt, Pseudomonas aeruginosa PA01
aagguaucggccaug

SEQ ID NO: 3372388 - RNA, 18 nt, Pseudomonas aeruginosa PA01
aaggucaccgcucgccag

SEQ ID NO: 3372389 - RNA, 16 nt, Pseudomonas aeruginosa PA01
aaggucagcacgccuu

SEQ ID NO: 3372390 - RNA, 23 nt, Pseudomonas aeruginosa PA01
aagguccuugggccaggcaucca

SEQ ID NO: 3372391 - RNA, 24 nt, Pseudomonas aeruginosa PA01
aaggucgacaucgauaacaccagg

SEQ ID NO: 3372392 - RNA, 14 nt, Pseudomonas aeruginosa PA01
aaggucgccgcgcu

SEQ ID NO: 3372393 - RNA, 14 nt, Pseudomonas aeruginosa PA01
aaggucgccgggcu

SEQ ID NO: 3372394 - RNA, 13 nt, Pseudomonas aeruginosa PA01
aaggucggcagca

SEQ ID NO: 3372395 - RNA, 16 nt, Pseudomonas aeruginosa PA01
aaugcugccacccggc

SEQ ID NO: 3372396 - RNA, 19 nt, Pseudomonas aeruginosa PA01
aaugcuuccguagguggau

SEQ ID NO: 3372397 - RNA, 20 nt, Pseudomonas aeruginosa PA01
aauggagggaucgcgcggcu

SEQ ID NO: 3372398 - RNA, 17 nt, Pseudomonas aeruginosa PA01
aauggauguugccgccg

SEQ ID NO: 3372399 - RNA, 18 nt, Pseudomonas aeruginosa PA01
aauggcaacccagggcgc

SEQ ID NO: 3372400 - RNA, 21 nt, Pseudomonas aeruginosa PA01
aauggcaacccagggcgcugc

SEQ ID NO: 3372401 - RNA, 15 nt, Pseudomonas aeruginosa PA01
aauggcagcaggcac

SEQ ID NO: 3372402 - RNA, 14 nt, Pseudomonas aeruginosa PA01
aauggcgcagccgc

SEQ ID NO: 3372403 - RNA, 15 nt, Pseudomonas aeruginosa PA01
aauggcgcagccgcu

SEQ ID NO: 3372404 - RNA, 18 nt, Pseudomonas aeruginosa PA01
aauggcgccggccagagc

SEQ ID NO: 3372405 - RNA, 12 nt, Pseudomonas aeruginosa PA01
aauggcgcgccu

SEQ ID NO: 3372406 - RNA, 16 nt, Pseudomonas aeruginosa PA01
aauggcggucgccgac

SEQ ID NO: 3372407 - RNA, 15 nt, Pseudomonas aeruginosa PA01
aauggcuucuugagc

SEQ ID NO: 3372408 - RNA, 22 nt, Pseudomonas aeruginosa PA01
aauggcuugaucgagucgccgg

SEQ ID NO: 3372409 - RNA, 17 nt, Pseudomonas aeruginosa PA01
aauguccggcgaccacc

SEQ ID NO: 3372410 - RNA, 19 nt, Pseudomonas aeruginosa PA01
aauguccggcgaccaccac

SEQ ID NO: 3372411 - RNA, 22 nt, Pseudomonas aeruginosa PA01
aauuaacggccauaauggccgc

SEQ ID NO: 3372412 - RNA, 17 nt, Pseudomonas aeruginosa PA01
aauucagcgcagcgaag

SEQ ID NO: 3372413 - RNA, 21 nt, Pseudomonas aeruginosa PA01
aauuccagcuuguccacgcca

SEQ ID NO: 3372414 - RNA, 18 nt, Pseudomonas aeruginosa PA01
aauuccgcagccuuggca

SEQ ID NO: 3372415 - RNA, 15 nt, Pseudomonas aeruginosa PA01
aauugaccagguacg

SEQ ID NO: 3372416 - RNA, 16 nt, Pseudomonas aeruginosa PA01
aauugccagaggcugc

SEQ ID NO: 3372417 - RNA, 13 nt, Pseudomonas aeruginosa PA01
aauugccguaggg

SEQ ID NO: 3372418 - RNA, 18 nt, Pseudomonas aeruginosa PA01
aauugccuccgcucugcu

SEQ ID NO: 3372419 - RNA, 22 nt, Pseudomonas aeruginosa PA01
aauugcgagcgagcuugcaauc

SEQ ID NO: 3372420 - RNA, 15 nt, Pseudomonas aeruginosa PA01
aauugcgcuggaagu

SEQ ID NO: 3372421 - RNA, 16 nt, Pseudomonas aeruginosa PA01
aauuggacagcaggcu

SEQ ID NO: 3372422 - RNA, 13 nt, Pseudomonas aeruginosa PA01
aauuggccaggcu

SEQ ID NO: 3372423 - RNA, 22 nt, Pseudomonas aeruginosa PA01
aauuugaacgcuguagaaugcg

SEQ ID NO: 3372424 - RNA, 12 nt, Pseudomonas aeruginosa PA01
acaaaaaacccg

SEQ ID NO: 3372425 - RNA, 12 nt, Pseudomonas aeruginosa PA01
acaaaaaagccc

SEQ ID NO: 3372426 - RNA, 16 nt, Pseudomonas aeruginosa PA01
acaaaaaagcccgcca

SEQ ID NO: 3372427 - RNA, 14 nt, Pseudomonas aeruginosa PA01
acaaacacugugga

SEQ ID NO: 3372428 - RNA, 18 nt, Pseudomonas aeruginosa PA01
acaacccggcgcuggccg

SEQ ID NO: 3372429 - RNA, 19 nt, Pseudomonas aeruginosa PA01
acaacccggcgcuggccgc

SEQ ID NO: 3372430 - RNA, 22 nt, Pseudomonas aeruginosa PA01
acaacccuguccccucacggcg

SEQ ID NO: 3372431 - RNA, 16 nt, Pseudomonas aeruginosa PA01
acaacgaaaagagccg

SEQ ID NO: 3372432 - RNA, 14 nt, Pseudomonas aeruginosa PA01
acaacgacagcccc

SEQ ID NO: 3372433 - RNA, 13 nt, Pseudomonas aeruginosa PA01
acaacgccgccgg

SEQ ID NO: 3372434 - RNA, 14 nt, Pseudomonas aeruginosa PA01
acaacgccgccggc

SEQ ID NO: 3372435 - RNA, 21 nt, Pseudomonas aeruginosa PA01
acaacgccgccggcguuaucc

SEQ ID NO: 3372436 - RNA, 14 nt, Pseudomonas aeruginosa PA01
acaacgccuuccuu

SEQ ID NO: 3372437 - RNA, 17 nt, Pseudomonas aeruginosa PA01
acaacggaagauggcua

SEQ ID NO: 3372438 - RNA, 20 nt, Pseudomonas aeruginosa PA01
acaagaagccccgcuauggc

SEQ ID NO: 3372439 - RNA, 15 nt, Pseudomonas aeruginosa PA01
acaagaauaggaaca

SEQ ID NO: 3372440 - RNA, 20 nt, Pseudomonas aeruginosa PA01
acaagagcagacacaaaaaa

SEQ ID NO: 3372441 - RNA, 17 nt, Pseudomonas aeruginosa PA01
acaagcauucuggaugc

SEQ ID NO: 3372442 - RNA, 16 nt, Pseudomonas aeruginosa PA01
acaagcccugguggug

SEQ ID NO: 3372443 - RNA, 12 nt, Pseudomonas aeruginosa PA01
acaagccgccuu

SEQ ID NO: 3372444 - RNA, 17 nt, Pseudomonas aeruginosa PA01
acaagccuccagcgccg

SEQ ID NO: 3372445 - RNA, 16 nt, Pseudomonas aeruginosa PA01
acaagcgcaacgcgcg

SEQ ID NO: 3372446 - RNA, 19 nt, Pseudomonas aeruginosa PA01
acaagcgucgccggccgcu

SEQ ID NO: 3372447 - RNA, 15 nt, Pseudomonas aeruginosa PA01
acaagggccagagca

SEQ ID NO: 3372448 - RNA, 18 nt, Pseudomonas aeruginosa PA01
acaagucgaaucaagcaa

SEQ ID NO: 3372449 - RNA, 17 nt, Pseudomonas aeruginosa PA01
acaaucagcggcgggcg

SEQ ID NO: 3372450 - RNA, 13 nt, Pseudomonas aeruginosa PA01
acaaucccagcuc

SEQ ID NO: 3372451 - RNA, 20 nt, Pseudomonas aeruginosa PA01
acaaucuauaaugcgccccc

SEQ ID NO: 3372452 - RNA, 18 nt, Pseudomonas aeruginosa PA01
acaaugaaaaacgccggc

SEQ ID NO: 3372453 - RNA, 19 nt, Pseudomonas aeruginosa PA01
acaaugaaaaagggaugcc

SEQ ID NO: 3372454 - RNA, 21 nt, Pseudomonas aeruginosa PA01
acaaugauggcccuucgcccu

SEQ ID NO: 3372455 - RNA, 23 nt, Pseudomonas aeruginosa PA01
acacacgcuucugcuggccgcgc

SEQ ID NO: 3372456 - RNA, 13 nt, Pseudomonas aeruginosa PA01
acacagacgcagc

SEQ ID NO: 3372457 - RNA, 15 nt, Pseudomonas aeruginosa PA01
acacauggucggcca

SEQ ID NO: 3372458 - RNA, 18 nt, Pseudomonas aeruginosa PA01
acacauggucggccaggu

SEQ ID NO: 3372459 - RNA, 14 nt, Pseudomonas aeruginosa PA01
acaccaccagcauc

SEQ ID NO: 3372460 - RNA, 15 nt, Pseudomonas aeruginosa PA01
acaccaccagcauca

SEQ ID NO: 3372461 - RNA, 17 nt, Pseudomonas aeruginosa PA01
acaccaccagcaucacc

SEQ ID NO: 3372462 - RNA, 23 nt, Pseudomonas aeruginosa PA01
acaccaccagguugaagaacggc

SEQ ID NO: 3372463 - RNA, 12 nt, Pseudomonas aeruginosa PA01
acaccagcgccg

SEQ ID NO: 3372464 - RNA, 15 nt, Pseudomonas aeruginosa PA01
acaccaggagcgcca

SEQ ID NO: 3372465 - RNA, 20 nt, Pseudomonas aeruginosa PA01
acaccaggagcgccagcacc

SEQ ID NO: 3372466 - RNA, 21 nt, Pseudomonas aeruginosa PA01
acaccaggagcgccagcacca

SEQ ID NO: 3372467 - RNA, 12 nt, Pseudomonas aeruginosa PA01
acaccaggccga

SEQ ID NO: 3372468 - RNA, 13 nt, Pseudomonas aeruginosa PA01
acaccaggccgau

SEQ ID NO: 3372469 - RNA, 12 nt, Pseudomonas aeruginosa PA01
acaccaggucgc

SEQ ID NO: 3372470 - RNA, 15 nt, Pseudomonas aeruginosa PA01
acaccaggucgccgc

SEQ ID NO: 3372471 - RNA, 18 nt, Pseudomonas aeruginosa PA01
acaccaggucgccgcaca

SEQ ID NO: 3372472 - RNA, 16 nt, Pseudomonas aeruginosa PA01
acaccagguuggccag

SEQ ID NO: 3372473 - RNA, 15 nt, Pseudomonas aeruginosa PA01
acaccaugcuccgcc

SEQ ID NO: 3372474 - RNA, 19 nt, Pseudomonas aeruginosa PA01
acacccagaagccgaccuu

SEQ ID NO: 3372475 - RNA, 14 nt, Pseudomonas aeruginosa PA01
acacccaggccugg

SEQ ID NO: 3372476 - RNA, 19 nt, Pseudomonas aeruginosa PA01
acacccugcugcugcucag

SEQ ID NO: 3372477 - RNA, 19 nt, Pseudomonas aeruginosa PA01
acaccgaacuuccgccgaa

SEQ ID NO: 3372478 - RNA, 20 nt, Pseudomonas aeruginosa PA01
acaccgaacuuccgccgaau

SEQ ID NO: 3372479 - RNA, 17 nt, Pseudomonas aeruginosa PA01
acaccgaagucgcccgc

SEQ ID NO: 3372480 - RNA, 18 nt, Pseudomonas aeruginosa PA01
acaccgaagucgcccgcc

SEQ ID NO: 3372481 - RNA, 20 nt, Pseudomonas aeruginosa PA01
acaccgaagucgcccgccgg

SEQ ID NO: 3372482 - RNA, 23 nt, Pseudomonas aeruginosa PA01
acaccgaccgcgaguucgccggc

SEQ ID NO: 3372483 - RNA, 16 nt, Pseudomonas aeruginosa PA01
acaccgagcgcaguuc

SEQ ID NO: 3372484 - RNA, 22 nt, Pseudomonas aeruginosa PA01
acaccgagcgcaguucgucgcc

SEQ ID NO: 3372485 - RNA, 21 nt, Pseudomonas aeruginosa PA01
acaccgaugccgaaggcgugg

SEQ ID NO: 3372486 - RNA, 17 nt, Pseudomonas aeruginosa PA01
acaccgcaucgaagcgc

SEQ ID NO: 3372487 - RNA, 14 nt, Pseudomonas aeruginosa PA01
acaccgccagcacc

SEQ ID NO: 3372488 - RNA, 13 nt, Pseudomonas aeruginosa PA01
acaccgcgcgcgc

SEQ ID NO: 3372489 - RNA, 13 nt, Pseudomonas aeruginosa PA01
acaccgcgguguc

SEQ ID NO: 3372490 - RNA, 20 nt, Pseudomonas aeruginosa PA01
acaccgcggugucggugccc

SEQ ID NO: 3372491 - RNA, 19 nt, Pseudomonas aeruginosa PA01
acaccgcugcgccgccguc

SEQ ID NO: 3372492 - RNA, 12 nt, Pseudomonas aeruginosa PA01
acaccggcgccg

SEQ ID NO: 3372493 - RNA, 14 nt, Pseudomonas aeruginosa PA01
acaccggcgccgcc

SEQ ID NO: 3372494 - RNA, 19 nt, Pseudomonas aeruginosa PA01
acaccggcgccgccuggcc

SEQ ID NO: 3372495 - RNA, 15 nt, Pseudomonas aeruginosa PA01
acaccgggccgccgg

SEQ ID NO: 3372496 - RNA, 19 nt, Pseudomonas aeruginosa PA01
acaccgggccgccggcgac

SEQ ID NO: 3372497 - RNA, 17 nt, Pseudomonas aeruginosa PA01
acaccguacucguugac

SEQ ID NO: 3372498 - RNA, 22 nt, Pseudomonas aeruginosa PA01
acagcuuggccagcaggccgag

SEQ ID NO: 3372499 - RNA, 23 nt, Pseudomonas aeruginosa PA01
acagcuugggauggccagccagg

SEQ ID NO: 3372500 - RNA, 17 nt, Pseudomonas aeruginosa PA01
acagcuugucggugauc

SEQ ID NO: 3372501 - RNA, 18 nt, Pseudomonas aeruginosa PA01
acaggaagagcaggcgga

SEQ ID NO: 3372502 - RNA, 20 nt, Pseudomonas aeruginosa PA01
acaggaaucgacccagccgc

SEQ ID NO: 3372503 - RNA, 14 nt, Pseudomonas aeruginosa PA01
acaggaccuucaga

SEQ ID NO: 3372504 - RNA, 16 nt, Pseudomonas aeruginosa PA01
acaggagccaucgcuc

SEQ ID NO: 3372505 - RNA, 22 nt, Pseudomonas aeruginosa PA01
acaggaugcgcuuuuccucgac

SEQ ID NO: 3372506 - RNA, 21 nt, Pseudomonas aeruginosa PA01
acaggccagcucgcccgccuc

SEQ ID NO: 3372507 - RNA, 16 nt, Pseudomonas aeruginosa PA01
acaggccccaggcgau

SEQ ID NO: 3372508 - RNA, 14 nt, Pseudomonas aeruginosa PA01
acaggcccugcagc

SEQ ID NO: 3372509 - RNA, 15 nt, Pseudomonas aeruginosa PA01
acaggccgggcggcg

SEQ ID NO: 3372510 - RNA, 17 nt, Pseudomonas aeruginosa PA01
acaggccgggcggcggc

SEQ ID NO: 3372511 - RNA, 21 nt, Pseudomonas aeruginosa PA01
acaggccggugccgccggcca

SEQ ID NO: 3372512 - RNA, 15 nt, Pseudomonas aeruginosa PA01
acaggccuccagcaa

SEQ ID NO: 3372513 - RNA, 19 nt, Pseudomonas aeruginosa PA01
acaggcgacgguaccaggg

SEQ ID NO: 3372514 - RNA, 22 nt, Pseudomonas aeruginosa PA01
acaggcgauagccgaccaggcc

SEQ ID NO: 3372515 - RNA, 15 nt, Pseudomonas aeruginosa PA01
acaggcgcagcagca

SEQ ID NO: 3372516 - RNA, 23 nt, Pseudomonas aeruginosa PA01
acaggcgcaggggcgagagacug

SEQ ID NO: 3372517 - RNA, 15 nt, Pseudomonas aeruginosa PA01
acaggcgcaugccau

SEQ ID NO: 3372518 - RNA, 12 nt, Pseudomonas aeruginosa PA01
acaggcgcgccu

SEQ ID NO: 3372519 - RNA, 14 nt, Pseudomonas aeruginosa PA01
acaggcgcuucagc

SEQ ID NO: 3372520 - RNA, 17 nt, Pseudomonas aeruginosa PA01
acaggcgcuucagcucg

SEQ ID NO: 3372521 - RNA, 22 nt, Pseudomonas aeruginosa PA01
acaggcggaaggccucgguggc

SEQ ID NO: 3372522 - RNA, 11 nt, Pseudomonas aeruginosa PA01
acaggcggcgg

SEQ ID NO: 3372523 - RNA, 20 nt, Pseudomonas aeruginosa PA01
acaggcggcggaagaagccc

SEQ ID NO: 3372524 - RNA, 16 nt, Pseudomonas aeruginosa PA01
acaggcggcuguugcc

SEQ ID NO: 3372525 - RNA, 15 nt, Pseudomonas aeruginosa PA01
acaggcguaccagcu

SEQ ID NO: 3372526 - RNA, 16 nt, Pseudomonas aeruginosa PA01
acaggcgucccauggc

SEQ ID NO: 3372527 - RNA, 17 nt, Pseudomonas aeruginosa PA01
acaggcgucccuggagc

SEQ ID NO: 3372528 - RNA, 21 nt, Pseudomonas aeruginosa PA01
acaggcgucccuggagcaggg

SEQ ID NO: 3372529 - RNA, 13 nt, Pseudomonas aeruginosa PA01
acaggcuggccag

SEQ ID NO: 3372530 - RNA, 23 nt, Pseudomonas aeruginosa PA01
acaggcuggcgucgacgccgaag

SEQ ID NO: 3372531 - RNA, 13 nt, Pseudomonas aeruginosa PA01
acaggcuggugcc

SEQ ID NO: 3372532 - RNA, 16 nt, Pseudomonas aeruginosa PA01
acaggcugugcgccag

SEQ ID NO: 3372533 - RNA, 18 nt, Pseudomonas aeruginosa PA01
acaggcugugcgccaggc

SEQ ID NO: 3372534 - RNA, 21 nt, Pseudomonas aeruginosa PA01
acaggcugugcgccaggccgg

SEQ ID NO: 3372535 - RNA, 21 nt, Pseudomonas aeruginosa PA01
acaggcuucgagcacuuccca

SEQ ID NO: 3372536 - RNA, 17 nt, Pseudomonas aeruginosa PA01
acagggaacacgcaacc

SEQ ID NO: 3372537 - RNA, 14 nt, Pseudomonas aeruginosa PA01
acagggcaaucaac

SEQ ID NO: 3372538 - RNA, 20 nt, Pseudomonas aeruginosa PA01
acagggcauuggccaucagc

SEQ ID NO: 3372539 - RNA, 19 nt, Pseudomonas aeruginosa PA01
acagggcgucgucgaggcu

SEQ ID NO: 3372540 - RNA, 15 nt, Pseudomonas aeruginosa PA01
acagguacucggccc

SEQ ID NO: 3372541 - RNA, 14 nt, Pseudomonas aeruginosa PA01
acaggucgcggaag

SEQ ID NO: 3372542 - RNA, 22 nt, Pseudomonas aeruginosa PA01
acaggucggccggcagcuccgg

SEQ ID NO: 3372543 - RNA, 17 nt, Pseudomonas aeruginosa PA01
acaggucgguguugcgc

SEQ ID NO: 3372544 - RNA, 18 nt, Pseudomonas aeruginosa PA01
acaggugcugguggcccu

SEQ ID NO: 3372545 - RNA, 20 nt, Pseudomonas aeruginosa PA01
acagucgucgcgcagcuccu

SEQ ID NO: 3372546 - RNA, 13 nt, Pseudomonas aeruginosa PA01
acagugccaggcu

SEQ ID NO: 3372547 - RNA, 17 nt, Pseudomonas aeruginosa PA01
acagugccaggcucgcc

SEQ ID NO: 3372548 - RNA, 20 nt, Pseudomonas aeruginosa PA01
acagugccaggcucgccgcc

SEQ ID NO: 3372549 - RNA, 14 nt, Pseudomonas aeruginosa PA01
acaguucaggcugg

SEQ ID NO: 3372550 - RNA, 14 nt, Pseudomonas aeruginosa PA01
acaguucggcgagu

SEQ ID NO: 3372551 - RNA, 20 nt, Pseudomonas aeruginosa PA01
acaguucggcgguggagcag

SEQ ID NO: 3372552 - RNA, 18 nt, Pseudomonas aeruginosa PA01
acaguugagcugugguug

SEQ ID NO: 3372553 - RNA, 20 nt, Pseudomonas aeruginosa PA01
acaguugccgcagcagcggc

SEQ ID NO: 3372554 - RNA, 21 nt, Pseudomonas aeruginosa PA01
acaguugcggagaauugcguu

SEQ ID NO: 3372555 - RNA, 23 nt, Pseudomonas aeruginosa PA01
acaguuucauggugcccagcagg

SEQ ID NO: 3372556 - RNA, 13 nt, Pseudomonas aeruginosa PA01
acauacaggcgcg

SEQ ID NO: 3372557 - RNA, 22 nt, Pseudomonas aeruginosa PA01
acauagccggcgaaccaggcgg

SEQ ID NO: 3372558 - RNA, 22 nt, Pseudomonas aeruginosa PA01
acaucaacccaccgaccaccau

SEQ ID NO: 3372559 - RNA, 14 nt, Pseudomonas aeruginosa PA01
acaucaccacgcga

SEQ ID NO: 3372560 - RNA, 15 nt, Pseudomonas aeruginosa PA01
acaucagcagcgcca

SEQ ID NO: 3372561 - RNA, 18 nt, Pseudomonas aeruginosa PA01
acaucauccacagcgugc

SEQ ID NO: 3372562 - RNA, 23 nt, Pseudomonas aeruginosa PA01
acauccagcccuggaaaggccuc

SEQ ID NO: 3372563 - RNA, 18 nt, Pseudomonas aeruginosa PA01
acauccaguguggcggcg

SEQ ID NO: 3372564 - RNA, 23 nt, Pseudomonas aeruginosa PA01
acaucccgggguugcccagcagg

SEQ ID NO: 3372565 - RNA, 19 nt, Pseudomonas aeruginosa PA01
acauccugucgaggccucg

SEQ ID NO: 3372566 - RNA, 21 nt, Pseudomonas aeruginosa PA01
acaucgaccaggucgccaugc

SEQ ID NO: 3372567 - RNA, 16 nt, Pseudomonas aeruginosa PA01
acaucgacgcccucgg

SEQ ID NO: 3372568 - RNA, 13 nt, Pseudomonas aeruginosa PA01
acaucgccagcgc

SEQ ID NO: 3372569 - RNA, 14 nt, Pseudomonas aeruginosa PA01
acaucggcgcuccg

SEQ ID NO: 3372570 - RNA, 15 nt, Pseudomonas aeruginosa PA01
acaucgucugcgcgg

SEQ ID NO: 3372571 - RNA, 17 nt, Pseudomonas aeruginosa PA01
acaucgucugcgcggcg

SEQ ID NO: 3372572 - RNA, 20 nt, Pseudomonas aeruginosa PA01
acaucguucauguagcgcuc

SEQ ID NO: 3372573 - RNA, 16 nt, Pseudomonas aeruginosa PA01
acaucguugaacucgc

SEQ ID NO: 3372574 - RNA, 15 nt, Pseudomonas aeruginosa PA01
acaucuccaggccgc

SEQ ID NO: 3372575 - RNA, 18 nt, Pseudomonas aeruginosa PA01
acaucuuccgacuggucc

SEQ ID NO: 3372576 - RNA, 16 nt, Pseudomonas aeruginosa PA01
acaugaaaaagccgga

SEQ ID NO: 3372577 - RNA, 13 nt, Pseudomonas aeruginosa PA01
acaugaagccgcg

SEQ ID NO: 3372578 - RNA, 13 nt, Pseudomonas aeruginosa PA01
acaugacgaagcg

SEQ ID NO: 3372579 - RNA, 20 nt, Pseudomonas aeruginosa PA01
acaugcaccaggcccugcuc

SEQ ID NO: 3372580 - RNA, 17 nt, Pseudomonas aeruginosa PA01
acaugcaccaggccgcc

SEQ ID NO: 3372581 - RNA, 19 nt, Pseudomonas aeruginosa PA01
acaugcaccaggccgccau

SEQ ID NO: 3372582 - RNA, 21 nt, Pseudomonas aeruginosa PA01
acaugcaccaggccgccaugc

SEQ ID NO: 3372583 - RNA, 17 nt, Pseudomonas aeruginosa PA01
acaugcaggccggccuc

SEQ ID NO: 3372584 - RNA, 18 nt, Pseudomonas aeruginosa PA01
acaugcaggccggccucc

SEQ ID NO: 3372585 - RNA, 23 nt, Pseudomonas aeruginosa PA01
acaugcaggcucgacaggucggc

SEQ ID NO: 3372586 - RNA, 22 nt, Pseudomonas aeruginosa PA01
acaugcaggcucucgcgcagca

SEQ ID NO: 3372587 - RNA, 18 nt, Pseudomonas aeruginosa PA01
acaugcaggucgugcagc

SEQ ID NO: 3372588 - RNA, 22 nt, Pseudomonas aeruginosa PA01
acaugcaggucgugcagcccgg

SEQ ID NO: 3372589 - RNA, 18 nt, Pseudomonas aeruginosa PA01
acaugcaguagagcccuc

SEQ ID NO: 3372590 - RNA, 21 nt, Pseudomonas aeruginosa PA01
acaugcgcucguagaacucgc

SEQ ID NO: 3372591 - RNA, 21 nt, Pseudomonas aeruginosa PA01
acaugcggugcggccauugcc

SEQ ID NO: 3372592 - RNA, 22 nt, Pseudomonas aeruginosa PA01
acaugcugcucaguugcaccug

SEQ ID NO: 3372593 - RNA, 17 nt, Pseudomonas aeruginosa PA01
acauggaucaccgccaa

SEQ ID NO: 3372594 - RNA, 22 nt, Pseudomonas aeruginosa PA01
acauggaucggcaacuggcugg

SEQ ID NO: 3372595 - RNA, 13 nt, Pseudomonas aeruginosa PA01
acauggccuucuc

SEQ ID NO: 3372596 - RNA, 15 nt, Pseudomonas aeruginosa PA01
acauggcgucggcga

SEQ ID NO: 3372597 - RNA, 23 nt, Pseudomonas aeruginosa PA01
acauggcgucggcgaucacgucc

SEQ ID NO: 3372598 - RNA, 21 nt, Pseudomonas aeruginosa PA01
acauggucgagaaggcugccg

SEQ ID NO: 3372599 - RNA, 22 nt, Pseudomonas aeruginosa PA01
acauggucuucccagaccccgg

SEQ ID NO: 3372600 - RNA, 12 nt, Pseudomonas aeruginosa PA01
accacuggaugg

SEQ ID NO: 3372601 - RNA, 20 nt, Pseudomonas aeruginosa PA01
accacuuccagguagcccac

SEQ ID NO: 3372602 - RNA, 13 nt, Pseudomonas aeruginosa PA01
accacuucgcgga

SEQ ID NO: 3372603 - RNA, 20 nt, Pseudomonas aeruginosa PA01
accacuucggcgguggggcc

SEQ ID NO: 3372604 - RNA, 23 nt, Pseudomonas aeruginosa PA01
accagaacgaaaaaggcgcgccg

SEQ ID NO: 3372605 - RNA, 14 nt, Pseudomonas aeruginosa PA01
accagaagccggcc

SEQ ID NO: 3372606 - RNA, 23 nt, Pseudomonas aeruginosa PA01
accagaagccggccgggugacgg

SEQ ID NO: 3372607 - RNA, 15 nt, Pseudomonas aeruginosa PA01
accagaaggucuugc

SEQ ID NO: 3372608 - RNA, 15 nt, Pseudomonas aeruginosa PA01
accagaccagcagga

SEQ ID NO: 3372609 - RNA, 14 nt, Pseudomonas aeruginosa PA01
accagacgcagcag

SEQ ID NO: 3372610 - RNA, 14 nt, Pseudomonas aeruginosa PA01
accagacguugcgc

SEQ ID NO: 3372611 - RNA, 16 nt, Pseudomonas aeruginosa PA01
accagacuuccgggcu

SEQ ID NO: 3372612 - RNA, 19 nt, Pseudomonas aeruginosa PA01
accagagacauccggccau

SEQ ID NO: 3372613 - RNA, 14 nt, Pseudomonas aeruginosa PA01
accagagccagccg

SEQ ID NO: 3372614 - RNA, 15 nt, Pseudomonas aeruginosa PA01
accagagccagccgc

SEQ ID NO: 3372615 - RNA, 19 nt, Pseudomonas aeruginosa PA01
accagagccagccgcgagu

SEQ ID NO: 3372616 - RNA, 15 nt, Pseudomonas aeruginosa PA01
accagagccgccgaa

SEQ ID NO: 3372617 - RNA, 13 nt, Pseudomonas aeruginosa PA01
accagaucggcgc

SEQ ID NO: 3372618 - RNA, 15 nt, Pseudomonas aeruginosa PA01
accagaucggcgcgc

SEQ ID NO: 3372619 - RNA, 20 nt, Pseudomonas aeruginosa PA01
accagauggcuggucaggcu

SEQ ID NO: 3372620 - RNA, 20 nt, Pseudomonas aeruginosa PA01
accagcaacgggucgggcuc

SEQ ID NO: 3372621 - RNA, 19 nt, Pseudomonas aeruginosa PA01
accagcaaugcccagcgca

SEQ ID NO: 3372622 - RNA, 20 nt, Pseudomonas aeruginosa PA01
accagcaaugcccagcgcag

SEQ ID NO: 3372623 - RNA, 13 nt, Pseudomonas aeruginosa PA01
accagcaccagcg

SEQ ID NO: 3372624 - RNA, 12 nt, Pseudomonas aeruginosa PA01
accagcaccgca

SEQ ID NO: 3372625 - RNA, 15 nt, Pseudomonas aeruginosa PA01
accagcaccgccugc

SEQ ID NO: 3372626 - RNA, 13 nt, Pseudomonas aeruginosa PA01
accagcaccugcg

SEQ ID NO: 3372627 - RNA, 15 nt, Pseudomonas aeruginosa PA01
accagcaccugcggg

SEQ ID NO: 3372628 - RNA, 19 nt, Pseudomonas aeruginosa PA01
accagcaccugcgggcugc

SEQ ID NO: 3372629 - RNA, 22 nt, Pseudomonas aeruginosa PA01
accagcacggcgaauucgucgc

SEQ ID NO: 3372630 - RNA, 20 nt, Pseudomonas aeruginosa PA01
accagcacguagccgcccuu

SEQ ID NO: 3372631 - RNA, 23 nt, Pseudomonas aeruginosa PA01
accagcacguugccauccagcgc

SEQ ID NO: 3372632 - RNA, 13 nt, Pseudomonas aeruginosa PA01
accagcagccccg

SEQ ID NO: 3372633 - RNA, 20 nt, Pseudomonas aeruginosa PA01
accagcagccccgaggccag

SEQ ID NO: 3372634 - RNA, 18 nt, Pseudomonas aeruginosa PA01
accagcagcgcaccaucc

SEQ ID NO: 3372635 - RNA, 14 nt, Pseudomonas aeruginosa PA01
accagcagcggcag

SEQ ID NO: 3372636 - RNA, 16 nt, Pseudomonas aeruginosa PA01
accagcaggaaaacgc

SEQ ID NO: 3372637 - RNA, 12 nt, Pseudomonas aeruginosa PA01
accagcaggaag

SEQ ID NO: 3372638 - RNA, 14 nt, Pseudomonas aeruginosa PA01
accagcaggaagcc

SEQ ID NO: 3372639 - RNA, 12 nt, Pseudomonas aeruginosa PA01
accagcaggagc

SEQ ID NO: 3372640 - RNA, 20 nt, Pseudomonas aeruginosa PA01
accagcaggaucgagcccug

SEQ ID NO: 3372641 - RNA, 22 nt, Pseudomonas aeruginosa PA01
accagcaggaucgagcccuggu

SEQ ID NO: 3372642 - RNA, 23 nt, Pseudomonas aeruginosa PA01
accagcaggaucgagcccugguc

SEQ ID NO: 3372643 - RNA, 18 nt, Pseudomonas aeruginosa PA01
accagcaggcccaguucg

SEQ ID NO: 3372644 - RNA, 12 nt, Pseudomonas aeruginosa PA01
accagcaggccg

SEQ ID NO: 3372645 - RNA, 14 nt, Pseudomonas aeruginosa PA01
accagcaggccgau

SEQ ID NO: 3372646 - RNA, 23 nt, Pseudomonas aeruginosa PA01
accagcaggcgacaaaucggcau

SEQ ID NO: 3372647 - RNA, 19 nt, Pseudomonas aeruginosa PA01
accagcaggcgcaaccaga

SEQ ID NO: 3372648 - RNA, 12 nt, Pseudomonas aeruginosa PA01
accagcagggcc

SEQ ID NO: 3372649 - RNA, 14 nt, Pseudomonas aeruginosa PA01
accagcagggccag

SEQ ID NO: 3372650 - RNA, 22 nt, Pseudomonas aeruginosa PA01
accagcagggccagcagcgcug

SEQ ID NO: 3372651 - RNA, 15 nt, Pseudomonas aeruginosa PA01
accagcagggccagg

SEQ ID NO: 3372652 - RNA, 20 nt, Pseudomonas aeruginosa PA01
accagcagggccaggccgag

SEQ ID NO: 3372653 - RNA, 11 nt, Pseudomonas aeruginosa PA01
accagcagggu

SEQ ID NO: 3372654 - RNA, 13 nt, Pseudomonas aeruginosa PA01
accagcaggucga

SEQ ID NO: 3372655 - RNA, 16 nt, Pseudomonas aeruginosa PA01
accagcaggucggcgc

SEQ ID NO: 3372656 - RNA, 22 nt, Pseudomonas aeruginosa PA01
accagcaguagugcgacgcagc

SEQ ID NO: 3372657 - RNA, 19 nt, Pseudomonas aeruginosa PA01
accagcaucaccaccggga

SEQ ID NO: 3372658 - RNA, 14 nt, Pseudomonas aeruginosa PA01
accagcauggcggg

SEQ ID NO: 3372659 - RNA, 17 nt, Pseudomonas aeruginosa PA01
accagcauggcgggcca

SEQ ID NO: 3372660 - RNA, 20 nt, Pseudomonas aeruginosa PA01
accagcauguccugcaggcu

SEQ ID NO: 3372661 - RNA, 21 nt, Pseudomonas aeruginosa PA01
accagcauguccugcaggcuc

SEQ ID NO: 3372662 - RNA, 23 nt, Pseudomonas aeruginosa PA01
accagcauguccugcaggcucag

SEQ ID NO: 3372663 - RNA, 13 nt, Pseudomonas aeruginosa PA01
accagccagcccg

SEQ ID NO: 3372664 - RNA, 17 nt, Pseudomonas aeruginosa PA01
accagccaguccggcag

SEQ ID NO: 3372665 - RNA, 18 nt, Pseudomonas aeruginosa PA01
accagccaguccggcagc

SEQ ID NO: 3372666 - RNA, 21 nt, Pseudomonas aeruginosa PA01
accagccagucgagacgccag

SEQ ID NO: 3372667 - RNA, 14 nt, Pseudomonas aeruginosa PA01
accagccagucggc

SEQ ID NO: 3372668 - RNA, 16 nt, Pseudomonas aeruginosa PA01
accagccagucggcgg

SEQ ID NO: 3372669 - RNA, 22 nt, Pseudomonas aeruginosa PA01
accagccagucggcggucuuga

SEQ ID NO: 3372670 - RNA, 14 nt, Pseudomonas aeruginosa PA01
accagcccgcgcga

SEQ ID NO: 3372671 - RNA, 14 nt, Pseudomonas aeruginosa PA01
accagcccggcggc

SEQ ID NO: 3372672 - RNA, 16 nt, Pseudomonas aeruginosa PA01
accagcccggcggcgg

SEQ ID NO: 3372673 - RNA, 14 nt, Pseudomonas aeruginosa PA01
accagcccuggcgc

SEQ ID NO: 3372674 - RNA, 16 nt, Pseudomonas aeruginosa PA01
accagcccuggcgcag

SEQ ID NO: 3372675 - RNA, 22 nt, Pseudomonas aeruginosa PA01
accagccgaacaguucggcggu

SEQ ID NO: 3372676 - RNA, 16 nt, Pseudomonas aeruginosa PA01
accagccgcaggcugc

SEQ ID NO: 3372677 - RNA, 22 nt, Pseudomonas aeruginosa PA01
accagccuugagccuugccccg

SEQ ID NO: 3372678 - RNA, 17 nt, Pseudomonas aeruginosa PA01
accagcgaaagcgucag

SEQ ID NO: 3372679 - RNA, 18 nt, Pseudomonas aeruginosa PA01
accagcgaaagcgucagc

SEQ ID NO: 3372680 - RNA, 22 nt, Pseudomonas aeruginosa PA01
accagcgaaagcgucagcgcgc

SEQ ID NO: 3372681 - RNA, 19 nt, Pseudomonas aeruginosa PA01
accagcgaagugcgcugcu

SEQ ID NO: 3372682 - RNA, 14 nt, Pseudomonas aeruginosa PA01
accagcgaggagcc

SEQ ID NO: 3372683 - RNA, 15 nt, Pseudomonas aeruginosa PA01
accagcgaggagccu

SEQ ID NO: 3372684 - RNA, 21 nt, Pseudomonas aeruginosa PA01
accagcgaggagccuuucacu

SEQ ID NO: 3372685 - RNA, 17 nt, Pseudomonas aeruginosa PA01
accagcgcaagcggcgg

SEQ ID NO: 3372686 - RNA, 13 nt, Pseudomonas aeruginosa PA01
accagcgccaggc

SEQ ID NO: 3372687 - RNA, 16 nt, Pseudomonas aeruginosa PA01
accagcgccaggccgc

SEQ ID NO: 3372688 - RNA, 16 nt, Pseudomonas aeruginosa PA01
accagcgccaggcgcg

SEQ ID NO: 3372689 - RNA, 17 nt, Pseudomonas aeruginosa PA01
accagcgccaggcgcgg

SEQ ID NO: 3372690 - RNA, 12 nt, Pseudomonas aeruginosa PA01
accagcgccgcc

SEQ ID NO: 3372691 - RNA, 15 nt, Pseudomonas aeruginosa PA01
accagcgccgccaac

SEQ ID NO: 3372692 - RNA, 17 nt, Pseudomonas aeruginosa PA01
accagcgccgccaccgc

SEQ ID NO: 3372693 - RNA, 18 nt, Pseudomonas aeruginosa PA01
accagcgccgccaccgcc

SEQ ID NO: 3372694 - RNA, 20 nt, Pseudomonas aeruginosa PA01
accagcgccgccaccgccac

SEQ ID NO: 3372695 - RNA, 15 nt, Pseudomonas aeruginosa PA01
accagcgccgccagg

SEQ ID NO: 3372696 - RNA, 17 nt, Pseudomonas aeruginosa PA01
accagcgccgccaggca

SEQ ID NO: 3372697 - RNA, 18 nt, Pseudomonas aeruginosa PA01
accagcgccgccaggcag

SEQ ID NO: 3372698 - RNA, 14 nt, Pseudomonas aeruginosa PA01
accagcgccgcggc

SEQ ID NO: 3372699 - RNA, 15 nt, Pseudomonas aeruginosa PA01
accagcgccgcggcg

SEQ ID NO: 3372700 - RNA, 12 nt, Pseudomonas aeruginosa PA01
accagcgccggg

SEQ ID NO: 3372701 - RNA, 20 nt, Pseudomonas aeruginosa PA01
accagcgccgucaccagcag

SEQ ID NO: 3372702 - RNA, 22 nt, Pseudomonas aeruginosa PA01
accagcgcgauacccuggccgg

SEQ ID NO: 3372703 - RNA, 22 nt, Pseudomonas aeruginosa PA01
accaggucgcuggcaccggcca

SEQ ID NO: 3372704 - RNA, 19 nt, Pseudomonas aeruginosa PA01
accaggucguggaaggcuu

SEQ ID NO: 3372705 - RNA, 18 nt, Pseudomonas aeruginosa PA01
accagguucugccagagc

SEQ ID NO: 3372706 - RNA, 21 nt, Pseudomonas aeruginosa PA01
accagguucugccagagcgcu

SEQ ID NO: 3372707 - RNA, 20 nt, Pseudomonas aeruginosa PA01
accagguuggccaguuggcc

SEQ ID NO: 3372708 - RNA, 14 nt, Pseudomonas aeruginosa PA01
accaguaccagcaa

SEQ ID NO: 3372709 - RNA, 22 nt, Pseudomonas aeruginosa PA01
accaguacgucgagaccgaccg

SEQ ID NO: 3372710 - RNA, 14 nt, Pseudomonas aeruginosa PA01
accaguagcgacag

SEQ ID NO: 3372711 - RNA, 14 nt, Pseudomonas aeruginosa PA01
accaguagggggug

SEQ ID NO: 3372712 - RNA, 18 nt, Pseudomonas aeruginosa PA01
accaguagggggugaagc

SEQ ID NO: 3372713 - RNA, 22 nt, Pseudomonas aeruginosa PA01
accaguagggggugaagcgcag

SEQ ID NO: 3372714 - RNA, 16 nt, Pseudomonas aeruginosa PA01
accagucccuggccgg

SEQ ID NO: 3372715 - RNA, 18 nt, Pseudomonas aeruginosa PA01
accagucccuggccggcg

SEQ ID NO: 3372716 - RNA, 19 nt, Pseudomonas aeruginosa PA01
accagucccuggccggcga

SEQ ID NO: 3372717 - RNA, 15 nt, Pseudomonas aeruginosa PA01
accagucggccguug

SEQ ID NO: 3372718 - RNA, 15 nt, Pseudomonas aeruginosa PA01
accagugcaccgccg

SEQ ID NO: 3372719 - RNA, 23 nt, Pseudomonas aeruginosa PA01
accagugcaccgccggguacagc

SEQ ID NO: 3372720 - RNA, 14 nt, Pseudomonas aeruginosa PA01
accagugccgcggu

SEQ ID NO: 3372721 - RNA, 21 nt, Pseudomonas aeruginosa PA01
accaguucagcgcgcucgcug

SEQ ID NO: 3372722 - RNA, 15 nt, Pseudomonas aeruginosa PA01
accaguucgccgccg

SEQ ID NO: 3372723 - RNA, 18 nt, Pseudomonas aeruginosa PA01
accaguucgccgccgcgc

SEQ ID NO: 3372724 - RNA, 16 nt, Pseudomonas aeruginosa PA01
accaguugcccgagug

SEQ ID NO: 3372725 - RNA, 22 nt, Pseudomonas aeruginosa PA01
accaguugcccgagugccggcg

SEQ ID NO: 3372726 - RNA, 23 nt, Pseudomonas aeruginosa PA01
accaguugcccgagugccggcgc

SEQ ID NO: 3372727 - RNA, 18 nt, Pseudomonas aeruginosa PA01
accaguugcucgcuccga

SEQ ID NO: 3372728 - RNA, 21 nt, Pseudomonas aeruginosa PA01
accaguugcucgcuccgagca

SEQ ID NO: 3372729 - RNA, 23 nt, Pseudomonas aeruginosa PA01
accaguuucuucgcgugggccag

SEQ ID NO: 3372730 - RNA, 17 nt, Pseudomonas aeruginosa PA01
accauagcgagccgcgc

SEQ ID NO: 3372731 - RNA, 21 nt, Pseudomonas aeruginosa PA01
accauagcgagccgcgcugcu

SEQ ID NO: 3372732 - RNA, 11 nt, Pseudomonas aeruginosa PA01
accaucaccag

SEQ ID NO: 3372733 - RNA, 14 nt, Pseudomonas aeruginosa PA01
accaucaccagcgc

SEQ ID NO: 3372734 - RNA, 23 nt, Pseudomonas aeruginosa PA01
accaucaccgacagucccaggcc

SEQ ID NO: 3372735 - RNA, 14 nt, Pseudomonas aeruginosa PA01
accaucaccgccau

SEQ ID NO: 3372736 - RNA, 18 nt, Pseudomonas aeruginosa PA01
accaucaccgccaucagc

SEQ ID NO: 3372737 - RNA, 16 nt, Pseudomonas aeruginosa PA01
accaucacgucgcgca

SEQ ID NO: 3372738 - RNA, 13 nt, Pseudomonas aeruginosa PA01
accaucagccagc

SEQ ID NO: 3372739 - RNA, 13 nt, Pseudomonas aeruginosa PA01
accauccagccug

SEQ ID NO: 3372740 - RNA, 23 nt, Pseudomonas aeruginosa PA01
accauccagccugcgcuguucgg

SEQ ID NO: 3372741 - RNA, 14 nt, Pseudomonas aeruginosa PA01
accauccgccgcag

SEQ ID NO: 3372742 - RNA, 12 nt, Pseudomonas aeruginosa PA01
accaucgccggc

SEQ ID NO: 3372743 - RNA, 13 nt, Pseudomonas aeruginosa PA01
accaucgccggcg

SEQ ID NO: 3372744 - RNA, 17 nt, Pseudomonas aeruginosa PA01
accaucgcggcgauggc

SEQ ID NO: 3372745 - RNA, 22 nt, Pseudomonas aeruginosa PA01
accaucgcggcgauggccgcca

SEQ ID NO: 3372746 - RNA, 23 nt, Pseudomonas aeruginosa PA01
accaucgcggcgauggccgccag

SEQ ID NO: 3372747 - RNA, 11 nt, Pseudomonas aeruginosa PA01
accaucggcac

SEQ ID NO: 3372748 - RNA, 12 nt, Pseudomonas aeruginosa PA01
accaucggcggc

SEQ ID NO: 3372749 - RNA, 13 nt, Pseudomonas aeruginosa PA01
accaucggcggcg

SEQ ID NO: 3372750 - RNA, 14 nt, Pseudomonas aeruginosa PA01
accaucggcggcgg

SEQ ID NO: 3372751 - RNA, 17 nt, Pseudomonas aeruginosa PA01
accaucggcggcggccc

SEQ ID NO: 3372752 - RNA, 18 nt, Pseudomonas aeruginosa PA01
accaucgucgcuuccggc

SEQ ID NO: 3372753 - RNA, 18 nt, Pseudomonas aeruginosa PA01
accaucuuuuccugcugg

SEQ ID NO: 3372754 - RNA, 23 nt, Pseudomonas aeruginosa PA01
accaucuuuuccugcuggcgaau

SEQ ID NO: 3372755 - RNA, 20 nt, Pseudomonas aeruginosa PA01
accaugaucaucggcuggcc

SEQ ID NO: 3372756 - RNA, 21 nt, Pseudomonas aeruginosa PA01
accaugaucaucggcuggccg

SEQ ID NO: 3372757 - RNA, 20 nt, Pseudomonas aeruginosa PA01
accaugccuuccaccggcgu

SEQ ID NO: 3372758 - RNA, 21 nt, Pseudomonas aeruginosa PA01
accaugcggcuacucgcccga

SEQ ID NO: 3372759 - RNA, 12 nt, Pseudomonas aeruginosa PA01
accauggucuuu

SEQ ID NO: 3372760 - RNA, 22 nt, Pseudomonas aeruginosa PA01
accaugguguuggcggccuggg

SEQ ID NO: 3372761 - RNA, 18 nt, Pseudomonas aeruginosa PA01
accauguucaccagcgcu

SEQ ID NO: 3372762 - RNA, 13 nt, Pseudomonas aeruginosa PA01
accauucaugggc

SEQ ID NO: 3372763 - RNA, 17 nt, Pseudomonas aeruginosa PA01
accauugcggcccgcca

SEQ ID NO: 3372764 - RNA, 21 nt, Pseudomonas aeruginosa PA01
accauugcggcccgccacaga

SEQ ID NO: 3372765 - RNA, 13 nt, Pseudomonas aeruginosa PA01
acccaaucacaac

SEQ ID NO: 3372766 - RNA, 17 nt, Pseudomonas aeruginosa PA01
acccacaggguggcggg

SEQ ID NO: 3372767 - RNA, 22 nt, Pseudomonas aeruginosa PA01
acccacauggcgguccagguca

SEQ ID NO: 3372768 - RNA, 17 nt, Pseudomonas aeruginosa PA01
acccaccgaccaccauc

SEQ ID NO: 3372769 - RNA, 20 nt, Pseudomonas aeruginosa PA01
acccaccgaccaccaucacc

SEQ ID NO: 3372770 - RNA, 19 nt, Pseudomonas aeruginosa PA01
acccacgcauuggcuucgc

SEQ ID NO: 3372771 - RNA, 22 nt, Pseudomonas aeruginosa PA01
acccacuccccagcaggcaggc

SEQ ID NO: 3372772 - RNA, 15 nt, Pseudomonas aeruginosa PA01
acccacuccggcagg

SEQ ID NO: 3372773 - RNA, 15 nt, Pseudomonas aeruginosa PA01
acccacuugaacacc

SEQ ID NO: 3372774 - RNA, 17 nt, Pseudomonas aeruginosa PA01
acccagaagccgaccuu

SEQ ID NO: 3372775 - RNA, 13 nt, Pseudomonas aeruginosa PA01
acccagacaggcc

SEQ ID NO: 3372776 - RNA, 19 nt, Pseudomonas aeruginosa PA01
acccagacaggccugugga

SEQ ID NO: 3372777 - RNA, 17 nt, Pseudomonas aeruginosa PA01
acccagaccugccgccc

SEQ ID NO: 3372778 - RNA, 21 nt, Pseudomonas aeruginosa PA01
acccagaccugccgcccggcc

SEQ ID NO: 3372779 - RNA, 22 nt, Pseudomonas aeruginosa PA01
acccagaccugccgcccggcca

SEQ ID NO: 3372780 - RNA, 21 nt, Pseudomonas aeruginosa PA01
acccagaccuuccagccgcgc

SEQ ID NO: 3372781 - RNA, 14 nt, Pseudomonas aeruginosa PA01
acccagagcaccag

SEQ ID NO: 3372782 - RNA, 16 nt, Pseudomonas aeruginosa PA01
acccagagccgcucgg

SEQ ID NO: 3372783 - RNA, 19 nt, Pseudomonas aeruginosa PA01
acccagccauugagcgcgc

SEQ ID NO: 3372784 - RNA, 22 nt, Pseudomonas aeruginosa PA01
acccagccauugagcgcgccca

SEQ ID NO: 3372785 - RNA, 14 nt, Pseudomonas aeruginosa PA01
acccagccgcacgc

SEQ ID NO: 3372786 - RNA, 13 nt, Pseudomonas aeruginosa PA01
acccagccgcggc

SEQ ID NO: 3372787 - RNA, 16 nt, Pseudomonas aeruginosa PA01
acccagcgaagcuucu

SEQ ID NO: 3372788 - RNA, 13 nt, Pseudomonas aeruginosa PA01
acccagcgcacgc

SEQ ID NO: 3372789 - RNA, 21 nt, Pseudomonas aeruginosa PA01
acccagcuugcuggcguagaa

SEQ ID NO: 3372790 - RNA, 21 nt, Pseudomonas aeruginosa PA01
acccaggauuuguccgcgcca

SEQ ID NO: 3372791 - RNA, 15 nt, Pseudomonas aeruginosa PA01
acccaggccacgccc

SEQ ID NO: 3372792 - RNA, 18 nt, Pseudomonas aeruginosa PA01
acccaggcccagccggug

SEQ ID NO: 3372793 - RNA, 15 nt, Pseudomonas aeruginosa PA01
acccaggccgacagc

SEQ ID NO: 3372794 - RNA, 16 nt, Pseudomonas aeruginosa PA01
acccaggccgcgcagc

SEQ ID NO: 3372795 - RNA, 13 nt, Pseudomonas aeruginosa PA01
acccaggccuggg

SEQ ID NO: 3372796 - RNA, 16 nt, Pseudomonas aeruginosa PA01
acccaggccugggugu

SEQ ID NO: 3372797 - RNA, 22 nt, Pseudomonas aeruginosa PA01
acccaggccuggguguugucgg

SEQ ID NO: 3372798 - RNA, 15 nt, Pseudomonas aeruginosa PA01
acccagggcgcugcc

SEQ ID NO: 3372799 - RNA, 15 nt, Pseudomonas aeruginosa PA01
acccagggugcgccg

SEQ ID NO: 3372800 - RNA, 20 nt, Pseudomonas aeruginosa PA01
acccaggugcgcaggcgcuc

SEQ ID NO: 3372801 - RNA, 15 nt, Pseudomonas aeruginosa PA01
acccagguggucgac

SEQ ID NO: 3372802 - RNA, 21 nt, Pseudomonas aeruginosa PA01
acccagguucuggucgccgac

SEQ ID NO: 3372803 - RNA, 23 nt, Pseudomonas aeruginosa PA01
acccagucuucgcuggcgaacgg

SEQ ID NO: 3372804 - RNA, 18 nt, Pseudomonas aeruginosa PA01
acccaguugggccaggag

SEQ ID NO: 3372805 - RNA, 21 nt, Pseudomonas aeruginosa PA01
acccgcggcagguccugggua

SEQ ID NO: 3372806 - RNA, 23 nt, Pseudomonas aeruginosa PA01
acccgcggcgagguugcccacgg

SEQ ID NO: 3372807 - RNA, 16 nt, Pseudomonas aeruginosa PA01
acccgcggcgcgccuu

SEQ ID NO: 3372808 - RNA, 20 nt, Pseudomonas aeruginosa PA01
acccgcgucccuugcgggua

SEQ ID NO: 3372809 - RNA, 14 nt, Pseudomonas aeruginosa PA01
acccgcuccgcggc

SEQ ID NO: 3372810 - RNA, 19 nt, Pseudomonas aeruginosa PA01
acccgcuccgucgcuucgc

SEQ ID NO: 3372811 - RNA, 13 nt, Pseudomonas aeruginosa PA01
acccgcucgccgg

SEQ ID NO: 3372812 - RNA, 15 nt, Pseudomonas aeruginosa PA01
acccgcucgccggga

SEQ ID NO: 3372813 - RNA, 23 nt, Pseudomonas aeruginosa PA01
acccgcucgccgggaaucgccag

SEQ ID NO: 3372814 - RNA, 13 nt, Pseudomonas aeruginosa PA01
acccgcucggccu

SEQ ID NO: 3372815 - RNA, 22 nt, Pseudomonas aeruginosa PA01
acccgcucggccuuguccggca

SEQ ID NO: 3372816 - RNA, 16 nt, Pseudomonas aeruginosa PA01
acccgcugcaccagcu

SEQ ID NO: 3372817 - RNA, 16 nt, Pseudomonas aeruginosa PA01
acccgcugcuggaugg

SEQ ID NO: 3372818 - RNA, 14 nt, Pseudomonas aeruginosa PA01
acccgcuucgucgg

SEQ ID NO: 3372819 - RNA, 13 nt, Pseudomonas aeruginosa PA01
acccggacagccu

SEQ ID NO: 3372820 - RNA, 19 nt, Pseudomonas aeruginosa PA01
acccggaucaugguaugga

SEQ ID NO: 3372821 - RNA, 13 nt, Pseudomonas aeruginosa PA01
acccggcagggcc

SEQ ID NO: 3372822 - RNA, 15 nt, Pseudomonas aeruginosa PA01
acccggcagggccag

SEQ ID NO: 3372823 - RNA, 17 nt, Pseudomonas aeruginosa PA01
acccggccagcccggcc

SEQ ID NO: 3372824 - RNA, 14 nt, Pseudomonas aeruginosa PA01
acccggccaggccc

SEQ ID NO: 3372825 - RNA, 16 nt, Pseudomonas aeruginosa PA01
acccggccauggcggg

SEQ ID NO: 3372826 - RNA, 22 nt, Pseudomonas aeruginosa PA01
acccggcccagcguucggcgcu

SEQ ID NO: 3372827 - RNA, 14 nt, Pseudomonas aeruginosa PA01
acccggcccaggcc

SEQ ID NO: 3372828 - RNA, 13 nt, Pseudomonas aeruginosa PA01
acccggcccaugg

SEQ ID NO: 3372829 - RNA, 19 nt, Pseudomonas aeruginosa PA01
acccggccgaccaggugcu

SEQ ID NO: 3372830 - RNA, 24 nt, Pseudomonas aeruginosa PA01
acccggccgccuuccucggccgcc

SEQ ID NO: 3372831 - RNA, 15 nt, Pseudomonas aeruginosa PA01
acccggccugggccg

SEQ ID NO: 3372832 - RNA, 23 nt, Pseudomonas aeruginosa PA01
acccggcgcacgccggccucgcg

SEQ ID NO: 3372833 - RNA, 11 nt, Pseudomonas aeruginosa PA01
acccggcgccc

SEQ ID NO: 3372834 - RNA, 17 nt, Pseudomonas aeruginosa PA01
acccggcgccccggccc

SEQ ID NO: 3372835 - RNA, 15 nt, Pseudomonas aeruginosa PA01
acccggcgcccggcg

SEQ ID NO: 3372836 - RNA, 16 nt, Pseudomonas aeruginosa PA01
acccggcgcccggcgc

SEQ ID NO: 3372837 - RNA, 22 nt, Pseudomonas aeruginosa PA01
acccggcgccgcuagggcgccc

SEQ ID NO: 3372838 - RNA, 23 nt, Pseudomonas aeruginosa PA01
acccggcgcggcgcagccagagc

SEQ ID NO: 3372839 - RNA, 13 nt, Pseudomonas aeruginosa PA01
acccggcgcuggc

SEQ ID NO: 3372840 - RNA, 17 nt, Pseudomonas aeruginosa PA01
acccggcgguccgccgc

SEQ ID NO: 3372841 - RNA, 18 nt, Pseudomonas aeruginosa PA01
acccggcugcaugccggg

SEQ ID NO: 3372842 - RNA, 22 nt, Pseudomonas aeruginosa PA01
acccgggcaacugaucagccgg

SEQ ID NO: 3372843 - RNA, 17 nt, Pseudomonas aeruginosa PA01
acccgggcccaagccga

SEQ ID NO: 3372844 - RNA, 19 nt, Pseudomonas aeruginosa PA01
acccgggcccaagccgagc

SEQ ID NO: 3372845 - RNA, 21 nt, Pseudomonas aeruginosa PA01
acccgggcccaagccgagcgg

SEQ ID NO: 3372846 - RNA, 23 nt, Pseudomonas aeruginosa PA01
acccgggcccaagccgagcggca

SEQ ID NO: 3372847 - RNA, 16 nt, Pseudomonas aeruginosa PA01
acccgggcgaccugcu

SEQ ID NO: 3372848 - RNA, 17 nt, Pseudomonas aeruginosa PA01
acccgggcgaccugcuc

SEQ ID NO: 3372849 - RNA, 19 nt, Pseudomonas aeruginosa PA01
acccgggcgaccugcucgc

SEQ ID NO: 3372850 - RNA, 20 nt, Pseudomonas aeruginosa PA01
acccgggcgaccugcucgcg

SEQ ID NO: 3372851 - RNA, 14 nt, Pseudomonas aeruginosa PA01
acccgggucaggcc

SEQ ID NO: 3372852 - RNA, 21 nt, Pseudomonas aeruginosa PA01
acccgggugccuuccgcgccc

SEQ ID NO: 3372853 - RNA, 19 nt, Pseudomonas aeruginosa PA01
acccggguuuccugcccga

SEQ ID NO: 3372854 - RNA, 21 nt, Pseudomonas aeruginosa PA01
acccggguuuccugcccgacc

SEQ ID NO: 3372855 - RNA, 16 nt, Pseudomonas aeruginosa PA01
acccgguacagcgccu

SEQ ID NO: 3372856 - RNA, 21 nt, Pseudomonas aeruginosa PA01
acccgguccugcaacuggaag

SEQ ID NO: 3372857 - RNA, 16 nt, Pseudomonas aeruginosa PA01
acccggucgcgcugga

SEQ ID NO: 3372858 - RNA, 19 nt, Pseudomonas aeruginosa PA01
acccggucgcgcuggaccu

SEQ ID NO: 3372859 - RNA, 16 nt, Pseudomonas aeruginosa PA01
acccggucgcugacca

SEQ ID NO: 3372860 - RNA, 23 nt, Pseudomonas aeruginosa PA01
acccggucggccuguucgcccaa

SEQ ID NO: 3372861 - RNA, 16 nt, Pseudomonas aeruginosa PA01
acccgguuaccggcga

SEQ ID NO: 3372862 - RNA, 23 nt, Pseudomonas aeruginosa PA01
acccgguuaccggcgaccaccgc

SEQ ID NO: 3372863 - RNA, 19 nt, Pseudomonas aeruginosa PA01
acccgguucucgccccagc

SEQ ID NO: 3372864 - RNA, 14 nt, Pseudomonas aeruginosa PA01
acccguaccccgac

SEQ ID NO: 3372865 - RNA, 16 nt, Pseudomonas aeruginosa PA01
acccgugcgccccagc

SEQ ID NO: 3372866 - RNA, 19 nt, Pseudomonas aeruginosa PA01
acccgugcgccccagcuca

SEQ ID NO: 3372867 - RNA, 16 nt, Pseudomonas aeruginosa PA01
acccgugguccgccag

SEQ ID NO: 3372868 - RNA, 17 nt, Pseudomonas aeruginosa PA01
acccgugguccgccagc

SEQ ID NO: 3372869 - RNA, 18 nt, Pseudomonas aeruginosa PA01
acccgugguccgccagca

SEQ ID NO: 3372870 - RNA, 20 nt, Pseudomonas aeruginosa PA01
acccgugguccgccagcagg

SEQ ID NO: 3372871 - RNA, 22 nt, Pseudomonas aeruginosa PA01
acccgugguccgccagcaggcg

SEQ ID NO: 3372872 - RNA, 19 nt, Pseudomonas aeruginosa PA01
acccguucgccggccucca

SEQ ID NO: 3372873 - RNA, 22 nt, Pseudomonas aeruginosa PA01
acccguugccgaccgagcagcg

SEQ ID NO: 3372874 - RNA, 16 nt, Pseudomonas aeruginosa PA01
acccuagggucggcgu

SEQ ID NO: 3372875 - RNA, 20 nt, Pseudomonas aeruginosa PA01
acccucaggggugcagcccu

SEQ ID NO: 3372876 - RNA, 16 nt, Pseudomonas aeruginosa PA01
acccucaggucggcgc

SEQ ID NO: 3372877 - RNA, 18 nt, Pseudomonas aeruginosa PA01
acccucagucgcccccac

SEQ ID NO: 3372878 - RNA, 19 nt, Pseudomonas aeruginosa PA01
acccucauggaaaccccgg

SEQ ID NO: 3372879 - RNA, 14 nt, Pseudomonas aeruginosa PA01
acccucggcgaggg

SEQ ID NO: 3372880 - RNA, 19 nt, Pseudomonas aeruginosa PA01
acccucggcuucguccugc

SEQ ID NO: 3372881 - RNA, 16 nt, Pseudomonas aeruginosa PA01
acccucggugcggccg

SEQ ID NO: 3372882 - RNA, 17 nt, Pseudomonas aeruginosa PA01
acccucggugcggccga

SEQ ID NO: 3372883 - RNA, 15 nt, Pseudomonas aeruginosa PA01
acccucuccccaacc

SEQ ID NO: 3372884 - RNA, 14 nt, Pseudomonas aeruginosa PA01
acccugaccgcgag

SEQ ID NO: 3372885 - RNA, 20 nt, Pseudomonas aeruginosa PA01
acccugaccgcgagcgccgc

SEQ ID NO: 3372886 - RNA, 16 nt, Pseudomonas aeruginosa PA01
acccugccccagcauc

SEQ ID NO: 3372887 - RNA, 14 nt, Pseudomonas aeruginosa PA01
acccugccgcgccg

SEQ ID NO: 3372888 - RNA, 13 nt, Pseudomonas aeruginosa PA01
acccugcgcgagg

SEQ ID NO: 3372889 - RNA, 18 nt, Pseudomonas aeruginosa PA01
acccugcugcugcucagc

SEQ ID NO: 3372890 - RNA, 22 nt, Pseudomonas aeruginosa PA01
acccugcugcugcucagcgcgc

SEQ ID NO: 3372891 - RNA, 14 nt, Pseudomonas aeruginosa PA01
acccugcuggccgg

SEQ ID NO: 3372892 - RNA, 14 nt, Pseudomonas aeruginosa PA01
acccugcugggcgg

SEQ ID NO: 3372893 - RNA, 17 nt, Pseudomonas aeruginosa PA01
acccuggacccgggccu

SEQ ID NO: 3372894 - RNA, 20 nt, Pseudomonas aeruginosa PA01
acccuggccacguccagcgg

SEQ ID NO: 3372895 - RNA, 23 nt, Pseudomonas aeruginosa PA01
acccuggccgcgcggcuugccgg

SEQ ID NO: 3372896 - RNA, 19 nt, Pseudomonas aeruginosa PA01
acccuggccggccucggcg

SEQ ID NO: 3372897 - RNA, 20 nt, Pseudomonas aeruginosa PA01
acccuggccggccucggcgg

SEQ ID NO: 3372898 - RNA, 15 nt, Pseudomonas aeruginosa PA01
acccuggcgccgacc

SEQ ID NO: 3372899 - RNA, 17 nt, Pseudomonas aeruginosa PA01
acccugggagccgccgg

SEQ ID NO: 3372900 - RNA, 18 nt, Pseudomonas aeruginosa PA01
acccugggagccgccgga

SEQ ID NO: 3372901 - RNA, 21 nt, Pseudomonas aeruginosa PA01
acccuguccccucacggcgcg

SEQ ID NO: 3372902 - RNA, 20 nt, Pseudomonas aeruginosa PA01
acccuuccagcguguggcga

SEQ ID NO: 3372903 - RNA, 20 nt, Pseudomonas aeruginosa PA01
acccuugaaacugcgaugga

SEQ ID NO: 3372904 - RNA, 16 nt, Pseudomonas aeruginosa PA01
acccuuggagccgccc

SEQ ID NO: 3372905 - RNA, 14 nt, Pseudomonas aeruginosa PA01
accgaaacagggcg

SEQ ID NO: 3372906 - RNA, 23 nt, Pseudomonas aeruginosa PA01
accgaacagcgcgccaucggcgg

SEQ ID NO: 3372907 - RNA, 20 nt, Pseudomonas aeruginosa PA01
accgcccgccucaggccggg

SEQ ID NO: 3372908 - RNA, 21 nt, Pseudomonas aeruginosa PA01
accgcccugcaacacguagcg

SEQ ID NO: 3372909 - RNA, 14 nt, Pseudomonas aeruginosa PA01
accgcccugcgcga

SEQ ID NO: 3372910 - RNA, 18 nt, Pseudomonas aeruginosa PA01
accgcccugcgcgauccc

SEQ ID NO: 3372911 - RNA, 16 nt, Pseudomonas aeruginosa PA01
accgccgagggcgcca

SEQ ID NO: 3372912 - RNA, 22 nt, Pseudomonas aeruginosa PA01
accgccgagggcgccaggugca

SEQ ID NO: 3372913 - RNA, 13 nt, Pseudomonas aeruginosa PA01
accgccgccagca

SEQ ID NO: 3372914 - RNA, 14 nt, Pseudomonas aeruginosa PA01
accgccgccagcaa

SEQ ID NO: 3372915 - RNA, 18 nt, Pseudomonas aeruginosa PA01
accgccgccagcaacagu

SEQ ID NO: 3372916 - RNA, 17 nt, Pseudomonas aeruginosa PA01
accgccgccgcaaccgc

SEQ ID NO: 3372917 - RNA, 15 nt, Pseudomonas aeruginosa PA01
accgccgccgccuug

SEQ ID NO: 3372918 - RNA, 20 nt, Pseudomonas aeruginosa PA01
accgccgccuggguggcgac

SEQ ID NO: 3372919 - RNA, 21 nt, Pseudomonas aeruginosa PA01
accgccggaaccuguccgaac

SEQ ID NO: 3372920 - RNA, 23 nt, Pseudomonas aeruginosa PA01
accgccggcagugugccgcccug

SEQ ID NO: 3372921 - RNA, 13 nt, Pseudomonas aeruginosa PA01
accgccggccucg

SEQ ID NO: 3372922 - RNA, 20 nt, Pseudomonas aeruginosa PA01
accgccggccucgcugccgc

SEQ ID NO: 3372923 - RNA, 14 nt, Pseudomonas aeruginosa PA01
accgccggcggcga

SEQ ID NO: 3372924 - RNA, 16 nt, Pseudomonas aeruginosa PA01
accgccggguacagcg

SEQ ID NO: 3372925 - RNA, 15 nt, Pseudomonas aeruginosa PA01
accgccguagccguc

SEQ ID NO: 3372926 - RNA, 19 nt, Pseudomonas aeruginosa PA01
accgccucgaccaucggcg

SEQ ID NO: 3372927 - RNA, 21 nt, Pseudomonas aeruginosa PA01
accgccucgaccaucggcggc

SEQ ID NO: 3372928 - RNA, 13 nt, Pseudomonas aeruginosa PA01
accgccucgaccc

SEQ ID NO: 3372929 - RNA, 19 nt, Pseudomonas aeruginosa PA01
accgccucggagaacagca

SEQ ID NO: 3372930 - RNA, 22 nt, Pseudomonas aeruginosa PA01
accgccucggagaacagcagcg

SEQ ID NO: 3372931 - RNA, 17 nt, Pseudomonas aeruginosa PA01
accgccugcagcaccac

SEQ ID NO: 3372932 - RNA, 21 nt, Pseudomonas aeruginosa PA01
accgccugcagcaccaccucg

SEQ ID NO: 3372933 - RNA, 23 nt, Pseudomonas aeruginosa PA01
accgccugcagcaccaccucgcc

SEQ ID NO: 3372934 - RNA, 21 nt, Pseudomonas aeruginosa PA01
accgccugccagaccguggcg

SEQ ID NO: 3372935 - RNA, 20 nt, Pseudomonas aeruginosa PA01
accgccugcucgcggcuggc

SEQ ID NO: 3372936 - RNA, 14 nt, Pseudomonas aeruginosa PA01
accgccuggaccag

SEQ ID NO: 3372937 - RNA, 13 nt, Pseudomonas aeruginosa PA01
accgccuggcgca

SEQ ID NO: 3372938 - RNA, 17 nt, Pseudomonas aeruginosa PA01
accgccuggucgaucuc

SEQ ID NO: 3372939 - RNA, 14 nt, Pseudomonas aeruginosa PA01
accgccuggucgcc

SEQ ID NO: 3372940 - RNA, 16 nt, Pseudomonas aeruginosa PA01
accgccuggucgccgg

SEQ ID NO: 3372941 - RNA, 22 nt, Pseudomonas aeruginosa PA01
accgccuucgcguucgcuccgg

SEQ ID NO: 3372942 - RNA, 20 nt, Pseudomonas aeruginosa PA01
accgccuuggcaucgccgcc

SEQ ID NO: 3372943 - RNA, 21 nt, Pseudomonas aeruginosa PA01
accgccuuggcaucgccgccc

SEQ ID NO: 3372944 - RNA, 21 nt, Pseudomonas aeruginosa PA01
accgcgaagcgguuagccggc

SEQ ID NO: 3372945 - RNA, 16 nt, Pseudomonas aeruginosa PA01
accgcgaauccgcggc

SEQ ID NO: 3372946 - RNA, 20 nt, Pseudomonas aeruginosa PA01
accgcgaauccgcggcccug

SEQ ID NO: 3372947 - RNA, 20 nt, Pseudomonas aeruginosa PA01
accgcgaauggcagcaggca

SEQ ID NO: 3372948 - RNA, 15 nt, Pseudomonas aeruginosa PA01
accgcgacaacccug

SEQ ID NO: 3372949 - RNA, 19 nt, Pseudomonas aeruginosa PA01
accgcgacaacccuguccc

SEQ ID NO: 3372950 - RNA, 13 nt, Pseudomonas aeruginosa PA01
accgcgacgcgcu

SEQ ID NO: 3372951 - RNA, 14 nt, Pseudomonas aeruginosa PA01
accgcgacgcgcug

SEQ ID NO: 3372952 - RNA, 15 nt, Pseudomonas aeruginosa PA01
accgcgacgcgcugg

SEQ ID NO: 3372953 - RNA, 16 nt, Pseudomonas aeruginosa PA01
accgcgacgcgcugga

SEQ ID NO: 3372954 - RNA, 20 nt, Pseudomonas aeruginosa PA01
accgcgagcaugcucacugc

SEQ ID NO: 3372955 - RNA, 11 nt, Pseudomonas aeruginosa PA01
accgcgagcgg

SEQ ID NO: 3372956 - RNA, 18 nt, Pseudomonas aeruginosa PA01
accgcgcaaaccggcagc

SEQ ID NO: 3372957 - RNA, 23 nt, Pseudomonas aeruginosa PA01
accgcgcaaaccggcagcaucuc

SEQ ID NO: 3372958 - RNA, 21 nt, Pseudomonas aeruginosa PA01
accgcgcagaugaucgccacc

SEQ ID NO: 3372959 - RNA, 23 nt, Pseudomonas aeruginosa PA01
accgcgcagaugaucgccaccgg

SEQ ID NO: 3372960 - RNA, 17 nt, Pseudomonas aeruginosa PA01
accgcgcauggcggcga

SEQ ID NO: 3372961 - RNA, 19 nt, Pseudomonas aeruginosa PA01
accgcgcauggcggcgacc

SEQ ID NO: 3372962 - RNA, 20 nt, Pseudomonas aeruginosa PA01
accgcgcauggcggcgaccg

SEQ ID NO: 3372963 - RNA, 23 nt, Pseudomonas aeruginosa PA01
accgcgcauggcggcgaccgcau

SEQ ID NO: 3372964 - RNA, 13 nt, Pseudomonas aeruginosa PA01
accgcgccgcgcu

SEQ ID NO: 3372965 - RNA, 23 nt, Pseudomonas aeruginosa PA01
accgcgccgcgcuuggccuugcc

SEQ ID NO: 3372966 - RNA, 13 nt, Pseudomonas aeruginosa PA01
accgcgccggcga

SEQ ID NO: 3372967 - RNA, 15 nt, Pseudomonas aeruginosa PA01
accgcgccgggaagc

SEQ ID NO: 3372968 - RNA, 23 nt, Pseudomonas aeruginosa PA01
accgcgccgggaagcaccgacuc

SEQ ID NO: 3372969 - RNA, 16 nt, Pseudomonas aeruginosa PA01
accgcgccuuccagcc

SEQ ID NO: 3372970 - RNA, 22 nt, Pseudomonas aeruginosa PA01
accgcgcgauaaaaagccccgc

SEQ ID NO: 3372971 - RNA, 16 nt, Pseudomonas aeruginosa PA01
accgcgcgccugcaac

SEQ ID NO: 3372972 - RNA, 21 nt, Pseudomonas aeruginosa PA01
accgcgcgccugcaacgccag

SEQ ID NO: 3372973 - RNA, 20 nt, Pseudomonas aeruginosa PA01
accgcgcgcgcaaggccgaa

SEQ ID NO: 3372974 - RNA, 22 nt, Pseudomonas aeruginosa PA01
accgcgcgcgcaaggccgaaga

SEQ ID NO: 3372975 - RNA, 19 nt, Pseudomonas aeruginosa PA01
accgcgcggcacaggcggc

SEQ ID NO: 3372976 - RNA, 15 nt, Pseudomonas aeruginosa PA01
accgcgcucggcggu

SEQ ID NO: 3372977 - RNA, 17 nt, Pseudomonas aeruginosa PA01
accgcgcucggcgguca

SEQ ID NO: 3372978 - RNA, 15 nt, Pseudomonas aeruginosa PA01
accgcgcuugacgac

SEQ ID NO: 3372979 - RNA, 22 nt, Pseudomonas aeruginosa PA01
accgcgcuugacgacugcacgc

SEQ ID NO: 3372980 - RNA, 19 nt, Pseudomonas aeruginosa PA01
accgcggaauccgcuucgu

SEQ ID NO: 3372981 - RNA, 21 nt, Pseudomonas aeruginosa PA01
accgcggauccacgccuggcc

SEQ ID NO: 3372982 - RNA, 13 nt, Pseudomonas aeruginosa PA01
accgcggccggcu

SEQ ID NO: 3372983 - RNA, 14 nt, Pseudomonas aeruginosa PA01
accgcggccggcuu

SEQ ID NO: 3372984 - RNA, 13 nt, Pseudomonas aeruginosa PA01
accgcggccucgc

SEQ ID NO: 3372985 - RNA, 18 nt, Pseudomonas aeruginosa PA01
accgcggccucgcuggcg

SEQ ID NO: 3372986 - RNA, 19 nt, Pseudomonas aeruginosa PA01
accgcggccucgcuggcga

SEQ ID NO: 3372987 - RNA, 16 nt, Pseudomonas aeruginosa PA01
accgcggcgagccggu

SEQ ID NO: 3372988 - RNA, 19 nt, Pseudomonas aeruginosa PA01
accgcggcgcccucugccg

SEQ ID NO: 3372989 - RNA, 11 nt, Pseudomonas aeruginosa PA01
accgcggcgcu

SEQ ID NO: 3372990 - RNA, 17 nt, Pseudomonas aeruginosa PA01
accgcgggcgaggucgc

SEQ ID NO: 3372991 - RNA, 12 nt, Pseudomonas aeruginosa PA01
accgcgggcuca

SEQ ID NO: 3372992 - RNA, 13 nt, Pseudomonas aeruginosa PA01
accgcgggcucag

SEQ ID NO: 3372993 - RNA, 14 nt, Pseudomonas aeruginosa PA01
accgcgggcucagg

SEQ ID NO: 3372994 - RNA, 22 nt, Pseudomonas aeruginosa PA01
accgcggucuucccguaaggcc

SEQ ID NO: 3372995 - RNA, 19 nt, Pseudomonas aeruginosa PA01
accgcgguggaggcggcgg

SEQ ID NO: 3372996 - RNA, 15 nt, Pseudomonas aeruginosa PA01
accgcggugucggug

SEQ ID NO: 3372997 - RNA, 20 nt, Pseudomonas aeruginosa PA01
accgcggugucggugcccuc

SEQ ID NO: 3372998 - RNA, 22 nt, Pseudomonas aeruginosa PA01
accgcggugugcuuguccacca

SEQ ID NO: 3372999 - RNA, 20 nt, Pseudomonas aeruginosa PA01
accgcguccauccccgccuc

SEQ ID NO: 3373000 - RNA, 21 nt, Pseudomonas aeruginosa PA01
accgcguccauccccgccucg

SEQ ID NO: 3373001 - RNA, 12 nt, Pseudomonas aeruginosa PA01
accgcgucggga

SEQ ID NO: 3373002 - RNA, 20 nt, Pseudomonas aeruginosa PA01
accgcgucgggaaaggccgc

SEQ ID NO: 3373003 - RNA, 23 nt, Pseudomonas aeruginosa PA01
accgcgucgggaaaggccgccac

SEQ ID NO: 3373004 - RNA, 13 nt, Pseudomonas aeruginosa PA01
accgcguggugcu

SEQ ID NO: 3373005 - RNA, 20 nt, Pseudomonas aeruginosa PA01
accgcguucaccguggcgcu

SEQ ID NO: 3373006 - RNA, 12 nt, Pseudomonas aeruginosa PA01
accgcucaagac

SEQ ID NO: 3373007 - RNA, 15 nt, Pseudomonas aeruginosa PA01
accgcuccggcgccg

SEQ ID NO: 3373008 - RNA, 16 nt, Pseudomonas aeruginosa PA01
accgcuccggcgccga

SEQ ID NO: 3373009 - RNA, 21 nt, Pseudomonas aeruginosa PA01
accggcuuggucacgccguuc

SEQ ID NO: 3373010 - RNA, 17 nt, Pseudomonas aeruginosa PA01
accgggaggcgccgcgc

SEQ ID NO: 3373011 - RNA, 20 nt, Pseudomonas aeruginosa PA01
accgggaggcgccgcgccag

SEQ ID NO: 3373012 - RNA, 15 nt, Pseudomonas aeruginosa PA01
accgggaucagcggc

SEQ ID NO: 3373013 - RNA, 17 nt, Pseudomonas aeruginosa PA01
accgggaucugccggua

SEQ ID NO: 3373014 - RNA, 18 nt, Pseudomonas aeruginosa PA01
accgggaugaacugcagc

SEQ ID NO: 3373015 - RNA, 13 nt, Pseudomonas aeruginosa PA01
accgggcaucgcc

SEQ ID NO: 3373016 - RNA, 15 nt, Pseudomonas aeruginosa PA01
accgggcaucgccga

SEQ ID NO: 3373017 - RNA, 16 nt, Pseudomonas aeruginosa PA01
accgggcaucgccgac

SEQ ID NO: 3373018 - RNA, 15 nt, Pseudomonas aeruginosa PA01
accgggcaugccgug

SEQ ID NO: 3373019 - RNA, 13 nt, Pseudomonas aeruginosa PA01
accgggccgccgg

SEQ ID NO: 3373020 - RNA, 15 nt, Pseudomonas aeruginosa PA01
accgggccgccggcg

SEQ ID NO: 3373021 - RNA, 17 nt, Pseudomonas aeruginosa PA01
accgggcggaucgccaa

SEQ ID NO: 3373022 - RNA, 18 nt, Pseudomonas aeruginosa PA01
accgggcggaucgccaac

SEQ ID NO: 3373023 - RNA, 19 nt, Pseudomonas aeruginosa PA01
accgggcggcaggcgccgg

SEQ ID NO: 3373024 - RNA, 14 nt, Pseudomonas aeruginosa PA01
accgggcggcgcgg

SEQ ID NO: 3373025 - RNA, 16 nt, Pseudomonas aeruginosa PA01
accgggcgggacucgc

SEQ ID NO: 3373026 - RNA, 19 nt, Pseudomonas aeruginosa PA01
accgggcgggacucgccgu

SEQ ID NO: 3373027 - RNA, 14 nt, Pseudomonas aeruginosa PA01
accggggaucagcu

SEQ ID NO: 3373028 - RNA, 12 nt, Pseudomonas aeruginosa PA01
accggggccuuc

SEQ ID NO: 3373029 - RNA, 19 nt, Pseudomonas aeruginosa PA01
accggggccuucaggcgcu

SEQ ID NO: 3373030 - RNA, 20 nt, Pseudomonas aeruginosa PA01
accggggccuucaggcgcuc

SEQ ID NO: 3373031 - RNA, 17 nt, Pseudomonas aeruginosa PA01
accggggugauccagcu

SEQ ID NO: 3373032 - RNA, 22 nt, Pseudomonas aeruginosa PA01
accggggugauccagcuggcgc

SEQ ID NO: 3373033 - RNA, 19 nt, Pseudomonas aeruginosa PA01
accgguaacuggccagggc

SEQ ID NO: 3373034 - RNA, 16 nt, Pseudomonas aeruginosa PA01
accgguacgcucacca

SEQ ID NO: 3373035 - RNA, 22 nt, Pseudomonas aeruginosa PA01
accgguacgcucaccaccaccg

SEQ ID NO: 3373036 - RNA, 19 nt, Pseudomonas aeruginosa PA01
accggucgagagggauacc

SEQ ID NO: 3373037 - RNA, 19 nt, Pseudomonas aeruginosa PA01
accggucgcaauggcggaa

SEQ ID NO: 3373038 - RNA, 18 nt, Pseudomonas aeruginosa PA01
accggucuuggcgcgcga

SEQ ID NO: 3373039 - RNA, 15 nt, Pseudomonas aeruginosa PA01
accggugccccgcug

SEQ ID NO: 3373040 - RNA, 20 nt, Pseudomonas aeruginosa PA01
accggugccgggaagcgcag

SEQ ID NO: 3373041 - RNA, 21 nt, Pseudomonas aeruginosa PA01
accgguuaauggcgcuccagg

SEQ ID NO: 3373042 - RNA, 17 nt, Pseudomonas aeruginosa PA01
accgguuccgcgucgcc

SEQ ID NO: 3373043 - RNA, 18 nt, Pseudomonas aeruginosa PA01
accgguuccgcgucgccu

SEQ ID NO: 3373044 - RNA, 13 nt, Pseudomonas aeruginosa PA01
accgguuucgcca

SEQ ID NO: 3373045 - RNA, 14 nt, Pseudomonas aeruginosa PA01
accguaggccaggc

SEQ ID NO: 3373046 - RNA, 16 nt, Pseudomonas aeruginosa PA01
accgucaccuguucgg

SEQ ID NO: 3373047 - RNA, 22 nt, Pseudomonas aeruginosa PA01
accgucaccuguucggcgcuga

SEQ ID NO: 3373048 - RNA, 13 nt, Pseudomonas aeruginosa PA01
accgucacgcgga

SEQ ID NO: 3373049 - RNA, 22 nt, Pseudomonas aeruginosa PA01
accgucacgcggacccaguugg

SEQ ID NO: 3373050 - RNA, 20 nt, Pseudomonas aeruginosa PA01
accgucagccaggcuggcug

SEQ ID NO: 3373051 - RNA, 17 nt, Pseudomonas aeruginosa PA01
accgucauguuguucgc

SEQ ID NO: 3373052 - RNA, 16 nt, Pseudomonas aeruginosa PA01
accguccagcgcgccg

SEQ ID NO: 3373053 - RNA, 18 nt, Pseudomonas aeruginosa PA01
accguccgcagcgccacu

SEQ ID NO: 3373054 - RNA, 16 nt, Pseudomonas aeruginosa PA01
accguccgccugcgga

SEQ ID NO: 3373055 - RNA, 13 nt, Pseudomonas aeruginosa PA01
accguccgcgccg

SEQ ID NO: 3373056 - RNA, 14 nt, Pseudomonas aeruginosa PA01
accguccgcgccgc

SEQ ID NO: 3373057 - RNA, 20 nt, Pseudomonas aeruginosa PA01
accguccuucggccgcacca

SEQ ID NO: 3373058 - RNA, 18 nt, Pseudomonas aeruginosa PA01
accgucgaacagguggcu

SEQ ID NO: 3373059 - RNA, 21 nt, Pseudomonas aeruginosa PA01
accgucgaaccagggacgccc

SEQ ID NO: 3373060 - RNA, 21 nt, Pseudomonas aeruginosa PA01
accgucgcggucaucgccggc

SEQ ID NO: 3373061 - RNA, 13 nt, Pseudomonas aeruginosa PA01
accgucggccggg

SEQ ID NO: 3373062 - RNA, 15 nt, Pseudomonas aeruginosa PA01
accgucgggcaguuc

SEQ ID NO: 3373063 - RNA, 15 nt, Pseudomonas aeruginosa PA01
accgucguucggcug

SEQ ID NO: 3373064 - RNA, 17 nt, Pseudomonas aeruginosa PA01
accgucugcaccgcccu

SEQ ID NO: 3373065 - RNA, 20 nt, Pseudomonas aeruginosa PA01
accgucuggcgcauccgccc

SEQ ID NO: 3373066 - RNA, 16 nt, Pseudomonas aeruginosa PA01
accgugaccagcaugg

SEQ ID NO: 3373067 - RNA, 18 nt, Pseudomonas aeruginosa PA01
accgugaggcgcaggggc

SEQ ID NO: 3373068 - RNA, 22 nt, Pseudomonas aeruginosa PA01
accgugcccgccggcgcgccca

SEQ ID NO: 3373069 - RNA, 16 nt, Pseudomonas aeruginosa PA01
accgugccgccggggc

SEQ ID NO: 3373070 - RNA, 17 nt, Pseudomonas aeruginosa PA01
accgugcgcaccucgcc

SEQ ID NO: 3373071 - RNA, 16 nt, Pseudomonas aeruginosa PA01
accgugcgcgcggccu

SEQ ID NO: 3373072 - RNA, 17 nt, Pseudomonas aeruginosa PA01
accgugcgcgcggccug

SEQ ID NO: 3373073 - RNA, 19 nt, Pseudomonas aeruginosa PA01
accgugcgcgcggccuguu

SEQ ID NO: 3373074 - RNA, 17 nt, Pseudomonas aeruginosa PA01
accguggaaccgauggc

SEQ ID NO: 3373075 - RNA, 18 nt, Pseudomonas aeruginosa PA01
accguggcgacgaugcgc

SEQ ID NO: 3373076 - RNA, 14 nt, Pseudomonas aeruginosa PA01
accguggcgccggc

SEQ ID NO: 3373077 - RNA, 15 nt, Pseudomonas aeruginosa PA01
accguggcgccggcg

SEQ ID NO: 3373078 - RNA, 24 nt, Pseudomonas aeruginosa PA01
accguggcgccggcgcgcuugccg

SEQ ID NO: 3373079 - RNA, 21 nt, Pseudomonas aeruginosa PA01
accguggcgcuacgcucgccg

SEQ ID NO: 3373080 - RNA, 18 nt, Pseudomonas aeruginosa PA01
accguggcgcuggccgaa

SEQ ID NO: 3373081 - RNA, 19 nt, Pseudomonas aeruginosa PA01
accguggcgcuggccgaau

SEQ ID NO: 3373082 - RNA, 12 nt, Pseudomonas aeruginosa PA01
accguggcggcc

SEQ ID NO: 3373083 - RNA, 13 nt, Pseudomonas aeruginosa PA01
accguggcggccg

SEQ ID NO: 3373084 - RNA, 17 nt, Pseudomonas aeruginosa PA01
accguggucagcaccag

SEQ ID NO: 3373085 - RNA, 14 nt, Pseudomonas aeruginosa PA01
accguggucauggc

SEQ ID NO: 3373086 - RNA, 15 nt, Pseudomonas aeruginosa PA01
accguggucgccgcu

SEQ ID NO: 3373087 - RNA, 17 nt, Pseudomonas aeruginosa PA01
accgugugcgugcucuu

SEQ ID NO: 3373088 - RNA, 15 nt, Pseudomonas aeruginosa PA01
accguuccagcgccu

SEQ ID NO: 3373089 - RNA, 15 nt, Pseudomonas aeruginosa PA01
accguucccagcagc

SEQ ID NO: 3373090 - RNA, 19 nt, Pseudomonas aeruginosa PA01
accguucccagcagcgccu

SEQ ID NO: 3373091 - RNA, 20 nt, Pseudomonas aeruginosa PA01
accguucccagcagcgccuc

SEQ ID NO: 3373092 - RNA, 23 nt, Pseudomonas aeruginosa PA01
accguucugccgcagcgccuccc

SEQ ID NO: 3373093 - RNA, 19 nt, Pseudomonas aeruginosa PA01
accguuggcgaugaucugg

SEQ ID NO: 3373094 - RNA, 23 nt, Pseudomonas aeruginosa PA01
accguuucgccgccggccagccg

SEQ ID NO: 3373095 - RNA, 14 nt, Pseudomonas aeruginosa PA01
accucagaccacgc

SEQ ID NO: 3373096 - RNA, 16 nt, Pseudomonas aeruginosa PA01
accucagaccacgccc

SEQ ID NO: 3373097 - RNA, 18 nt, Pseudomonas aeruginosa PA01
accucauacuugggucgu

SEQ ID NO: 3373098 - RNA, 12 nt, Pseudomonas aeruginosa PA01
accuccagccag

SEQ ID NO: 3373099 - RNA, 16 nt, Pseudomonas aeruginosa PA01
accuccagccagcagc

SEQ ID NO: 3373100 - RNA, 20 nt, Pseudomonas aeruginosa PA01
accuccagccagcagcccgg

SEQ ID NO: 3373101 - RNA, 13 nt, Pseudomonas aeruginosa PA01
accuccagccggc

SEQ ID NO: 3373102 - RNA, 15 nt, Pseudomonas aeruginosa PA01
accuccagccggcca

SEQ ID NO: 3373103 - RNA, 19 nt, Pseudomonas aeruginosa PA01
accucccgcgccagcucga

SEQ ID NO: 3373104 - RNA, 13 nt, Pseudomonas aeruginosa PA01
accuccgccagga

SEQ ID NO: 3373105 - RNA, 13 nt, Pseudomonas aeruginosa PA01
accuccgccaggu

SEQ ID NO: 3373106 - RNA, 17 nt, Pseudomonas aeruginosa PA01
accuccggcgccaggcc

SEQ ID NO: 3373107 - RNA, 20 nt, Pseudomonas aeruginosa PA01
accuccucgaugaaacgcag

SEQ ID NO: 3373108 - RNA, 22 nt, Pseudomonas aeruginosa PA01
accuccucgaugaaacgcaggg

SEQ ID NO: 3373109 - RNA, 14 nt, Pseudomonas aeruginosa PA01
accuccuggcgcgu

SEQ ID NO: 3373110 - RNA, 22 nt, Pseudomonas aeruginosa PA01
accuccuguucgcgcgccucgc

SEQ ID NO: 3373111 - RNA, 19 nt, Pseudomonas aeruginosa PA01
accuccuugggaucggcga

SEQ ID NO: 3373112 - RNA, 22 nt, Pseudomonas aeruginosa PA01
accugggauggggcugccggcc

SEQ ID NO: 3373113 - RNA, 15 nt, Pseudomonas aeruginosa PA01
accugggcaccagug

SEQ ID NO: 3373114 - RNA, 18 nt, Pseudomonas aeruginosa PA01
accugggcguuggccagc

SEQ ID NO: 3373115 - RNA, 20 nt, Pseudomonas aeruginosa PA01
accugggcguuggccagcgc

SEQ ID NO: 3373116 - RNA, 21 nt, Pseudomonas aeruginosa PA01
accugggcguuggccagcgcc

SEQ ID NO: 3373117 - RNA, 13 nt, Pseudomonas aeruginosa PA01
accuggggcggcc

SEQ ID NO: 3373118 - RNA, 23 nt, Pseudomonas aeruginosa PA01
accuggguaccgacggucggcag

SEQ ID NO: 3373119 - RNA, 18 nt, Pseudomonas aeruginosa PA01
accuggguugccgcgccg

SEQ ID NO: 3373120 - RNA, 19 nt, Pseudomonas aeruginosa PA01
accuggguugccgcgccga

SEQ ID NO: 3373121 - RNA, 22 nt, Pseudomonas aeruginosa PA01
accugguagcagagggucgcca

SEQ ID NO: 3373122 - RNA, 23 nt, Pseudomonas aeruginosa PA01
accugguagcagagggucgccag

SEQ ID NO: 3373123 - RNA, 22 nt, Pseudomonas aeruginosa PA01
accugguagccgaagucggcgu

SEQ ID NO: 3373124 - RNA, 13 nt, Pseudomonas aeruginosa PA01
accugguagguca

SEQ ID NO: 3373125 - RNA, 19 nt, Pseudomonas aeruginosa PA01
accugguccgucucgucga

SEQ ID NO: 3373126 - RNA, 14 nt, Pseudomonas aeruginosa PA01
accuggucgccgaa

SEQ ID NO: 3373127 - RNA, 19 nt, Pseudomonas aeruginosa PA01
accuggucguugcgcgcau

SEQ ID NO: 3373128 - RNA, 20 nt, Pseudomonas aeruginosa PA01
accuggucuucgguggcggc

SEQ ID NO: 3373129 - RNA, 19 nt, Pseudomonas aeruginosa PA01
accugguggacacccugcu

SEQ ID NO: 3373130 - RNA, 20 nt, Pseudomonas aeruginosa PA01
accugguggcgccggcugac

SEQ ID NO: 3373131 - RNA, 22 nt, Pseudomonas aeruginosa PA01
accugguucaucgagcggcggc

SEQ ID NO: 3373132 - RNA, 21 nt, Pseudomonas aeruginosa PA01
accuguccagucaccaggucg

SEQ ID NO: 3373133 - RNA, 23 nt, Pseudomonas aeruginosa PA01
accugucccggacgacgaaagaa

SEQ ID NO: 3373134 - RNA, 19 nt, Pseudomonas aeruginosa PA01
accuguccgaacagggcga

SEQ ID NO: 3373135 - RNA, 21 nt, Pseudomonas aeruginosa PA01
accuguggaauguccugccgc

SEQ ID NO: 3373136 - RNA, 13 nt, Pseudomonas aeruginosa PA01
accuguggauaac

SEQ ID NO: 3373137 - RNA, 19 nt, Pseudomonas aeruginosa PA01
accuguggauaacguccgc

SEQ ID NO: 3373138 - RNA, 21 nt, Pseudomonas aeruginosa PA01
accuguggauaacguccgcgu

SEQ ID NO: 3373139 - RNA, 22 nt, Pseudomonas aeruginosa PA01
accuguucgaaguucuccagca

SEQ ID NO: 3373140 - RNA, 15 nt, Pseudomonas aeruginosa PA01
accuguucggcgcug

SEQ ID NO: 3373141 - RNA, 16 nt, Pseudomonas aeruginosa PA01
accuguugcagagcgg

SEQ ID NO: 3373142 - RNA, 19 nt, Pseudomonas aeruginosa PA01
accuguugcagagcggcca

SEQ ID NO: 3373143 - RNA, 22 nt, Pseudomonas aeruginosa PA01
accuguuucagcggguagcugc

SEQ ID NO: 3373144 - RNA, 22 nt, Pseudomonas aeruginosa PA01
accuuaguuaucacaaccuuuc

SEQ ID NO: 3373145 - RNA, 18 nt, Pseudomonas aeruginosa PA01
accuucaccggcacgccc

SEQ ID NO: 3373146 - RNA, 19 nt, Pseudomonas aeruginosa PA01
accuucagauacuccagca

SEQ ID NO: 3373147 - RNA, 19 nt, Pseudomonas aeruginosa PA01
accuucagcaccugcgccg

SEQ ID NO: 3373148 - RNA, 14 nt, Pseudomonas aeruginosa PA01
accuucaggcugcu

SEQ ID NO: 3373149 - RNA, 17 nt, Pseudomonas aeruginosa PA01
accuucaucaggcggca

SEQ ID NO: 3373150 - RNA, 18 nt, Pseudomonas aeruginosa PA01
accuuccgccagcaggcg

SEQ ID NO: 3373151 - RNA, 22 nt, Pseudomonas aeruginosa PA01
accuuccgccagcaggcgcggg

SEQ ID NO: 3373152 - RNA, 15 nt, Pseudomonas aeruginosa PA01
accuuccugccagcg

SEQ ID NO: 3373153 - RNA, 19 nt, Pseudomonas aeruginosa PA01
accuuccugccagcgcguc

SEQ ID NO: 3373154 - RNA, 22 nt, Pseudomonas aeruginosa PA01
accuucgaagacccccugccgc

SEQ ID NO: 3373155 - RNA, 14 nt, Pseudomonas aeruginosa PA01
accuucgacggcag

SEQ ID NO: 3373156 - RNA, 15 nt, Pseudomonas aeruginosa PA01
accuucgacggcagg

SEQ ID NO: 3373157 - RNA, 22 nt, Pseudomonas aeruginosa PA01
accuucgacggcagguggcggg

SEQ ID NO: 3373158 - RNA, 19 nt, Pseudomonas aeruginosa PA01
accuucgaggugucgucca

SEQ ID NO: 3373159 - RNA, 16 nt, Pseudomonas aeruginosa PA01
accuucgaucacccgg

SEQ ID NO: 3373160 - RNA, 19 nt, Pseudomonas aeruginosa PA01
accuucgcccgcugcgcug

SEQ ID NO: 3373161 - RNA, 20 nt, Pseudomonas aeruginosa PA01
accuucgcccgcugcgcugc

SEQ ID NO: 3373162 - RNA, 22 nt, Pseudomonas aeruginosa PA01
accuucgcccgcugcgcugcca

SEQ ID NO: 3373163 - RNA, 22 nt, Pseudomonas aeruginosa PA01
accuucgcccucagcagcgccg

SEQ ID NO: 3373164 - RNA, 14 nt, Pseudomonas aeruginosa PA01
accuucuccgacca

SEQ ID NO: 3373165 - RNA, 20 nt, Pseudomonas aeruginosa PA01
accuugaacucgcccggcuc

SEQ ID NO: 3373166 - RNA, 18 nt, Pseudomonas aeruginosa PA01
accuugaagccuucgccc

SEQ ID NO: 3373167 - RNA, 23 nt, Pseudomonas aeruginosa PA01
accuugaccuugucggccgacgg

SEQ ID NO: 3373168 - RNA, 19 nt, Pseudomonas aeruginosa PA01
accuugacgaagccggcga

SEQ ID NO: 3373169 - RNA, 14 nt, Pseudomonas aeruginosa PA01
accuugccgcgccc

SEQ ID NO: 3373170 - RNA, 20 nt, Pseudomonas aeruginosa PA01
accuugccguugcucacgcc

SEQ ID NO: 3373171 - RNA, 23 nt, Pseudomonas aeruginosa PA01
accuugcgcaccagggccaggag

SEQ ID NO: 3373172 - RNA, 19 nt, Pseudomonas aeruginosa PA01
accuugcgcaccgccugca

SEQ ID NO: 3373173 - RNA, 20 nt, Pseudomonas aeruginosa PA01
accuugcggccguucuccgg

SEQ ID NO: 3373174 - RNA, 19 nt, Pseudomonas aeruginosa PA01
accuugcggguggucuugc

SEQ ID NO: 3373175 - RNA, 17 nt, Pseudomonas aeruginosa PA01
accuugcgguagcgcuc

SEQ ID NO: 3373176 - RNA, 21 nt, Pseudomonas aeruginosa PA01
accuugcgguagcgcucgccu

SEQ ID NO: 3373177 - RNA, 23 nt, Pseudomonas aeruginosa PA01
accuugcgucuucgccgaugcgc

SEQ ID NO: 3373178 - RNA, 23 nt, Pseudomonas aeruginosa PA01
accuugcuggugcccugggcggc

SEQ ID NO: 3373179 - RNA, 11 nt, Pseudomonas aeruginosa PA01
accuuggacuu

SEQ ID NO: 3373180 - RNA, 15 nt, Pseudomonas aeruginosa PA01
accuuggccacgcug

SEQ ID NO: 3373181 - RNA, 15 nt, Pseudomonas aeruginosa PA01
accuuggccaugggc

SEQ ID NO: 3373182 - RNA, 20 nt, Pseudomonas aeruginosa PA01
accuuggcuugcagguagcu

SEQ ID NO: 3373183 - RNA, 17 nt, Pseudomonas aeruginosa PA01
accuugggaucgucgaa

SEQ ID NO: 3373184 - RNA, 18 nt, Pseudomonas aeruginosa PA01
accuugggguguccgauu

SEQ ID NO: 3373185 - RNA, 22 nt, Pseudomonas aeruginosa PA01
accuugggguguccgauucuug

SEQ ID NO: 3373186 - RNA, 18 nt, Pseudomonas aeruginosa PA01
accuuggugucgaugccg

SEQ ID NO: 3373187 - RNA, 14 nt, Pseudomonas aeruginosa PA01
accuuguacggcag

SEQ ID NO: 3373188 - RNA, 16 nt, Pseudomonas aeruginosa PA01
accuuguccaggcgcu

SEQ ID NO: 3373189 - RNA, 14 nt, Pseudomonas aeruginosa PA01
accuuguccugcgg

SEQ ID NO: 3373190 - RNA, 18 nt, Pseudomonas aeruginosa PA01
accuuguccugcggccgg

SEQ ID NO: 3373191 - RNA, 18 nt, Pseudomonas aeruginosa PA01
accuuguccuggccggcg

SEQ ID NO: 3373192 - RNA, 19 nt, Pseudomonas aeruginosa PA01
accuugucgauggucuuga

SEQ ID NO: 3373193 - RNA, 20 nt, Pseudomonas aeruginosa PA01
accuugucgccggugaggau

SEQ ID NO: 3373194 - RNA, 14 nt, Pseudomonas aeruginosa PA01
accuugucggccga

SEQ ID NO: 3373195 - RNA, 17 nt, Pseudomonas aeruginosa PA01
accuuucggagugaaca

SEQ ID NO: 3373196 - RNA, 21 nt, Pseudomonas aeruginosa PA01
accuuucuccccucaggcgcc

SEQ ID NO: 3373197 - RNA, 23 nt, Pseudomonas aeruginosa PA01
accuuugagggucagaccagccc

SEQ ID NO: 3373198 - RNA, 20 nt, Pseudomonas aeruginosa PA01
acgaaaaagccccugcgccu

SEQ ID NO: 3373199 - RNA, 18 nt, Pseudomonas aeruginosa PA01
acgaaaaagcccggcauu

SEQ ID NO: 3373200 - RNA, 14 nt, Pseudomonas aeruginosa PA01
acgaaaaagccggc

SEQ ID NO: 3373201 - RNA, 14 nt, Pseudomonas aeruginosa PA01
acgaaaagccgccc

SEQ ID NO: 3373202 - RNA, 16 nt, Pseudomonas aeruginosa PA01
acgaaagaagccgcac

SEQ ID NO: 3373203 - RNA, 21 nt, Pseudomonas aeruginosa PA01
acgaaagaagccgcacuucca

SEQ ID NO: 3373204 - RNA, 14 nt, Pseudomonas aeruginosa PA01
acgaaagagcccgg

SEQ ID NO: 3373205 - RNA, 14 nt, Pseudomonas aeruginosa PA01
acgaaagccaugcc

SEQ ID NO: 3373206 - RNA, 19 nt, Pseudomonas aeruginosa PA01
acgaaagccaugcccagac

SEQ ID NO: 3373207 - RNA, 17 nt, Pseudomonas aeruginosa PA01
acgaaagccuugaccaa

SEQ ID NO: 3373208 - RNA, 14 nt, Pseudomonas aeruginosa PA01
acgaaaggccgcgc

SEQ ID NO: 3373209 - RNA, 11 nt, Pseudomonas aeruginosa PA01
acgaacagcuu

SEQ ID NO: 3373210 - RNA, 22 nt, Pseudomonas aeruginosa PA01
acgaacaggcugugcgccaggc

SEQ ID NO: 3373211 - RNA, 22 nt, Pseudomonas aeruginosa PA01
acgaacaggugcugguggcccu

SEQ ID NO: 3373212 - RNA, 23 nt, Pseudomonas aeruginosa PA01
acgaacaggugcugguggcccug

SEQ ID NO: 3373213 - RNA, 15 nt, Pseudomonas aeruginosa PA01
acgaucucccgcgau

SEQ ID NO: 3373214 - RNA, 15 nt, Pseudomonas aeruginosa PA01
acgaucugcgagcgc

SEQ ID NO: 3373215 - RNA, 24 nt, Pseudomonas aeruginosa PA01
acgaucugucgauaccagcgccgc

SEQ ID NO: 3373216 - RNA, 14 nt, Pseudomonas aeruginosa PA01
acgaugaagcccca

SEQ ID NO: 3373217 - RNA, 22 nt, Pseudomonas aeruginosa PA01
acgaugaucaccaggacccaga

SEQ ID NO: 3373218 - RNA, 16 nt, Pseudomonas aeruginosa PA01
acgaugcacaggcgua

SEQ ID NO: 3373219 - RNA, 23 nt, Pseudomonas aeruginosa PA01
acgaugcacaggcguaccagcuu

SEQ ID NO: 3373220 - RNA, 12 nt, Pseudomonas aeruginosa PA01
acgaugccgccg

SEQ ID NO: 3373221 - RNA, 23 nt, Pseudomonas aeruginosa PA01
acgaugccguucucggugaccac

SEQ ID NO: 3373222 - RNA, 23 nt, Pseudomonas aeruginosa PA01
acgaugccguuguagcugaccac

SEQ ID NO: 3373223 - RNA, 20 nt, Pseudomonas aeruginosa PA01
acgaugcgccccagcgccug

SEQ ID NO: 3373224 - RNA, 20 nt, Pseudomonas aeruginosa PA01
acgaugcuggcaacggcggg

SEQ ID NO: 3373225 - RNA, 14 nt, Pseudomonas aeruginosa PA01
acgauggccagccc

SEQ ID NO: 3373226 - RNA, 15 nt, Pseudomonas aeruginosa PA01
acgauggccagcccg

SEQ ID NO: 3373227 - RNA, 13 nt, Pseudomonas aeruginosa PA01
acgauggccggca

SEQ ID NO: 3373228 - RNA, 19 nt, Pseudomonas aeruginosa PA01
acgauggccggcagcagcg

SEQ ID NO: 3373229 - RNA, 20 nt, Pseudomonas aeruginosa PA01
acgauggccggcagcagcgc

SEQ ID NO: 3373230 - RNA, 19 nt, Pseudomonas aeruginosa PA01
acgauguucgaggcgccga

SEQ ID NO: 3373231 - RNA, 20 nt, Pseudomonas aeruginosa PA01
acgauguuguugcccaccag

SEQ ID NO: 3373232 - RNA, 22 nt, Pseudomonas aeruginosa PA01
acgauguuguugcccaccagcg

SEQ ID NO: 3373233 - RNA, 16 nt, Pseudomonas aeruginosa PA01
acgcaaacgccauccg

SEQ ID NO: 3373234 - RNA, 17 nt, Pseudomonas aeruginosa PA01
acgcaacccgcccggcu

SEQ ID NO: 3373235 - RNA, 17 nt, Pseudomonas aeruginosa PA01
acgcaagcgcucggccu

SEQ ID NO: 3373236 - RNA, 17 nt, Pseudomonas aeruginosa PA01
acgcaagugcccugggc

SEQ ID NO: 3373237 - RNA, 18 nt, Pseudomonas aeruginosa PA01
acgcaagugcccugggcg

SEQ ID NO: 3373238 - RNA, 17 nt, Pseudomonas aeruginosa PA01
acgcaauagugcagcuc

SEQ ID NO: 3373239 - RNA, 13 nt, Pseudomonas aeruginosa PA01
acgcaccagcagg

SEQ ID NO: 3373240 - RNA, 13 nt, Pseudomonas aeruginosa PA01
acgcaccagcucc

SEQ ID NO: 3373241 - RNA, 19 nt, Pseudomonas aeruginosa PA01
acgcaccagcucccggcuc

SEQ ID NO: 3373242 - RNA, 13 nt, Pseudomonas aeruginosa PA01
acgcaccggcuuc

SEQ ID NO: 3373243 - RNA, 18 nt, Pseudomonas aeruginosa PA01
acgcaccucgucgagcag

SEQ ID NO: 3373244 - RNA, 12 nt, Pseudomonas aeruginosa PA01
acgcacgcgccu

SEQ ID NO: 3373245 - RNA, 17 nt, Pseudomonas aeruginosa PA01
acgcacucauagcucag

SEQ ID NO: 3373246 - RNA, 21 nt, Pseudomonas aeruginosa PA01
acgcacucauagcucagcugg

SEQ ID NO: 3373247 - RNA, 16 nt, Pseudomonas aeruginosa PA01
acgcacugguugaagc

SEQ ID NO: 3373248 - RNA, 21 nt, Pseudomonas aeruginosa PA01
acgcacugguugaagcgggag

SEQ ID NO: 3373249 - RNA, 18 nt, Pseudomonas aeruginosa PA01
acgcacuucguccgccac

SEQ ID NO: 3373250 - RNA, 22 nt, Pseudomonas aeruginosa PA01
acgcacuucguccgccaccacg

SEQ ID NO: 3373251 - RNA, 19 nt, Pseudomonas aeruginosa PA01
acgcagagcggcaggccgc

SEQ ID NO: 3373252 - RNA, 22 nt, Pseudomonas aeruginosa PA01
acgcagagcggcaggccgccga

SEQ ID NO: 3373253 - RNA, 18 nt, Pseudomonas aeruginosa PA01
acgcagcaugucgucgaa

SEQ ID NO: 3373254 - RNA, 16 nt, Pseudomonas aeruginosa PA01
acgcagccacccgcgg

SEQ ID NO: 3373255 - RNA, 14 nt, Pseudomonas aeruginosa PA01
acgcagccgggccg

SEQ ID NO: 3373256 - RNA, 18 nt, Pseudomonas aeruginosa PA01
acgcagccgggccgcagc

SEQ ID NO: 3373257 - RNA, 17 nt, Pseudomonas aeruginosa PA01
acgcagccguuggccag

SEQ ID NO: 3373258 - RNA, 23 nt, Pseudomonas aeruginosa PA01
acgcagccguuggccagcaggcg

SEQ ID NO: 3373259 - RNA, 13 nt, Pseudomonas aeruginosa PA01
acgcagcgccgcg

SEQ ID NO: 3373260 - RNA, 15 nt, Pseudomonas aeruginosa PA01
acgcagcgccgcgua

SEQ ID NO: 3373261 - RNA, 19 nt, Pseudomonas aeruginosa PA01
acgcagcgcgcgccgagca

SEQ ID NO: 3373262 - RNA, 20 nt, Pseudomonas aeruginosa PA01
acgcagcgcgcgccgagcaa

SEQ ID NO: 3373263 - RNA, 21 nt, Pseudomonas aeruginosa PA01
acgcagcgcuagcgcauggcg

SEQ ID NO: 3373264 - RNA, 22 nt, Pseudomonas aeruginosa PA01
acgcaggaacagcuccuccagc

SEQ ID NO: 3373265 - RNA, 22 nt, Pseudomonas aeruginosa PA01
acgcaggaacuggucgauccgc

SEQ ID NO: 3373266 - RNA, 16 nt, Pseudomonas aeruginosa PA01
acgcaggcaggucauc

SEQ ID NO: 3373267 - RNA, 16 nt, Pseudomonas aeruginosa PA01
acgcaggccagcgcca

SEQ ID NO: 3373268 - RNA, 12 nt, Pseudomonas aeruginosa PA01
acgcaggccgcu

SEQ ID NO: 3373269 - RNA, 16 nt, Pseudomonas aeruginosa PA01
acgcaggccgcugccu

SEQ ID NO: 3373270 - RNA, 12 nt, Pseudomonas aeruginosa PA01
acgcaggcgcau

SEQ ID NO: 3373271 - RNA, 16 nt, Pseudomonas aeruginosa PA01
acgcaggcgcauggcg

SEQ ID NO: 3373272 - RNA, 17 nt, Pseudomonas aeruginosa PA01
acgcaggcgccgauggc

SEQ ID NO: 3373273 - RNA, 23 nt, Pseudomonas aeruginosa PA01
acgcaggcgccgauggcugucgg

SEQ ID NO: 3373274 - RNA, 12 nt, Pseudomonas aeruginosa PA01
acgcaggcgcug

SEQ ID NO: 3373275 - RNA, 16 nt, Pseudomonas aeruginosa PA01
acgcaggcgcuggccg

SEQ ID NO: 3373276 - RNA, 21 nt, Pseudomonas aeruginosa PA01
acgcaggcuuuccagcccggc

SEQ ID NO: 3373277 - RNA, 13 nt, Pseudomonas aeruginosa PA01
acgcagggccgga

SEQ ID NO: 3373278 - RNA, 14 nt, Pseudomonas aeruginosa PA01
acgcagggccggau

SEQ ID NO: 3373279 - RNA, 19 nt, Pseudomonas aeruginosa PA01
acgcagggccucuucgcaa

SEQ ID NO: 3373280 - RNA, 16 nt, Pseudomonas aeruginosa PA01
acgcagggcggcgccu

SEQ ID NO: 3373281 - RNA, 20 nt, Pseudomonas aeruginosa PA01
acgcagggcggcgccuggag

SEQ ID NO: 3373282 - RNA, 22 nt, Pseudomonas aeruginosa PA01
acgcaguacagcugcaccgcgc

SEQ ID NO: 3373283 - RNA, 18 nt, Pseudomonas aeruginosa PA01
acgcagugggaagcucac

SEQ ID NO: 3373284 - RNA, 16 nt, Pseudomonas aeruginosa PA01
acgcaguuccgcggcg

SEQ ID NO: 3373285 - RNA, 12 nt, Pseudomonas aeruginosa PA01
acgcaugcgcgg

SEQ ID NO: 3373286 - RNA, 15 nt, Pseudomonas aeruginosa PA01
acgcaugcgcggcgu

SEQ ID NO: 3373287 - RNA, 19 nt, Pseudomonas aeruginosa PA01
acgcauguucaugcgcugg

SEQ ID NO: 3373288 - RNA, 20 nt, Pseudomonas aeruginosa PA01
acgcauguucaugcgcuggu

SEQ ID NO: 3373289 - RNA, 17 nt, Pseudomonas aeruginosa PA01
acgccaccagccaggcg

SEQ ID NO: 3373290 - RNA, 14 nt, Pseudomonas aeruginosa PA01
acgccacccgcauc

SEQ ID NO: 3373291 - RNA, 22 nt, Pseudomonas aeruginosa PA01
acgccacccgcaucgaggccgc

SEQ ID NO: 3373292 - RNA, 14 nt, Pseudomonas aeruginosa PA01
acgccagcaggcgc

SEQ ID NO: 3373293 - RNA, 21 nt, Pseudomonas aeruginosa PA01
acgccagcccagugcuggcgu

SEQ ID NO: 3373294 - RNA, 12 nt, Pseudomonas aeruginosa PA01
acgccagcccuc

SEQ ID NO: 3373295 - RNA, 19 nt, Pseudomonas aeruginosa PA01
acgccagcccucgcccagg

SEQ ID NO: 3373296 - RNA, 16 nt, Pseudomonas aeruginosa PA01
acgccagccgcccugg

SEQ ID NO: 3373297 - RNA, 16 nt, Pseudomonas aeruginosa PA01
acgccagcucggccgg

SEQ ID NO: 3373298 - RNA, 17 nt, Pseudomonas aeruginosa PA01
acgccagcucggccggc

SEQ ID NO: 3373299 - RNA, 15 nt, Pseudomonas aeruginosa PA01
acgccaggacguuau

SEQ ID NO: 3373300 - RNA, 20 nt, Pseudomonas aeruginosa PA01
acgccaggcugucagggcgc

SEQ ID NO: 3373301 - RNA, 13 nt, Pseudomonas aeruginosa PA01
acgccagggugcu

SEQ ID NO: 3373302 - RNA, 13 nt, Pseudomonas aeruginosa PA01
acgcccagcagcg

SEQ ID NO: 3373303 - RNA, 17 nt, Pseudomonas aeruginosa PA01
acgcccagcagggccag

SEQ ID NO: 3373304 - RNA, 22 nt, Pseudomonas aeruginosa PA01
acgcccagcagggccagccaga

SEQ ID NO: 3373305 - RNA, 19 nt, Pseudomonas aeruginosa PA01
acgcccaggcgcucggcga

SEQ ID NO: 3373306 - RNA, 20 nt, Pseudomonas aeruginosa PA01
acgcccaguugcgccgccug

SEQ ID NO: 3373307 - RNA, 20 nt, Pseudomonas aeruginosa PA01
acgcccaucgccaccagcag

SEQ ID NO: 3373308 - RNA, 13 nt, Pseudomonas aeruginosa PA01
acgcccaucggcg

SEQ ID NO: 3373309 - RNA, 15 nt, Pseudomonas aeruginosa PA01
acgcccaucuucagg

SEQ ID NO: 3373310 - RNA, 18 nt, Pseudomonas aeruginosa PA01
acgcccaugccuugcagc

SEQ ID NO: 3373311 - RNA, 22 nt, Pseudomonas aeruginosa PA01
acgcccaugccuugcagcgcca

SEQ ID NO: 3373312 - RNA, 17 nt, Pseudomonas aeruginosa PA01
acgccccagaagcccca

SEQ ID NO: 3373313 - RNA, 15 nt, Pseudomonas aeruginosa PA01
acgccccgucgacgc

SEQ ID NO: 3373314 - RNA, 16 nt, Pseudomonas aeruginosa PA01
acgccccgucgacgca

SEQ ID NO: 3373315 - RNA, 21 nt, Pseudomonas aeruginosa PA01
acgccgucgcgcucuuccuuc

SEQ ID NO: 3373316 - RNA, 18 nt, Pseudomonas aeruginosa PA01
acgccgugcaucaccggc

SEQ ID NO: 3373317 - RNA, 23 nt, Pseudomonas aeruginosa PA01
acgccguguaaguuaaugcuuac

SEQ ID NO: 3373318 - RNA, 21 nt, Pseudomonas aeruginosa PA01
acgccguuggcguuaugcgcc

SEQ ID NO: 3373319 - RNA, 20 nt, Pseudomonas aeruginosa PA01
acgccuauggcguuauucgc

SEQ ID NO: 3373320 - RNA, 13 nt, Pseudomonas aeruginosa PA01
acgccucgcagag

SEQ ID NO: 3373321 - RNA, 22 nt, Pseudomonas aeruginosa PA01
acgccucgcggcuaucgaucac

SEQ ID NO: 3373322 - RNA, 15 nt, Pseudomonas aeruginosa PA01
acgccucggcgcgau

SEQ ID NO: 3373323 - RNA, 22 nt, Pseudomonas aeruginosa PA01
acgccucggcgcgauccuccgc

SEQ ID NO: 3373324 - RNA, 13 nt, Pseudomonas aeruginosa PA01
acgccucugcgcu

SEQ ID NO: 3373325 - RNA, 12 nt, Pseudomonas aeruginosa PA01
acgccuggcggc

SEQ ID NO: 3373326 - RNA, 16 nt, Pseudomonas aeruginosa PA01
acgccuggcggcuggc

SEQ ID NO: 3373327 - RNA, 18 nt, Pseudomonas aeruginosa PA01
acgccuggcggcuggcgu

SEQ ID NO: 3373328 - RNA, 12 nt, Pseudomonas aeruginosa PA01
acgccugggcgu

SEQ ID NO: 3373329 - RNA, 23 nt, Pseudomonas aeruginosa PA01
acgccuggugcaggucgcgcggc

SEQ ID NO: 3373330 - RNA, 20 nt, Pseudomonas aeruginosa PA01
acgccugucgcuccggcagc

SEQ ID NO: 3373331 - RNA, 14 nt, Pseudomonas aeruginosa PA01
acgccugucggcac

SEQ ID NO: 3373332 - RNA, 20 nt, Pseudomonas aeruginosa PA01
acgccuguggcguuauucgc

SEQ ID NO: 3373333 - RNA, 22 nt, Pseudomonas aeruginosa PA01
acgccuuccggguugaaggcgc

SEQ ID NO: 3373334 - RNA, 19 nt, Pseudomonas aeruginosa PA01
acgccuucgggcgaugcgg

SEQ ID NO: 3373335 - RNA, 14 nt, Pseudomonas aeruginosa PA01
acgccuucguggcc

SEQ ID NO: 3373336 - RNA, 17 nt, Pseudomonas aeruginosa PA01
acgccuucguggccgcg

SEQ ID NO: 3373337 - RNA, 21 nt, Pseudomonas aeruginosa PA01
acgccuugcagcaccgccugg

SEQ ID NO: 3373338 - RNA, 11 nt, Pseudomonas aeruginosa PA01
acgccuugcca

SEQ ID NO: 3373339 - RNA, 17 nt, Pseudomonas aeruginosa PA01
acgcgaaugcccggcag

SEQ ID NO: 3373340 - RNA, 18 nt, Pseudomonas aeruginosa PA01
acgcgaaugcccggcagc

SEQ ID NO: 3373341 - RNA, 15 nt, Pseudomonas aeruginosa PA01
acgcgacagcgacuc

SEQ ID NO: 3373342 - RNA, 16 nt, Pseudomonas aeruginosa PA01
acgcgaccagcgccag

SEQ ID NO: 3373343 - RNA, 19 nt, Pseudomonas aeruginosa PA01
acgcgaccagcgccaggcg

SEQ ID NO: 3373344 - RNA, 21 nt, Pseudomonas aeruginosa PA01
acgcgacgaucucuucccggc

SEQ ID NO: 3373345 - RNA, 14 nt, Pseudomonas aeruginosa PA01
acgcgacugcugcu

SEQ ID NO: 3373346 - RNA, 15 nt, Pseudomonas aeruginosa PA01
acgcgagaagccgcc

SEQ ID NO: 3373347 - RNA, 16 nt, Pseudomonas aeruginosa PA01
acgcgaggagaucggc

SEQ ID NO: 3373348 - RNA, 18 nt, Pseudomonas aeruginosa PA01
acgcgaggagaucggcgu

SEQ ID NO: 3373349 - RNA, 14 nt, Pseudomonas aeruginosa PA01
acgcgaggucucga

SEQ ID NO: 3373350 - RNA, 14 nt, Pseudomonas aeruginosa PA01
acgcgauauccgcc

SEQ ID NO: 3373351 - RNA, 18 nt, Pseudomonas aeruginosa PA01
acgcgauauccgccaggc

SEQ ID NO: 3373352 - RNA, 21 nt, Pseudomonas aeruginosa PA01
acgcgcacgucaccguccuuc

SEQ ID NO: 3373353 - RNA, 14 nt, Pseudomonas aeruginosa PA01
acgcgcagcgccgc

SEQ ID NO: 3373354 - RNA, 15 nt, Pseudomonas aeruginosa PA01
acgcgcagcgccgcc

SEQ ID NO: 3373355 - RNA, 17 nt, Pseudomonas aeruginosa PA01
acgcgcagcgccgccgc

SEQ ID NO: 3373356 - RNA, 13 nt, Pseudomonas aeruginosa PA01
acgcgcagcggcg

SEQ ID NO: 3373357 - RNA, 17 nt, Pseudomonas aeruginosa PA01
acgcgcaggccggugau

SEQ ID NO: 3373358 - RNA, 16 nt, Pseudomonas aeruginosa PA01
acgcgcagggucaggc

SEQ ID NO: 3373359 - RNA, 19 nt, Pseudomonas aeruginosa PA01
acgcgcaguacgaucagcc

SEQ ID NO: 3373360 - RNA, 22 nt, Pseudomonas aeruginosa PA01
acgcgcauccguuugggaucgg

SEQ ID NO: 3373361 - RNA, 14 nt, Pseudomonas aeruginosa PA01
acgcgccacgcagg

SEQ ID NO: 3373362 - RNA, 16 nt, Pseudomonas aeruginosa PA01
acgcgccacgcaggaa

SEQ ID NO: 3373363 - RNA, 17 nt, Pseudomonas aeruginosa PA01
acgcgccacgcaggaac

SEQ ID NO: 3373364 - RNA, 14 nt, Pseudomonas aeruginosa PA01
acgcgccaggugcg

SEQ ID NO: 3373365 - RNA, 22 nt, Pseudomonas aeruginosa PA01
acgcgcccacuccuccgccugc

SEQ ID NO: 3373366 - RNA, 16 nt, Pseudomonas aeruginosa PA01
acgcgcccggccaggc

SEQ ID NO: 3373367 - RNA, 17 nt, Pseudomonas aeruginosa PA01
acgcgcccggccaggcc

SEQ ID NO: 3373368 - RNA, 12 nt, Pseudomonas aeruginosa PA01
acgcgccgaucc

SEQ ID NO: 3373369 - RNA, 19 nt, Pseudomonas aeruginosa PA01
acgcgccgauccaggcgug

SEQ ID NO: 3373370 - RNA, 20 nt, Pseudomonas aeruginosa PA01
acgcgccgcgguuuccgugc

SEQ ID NO: 3373371 - RNA, 17 nt, Pseudomonas aeruginosa PA01
acgcgccgggucggaug

SEQ ID NO: 3373372 - RNA, 15 nt, Pseudomonas aeruginosa PA01
acgcgccgucgcgac

SEQ ID NO: 3373373 - RNA, 16 nt, Pseudomonas aeruginosa PA01
acgcgccuccggcagc

SEQ ID NO: 3373374 - RNA, 20 nt, Pseudomonas aeruginosa PA01
acgcgccuccggcagcgucg

SEQ ID NO: 3373375 - RNA, 19 nt, Pseudomonas aeruginosa PA01
acgcgcgcucucgccggcc

SEQ ID NO: 3373376 - RNA, 22 nt, Pseudomonas aeruginosa PA01
acgcgcuggaccauggccggcg

SEQ ID NO: 3373377 - RNA, 22 nt, Pseudomonas aeruginosa PA01
acgcgcuggaguaucgcccugg

SEQ ID NO: 3373378 - RNA, 18 nt, Pseudomonas aeruginosa PA01
acgcgcuuguccuccagc

SEQ ID NO: 3373379 - RNA, 20 nt, Pseudomonas aeruginosa PA01
acgcgcuuguccuccagcug

SEQ ID NO: 3373380 - RNA, 13 nt, Pseudomonas aeruginosa PA01
acgcggacagccu

SEQ ID NO: 3373381 - RNA, 17 nt, Pseudomonas aeruginosa PA01
acgcggacagccugggc

SEQ ID NO: 3373382 - RNA, 23 nt, Pseudomonas aeruginosa PA01
acgcggacccaguugggccagga

SEQ ID NO: 3373383 - RNA, 21 nt, Pseudomonas aeruginosa PA01
acgcggaccuugucgccggug

SEQ ID NO: 3373384 - RNA, 15 nt, Pseudomonas aeruginosa PA01
acgcggagcaggcgg

SEQ ID NO: 3373385 - RNA, 14 nt, Pseudomonas aeruginosa PA01
acgcggagggcggc

SEQ ID NO: 3373386 - RNA, 17 nt, Pseudomonas aeruginosa PA01
acgcggauuggccgggc

SEQ ID NO: 3373387 - RNA, 13 nt, Pseudomonas aeruginosa PA01
acgcggcaccgcu

SEQ ID NO: 3373388 - RNA, 18 nt, Pseudomonas aeruginosa PA01
acgcggccagcagcacgc

SEQ ID NO: 3373389 - RNA, 19 nt, Pseudomonas aeruginosa PA01
acgcggccagcagcacgcc

SEQ ID NO: 3373390 - RNA, 15 nt, Pseudomonas aeruginosa PA01
acgcggccugggccg

SEQ ID NO: 3373391 - RNA, 16 nt, Pseudomonas aeruginosa PA01
acgcggcgaagggcgc

SEQ ID NO: 3373392 - RNA, 17 nt, Pseudomonas aeruginosa PA01
acgcggcuggcgcagga

SEQ ID NO: 3373393 - RNA, 19 nt, Pseudomonas aeruginosa PA01
acgcggcuucggucaggug

SEQ ID NO: 3373394 - RNA, 23 nt, Pseudomonas aeruginosa PA01
acgcgggacuuguacucgccggu

SEQ ID NO: 3373395 - RNA, 12 nt, Pseudomonas aeruginosa PA01
acgcgggccucu

SEQ ID NO: 3373396 - RNA, 16 nt, Pseudomonas aeruginosa PA01
acgcggguugcccggc

SEQ ID NO: 3373397 - RNA, 17 nt, Pseudomonas aeruginosa PA01
acgcggguugcccggcu

SEQ ID NO: 3373398 - RNA, 22 nt, Pseudomonas aeruginosa PA01
acgcggugccauucggugcgcu

SEQ ID NO: 3373399 - RNA, 19 nt, Pseudomonas aeruginosa PA01
acgcguaggggaccacccc

SEQ ID NO: 3373400 - RNA, 16 nt, Pseudomonas aeruginosa PA01
acgcgugauacagcuc

SEQ ID NO: 3373401 - RNA, 17 nt, Pseudomonas aeruginosa PA01
acgcgugauacagcucg

SEQ ID NO: 3373402 - RNA, 19 nt, Pseudomonas aeruginosa PA01
acgcguucccccguggcga

SEQ ID NO: 3373403 - RNA, 17 nt, Pseudomonas aeruginosa PA01
acgcguucggcgaugcc

SEQ ID NO: 3373404 - RNA, 20 nt, Pseudomonas aeruginosa PA01
acgcuacguuccagggccug

SEQ ID NO: 3373405 - RNA, 14 nt, Pseudomonas aeruginosa PA01
acgcucaccaccac

SEQ ID NO: 3373406 - RNA, 20 nt, Pseudomonas aeruginosa PA01
acgcucaccaccaccgcgcc

SEQ ID NO: 3373407 - RNA, 21 nt, Pseudomonas aeruginosa PA01
acgcucaccaccaccgcgccg

SEQ ID NO: 3373408 - RNA, 21 nt, Pseudomonas aeruginosa PA01
acgcucacguagcccccgccg

SEQ ID NO: 3373409 - RNA, 22 nt, Pseudomonas aeruginosa PA01
acgcucaggaagaagccucgcg

SEQ ID NO: 3373410 - RNA, 13 nt, Pseudomonas aeruginosa PA01
acgcucaggccaa

SEQ ID NO: 3373411 - RNA, 14 nt, Pseudomonas aeruginosa PA01
acgcucaggucggu

SEQ ID NO: 3373412 - RNA, 15 nt, Pseudomonas aeruginosa PA01
acgcucaggucgguc

SEQ ID NO: 3373413 - RNA, 14 nt, Pseudomonas aeruginosa PA01
acgcucagugcgcc

SEQ ID NO: 3373414 - RNA, 15 nt, Pseudomonas aeruginosa PA01
acgcuccggugccag

SEQ ID NO: 3373415 - RNA, 16 nt, Pseudomonas aeruginosa PA01
acgcuccugcgccggc

SEQ ID NO: 3373416 - RNA, 24 nt, Pseudomonas aeruginosa PA01
acgcuccugcgccggcucgugcga

SEQ ID NO: 3373417 - RNA, 21 nt, Pseudomonas aeruginosa PA01
acgcuccuggaagaacaggcg

SEQ ID NO: 3373418 - RNA, 22 nt, Pseudomonas aeruginosa PA01
acggcagggucagccgaugcuc

SEQ ID NO: 3373419 - RNA, 16 nt, Pseudomonas aeruginosa PA01
acggcagguggcgggu

SEQ ID NO: 3373420 - RNA, 22 nt, Pseudomonas aeruginosa PA01
acggcagguggcgggucggcgg

SEQ ID NO: 3373421 - RNA, 23 nt, Pseudomonas aeruginosa PA01
acggcagguggcgggucggcgga

SEQ ID NO: 3373422 - RNA, 16 nt, Pseudomonas aeruginosa PA01
acggcaucaccggcgg

SEQ ID NO: 3373423 - RNA, 19 nt, Pseudomonas aeruginosa PA01
acggcaucggagaccacgg

SEQ ID NO: 3373424 - RNA, 14 nt, Pseudomonas aeruginosa PA01
acggcaucggccac

SEQ ID NO: 3373425 - RNA, 20 nt, Pseudomonas aeruginosa PA01
acggcaugcacgcccuggag

SEQ ID NO: 3373426 - RNA, 22 nt, Pseudomonas aeruginosa PA01
acggcauuccugguccagccag

SEQ ID NO: 3373427 - RNA, 23 nt, Pseudomonas aeruginosa PA01
acggcauuccugguccagccagc

SEQ ID NO: 3373428 - RNA, 15 nt, Pseudomonas aeruginosa PA01
acggcauucucucuu

SEQ ID NO: 3373429 - RNA, 12 nt, Pseudomonas aeruginosa PA01
acggccagcagg

SEQ ID NO: 3373430 - RNA, 13 nt, Pseudomonas aeruginosa PA01
acggccaggccca

SEQ ID NO: 3373431 - RNA, 19 nt, Pseudomonas aeruginosa PA01
acggccaggucuucuggaa

SEQ ID NO: 3373432 - RNA, 14 nt, Pseudomonas aeruginosa PA01
acggccagucgcgu

SEQ ID NO: 3373433 - RNA, 14 nt, Pseudomonas aeruginosa PA01
acggcccacggcga

SEQ ID NO: 3373434 - RNA, 16 nt, Pseudomonas aeruginosa PA01
acggccccgagaaaac

SEQ ID NO: 3373435 - RNA, 19 nt, Pseudomonas aeruginosa PA01
acggccccgagaaaacccu

SEQ ID NO: 3373436 - RNA, 20 nt, Pseudomonas aeruginosa PA01
acggccccgagaaaacccug

SEQ ID NO: 3373437 - RNA, 22 nt, Pseudomonas aeruginosa PA01
acggcccgcucuugauacccac

SEQ ID NO: 3373438 - RNA, 16 nt, Pseudomonas aeruginosa PA01
acggcccuccggcgcg

SEQ ID NO: 3373439 - RNA, 22 nt, Pseudomonas aeruginosa PA01
acggccggcucgguguaggcga

SEQ ID NO: 3373440 - RNA, 21 nt, Pseudomonas aeruginosa PA01
acggccgucccagguuggcga

SEQ ID NO: 3373441 - RNA, 16 nt, Pseudomonas aeruginosa PA01
acggccguccugcggc

SEQ ID NO: 3373442 - RNA, 17 nt, Pseudomonas aeruginosa PA01
acggccguccugcggcc

SEQ ID NO: 3373443 - RNA, 22 nt, Pseudomonas aeruginosa PA01
acggccguccugcggccguucg

SEQ ID NO: 3373444 - RNA, 16 nt, Pseudomonas aeruginosa PA01
acggccuccgguggcg

SEQ ID NO: 3373445 - RNA, 20 nt, Pseudomonas aeruginosa PA01
acggccucgcgugcgcuggu

SEQ ID NO: 3373446 - RNA, 13 nt, Pseudomonas aeruginosa PA01
acggccugcgccc

SEQ ID NO: 3373447 - RNA, 13 nt, Pseudomonas aeruginosa PA01
acggccuucggca

SEQ ID NO: 3373448 - RNA, 16 nt, Pseudomonas aeruginosa PA01
acggcgaaaccggcca

SEQ ID NO: 3373449 - RNA, 17 nt, Pseudomonas aeruginosa PA01
acggcgaacaccgggcc

SEQ ID NO: 3373450 - RNA, 21 nt, Pseudomonas aeruginosa PA01
acggcgaacaccgggccgccg

SEQ ID NO: 3373451 - RNA, 23 nt, Pseudomonas aeruginosa PA01
acggcgaacaccgggccgccggc

SEQ ID NO: 3373452 - RNA, 17 nt, Pseudomonas aeruginosa PA01
acggcgaagaacagcgg

SEQ ID NO: 3373453 - RNA, 13 nt, Pseudomonas aeruginosa PA01
acggcgaagccgc

SEQ ID NO: 3373454 - RNA, 18 nt, Pseudomonas aeruginosa PA01
acggcgaauucgucgccg

SEQ ID NO: 3373455 - RNA, 20 nt, Pseudomonas aeruginosa PA01
acggcgaauucgucgccgcc

SEQ ID NO: 3373456 - RNA, 21 nt, Pseudomonas aeruginosa PA01
acggcgaauucgucgccgccg

SEQ ID NO: 3373457 - RNA, 19 nt, Pseudomonas aeruginosa PA01
acggcgacccgaaggucgc

SEQ ID NO: 3373458 - RNA, 20 nt, Pseudomonas aeruginosa PA01
acggcgacccgcacguugag

SEQ ID NO: 3373459 - RNA, 19 nt, Pseudomonas aeruginosa PA01
acggcgacccgccguucgc

SEQ ID NO: 3373460 - RNA, 15 nt, Pseudomonas aeruginosa PA01
acggcgacccugggg

SEQ ID NO: 3373461 - RNA, 22 nt, Pseudomonas aeruginosa PA01
acggcgacccuggggucgccgu

SEQ ID NO: 3373462 - RNA, 15 nt, Pseudomonas aeruginosa PA01
acggcgaccgcugga

SEQ ID NO: 3373463 - RNA, 16 nt, Pseudomonas aeruginosa PA01
acggcgagacuaccga

SEQ ID NO: 3373464 - RNA, 16 nt, Pseudomonas aeruginosa PA01
acggcgagagcgccga

SEQ ID NO: 3373465 - RNA, 16 nt, Pseudomonas aeruginosa PA01
acggcgauacccaggc

SEQ ID NO: 3373466 - RNA, 14 nt, Pseudomonas aeruginosa PA01
acggcgaucgccgg

SEQ ID NO: 3373467 - RNA, 16 nt, Pseudomonas aeruginosa PA01
acggcgauggucagga

SEQ ID NO: 3373468 - RNA, 15 nt, Pseudomonas aeruginosa PA01
acggcgcaagggcgc

SEQ ID NO: 3373469 - RNA, 15 nt, Pseudomonas aeruginosa PA01
acggcgcagcagggc

SEQ ID NO: 3373470 - RNA, 14 nt, Pseudomonas aeruginosa PA01
acggcgcagccgca

SEQ ID NO: 3373471 - RNA, 18 nt, Pseudomonas aeruginosa PA01
acggcgcagccgcaaggc

SEQ ID NO: 3373472 - RNA, 21 nt, Pseudomonas aeruginosa PA01
acggcgcagccgcaaggccag

SEQ ID NO: 3373473 - RNA, 13 nt, Pseudomonas aeruginosa PA01
acggcgcagggca

SEQ ID NO: 3373474 - RNA, 12 nt, Pseudomonas aeruginosa PA01
acggcgcauccc

SEQ ID NO: 3373475 - RNA, 16 nt, Pseudomonas aeruginosa PA01
acggcgcaucgucgau

SEQ ID NO: 3373476 - RNA, 22 nt, Pseudomonas aeruginosa PA01
acggcgcaucgucgaugcgucc

SEQ ID NO: 3373477 - RNA, 15 nt, Pseudomonas aeruginosa PA01
acggcgcccgagggc

SEQ ID NO: 3373478 - RNA, 19 nt, Pseudomonas aeruginosa PA01
acggcgcccucgggcgccg

SEQ ID NO: 3373479 - RNA, 14 nt, Pseudomonas aeruginosa PA01
acggcgccgaugcc

SEQ ID NO: 3373480 - RNA, 15 nt, Pseudomonas aeruginosa PA01
acggcgcgagaaaaa

SEQ ID NO: 3373481 - RNA, 13 nt, Pseudomonas aeruginosa PA01
acggcgcgaugga

SEQ ID NO: 3373482 - RNA, 18 nt, Pseudomonas aeruginosa PA01
acggcgcggaacaucgcc

SEQ ID NO: 3373483 - RNA, 21 nt, Pseudomonas aeruginosa PA01
acggcgcggaacaucgcccgg

SEQ ID NO: 3373484 - RNA, 23 nt, Pseudomonas aeruginosa PA01
acggcgcggaacaucgcccggcg

SEQ ID NO: 3373485 - RNA, 15 nt, Pseudomonas aeruginosa PA01
acggcgcggugaggg

SEQ ID NO: 3373486 - RNA, 15 nt, Pseudomonas aeruginosa PA01
acggcgcgucggcgg

SEQ ID NO: 3373487 - RNA, 13 nt, Pseudomonas aeruginosa PA01
acggcgcuggucu

SEQ ID NO: 3373488 - RNA, 17 nt, Pseudomonas aeruginosa PA01
acggcgcuucaacugcu

SEQ ID NO: 3373489 - RNA, 18 nt, Pseudomonas aeruginosa PA01
acggcgcuuucaucaggc

SEQ ID NO: 3373490 - RNA, 23 nt, Pseudomonas aeruginosa PA01
acggcggacugcucgccgccggc

SEQ ID NO: 3373491 - RNA, 17 nt, Pseudomonas aeruginosa PA01
acggcggaucgaucagc

SEQ ID NO: 3373492 - RNA, 15 nt, Pseudomonas aeruginosa PA01
acggcggccgccauc

SEQ ID NO: 3373493 - RNA, 20 nt, Pseudomonas aeruginosa PA01
acggcggccggauggccgcc

SEQ ID NO: 3373494 - RNA, 20 nt, Pseudomonas aeruginosa PA01
acggcggccucgaggucggc

SEQ ID NO: 3373495 - RNA, 16 nt, Pseudomonas aeruginosa PA01
acggcggcgaccccga

SEQ ID NO: 3373496 - RNA, 23 nt, Pseudomonas aeruginosa PA01
acggcggcggcggaccuccgcca

SEQ ID NO: 3373497 - RNA, 16 nt, Pseudomonas aeruginosa PA01
acggcgggagcggccu

SEQ ID NO: 3373498 - RNA, 17 nt, Pseudomonas aeruginosa PA01
acggcgggagcggccug

SEQ ID NO: 3373499 - RNA, 23 nt, Pseudomonas aeruginosa PA01
acggcguaccaggaugcccugcu

SEQ ID NO: 3373500 - RNA, 13 nt, Pseudomonas aeruginosa PA01
acggcgucacgcc

SEQ ID NO: 3373501 - RNA, 17 nt, Pseudomonas aeruginosa PA01
acggcgucacgccgauc

SEQ ID NO: 3373502 - RNA, 16 nt, Pseudomonas aeruginosa PA01
acggcgugcagguagc

SEQ ID NO: 3373503 - RNA, 14 nt, Pseudomonas aeruginosa PA01
acggcgugccgcag

SEQ ID NO: 3373504 - RNA, 19 nt, Pseudomonas aeruginosa PA01
acggcgugccgcaggccgc

SEQ ID NO: 3373505 - RNA, 14 nt, Pseudomonas aeruginosa PA01
acggcgugccgggc

SEQ ID NO: 3373506 - RNA, 15 nt, Pseudomonas aeruginosa PA01
acggcgugccgggca

SEQ ID NO: 3373507 - RNA, 15 nt, Pseudomonas aeruginosa PA01
acggcguguccaggg

SEQ ID NO: 3373508 - RNA, 15 nt, Pseudomonas aeruginosa PA01
acggcguuauccgcc

SEQ ID NO: 3373509 - RNA, 20 nt, Pseudomonas aeruginosa PA01
acggcguucggggcccucca

SEQ ID NO: 3373510 - RNA, 16 nt, Pseudomonas aeruginosa PA01
acggcuaucaggugag

SEQ ID NO: 3373511 - RNA, 19 nt, Pseudomonas aeruginosa PA01
acggcuaucaggugagggc

SEQ ID NO: 3373512 - RNA, 19 nt, Pseudomonas aeruginosa PA01
acggcucaauccggcugga

SEQ ID NO: 3373513 - RNA, 22 nt, Pseudomonas aeruginosa PA01
acggcucagaacagcggcagcu

SEQ ID NO: 3373514 - RNA, 16 nt, Pseudomonas aeruginosa PA01
acggcuccggcuccgc

SEQ ID NO: 3373515 - RNA, 13 nt, Pseudomonas aeruginosa PA01
acggcucgcgcag

SEQ ID NO: 3373516 - RNA, 18 nt, Pseudomonas aeruginosa PA01
acggcucgcgcagcggcg

SEQ ID NO: 3373517 - RNA, 15 nt, Pseudomonas aeruginosa PA01
acggcucgcggguca

SEQ ID NO: 3373518 - RNA, 13 nt, Pseudomonas aeruginosa PA01
acggcucggcgag

SEQ ID NO: 3373519 - RNA, 20 nt, Pseudomonas aeruginosa PA01
acggcucggcgaggaacagc

SEQ ID NO: 3373520 - RNA, 13 nt, Pseudomonas aeruginosa PA01
acggcucuucccc

SEQ ID NO: 3373521 - RNA, 22 nt, Pseudomonas aeruginosa PA01
acgucggcguccauggcggcga

SEQ ID NO: 3373522 - RNA, 23 nt, Pseudomonas aeruginosa PA01
acgucggcgucgaggugcggcug

SEQ ID NO: 3373523 - RNA, 17 nt, Pseudomonas aeruginosa PA01
acgucgguucagcgcgg

SEQ ID NO: 3373524 - RNA, 18 nt, Pseudomonas aeruginosa PA01
acgucgguucagcgcgga

SEQ ID NO: 3373525 - RNA, 16 nt, Pseudomonas aeruginosa PA01
acgucguacucggcgg

SEQ ID NO: 3373526 - RNA, 17 nt, Pseudomonas aeruginosa PA01
acgucguacucggcggg

SEQ ID NO: 3373527 - RNA, 16 nt, Pseudomonas aeruginosa PA01
acgucguagccaggca

SEQ ID NO: 3373528 - RNA, 15 nt, Pseudomonas aeruginosa PA01
acgucguccagcgcc

SEQ ID NO: 3373529 - RNA, 14 nt, Pseudomonas aeruginosa PA01
acgucgucggcgac

SEQ ID NO: 3373530 - RNA, 20 nt, Pseudomonas aeruginosa PA01
acgucguggauaggcggcgg

SEQ ID NO: 3373531 - RNA, 17 nt, Pseudomonas aeruginosa PA01
acgucguuucucggcga

SEQ ID NO: 3373532 - RNA, 21 nt, Pseudomonas aeruginosa PA01
acgucguuucucggcgauggc

SEQ ID NO: 3373533 - RNA, 23 nt, Pseudomonas aeruginosa PA01
acgucuggccagaaggucgggga

SEQ ID NO: 3373534 - RNA, 19 nt, Pseudomonas aeruginosa PA01
acgucuuccgggaccggcu

SEQ ID NO: 3373535 - RNA, 21 nt, Pseudomonas aeruginosa PA01
acgucuuccgggaccggcugc

SEQ ID NO: 3373536 - RNA, 19 nt, Pseudomonas aeruginosa PA01
acgucuucgauggcggccg

SEQ ID NO: 3373537 - RNA, 20 nt, Pseudomonas aeruginosa PA01
acgucuucgauggcggccgc

SEQ ID NO: 3373538 - RNA, 14 nt, Pseudomonas aeruginosa PA01
acgugaagccccug

SEQ ID NO: 3373539 - RNA, 21 nt, Pseudomonas aeruginosa PA01
acgugaccguccagcgcgccg

SEQ ID NO: 3373540 - RNA, 22 nt, Pseudomonas aeruginosa PA01
acgugaccguccagcgcgccgc

SEQ ID NO: 3373541 - RNA, 12 nt, Pseudomonas aeruginosa PA01
acgugcaccauc

SEQ ID NO: 3373542 - RNA, 13 nt, Pseudomonas aeruginosa PA01
acgugcacccgcu

SEQ ID NO: 3373543 - RNA, 15 nt, Pseudomonas aeruginosa PA01
acgugcagcucggca

SEQ ID NO: 3373544 - RNA, 16 nt, Pseudomonas aeruginosa PA01
acgugcagcucggcac

SEQ ID NO: 3373545 - RNA, 18 nt, Pseudomonas aeruginosa PA01
acgugcccauuuuccaac

SEQ ID NO: 3373546 - RNA, 13 nt, Pseudomonas aeruginosa PA01
acgugccccaggc

SEQ ID NO: 3373547 - RNA, 19 nt, Pseudomonas aeruginosa PA01
acgugccccaggccgaacu

SEQ ID NO: 3373548 - RNA, 18 nt, Pseudomonas aeruginosa PA01
acgugcggccugcaacag

SEQ ID NO: 3373549 - RNA, 18 nt, Pseudomonas aeruginosa PA01
acguggauauugugcgag

SEQ ID NO: 3373550 - RNA, 15 nt, Pseudomonas aeruginosa PA01
acguggcgcuugagc

SEQ ID NO: 3373551 - RNA, 17 nt, Pseudomonas aeruginosa PA01
acguggcgcuugagcag

SEQ ID NO: 3373552 - RNA, 23 nt, Pseudomonas aeruginosa PA01
acguggcgcuugagcagccaggc

SEQ ID NO: 3373553 - RNA, 13 nt, Pseudomonas aeruginosa PA01
acgugggccugcu

SEQ ID NO: 3373554 - RNA, 17 nt, Pseudomonas aeruginosa PA01
acguguucgcagucgcu

SEQ ID NO: 3373555 - RNA, 13 nt, Pseudomonas aeruginosa PA01
acguucaggcugu

SEQ ID NO: 3373556 - RNA, 22 nt, Pseudomonas aeruginosa PA01
acguucaguucugggcggccag

SEQ ID NO: 3373557 - RNA, 23 nt, Pseudomonas aeruginosa PA01
acguuccaccuggcgcagguaga

SEQ ID NO: 3373558 - RNA, 14 nt, Pseudomonas aeruginosa PA01
acguucugcaggac

SEQ ID NO: 3373559 - RNA, 17 nt, Pseudomonas aeruginosa PA01
acguucugcccgccggc

SEQ ID NO: 3373560 - RNA, 14 nt, Pseudomonas aeruginosa PA01
acguucugcucgcu

SEQ ID NO: 3373561 - RNA, 18 nt, Pseudomonas aeruginosa PA01
acguucugcucgcugccc

SEQ ID NO: 3373562 - RNA, 13 nt, Pseudomonas aeruginosa PA01
acguucuugaccu

SEQ ID NO: 3373563 - RNA, 16 nt, Pseudomonas aeruginosa PA01
acguugaacacaucga

SEQ ID NO: 3373564 - RNA, 18 nt, Pseudomonas aeruginosa PA01
acguugacgaucgccccg

SEQ ID NO: 3373565 - RNA, 16 nt, Pseudomonas aeruginosa PA01
acguugagaaggcgcc

SEQ ID NO: 3373566 - RNA, 17 nt, Pseudomonas aeruginosa PA01
acguugcaguccaggcc

SEQ ID NO: 3373567 - RNA, 19 nt, Pseudomonas aeruginosa PA01
acguugccauccagcgccu

SEQ ID NO: 3373568 - RNA, 21 nt, Pseudomonas aeruginosa PA01
acguugccgcgcgggccggcg

SEQ ID NO: 3373569 - RNA, 18 nt, Pseudomonas aeruginosa PA01
acguugcugcccuggcgc

SEQ ID NO: 3373570 - RNA, 23 nt, Pseudomonas aeruginosa PA01
acguugcugugcugcaccagcag

SEQ ID NO: 3373571 - RNA, 19 nt, Pseudomonas aeruginosa PA01
acguuggccgucuccaggc

SEQ ID NO: 3373572 - RNA, 23 nt, Pseudomonas aeruginosa PA01
acguuggccgucuccaggcgcgc

SEQ ID NO: 3373573 - RNA, 15 nt, Pseudomonas aeruginosa PA01
acguuuuucccgugg

SEQ ID NO: 3373574 - RNA, 21 nt, Pseudomonas aeruginosa PA01
acuacaggaccuucagauacu

SEQ ID NO: 3373575 - RNA, 18 nt, Pseudomonas aeruginosa PA01
acuaccagguucugccag

SEQ ID NO: 3373576 - RNA, 21 nt, Pseudomonas aeruginosa PA01
acuaccagguucugccagagc

SEQ ID NO: 3373577 - RNA, 14 nt, Pseudomonas aeruginosa PA01
acuagcccucgacc

SEQ ID NO: 3373578 - RNA, 14 nt, Pseudomonas aeruginosa PA01
acuaucgucgaggg

SEQ ID NO: 3373579 - RNA, 18 nt, Pseudomonas aeruginosa PA01
acuaucuucgauugcuac

SEQ ID NO: 3373580 - RNA, 20 nt, Pseudomonas aeruginosa PA01
acuauuccgccaccagccag

SEQ ID NO: 3373581 - RNA, 14 nt, Pseudomonas aeruginosa PA01
acucacccgcugcg

SEQ ID NO: 3373582 - RNA, 12 nt, Pseudomonas aeruginosa PA01
acucauagcuca

SEQ ID NO: 3373583 - RNA, 14 nt, Pseudomonas aeruginosa PA01
acucaucaggcugc

SEQ ID NO: 3373584 - RNA, 21 nt, Pseudomonas aeruginosa PA01
acucauccucgccgcuggcgc

SEQ ID NO: 3373585 - RNA, 15 nt, Pseudomonas aeruginosa PA01
acucaugaccgccgc

SEQ ID NO: 3373586 - RNA, 18 nt, Pseudomonas aeruginosa PA01
acuccacacggaacaugg

SEQ ID NO: 3373587 - RNA, 19 nt, Pseudomonas aeruginosa PA01
acuccacgaggaugucggc

SEQ ID NO: 3373588 - RNA, 16 nt, Pseudomonas aeruginosa PA01
acuccagagccauggg

SEQ ID NO: 3373589 - RNA, 23 nt, Pseudomonas aeruginosa PA01
acuccagauagugcggccaggcg

SEQ ID NO: 3373590 - RNA, 14 nt, Pseudomonas aeruginosa PA01
acuccagcagcgca

SEQ ID NO: 3373591 - RNA, 19 nt, Pseudomonas aeruginosa PA01
acuccagccaggcgaugaa

SEQ ID NO: 3373592 - RNA, 20 nt, Pseudomonas aeruginosa PA01
acuccagccccgcgauugca

SEQ ID NO: 3373593 - RNA, 15 nt, Pseudomonas aeruginosa PA01
acuccagcgcgggca

SEQ ID NO: 3373594 - RNA, 22 nt, Pseudomonas aeruginosa PA01
acuccagcucgacccgcccgcc

SEQ ID NO: 3373595 - RNA, 14 nt, Pseudomonas aeruginosa PA01
acuccagcuucuuc

SEQ ID NO: 3373596 - RNA, 13 nt, Pseudomonas aeruginosa PA01
acuccaggcggcg

SEQ ID NO: 3373597 - RNA, 14 nt, Pseudomonas aeruginosa PA01
acuccaggcggcgg

SEQ ID NO: 3373598 - RNA, 15 nt, Pseudomonas aeruginosa PA01
acuccaggggucggc

SEQ ID NO: 3373599 - RNA, 17 nt, Pseudomonas aeruginosa PA01
acucccguccagcgcuu

SEQ ID NO: 3373600 - RNA, 19 nt, Pseudomonas aeruginosa PA01
acucccugcucgcgcaggg

SEQ ID NO: 3373601 - RNA, 14 nt, Pseudomonas aeruginosa PA01
acuccgagcaggac

SEQ ID NO: 3373602 - RNA, 17 nt, Pseudomonas aeruginosa PA01
acuccgagcaggacagc

SEQ ID NO: 3373603 - RNA, 14 nt, Pseudomonas aeruginosa PA01
acuccgagggccgc

SEQ ID NO: 3373604 - RNA, 12 nt, Pseudomonas aeruginosa PA01
acuccgccagca

SEQ ID NO: 3373605 - RNA, 13 nt, Pseudomonas aeruginosa PA01
acuccgccagcac

SEQ ID NO: 3373606 - RNA, 18 nt, Pseudomonas aeruginosa PA01
acuccgccagcaccaccc

SEQ ID NO: 3373607 - RNA, 22 nt, Pseudomonas aeruginosa PA01
acuccgcccaguucuucgccgc

SEQ ID NO: 3373608 - RNA, 23 nt, Pseudomonas aeruginosa PA01
acuccggagaaccggcggauaac

SEQ ID NO: 3373609 - RNA, 15 nt, Pseudomonas aeruginosa PA01
acuccggcauaccgc

SEQ ID NO: 3373610 - RNA, 23 nt, Pseudomonas aeruginosa PA01
acuccggccggcggccugagccg

SEQ ID NO: 3373611 - RNA, 22 nt, Pseudomonas aeruginosa PA01
acuccggcgcagcccagccgcu

SEQ ID NO: 3373612 - RNA, 16 nt, Pseudomonas aeruginosa PA01
acuccgggcuggucgu

SEQ ID NO: 3373613 - RNA, 22 nt, Pseudomonas aeruginosa PA01
acuccggguugaccgccagaca

SEQ ID NO: 3373614 - RNA, 18 nt, Pseudomonas aeruginosa PA01
acuccggugucaggccga

SEQ ID NO: 3373615 - RNA, 17 nt, Pseudomonas aeruginosa PA01
acuccgucuccagcaac

SEQ ID NO: 3373616 - RNA, 16 nt, Pseudomonas aeruginosa PA01
acuccuccagcaucca

SEQ ID NO: 3373617 - RNA, 15 nt, Pseudomonas aeruginosa PA01
acuccuccgccugca

SEQ ID NO: 3373618 - RNA, 17 nt, Pseudomonas aeruginosa PA01
acuccuccgccugcacg

SEQ ID NO: 3373619 - RNA, 18 nt, Pseudomonas aeruginosa PA01
acuccuccgccugcacgu

SEQ ID NO: 3373620 - RNA, 16 nt, Pseudomonas aeruginosa PA01
acuccuccucgcucca

SEQ ID NO: 3373621 - RNA, 22 nt, Pseudomonas aeruginosa PA01
acuccuccucgcuccagaggaa

SEQ ID NO: 3373622 - RNA, 14 nt, Pseudomonas aeruginosa PA01
acuccugcaaacgg

SEQ ID NO: 3373623 - RNA, 18 nt, Pseudomonas aeruginosa PA01
acuggaucggccccaccu

SEQ ID NO: 3373624 - RNA, 14 nt, Pseudomonas aeruginosa PA01
acuggaugucgcug

SEQ ID NO: 3373625 - RNA, 19 nt, Pseudomonas aeruginosa PA01
acuggccagcaccaguccc

SEQ ID NO: 3373626 - RNA, 17 nt, Pseudomonas aeruginosa PA01
acuggcccacggcgccu

SEQ ID NO: 3373627 - RNA, 22 nt, Pseudomonas aeruginosa PA01
acuggcccacggcgccuuccca

SEQ ID NO: 3373628 - RNA, 22 nt, Pseudomonas aeruginosa PA01
acuggcccucucucgccucggc

SEQ ID NO: 3373629 - RNA, 21 nt, Pseudomonas aeruginosa PA01
acuggccgaaauugaccaggu

SEQ ID NO: 3373630 - RNA, 18 nt, Pseudomonas aeruginosa PA01
acuggcgaaugccuucga

SEQ ID NO: 3373631 - RNA, 13 nt, Pseudomonas aeruginosa PA01
acuggcgauggau

SEQ ID NO: 3373632 - RNA, 15 nt, Pseudomonas aeruginosa PA01
acuggcgcugcgcgg

SEQ ID NO: 3373633 - RNA, 14 nt, Pseudomonas aeruginosa PA01
acuggcggaccgcc

SEQ ID NO: 3373634 - RNA, 18 nt, Pseudomonas aeruginosa PA01
acuggcggaucaccggcu

SEQ ID NO: 3373635 - RNA, 13 nt, Pseudomonas aeruginosa PA01
acuggcggcuggg

SEQ ID NO: 3373636 - RNA, 22 nt, Pseudomonas aeruginosa PA01
acugggcgauguccuggaucgg

SEQ ID NO: 3373637 - RNA, 21 nt, Pseudomonas aeruginosa PA01
acugggcguggcggccgccgg

SEQ ID NO: 3373638 - RNA, 22 nt, Pseudomonas aeruginosa PA01
acugggcguggcggccgccggc

SEQ ID NO: 3373639 - RNA, 18 nt, Pseudomonas aeruginosa PA01
acuggggcaucucggcca

SEQ ID NO: 3373640 - RNA, 20 nt, Pseudomonas aeruginosa PA01
acugggucuuguaguucauc

SEQ ID NO: 3373641 - RNA, 22 nt, Pseudomonas aeruginosa PA01
acugguaggacagggccaggcc

SEQ ID NO: 3373642 - RNA, 20 nt, Pseudomonas aeruginosa PA01
acugguccggguuggcgcag

SEQ ID NO: 3373643 - RNA, 14 nt, Pseudomonas aeruginosa PA01
acuggucgcagccg

SEQ ID NO: 3373644 - RNA, 15 nt, Pseudomonas aeruginosa PA01
acuggucgcagccgc

SEQ ID NO: 3373645 - RNA, 14 nt, Pseudomonas aeruginosa PA01
acuggucgccgcag

SEQ ID NO: 3373646 - RNA, 18 nt, Pseudomonas aeruginosa PA01
acuggucgccgcaggucc

SEQ ID NO: 3373647 - RNA, 14 nt, Pseudomonas aeruginosa PA01
acuggucgcgcgcg

SEQ ID NO: 3373648 - RNA, 18 nt, Pseudomonas aeruginosa PA01
acuggucgcgcgcggcca

SEQ ID NO: 3373649 - RNA, 20 nt, Pseudomonas aeruginosa PA01
acuggucgcgcgcggccagc

SEQ ID NO: 3373650 - RNA, 22 nt, Pseudomonas aeruginosa PA01
acuggucgcgcgcggccagcuc

SEQ ID NO: 3373651 - RNA, 21 nt, Pseudomonas aeruginosa PA01
acuggucgcggcugcgcgccg

SEQ ID NO: 3373652 - RNA, 22 nt, Pseudomonas aeruginosa PA01
acuggucgcggcugcgcgccgg

SEQ ID NO: 3373653 - RNA, 16 nt, Pseudomonas aeruginosa PA01
acuggucgcuccagcc

SEQ ID NO: 3373654 - RNA, 19 nt, Pseudomonas aeruginosa PA01
acuggucgcuccagcccca

SEQ ID NO: 3373655 - RNA, 18 nt, Pseudomonas aeruginosa PA01
acuggucuugccgauggc

SEQ ID NO: 3373656 - RNA, 17 nt, Pseudomonas aeruginosa PA01
acugguggcgaacagca

SEQ ID NO: 3373657 - RNA, 17 nt, Pseudomonas aeruginosa PA01
acugguugaagcgggag

SEQ ID NO: 3373658 - RNA, 20 nt, Pseudomonas aeruginosa PA01
acugguugaccugcagcgcc

SEQ ID NO: 3373659 - RNA, 14 nt, Pseudomonas aeruginosa PA01
acuguaccgcucug

SEQ ID NO: 3373660 - RNA, 20 nt, Pseudomonas aeruginosa PA01
acuguccgaccacuucggcg

SEQ ID NO: 3373661 - RNA, 18 nt, Pseudomonas aeruginosa PA01
acugucgugccuccagcc

SEQ ID NO: 3373662 - RNA, 14 nt, Pseudomonas aeruginosa PA01
acugucucgccgau

SEQ ID NO: 3373663 - RNA, 17 nt, Pseudomonas aeruginosa PA01
acugucucgccgaugcc

SEQ ID NO: 3373664 - RNA, 20 nt, Pseudomonas aeruginosa PA01
acuguuaaucauuggguccc

SEQ ID NO: 3373665 - RNA, 17 nt, Pseudomonas aeruginosa PA01
acuguuccucagccccu

SEQ ID NO: 3373666 - RNA, 14 nt, Pseudomonas aeruginosa PA01
acuguucggucggu

SEQ ID NO: 3373667 - RNA, 12 nt, Pseudomonas aeruginosa PA01
acuguugcucgg

SEQ ID NO: 3373668 - RNA, 21 nt, Pseudomonas aeruginosa PA01
acuguuggggcugcccaccac

SEQ ID NO: 3373669 - RNA, 17 nt, Pseudomonas aeruginosa PA01
acuucacgacaggcggc

SEQ ID NO: 3373670 - RNA, 14 nt, Pseudomonas aeruginosa PA01
acuucacguccagc

SEQ ID NO: 3373671 - RNA, 19 nt, Pseudomonas aeruginosa PA01
acuucacguccagcuguac

SEQ ID NO: 3373672 - RNA, 14 nt, Pseudomonas aeruginosa PA01
acuucaggccggcg

SEQ ID NO: 3373673 - RNA, 23 nt, Pseudomonas aeruginosa PA01
acuuccaccggcuugccgggugc

SEQ ID NO: 3373674 - RNA, 18 nt, Pseudomonas aeruginosa PA01
acuuccacuccaggcggc

SEQ ID NO: 3373675 - RNA, 20 nt, Pseudomonas aeruginosa PA01
acuuccacuccaggcggcgg

SEQ ID NO: 3373676 - RNA, 17 nt, Pseudomonas aeruginosa PA01
acuuccagcacgccgau

SEQ ID NO: 3373677 - RNA, 20 nt, Pseudomonas aeruginosa PA01
acuuccagcacgccgauccc

SEQ ID NO: 3373678 - RNA, 14 nt, Pseudomonas aeruginosa PA01
acuuccagcugcca

SEQ ID NO: 3373679 - RNA, 14 nt, Pseudomonas aeruginosa PA01
acuuccaggcgcag

SEQ ID NO: 3373680 - RNA, 16 nt, Pseudomonas aeruginosa PA01
acuuccaggcgcaggc

SEQ ID NO: 3373681 - RNA, 21 nt, Pseudomonas aeruginosa PA01
acuuccagguagcccaccucg

SEQ ID NO: 3373682 - RNA, 20 nt, Pseudomonas aeruginosa PA01
acuucccaggugcccuggaa

SEQ ID NO: 3373683 - RNA, 14 nt, Pseudomonas aeruginosa PA01
acuuccccucccga

SEQ ID NO: 3373684 - RNA, 14 nt, Pseudomonas aeruginosa PA01
acuucccggcgcag

SEQ ID NO: 3373685 - RNA, 17 nt, Pseudomonas aeruginosa PA01
acuucccugccggcggu

SEQ ID NO: 3373686 - RNA, 12 nt, Pseudomonas aeruginosa PA01
acuuccggcccg

SEQ ID NO: 3373687 - RNA, 19 nt, Pseudomonas aeruginosa PA01
acuuccggcccggccaggc

SEQ ID NO: 3373688 - RNA, 19 nt, Pseudomonas aeruginosa PA01
acuuccgggcugcgcucgg

SEQ ID NO: 3373689 - RNA, 20 nt, Pseudomonas aeruginosa PA01
acuuccgggcugcgcucggc

SEQ ID NO: 3373690 - RNA, 13 nt, Pseudomonas aeruginosa PA01
acuuccucggcga

SEQ ID NO: 3373691 - RNA, 18 nt, Pseudomonas aeruginosa PA01
acuuccugggaugccggg

SEQ ID NO: 3373692 - RNA, 20 nt, Pseudomonas aeruginosa PA01
acuucgaccaguacgucgag

SEQ ID NO: 3373693 - RNA, 20 nt, Pseudomonas aeruginosa PA01
acuucgacgaacucgacgcg

SEQ ID NO: 3373694 - RNA, 17 nt, Pseudomonas aeruginosa PA01
acuucgcaccagccggc

SEQ ID NO: 3373695 - RNA, 18 nt, Pseudomonas aeruginosa PA01
acuucgcaccagccggcc

SEQ ID NO: 3373696 - RNA, 21 nt, Pseudomonas aeruginosa PA01
acuucgcaccagccggccgcg

SEQ ID NO: 3373697 - RNA, 22 nt, Pseudomonas aeruginosa PA01
acuucggcgcgcggcagcacca

SEQ ID NO: 3373698 - RNA, 15 nt, Pseudomonas aeruginosa PA01
acuucggcuucaacg

SEQ ID NO: 3373699 - RNA, 22 nt, Pseudomonas aeruginosa PA01
acuucggucucguccggcgugg

SEQ ID NO: 3373700 - RNA, 16 nt, Pseudomonas aeruginosa PA01
acuucgguggauucga

SEQ ID NO: 3373701 - RNA, 13 nt, Pseudomonas aeruginosa PA01
acuucguccgcca

SEQ ID NO: 3373702 - RNA, 22 nt, Pseudomonas aeruginosa PA01
acuucguccgccaccacggcga

SEQ ID NO: 3373703 - RNA, 17 nt, Pseudomonas aeruginosa PA01
acuucguccggccgccc

SEQ ID NO: 3373704 - RNA, 15 nt, Pseudomonas aeruginosa PA01
acuucuccagguaca

SEQ ID NO: 3373705 - RNA, 18 nt, Pseudomonas aeruginosa PA01
acuucucgaacagcuccu

SEQ ID NO: 3373706 - RNA, 19 nt, Pseudomonas aeruginosa PA01
acuucucgacgaaggcgcg

SEQ ID NO: 3373707 - RNA, 15 nt, Pseudomonas aeruginosa PA01
acuugaacagggucu

SEQ ID NO: 3373708 - RNA, 18 nt, Pseudomonas aeruginosa PA01
acuugaaguguccguggu

SEQ ID NO: 3373709 - RNA, 13 nt, Pseudomonas aeruginosa PA01
acuugacggcgcc

SEQ ID NO: 3373710 - RNA, 13 nt, Pseudomonas aeruginosa PA01
acuugaucagccg

SEQ ID NO: 3373711 - RNA, 15 nt, Pseudomonas aeruginosa PA01
acuugccggcgccau

SEQ ID NO: 3373712 - RNA, 18 nt, Pseudomonas aeruginosa PA01
acuugccguccuucagga

SEQ ID NO: 3373713 - RNA, 14 nt, Pseudomonas aeruginosa PA01
acuugcgcaccgcg

SEQ ID NO: 3373714 - RNA, 19 nt, Pseudomonas aeruginosa PA01
acuugcgcaccgcgccggg

SEQ ID NO: 3373715 - RNA, 18 nt, Pseudomonas aeruginosa PA01
acuugcgccgaccgcgcg

SEQ ID NO: 3373716 - RNA, 22 nt, Pseudomonas aeruginosa PA01
acuugcggcccaccaccacgac

SEQ ID NO: 3373717 - RNA, 16 nt, Pseudomonas aeruginosa PA01
acuugcgggugcgcag

SEQ ID NO: 3373718 - RNA, 18 nt, Pseudomonas aeruginosa PA01
acuugcgggugcgcaggc

SEQ ID NO: 3373719 - RNA, 21 nt, Pseudomonas aeruginosa PA01
acuugcgggugcgcaggcugc

SEQ ID NO: 3373720 - RNA, 14 nt, Pseudomonas aeruginosa PA01
acuugcuguugccg

SEQ ID NO: 3373721 - RNA, 22 nt, Pseudomonas aeruginosa PA01
acuugcuguugccgcugcaggc

SEQ ID NO: 3373722 - RNA, 17 nt, Pseudomonas aeruginosa PA01
acuuggagaagaucgcc

SEQ ID NO: 3373723 - RNA, 14 nt, Pseudomonas aeruginosa PA01
acuuggccacgccu

SEQ ID NO: 3373724 - RNA, 22 nt, Pseudomonas aeruginosa PA01
acuugggcaucagcucgucuuu

SEQ ID NO: 3373725 - RNA, 20 nt, Pseudomonas aeruginosa PA01
agaccgagauuggccgccug

SEQ ID NO: 3373726 - RNA, 16 nt, Pseudomonas aeruginosa PA01
agaccggcagccgggu

SEQ ID NO: 3373727 - RNA, 14 nt, Pseudomonas aeruginosa PA01
agaccggcagcgcc

SEQ ID NO: 3373728 - RNA, 20 nt, Pseudomonas aeruginosa PA01
agaccggcagcgccgccagc

SEQ ID NO: 3373729 - RNA, 23 nt, Pseudomonas aeruginosa PA01
agaccggcgccccugcggcgccg

SEQ ID NO: 3373730 - RNA, 15 nt, Pseudomonas aeruginosa PA01
agaccggcuccaggg

SEQ ID NO: 3373731 - RNA, 18 nt, Pseudomonas aeruginosa PA01
agaccggcuccagggcga

SEQ ID NO: 3373732 - RNA, 15 nt, Pseudomonas aeruginosa PA01
agaccgugccgccgg

SEQ ID NO: 3373733 - RNA, 14 nt, Pseudomonas aeruginosa PA01
agaccguggcgcua

SEQ ID NO: 3373734 - RNA, 13 nt, Pseudomonas aeruginosa PA01
agaccuccaggua

SEQ ID NO: 3373735 - RNA, 15 nt, Pseudomonas aeruginosa PA01
agaccucgaaguccu

SEQ ID NO: 3373736 - RNA, 13 nt, Pseudomonas aeruginosa PA01
agaccucgagcag

SEQ ID NO: 3373737 - RNA, 15 nt, Pseudomonas aeruginosa PA01
agaccucgagcaggc

SEQ ID NO: 3373738 - RNA, 22 nt, Pseudomonas aeruginosa PA01
agaccucgagcaggccgaggag

SEQ ID NO: 3373739 - RNA, 19 nt, Pseudomonas aeruginosa PA01
agaccucgcugacuuccau

SEQ ID NO: 3373740 - RNA, 17 nt, Pseudomonas aeruginosa PA01
agaccugccgcccggcc

SEQ ID NO: 3373741 - RNA, 20 nt, Pseudomonas aeruginosa PA01
agaccugccgcccggccagg

SEQ ID NO: 3373742 - RNA, 22 nt, Pseudomonas aeruginosa PA01
agaccugccgcccggccaggcc

SEQ ID NO: 3373743 - RNA, 13 nt, Pseudomonas aeruginosa PA01
agaccuggccgcu

SEQ ID NO: 3373744 - RNA, 22 nt, Pseudomonas aeruginosa PA01
agaccuggccgcuguggaagua

SEQ ID NO: 3373745 - RNA, 23 nt, Pseudomonas aeruginosa PA01
agaccuggccgcuguggaaguac

SEQ ID NO: 3373746 - RNA, 21 nt, Pseudomonas aeruginosa PA01
agaccuggcugaauaccacgu

SEQ ID NO: 3373747 - RNA, 18 nt, Pseudomonas aeruginosa PA01
agaccuugaacucgcccg

SEQ ID NO: 3373748 - RNA, 17 nt, Pseudomonas aeruginosa PA01
agaccuugccguugcuc

SEQ ID NO: 3373749 - RNA, 18 nt, Pseudomonas aeruginosa PA01
agacgaaacucaucaggc

SEQ ID NO: 3373750 - RNA, 19 nt, Pseudomonas aeruginosa PA01
agacgaaagagcccggcaa

SEQ ID NO: 3373751 - RNA, 16 nt, Pseudomonas aeruginosa PA01
agacgaucagcaggau

SEQ ID NO: 3373752 - RNA, 14 nt, Pseudomonas aeruginosa PA01
agacgaucagcggc

SEQ ID NO: 3373753 - RNA, 21 nt, Pseudomonas aeruginosa PA01
agacgaucagcggcccgagca

SEQ ID NO: 3373754 - RNA, 13 nt, Pseudomonas aeruginosa PA01
agacgauggcgac

SEQ ID NO: 3373755 - RNA, 15 nt, Pseudomonas aeruginosa PA01
agacgauggcgacgu

SEQ ID NO: 3373756 - RNA, 16 nt, Pseudomonas aeruginosa PA01
agacgauugaccuccc

SEQ ID NO: 3373757 - RNA, 12 nt, Pseudomonas aeruginosa PA01
agacgcaccgag

SEQ ID NO: 3373758 - RNA, 20 nt, Pseudomonas aeruginosa PA01
agacgcaggugcccuggcag

SEQ ID NO: 3373759 - RNA, 22 nt, Pseudomonas aeruginosa PA01
agacgccaucaacggauauccc

SEQ ID NO: 3373760 - RNA, 16 nt, Pseudomonas aeruginosa PA01
agacgcccagcagggc

SEQ ID NO: 3373761 - RNA, 17 nt, Pseudomonas aeruginosa PA01
agacgcccagcagggcc

SEQ ID NO: 3373762 - RNA, 19 nt, Pseudomonas aeruginosa PA01
agacgcccagcagggccag

SEQ ID NO: 3373763 - RNA, 21 nt, Pseudomonas aeruginosa PA01
agacgcccggaccgaucucgu

SEQ ID NO: 3373764 - RNA, 15 nt, Pseudomonas aeruginosa PA01
agacgcccuggauga

SEQ ID NO: 3373765 - RNA, 21 nt, Pseudomonas aeruginosa PA01
agacgccgaggagacgcggca

SEQ ID NO: 3373766 - RNA, 18 nt, Pseudomonas aeruginosa PA01
agacgccgccccagccuc

SEQ ID NO: 3373767 - RNA, 20 nt, Pseudomonas aeruginosa PA01
agacgccgcucuaucagggu

SEQ ID NO: 3373768 - RNA, 19 nt, Pseudomonas aeruginosa PA01
agacgccguccaccagcca

SEQ ID NO: 3373769 - RNA, 21 nt, Pseudomonas aeruginosa PA01
agacgccguccaccagccagc

SEQ ID NO: 3373770 - RNA, 22 nt, Pseudomonas aeruginosa PA01
agacgccguccaccagccagcu

SEQ ID NO: 3373771 - RNA, 23 nt, Pseudomonas aeruginosa PA01
agacgccguccaccagccagcuc

SEQ ID NO: 3373772 - RNA, 19 nt, Pseudomonas aeruginosa PA01
agacgcggauuggccgggc

SEQ ID NO: 3373773 - RNA, 15 nt, Pseudomonas aeruginosa PA01
agacgcucggccagc

SEQ ID NO: 3373774 - RNA, 13 nt, Pseudomonas aeruginosa PA01
agacgcugcaccg

SEQ ID NO: 3373775 - RNA, 15 nt, Pseudomonas aeruginosa PA01
agacgcugcaccgcg

SEQ ID NO: 3373776 - RNA, 17 nt, Pseudomonas aeruginosa PA01
agacgcugcaccgcggc

SEQ ID NO: 3373777 - RNA, 19 nt, Pseudomonas aeruginosa PA01
agacgcugccgaggaacuc

SEQ ID NO: 3373778 - RNA, 19 nt, Pseudomonas aeruginosa PA01
agacgcugcucgacggcac

SEQ ID NO: 3373779 - RNA, 21 nt, Pseudomonas aeruginosa PA01
agacgcugcucgacggcacca

SEQ ID NO: 3373780 - RNA, 23 nt, Pseudomonas aeruginosa PA01
agacggaaacgcgcgcucucgcc

SEQ ID NO: 3373781 - RNA, 13 nt, Pseudomonas aeruginosa PA01
agacggccaggau

SEQ ID NO: 3373782 - RNA, 22 nt, Pseudomonas aeruginosa PA01
agacggcggcgaccccgaucac

SEQ ID NO: 3373783 - RNA, 12 nt, Pseudomonas aeruginosa PA01
agacgggacagg

SEQ ID NO: 3373784 - RNA, 14 nt, Pseudomonas aeruginosa PA01
agacgggcgacgcc

SEQ ID NO: 3373785 - RNA, 17 nt, Pseudomonas aeruginosa PA01
agacgggcgacgcccau

SEQ ID NO: 3373786 - RNA, 19 nt, Pseudomonas aeruginosa PA01
agacggggccucgcugccu

SEQ ID NO: 3373787 - RNA, 16 nt, Pseudomonas aeruginosa PA01
agacgguucagcagcg

SEQ ID NO: 3373788 - RNA, 19 nt, Pseudomonas aeruginosa PA01
agacgguucagcagcggca

SEQ ID NO: 3373789 - RNA, 16 nt, Pseudomonas aeruginosa PA01
agacguccagcgccac

SEQ ID NO: 3373790 - RNA, 18 nt, Pseudomonas aeruginosa PA01
agacguccuccaccgcuc

SEQ ID NO: 3373791 - RNA, 15 nt, Pseudomonas aeruginosa PA01
agacgucguccaccg

SEQ ID NO: 3373792 - RNA, 14 nt, Pseudomonas aeruginosa PA01
agacgugcugguag

SEQ ID NO: 3373793 - RNA, 23 nt, Pseudomonas aeruginosa PA01
agacguggcauucgucgccgcug

SEQ ID NO: 3373794 - RNA, 15 nt, Pseudomonas aeruginosa PA01
agacguugacgaucg

SEQ ID NO: 3373795 - RNA, 16 nt, Pseudomonas aeruginosa PA01
agacuccggcgcagcc

SEQ ID NO: 3373796 - RNA, 14 nt, Pseudomonas aeruginosa PA01
agacucuccagguc

SEQ ID NO: 3373797 - RNA, 13 nt, Pseudomonas aeruginosa PA01
agacuuccgggcu

SEQ ID NO: 3373798 - RNA, 14 nt, Pseudomonas aeruginosa PA01
agagaagcguucgc

SEQ ID NO: 3373799 - RNA, 24 nt, Pseudomonas aeruginosa PA01
agagacgcagcgcuagcgcauggc

SEQ ID NO: 3373800 - RNA, 14 nt, Pseudomonas aeruginosa PA01
agagacugaacucg

SEQ ID NO: 3373801 - RNA, 13 nt, Pseudomonas aeruginosa PA01
agagagcgccagc

SEQ ID NO: 3373802 - RNA, 13 nt, Pseudomonas aeruginosa PA01
agagaggcuggcg

SEQ ID NO: 3373803 - RNA, 13 nt, Pseudomonas aeruginosa PA01
agagaucgcccag

SEQ ID NO: 3373804 - RNA, 18 nt, Pseudomonas aeruginosa PA01
agagaugcaccggccacu

SEQ ID NO: 3373805 - RNA, 14 nt, Pseudomonas aeruginosa PA01
agagcaccuugucg

SEQ ID NO: 3373806 - RNA, 17 nt, Pseudomonas aeruginosa PA01
agagcagacacaaaaaa

SEQ ID NO: 3373807 - RNA, 14 nt, Pseudomonas aeruginosa PA01
agagcagagucgcc

SEQ ID NO: 3373808 - RNA, 16 nt, Pseudomonas aeruginosa PA01
agagcagcaccagcac

SEQ ID NO: 3373809 - RNA, 14 nt, Pseudomonas aeruginosa PA01
agagcccgccgaac

SEQ ID NO: 3373810 - RNA, 21 nt, Pseudomonas aeruginosa PA01
agagcgaauacaccgagcgca

SEQ ID NO: 3373811 - RNA, 20 nt, Pseudomonas aeruginosa PA01
agagcgcgcccugcaggccg

SEQ ID NO: 3373812 - RNA, 21 nt, Pseudomonas aeruginosa PA01
agagcgcugccugcaccgggc

SEQ ID NO: 3373813 - RNA, 22 nt, Pseudomonas aeruginosa PA01
agagcgcugccugcaccgggcc

SEQ ID NO: 3373814 - RNA, 15 nt, Pseudomonas aeruginosa PA01
agagcggcaggccgc

SEQ ID NO: 3373815 - RNA, 13 nt, Pseudomonas aeruginosa PA01
agagcguccggca

SEQ ID NO: 3373816 - RNA, 14 nt, Pseudomonas aeruginosa PA01
agagcgugcggccg

SEQ ID NO: 3373817 - RNA, 19 nt, Pseudomonas aeruginosa PA01
agagcuaguuauugaagug

SEQ ID NO: 3373818 - RNA, 22 nt, Pseudomonas aeruginosa PA01
agagcuaguuauugaaguggug

SEQ ID NO: 3373819 - RNA, 16 nt, Pseudomonas aeruginosa PA01
agagcucccugccgcc

SEQ ID NO: 3373820 - RNA, 21 nt, Pseudomonas aeruginosa PA01
agagcuggacgacgcuggccu

SEQ ID NO: 3373821 - RNA, 22 nt, Pseudomonas aeruginosa PA01
agagcuggacgacgcuggccug

SEQ ID NO: 3373822 - RNA, 20 nt, Pseudomonas aeruginosa PA01
agagcuucucgucgccgccg

SEQ ID NO: 3373823 - RNA, 23 nt, Pseudomonas aeruginosa PA01
agagcuucugcuggauccucgcc

SEQ ID NO: 3373824 - RNA, 19 nt, Pseudomonas aeruginosa PA01
agagcuugcugaagcccca

SEQ ID NO: 3373825 - RNA, 19 nt, Pseudomonas aeruginosa PA01
agagcuuggcucgguucau

SEQ ID NO: 3373826 - RNA, 17 nt, Pseudomonas aeruginosa PA01
agaggaucuccgagucc

SEQ ID NO: 3373827 - RNA, 12 nt, Pseudomonas aeruginosa PA01
agauguccaggc

SEQ ID NO: 3373828 - RNA, 16 nt, Pseudomonas aeruginosa PA01
agauguccaggcaggc

SEQ ID NO: 3373829 - RNA, 16 nt, Pseudomonas aeruginosa PA01
agaugucgaagucgaa

SEQ ID NO: 3373830 - RNA, 14 nt, Pseudomonas aeruginosa PA01
agaugugcgcggug

SEQ ID NO: 3373831 - RNA, 14 nt, Pseudomonas aeruginosa PA01
agauguucgccgcc

SEQ ID NO: 3373832 - RNA, 15 nt, Pseudomonas aeruginosa PA01
agauguucgccgccg

SEQ ID NO: 3373833 - RNA, 15 nt, Pseudomonas aeruginosa PA01
agauuccgcugagga

SEQ ID NO: 3373834 - RNA, 16 nt, Pseudomonas aeruginosa PA01
agauuccuggaccccg

SEQ ID NO: 3373835 - RNA, 22 nt, Pseudomonas aeruginosa PA01
agauuccuggaccccgcccuag

SEQ ID NO: 3373836 - RNA, 13 nt, Pseudomonas aeruginosa PA01
agauucugcaggc

SEQ ID NO: 3373837 - RNA, 21 nt, Pseudomonas aeruginosa PA01
agauucugcaggcgcuccaga

SEQ ID NO: 3373838 - RNA, 20 nt, Pseudomonas aeruginosa PA01
agauugaugaagcgcugcug

SEQ ID NO: 3373839 - RNA, 19 nt, Pseudomonas aeruginosa PA01
agauugucgcguccggcca

SEQ ID NO: 3373840 - RNA, 18 nt, Pseudomonas aeruginosa PA01
agcaaaaaaagcccaucc

SEQ ID NO: 3373841 - RNA, 23 nt, Pseudomonas aeruginosa PA01
agcaaacccgggcccaagccgag

SEQ ID NO: 3373842 - RNA, 22 nt, Pseudomonas aeruginosa PA01
agcaaagcgcagguagcggcga

SEQ ID NO: 3373843 - RNA, 16 nt, Pseudomonas aeruginosa PA01
agcaacacaugcaggc

SEQ ID NO: 3373844 - RNA, 17 nt, Pseudomonas aeruginosa PA01
agcaacacaugcaggcu

SEQ ID NO: 3373845 - RNA, 14 nt, Pseudomonas aeruginosa PA01
agcaacaccgcgca

SEQ ID NO: 3373846 - RNA, 14 nt, Pseudomonas aeruginosa PA01
agcaacagcgccgc

SEQ ID NO: 3373847 - RNA, 22 nt, Pseudomonas aeruginosa PA01
agcaacagcgucgccaacgcgc

SEQ ID NO: 3373848 - RNA, 19 nt, Pseudomonas aeruginosa PA01
agcaacaguugccgcagca

SEQ ID NO: 3373849 - RNA, 12 nt, Pseudomonas aeruginosa PA01
agcaacgccgcc

SEQ ID NO: 3373850 - RNA, 22 nt, Pseudomonas aeruginosa PA01
agcaacgccgcccccagcgcgc

SEQ ID NO: 3373851 - RNA, 23 nt, Pseudomonas aeruginosa PA01
agcaacgggucgggcucaugggc

SEQ ID NO: 3373852 - RNA, 22 nt, Pseudomonas aeruginosa PA01
agcaacuccagagccaugggcc

SEQ ID NO: 3373853 - RNA, 13 nt, Pseudomonas aeruginosa PA01
agcaacucgccgc

SEQ ID NO: 3373854 - RNA, 15 nt, Pseudomonas aeruginosa PA01
agcaacucggcggcg

SEQ ID NO: 3373855 - RNA, 16 nt, Pseudomonas aeruginosa PA01
agcaacucggcggcga

SEQ ID NO: 3373856 - RNA, 17 nt, Pseudomonas aeruginosa PA01
agcaacugaccuggccg

SEQ ID NO: 3373857 - RNA, 19 nt, Pseudomonas aeruginosa PA01
agcaacuggucgccgcagg

SEQ ID NO: 3373858 - RNA, 19 nt, Pseudomonas aeruginosa PA01
agcaacuguccgaccacuu

SEQ ID NO: 3373859 - RNA, 22 nt, Pseudomonas aeruginosa PA01
agcaacuguccgaccacuucgg

SEQ ID NO: 3373860 - RNA, 15 nt, Pseudomonas aeruginosa PA01
agcaagacggucccc

SEQ ID NO: 3373861 - RNA, 17 nt, Pseudomonas aeruginosa PA01
agcaagccgcagcgccc

SEQ ID NO: 3373862 - RNA, 20 nt, Pseudomonas aeruginosa PA01
agcaagccguagaacgccag

SEQ ID NO: 3373863 - RNA, 22 nt, Pseudomonas aeruginosa PA01
agcaagccguagaacgccagga

SEQ ID NO: 3373864 - RNA, 22 nt, Pseudomonas aeruginosa PA01
agcaaggcgucauagcagcgcc

SEQ ID NO: 3373865 - RNA, 18 nt, Pseudomonas aeruginosa PA01
agcaagucgaacaggccc

SEQ ID NO: 3373866 - RNA, 17 nt, Pseudomonas aeruginosa PA01
agcaauaccgguuggcu

SEQ ID NO: 3373867 - RNA, 19 nt, Pseudomonas aeruginosa PA01
agcaauccggcgcugccga

SEQ ID NO: 3373868 - RNA, 14 nt, Pseudomonas aeruginosa PA01
agcaaugccagcgc

SEQ ID NO: 3373869 - RNA, 13 nt, Pseudomonas aeruginosa PA01
agcaaugcccagc

SEQ ID NO: 3373870 - RNA, 14 nt, Pseudomonas aeruginosa PA01
agcaaugcccagcg

SEQ ID NO: 3373871 - RNA, 13 nt, Pseudomonas aeruginosa PA01
agcaaugcccgcg

SEQ ID NO: 3373872 - RNA, 18 nt, Pseudomonas aeruginosa PA01
agcaauuacacccaacuu

SEQ ID NO: 3373873 - RNA, 19 nt, Pseudomonas aeruginosa PA01
agcaauugccgcugcacgc

SEQ ID NO: 3373874 - RNA, 19 nt, Pseudomonas aeruginosa PA01
agcaauugccggcgugaac

SEQ ID NO: 3373875 - RNA, 20 nt, Pseudomonas aeruginosa PA01
agcacaaugaaaaacgccgg

SEQ ID NO: 3373876 - RNA, 21 nt, Pseudomonas aeruginosa PA01
agcacaaugaaaaacgccggc

SEQ ID NO: 3373877 - RNA, 18 nt, Pseudomonas aeruginosa PA01
agcacaccuccagcggcu

SEQ ID NO: 3373878 - RNA, 14 nt, Pseudomonas aeruginosa PA01
agcacagccccagc

SEQ ID NO: 3373879 - RNA, 16 nt, Pseudomonas aeruginosa PA01
agcacagccccagccu

SEQ ID NO: 3373880 - RNA, 18 nt, Pseudomonas aeruginosa PA01
agcacagccccagccucg

SEQ ID NO: 3373881 - RNA, 19 nt, Pseudomonas aeruginosa PA01
agcacagccccagccucgg

SEQ ID NO: 3373882 - RNA, 21 nt, Pseudomonas aeruginosa PA01
agcacagccccagccucggca

SEQ ID NO: 3373883 - RNA, 20 nt, Pseudomonas aeruginosa PA01
agcacaugcggugcggccau

SEQ ID NO: 3373884 - RNA, 12 nt, Pseudomonas aeruginosa PA01
agcaccacagca

SEQ ID NO: 3373885 - RNA, 22 nt, Pseudomonas aeruginosa PA01
agcaccacccggccgcgcucga

SEQ ID NO: 3373886 - RNA, 13 nt, Pseudomonas aeruginosa PA01
agcaccacgaugc

SEQ ID NO: 3373887 - RNA, 13 nt, Pseudomonas aeruginosa PA01
agcaccacggcga

SEQ ID NO: 3373888 - RNA, 17 nt, Pseudomonas aeruginosa PA01
agcaccagcaauagccu

SEQ ID NO: 3373889 - RNA, 13 nt, Pseudomonas aeruginosa PA01
agcaccagcacca

SEQ ID NO: 3373890 - RNA, 17 nt, Pseudomonas aeruginosa PA01
agcaccagcacgcccuu

SEQ ID NO: 3373891 - RNA, 12 nt, Pseudomonas aeruginosa PA01
agcaccagcagg

SEQ ID NO: 3373892 - RNA, 16 nt, Pseudomonas aeruginosa PA01
agcaccagggccaggg

SEQ ID NO: 3373893 - RNA, 15 nt, Pseudomonas aeruginosa PA01
agcaccagucccugg

SEQ ID NO: 3373894 - RNA, 18 nt, Pseudomonas aeruginosa PA01
agcaccagucccuggccg

SEQ ID NO: 3373895 - RNA, 20 nt, Pseudomonas aeruginosa PA01
agcaccagucccuggccggc

SEQ ID NO: 3373896 - RNA, 21 nt, Pseudomonas aeruginosa PA01
agcaccagucccuggccggcg

SEQ ID NO: 3373897 - RNA, 13 nt, Pseudomonas aeruginosa PA01
agcaccaucagcc

SEQ ID NO: 3373898 - RNA, 15 nt, Pseudomonas aeruginosa PA01
agcaccaucagccag

SEQ ID NO: 3373899 - RNA, 18 nt, Pseudomonas aeruginosa PA01
agcaccaucagccagccc

SEQ ID NO: 3373900 - RNA, 16 nt, Pseudomonas aeruginosa PA01
agcaccaugcgcggca

SEQ ID NO: 3373901 - RNA, 16 nt, Pseudomonas aeruginosa PA01
agcacccccagcaggc

SEQ ID NO: 3373902 - RNA, 22 nt, Pseudomonas aeruginosa PA01
agcacccccagcaggccagcca

SEQ ID NO: 3373903 - RNA, 17 nt, Pseudomonas aeruginosa PA01
agcaccccgaccacccu

SEQ ID NO: 3373904 - RNA, 23 nt, Pseudomonas aeruginosa PA01
agcaccccgaccacccuguccug

SEQ ID NO: 3373905 - RNA, 18 nt, Pseudomonas aeruginosa PA01
agcaccccgagcccggcc

SEQ ID NO: 3373906 - RNA, 22 nt, Pseudomonas aeruginosa PA01
agcacccggaccuuguccaggg

SEQ ID NO: 3373907 - RNA, 18 nt, Pseudomonas aeruginosa PA01
agcacccuggccacgucc

SEQ ID NO: 3373908 - RNA, 14 nt, Pseudomonas aeruginosa PA01
agcaccgagcaggc

SEQ ID NO: 3373909 - RNA, 16 nt, Pseudomonas aeruginosa PA01
agcaccgauuucccca

SEQ ID NO: 3373910 - RNA, 15 nt, Pseudomonas aeruginosa PA01
agcaccgccuggcgc

SEQ ID NO: 3373911 - RNA, 16 nt, Pseudomonas aeruginosa PA01
agcaccgccuggcgca

SEQ ID NO: 3373912 - RNA, 16 nt, Pseudomonas aeruginosa PA01
agcaccgcgccuucca

SEQ ID NO: 3373913 - RNA, 17 nt, Pseudomonas aeruginosa PA01
agcaccggaaaggcguc

SEQ ID NO: 3373914 - RNA, 11 nt, Pseudomonas aeruginosa PA01
agcaccggcag

SEQ ID NO: 3373915 - RNA, 20 nt, Pseudomonas aeruginosa PA01
agcaccggcaggacgaugau

SEQ ID NO: 3373916 - RNA, 22 nt, Pseudomonas aeruginosa PA01
agcaccggcaggacgaugauca

SEQ ID NO: 3373917 - RNA, 14 nt, Pseudomonas aeruginosa PA01
agcaccggcggcgc

SEQ ID NO: 3373918 - RNA, 20 nt, Pseudomonas aeruginosa PA01
agcaccggcggcgccaggcc

SEQ ID NO: 3373919 - RNA, 15 nt, Pseudomonas aeruginosa PA01
agcaccguggcgcca

SEQ ID NO: 3373920 - RNA, 17 nt, Pseudomonas aeruginosa PA01
agcaccguggucagcac

SEQ ID NO: 3373921 - RNA, 19 nt, Pseudomonas aeruginosa PA01
agcaccguggucagcacca

SEQ ID NO: 3373922 - RNA, 15 nt, Pseudomonas aeruginosa PA01
agcaccucgaccugg

SEQ ID NO: 3373923 - RNA, 14 nt, Pseudomonas aeruginosa PA01
agcaccucgacgcc

SEQ ID NO: 3373924 - RNA, 20 nt, Pseudomonas aeruginosa PA01
agcaccucguaggccgacuc

SEQ ID NO: 3373925 - RNA, 14 nt, Pseudomonas aeruginosa PA01
agcaccugcgccga

SEQ ID NO: 3373926 - RNA, 21 nt, Pseudomonas aeruginosa PA01
agcaccugcgccgaaggcguc

SEQ ID NO: 3373927 - RNA, 21 nt, Pseudomonas aeruginosa PA01
agcaccuggcagugcgccggc

SEQ ID NO: 3373928 - RNA, 20 nt, Pseudomonas aeruginosa PA01
agcaccuucaucaccagguc

SEQ ID NO: 3373929 - RNA, 17 nt, Pseudomonas aeruginosa PA01
agcaccuugagggccuu

SEQ ID NO: 3373930 - RNA, 14 nt, Pseudomonas aeruginosa PA01
agcagcgccgcccu

SEQ ID NO: 3373931 - RNA, 15 nt, Pseudomonas aeruginosa PA01
agcagcgccgcccug

SEQ ID NO: 3373932 - RNA, 12 nt, Pseudomonas aeruginosa PA01
agcagcgccgcg

SEQ ID NO: 3373933 - RNA, 15 nt, Pseudomonas aeruginosa PA01
agcagcgccgcgaac

SEQ ID NO: 3373934 - RNA, 15 nt, Pseudomonas aeruginosa PA01
agcagcgccgcgccu

SEQ ID NO: 3373935 - RNA, 12 nt, Pseudomonas aeruginosa PA01
agcagcgccucc

SEQ ID NO: 3373936 - RNA, 13 nt, Pseudomonas aeruginosa PA01
agcagcgccuuca

SEQ ID NO: 3373937 - RNA, 14 nt, Pseudomonas aeruginosa PA01
agcagcgcgcggcu

SEQ ID NO: 3373938 - RNA, 21 nt, Pseudomonas aeruginosa PA01
agcagcgcgcggcucggcggg

SEQ ID NO: 3373939 - RNA, 16 nt, Pseudomonas aeruginosa PA01
agcagcgcggcggcgg

SEQ ID NO: 3373940 - RNA, 23 nt, Pseudomonas aeruginosa PA01
agcagcgcuucgggagucaacgc

SEQ ID NO: 3373941 - RNA, 20 nt, Pseudomonas aeruginosa PA01
agcagcggaaaugcucgccg

SEQ ID NO: 3373942 - RNA, 21 nt, Pseudomonas aeruginosa PA01
agcagcggcaaaggcccggcg

SEQ ID NO: 3373943 - RNA, 13 nt, Pseudomonas aeruginosa PA01
agcagcggcacca

SEQ ID NO: 3373944 - RNA, 18 nt, Pseudomonas aeruginosa PA01
agcagcggcaccagcacg

SEQ ID NO: 3373945 - RNA, 13 nt, Pseudomonas aeruginosa PA01
agcagcggcacgc

SEQ ID NO: 3373946 - RNA, 19 nt, Pseudomonas aeruginosa PA01
agcagcggcacgcucuggc

SEQ ID NO: 3373947 - RNA, 20 nt, Pseudomonas aeruginosa PA01
agcagcggcgacaccgccag

SEQ ID NO: 3373948 - RNA, 13 nt, Pseudomonas aeruginosa PA01
agcagcggcggcg

SEQ ID NO: 3373949 - RNA, 19 nt, Pseudomonas aeruginosa PA01
agcagcggcucacgcccca

SEQ ID NO: 3373950 - RNA, 19 nt, Pseudomonas aeruginosa PA01
agcagcgggcguccggcga

SEQ ID NO: 3373951 - RNA, 19 nt, Pseudomonas aeruginosa PA01
agcagcuccgggcuggcca

SEQ ID NO: 3373952 - RNA, 14 nt, Pseudomonas aeruginosa PA01
agcagcucgccggc

SEQ ID NO: 3373953 - RNA, 17 nt, Pseudomonas aeruginosa PA01
agcagcucgccggcguc

SEQ ID NO: 3373954 - RNA, 15 nt, Pseudomonas aeruginosa PA01
agcagcuugcgcgag

SEQ ID NO: 3373955 - RNA, 17 nt, Pseudomonas aeruginosa PA01
agcaggaacucgaucag

SEQ ID NO: 3373956 - RNA, 18 nt, Pseudomonas aeruginosa PA01
agcaggaauucgggaagg

SEQ ID NO: 3373957 - RNA, 19 nt, Pseudomonas aeruginosa PA01
agcaggaauucgggaaggg

SEQ ID NO: 3373958 - RNA, 20 nt, Pseudomonas aeruginosa PA01
agcaggacccaucgaugcuc

SEQ ID NO: 3373959 - RNA, 15 nt, Pseudomonas aeruginosa PA01
agcaggaccuggccg

SEQ ID NO: 3373960 - RNA, 16 nt, Pseudomonas aeruginosa PA01
agcaggaccuggccgu

SEQ ID NO: 3373961 - RNA, 15 nt, Pseudomonas aeruginosa PA01
agcaggacggcgacc

SEQ ID NO: 3373962 - RNA, 16 nt, Pseudomonas aeruginosa PA01
agcaggagaagcgccu

SEQ ID NO: 3373963 - RNA, 14 nt, Pseudomonas aeruginosa PA01
agcaggagcgccau

SEQ ID NO: 3373964 - RNA, 14 nt, Pseudomonas aeruginosa PA01
agcaggauccaggu

SEQ ID NO: 3373965 - RNA, 15 nt, Pseudomonas aeruginosa PA01
agcaggauccaggug

SEQ ID NO: 3373966 - RNA, 17 nt, Pseudomonas aeruginosa PA01
agcaggauccaggugcg

SEQ ID NO: 3373967 - RNA, 10 nt, Pseudomonas aeruginosa PA01
agcaggaucg

SEQ ID NO: 3373968 - RNA, 21 nt, Pseudomonas aeruginosa PA01
agcaggaucgagcccuggucg

SEQ ID NO: 3373969 - RNA, 13 nt, Pseudomonas aeruginosa PA01
agcaggaugcagu

SEQ ID NO: 3373970 - RNA, 17 nt, Pseudomonas aeruginosa PA01
agcaggaugcagucggc

SEQ ID NO: 3373971 - RNA, 16 nt, Pseudomonas aeruginosa PA01
agcaggaugccgcugu

SEQ ID NO: 3373972 - RNA, 17 nt, Pseudomonas aeruginosa PA01
agcaggaugcugcacag

SEQ ID NO: 3373973 - RNA, 22 nt, Pseudomonas aeruginosa PA01
agcaggauguccuuguucggcu

SEQ ID NO: 3373974 - RNA, 14 nt, Pseudomonas aeruginosa PA01
agcaggcacagggc

SEQ ID NO: 3373975 - RNA, 15 nt, Pseudomonas aeruginosa PA01
agcaggcaggcgcgg

SEQ ID NO: 3373976 - RNA, 19 nt, Pseudomonas aeruginosa PA01
agcaggccacgcaccagcu

SEQ ID NO: 3373977 - RNA, 11 nt, Pseudomonas aeruginosa PA01
agcaggccagc

SEQ ID NO: 3373978 - RNA, 16 nt, Pseudomonas aeruginosa PA01
agcaggcccagccauu

SEQ ID NO: 3373979 - RNA, 20 nt, Pseudomonas aeruginosa PA01
agcaggcccaugauggucgg

SEQ ID NO: 3373980 - RNA, 22 nt, Pseudomonas aeruginosa PA01
agcaggcccaugauggucggca

SEQ ID NO: 3373981 - RNA, 17 nt, Pseudomonas aeruginosa PA01
agcaggccgaaggccag

SEQ ID NO: 3373982 - RNA, 17 nt, Pseudomonas aeruginosa PA01
agcaggccgacggcgcg

SEQ ID NO: 3373983 - RNA, 22 nt, Pseudomonas aeruginosa PA01
agcaggccgacggcgcgcugcg

SEQ ID NO: 3373984 - RNA, 18 nt, Pseudomonas aeruginosa PA01
agcaggccgagcccgagu

SEQ ID NO: 3373985 - RNA, 19 nt, Pseudomonas aeruginosa PA01
agcaggccgagcccgagug

SEQ ID NO: 3373986 - RNA, 18 nt, Pseudomonas aeruginosa PA01
agcaggccgaggaggacg

SEQ ID NO: 3373987 - RNA, 18 nt, Pseudomonas aeruginosa PA01
agcaggccgaggucggcg

SEQ ID NO: 3373988 - RNA, 15 nt, Pseudomonas aeruginosa PA01
agcaggccgaucacc

SEQ ID NO: 3373989 - RNA, 17 nt, Pseudomonas aeruginosa PA01
agcaggccgaucaccag

SEQ ID NO: 3373990 - RNA, 21 nt, Pseudomonas aeruginosa PA01
agcaggccgaucaccagcgcc

SEQ ID NO: 3373991 - RNA, 19 nt, Pseudomonas aeruginosa PA01
agcaggccgccgcgugccg

SEQ ID NO: 3373992 - RNA, 14 nt, Pseudomonas aeruginosa PA01
agcaggccgcuggc

SEQ ID NO: 3373993 - RNA, 15 nt, Pseudomonas aeruginosa PA01
agcaggccgcuggcg

SEQ ID NO: 3373994 - RNA, 19 nt, Pseudomonas aeruginosa PA01
agcaggccgcuggcgacgc

SEQ ID NO: 3373995 - RNA, 15 nt, Pseudomonas aeruginosa PA01
agcaggccggccagc

SEQ ID NO: 3373996 - RNA, 17 nt, Pseudomonas aeruginosa PA01
agcaggccggccagccu

SEQ ID NO: 3373997 - RNA, 13 nt, Pseudomonas aeruginosa PA01
agcaggccggcga

SEQ ID NO: 3373998 - RNA, 22 nt, Pseudomonas aeruginosa PA01
agcaggccuugcagggccgcca

SEQ ID NO: 3373999 - RNA, 21 nt, Pseudomonas aeruginosa PA01
agcaggcgauacaggcgguga

SEQ ID NO: 3374000 - RNA, 13 nt, Pseudomonas aeruginosa PA01
agcaggcgcagca

SEQ ID NO: 3374001 - RNA, 14 nt, Pseudomonas aeruginosa PA01
agcaggcgccggcg

SEQ ID NO: 3374002 - RNA, 13 nt, Pseudomonas aeruginosa PA01
agcaggcgcgccc

SEQ ID NO: 3374003 - RNA, 15 nt, Pseudomonas aeruginosa PA01
agcaggcgcgggcug

SEQ ID NO: 3374004 - RNA, 19 nt, Pseudomonas aeruginosa PA01
agcaggcgcgggcuggcca

SEQ ID NO: 3374005 - RNA, 13 nt, Pseudomonas aeruginosa PA01
agcaggcgcucgc

SEQ ID NO: 3374006 - RNA, 19 nt, Pseudomonas aeruginosa PA01
agcaggcgcucggcgacgc

SEQ ID NO: 3374007 - RNA, 16 nt, Pseudomonas aeruginosa PA01
agcaggcgcucgggga

SEQ ID NO: 3374008 - RNA, 15 nt, Pseudomonas aeruginosa PA01
agcaggcggaucgcc

SEQ ID NO: 3374009 - RNA, 20 nt, Pseudomonas aeruginosa PA01
agcaggcggaucgccgccuu

SEQ ID NO: 3374010 - RNA, 12 nt, Pseudomonas aeruginosa PA01
agcaggcggccg

SEQ ID NO: 3374011 - RNA, 14 nt, Pseudomonas aeruginosa PA01
agcaggcggccguc

SEQ ID NO: 3374012 - RNA, 16 nt, Pseudomonas aeruginosa PA01
agcaggcguucggcga

SEQ ID NO: 3374013 - RNA, 22 nt, Pseudomonas aeruginosa PA01
agcaggcguucggcgaugucgc

SEQ ID NO: 3374014 - RNA, 19 nt, Pseudomonas aeruginosa PA01
agcaggcguugcagugcgc

SEQ ID NO: 3374015 - RNA, 12 nt, Pseudomonas aeruginosa PA01
agcaggcugccg

SEQ ID NO: 3374016 - RNA, 15 nt, Pseudomonas aeruginosa PA01
agcaggcugccguug

SEQ ID NO: 3374017 - RNA, 14 nt, Pseudomonas aeruginosa PA01
agcaggcugcugcu

SEQ ID NO: 3374018 - RNA, 15 nt, Pseudomonas aeruginosa PA01
agcaggcuggcggca

SEQ ID NO: 3374019 - RNA, 18 nt, Pseudomonas aeruginosa PA01
agcaggcuguacagcagg

SEQ ID NO: 3374020 - RNA, 22 nt, Pseudomonas aeruginosa PA01
agcaggcuguacagcaggagcg

SEQ ID NO: 3374021 - RNA, 20 nt, Pseudomonas aeruginosa PA01
agcagggagaaccaggcggu

SEQ ID NO: 3374022 - RNA, 14 nt, Pseudomonas aeruginosa PA01
agcagggaggcgca

SEQ ID NO: 3374023 - RNA, 22 nt, Pseudomonas aeruginosa PA01
agcagggaggcgcacaucaccc

SEQ ID NO: 3374024 - RNA, 14 nt, Pseudomonas aeruginosa PA01
agcagggccagcag

SEQ ID NO: 3374025 - RNA, 15 nt, Pseudomonas aeruginosa PA01
agcagggccagcagc

SEQ ID NO: 3374026 - RNA, 13 nt, Pseudomonas aeruginosa PA01
agcagggccagcc

SEQ ID NO: 3374027 - RNA, 18 nt, Pseudomonas aeruginosa PA01
agcagggccagcgccugg

SEQ ID NO: 3374028 - RNA, 13 nt, Pseudomonas aeruginosa PA01
agcagggccaggc

SEQ ID NO: 3374029 - RNA, 14 nt, Pseudomonas aeruginosa PA01
agcagggccaggcc

SEQ ID NO: 3374030 - RNA, 22 nt, Pseudomonas aeruginosa PA01
agcagggccaggccgagcgcgc

SEQ ID NO: 3374031 - RNA, 21 nt, Pseudomonas aeruginosa PA01
agcagggccgagcgcagcgcc

SEQ ID NO: 3374032 - RNA, 13 nt, Pseudomonas aeruginosa PA01
agcagggccgccg

SEQ ID NO: 3374033 - RNA, 15 nt, Pseudomonas aeruginosa PA01
agcagggccgccgag

SEQ ID NO: 3374034 - RNA, 14 nt, Pseudomonas aeruginosa PA01
agccaaggaugcgc

SEQ ID NO: 3374035 - RNA, 20 nt, Pseudomonas aeruginosa PA01
agccacagaggucgcugacc

SEQ ID NO: 3374036 - RNA, 12 nt, Pseudomonas aeruginosa PA01
agccacaggcgc

SEQ ID NO: 3374037 - RNA, 16 nt, Pseudomonas aeruginosa PA01
agccaccagccgaaca

SEQ ID NO: 3374038 - RNA, 13 nt, Pseudomonas aeruginosa PA01
agccaccagcgac

SEQ ID NO: 3374039 - RNA, 14 nt, Pseudomonas aeruginosa PA01
agccacccagcagc

SEQ ID NO: 3374040 - RNA, 13 nt, Pseudomonas aeruginosa PA01
agccacccgcucg

SEQ ID NO: 3374041 - RNA, 19 nt, Pseudomonas aeruginosa PA01
agccaccgggaucuggccc

SEQ ID NO: 3374042 - RNA, 16 nt, Pseudomonas aeruginosa PA01
agccacgaagccucuu

SEQ ID NO: 3374043 - RNA, 16 nt, Pseudomonas aeruginosa PA01
agccacgccggucucg

SEQ ID NO: 3374044 - RNA, 15 nt, Pseudomonas aeruginosa PA01
agccacggacgcgca

SEQ ID NO: 3374045 - RNA, 20 nt, Pseudomonas aeruginosa PA01
agccacggauaugcgccgcc

SEQ ID NO: 3374046 - RNA, 19 nt, Pseudomonas aeruginosa PA01
agccacggcgagagcgccg

SEQ ID NO: 3374047 - RNA, 17 nt, Pseudomonas aeruginosa PA01
agccacucggccaggcg

SEQ ID NO: 3374048 - RNA, 18 nt, Pseudomonas aeruginosa PA01
agccacucggccaggcgc

SEQ ID NO: 3374049 - RNA, 20 nt, Pseudomonas aeruginosa PA01
agccacugccgccucagcga

SEQ ID NO: 3374050 - RNA, 12 nt, Pseudomonas aeruginosa PA01
agccacuggcgg

SEQ ID NO: 3374051 - RNA, 14 nt, Pseudomonas aeruginosa PA01
agccagacccagug

SEQ ID NO: 3374052 - RNA, 14 nt, Pseudomonas aeruginosa PA01
agccagagcagcgu

SEQ ID NO: 3374053 - RNA, 14 nt, Pseudomonas aeruginosa PA01
agccagagcccguc

SEQ ID NO: 3374054 - RNA, 17 nt, Pseudomonas aeruginosa PA01
agccagagcuccagggc

SEQ ID NO: 3374055 - RNA, 19 nt, Pseudomonas aeruginosa PA01
agccagaggucgagcuggg

SEQ ID NO: 3374056 - RNA, 19 nt, Pseudomonas aeruginosa PA01
agccagcaaacccgggccc

SEQ ID NO: 3374057 - RNA, 21 nt, Pseudomonas aeruginosa PA01
agccagcacaugcggugcggc

SEQ ID NO: 3374058 - RNA, 14 nt, Pseudomonas aeruginosa PA01
agccagccaggucg

SEQ ID NO: 3374059 - RNA, 16 nt, Pseudomonas aeruginosa PA01
agccagcccaguucgu

SEQ ID NO: 3374060 - RNA, 14 nt, Pseudomonas aeruginosa PA01
agccagccgagcaa

SEQ ID NO: 3374061 - RNA, 14 nt, Pseudomonas aeruginosa PA01
agccagccgcagcc

SEQ ID NO: 3374062 - RNA, 19 nt, Pseudomonas aeruginosa PA01
agccagccgcagcccgguc

SEQ ID NO: 3374063 - RNA, 14 nt, Pseudomonas aeruginosa PA01
agccagccgccgaa

SEQ ID NO: 3374064 - RNA, 11 nt, Pseudomonas aeruginosa PA01
agccagccgcg

SEQ ID NO: 3374065 - RNA, 16 nt, Pseudomonas aeruginosa PA01
agccagccgcgcgccg

SEQ ID NO: 3374066 - RNA, 16 nt, Pseudomonas aeruginosa PA01
agccagccgcggauca

SEQ ID NO: 3374067 - RNA, 22 nt, Pseudomonas aeruginosa PA01
agccagccggcgaagggcaggc

SEQ ID NO: 3374068 - RNA, 23 nt, Pseudomonas aeruginosa PA01
agccagccggcgaagggcaggcc

SEQ ID NO: 3374069 - RNA, 15 nt, Pseudomonas aeruginosa PA01
agccagccguggcag

SEQ ID NO: 3374070 - RNA, 19 nt, Pseudomonas aeruginosa PA01
agccagccguggcaggcgc

SEQ ID NO: 3374071 - RNA, 20 nt, Pseudomonas aeruginosa PA01
agccagccguggcaggcgcc

SEQ ID NO: 3374072 - RNA, 12 nt, Pseudomonas aeruginosa PA01
agccagcgcggc

SEQ ID NO: 3374073 - RNA, 22 nt, Pseudomonas aeruginosa PA01
agccagcgcucgaacgccgccc

SEQ ID NO: 3374074 - RNA, 22 nt, Pseudomonas aeruginosa PA01
agccagcgguugagcagggcgu

SEQ ID NO: 3374075 - RNA, 15 nt, Pseudomonas aeruginosa PA01
agccagcucggcgag

SEQ ID NO: 3374076 - RNA, 17 nt, Pseudomonas aeruginosa PA01
agccaggaagcggcggu

SEQ ID NO: 3374077 - RNA, 14 nt, Pseudomonas aeruginosa PA01
agccaggacaaugg

SEQ ID NO: 3374078 - RNA, 15 nt, Pseudomonas aeruginosa PA01
agccaggcccgguug

SEQ ID NO: 3374079 - RNA, 16 nt, Pseudomonas aeruginosa PA01
agccaggcgaagcggc

SEQ ID NO: 3374080 - RNA, 14 nt, Pseudomonas aeruginosa PA01
agccaggcgaaggc

SEQ ID NO: 3374081 - RNA, 18 nt, Pseudomonas aeruginosa PA01
agccaggcgauggugcgc

SEQ ID NO: 3374082 - RNA, 14 nt, Pseudomonas aeruginosa PA01
agccaggcgcucuc

SEQ ID NO: 3374083 - RNA, 20 nt, Pseudomonas aeruginosa PA01
agccaggcgcucucgccgcc

SEQ ID NO: 3374084 - RNA, 22 nt, Pseudomonas aeruginosa PA01
agccaggcguauucggcgacca

SEQ ID NO: 3374085 - RNA, 15 nt, Pseudomonas aeruginosa PA01
agccaggcuggcugg

SEQ ID NO: 3374086 - RNA, 21 nt, Pseudomonas aeruginosa PA01
agccaggcuggcugguaacgg

SEQ ID NO: 3374087 - RNA, 20 nt, Pseudomonas aeruginosa PA01
agccagggcaacgccaggcu

SEQ ID NO: 3374088 - RNA, 21 nt, Pseudomonas aeruginosa PA01
agccagggcaacgccaggcug

SEQ ID NO: 3374089 - RNA, 14 nt, Pseudomonas aeruginosa PA01
agccagggcagcag

SEQ ID NO: 3374090 - RNA, 14 nt, Pseudomonas aeruginosa PA01
agccagggccgcga

SEQ ID NO: 3374091 - RNA, 16 nt, Pseudomonas aeruginosa PA01
agccaggggcacgcug

SEQ ID NO: 3374092 - RNA, 16 nt, Pseudomonas aeruginosa PA01
agccaggggucaggcc

SEQ ID NO: 3374093 - RNA, 17 nt, Pseudomonas aeruginosa PA01
agccaggggucaggccg

SEQ ID NO: 3374094 - RNA, 17 nt, Pseudomonas aeruginosa PA01
agccaggucggagugcu

SEQ ID NO: 3374095 - RNA, 21 nt, Pseudomonas aeruginosa PA01
agccaguaguccuccgcgccc

SEQ ID NO: 3374096 - RNA, 17 nt, Pseudomonas aeruginosa PA01
agccagucggcggucuu

SEQ ID NO: 3374097 - RNA, 18 nt, Pseudomonas aeruginosa PA01
agccaguuggaaguugcc

SEQ ID NO: 3374098 - RNA, 18 nt, Pseudomonas aeruginosa PA01
agccauagaguugcuugg

SEQ ID NO: 3374099 - RNA, 14 nt, Pseudomonas aeruginosa PA01
agccauagcgccgg

SEQ ID NO: 3374100 - RNA, 15 nt, Pseudomonas aeruginosa PA01
agccauagcgccggc

SEQ ID NO: 3374101 - RNA, 15 nt, Pseudomonas aeruginosa PA01
agccauagugcuggg

SEQ ID NO: 3374102 - RNA, 17 nt, Pseudomonas aeruginosa PA01
agccauagugcugggcg

SEQ ID NO: 3374103 - RNA, 20 nt, Pseudomonas aeruginosa PA01
agccaucaaacgggcgugag

SEQ ID NO: 3374104 - RNA, 12 nt, Pseudomonas aeruginosa PA01
agccaucuuccg

SEQ ID NO: 3374105 - RNA, 22 nt, Pseudomonas aeruginosa PA01
agccaugcacacgcucccaaca

SEQ ID NO: 3374106 - RNA, 15 nt, Pseudomonas aeruginosa PA01
agccaugcaggcugc

SEQ ID NO: 3374107 - RNA, 16 nt, Pseudomonas aeruginosa PA01
agccaugcaggcugcc

SEQ ID NO: 3374108 - RNA, 13 nt, Pseudomonas aeruginosa PA01
agccaugcccaga

SEQ ID NO: 3374109 - RNA, 19 nt, Pseudomonas aeruginosa PA01
agccaugcccagacgccgc

SEQ ID NO: 3374110 - RNA, 14 nt, Pseudomonas aeruginosa PA01
agccaugcccggcu

SEQ ID NO: 3374111 - RNA, 14 nt, Pseudomonas aeruginosa PA01
agccaugggccggc

SEQ ID NO: 3374112 - RNA, 15 nt, Pseudomonas aeruginosa PA01
agccauugagcgcgc

SEQ ID NO: 3374113 - RNA, 20 nt, Pseudomonas aeruginosa PA01
agcccacccccagcccggcc

SEQ ID NO: 3374114 - RNA, 22 nt, Pseudomonas aeruginosa PA01
agcccacccccagcccggccau

SEQ ID NO: 3374115 - RNA, 14 nt, Pseudomonas aeruginosa PA01
agcccacccccggc

SEQ ID NO: 3374116 - RNA, 18 nt, Pseudomonas aeruginosa PA01
agcccacgcgccuggccg

SEQ ID NO: 3374117 - RNA, 13 nt, Pseudomonas aeruginosa PA01
agcccagccgcuc

SEQ ID NO: 3374118 - RNA, 14 nt, Pseudomonas aeruginosa PA01
agcccagcgccugc

SEQ ID NO: 3374119 - RNA, 20 nt, Pseudomonas aeruginosa PA01
agcccagcucguccaggcaa

SEQ ID NO: 3374120 - RNA, 22 nt, Pseudomonas aeruginosa PA01
agcccagcucguccaggcaagc

SEQ ID NO: 3374121 - RNA, 19 nt, Pseudomonas aeruginosa PA01
agcccaggcagaucgcgcc

SEQ ID NO: 3374122 - RNA, 22 nt, Pseudomonas aeruginosa PA01
agcccaggcagaucgcgccgag

SEQ ID NO: 3374123 - RNA, 12 nt, Pseudomonas aeruginosa PA01
agcccaggccga

SEQ ID NO: 3374124 - RNA, 19 nt, Pseudomonas aeruginosa PA01
agcccaggcgcucggcggc

SEQ ID NO: 3374125 - RNA, 21 nt, Pseudomonas aeruginosa PA01
agcccaggcgcucggcggcgc

SEQ ID NO: 3374126 - RNA, 17 nt, Pseudomonas aeruginosa PA01
agcccaggcgucgcgcc

SEQ ID NO: 3374127 - RNA, 18 nt, Pseudomonas aeruginosa PA01
agcccagguacugggcga

SEQ ID NO: 3374128 - RNA, 12 nt, Pseudomonas aeruginosa PA01
agcccagguggc

SEQ ID NO: 3374129 - RNA, 16 nt, Pseudomonas aeruginosa PA01
agcccagguggcaggc

SEQ ID NO: 3374130 - RNA, 20 nt, Pseudomonas aeruginosa PA01
agcccagguggcaggccugg

SEQ ID NO: 3374131 - RNA, 18 nt, Pseudomonas aeruginosa PA01
agcccaucgacugcaaca

SEQ ID NO: 3374132 - RNA, 21 nt, Pseudomonas aeruginosa PA01
agccccacuggaagaaggcga

SEQ ID NO: 3374133 - RNA, 20 nt, Pseudomonas aeruginosa PA01
agccccagaagaucgccugc

SEQ ID NO: 3374134 - RNA, 13 nt, Pseudomonas aeruginosa PA01
agccccagagccc

SEQ ID NO: 3374135 - RNA, 12 nt, Pseudomonas aeruginosa PA01
agccccagcacg

SEQ ID NO: 3374136 - RNA, 17 nt, Pseudomonas aeruginosa PA01
agccccagcacgccgag

SEQ ID NO: 3374137 - RNA, 20 nt, Pseudomonas aeruginosa PA01
agccgcuggcgucgaaugcg

SEQ ID NO: 3374138 - RNA, 20 nt, Pseudomonas aeruginosa PA01
agccgcugguccagcuggcg

SEQ ID NO: 3374139 - RNA, 16 nt, Pseudomonas aeruginosa PA01
agccggaagcgcucgc

SEQ ID NO: 3374140 - RNA, 21 nt, Pseudomonas aeruginosa PA01
agccggaccagccguccgcgg

SEQ ID NO: 3374141 - RNA, 22 nt, Pseudomonas aeruginosa PA01
agccggaccucucucgcugcgc

SEQ ID NO: 3374142 - RNA, 13 nt, Pseudomonas aeruginosa PA01
agccggaggcagc

SEQ ID NO: 3374143 - RNA, 18 nt, Pseudomonas aeruginosa PA01
agccggaggcagcgaugc

SEQ ID NO: 3374144 - RNA, 21 nt, Pseudomonas aeruginosa PA01
agccggauagaucaggccggc

SEQ ID NO: 3374145 - RNA, 15 nt, Pseudomonas aeruginosa PA01
agccggauucgcgca

SEQ ID NO: 3374146 - RNA, 16 nt, Pseudomonas aeruginosa PA01
agccggauucgcgcag

SEQ ID NO: 3374147 - RNA, 15 nt, Pseudomonas aeruginosa PA01
agccggcaagcgugc

SEQ ID NO: 3374148 - RNA, 20 nt, Pseudomonas aeruginosa PA01
agccggcaagcgugccccga

SEQ ID NO: 3374149 - RNA, 19 nt, Pseudomonas aeruginosa PA01
agccggcacgguagccgcc

SEQ ID NO: 3374150 - RNA, 12 nt, Pseudomonas aeruginosa PA01
agccggcaucca

SEQ ID NO: 3374151 - RNA, 21 nt, Pseudomonas aeruginosa PA01
agccggcauccagcauccgug

SEQ ID NO: 3374152 - RNA, 20 nt, Pseudomonas aeruginosa PA01
agccggccaaccaccggcgc

SEQ ID NO: 3374153 - RNA, 21 nt, Pseudomonas aeruginosa PA01
agccggccaaccaccggcgca

SEQ ID NO: 3374154 - RNA, 22 nt, Pseudomonas aeruginosa PA01
agccggccaaccaccggcgcac

SEQ ID NO: 3374155 - RNA, 12 nt, Pseudomonas aeruginosa PA01
agccggccaggg

SEQ ID NO: 3374156 - RNA, 21 nt, Pseudomonas aeruginosa PA01
agccggccauccagccaggcg

SEQ ID NO: 3374157 - RNA, 19 nt, Pseudomonas aeruginosa PA01
agccggccaugcuggcgcu

SEQ ID NO: 3374158 - RNA, 20 nt, Pseudomonas aeruginosa PA01
agccggcccauccgccgcag

SEQ ID NO: 3374159 - RNA, 17 nt, Pseudomonas aeruginosa PA01
agccggccccugggccg

SEQ ID NO: 3374160 - RNA, 19 nt, Pseudomonas aeruginosa PA01
agccggccccugggccggc

SEQ ID NO: 3374161 - RNA, 19 nt, Pseudomonas aeruginosa PA01
agccggccgaucuucagca

SEQ ID NO: 3374162 - RNA, 21 nt, Pseudomonas aeruginosa PA01
agccggccgcgucgcccaggc

SEQ ID NO: 3374163 - RNA, 15 nt, Pseudomonas aeruginosa PA01
agccggcgaacaggu

SEQ ID NO: 3374164 - RNA, 20 nt, Pseudomonas aeruginosa PA01
agccggcgaacagguagccc

SEQ ID NO: 3374165 - RNA, 19 nt, Pseudomonas aeruginosa PA01
agccggcgaaccaggcggc

SEQ ID NO: 3374166 - RNA, 18 nt, Pseudomonas aeruginosa PA01
agccggcgaagggcaggc

SEQ ID NO: 3374167 - RNA, 17 nt, Pseudomonas aeruginosa PA01
agccggcgacgcaggac

SEQ ID NO: 3374168 - RNA, 13 nt, Pseudomonas aeruginosa PA01
agccggcgagcgc

SEQ ID NO: 3374169 - RNA, 17 nt, Pseudomonas aeruginosa PA01
agccggcgaucagcgcu

SEQ ID NO: 3374170 - RNA, 21 nt, Pseudomonas aeruginosa PA01
agccggcgaucauccagcccc

SEQ ID NO: 3374171 - RNA, 13 nt, Pseudomonas aeruginosa PA01
agccggcgaugcc

SEQ ID NO: 3374172 - RNA, 17 nt, Pseudomonas aeruginosa PA01
agccggcgaugccgccc

SEQ ID NO: 3374173 - RNA, 14 nt, Pseudomonas aeruginosa PA01
agccggcgaugugc

SEQ ID NO: 3374174 - RNA, 22 nt, Pseudomonas aeruginosa PA01
agccggcgaugugcggcguggc

SEQ ID NO: 3374175 - RNA, 21 nt, Pseudomonas aeruginosa PA01
agccggcgauguucgcccccu

SEQ ID NO: 3374176 - RNA, 16 nt, Pseudomonas aeruginosa PA01
agccggcgcaucagcg

SEQ ID NO: 3374177 - RNA, 19 nt, Pseudomonas aeruginosa PA01
agccggcgcaucagcgccg

SEQ ID NO: 3374178 - RNA, 13 nt, Pseudomonas aeruginosa PA01
agccggcgcaugc

SEQ ID NO: 3374179 - RNA, 17 nt, Pseudomonas aeruginosa PA01
agccggcgcaugcgccg

SEQ ID NO: 3374180 - RNA, 20 nt, Pseudomonas aeruginosa PA01
agccggcgcaugcgccggcu

SEQ ID NO: 3374181 - RNA, 12 nt, Pseudomonas aeruginosa PA01
agccggcgccgu

SEQ ID NO: 3374182 - RNA, 17 nt, Pseudomonas aeruginosa PA01
agccggcgcgcccggcg

SEQ ID NO: 3374183 - RNA, 21 nt, Pseudomonas aeruginosa PA01
agccggcgcgcccggcgcccu

SEQ ID NO: 3374184 - RNA, 20 nt, Pseudomonas aeruginosa PA01
agccggcgcggcgcagcggc

SEQ ID NO: 3374185 - RNA, 21 nt, Pseudomonas aeruginosa PA01
agccggcgcggcgcagcggcg

SEQ ID NO: 3374186 - RNA, 19 nt, Pseudomonas aeruginosa PA01
agccggcgcguucacucca

SEQ ID NO: 3374187 - RNA, 22 nt, Pseudomonas aeruginosa PA01
agccggcgcguucacuccacga

SEQ ID NO: 3374188 - RNA, 23 nt, Pseudomonas aeruginosa PA01
agccggcgcugguugaggucgac

SEQ ID NO: 3374189 - RNA, 12 nt, Pseudomonas aeruginosa PA01
agccggcggcga

SEQ ID NO: 3374190 - RNA, 15 nt, Pseudomonas aeruginosa PA01
agccggcggcgcggc

SEQ ID NO: 3374191 - RNA, 17 nt, Pseudomonas aeruginosa PA01
agccggcggcgcggcag

SEQ ID NO: 3374192 - RNA, 13 nt, Pseudomonas aeruginosa PA01
agccggcugaugc

SEQ ID NO: 3374193 - RNA, 13 nt, Pseudomonas aeruginosa PA01
agccggcugccga

SEQ ID NO: 3374194 - RNA, 16 nt, Pseudomonas aeruginosa PA01
agccgggaagccgcuc

SEQ ID NO: 3374195 - RNA, 21 nt, Pseudomonas aeruginosa PA01
agccgggaucuccucgacggc

SEQ ID NO: 3374196 - RNA, 19 nt, Pseudomonas aeruginosa PA01
agccgggaugaacccggcu

SEQ ID NO: 3374197 - RNA, 17 nt, Pseudomonas aeruginosa PA01
agccgggcaccgucacc

SEQ ID NO: 3374198 - RNA, 13 nt, Pseudomonas aeruginosa PA01
agccgggcagccg

SEQ ID NO: 3374199 - RNA, 16 nt, Pseudomonas aeruginosa PA01
agccggggccguucag

SEQ ID NO: 3374200 - RNA, 22 nt, Pseudomonas aeruginosa PA01
agccggggcucaggccuuggcu

SEQ ID NO: 3374201 - RNA, 21 nt, Pseudomonas aeruginosa PA01
agccgggguugaguugcaggc

SEQ ID NO: 3374202 - RNA, 23 nt, Pseudomonas aeruginosa PA01
agccgggguugaguugcaggccg

SEQ ID NO: 3374203 - RNA, 19 nt, Pseudomonas aeruginosa PA01
agccggguucccaguugcu

SEQ ID NO: 3374204 - RNA, 14 nt, Pseudomonas aeruginosa PA01
agccgguaggggcc

SEQ ID NO: 3374205 - RNA, 15 nt, Pseudomonas aeruginosa PA01
agccgguaggggccg

SEQ ID NO: 3374206 - RNA, 21 nt, Pseudomonas aeruginosa PA01
agccgguagugcuucagguag

SEQ ID NO: 3374207 - RNA, 13 nt, Pseudomonas aeruginosa PA01
agccggucaggcg

SEQ ID NO: 3374208 - RNA, 16 nt, Pseudomonas aeruginosa PA01
agccggucaggcgccc

SEQ ID NO: 3374209 - RNA, 15 nt, Pseudomonas aeruginosa PA01
agccggucccgggcu

SEQ ID NO: 3374210 - RNA, 23 nt, Pseudomonas aeruginosa PA01
agccggucccgggcuccggguug

SEQ ID NO: 3374211 - RNA, 22 nt, Pseudomonas aeruginosa PA01
agccggugaaacggaucacgau

SEQ ID NO: 3374212 - RNA, 16 nt, Pseudomonas aeruginosa PA01
agccggugccggcggc

SEQ ID NO: 3374213 - RNA, 20 nt, Pseudomonas aeruginosa PA01
agccgguggucuucagcaca

SEQ ID NO: 3374214 - RNA, 19 nt, Pseudomonas aeruginosa PA01
agccgguguagaucaggcu

SEQ ID NO: 3374215 - RNA, 16 nt, Pseudomonas aeruginosa PA01
agccguagaacgccag

SEQ ID NO: 3374216 - RNA, 23 nt, Pseudomonas aeruginosa PA01
agccguagauggucagcaacugc

SEQ ID NO: 3374217 - RNA, 14 nt, Pseudomonas aeruginosa PA01
agccguagggcgca

SEQ ID NO: 3374218 - RNA, 20 nt, Pseudomonas aeruginosa PA01
agccguccgcccaguucgcc

SEQ ID NO: 3374219 - RNA, 19 nt, Pseudomonas aeruginosa PA01
agccguccgggucggucac

SEQ ID NO: 3374220 - RNA, 12 nt, Pseudomonas aeruginosa PA01
agccguccugcg

SEQ ID NO: 3374221 - RNA, 16 nt, Pseudomonas aeruginosa PA01
agccguccugcggccg

SEQ ID NO: 3374222 - RNA, 17 nt, Pseudomonas aeruginosa PA01
agccguccugcggccgc

SEQ ID NO: 3374223 - RNA, 16 nt, Pseudomonas aeruginosa PA01
agccgucgaacagcag

SEQ ID NO: 3374224 - RNA, 22 nt, Pseudomonas aeruginosa PA01
agccgucgaacagcagcucgcc

SEQ ID NO: 3374225 - RNA, 13 nt, Pseudomonas aeruginosa PA01
agccgucggcgau

SEQ ID NO: 3374226 - RNA, 15 nt, Pseudomonas aeruginosa PA01
agccgucggugaucg

SEQ ID NO: 3374227 - RNA, 19 nt, Pseudomonas aeruginosa PA01
agccgucggugaucgagac

SEQ ID NO: 3374228 - RNA, 22 nt, Pseudomonas aeruginosa PA01
agccgucggugaucgagacgcc

SEQ ID NO: 3374229 - RNA, 17 nt, Pseudomonas aeruginosa PA01
agccgucguagcgcagc

SEQ ID NO: 3374230 - RNA, 19 nt, Pseudomonas aeruginosa PA01
agccgucguagcgcagcgg

SEQ ID NO: 3374231 - RNA, 21 nt, Pseudomonas aeruginosa PA01
agccgucguagcgcagcggca

SEQ ID NO: 3374232 - RNA, 15 nt, Pseudomonas aeruginosa PA01
agccgugcagcagcg

SEQ ID NO: 3374233 - RNA, 18 nt, Pseudomonas aeruginosa PA01
agccguggcacccaggcc

SEQ ID NO: 3374234 - RNA, 20 nt, Pseudomonas aeruginosa PA01
agccguggcacccaggccac

SEQ ID NO: 3374235 - RNA, 22 nt, Pseudomonas aeruginosa PA01
agccguggcaggcgcccgguca

SEQ ID NO: 3374236 - RNA, 13 nt, Pseudomonas aeruginosa PA01
agccguggcgggc

SEQ ID NO: 3374237 - RNA, 22 nt, Pseudomonas aeruginosa PA01
agccguuacgacaucgacgccc

SEQ ID NO: 3374238 - RNA, 14 nt, Pseudomonas aeruginosa PA01
agccguuccaggcg

SEQ ID NO: 3374239 - RNA, 14 nt, Pseudomonas aeruginosa PA01
agcgagaccucgcc

SEQ ID NO: 3374240 - RNA, 17 nt, Pseudomonas aeruginosa PA01
agcgagacgggcgaggc

SEQ ID NO: 3374241 - RNA, 16 nt, Pseudomonas aeruginosa PA01
agcgagagcuguccgg

SEQ ID NO: 3374242 - RNA, 23 nt, Pseudomonas aeruginosa PA01
agcgagaggggcgcucguugcgc

SEQ ID NO: 3374243 - RNA, 15 nt, Pseudomonas aeruginosa PA01
agcgagccgagcaug

SEQ ID NO: 3374244 - RNA, 17 nt, Pseudomonas aeruginosa PA01
agcgagccgaucaccag

SEQ ID NO: 3374245 - RNA, 20 nt, Pseudomonas aeruginosa PA01
agcgagccgaucaccagcaa

SEQ ID NO: 3374246 - RNA, 17 nt, Pseudomonas aeruginosa PA01
agcgagccgcgcugcug

SEQ ID NO: 3374247 - RNA, 13 nt, Pseudomonas aeruginosa PA01
agcgagcgggcga

SEQ ID NO: 3374248 - RNA, 20 nt, Pseudomonas aeruginosa PA01
agcgagcgggcgagggcggc

SEQ ID NO: 3374249 - RNA, 21 nt, Pseudomonas aeruginosa PA01
agcgagcgggcgagggcggcg

SEQ ID NO: 3374250 - RNA, 23 nt, Pseudomonas aeruginosa PA01
agcgagcgggcgagggcggcgcg

SEQ ID NO: 3374251 - RNA, 17 nt, Pseudomonas aeruginosa PA01
agcgagcggucggccau

SEQ ID NO: 3374252 - RNA, 23 nt, Pseudomonas aeruginosa PA01
agcgagcuaucgccucccgccaa

SEQ ID NO: 3374253 - RNA, 12 nt, Pseudomonas aeruginosa PA01
agcgagcuugca

SEQ ID NO: 3374254 - RNA, 13 nt, Pseudomonas aeruginosa PA01
agcgagcuugcaa

SEQ ID NO: 3374255 - RNA, 13 nt, Pseudomonas aeruginosa PA01
agcgaggagccuu

SEQ ID NO: 3374256 - RNA, 13 nt, Pseudomonas aeruginosa PA01
agcgaggcccgcg

SEQ ID NO: 3374257 - RNA, 16 nt, Pseudomonas aeruginosa PA01
agcgaggcccgcgccg

SEQ ID NO: 3374258 - RNA, 17 nt, Pseudomonas aeruginosa PA01
agcgaggcccgcgccgc

SEQ ID NO: 3374259 - RNA, 20 nt, Pseudomonas aeruginosa PA01
agcgaguaggcgaagcccag

SEQ ID NO: 3374260 - RNA, 22 nt, Pseudomonas aeruginosa PA01
agcgaguaggcgaagcccagcg

SEQ ID NO: 3374261 - RNA, 14 nt, Pseudomonas aeruginosa PA01
agcgaguccgaccc

SEQ ID NO: 3374262 - RNA, 20 nt, Pseudomonas aeruginosa PA01
agcgaguccgacccgcuccg

SEQ ID NO: 3374263 - RNA, 15 nt, Pseudomonas aeruginosa PA01
agcgagucgacccag

SEQ ID NO: 3374264 - RNA, 16 nt, Pseudomonas aeruginosa PA01
agcgagucgacccagg

SEQ ID NO: 3374265 - RNA, 23 nt, Pseudomonas aeruginosa PA01
agcgagucgacccaggcccagcc

SEQ ID NO: 3374266 - RNA, 13 nt, Pseudomonas aeruginosa PA01
agcgagucgccgu

SEQ ID NO: 3374267 - RNA, 15 nt, Pseudomonas aeruginosa PA01
agcgagugcaggaag

SEQ ID NO: 3374268 - RNA, 23 nt, Pseudomonas aeruginosa PA01
agcgagugcugaacaucagguuc

SEQ ID NO: 3374269 - RNA, 12 nt, Pseudomonas aeruginosa PA01
agcgauacaccu

SEQ ID NO: 3374270 - RNA, 17 nt, Pseudomonas aeruginosa PA01
agcgauaggccuugccu

SEQ ID NO: 3374271 - RNA, 23 nt, Pseudomonas aeruginosa PA01
agcgaucggaagaucgcccgccu

SEQ ID NO: 3374272 - RNA, 21 nt, Pseudomonas aeruginosa PA01
agcgaucuccugccgcggcga

SEQ ID NO: 3374273 - RNA, 16 nt, Pseudomonas aeruginosa PA01
agcgaugccuccggcu

SEQ ID NO: 3374274 - RNA, 21 nt, Pseudomonas aeruginosa PA01
agcgaugcgguuccuggcugg

SEQ ID NO: 3374275 - RNA, 15 nt, Pseudomonas aeruginosa PA01
agcgaugggcgagac

SEQ ID NO: 3374276 - RNA, 17 nt, Pseudomonas aeruginosa PA01
agcgauuccaugggcag

SEQ ID NO: 3374277 - RNA, 14 nt, Pseudomonas aeruginosa PA01
agcgauugaacucg

SEQ ID NO: 3374278 - RNA, 19 nt, Pseudomonas aeruginosa PA01
agcgcaacgaaaagccgcc

SEQ ID NO: 3374279 - RNA, 16 nt, Pseudomonas aeruginosa PA01
agcgcaacgcgcgcag

SEQ ID NO: 3374280 - RNA, 14 nt, Pseudomonas aeruginosa PA01
agcgcaacgcgguu

SEQ ID NO: 3374281 - RNA, 22 nt, Pseudomonas aeruginosa PA01
agcgcaagcggcggcuucagcc

SEQ ID NO: 3374282 - RNA, 15 nt, Pseudomonas aeruginosa PA01
agcgcaagucggccu

SEQ ID NO: 3374283 - RNA, 16 nt, Pseudomonas aeruginosa PA01
agcgcaagucggccug

SEQ ID NO: 3374284 - RNA, 21 nt, Pseudomonas aeruginosa PA01
agcgcaagucggccugcacca

SEQ ID NO: 3374285 - RNA, 16 nt, Pseudomonas aeruginosa PA01
agcgcacaacgccuuc

SEQ ID NO: 3374286 - RNA, 14 nt, Pseudomonas aeruginosa PA01
agcgcaccaccugc

SEQ ID NO: 3374287 - RNA, 13 nt, Pseudomonas aeruginosa PA01
agcgcaccagggu

SEQ ID NO: 3374288 - RNA, 16 nt, Pseudomonas aeruginosa PA01
agcgcaccgccaagga

SEQ ID NO: 3374289 - RNA, 14 nt, Pseudomonas aeruginosa PA01
agcgcaccgcccug

SEQ ID NO: 3374290 - RNA, 16 nt, Pseudomonas aeruginosa PA01
agcgcaccuacuaccg

SEQ ID NO: 3374291 - RNA, 19 nt, Pseudomonas aeruginosa PA01
agcgcagccauucgccgcg

SEQ ID NO: 3374292 - RNA, 13 nt, Pseudomonas aeruginosa PA01
agcgcagccgcuc

SEQ ID NO: 3374293 - RNA, 15 nt, Pseudomonas aeruginosa PA01
agcgcagccugcugg

SEQ ID NO: 3374294 - RNA, 18 nt, Pseudomonas aeruginosa PA01
agcgcagccugcuggccu

SEQ ID NO: 3374295 - RNA, 18 nt, Pseudomonas aeruginosa PA01
agcgcagcggcaggccac

SEQ ID NO: 3374296 - RNA, 14 nt, Pseudomonas aeruginosa PA01
agcgcagcuccggc

SEQ ID NO: 3374297 - RNA, 15 nt, Pseudomonas aeruginosa PA01
agcgcagcuccggca

SEQ ID NO: 3374298 - RNA, 14 nt, Pseudomonas aeruginosa PA01
agcgcaggccgccg

SEQ ID NO: 3374299 - RNA, 22 nt, Pseudomonas aeruginosa PA01
agcgcaggcggacacgcaggcg

SEQ ID NO: 3374300 - RNA, 13 nt, Pseudomonas aeruginosa PA01
agcgcaggcggcu

SEQ ID NO: 3374301 - RNA, 17 nt, Pseudomonas aeruginosa PA01
agcgcaggcggcuggcg

SEQ ID NO: 3374302 - RNA, 19 nt, Pseudomonas aeruginosa PA01
agcgcaggcggcuggcgcg

SEQ ID NO: 3374303 - RNA, 19 nt, Pseudomonas aeruginosa PA01
agcgcagggucgcguuggc

SEQ ID NO: 3374304 - RNA, 20 nt, Pseudomonas aeruginosa PA01
agcgcagggucgcguuggcg

SEQ ID NO: 3374305 - RNA, 16 nt, Pseudomonas aeruginosa PA01
agcgcaggugcaccgc

SEQ ID NO: 3374306 - RNA, 18 nt, Pseudomonas aeruginosa PA01
agcgcagguugcgcuggc

SEQ ID NO: 3374307 - RNA, 21 nt, Pseudomonas aeruginosa PA01
agcgcagguugcgcuggcgca

SEQ ID NO: 3374308 - RNA, 20 nt, Pseudomonas aeruginosa PA01
agcgcaguacccggccgccu

SEQ ID NO: 3374309 - RNA, 15 nt, Pseudomonas aeruginosa PA01
agcgcaguucgccgc

SEQ ID NO: 3374310 - RNA, 15 nt, Pseudomonas aeruginosa PA01
agcgcaguucgucgc

SEQ ID NO: 3374311 - RNA, 21 nt, Pseudomonas aeruginosa PA01
agcgcauacgaaaacggcccu

SEQ ID NO: 3374312 - RNA, 18 nt, Pseudomonas aeruginosa PA01
agcgcauaggccugggcg

SEQ ID NO: 3374313 - RNA, 18 nt, Pseudomonas aeruginosa PA01
agcgcaucgaggccggca

SEQ ID NO: 3374314 - RNA, 14 nt, Pseudomonas aeruginosa PA01
agcgcaucgcgcac

SEQ ID NO: 3374315 - RNA, 22 nt, Pseudomonas aeruginosa PA01
agcgcaucggcgccucccaggg

SEQ ID NO: 3374316 - RNA, 14 nt, Pseudomonas aeruginosa PA01
agcgcaugaggcug

SEQ ID NO: 3374317 - RNA, 17 nt, Pseudomonas aeruginosa PA01
agcgcaugaggcuggcc

SEQ ID NO: 3374318 - RNA, 18 nt, Pseudomonas aeruginosa PA01
agcgcaugaggcuggcca

SEQ ID NO: 3374319 - RNA, 20 nt, Pseudomonas aeruginosa PA01
agcgcaugaggcuggccagc

SEQ ID NO: 3374320 - RNA, 22 nt, Pseudomonas aeruginosa PA01
agcgcaugaggcuggccagcaa

SEQ ID NO: 3374321 - RNA, 19 nt, Pseudomonas aeruginosa PA01
agcgcaugccguuggccga

SEQ ID NO: 3374322 - RNA, 13 nt, Pseudomonas aeruginosa PA01
agcgccaccagca

SEQ ID NO: 3374323 - RNA, 18 nt, Pseudomonas aeruginosa PA01
agcgccaccagcagggcc

SEQ ID NO: 3374324 - RNA, 16 nt, Pseudomonas aeruginosa PA01
agcgccacgccgcugu

SEQ ID NO: 3374325 - RNA, 17 nt, Pseudomonas aeruginosa PA01
agcgccacgcgagaagc

SEQ ID NO: 3374326 - RNA, 13 nt, Pseudomonas aeruginosa PA01
agcgccacgcuga

SEQ ID NO: 3374327 - RNA, 23 nt, Pseudomonas aeruginosa PA01
agcgccacgcugaucaucagcag

SEQ ID NO: 3374328 - RNA, 13 nt, Pseudomonas aeruginosa PA01
agcgccacggcga

SEQ ID NO: 3374329 - RNA, 14 nt, Pseudomonas aeruginosa PA01
agcgccacggcgcg

SEQ ID NO: 3374330 - RNA, 16 nt, Pseudomonas aeruginosa PA01
agcgccacuuccaggu

SEQ ID NO: 3374331 - RNA, 12 nt, Pseudomonas aeruginosa PA01
agcgccagcaac

SEQ ID NO: 3374332 - RNA, 16 nt, Pseudomonas aeruginosa PA01
agcgccagcaccagca

SEQ ID NO: 3374333 - RNA, 22 nt, Pseudomonas aeruginosa PA01
agcgccagcaccagcaggagca

SEQ ID NO: 3374334 - RNA, 13 nt, Pseudomonas aeruginosa PA01
agcgccagcaggc

SEQ ID NO: 3374335 - RNA, 14 nt, Pseudomonas aeruginosa PA01
agcgccagcaggcg

SEQ ID NO: 3374336 - RNA, 15 nt, Pseudomonas aeruginosa PA01
agcgccagcaggcga

SEQ ID NO: 3374337 - RNA, 16 nt, Pseudomonas aeruginosa PA01
agcgccagcagguggu

SEQ ID NO: 3374338 - RNA, 16 nt, Pseudomonas aeruginosa PA01
agcgccagcagguugg

SEQ ID NO: 3374339 - RNA, 22 nt, Pseudomonas aeruginosa PA01
agcgccagcagguuggucugcu

SEQ ID NO: 3374340 - RNA, 14 nt, Pseudomonas aeruginosa PA01
agcgccagccagcg

SEQ ID NO: 3374341 - RNA, 15 nt, Pseudomonas aeruginosa PA01
agcgccagccagcgc

SEQ ID NO: 3374342 - RNA, 23 nt, Pseudomonas aeruginosa PA01
agcgccuccucuaccaggcgguu

SEQ ID NO: 3374343 - RNA, 19 nt, Pseudomonas aeruginosa PA01
agcgccucgaccucggccg

SEQ ID NO: 3374344 - RNA, 14 nt, Pseudomonas aeruginosa PA01
agcgccucgaucgc

SEQ ID NO: 3374345 - RNA, 15 nt, Pseudomonas aeruginosa PA01
agcgccucgaucgcc

SEQ ID NO: 3374346 - RNA, 23 nt, Pseudomonas aeruginosa PA01
agcgccucgaucgccucgggcga

SEQ ID NO: 3374347 - RNA, 13 nt, Pseudomonas aeruginosa PA01
agcgccucgccga

SEQ ID NO: 3374348 - RNA, 15 nt, Pseudomonas aeruginosa PA01
agcgccucgccgagc

SEQ ID NO: 3374349 - RNA, 16 nt, Pseudomonas aeruginosa PA01
agcgccucgccgagca

SEQ ID NO: 3374350 - RNA, 20 nt, Pseudomonas aeruginosa PA01
agcgccucggcaucgaccag

SEQ ID NO: 3374351 - RNA, 15 nt, Pseudomonas aeruginosa PA01
agcgccucggcgcag

SEQ ID NO: 3374352 - RNA, 14 nt, Pseudomonas aeruginosa PA01
agcgccucggcggc

SEQ ID NO: 3374353 - RNA, 19 nt, Pseudomonas aeruginosa PA01
agcgccucguggaacagcg

SEQ ID NO: 3374354 - RNA, 20 nt, Pseudomonas aeruginosa PA01
agcgccucguggaacagcgc

SEQ ID NO: 3374355 - RNA, 15 nt, Pseudomonas aeruginosa PA01
agcgccugcugcgcg

SEQ ID NO: 3374356 - RNA, 13 nt, Pseudomonas aeruginosa PA01
agcgccuggcgca

SEQ ID NO: 3374357 - RNA, 20 nt, Pseudomonas aeruginosa PA01
agcgccuggcgcaacgccgg

SEQ ID NO: 3374358 - RNA, 14 nt, Pseudomonas aeruginosa PA01
agcgccuggcgcag

SEQ ID NO: 3374359 - RNA, 22 nt, Pseudomonas aeruginosa PA01
agcgccuggcgcaguucaucga

SEQ ID NO: 3374360 - RNA, 13 nt, Pseudomonas aeruginosa PA01
agcgccuggcguc

SEQ ID NO: 3374361 - RNA, 15 nt, Pseudomonas aeruginosa PA01
agcgccuggcgucga

SEQ ID NO: 3374362 - RNA, 15 nt, Pseudomonas aeruginosa PA01
agcgccuggucggcg

SEQ ID NO: 3374363 - RNA, 19 nt, Pseudomonas aeruginosa PA01
agcgccuggucggcggccu

SEQ ID NO: 3374364 - RNA, 19 nt, Pseudomonas aeruginosa PA01
agcgccugguucugcuccg

SEQ ID NO: 3374365 - RNA, 23 nt, Pseudomonas aeruginosa PA01
agcgccuguaccccguagcgcuc

SEQ ID NO: 3374366 - RNA, 12 nt, Pseudomonas aeruginosa PA01
agcgccuguucc

SEQ ID NO: 3374367 - RNA, 14 nt, Pseudomonas aeruginosa PA01
agcgccuguuccag

SEQ ID NO: 3374368 - RNA, 14 nt, Pseudomonas aeruginosa PA01
agcgccuucaccgu

SEQ ID NO: 3374369 - RNA, 23 nt, Pseudomonas aeruginosa PA01
agcgccuucaccguucccagcag

SEQ ID NO: 3374370 - RNA, 19 nt, Pseudomonas aeruginosa PA01
agcgccuucugcgugggca

SEQ ID NO: 3374371 - RNA, 19 nt, Pseudomonas aeruginosa PA01
agcgccuugaccucgacgc

SEQ ID NO: 3374372 - RNA, 16 nt, Pseudomonas aeruginosa PA01
agcgccuuuucggcac

SEQ ID NO: 3374373 - RNA, 21 nt, Pseudomonas aeruginosa PA01
agcgccuuuucggcacucagg

SEQ ID NO: 3374374 - RNA, 16 nt, Pseudomonas aeruginosa PA01
agcgcgaaagcgcccc

SEQ ID NO: 3374375 - RNA, 22 nt, Pseudomonas aeruginosa PA01
agcgcgaacaguuccgacugcg

SEQ ID NO: 3374376 - RNA, 14 nt, Pseudomonas aeruginosa PA01
agcgcgaaggcgcc

SEQ ID NO: 3374377 - RNA, 16 nt, Pseudomonas aeruginosa PA01
agcgcgaaggcgccuu

SEQ ID NO: 3374378 - RNA, 17 nt, Pseudomonas aeruginosa PA01
agcgcgaaggcgccuuc

SEQ ID NO: 3374379 - RNA, 19 nt, Pseudomonas aeruginosa PA01
agcgcgaaggcgccuucca

SEQ ID NO: 3374380 - RNA, 16 nt, Pseudomonas aeruginosa PA01
agcgcgacaucggcga

SEQ ID NO: 3374381 - RNA, 14 nt, Pseudomonas aeruginosa PA01
agcgcgagcggcag

SEQ ID NO: 3374382 - RNA, 13 nt, Pseudomonas aeruginosa PA01
agcgcgaggcgag

SEQ ID NO: 3374383 - RNA, 15 nt, Pseudomonas aeruginosa PA01
agcgcgaggcgagua

SEQ ID NO: 3374384 - RNA, 14 nt, Pseudomonas aeruginosa PA01
agcgcgaggcgcag

SEQ ID NO: 3374385 - RNA, 20 nt, Pseudomonas aeruginosa PA01
agcgcgaguaguaggucggu

SEQ ID NO: 3374386 - RNA, 21 nt, Pseudomonas aeruginosa PA01
agcgcgaguaguaggucgguu

SEQ ID NO: 3374387 - RNA, 15 nt, Pseudomonas aeruginosa PA01
agcgcgagugcagcg

SEQ ID NO: 3374388 - RNA, 20 nt, Pseudomonas aeruginosa PA01
agcgcgauacccuggccggc

SEQ ID NO: 3374389 - RNA, 22 nt, Pseudomonas aeruginosa PA01
agcgcgauacccuggccggccu

SEQ ID NO: 3374390 - RNA, 17 nt, Pseudomonas aeruginosa PA01
agcgcgauaucgcaggc

SEQ ID NO: 3374391 - RNA, 20 nt, Pseudomonas aeruginosa PA01
agcgcgauaucgcaggccag

SEQ ID NO: 3374392 - RNA, 22 nt, Pseudomonas aeruginosa PA01
agcgcgauaucgcaggccaggc

SEQ ID NO: 3374393 - RNA, 23 nt, Pseudomonas aeruginosa PA01
agcgcgaucucuacuaccgccag

SEQ ID NO: 3374394 - RNA, 14 nt, Pseudomonas aeruginosa PA01
agcgcgcaggcgcu

SEQ ID NO: 3374395 - RNA, 15 nt, Pseudomonas aeruginosa PA01
agcgcgcaggcgcua

SEQ ID NO: 3374396 - RNA, 19 nt, Pseudomonas aeruginosa PA01
agcgcgccagcacggcgca

SEQ ID NO: 3374397 - RNA, 20 nt, Pseudomonas aeruginosa PA01
agcgcgccagcacggcgcag

SEQ ID NO: 3374398 - RNA, 18 nt, Pseudomonas aeruginosa PA01
agcgcgccaucggcggua

SEQ ID NO: 3374399 - RNA, 21 nt, Pseudomonas aeruginosa PA01
agcgcgccaucggcgguacgc

SEQ ID NO: 3374400 - RNA, 13 nt, Pseudomonas aeruginosa PA01
agcgcgcccggcg

SEQ ID NO: 3374401 - RNA, 23 nt, Pseudomonas aeruginosa PA01
agcgcgcccggcgccaccccgcc

SEQ ID NO: 3374402 - RNA, 13 nt, Pseudomonas aeruginosa PA01
agcgcgccgagcc

SEQ ID NO: 3374403 - RNA, 16 nt, Pseudomonas aeruginosa PA01
agcgcgccgagccagg

SEQ ID NO: 3374404 - RNA, 17 nt, Pseudomonas aeruginosa PA01
agcgcgccgagccaggu

SEQ ID NO: 3374405 - RNA, 18 nt, Pseudomonas aeruginosa PA01
agcgcgccgagccaggua

SEQ ID NO: 3374406 - RNA, 19 nt, Pseudomonas aeruginosa PA01
agcgcgccgagccagguac

SEQ ID NO: 3374407 - RNA, 15 nt, Pseudomonas aeruginosa PA01
agcgcgccgccgagg

SEQ ID NO: 3374408 - RNA, 22 nt, Pseudomonas aeruginosa PA01
agcgcgccgcgcaguucgucca

SEQ ID NO: 3374409 - RNA, 12 nt, Pseudomonas aeruginosa PA01
agcgcgccgggu

SEQ ID NO: 3374410 - RNA, 20 nt, Pseudomonas aeruginosa PA01
agcgcgcgauaccgacaagc

SEQ ID NO: 3374411 - RNA, 14 nt, Pseudomonas aeruginosa PA01
agcgcgcgccgaca

SEQ ID NO: 3374412 - RNA, 16 nt, Pseudomonas aeruginosa PA01
agcgcgcgccgagcaa

SEQ ID NO: 3374413 - RNA, 14 nt, Pseudomonas aeruginosa PA01
agcgcgcgcuggcg

SEQ ID NO: 3374414 - RNA, 13 nt, Pseudomonas aeruginosa PA01
agcgcgcgcuggu

SEQ ID NO: 3374415 - RNA, 20 nt, Pseudomonas aeruginosa PA01
agcgcgcggcucggcgggcu

SEQ ID NO: 3374416 - RNA, 21 nt, Pseudomonas aeruginosa PA01
agcgcgcggcucggcgggcug

SEQ ID NO: 3374417 - RNA, 22 nt, Pseudomonas aeruginosa PA01
agcgcgcguagcgugccgccau

SEQ ID NO: 3374418 - RNA, 15 nt, Pseudomonas aeruginosa PA01
agcgcgcgucggcgg

SEQ ID NO: 3374419 - RNA, 14 nt, Pseudomonas aeruginosa PA01
agcgcgcucggccu

SEQ ID NO: 3374420 - RNA, 18 nt, Pseudomonas aeruginosa PA01
agcgcgcuguagccggcg

SEQ ID NO: 3374421 - RNA, 22 nt, Pseudomonas aeruginosa PA01
agcgcggaaaaucaaaaccagc

SEQ ID NO: 3374422 - RNA, 23 nt, Pseudomonas aeruginosa PA01
agcgcggagcguccaccagcgcc

SEQ ID NO: 3374423 - RNA, 19 nt, Pseudomonas aeruginosa PA01
agcgcggaucagucaggau

SEQ ID NO: 3374424 - RNA, 23 nt, Pseudomonas aeruginosa PA01
agcgcggaucagucaggaucggc

SEQ ID NO: 3374425 - RNA, 17 nt, Pseudomonas aeruginosa PA01
agcgcggcagcgccauc

SEQ ID NO: 3374426 - RNA, 24 nt, Pseudomonas aeruginosa PA01
agcgcggccacuucguccggccgc

SEQ ID NO: 3374427 - RNA, 22 nt, Pseudomonas aeruginosa PA01
agcgcggccgccgccgacaggu

SEQ ID NO: 3374428 - RNA, 13 nt, Pseudomonas aeruginosa PA01
agcgcggccggcc

SEQ ID NO: 3374429 - RNA, 21 nt, Pseudomonas aeruginosa PA01
agcgcggccggccacgcgacc

SEQ ID NO: 3374430 - RNA, 19 nt, Pseudomonas aeruginosa PA01
agcgcggccuucagcggug

SEQ ID NO: 3374431 - RNA, 16 nt, Pseudomonas aeruginosa PA01
agcgcggcgccccagg

SEQ ID NO: 3374432 - RNA, 18 nt, Pseudomonas aeruginosa PA01
agcgcggcgccccaggcg

SEQ ID NO: 3374433 - RNA, 19 nt, Pseudomonas aeruginosa PA01
agcgcggcgccccaggcgc

SEQ ID NO: 3374434 - RNA, 21 nt, Pseudomonas aeruginosa PA01
agcgcggcgcggacauggcgc

SEQ ID NO: 3374435 - RNA, 13 nt, Pseudomonas aeruginosa PA01
agcgcggcgcugg

SEQ ID NO: 3374436 - RNA, 16 nt, Pseudomonas aeruginosa PA01
agcgcggcgcuuggcg

SEQ ID NO: 3374437 - RNA, 19 nt, Pseudomonas aeruginosa PA01
agcgcggcgcuuggcgaaa

SEQ ID NO: 3374438 - RNA, 15 nt, Pseudomonas aeruginosa PA01
agcgcggcggcgcgg

SEQ ID NO: 3374439 - RNA, 18 nt, Pseudomonas aeruginosa PA01
agcgcggcggcgcggaga

SEQ ID NO: 3374440 - RNA, 21 nt, Pseudomonas aeruginosa PA01
agcgcggcggcgcggagaucc

SEQ ID NO: 3374441 - RNA, 13 nt, Pseudomonas aeruginosa PA01
agcgcggcggcgg

SEQ ID NO: 3374442 - RNA, 22 nt, Pseudomonas aeruginosa PA01
agcgcggcggcggccagcagca

SEQ ID NO: 3374443 - RNA, 23 nt, Pseudomonas aeruginosa PA01
agcgcggcggcggccagcagcac

SEQ ID NO: 3374444 - RNA, 16 nt, Pseudomonas aeruginosa PA01
agcgcggcggcggccg

SEQ ID NO: 3374445 - RNA, 22 nt, Pseudomonas aeruginosa PA01
agcgcggcggugcagaacgcgu

SEQ ID NO: 3374446 - RNA, 17 nt, Pseudomonas aeruginosa PA01
agcgcggcucggggaug

SEQ ID NO: 3374447 - RNA, 22 nt, Pseudomonas aeruginosa PA01
agcgcggcucggggauguagcg

SEQ ID NO: 3374448 - RNA, 15 nt, Pseudomonas aeruginosa PA01
agcgcggcuucagag

SEQ ID NO: 3374449 - RNA, 18 nt, Pseudomonas aeruginosa PA01
agcgcggcuucagagcug

SEQ ID NO: 3374450 - RNA, 19 nt, Pseudomonas aeruginosa PA01
agcgcggcuucagagcugg

SEQ ID NO: 3374451 - RNA, 22 nt, Pseudomonas aeruginosa PA01
agcgcggcuucagagcuggacg

SEQ ID NO: 3374452 - RNA, 15 nt, Pseudomonas aeruginosa PA01
agcgcggucacccau

SEQ ID NO: 3374453 - RNA, 22 nt, Pseudomonas aeruginosa PA01
agcgcggucacccauucgaugc

SEQ ID NO: 3374454 - RNA, 16 nt, Pseudomonas aeruginosa PA01
agcgcggucauccgcc

SEQ ID NO: 3374455 - RNA, 15 nt, Pseudomonas aeruginosa PA01
agcgcggugagcagg

SEQ ID NO: 3374456 - RNA, 16 nt, Pseudomonas aeruginosa PA01
agcgcggugagcaggg

SEQ ID NO: 3374457 - RNA, 19 nt, Pseudomonas aeruginosa PA01
agcgcggugagcaggguga

SEQ ID NO: 3374458 - RNA, 19 nt, Pseudomonas aeruginosa PA01
agcgcgucaucaggcucag

SEQ ID NO: 3374459 - RNA, 17 nt, Pseudomonas aeruginosa PA01
agcgcgucgaccaccgc

SEQ ID NO: 3374460 - RNA, 19 nt, Pseudomonas aeruginosa PA01
agcgcgucggcacgccgaa

SEQ ID NO: 3374461 - RNA, 13 nt, Pseudomonas aeruginosa PA01
agcgcgugcaggc

SEQ ID NO: 3374462 - RNA, 23 nt, Pseudomonas aeruginosa PA01
agcgcgugcaggcgcccuggccg

SEQ ID NO: 3374463 - RNA, 19 nt, Pseudomonas aeruginosa PA01
agcgcguucaccccgcccu

SEQ ID NO: 3374464 - RNA, 14 nt, Pseudomonas aeruginosa PA01
agcgcuacgcaggc

SEQ ID NO: 3374465 - RNA, 13 nt, Pseudomonas aeruginosa PA01
agcgcuccaccgc

SEQ ID NO: 3374466 - RNA, 14 nt, Pseudomonas aeruginosa PA01
agcgcuccaccgcg

SEQ ID NO: 3374467 - RNA, 13 nt, Pseudomonas aeruginosa PA01
agcgcuccagcuc

SEQ ID NO: 3374468 - RNA, 15 nt, Pseudomonas aeruginosa PA01
agcgcuccagcuccu

SEQ ID NO: 3374469 - RNA, 16 nt, Pseudomonas aeruginosa PA01
agcgcucccagaccuc

SEQ ID NO: 3374470 - RNA, 19 nt, Pseudomonas aeruginosa PA01
agcgcuccucgcgcugccc

SEQ ID NO: 3374471 - RNA, 20 nt, Pseudomonas aeruginosa PA01
agcgcuccucgcgcugcccg

SEQ ID NO: 3374472 - RNA, 21 nt, Pseudomonas aeruginosa PA01
agcgcuccucgcgcugcccgg

SEQ ID NO: 3374473 - RNA, 18 nt, Pseudomonas aeruginosa PA01
agcgcuccuguucgucgc

SEQ ID NO: 3374474 - RNA, 16 nt, Pseudomonas aeruginosa PA01
agcgcuccuugcgcca

SEQ ID NO: 3374475 - RNA, 20 nt, Pseudomonas aeruginosa PA01
agcgcuccuugcgccaggcc

SEQ ID NO: 3374476 - RNA, 13 nt, Pseudomonas aeruginosa PA01
agcgcucgcgcag

SEQ ID NO: 3374477 - RNA, 20 nt, Pseudomonas aeruginosa PA01
agcgcucggucagcucccug

SEQ ID NO: 3374478 - RNA, 14 nt, Pseudomonas aeruginosa PA01
agcgcucgguggca

SEQ ID NO: 3374479 - RNA, 20 nt, Pseudomonas aeruginosa PA01
agcgcucgguggcauggugu

SEQ ID NO: 3374480 - RNA, 14 nt, Pseudomonas aeruginosa PA01
agcgcugacgaaac

SEQ ID NO: 3374481 - RNA, 14 nt, Pseudomonas aeruginosa PA01
agcgcugccugcac

SEQ ID NO: 3374482 - RNA, 15 nt, Pseudomonas aeruginosa PA01
agcgcugcgccaggc

SEQ ID NO: 3374483 - RNA, 16 nt, Pseudomonas aeruginosa PA01
agcgcugcgccaggcu

SEQ ID NO: 3374484 - RNA, 12 nt, Pseudomonas aeruginosa PA01
agcgcugcgccc

SEQ ID NO: 3374485 - RNA, 20 nt, Pseudomonas aeruginosa PA01
agcgcugcgcccgcucgacc

SEQ ID NO: 3374486 - RNA, 15 nt, Pseudomonas aeruginosa PA01
agcgcugcugggcgg

SEQ ID NO: 3374487 - RNA, 16 nt, Pseudomonas aeruginosa PA01
agcgcuggcagguugc

SEQ ID NO: 3374488 - RNA, 16 nt, Pseudomonas aeruginosa PA01
agcgcuggcgaucacc

SEQ ID NO: 3374489 - RNA, 19 nt, Pseudomonas aeruginosa PA01
agcgcugguugacgaacag

SEQ ID NO: 3374490 - RNA, 22 nt, Pseudomonas aeruginosa PA01
agcgcuucauccugcgcgccuc

SEQ ID NO: 3374491 - RNA, 14 nt, Pseudomonas aeruginosa PA01
agcgcuuccaccgc

SEQ ID NO: 3374492 - RNA, 19 nt, Pseudomonas aeruginosa PA01
agcgcuuccaccgccugcc

SEQ ID NO: 3374493 - RNA, 21 nt, Pseudomonas aeruginosa PA01
agcgcuuccaccgccugcccc

SEQ ID NO: 3374494 - RNA, 14 nt, Pseudomonas aeruginosa PA01
agcgcuucgcgcag

SEQ ID NO: 3374495 - RNA, 22 nt, Pseudomonas aeruginosa PA01
agcgcuucgggagucaacgccu

SEQ ID NO: 3374496 - RNA, 14 nt, Pseudomonas aeruginosa PA01
agcgcuucucggca

SEQ ID NO: 3374497 - RNA, 14 nt, Pseudomonas aeruginosa PA01
agcgcuugcauggc

SEQ ID NO: 3374498 - RNA, 16 nt, Pseudomonas aeruginosa PA01
agcgcuugcuggcgcg

SEQ ID NO: 3374499 - RNA, 17 nt, Pseudomonas aeruginosa PA01
agcgcuugcuggcgcga

SEQ ID NO: 3374500 - RNA, 22 nt, Pseudomonas aeruginosa PA01
agcgcuuguagcagccgcagga

SEQ ID NO: 3374501 - RNA, 17 nt, Pseudomonas aeruginosa PA01
agcggaaaugcucgccg

SEQ ID NO: 3374502 - RNA, 20 nt, Pseudomonas aeruginosa PA01
agcggaaaugcucgccgucc

SEQ ID NO: 3374503 - RNA, 21 nt, Pseudomonas aeruginosa PA01
agcggaaaugcucgccguccg

SEQ ID NO: 3374504 - RNA, 22 nt, Pseudomonas aeruginosa PA01
agcggaacgaaggacaggucgc

SEQ ID NO: 3374505 - RNA, 21 nt, Pseudomonas aeruginosa PA01
agcggaacuugcgccgaccgc

SEQ ID NO: 3374506 - RNA, 14 nt, Pseudomonas aeruginosa PA01
agcggaagcccagc

SEQ ID NO: 3374507 - RNA, 18 nt, Pseudomonas aeruginosa PA01
agcggaagcccagcaggu

SEQ ID NO: 3374508 - RNA, 21 nt, Pseudomonas aeruginosa PA01
agcggaagcccugcuggcgca

SEQ ID NO: 3374509 - RNA, 22 nt, Pseudomonas aeruginosa PA01
agcggaagcgcagccauucgcc

SEQ ID NO: 3374510 - RNA, 15 nt, Pseudomonas aeruginosa PA01
agcggaaucgcgccc

SEQ ID NO: 3374511 - RNA, 21 nt, Pseudomonas aeruginosa PA01
agcggaggauucagcaggaau

SEQ ID NO: 3374512 - RNA, 20 nt, Pseudomonas aeruginosa PA01
agcggaguucgucaaccagc

SEQ ID NO: 3374513 - RNA, 23 nt, Pseudomonas aeruginosa PA01
agcggaguucgucaaccagcacc

SEQ ID NO: 3374514 - RNA, 23 nt, Pseudomonas aeruginosa PA01
agcggauauucgacgcgcggcug

SEQ ID NO: 3374515 - RNA, 13 nt, Pseudomonas aeruginosa PA01
agcggaucagccg

SEQ ID NO: 3374516 - RNA, 15 nt, Pseudomonas aeruginosa PA01
agcggaucagccggc

SEQ ID NO: 3374517 - RNA, 17 nt, Pseudomonas aeruginosa PA01
agcggaucagccggccc

SEQ ID NO: 3374518 - RNA, 13 nt, Pseudomonas aeruginosa PA01
agcggaucaggcc

SEQ ID NO: 3374519 - RNA, 17 nt, Pseudomonas aeruginosa PA01
agcggaucucgucgccg

SEQ ID NO: 3374520 - RNA, 19 nt, Pseudomonas aeruginosa PA01
agcggaucucgucgccgac

SEQ ID NO: 3374521 - RNA, 20 nt, Pseudomonas aeruginosa PA01
agcggaucucgucgccgacc

SEQ ID NO: 3374522 - RNA, 15 nt, Pseudomonas aeruginosa PA01
agcggaugcgcgaau

SEQ ID NO: 3374523 - RNA, 23 nt, Pseudomonas aeruginosa PA01
agcggaugcgcgaauaccgcgcg

SEQ ID NO: 3374524 - RNA, 14 nt, Pseudomonas aeruginosa PA01
agcggaugcuggcg

SEQ ID NO: 3374525 - RNA, 14 nt, Pseudomonas aeruginosa PA01
agcggaugucgucg

SEQ ID NO: 3374526 - RNA, 17 nt, Pseudomonas aeruginosa PA01
agcggaugucgucgcag

SEQ ID NO: 3374527 - RNA, 19 nt, Pseudomonas aeruginosa PA01
agcggauguucuucaccuu

SEQ ID NO: 3374528 - RNA, 17 nt, Pseudomonas aeruginosa PA01
agcggcaaaggcccggc

SEQ ID NO: 3374529 - RNA, 16 nt, Pseudomonas aeruginosa PA01
agcggcaacgcgccca

SEQ ID NO: 3374530 - RNA, 13 nt, Pseudomonas aeruginosa PA01
agcggcaccucga

SEQ ID NO: 3374531 - RNA, 18 nt, Pseudomonas aeruginosa PA01
agcggcacgcucuggccg

SEQ ID NO: 3374532 - RNA, 21 nt, Pseudomonas aeruginosa PA01
agcggcacggucauggccagc

SEQ ID NO: 3374533 - RNA, 22 nt, Pseudomonas aeruginosa PA01
agcggcacggucauggccagcu

SEQ ID NO: 3374534 - RNA, 15 nt, Pseudomonas aeruginosa PA01
agcggcagauccgcc

SEQ ID NO: 3374535 - RNA, 17 nt, Pseudomonas aeruginosa PA01
agcggcagauccgccgu

SEQ ID NO: 3374536 - RNA, 18 nt, Pseudomonas aeruginosa PA01
agcggcagauccgccgug

SEQ ID NO: 3374537 - RNA, 14 nt, Pseudomonas aeruginosa PA01
agcggcagaucggu

SEQ ID NO: 3374538 - RNA, 23 nt, Pseudomonas aeruginosa PA01
agcggcagaucggugcgggcaga

SEQ ID NO: 3374539 - RNA, 14 nt, Pseudomonas aeruginosa PA01
agcggcagccacuc

SEQ ID NO: 3374540 - RNA, 19 nt, Pseudomonas aeruginosa PA01
agcggcagccacucggcca

SEQ ID NO: 3374541 - RNA, 20 nt, Pseudomonas aeruginosa PA01
agcggcagccccuugcgcuc

SEQ ID NO: 3374542 - RNA, 12 nt, Pseudomonas aeruginosa PA01
agcggcagcgcc

SEQ ID NO: 3374543 - RNA, 13 nt, Pseudomonas aeruginosa PA01
agcggcagcgcca

SEQ ID NO: 3374544 - RNA, 16 nt, Pseudomonas aeruginosa PA01
agcggcagcgccaggu

SEQ ID NO: 3374545 - RNA, 17 nt, Pseudomonas aeruginosa PA01
agcggcagcgccaggua

SEQ ID NO: 3374546 - RNA, 17 nt, Pseudomonas aeruginosa PA01
agcgggucggcgaagua

SEQ ID NO: 3374547 - RNA, 23 nt, Pseudomonas aeruginosa PA01
agcgggucgucgaagcgcagcag

SEQ ID NO: 3374548 - RNA, 18 nt, Pseudomonas aeruginosa PA01
agcggguucccugcgccu

SEQ ID NO: 3374549 - RNA, 23 nt, Pseudomonas aeruginosa PA01
agcggguuggcuuccagccagcc

SEQ ID NO: 3374550 - RNA, 14 nt, Pseudomonas aeruginosa PA01
agcgguacaggcgg

SEQ ID NO: 3374551 - RNA, 15 nt, Pseudomonas aeruginosa PA01
agcgguacaggcgga

SEQ ID NO: 3374552 - RNA, 15 nt, Pseudomonas aeruginosa PA01
agcgguaccagcagc

SEQ ID NO: 3374553 - RNA, 17 nt, Pseudomonas aeruginosa PA01
agcgguaccagcagcgc

SEQ ID NO: 3374554 - RNA, 19 nt, Pseudomonas aeruginosa PA01
agcgguaccagcagcgccg

SEQ ID NO: 3374555 - RNA, 16 nt, Pseudomonas aeruginosa PA01
agcgguacccgccggc

SEQ ID NO: 3374556 - RNA, 17 nt, Pseudomonas aeruginosa PA01
agcgguacccgccggcc

SEQ ID NO: 3374557 - RNA, 22 nt, Pseudomonas aeruginosa PA01
agcgguacuaucccggucgggu

SEQ ID NO: 3374558 - RNA, 17 nt, Pseudomonas aeruginosa PA01
agcgguagaacaggcga

SEQ ID NO: 3374559 - RNA, 14 nt, Pseudomonas aeruginosa PA01
agcgguagccguca

SEQ ID NO: 3374560 - RNA, 18 nt, Pseudomonas aeruginosa PA01
agcgguagugggcgaggc

SEQ ID NO: 3374561 - RNA, 19 nt, Pseudomonas aeruginosa PA01
agcgguagugggcgaggcg

SEQ ID NO: 3374562 - RNA, 23 nt, Pseudomonas aeruginosa PA01
agcgguagugggcgaggcgcucg

SEQ ID NO: 3374563 - RNA, 18 nt, Pseudomonas aeruginosa PA01
agcgguaguucagucggu

SEQ ID NO: 3374564 - RNA, 23 nt, Pseudomonas aeruginosa PA01
agcgguaugccgcaggcaguggc

SEQ ID NO: 3374565 - RNA, 16 nt, Pseudomonas aeruginosa PA01
agcgguccucgggcac

SEQ ID NO: 3374566 - RNA, 22 nt, Pseudomonas aeruginosa PA01
agcgguccucgggcaccagcac

SEQ ID NO: 3374567 - RNA, 23 nt, Pseudomonas aeruginosa PA01
agcgguccucgggcaccagcacg

SEQ ID NO: 3374568 - RNA, 14 nt, Pseudomonas aeruginosa PA01
agcggucgccggcg

SEQ ID NO: 3374569 - RNA, 13 nt, Pseudomonas aeruginosa PA01
agcggucgccggu

SEQ ID NO: 3374570 - RNA, 15 nt, Pseudomonas aeruginosa PA01
agcggucgccggucg

SEQ ID NO: 3374571 - RNA, 20 nt, Pseudomonas aeruginosa PA01
agcggucggagguucgaauc

SEQ ID NO: 3374572 - RNA, 16 nt, Pseudomonas aeruginosa PA01
agcggucggccauggc

SEQ ID NO: 3374573 - RNA, 13 nt, Pseudomonas aeruginosa PA01
agcggucgugcag

SEQ ID NO: 3374574 - RNA, 16 nt, Pseudomonas aeruginosa PA01
agcggucgugcagcag

SEQ ID NO: 3374575 - RNA, 13 nt, Pseudomonas aeruginosa PA01
agcggugccgcgu

SEQ ID NO: 3374576 - RNA, 13 nt, Pseudomonas aeruginosa PA01
agcggugggaaga

SEQ ID NO: 3374577 - RNA, 17 nt, Pseudomonas aeruginosa PA01
agcggugugcucaggcg

SEQ ID NO: 3374578 - RNA, 18 nt, Pseudomonas aeruginosa PA01
agcggugugcucaggcga

SEQ ID NO: 3374579 - RNA, 14 nt, Pseudomonas aeruginosa PA01
agcgguuagccggc

SEQ ID NO: 3374580 - RNA, 17 nt, Pseudomonas aeruginosa PA01
agcgguuagccggcgau

SEQ ID NO: 3374581 - RNA, 14 nt, Pseudomonas aeruginosa PA01
agcgguuauucgcc

SEQ ID NO: 3374582 - RNA, 17 nt, Pseudomonas aeruginosa PA01
agcgguuauucgcccua

SEQ ID NO: 3374583 - RNA, 22 nt, Pseudomonas aeruginosa PA01
agcgguuauucgcccuacgggg

SEQ ID NO: 3374584 - RNA, 13 nt, Pseudomonas aeruginosa PA01
agcgguucagguc

SEQ ID NO: 3374585 - RNA, 21 nt, Pseudomonas aeruginosa PA01
agcgguucaggucgaggccgc

SEQ ID NO: 3374586 - RNA, 15 nt, Pseudomonas aeruginosa PA01
agcgguucgcccgcg

SEQ ID NO: 3374587 - RNA, 21 nt, Pseudomonas aeruginosa PA01
agcguaucgaugcgcgcggcg

SEQ ID NO: 3374588 - RNA, 22 nt, Pseudomonas aeruginosa PA01
agcguaucgaugcgcgcggcga

SEQ ID NO: 3374589 - RNA, 15 nt, Pseudomonas aeruginosa PA01
agcgucaccgcgccg

SEQ ID NO: 3374590 - RNA, 23 nt, Pseudomonas aeruginosa PA01
agcgucaccgcgucgggaaaggc

SEQ ID NO: 3374591 - RNA, 16 nt, Pseudomonas aeruginosa PA01
agcgucacucccaggc

SEQ ID NO: 3374592 - RNA, 17 nt, Pseudomonas aeruginosa PA01
agcgucagccgcggccg

SEQ ID NO: 3374593 - RNA, 18 nt, Pseudomonas aeruginosa PA01
agcgucagcgcgccagca

SEQ ID NO: 3374594 - RNA, 17 nt, Pseudomonas aeruginosa PA01
agcguccaccagcgccc

SEQ ID NO: 3374595 - RNA, 18 nt, Pseudomonas aeruginosa PA01
agcguccaccagcgcccg

SEQ ID NO: 3374596 - RNA, 13 nt, Pseudomonas aeruginosa PA01
agcguccaggugc

SEQ ID NO: 3374597 - RNA, 16 nt, Pseudomonas aeruginosa PA01
agcguccaggugcggc

SEQ ID NO: 3374598 - RNA, 21 nt, Pseudomonas aeruginosa PA01
agcguccgagguggcugaagc

SEQ ID NO: 3374599 - RNA, 15 nt, Pseudomonas aeruginosa PA01
agcguccgccgccgu

SEQ ID NO: 3374600 - RNA, 19 nt, Pseudomonas aeruginosa PA01
agcguccgccgccguggcu

SEQ ID NO: 3374601 - RNA, 16 nt, Pseudomonas aeruginosa PA01
agcgucgacgccgagc

SEQ ID NO: 3374602 - RNA, 17 nt, Pseudomonas aeruginosa PA01
agcgucgacgccgagcu

SEQ ID NO: 3374603 - RNA, 18 nt, Pseudomonas aeruginosa PA01
agcgucgagcuggcgcag

SEQ ID NO: 3374604 - RNA, 15 nt, Pseudomonas aeruginosa PA01
agcgucgagucgcgc

SEQ ID NO: 3374605 - RNA, 18 nt, Pseudomonas aeruginosa PA01
agcgucgccaacgcgccg

SEQ ID NO: 3374606 - RNA, 21 nt, Pseudomonas aeruginosa PA01
agcgucgccaacgcgccgucg

SEQ ID NO: 3374607 - RNA, 20 nt, Pseudomonas aeruginosa PA01
agcgucgccggccgcugucg

SEQ ID NO: 3374608 - RNA, 13 nt, Pseudomonas aeruginosa PA01
agcgucgcgcggc

SEQ ID NO: 3374609 - RNA, 18 nt, Pseudomonas aeruginosa PA01
agcgucgcgcggccagcg

SEQ ID NO: 3374610 - RNA, 23 nt, Pseudomonas aeruginosa PA01
agcgucgcgcgugccccguggcg

SEQ ID NO: 3374611 - RNA, 20 nt, Pseudomonas aeruginosa PA01
agcgucgcgucggccuggcg

SEQ ID NO: 3374612 - RNA, 21 nt, Pseudomonas aeruginosa PA01
agcgucgcgucggccuggcgc

SEQ ID NO: 3374613 - RNA, 22 nt, Pseudomonas aeruginosa PA01
agcgucggaagcgucagccgcg

SEQ ID NO: 3374614 - RNA, 24 nt, Pseudomonas aeruginosa PA01
agcgucggaagcgucagccgcggc

SEQ ID NO: 3374615 - RNA, 20 nt, Pseudomonas aeruginosa PA01
agcgucgggcgggaucaggu

SEQ ID NO: 3374616 - RNA, 23 nt, Pseudomonas aeruginosa PA01
agcgucgggcgggaucaggucgc

SEQ ID NO: 3374617 - RNA, 22 nt, Pseudomonas aeruginosa PA01
agcgucguagagcgugcggccg

SEQ ID NO: 3374618 - RNA, 14 nt, Pseudomonas aeruginosa PA01
agcgucgugcgccg

SEQ ID NO: 3374619 - RNA, 17 nt, Pseudomonas aeruginosa PA01
agcgucgugcgccggcc

SEQ ID NO: 3374620 - RNA, 22 nt, Pseudomonas aeruginosa PA01
agcgucgugcgccggccucucc

SEQ ID NO: 3374621 - RNA, 14 nt, Pseudomonas aeruginosa PA01
agcgucucagcccu

SEQ ID NO: 3374622 - RNA, 19 nt, Pseudomonas aeruginosa PA01
agcgucugccgcuggcggc

SEQ ID NO: 3374623 - RNA, 21 nt, Pseudomonas aeruginosa PA01
agcgucugccgcuggcggccu

SEQ ID NO: 3374624 - RNA, 13 nt, Pseudomonas aeruginosa PA01
agcgugacccgcg

SEQ ID NO: 3374625 - RNA, 23 nt, Pseudomonas aeruginosa PA01
agcgugccgccaucgccucgccg

SEQ ID NO: 3374626 - RNA, 18 nt, Pseudomonas aeruginosa PA01
agcgugcgcaugcccgcg

SEQ ID NO: 3374627 - RNA, 13 nt, Pseudomonas aeruginosa PA01
agcguggccagcg

SEQ ID NO: 3374628 - RNA, 15 nt, Pseudomonas aeruginosa PA01
agcguggccagcgcc

SEQ ID NO: 3374629 - RNA, 16 nt, Pseudomonas aeruginosa PA01
agcguggccagcgccc

SEQ ID NO: 3374630 - RNA, 15 nt, Pseudomonas aeruginosa PA01
agcgugggcaacagg

SEQ ID NO: 3374631 - RNA, 14 nt, Pseudomonas aeruginosa PA01
agcgugggcggccg

SEQ ID NO: 3374632 - RNA, 15 nt, Pseudomonas aeruginosa PA01
agcgugggcggccgg

SEQ ID NO: 3374633 - RNA, 16 nt, Pseudomonas aeruginosa PA01
agcgugggcggccggc

SEQ ID NO: 3374634 - RNA, 20 nt, Pseudomonas aeruginosa PA01
agcgugggcggccggccagg

SEQ ID NO: 3374635 - RNA, 23 nt, Pseudomonas aeruginosa PA01
agcgugggcggccggccaggucg

SEQ ID NO: 3374636 - RNA, 17 nt, Pseudomonas aeruginosa PA01
agcgugguaccgcugcg

SEQ ID NO: 3374637 - RNA, 21 nt, Pseudomonas aeruginosa PA01
agcguggugcuaucgaugcuc

SEQ ID NO: 3374638 - RNA, 15 nt, Pseudomonas aeruginosa PA01
agcguuaucgccggu

SEQ ID NO: 3374639 - RNA, 15 nt, Pseudomonas aeruginosa PA01
agcguuccuggaagc

SEQ ID NO: 3374640 - RNA, 15 nt, Pseudomonas aeruginosa PA01
agcguuccuggcgcg

SEQ ID NO: 3374641 - RNA, 18 nt, Pseudomonas aeruginosa PA01
agcguuccuggcgcgcgg

SEQ ID NO: 3374642 - RNA, 21 nt, Pseudomonas aeruginosa PA01
agcguuccuggcgcgcggccg

SEQ ID NO: 3374643 - RNA, 18 nt, Pseudomonas aeruginosa PA01
agcguucggaucggcccg

SEQ ID NO: 3374644 - RNA, 13 nt, Pseudomonas aeruginosa PA01
agcguugcagcgu

SEQ ID NO: 3374645 - RNA, 22 nt, Pseudomonas aeruginosa PA01
agcguugcgccagaccagcccc

SEQ ID NO: 3374646 - RNA, 20 nt, Pseudomonas aeruginosa PA01
agcguugcgcgagcaccgcg

SEQ ID NO: 3374647 - RNA, 22 nt, Pseudomonas aeruginosa PA01
agcguugggccucgcugcgcag

SEQ ID NO: 3374648 - RNA, 20 nt, Pseudomonas aeruginosa PA01
agcucggugagcaggcgccg

SEQ ID NO: 3374649 - RNA, 22 nt, Pseudomonas aeruginosa PA01
agcucggugagcaggcgccgga

SEQ ID NO: 3374650 - RNA, 23 nt, Pseudomonas aeruginosa PA01
agcucgucacccgcgccugcagg

SEQ ID NO: 3374651 - RNA, 20 nt, Pseudomonas aeruginosa PA01
agcucguccauguugcggcc

SEQ ID NO: 3374652 - RNA, 19 nt, Pseudomonas aeruginosa PA01
agcucgucgagcugcucgg

SEQ ID NO: 3374653 - RNA, 16 nt, Pseudomonas aeruginosa PA01
agcucgucguggaagu

SEQ ID NO: 3374654 - RNA, 22 nt, Pseudomonas aeruginosa PA01
agcucguugcacagcgcccaga

SEQ ID NO: 3374655 - RNA, 15 nt, Pseudomonas aeruginosa PA01
agcucguuggccacc

SEQ ID NO: 3374656 - RNA, 18 nt, Pseudomonas aeruginosa PA01
agcucuaccgagaucacc

SEQ ID NO: 3374657 - RNA, 12 nt, Pseudomonas aeruginosa PA01
agcucucgcugg

SEQ ID NO: 3374658 - RNA, 20 nt, Pseudomonas aeruginosa PA01
agcucugcacaaacucaggg

SEQ ID NO: 3374659 - RNA, 18 nt, Pseudomonas aeruginosa PA01
agcucugcgaucagggcc

SEQ ID NO: 3374660 - RNA, 23 nt, Pseudomonas aeruginosa PA01
agcucugcgaucagggccucgcc

SEQ ID NO: 3374661 - RNA, 15 nt, Pseudomonas aeruginosa PA01
agcucugcuggcugu

SEQ ID NO: 3374662 - RNA, 15 nt, Pseudomonas aeruginosa PA01
agcucuggggucagu

SEQ ID NO: 3374663 - RNA, 15 nt, Pseudomonas aeruginosa PA01
agcucuuccagguga

SEQ ID NO: 3374664 - RNA, 12 nt, Pseudomonas aeruginosa PA01
agcucuucgcca

SEQ ID NO: 3374665 - RNA, 15 nt, Pseudomonas aeruginosa PA01
agcugaagcgccgcg

SEQ ID NO: 3374666 - RNA, 20 nt, Pseudomonas aeruginosa PA01
agcugaagcgccgcggcccg

SEQ ID NO: 3374667 - RNA, 22 nt, Pseudomonas aeruginosa PA01
agcugaagcgccgcggcccggc

SEQ ID NO: 3374668 - RNA, 18 nt, Pseudomonas aeruginosa PA01
agcugaccaccagggcga

SEQ ID NO: 3374669 - RNA, 15 nt, Pseudomonas aeruginosa PA01
agcugaccacgacga

SEQ ID NO: 3374670 - RNA, 16 nt, Pseudomonas aeruginosa PA01
agcugacgaacaucgc

SEQ ID NO: 3374671 - RNA, 21 nt, Pseudomonas aeruginosa PA01
agcugacgaacaucgccagcg

SEQ ID NO: 3374672 - RNA, 15 nt, Pseudomonas aeruginosa PA01
agcugagcaggccga

SEQ ID NO: 3374673 - RNA, 14 nt, Pseudomonas aeruginosa PA01
agcugaggccggug

SEQ ID NO: 3374674 - RNA, 14 nt, Pseudomonas aeruginosa PA01
agcugaggccguag

SEQ ID NO: 3374675 - RNA, 22 nt, Pseudomonas aeruginosa PA01
agcugaucgcgcagaucgccgc

SEQ ID NO: 3374676 - RNA, 20 nt, Pseudomonas aeruginosa PA01
agcugcaaggcuucggcggu

SEQ ID NO: 3374677 - RNA, 13 nt, Pseudomonas aeruginosa PA01
agcugcacggcga

SEQ ID NO: 3374678 - RNA, 14 nt, Pseudomonas aeruginosa PA01
agcugcacggcgac

SEQ ID NO: 3374679 - RNA, 13 nt, Pseudomonas aeruginosa PA01
agcugcagcgccc

SEQ ID NO: 3374680 - RNA, 19 nt, Pseudomonas aeruginosa PA01
agcugcaugagugucgcca

SEQ ID NO: 3374681 - RNA, 20 nt, Pseudomonas aeruginosa PA01
agcugcaugagugucgccau

SEQ ID NO: 3374682 - RNA, 13 nt, Pseudomonas aeruginosa PA01
agcugccagcccc

SEQ ID NO: 3374683 - RNA, 14 nt, Pseudomonas aeruginosa PA01
agcugccagccccg

SEQ ID NO: 3374684 - RNA, 14 nt, Pseudomonas aeruginosa PA01
agcugccagugcuc

SEQ ID NO: 3374685 - RNA, 16 nt, Pseudomonas aeruginosa PA01
agcugccagugcucga

SEQ ID NO: 3374686 - RNA, 16 nt, Pseudomonas aeruginosa PA01
agcugccccacaggcc

SEQ ID NO: 3374687 - RNA, 17 nt, Pseudomonas aeruginosa PA01
agcugccccacaggccc

SEQ ID NO: 3374688 - RNA, 22 nt, Pseudomonas aeruginosa PA01
agcugccccacaggcccugcag

SEQ ID NO: 3374689 - RNA, 16 nt, Pseudomonas aeruginosa PA01
agcugccgcuucggcu

SEQ ID NO: 3374690 - RNA, 18 nt, Pseudomonas aeruginosa PA01
agcugccgcuucggcugc

SEQ ID NO: 3374691 - RNA, 20 nt, Pseudomonas aeruginosa PA01
agcugccgcuucggcugcug

SEQ ID NO: 3374692 - RNA, 13 nt, Pseudomonas aeruginosa PA01
agcugccggcauu

SEQ ID NO: 3374693 - RNA, 15 nt, Pseudomonas aeruginosa PA01
agcugccggcgucgu

SEQ ID NO: 3374694 - RNA, 19 nt, Pseudomonas aeruginosa PA01
agcugccgggcgagcugca

SEQ ID NO: 3374695 - RNA, 17 nt, Pseudomonas aeruginosa PA01
agcugccuuccagcagg

SEQ ID NO: 3374696 - RNA, 18 nt, Pseudomonas aeruginosa PA01
agcugccuuccagcaggu

SEQ ID NO: 3374697 - RNA, 15 nt, Pseudomonas aeruginosa PA01
agcugcgcagggcgc

SEQ ID NO: 3374698 - RNA, 16 nt, Pseudomonas aeruginosa PA01
agcugcgcagggcgcc

SEQ ID NO: 3374699 - RNA, 12 nt, Pseudomonas aeruginosa PA01
agcugcgccgcc

SEQ ID NO: 3374700 - RNA, 15 nt, Pseudomonas aeruginosa PA01
agcugcgccgccuuu

SEQ ID NO: 3374701 - RNA, 17 nt, Pseudomonas aeruginosa PA01
agcugcgccgccuuucu

SEQ ID NO: 3374702 - RNA, 13 nt, Pseudomonas aeruginosa PA01
agcugcgccugca

SEQ ID NO: 3374703 - RNA, 18 nt, Pseudomonas aeruginosa PA01
agcugcgccugcagcucg

SEQ ID NO: 3374704 - RNA, 22 nt, Pseudomonas aeruginosa PA01
agcugcgccugcagcucgguga

SEQ ID NO: 3374705 - RNA, 14 nt, Pseudomonas aeruginosa PA01
agcugcgcgcgauc

SEQ ID NO: 3374706 - RNA, 17 nt, Pseudomonas aeruginosa PA01
agcugcgcucggauucc

SEQ ID NO: 3374707 - RNA, 15 nt, Pseudomonas aeruginosa PA01
agcugcggccgagca

SEQ ID NO: 3374708 - RNA, 17 nt, Pseudomonas aeruginosa PA01
agcugcggcggcaccac

SEQ ID NO: 3374709 - RNA, 15 nt, Pseudomonas aeruginosa PA01
agcugcuccagcccg

SEQ ID NO: 3374710 - RNA, 21 nt, Pseudomonas aeruginosa PA01
agcugcucgaagcaauaccgg

SEQ ID NO: 3374711 - RNA, 23 nt, Pseudomonas aeruginosa PA01
agcugcucgaagcaauaccgguu

SEQ ID NO: 3374712 - RNA, 14 nt, Pseudomonas aeruginosa PA01
agcugcucggcggu

SEQ ID NO: 3374713 - RNA, 12 nt, Pseudomonas aeruginosa PA01
agcuggaaagcu

SEQ ID NO: 3374714 - RNA, 17 nt, Pseudomonas aeruginosa PA01
agcuggaaauggcgguc

SEQ ID NO: 3374715 - RNA, 19 nt, Pseudomonas aeruginosa PA01
agcuggaagucguccagca

SEQ ID NO: 3374716 - RNA, 21 nt, Pseudomonas aeruginosa PA01
agcuggaagucguccagcagg

SEQ ID NO: 3374717 - RNA, 20 nt, Pseudomonas aeruginosa PA01
agcuggacgacgcuggccug

SEQ ID NO: 3374718 - RNA, 22 nt, Pseudomonas aeruginosa PA01
agcuggacgacgcuggccugcc

SEQ ID NO: 3374719 - RNA, 23 nt, Pseudomonas aeruginosa PA01
agcuggacgacgcuggccugccg

SEQ ID NO: 3374720 - RNA, 16 nt, Pseudomonas aeruginosa PA01
agcuggagcagcagcg

SEQ ID NO: 3374721 - RNA, 22 nt, Pseudomonas aeruginosa PA01
agcuggauagaguacucggcua

SEQ ID NO: 3374722 - RNA, 19 nt, Pseudomonas aeruginosa PA01
agcuggauccgugccaggc

SEQ ID NO: 3374723 - RNA, 20 nt, Pseudomonas aeruginosa PA01
agcuggauccgugccaggcg

SEQ ID NO: 3374724 - RNA, 18 nt, Pseudomonas aeruginosa PA01
agcuggccaguugcaccg

SEQ ID NO: 3374725 - RNA, 20 nt, Pseudomonas aeruginosa PA01
agcuggccaugcguugcggc

SEQ ID NO: 3374726 - RNA, 21 nt, Pseudomonas aeruginosa PA01
agcuggcccaguugcccggcc

SEQ ID NO: 3374727 - RNA, 17 nt, Pseudomonas aeruginosa PA01
agcuggcgacggcucug

SEQ ID NO: 3374728 - RNA, 18 nt, Pseudomonas aeruginosa PA01
agcuggcgaucgaccugc

SEQ ID NO: 3374729 - RNA, 20 nt, Pseudomonas aeruginosa PA01
agcuggcgaucgaccugccg

SEQ ID NO: 3374730 - RNA, 21 nt, Pseudomonas aeruginosa PA01
agcuggcgaucgaccugccgg

SEQ ID NO: 3374731 - RNA, 19 nt, Pseudomonas aeruginosa PA01
agcuggcgcaacugcgcca

SEQ ID NO: 3374732 - RNA, 20 nt, Pseudomonas aeruginosa PA01
agcuggcgcaacugcgccag

SEQ ID NO: 3374733 - RNA, 23 nt, Pseudomonas aeruginosa PA01
agcuggcgcaacugcgccagccg

SEQ ID NO: 3374734 - RNA, 15 nt, Pseudomonas aeruginosa PA01
agcuggcgcacacgg

SEQ ID NO: 3374735 - RNA, 14 nt, Pseudomonas aeruginosa PA01
agcuggcgcagccg

SEQ ID NO: 3374736 - RNA, 17 nt, Pseudomonas aeruginosa PA01
agcuggcgcaggccuuc

SEQ ID NO: 3374737 - RNA, 15 nt, Pseudomonas aeruginosa PA01
agcuggcgcagggcg

SEQ ID NO: 3374738 - RNA, 24 nt, Pseudomonas aeruginosa PA01
agcuggcgccgucaucgcugaccu

SEQ ID NO: 3374739 - RNA, 17 nt, Pseudomonas aeruginosa PA01
agcuggcgcgccuccug

SEQ ID NO: 3374740 - RNA, 22 nt, Pseudomonas aeruginosa PA01
agcuggcgcgucgcugccgccg

SEQ ID NO: 3374741 - RNA, 22 nt, Pseudomonas aeruginosa PA01
agcuggggcuguugcugggcua

SEQ ID NO: 3374742 - RNA, 18 nt, Pseudomonas aeruginosa PA01
agcuguagcggcuugcag

SEQ ID NO: 3374743 - RNA, 14 nt, Pseudomonas aeruginosa PA01
agcugucgcccucg

SEQ ID NO: 3374744 - RNA, 22 nt, Pseudomonas aeruginosa PA01
agcugucgcccucgcggagcug

SEQ ID NO: 3374745 - RNA, 22 nt, Pseudomonas aeruginosa PA01
agcugucguaguccugggccgg

SEQ ID NO: 3374746 - RNA, 17 nt, Pseudomonas aeruginosa PA01
agcuguucacaaaggcg

SEQ ID NO: 3374747 - RNA, 14 nt, Pseudomonas aeruginosa PA01
agcuguugcuccaa

SEQ ID NO: 3374748 - RNA, 23 nt, Pseudomonas aeruginosa PA01
agcuguuucagcccacgcgccug

SEQ ID NO: 3374749 - RNA, 16 nt, Pseudomonas aeruginosa PA01
agcuucaaccguggcu

SEQ ID NO: 3374750 - RNA, 17 nt, Pseudomonas aeruginosa PA01
aggacaacgacagcccc

SEQ ID NO: 3374751 - RNA, 18 nt, Pseudomonas aeruginosa PA01
aggacacuuccaguucgu

SEQ ID NO: 3374752 - RNA, 17 nt, Pseudomonas aeruginosa PA01
aggacagcacgcucagg

SEQ ID NO: 3374753 - RNA, 19 nt, Pseudomonas aeruginosa PA01
aggacagcacgcucaggca

SEQ ID NO: 3374754 - RNA, 21 nt, Pseudomonas aeruginosa PA01
aggacagcacgcucaggcagc

SEQ ID NO: 3374755 - RNA, 14 nt, Pseudomonas aeruginosa PA01
aggacagcaggguc

SEQ ID NO: 3374756 - RNA, 12 nt, Pseudomonas aeruginosa PA01
aggacaggccga

SEQ ID NO: 3374757 - RNA, 15 nt, Pseudomonas aeruginosa PA01
aggacagggccaggc

SEQ ID NO: 3374758 - RNA, 16 nt, Pseudomonas aeruginosa PA01
aggacagggccaggcc

SEQ ID NO: 3374759 - RNA, 15 nt, Pseudomonas aeruginosa PA01
aggacagguucaggu

SEQ ID NO: 3374760 - RNA, 16 nt, Pseudomonas aeruginosa PA01
aggaccagggcgggcc

SEQ ID NO: 3374761 - RNA, 22 nt, Pseudomonas aeruginosa PA01
aggaccgacuccaugaaacggu

SEQ ID NO: 3374762 - RNA, 15 nt, Pseudomonas aeruginosa PA01
aggaccugcugcccg

SEQ ID NO: 3374763 - RNA, 18 nt, Pseudomonas aeruginosa PA01
aggaccugcugcccggca

SEQ ID NO: 3374764 - RNA, 14 nt, Pseudomonas aeruginosa PA01
aggaccuggccgcg

SEQ ID NO: 3374765 - RNA, 22 nt, Pseudomonas aeruginosa PA01
aggaccuggccgcguucgccga

SEQ ID NO: 3374766 - RNA, 19 nt, Pseudomonas aeruginosa PA01
aggaccuggccguuggcga

SEQ ID NO: 3374767 - RNA, 23 nt, Pseudomonas aeruginosa PA01
aggaccuggcugaggcguuccag

SEQ ID NO: 3374768 - RNA, 17 nt, Pseudomonas aeruginosa PA01
aggaccuucagauacuc

SEQ ID NO: 3374769 - RNA, 23 nt, Pseudomonas aeruginosa PA01
aggaccuuccgccagcaggcgcg

SEQ ID NO: 3374770 - RNA, 15 nt, Pseudomonas aeruginosa PA01
aggacgaacaaccgc

SEQ ID NO: 3374771 - RNA, 20 nt, Pseudomonas aeruginosa PA01
aggacgaacaaccgcuugcg

SEQ ID NO: 3374772 - RNA, 16 nt, Pseudomonas aeruginosa PA01
aggacgaagucgccgg

SEQ ID NO: 3374773 - RNA, 17 nt, Pseudomonas aeruginosa PA01
aggacgaagucgccggc

SEQ ID NO: 3374774 - RNA, 18 nt, Pseudomonas aeruginosa PA01
aggacgaagucgccggca

SEQ ID NO: 3374775 - RNA, 17 nt, Pseudomonas aeruginosa PA01
aggacgagcguccgccg

SEQ ID NO: 3374776 - RNA, 20 nt, Pseudomonas aeruginosa PA01
aggacgaggaaggcgcgcac

SEQ ID NO: 3374777 - RNA, 14 nt, Pseudomonas aeruginosa PA01
aggacgaugaucac

SEQ ID NO: 3374778 - RNA, 17 nt, Pseudomonas aeruginosa PA01
aggacgaugaucaccag

SEQ ID NO: 3374779 - RNA, 13 nt, Pseudomonas aeruginosa PA01
aggacgccgggcu

SEQ ID NO: 3374780 - RNA, 16 nt, Pseudomonas aeruginosa PA01
aggacgccgggcuggu

SEQ ID NO: 3374781 - RNA, 22 nt, Pseudomonas aeruginosa PA01
aggacgcuacgcucggggugcg

SEQ ID NO: 3374782 - RNA, 17 nt, Pseudomonas aeruginosa PA01
aggacgcuccugcgccg

SEQ ID NO: 3374783 - RNA, 19 nt, Pseudomonas aeruginosa PA01
aggacgcuccugcgccggc

SEQ ID NO: 3374784 - RNA, 20 nt, Pseudomonas aeruginosa PA01
aggacgcuccugcgccggcu

SEQ ID NO: 3374785 - RNA, 18 nt, Pseudomonas aeruginosa PA01
aggacggauaacggcagc

SEQ ID NO: 3374786 - RNA, 14 nt, Pseudomonas aeruginosa PA01
aggacggcaggguc

SEQ ID NO: 3374787 - RNA, 14 nt, Pseudomonas aeruginosa PA01
aggacguccuggcc

SEQ ID NO: 3374788 - RNA, 15 nt, Pseudomonas aeruginosa PA01
aggacguccuggccg

SEQ ID NO: 3374789 - RNA, 16 nt, Pseudomonas aeruginosa PA01
aggacguccuggccga

SEQ ID NO: 3374790 - RNA, 23 nt, Pseudomonas aeruginosa PA01
aggacugcccgcgucccaucggg

SEQ ID NO: 3374791 - RNA, 16 nt, Pseudomonas aeruginosa PA01
aggagaaccuggccaa

SEQ ID NO: 3374792 - RNA, 14 nt, Pseudomonas aeruginosa PA01
aggagaagcgccuc

SEQ ID NO: 3374793 - RNA, 18 nt, Pseudomonas aeruginosa PA01
aggagacucagcgcgaca

SEQ ID NO: 3374794 - RNA, 21 nt, Pseudomonas aeruginosa PA01
aggagagggucagcaggcugc

SEQ ID NO: 3374795 - RNA, 21 nt, Pseudomonas aeruginosa PA01
aggagcacgccgugcaggguc

SEQ ID NO: 3374796 - RNA, 12 nt, Pseudomonas aeruginosa PA01
aggagcacggcc

SEQ ID NO: 3374797 - RNA, 10 nt, Pseudomonas aeruginosa PA01
aggagcaggg

SEQ ID NO: 3374798 - RNA, 14 nt, Pseudomonas aeruginosa PA01
aggagcagggcgcc

SEQ ID NO: 3374799 - RNA, 18 nt, Pseudomonas aeruginosa PA01
aggagcaucggcgcggcc

SEQ ID NO: 3374800 - RNA, 19 nt, Pseudomonas aeruginosa PA01
aggagcaucggcgcggccu

SEQ ID NO: 3374801 - RNA, 15 nt, Pseudomonas aeruginosa PA01
aggagccggccaggc

SEQ ID NO: 3374802 - RNA, 17 nt, Pseudomonas aeruginosa PA01
aggagccguagggcgca

SEQ ID NO: 3374803 - RNA, 14 nt, Pseudomonas aeruginosa PA01
aggagccgucgccg

SEQ ID NO: 3374804 - RNA, 18 nt, Pseudomonas aeruginosa PA01
aggagccugcgugagcug

SEQ ID NO: 3374805 - RNA, 22 nt, Pseudomonas aeruginosa PA01
aggagccugcgugagcugggca

SEQ ID NO: 3374806 - RNA, 14 nt, Pseudomonas aeruginosa PA01
aggagccuuucacu

SEQ ID NO: 3374807 - RNA, 15 nt, Pseudomonas aeruginosa PA01
aggagcgccagcacc

SEQ ID NO: 3374808 - RNA, 20 nt, Pseudomonas aeruginosa PA01
aggagcgccagcaccagcag

SEQ ID NO: 3374809 - RNA, 15 nt, Pseudomonas aeruginosa PA01
aggagcggacucaua

SEQ ID NO: 3374810 - RNA, 15 nt, Pseudomonas aeruginosa PA01
aggaggauacggcgc

SEQ ID NO: 3374811 - RNA, 20 nt, Pseudomonas aeruginosa PA01
aggagggaacgucuggccag

SEQ ID NO: 3374812 - RNA, 12 nt, Pseudomonas aeruginosa PA01
aggagggcugcu

SEQ ID NO: 3374813 - RNA, 15 nt, Pseudomonas aeruginosa PA01
aggagggcugcuguc

SEQ ID NO: 3374814 - RNA, 15 nt, Pseudomonas aeruginosa PA01
aggagguuggucugc

SEQ ID NO: 3374815 - RNA, 22 nt, Pseudomonas aeruginosa PA01
aggaguaggucacuuccuugcg

SEQ ID NO: 3374816 - RNA, 15 nt, Pseudomonas aeruginosa PA01
aggagucgacgaaaa

SEQ ID NO: 3374817 - RNA, 20 nt, Pseudomonas aeruginosa PA01
aggagucgacgaaaagcggu

SEQ ID NO: 3374818 - RNA, 22 nt, Pseudomonas aeruginosa PA01
aggauacgucuucgauggcggc

SEQ ID NO: 3374819 - RNA, 14 nt, Pseudomonas aeruginosa PA01
aggauagccggcgc

SEQ ID NO: 3374820 - RNA, 16 nt, Pseudomonas aeruginosa PA01
aggaucacgauggccg

SEQ ID NO: 3374821 - RNA, 14 nt, Pseudomonas aeruginosa PA01
aggaucacgcagca

SEQ ID NO: 3374822 - RNA, 15 nt, Pseudomonas aeruginosa PA01
aggaucacgcagcag

SEQ ID NO: 3374823 - RNA, 19 nt, Pseudomonas aeruginosa PA01
aggaucacgcagcaggcga

SEQ ID NO: 3374824 - RNA, 18 nt, Pseudomonas aeruginosa PA01
aggaucagccacgggcgc

SEQ ID NO: 3374825 - RNA, 13 nt, Pseudomonas aeruginosa PA01
aggaucagccagc

SEQ ID NO: 3374826 - RNA, 14 nt, Pseudomonas aeruginosa PA01
aggaucagucccuu

SEQ ID NO: 3374827 - RNA, 23 nt, Pseudomonas aeruginosa PA01
aggaucaguucgugccaggcgac

SEQ ID NO: 3374828 - RNA, 15 nt, Pseudomonas aeruginosa PA01
aggauccaggugcgc

SEQ ID NO: 3374829 - RNA, 15 nt, Pseudomonas aeruginosa PA01
aggaucgacagcagc

SEQ ID NO: 3374830 - RNA, 16 nt, Pseudomonas aeruginosa PA01
aggaucgaccccgccg

SEQ ID NO: 3374831 - RNA, 14 nt, Pseudomonas aeruginosa PA01
aggaucgagccagc

SEQ ID NO: 3374832 - RNA, 16 nt, Pseudomonas aeruginosa PA01
aggaucgagccagcgc

SEQ ID NO: 3374833 - RNA, 18 nt, Pseudomonas aeruginosa PA01
aggaucgagccagcgcuc

SEQ ID NO: 3374834 - RNA, 13 nt, Pseudomonas aeruginosa PA01
aggaucgccagca

SEQ ID NO: 3374835 - RNA, 15 nt, Pseudomonas aeruginosa PA01
aggaucgccagcaau

SEQ ID NO: 3374836 - RNA, 16 nt, Pseudomonas aeruginosa PA01
aggaucgccagcaauu

SEQ ID NO: 3374837 - RNA, 14 nt, Pseudomonas aeruginosa PA01
aggaucgccaggac

SEQ ID NO: 3374838 - RNA, 22 nt, Pseudomonas aeruginosa PA01
aggaucgccgcgaccugcucgu

SEQ ID NO: 3374839 - RNA, 14 nt, Pseudomonas aeruginosa PA01
aggaucgccgggcu

SEQ ID NO: 3374840 - RNA, 15 nt, Pseudomonas aeruginosa PA01
aggaucgccuccacc

SEQ ID NO: 3374841 - RNA, 21 nt, Pseudomonas aeruginosa PA01
aggaucgccuccaccagcgcc

SEQ ID NO: 3374842 - RNA, 13 nt, Pseudomonas aeruginosa PA01
aggaucgcgcugg

SEQ ID NO: 3374843 - RNA, 15 nt, Pseudomonas aeruginosa PA01
aggaucgcgcuggcc

SEQ ID NO: 3374844 - RNA, 16 nt, Pseudomonas aeruginosa PA01
aggaucgcgcuggcca

SEQ ID NO: 3374845 - RNA, 17 nt, Pseudomonas aeruginosa PA01
aggaucgcgcuggccag

SEQ ID NO: 3374846 - RNA, 22 nt, Pseudomonas aeruginosa PA01
aggaucgcuauccaccgucgcg

SEQ ID NO: 3374847 - RNA, 21 nt, Pseudomonas aeruginosa PA01
aggaucgcucccaggcucacg

SEQ ID NO: 3374848 - RNA, 16 nt, Pseudomonas aeruginosa PA01
aggaucggcauggcca

SEQ ID NO: 3374849 - RNA, 21 nt, Pseudomonas aeruginosa PA01
aggaucggcauggccacgcuc

SEQ ID NO: 3374850 - RNA, 24 nt, Pseudomonas aeruginosa PA01
aggaucggccaacugagcggcggc

SEQ ID NO: 3374851 - RNA, 20 nt, Pseudomonas aeruginosa PA01
aggaucuccaacuggcggcu

SEQ ID NO: 3374852 - RNA, 23 nt, Pseudomonas aeruginosa PA01
aggaucugcugcaacauggcguc

SEQ ID NO: 3374853 - RNA, 18 nt, Pseudomonas aeruginosa PA01
aggccaugaucaucgccu

SEQ ID NO: 3374854 - RNA, 20 nt, Pseudomonas aeruginosa PA01
aggccaugaucaucgccugc

SEQ ID NO: 3374855 - RNA, 23 nt, Pseudomonas aeruginosa PA01
aggccaugaucaucgccugcugg

SEQ ID NO: 3374856 - RNA, 15 nt, Pseudomonas aeruginosa PA01
aggcccacgccgaag

SEQ ID NO: 3374857 - RNA, 19 nt, Pseudomonas aeruginosa PA01
aggcccagccauugcgcca

SEQ ID NO: 3374858 - RNA, 22 nt, Pseudomonas aeruginosa PA01
aggcccagccauugcgccagga

SEQ ID NO: 3374859 - RNA, 13 nt, Pseudomonas aeruginosa PA01
aggcccaguucgc

SEQ ID NO: 3374860 - RNA, 16 nt, Pseudomonas aeruginosa PA01
aggcccaguucgcugc

SEQ ID NO: 3374861 - RNA, 18 nt, Pseudomonas aeruginosa PA01
aggcccaguucgcugccg

SEQ ID NO: 3374862 - RNA, 21 nt, Pseudomonas aeruginosa PA01
aggcccaguucgcugccgccg

SEQ ID NO: 3374863 - RNA, 22 nt, Pseudomonas aeruginosa PA01
aggcccaucauguagacgaugc

SEQ ID NO: 3374864 - RNA, 18 nt, Pseudomonas aeruginosa PA01
aggcccauuucguagccc

SEQ ID NO: 3374865 - RNA, 14 nt, Pseudomonas aeruginosa PA01
aggccccaggcgau

SEQ ID NO: 3374866 - RNA, 17 nt, Pseudomonas aeruginosa PA01
aggccccagggccggcg

SEQ ID NO: 3374867 - RNA, 20 nt, Pseudomonas aeruginosa PA01
aggccccagggccggcgccc

SEQ ID NO: 3374868 - RNA, 15 nt, Pseudomonas aeruginosa PA01
aggcccgccgcggcg

SEQ ID NO: 3374869 - RNA, 19 nt, Pseudomonas aeruginosa PA01
aggcccggagugugucggg

SEQ ID NO: 3374870 - RNA, 16 nt, Pseudomonas aeruginosa PA01
aggcccggccgccugc

SEQ ID NO: 3374871 - RNA, 23 nt, Pseudomonas aeruginosa PA01
aggcccggcgcgguuucgcagcg

SEQ ID NO: 3374872 - RNA, 22 nt, Pseudomonas aeruginosa PA01
aggcccggcgcugcuucuuguc

SEQ ID NO: 3374873 - RNA, 19 nt, Pseudomonas aeruginosa PA01
aggcccgguugagauccug

SEQ ID NO: 3374874 - RNA, 19 nt, Pseudomonas aeruginosa PA01
aggcccuacaaugauggcc

SEQ ID NO: 3374875 - RNA, 15 nt, Pseudomonas aeruginosa PA01
aggcccucagcggcg

SEQ ID NO: 3374876 - RNA, 13 nt, Pseudomonas aeruginosa PA01
aggcccucggcga

SEQ ID NO: 3374877 - RNA, 14 nt, Pseudomonas aeruginosa PA01
aggcccucggcgac

SEQ ID NO: 3374878 - RNA, 16 nt, Pseudomonas aeruginosa PA01
aggcccucggcgacca

SEQ ID NO: 3374879 - RNA, 13 nt, Pseudomonas aeruginosa PA01
aggcccucggcgg

SEQ ID NO: 3374880 - RNA, 15 nt, Pseudomonas aeruginosa PA01
aggcccucggcggcg

SEQ ID NO: 3374881 - RNA, 12 nt, Pseudomonas aeruginosa PA01
aggcccugcagc

SEQ ID NO: 3374882 - RNA, 16 nt, Pseudomonas aeruginosa PA01
aggcccugcagcgcca

SEQ ID NO: 3374883 - RNA, 23 nt, Pseudomonas aeruginosa PA01
aggcccuggaucaccgcggcgcu

SEQ ID NO: 3374884 - RNA, 16 nt, Pseudomonas aeruginosa PA01
aggcccugggcggcgg

SEQ ID NO: 3374885 - RNA, 20 nt, Pseudomonas aeruginosa PA01
aggcccuugaacaggcuggc

SEQ ID NO: 3374886 - RNA, 21 nt, Pseudomonas aeruginosa PA01
aggcccuugaacaggcuggcg

SEQ ID NO: 3374887 - RNA, 16 nt, Pseudomonas aeruginosa PA01
aggcccuugaggaagu

SEQ ID NO: 3374888 - RNA, 16 nt, Pseudomonas aeruginosa PA01
aggcccuuggucaggc

SEQ ID NO: 3374889 - RNA, 17 nt, Pseudomonas aeruginosa PA01
aggcccuuggucaggcc

SEQ ID NO: 3374890 - RNA, 16 nt, Pseudomonas aeruginosa PA01
aggccgaagaggcccu

SEQ ID NO: 3374891 - RNA, 20 nt, Pseudomonas aeruginosa PA01
aggccgaagaggcccucggc

SEQ ID NO: 3374892 - RNA, 22 nt, Pseudomonas aeruginosa PA01
aggccgaagaggcccucggcgc

SEQ ID NO: 3374893 - RNA, 15 nt, Pseudomonas aeruginosa PA01
aggccgaagccgccg

SEQ ID NO: 3374894 - RNA, 22 nt, Pseudomonas aeruginosa PA01
aggccgaagcgugggcggccgg

SEQ ID NO: 3374895 - RNA, 20 nt, Pseudomonas aeruginosa PA01
aggccgaagcugucgagcac

SEQ ID NO: 3374896 - RNA, 15 nt, Pseudomonas aeruginosa PA01
aggccgaaggccagg

SEQ ID NO: 3374897 - RNA, 17 nt, Pseudomonas aeruginosa PA01
aggccgaaggccaggac

SEQ ID NO: 3374898 - RNA, 17 nt, Pseudomonas aeruginosa PA01
aggccgaaggccuggcc

SEQ ID NO: 3374899 - RNA, 17 nt, Pseudomonas aeruginosa PA01
aggccgaauccgccggc

SEQ ID NO: 3374900 - RNA, 22 nt, Pseudomonas aeruginosa PA01
aggccgacaccucgaucagcgg

SEQ ID NO: 3374901 - RNA, 17 nt, Pseudomonas aeruginosa PA01
aggccgacagcggcugg

SEQ ID NO: 3374902 - RNA, 19 nt, Pseudomonas aeruginosa PA01
aggccgacagcggcuggcg

SEQ ID NO: 3374903 - RNA, 14 nt, Pseudomonas aeruginosa PA01
aggccgaccagcag

SEQ ID NO: 3374904 - RNA, 16 nt, Pseudomonas aeruginosa PA01
aggccgaccagcgccg

SEQ ID NO: 3374905 - RNA, 18 nt, Pseudomonas aeruginosa PA01
aggccgaccagcgccgac

SEQ ID NO: 3374906 - RNA, 16 nt, Pseudomonas aeruginosa PA01
aggccgaccucggcgg

SEQ ID NO: 3374907 - RNA, 18 nt, Pseudomonas aeruginosa PA01
aggccgaccucggcgguc

SEQ ID NO: 3374908 - RNA, 19 nt, Pseudomonas aeruginosa PA01
aggccgaccucggcgguca

SEQ ID NO: 3374909 - RNA, 15 nt, Pseudomonas aeruginosa PA01
aggccgacgaacagc

SEQ ID NO: 3374910 - RNA, 17 nt, Pseudomonas aeruginosa PA01
aggccgacgaacagcca

SEQ ID NO: 3374911 - RNA, 18 nt, Pseudomonas aeruginosa PA01
aggccgacucgcgaucga

SEQ ID NO: 3374912 - RNA, 19 nt, Pseudomonas aeruginosa PA01
aggccgagaaaccgccauc

SEQ ID NO: 3374913 - RNA, 14 nt, Pseudomonas aeruginosa PA01
aggccgagaagguu

SEQ ID NO: 3374914 - RNA, 17 nt, Pseudomonas aeruginosa PA01
aggccgagaagguucuc

SEQ ID NO: 3374915 - RNA, 22 nt, Pseudomonas aeruginosa PA01
aggccgagaagguucucggcca

SEQ ID NO: 3374916 - RNA, 23 nt, Pseudomonas aeruginosa PA01
aggccgagaagguucucggccac

SEQ ID NO: 3374917 - RNA, 21 nt, Pseudomonas aeruginosa PA01
aggccgagcaauccggcgcug

SEQ ID NO: 3374918 - RNA, 14 nt, Pseudomonas aeruginosa PA01
aggccgagcaggaa

SEQ ID NO: 3374919 - RNA, 16 nt, Pseudomonas aeruginosa PA01
aggccgagcaggaaga

SEQ ID NO: 3374920 - RNA, 20 nt, Pseudomonas aeruginosa PA01
aggccgagcccgagugcgcc

SEQ ID NO: 3374921 - RNA, 21 nt, Pseudomonas aeruginosa PA01
aggccgagcccgagugcgccc

SEQ ID NO: 3374922 - RNA, 19 nt, Pseudomonas aeruginosa PA01
aggccgagccgacauccug

SEQ ID NO: 3374923 - RNA, 14 nt, Pseudomonas aeruginosa PA01
aggccgagccggca

SEQ ID NO: 3374924 - RNA, 15 nt, Pseudomonas aeruginosa PA01
aggccgagccggcau

SEQ ID NO: 3374925 - RNA, 16 nt, Pseudomonas aeruginosa PA01
aggccgagcgccaggg

SEQ ID NO: 3374926 - RNA, 13 nt, Pseudomonas aeruginosa PA01
aggccgagcgcgc

SEQ ID NO: 3374927 - RNA, 23 nt, Pseudomonas aeruginosa PA01
aggccgagcgugcgcaugcccgc

SEQ ID NO: 3374928 - RNA, 14 nt, Pseudomonas aeruginosa PA01
aggccgagcugcuc

SEQ ID NO: 3374929 - RNA, 20 nt, Pseudomonas aeruginosa PA01
aggccgaggaugcucgccug

SEQ ID NO: 3374930 - RNA, 14 nt, Pseudomonas aeruginosa PA01
aggccgaggcgcuu

SEQ ID NO: 3374931 - RNA, 22 nt, Pseudomonas aeruginosa PA01
aggccgaggcgcuucugcucgg

SEQ ID NO: 3374932 - RNA, 16 nt, Pseudomonas aeruginosa PA01
aggccgagggcugccg

SEQ ID NO: 3374933 - RNA, 17 nt, Pseudomonas aeruginosa PA01
aggccgaggucggcggc

SEQ ID NO: 3374934 - RNA, 22 nt, Pseudomonas aeruginosa PA01
aggccgagguuuccaguugcag

SEQ ID NO: 3374935 - RNA, 15 nt, Pseudomonas aeruginosa PA01
aggccgaguccgcgc

SEQ ID NO: 3374936 - RNA, 17 nt, Pseudomonas aeruginosa PA01
aggccgaucaccaccag

SEQ ID NO: 3374937 - RNA, 20 nt, Pseudomonas aeruginosa PA01
aggccgaucaccaccagcgc

SEQ ID NO: 3374938 - RNA, 18 nt, Pseudomonas aeruginosa PA01
aggccgaucaccagcgcc

SEQ ID NO: 3374939 - RNA, 19 nt, Pseudomonas aeruginosa PA01
aggccgaucaccagcgcca

SEQ ID NO: 3374940 - RNA, 23 nt, Pseudomonas aeruginosa PA01
aggccgaucaccagcgccaggcc

SEQ ID NO: 3374941 - RNA, 21 nt, Pseudomonas aeruginosa PA01
aggccgaucagcgccucggcg

SEQ ID NO: 3374942 - RNA, 17 nt, Pseudomonas aeruginosa PA01
aggccgaucagcggcgg

SEQ ID NO: 3374943 - RNA, 19 nt, Pseudomonas aeruginosa PA01
aggccgaucagcggcgguc

SEQ ID NO: 3374944 - RNA, 15 nt, Pseudomonas aeruginosa PA01
aggccgaucaggaaa

SEQ ID NO: 3374945 - RNA, 21 nt, Pseudomonas aeruginosa PA01
aggccgaucaucaucagguag

SEQ ID NO: 3374946 - RNA, 14 nt, Pseudomonas aeruginosa PA01
aggccgaucgccuc

SEQ ID NO: 3374947 - RNA, 22 nt, Pseudomonas aeruginosa PA01
aggccgaucucgugggccagca

SEQ ID NO: 3374948 - RNA, 19 nt, Pseudomonas aeruginosa PA01
aggccgaugaacgccgcga

SEQ ID NO: 3374949 - RNA, 23 nt, Pseudomonas aeruginosa PA01
aggccgaugcccaauacccacag

SEQ ID NO: 3374950 - RNA, 13 nt, Pseudomonas aeruginosa PA01
aggccgauggccc

SEQ ID NO: 3374951 - RNA, 16 nt, Pseudomonas aeruginosa PA01
aggccgcaagcgguau

SEQ ID NO: 3374952 - RNA, 22 nt, Pseudomonas aeruginosa PA01
aggccgcaagcgguauugucga

SEQ ID NO: 3374953 - RNA, 14 nt, Pseudomonas aeruginosa PA01
aggccgcaggugaa

SEQ ID NO: 3374954 - RNA, 13 nt, Pseudomonas aeruginosa PA01
aggccgcauccgc

SEQ ID NO: 3374955 - RNA, 21 nt, Pseudomonas aeruginosa PA01
aggccuuggcgaucucgugcu

SEQ ID NO: 3374956 - RNA, 19 nt, Pseudomonas aeruginosa PA01
aggccuuucuucugcugug

SEQ ID NO: 3374957 - RNA, 23 nt, Pseudomonas aeruginosa PA01
aggcgaaaaaaagccccgccgaa

SEQ ID NO: 3374958 - RNA, 21 nt, Pseudomonas aeruginosa PA01
aggcgaaagucggcgcgacug

SEQ ID NO: 3374959 - RNA, 18 nt, Pseudomonas aeruginosa PA01
aggcgaacacgucggcgc

SEQ ID NO: 3374960 - RNA, 16 nt, Pseudomonas aeruginosa PA01
aggcgaacagggccau

SEQ ID NO: 3374961 - RNA, 21 nt, Pseudomonas aeruginosa PA01
aggcgaacagggccaucaggg

SEQ ID NO: 3374962 - RNA, 17 nt, Pseudomonas aeruginosa PA01
aggcgaaccacaccagg

SEQ ID NO: 3374963 - RNA, 21 nt, Pseudomonas aeruginosa PA01
aggcgaaccacaccaggucgc

SEQ ID NO: 3374964 - RNA, 21 nt, Pseudomonas aeruginosa PA01
aggcgaaccuggagaaauccg

SEQ ID NO: 3374965 - RNA, 15 nt, Pseudomonas aeruginosa PA01
aggcgaacggcaggu

SEQ ID NO: 3374966 - RNA, 22 nt, Pseudomonas aeruginosa PA01
aggcgaacugccgacggcggcg

SEQ ID NO: 3374967 - RNA, 22 nt, Pseudomonas aeruginosa PA01
aggcgaagaaagccccugccgu

SEQ ID NO: 3374968 - RNA, 14 nt, Pseudomonas aeruginosa PA01
aggcgaagcccagc

SEQ ID NO: 3374969 - RNA, 22 nt, Pseudomonas aeruginosa PA01
aggcgaagcggcucggccaggg

SEQ ID NO: 3374970 - RNA, 13 nt, Pseudomonas aeruginosa PA01
aggcgaaggcgau

SEQ ID NO: 3374971 - RNA, 16 nt, Pseudomonas aeruginosa PA01
aggcgaaggucgaagg

SEQ ID NO: 3374972 - RNA, 18 nt, Pseudomonas aeruginosa PA01
aggcgacaaaucggcauc

SEQ ID NO: 3374973 - RNA, 18 nt, Pseudomonas aeruginosa PA01
aggcgacccgggucaggc

SEQ ID NO: 3374974 - RNA, 20 nt, Pseudomonas aeruginosa PA01
aggcgacccgggucaggccg

SEQ ID NO: 3374975 - RNA, 22 nt, Pseudomonas aeruginosa PA01
aggcgacccgggucaggccgag

SEQ ID NO: 3374976 - RNA, 16 nt, Pseudomonas aeruginosa PA01
aggcgaccuuggccag

SEQ ID NO: 3374977 - RNA, 12 nt, Pseudomonas aeruginosa PA01
aggcgacgaaac

SEQ ID NO: 3374978 - RNA, 18 nt, Pseudomonas aeruginosa PA01
aggcgacgaagcuggcga

SEQ ID NO: 3374979 - RNA, 15 nt, Pseudomonas aeruginosa PA01
aggcgacgaucagcc

SEQ ID NO: 3374980 - RNA, 15 nt, Pseudomonas aeruginosa PA01
aggcgacgccgcgcu

SEQ ID NO: 3374981 - RNA, 16 nt, Pseudomonas aeruginosa PA01
aggcgacgccgcgcug

SEQ ID NO: 3374982 - RNA, 15 nt, Pseudomonas aeruginosa PA01
aggcgacgcugaugc

SEQ ID NO: 3374983 - RNA, 18 nt, Pseudomonas aeruginosa PA01
aggcgacggucaggccga

SEQ ID NO: 3374984 - RNA, 20 nt, Pseudomonas aeruginosa PA01
aggcgacggucaggccgagc

SEQ ID NO: 3374985 - RNA, 19 nt, Pseudomonas aeruginosa PA01
aggcgacguuuuucccgug

SEQ ID NO: 3374986 - RNA, 12 nt, Pseudomonas aeruginosa PA01
aggcgagcagcg

SEQ ID NO: 3374987 - RNA, 13 nt, Pseudomonas aeruginosa PA01
aggcgagcagcgg

SEQ ID NO: 3374988 - RNA, 16 nt, Pseudomonas aeruginosa PA01
aggcgagcagcggcac

SEQ ID NO: 3374989 - RNA, 13 nt, Pseudomonas aeruginosa PA01
aggcgaggauggc

SEQ ID NO: 3374990 - RNA, 12 nt, Pseudomonas aeruginosa PA01
aggcgaggucgc

SEQ ID NO: 3374991 - RNA, 14 nt, Pseudomonas aeruginosa PA01
aggcgaggucgccg

SEQ ID NO: 3374992 - RNA, 17 nt, Pseudomonas aeruginosa PA01
aggcgaguaccaccgug

SEQ ID NO: 3374993 - RNA, 23 nt, Pseudomonas aeruginosa PA01
aggcgagucuugaggaagucgau

SEQ ID NO: 3374994 - RNA, 17 nt, Pseudomonas aeruginosa PA01
aggcgauacaggcggug

SEQ ID NO: 3374995 - RNA, 21 nt, Pseudomonas aeruginosa PA01
aggcgauacgcggcccggaau

SEQ ID NO: 3374996 - RNA, 16 nt, Pseudomonas aeruginosa PA01
aggcgauagccgacca

SEQ ID NO: 3374997 - RNA, 16 nt, Pseudomonas aeruginosa PA01
aggcgauaucccgccg

SEQ ID NO: 3374998 - RNA, 15 nt, Pseudomonas aeruginosa PA01
aggcgaucaucgcca

SEQ ID NO: 3374999 - RNA, 23 nt, Pseudomonas aeruginosa PA01
aggcgaucaucgccaccgguacg

SEQ ID NO: 3375000 - RNA, 15 nt, Pseudomonas aeruginosa PA01
aggcgauccacagca

SEQ ID NO: 3375001 - RNA, 17 nt, Pseudomonas aeruginosa PA01
aggcgauccacagcagg

SEQ ID NO: 3375002 - RNA, 19 nt, Pseudomonas aeruginosa PA01
aggcgauccacagcagguu

SEQ ID NO: 3375003 - RNA, 15 nt, Pseudomonas aeruginosa PA01
aggcgaucgccgcgg

SEQ ID NO: 3375004 - RNA, 17 nt, Pseudomonas aeruginosa PA01
aggcgaugaccgccccg

SEQ ID NO: 3375005 - RNA, 15 nt, Pseudomonas aeruginosa PA01
aggcgaugcgccgga

SEQ ID NO: 3375006 - RNA, 15 nt, Pseudomonas aeruginosa PA01
aggcgauggccuggu

SEQ ID NO: 3375007 - RNA, 21 nt, Pseudomonas aeruginosa PA01
aggcgauggccuggucggcgc

SEQ ID NO: 3375008 - RNA, 22 nt, Pseudomonas aeruginosa PA01
aggcgauguaggucaccgcgcc

SEQ ID NO: 3375009 - RNA, 23 nt, Pseudomonas aeruginosa PA01
aggcgcaaccagaccagcaggaa

SEQ ID NO: 3375010 - RNA, 13 nt, Pseudomonas aeruginosa PA01
aggcgcacaucac

SEQ ID NO: 3375011 - RNA, 21 nt, Pseudomonas aeruginosa PA01
aggcgcacaucacccgguucu

SEQ ID NO: 3375012 - RNA, 18 nt, Pseudomonas aeruginosa PA01
aggcgcaccagcaggcgc

SEQ ID NO: 3375013 - RNA, 14 nt, Pseudomonas aeruginosa PA01
aggcgcaccaggcc

SEQ ID NO: 3375014 - RNA, 20 nt, Pseudomonas aeruginosa PA01
aggcgcaccaggccaggcug

SEQ ID NO: 3375015 - RNA, 13 nt, Pseudomonas aeruginosa PA01
aggcgcagcagca

SEQ ID NO: 3375016 - RNA, 20 nt, Pseudomonas aeruginosa PA01
aggcgcagcagcaugaugcc

SEQ ID NO: 3375017 - RNA, 17 nt, Pseudomonas aeruginosa PA01
aggcgcagcagcgccag

SEQ ID NO: 3375018 - RNA, 13 nt, Pseudomonas aeruginosa PA01
aggcgcagccagc

SEQ ID NO: 3375019 - RNA, 14 nt, Pseudomonas aeruginosa PA01
aggcgcagccagca

SEQ ID NO: 3375020 - RNA, 16 nt, Pseudomonas aeruginosa PA01
aggcgcagccagcaca

SEQ ID NO: 3375021 - RNA, 16 nt, Pseudomonas aeruginosa PA01
aggcgcagcguccugc

SEQ ID NO: 3375022 - RNA, 17 nt, Pseudomonas aeruginosa PA01
aggcgcagcguccugcc

SEQ ID NO: 3375023 - RNA, 19 nt, Pseudomonas aeruginosa PA01
aggcgcagcguccugcccu

SEQ ID NO: 3375024 - RNA, 18 nt, Pseudomonas aeruginosa PA01
aggcgcaguaacgccugu

SEQ ID NO: 3375025 - RNA, 16 nt, Pseudomonas aeruginosa PA01
aggcgcaguaggccug

SEQ ID NO: 3375026 - RNA, 13 nt, Pseudomonas aeruginosa PA01
aggcgcaucaggc

SEQ ID NO: 3375027 - RNA, 14 nt, Pseudomonas aeruginosa PA01
aggcgcaucaggcc

SEQ ID NO: 3375028 - RNA, 13 nt, Pseudomonas aeruginosa PA01
aggcgcaugccau

SEQ ID NO: 3375029 - RNA, 13 nt, Pseudomonas aeruginosa PA01
aggcgcaugccca

SEQ ID NO: 3375030 - RNA, 22 nt, Pseudomonas aeruginosa PA01
aggcgcaugcccagggccagca

SEQ ID NO: 3375031 - RNA, 16 nt, Pseudomonas aeruginosa PA01
aggcgcauggacaggu

SEQ ID NO: 3375032 - RNA, 20 nt, Pseudomonas aeruginosa PA01
aggcgcauggacaggucgac

SEQ ID NO: 3375033 - RNA, 22 nt, Pseudomonas aeruginosa PA01
aggcgcauggacaggucgacgg

SEQ ID NO: 3375034 - RNA, 23 nt, Pseudomonas aeruginosa PA01
aggcgcauggacaggucgacggc

SEQ ID NO: 3375035 - RNA, 14 nt, Pseudomonas aeruginosa PA01
aggcgcauguccag

SEQ ID NO: 3375036 - RNA, 20 nt, Pseudomonas aeruginosa PA01
aggcgcauguccagccagug

SEQ ID NO: 3375037 - RNA, 14 nt, Pseudomonas aeruginosa PA01
aggcgccagagcgc

SEQ ID NO: 3375038 - RNA, 16 nt, Pseudomonas aeruginosa PA01
aggcgccagagcgcgc

SEQ ID NO: 3375039 - RNA, 18 nt, Pseudomonas aeruginosa PA01
aggcgccagccuacuggg

SEQ ID NO: 3375040 - RNA, 21 nt, Pseudomonas aeruginosa PA01
aggcgccagccuacugggcgu

SEQ ID NO: 3375041 - RNA, 14 nt, Pseudomonas aeruginosa PA01
aggcgccaggacuc

SEQ ID NO: 3375042 - RNA, 20 nt, Pseudomonas aeruginosa PA01
aggcgccaggacucgccauc

SEQ ID NO: 3375043 - RNA, 11 nt, Pseudomonas aeruginosa PA01
aggcgccaggg

SEQ ID NO: 3375044 - RNA, 19 nt, Pseudomonas aeruginosa PA01
aggcgccagggacgcgcag

SEQ ID NO: 3375045 - RNA, 14 nt, Pseudomonas aeruginosa PA01
aggcgccagggccg

SEQ ID NO: 3375046 - RNA, 21 nt, Pseudomonas aeruginosa PA01
aggcgccagguagugccgccc

SEQ ID NO: 3375047 - RNA, 23 nt, Pseudomonas aeruginosa PA01
aggcgccagucauugcgcuccga

SEQ ID NO: 3375048 - RNA, 14 nt, Pseudomonas aeruginosa PA01
aggcgcccaggcag

SEQ ID NO: 3375049 - RNA, 17 nt, Pseudomonas aeruginosa PA01
aggcgcccaggcagcag

SEQ ID NO: 3375050 - RNA, 15 nt, Pseudomonas aeruginosa PA01
aggcgcccgccggcc

SEQ ID NO: 3375051 - RNA, 16 nt, Pseudomonas aeruginosa PA01
aggcgcccggucaggu

SEQ ID NO: 3375052 - RNA, 20 nt, Pseudomonas aeruginosa PA01
aggcgcccggucagguugga

SEQ ID NO: 3375053 - RNA, 13 nt, Pseudomonas aeruginosa PA01
aggcgcccggugg

SEQ ID NO: 3375054 - RNA, 21 nt, Pseudomonas aeruginosa PA01
aggcgcccgguggaggucugc

SEQ ID NO: 3375055 - RNA, 14 nt, Pseudomonas aeruginosa PA01
aggcgcccuggccg

SEQ ID NO: 3375056 - RNA, 17 nt, Pseudomonas aeruginosa PA01
aggcgcccuggccgucg

SEQ ID NO: 3375057 - RNA, 14 nt, Pseudomonas aeruginosa PA01
aggcgcccuugacg

SEQ ID NO: 3375058 - RNA, 18 nt, Pseudomonas aeruginosa PA01
aggcggauaacgccagga

SEQ ID NO: 3375059 - RNA, 17 nt, Pseudomonas aeruginosa PA01
aggcggaucgcccggcg

SEQ ID NO: 3375060 - RNA, 18 nt, Pseudomonas aeruginosa PA01
aggcggaucgcccggcgc

SEQ ID NO: 3375061 - RNA, 16 nt, Pseudomonas aeruginosa PA01
aggcggaucgccgccu

SEQ ID NO: 3375062 - RNA, 14 nt, Pseudomonas aeruginosa PA01
aggcggauggcguu

SEQ ID NO: 3375063 - RNA, 17 nt, Pseudomonas aeruginosa PA01
aggcggauuugccgccg

SEQ ID NO: 3375064 - RNA, 16 nt, Pseudomonas aeruginosa PA01
aggcggcacucggcga

SEQ ID NO: 3375065 - RNA, 18 nt, Pseudomonas aeruginosa PA01
aggcggcacucggcgacc

SEQ ID NO: 3375066 - RNA, 21 nt, Pseudomonas aeruginosa PA01
aggcggcacucggcgaccacc

SEQ ID NO: 3375067 - RNA, 21 nt, Pseudomonas aeruginosa PA01
aggcggccgaagaacaccacg

SEQ ID NO: 3375068 - RNA, 14 nt, Pseudomonas aeruginosa PA01
aggcggccgcuggc

SEQ ID NO: 3375069 - RNA, 15 nt, Pseudomonas aeruginosa PA01
aggcggccgcuggcg

SEQ ID NO: 3375070 - RNA, 16 nt, Pseudomonas aeruginosa PA01
aggcggccgcuggcga

SEQ ID NO: 3375071 - RNA, 18 nt, Pseudomonas aeruginosa PA01
aggcggccguccucggga

SEQ ID NO: 3375072 - RNA, 19 nt, Pseudomonas aeruginosa PA01
aggcggccgucggccuggc

SEQ ID NO: 3375073 - RNA, 16 nt, Pseudomonas aeruginosa PA01
aggcggcgaaggccgc

SEQ ID NO: 3375074 - RNA, 15 nt, Pseudomonas aeruginosa PA01
aggcggcgcggcggg

SEQ ID NO: 3375075 - RNA, 19 nt, Pseudomonas aeruginosa PA01
aggcggcgcggcggguggc

SEQ ID NO: 3375076 - RNA, 23 nt, Pseudomonas aeruginosa PA01
aggcggcgcggcggguggcgcug

SEQ ID NO: 3375077 - RNA, 22 nt, Pseudomonas aeruginosa PA01
aggcggcgcuguuugcggcgca

SEQ ID NO: 3375078 - RNA, 17 nt, Pseudomonas aeruginosa PA01
aggcggcggaagaagcc

SEQ ID NO: 3375079 - RNA, 23 nt, Pseudomonas aeruginosa PA01
aggcggcggauaaccgcgagcgg

SEQ ID NO: 3375080 - RNA, 20 nt, Pseudomonas aeruginosa PA01
aggcggcggucaucgcgccg

SEQ ID NO: 3375081 - RNA, 22 nt, Pseudomonas aeruginosa PA01
aggcggcggucaucgcgccgcc

SEQ ID NO: 3375082 - RNA, 18 nt, Pseudomonas aeruginosa PA01
aggcggcgucgucgcugc

SEQ ID NO: 3375083 - RNA, 17 nt, Pseudomonas aeruginosa PA01
aggcgggcacgucgcgg

SEQ ID NO: 3375084 - RNA, 12 nt, Pseudomonas aeruginosa PA01
aggcgggcgcca

SEQ ID NO: 3375085 - RNA, 18 nt, Pseudomonas aeruginosa PA01
aggcgggcgccaucgcuu

SEQ ID NO: 3375086 - RNA, 13 nt, Pseudomonas aeruginosa PA01
aggcgggcggcgu

SEQ ID NO: 3375087 - RNA, 13 nt, Pseudomonas aeruginosa PA01
aggcgggcgucgg

SEQ ID NO: 3375088 - RNA, 16 nt, Pseudomonas aeruginosa PA01
aggcgggcgucggcgu

SEQ ID NO: 3375089 - RNA, 23 nt, Pseudomonas aeruginosa PA01
aggcgggcgucggcgucggcugc

SEQ ID NO: 3375090 - RNA, 16 nt, Pseudomonas aeruginosa PA01
aggcgggcgucgucgg

SEQ ID NO: 3375091 - RNA, 23 nt, Pseudomonas aeruginosa PA01
aggcgggcuggaaaacgccacac

SEQ ID NO: 3375092 - RNA, 23 nt, Pseudomonas aeruginosa PA01
aggcgguaguaggguucgccgac

SEQ ID NO: 3375093 - RNA, 19 nt, Pseudomonas aeruginosa PA01
aggcggucaugcgcccuac

SEQ ID NO: 3375094 - RNA, 15 nt, Pseudomonas aeruginosa PA01
aggcgguccagccag

SEQ ID NO: 3375095 - RNA, 16 nt, Pseudomonas aeruginosa PA01
aggcgguccagccaga

SEQ ID NO: 3375096 - RNA, 15 nt, Pseudomonas aeruginosa PA01
aggcggucgccgaac

SEQ ID NO: 3375097 - RNA, 19 nt, Pseudomonas aeruginosa PA01
aggcggucgccgaacagcc

SEQ ID NO: 3375098 - RNA, 13 nt, Pseudomonas aeruginosa PA01
aggcggucgcggg

SEQ ID NO: 3375099 - RNA, 16 nt, Pseudomonas aeruginosa PA01
aggcggucggaaagca

SEQ ID NO: 3375100 - RNA, 15 nt, Pseudomonas aeruginosa PA01
aggcggucggccauc

SEQ ID NO: 3375101 - RNA, 21 nt, Pseudomonas aeruginosa PA01
aggcggucuuuuugcagggaa

SEQ ID NO: 3375102 - RNA, 18 nt, Pseudomonas aeruginosa PA01
aggcggugaccagcggca

SEQ ID NO: 3375103 - RNA, 15 nt, Pseudomonas aeruginosa PA01
aggcgguggagcacg

SEQ ID NO: 3375104 - RNA, 23 nt, Pseudomonas aeruginosa PA01
aggcgguggccacgucgccccag

SEQ ID NO: 3375105 - RNA, 20 nt, Pseudomonas aeruginosa PA01
aggcgguguagaccaccagc

SEQ ID NO: 3375106 - RNA, 14 nt, Pseudomonas aeruginosa PA01
aggcggugucgcgg

SEQ ID NO: 3375107 - RNA, 19 nt, Pseudomonas aeruginosa PA01
aggcgguuggcccgcgccg

SEQ ID NO: 3375108 - RNA, 20 nt, Pseudomonas aeruginosa PA01
aggcgguuguucagcgggcg

SEQ ID NO: 3375109 - RNA, 22 nt, Pseudomonas aeruginosa PA01
aggcguaccagcuugucgccuu

SEQ ID NO: 3375110 - RNA, 13 nt, Pseudomonas aeruginosa PA01
aggcguacgucga

SEQ ID NO: 3375111 - RNA, 14 nt, Pseudomonas aeruginosa PA01
aggcguacgucgau

SEQ ID NO: 3375112 - RNA, 14 nt, Pseudomonas aeruginosa PA01
aggcgucauccgcc

SEQ ID NO: 3375113 - RNA, 16 nt, Pseudomonas aeruginosa PA01
aggcgucccauggcgc

SEQ ID NO: 3375114 - RNA, 20 nt, Pseudomonas aeruginosa PA01
aggcgucccauggcgccacg

SEQ ID NO: 3375115 - RNA, 18 nt, Pseudomonas aeruginosa PA01
aggcgucccuggagcagg

SEQ ID NO: 3375116 - RNA, 21 nt, Pseudomonas aeruginosa PA01
aggcgucccuggagcagggcg

SEQ ID NO: 3375117 - RNA, 13 nt, Pseudomonas aeruginosa PA01
aggcguccgcugg

SEQ ID NO: 3375118 - RNA, 17 nt, Pseudomonas aeruginosa PA01
aggcguccgcuggccug

SEQ ID NO: 3375119 - RNA, 16 nt, Pseudomonas aeruginosa PA01
aggcguccuggcgagu

SEQ ID NO: 3375120 - RNA, 18 nt, Pseudomonas aeruginosa PA01
aggcguccuggcgagugg

SEQ ID NO: 3375121 - RNA, 16 nt, Pseudomonas aeruginosa PA01
aggcgucgaaggccuc

SEQ ID NO: 3375122 - RNA, 21 nt, Pseudomonas aeruginosa PA01
aggcgucgaucccgaucgcca

SEQ ID NO: 3375123 - RNA, 13 nt, Pseudomonas aeruginosa PA01
aggcgucgccgac

SEQ ID NO: 3375124 - RNA, 15 nt, Pseudomonas aeruginosa PA01
aggcgucgcgccagc

SEQ ID NO: 3375125 - RNA, 21 nt, Pseudomonas aeruginosa PA01
aggcgucgcgccagcaccgug

SEQ ID NO: 3375126 - RNA, 18 nt, Pseudomonas aeruginosa PA01
aggcgucgguccagcucc

SEQ ID NO: 3375127 - RNA, 16 nt, Pseudomonas aeruginosa PA01
aggcgucguccucgaa

SEQ ID NO: 3375128 - RNA, 17 nt, Pseudomonas aeruginosa PA01
aggcgucgucgaccucg

SEQ ID NO: 3375129 - RNA, 22 nt, Pseudomonas aeruginosa PA01
aggcgugcaguacuuggccagc

SEQ ID NO: 3375130 - RNA, 23 nt, Pseudomonas aeruginosa PA01
aggcgugcaguacuuggccagca

SEQ ID NO: 3375131 - RNA, 15 nt, Pseudomonas aeruginosa PA01
aggcgugccuguucc

SEQ ID NO: 3375132 - RNA, 17 nt, Pseudomonas aeruginosa PA01
aggcgugccuguuccuc

SEQ ID NO: 3375133 - RNA, 20 nt, Pseudomonas aeruginosa PA01
aggcgugcugcacggagugg

SEQ ID NO: 3375134 - RNA, 19 nt, Pseudomonas aeruginosa PA01
aggcgugggccagcccaga

SEQ ID NO: 3375135 - RNA, 17 nt, Pseudomonas aeruginosa PA01
aggcgugggcgccggcg

SEQ ID NO: 3375136 - RNA, 23 nt, Pseudomonas aeruginosa PA01
aggcgugggcgccggcgcgcagg

SEQ ID NO: 3375137 - RNA, 16 nt, Pseudomonas aeruginosa PA01
aggcguggucuuccuc

SEQ ID NO: 3375138 - RNA, 15 nt, Pseudomonas aeruginosa PA01
aggcguuauccgccg

SEQ ID NO: 3375139 - RNA, 18 nt, Pseudomonas aeruginosa PA01
aggcguuauccgccgccg

SEQ ID NO: 3375140 - RNA, 21 nt, Pseudomonas aeruginosa PA01
aggcguucaugaaagccagca

SEQ ID NO: 3375141 - RNA, 22 nt, Pseudomonas aeruginosa PA01
aggcguucaugaaagccagcaa

SEQ ID NO: 3375142 - RNA, 17 nt, Pseudomonas aeruginosa PA01
aggcguuccaccaggcg

SEQ ID NO: 3375143 - RNA, 13 nt, Pseudomonas aeruginosa PA01
aggcguuccagcu

SEQ ID NO: 3375144 - RNA, 13 nt, Pseudomonas aeruginosa PA01
aggcguucgaggg

SEQ ID NO: 3375145 - RNA, 14 nt, Pseudomonas aeruginosa PA01
aggcguucggcgau

SEQ ID NO: 3375146 - RNA, 21 nt, Pseudomonas aeruginosa PA01
aggcguucggcgaugucgcgg

SEQ ID NO: 3375147 - RNA, 21 nt, Pseudomonas aeruginosa PA01
aggcguugcagugcgccgcag

SEQ ID NO: 3375148 - RNA, 13 nt, Pseudomonas aeruginosa PA01
aggcguugccgga

SEQ ID NO: 3375149 - RNA, 22 nt, Pseudomonas aeruginosa PA01
aggcucaaucaaucggucguga

SEQ ID NO: 3375150 - RNA, 21 nt, Pseudomonas aeruginosa PA01
aggcucacgcaucccuucgag

SEQ ID NO: 3375151 - RNA, 22 nt, Pseudomonas aeruginosa PA01
aggcucagccgauuacuuggcu

SEQ ID NO: 3375152 - RNA, 18 nt, Pseudomonas aeruginosa PA01
aggcucagcgcgccgagu

SEQ ID NO: 3375153 - RNA, 14 nt, Pseudomonas aeruginosa PA01
aggcucagcucggc

SEQ ID NO: 3375154 - RNA, 16 nt, Pseudomonas aeruginosa PA01
aggcucagcucggcga

SEQ ID NO: 3375155 - RNA, 13 nt, Pseudomonas aeruginosa PA01
aggcucaggcguu

SEQ ID NO: 3375156 - RNA, 18 nt, Pseudomonas aeruginosa PA01
aggcuccaauucgacgcc

SEQ ID NO: 3375157 - RNA, 19 nt, Pseudomonas aeruginosa PA01
aggcuccaauucgacgccg

SEQ ID NO: 3375158 - RNA, 16 nt, Pseudomonas aeruginosa PA01
aggcucccagguggaa

SEQ ID NO: 3375159 - RNA, 20 nt, Pseudomonas aeruginosa PA01
aggcucccccgcgccgccgg

SEQ ID NO: 3375160 - RNA, 13 nt, Pseudomonas aeruginosa PA01
agggcgagcaggg

SEQ ID NO: 3375161 - RNA, 14 nt, Pseudomonas aeruginosa PA01
agggcgagcagggc

SEQ ID NO: 3375162 - RNA, 20 nt, Pseudomonas aeruginosa PA01
agggcgagcagggcacagcc

SEQ ID NO: 3375163 - RNA, 14 nt, Pseudomonas aeruginosa PA01
agggcgaguucggc

SEQ ID NO: 3375164 - RNA, 22 nt, Pseudomonas aeruginosa PA01
agggcgaguucggcgagcaggu

SEQ ID NO: 3375165 - RNA, 17 nt, Pseudomonas aeruginosa PA01
agggcgauccagaagau

SEQ ID NO: 3375166 - RNA, 22 nt, Pseudomonas aeruginosa PA01
agggcgauccagaagaucagcg

SEQ ID NO: 3375167 - RNA, 17 nt, Pseudomonas aeruginosa PA01
agggcgauccgcccgca

SEQ ID NO: 3375168 - RNA, 14 nt, Pseudomonas aeruginosa PA01
agggcgaugccgau

SEQ ID NO: 3375169 - RNA, 16 nt, Pseudomonas aeruginosa PA01
agggcgauggcgguga

SEQ ID NO: 3375170 - RNA, 21 nt, Pseudomonas aeruginosa PA01
agggcgaugguccccggcccc

SEQ ID NO: 3375171 - RNA, 19 nt, Pseudomonas aeruginosa PA01
agggcgcaauugcaccgcu

SEQ ID NO: 3375172 - RNA, 20 nt, Pseudomonas aeruginosa PA01
agggcgcauaaccgcuugcg

SEQ ID NO: 3375173 - RNA, 15 nt, Pseudomonas aeruginosa PA01
agggcgcccgcccgg

SEQ ID NO: 3375174 - RNA, 17 nt, Pseudomonas aeruginosa PA01
agggcgcccucgccaau

SEQ ID NO: 3375175 - RNA, 19 nt, Pseudomonas aeruginosa PA01
agggcgccgaccagcuuca

SEQ ID NO: 3375176 - RNA, 17 nt, Pseudomonas aeruginosa PA01
agggcgccgaucaggcg

SEQ ID NO: 3375177 - RNA, 19 nt, Pseudomonas aeruginosa PA01
agggcgccgaucaggcgua

SEQ ID NO: 3375178 - RNA, 12 nt, Pseudomonas aeruginosa PA01
agggcgccgccg

SEQ ID NO: 3375179 - RNA, 21 nt, Pseudomonas aeruginosa PA01
agggcgccgccgacgccaugg

SEQ ID NO: 3375180 - RNA, 23 nt, Pseudomonas aeruginosa PA01
agggcgccgccgacgccaugggu

SEQ ID NO: 3375181 - RNA, 15 nt, Pseudomonas aeruginosa PA01
agggcgccgccgagg

SEQ ID NO: 3375182 - RNA, 16 nt, Pseudomonas aeruginosa PA01
agggcgccgccgagga

SEQ ID NO: 3375183 - RNA, 15 nt, Pseudomonas aeruginosa PA01
agggcgccgggcugc

SEQ ID NO: 3375184 - RNA, 15 nt, Pseudomonas aeruginosa PA01
agggcgccgucgggg

SEQ ID NO: 3375185 - RNA, 13 nt, Pseudomonas aeruginosa PA01
agggcgcgccccg

SEQ ID NO: 3375186 - RNA, 13 nt, Pseudomonas aeruginosa PA01
agggcgcggauga

SEQ ID NO: 3375187 - RNA, 21 nt, Pseudomonas aeruginosa PA01
agggcgcguugcccagcccca

SEQ ID NO: 3375188 - RNA, 19 nt, Pseudomonas aeruginosa PA01
agggcgcugccgaucagcc

SEQ ID NO: 3375189 - RNA, 15 nt, Pseudomonas aeruginosa PA01
agggcggauagcgcg

SEQ ID NO: 3375190 - RNA, 22 nt, Pseudomonas aeruginosa PA01
agggcggcccggaagcucugca

SEQ ID NO: 3375191 - RNA, 14 nt, Pseudomonas aeruginosa PA01
agggcggcgaccgg

SEQ ID NO: 3375192 - RNA, 14 nt, Pseudomonas aeruginosa PA01
agggcggcgccacc

SEQ ID NO: 3375193 - RNA, 12 nt, Pseudomonas aeruginosa PA01
agggcggcgccg

SEQ ID NO: 3375194 - RNA, 16 nt, Pseudomonas aeruginosa PA01
agggcggcgcggagcu

SEQ ID NO: 3375195 - RNA, 20 nt, Pseudomonas aeruginosa PA01
agggcggcgcggagcugcau

SEQ ID NO: 3375196 - RNA, 18 nt, Pseudomonas aeruginosa PA01
agggcggcgcgggcgcgc

SEQ ID NO: 3375197 - RNA, 24 nt, Pseudomonas aeruginosa PA01
agggcggcgcgggcgcgcgccacc

SEQ ID NO: 3375198 - RNA, 21 nt, Pseudomonas aeruginosa PA01
agggcggcuuccagguacggc

SEQ ID NO: 3375199 - RNA, 15 nt, Pseudomonas aeruginosa PA01
agggcgggccgcucg

SEQ ID NO: 3375200 - RNA, 17 nt, Pseudomonas aeruginosa PA01
agggcgggccgcucgcg

SEQ ID NO: 3375201 - RNA, 18 nt, Pseudomonas aeruginosa PA01
agggcgguacgccgcgcu

SEQ ID NO: 3375202 - RNA, 19 nt, Pseudomonas aeruginosa PA01
agggcgguacgccgcgcug

SEQ ID NO: 3375203 - RNA, 17 nt, Pseudomonas aeruginosa PA01
agggcguaggcgucgcg

SEQ ID NO: 3375204 - RNA, 21 nt, Pseudomonas aeruginosa PA01
agggcguaggcgucgcgaacc

SEQ ID NO: 3375205 - RNA, 18 nt, Pseudomonas aeruginosa PA01
agggcguagugcaucagc

SEQ ID NO: 3375206 - RNA, 20 nt, Pseudomonas aeruginosa PA01
agggcguauaaccgcucgcg

SEQ ID NO: 3375207 - RNA, 20 nt, Pseudomonas aeruginosa PA01
agggcguccaguagcgccug

SEQ ID NO: 3375208 - RNA, 22 nt, Pseudomonas aeruginosa PA01
agggcgucccguuccggcgcag

SEQ ID NO: 3375209 - RNA, 18 nt, Pseudomonas aeruginosa PA01
agggcguccugcuuccag

SEQ ID NO: 3375210 - RNA, 23 nt, Pseudomonas aeruginosa PA01
agggcguccugcuuccagaccuc

SEQ ID NO: 3375211 - RNA, 14 nt, Pseudomonas aeruginosa PA01
agggcguccuugcc

SEQ ID NO: 3375212 - RNA, 18 nt, Pseudomonas aeruginosa PA01
agggcgucgaaggcggcg

SEQ ID NO: 3375213 - RNA, 14 nt, Pseudomonas aeruginosa PA01
agggcgucgauguc

SEQ ID NO: 3375214 - RNA, 21 nt, Pseudomonas aeruginosa PA01
agggcgucgcccucggcgcug

SEQ ID NO: 3375215 - RNA, 22 nt, Pseudomonas aeruginosa PA01
agggcgucgcccucggcgcugg

SEQ ID NO: 3375216 - RNA, 23 nt, Pseudomonas aeruginosa PA01
agggcgucgcccucggcgcuggc

SEQ ID NO: 3375217 - RNA, 12 nt, Pseudomonas aeruginosa PA01
agggcgucgccg

SEQ ID NO: 3375218 - RNA, 13 nt, Pseudomonas aeruginosa PA01
agggcgucggcgu

SEQ ID NO: 3375219 - RNA, 20 nt, Pseudomonas aeruginosa PA01
agggcgucgucgaggcuguc

SEQ ID NO: 3375220 - RNA, 16 nt, Pseudomonas aeruginosa PA01
agggcguggucggcgg

SEQ ID NO: 3375221 - RNA, 17 nt, Pseudomonas aeruginosa PA01
agggcguggucggcggc

SEQ ID NO: 3375222 - RNA, 19 nt, Pseudomonas aeruginosa PA01
agggcguggucggcggccu

SEQ ID NO: 3375223 - RNA, 21 nt, Pseudomonas aeruginosa PA01
agggcguucuuggccgcgccg

SEQ ID NO: 3375224 - RNA, 21 nt, Pseudomonas aeruginosa PA01
agggcguuucagaacgucggc

SEQ ID NO: 3375225 - RNA, 18 nt, Pseudomonas aeruginosa PA01
agggcucagcccaggcgc

SEQ ID NO: 3375226 - RNA, 19 nt, Pseudomonas aeruginosa PA01
agggcucagcccaggcgcc

SEQ ID NO: 3375227 - RNA, 20 nt, Pseudomonas aeruginosa PA01
agggcucagcccaggcgccg

SEQ ID NO: 3375228 - RNA, 22 nt, Pseudomonas aeruginosa PA01
agggcucgugccaucaggccgc

SEQ ID NO: 3375229 - RNA, 10 nt, Pseudomonas aeruginosa PA01
agggcugaga

SEQ ID NO: 3375230 - RNA, 15 nt, Pseudomonas aeruginosa PA01
agggcugagacgcug

SEQ ID NO: 3375231 - RNA, 17 nt, Pseudomonas aeruginosa PA01
agggcugagacgcugcc

SEQ ID NO: 3375232 - RNA, 20 nt, Pseudomonas aeruginosa PA01
agggcugccaccgagggcag

SEQ ID NO: 3375233 - RNA, 17 nt, Pseudomonas aeruginosa PA01
agggcugccgcccgguc

SEQ ID NO: 3375234 - RNA, 22 nt, Pseudomonas aeruginosa PA01
agggcugcuguccagcgcuccu

SEQ ID NO: 3375235 - RNA, 20 nt, Pseudomonas aeruginosa PA01
agggcugcuguugccaggga

SEQ ID NO: 3375236 - RNA, 18 nt, Pseudomonas aeruginosa PA01
agggcugggcagcgccgc

SEQ ID NO: 3375237 - RNA, 23 nt, Pseudomonas aeruginosa PA01
agggcuguaaucgccgcuucgcg

SEQ ID NO: 3375238 - RNA, 14 nt, Pseudomonas aeruginosa PA01
agggcuucccaggc

SEQ ID NO: 3375239 - RNA, 17 nt, Pseudomonas aeruginosa PA01
agggcuucccaggccag

SEQ ID NO: 3375240 - RNA, 18 nt, Pseudomonas aeruginosa PA01
agggcuucccaggccagc

SEQ ID NO: 3375241 - RNA, 18 nt, Pseudomonas aeruginosa PA01
agggcuuccuuggcggga

SEQ ID NO: 3375242 - RNA, 14 nt, Pseudomonas aeruginosa PA01
agggcuucgcggug

SEQ ID NO: 3375243 - RNA, 22 nt, Pseudomonas aeruginosa PA01
agggcuugcgcgccaccagcgu

SEQ ID NO: 3375244 - RNA, 23 nt, Pseudomonas aeruginosa PA01
agggcuugcgcgccaccagcgug

SEQ ID NO: 3375245 - RNA, 18 nt, Pseudomonas aeruginosa PA01
agggcuugugcagagagg

SEQ ID NO: 3375246 - RNA, 15 nt, Pseudomonas aeruginosa PA01
aggggaccaccccgg

SEQ ID NO: 3375247 - RNA, 17 nt, Pseudomonas aeruginosa PA01
aggggaccaccccgguc

SEQ ID NO: 3375248 - RNA, 14 nt, Pseudomonas aeruginosa PA01
aggggagcacggca

SEQ ID NO: 3375249 - RNA, 15 nt, Pseudomonas aeruginosa PA01
aggggagcgccggcg

SEQ ID NO: 3375250 - RNA, 22 nt, Pseudomonas aeruginosa PA01
aggggaugccauggcauccccu

SEQ ID NO: 3375251 - RNA, 23 nt, Pseudomonas aeruginosa PA01
aggggcauguccaccgccgccag

SEQ ID NO: 3375252 - RNA, 15 nt, Pseudomonas aeruginosa PA01
aggggcccgaaggcc

SEQ ID NO: 3375253 - RNA, 16 nt, Pseudomonas aeruginosa PA01
aggggccgacgcgcug

SEQ ID NO: 3375254 - RNA, 14 nt, Pseudomonas aeruginosa PA01
aggggccgaugccg

SEQ ID NO: 3375255 - RNA, 18 nt, Pseudomonas aeruginosa PA01
aggggccgaugccgggca

SEQ ID NO: 3375256 - RNA, 15 nt, Pseudomonas aeruginosa PA01
aggggccgcgcuuca

SEQ ID NO: 3375257 - RNA, 12 nt, Pseudomonas aeruginosa PA01
aggggcgcgccg

SEQ ID NO: 3375258 - RNA, 15 nt, Pseudomonas aeruginosa PA01
aggggcggcucggcu

SEQ ID NO: 3375259 - RNA, 17 nt, Pseudomonas aeruginosa PA01
aggggcuacuucgccgg

SEQ ID NO: 3375260 - RNA, 17 nt, Pseudomonas aeruginosa PA01
aggggcuagucgcgcag

SEQ ID NO: 3375261 - RNA, 22 nt, Pseudomonas aeruginosa PA01
aggggcuagucgcgcagcgccu

SEQ ID NO: 3375262 - RNA, 15 nt, Pseudomonas aeruginosa PA01
agguagagaugcagc

SEQ ID NO: 3375263 - RNA, 13 nt, Pseudomonas aeruginosa PA01
agguagagcagcc

SEQ ID NO: 3375264 - RNA, 16 nt, Pseudomonas aeruginosa PA01
agguagauguucagug

SEQ ID NO: 3375265 - RNA, 14 nt, Pseudomonas aeruginosa PA01
agguagcagccguc

SEQ ID NO: 3375266 - RNA, 13 nt, Pseudomonas aeruginosa PA01
agguagccagggg

SEQ ID NO: 3375267 - RNA, 19 nt, Pseudomonas aeruginosa PA01
agguagccugcggccagcg

SEQ ID NO: 3375268 - RNA, 13 nt, Pseudomonas aeruginosa PA01
agguagcgcugcg

SEQ ID NO: 3375269 - RNA, 20 nt, Pseudomonas aeruginosa PA01
agguagcggaccccggccuc

SEQ ID NO: 3375270 - RNA, 15 nt, Pseudomonas aeruginosa PA01
agguagcggucgggu

SEQ ID NO: 3375271 - RNA, 19 nt, Pseudomonas aeruginosa PA01
agguagcggucggguucuu

SEQ ID NO: 3375272 - RNA, 17 nt, Pseudomonas aeruginosa PA01
agguagcguugcgccag

SEQ ID NO: 3375273 - RNA, 18 nt, Pseudomonas aeruginosa PA01
agguagcugagcaggccg

SEQ ID NO: 3375274 - RNA, 21 nt, Pseudomonas aeruginosa PA01
agguaggcaucgacgccagcg

SEQ ID NO: 3375275 - RNA, 21 nt, Pseudomonas aeruginosa PA01
agguaggcgcgggcguagccu

SEQ ID NO: 3375276 - RNA, 22 nt, Pseudomonas aeruginosa PA01
agguagguggaggccguggugg

SEQ ID NO: 3375277 - RNA, 15 nt, Pseudomonas aeruginosa PA01
agguagucgcccggc

SEQ ID NO: 3375278 - RNA, 16 nt, Pseudomonas aeruginosa PA01
agguagucgcccggcu

SEQ ID NO: 3375279 - RNA, 20 nt, Pseudomonas aeruginosa PA01
agguagucgcucauggcgcc

SEQ ID NO: 3375280 - RNA, 21 nt, Pseudomonas aeruginosa PA01
agguagucgcucauggcgccg

SEQ ID NO: 3375281 - RNA, 13 nt, Pseudomonas aeruginosa PA01
agguagucggcga

SEQ ID NO: 3375282 - RNA, 23 nt, Pseudomonas aeruginosa PA01
agguagucggcgaugcgcuggaa

SEQ ID NO: 3375283 - RNA, 24 nt, Pseudomonas aeruginosa PA01
agguagugcaacaccuggcgcucg

SEQ ID NO: 3375284 - RNA, 14 nt, Pseudomonas aeruginosa PA01
agguaguugagguc

SEQ ID NO: 3375285 - RNA, 14 nt, Pseudomonas aeruginosa PA01
agguauccgccggc

SEQ ID NO: 3375286 - RNA, 15 nt, Pseudomonas aeruginosa PA01
agguauccgccggcc

SEQ ID NO: 3375287 - RNA, 16 nt, Pseudomonas aeruginosa PA01
agguauccgccggccg

SEQ ID NO: 3375288 - RNA, 17 nt, Pseudomonas aeruginosa PA01
agguauccgccggccgg

SEQ ID NO: 3375289 - RNA, 20 nt, Pseudomonas aeruginosa PA01
agguaucggccauggccgag

SEQ ID NO: 3375290 - RNA, 14 nt, Pseudomonas aeruginosa PA01
agguauucgcgcuc

SEQ ID NO: 3375291 - RNA, 19 nt, Pseudomonas aeruginosa PA01
aggucaccagguugcccgg

SEQ ID NO: 3375292 - RNA, 13 nt, Pseudomonas aeruginosa PA01
aggucaccgcgcc

SEQ ID NO: 3375293 - RNA, 15 nt, Pseudomonas aeruginosa PA01
aggucaccgcgccgg

SEQ ID NO: 3375294 - RNA, 14 nt, Pseudomonas aeruginosa PA01
aggucacgcccugc

SEQ ID NO: 3375295 - RNA, 12 nt, Pseudomonas aeruginosa PA01
aggucacuuccu

SEQ ID NO: 3375296 - RNA, 16 nt, Pseudomonas aeruginosa PA01
aggucagccaccugcu

SEQ ID NO: 3375297 - RNA, 13 nt, Pseudomonas aeruginosa PA01
aggucagcccgug

SEQ ID NO: 3375298 - RNA, 16 nt, Pseudomonas aeruginosa PA01
aggucaugaaggaaac

SEQ ID NO: 3375299 - RNA, 15 nt, Pseudomonas aeruginosa PA01
aggucaugcccuggc

SEQ ID NO: 3375300 - RNA, 16 nt, Pseudomonas aeruginosa PA01
aggucaugcccuggcc

SEQ ID NO: 3375301 - RNA, 14 nt, Pseudomonas aeruginosa PA01
agguccaggcucag

SEQ ID NO: 3375302 - RNA, 15 nt, Pseudomonas aeruginosa PA01
agguccaggcucagc

SEQ ID NO: 3375303 - RNA, 20 nt, Pseudomonas aeruginosa PA01
agguccgccugguccagcag

SEQ ID NO: 3375304 - RNA, 20 nt, Pseudomonas aeruginosa PA01
agguccgcgccaugccggcg

SEQ ID NO: 3375305 - RNA, 22 nt, Pseudomonas aeruginosa PA01
agguccgcgccaugccggcgcc

SEQ ID NO: 3375306 - RNA, 15 nt, Pseudomonas aeruginosa PA01
agguccgcgccucgc

SEQ ID NO: 3375307 - RNA, 16 nt, Pseudomonas aeruginosa PA01
agguccgcgccucgcg

SEQ ID NO: 3375308 - RNA, 20 nt, Pseudomonas aeruginosa PA01
agguccggguugucguugcg

SEQ ID NO: 3375309 - RNA, 18 nt, Pseudomonas aeruginosa PA01
aggucgaacagcggcugg

SEQ ID NO: 3375310 - RNA, 19 nt, Pseudomonas aeruginosa PA01
aggucgaacagcggcuggc

SEQ ID NO: 3375311 - RNA, 20 nt, Pseudomonas aeruginosa PA01
aggucgaacugcacccgccg

SEQ ID NO: 3375312 - RNA, 14 nt, Pseudomonas aeruginosa PA01
aggucgaaggcgcg

SEQ ID NO: 3375313 - RNA, 20 nt, Pseudomonas aeruginosa PA01
aggucgacaugcaccaggcc

SEQ ID NO: 3375314 - RNA, 22 nt, Pseudomonas aeruginosa PA01
aggucgaccagccagucggcgg

SEQ ID NO: 3375315 - RNA, 19 nt, Pseudomonas aeruginosa PA01
aggucgacgaccuugccca

SEQ ID NO: 3375316 - RNA, 16 nt, Pseudomonas aeruginosa PA01
aggucgacgccgccga

SEQ ID NO: 3375317 - RNA, 19 nt, Pseudomonas aeruginosa PA01
aggucgacgccgccgagca

SEQ ID NO: 3375318 - RNA, 14 nt, Pseudomonas aeruginosa PA01
aggucgacggcggc

SEQ ID NO: 3375319 - RNA, 20 nt, Pseudomonas aeruginosa PA01
aggucgacggcggccgccau

SEQ ID NO: 3375320 - RNA, 18 nt, Pseudomonas aeruginosa PA01
aggucgagcaguuccggc

SEQ ID NO: 3375321 - RNA, 16 nt, Pseudomonas aeruginosa PA01
aggucgagcuggguca

SEQ ID NO: 3375322 - RNA, 14 nt, Pseudomonas aeruginosa PA01
aggucgaggcgcuc

SEQ ID NO: 3375323 - RNA, 14 nt, Pseudomonas aeruginosa PA01
aggucgagguugua

SEQ ID NO: 3375324 - RNA, 17 nt, Pseudomonas aeruginosa PA01
aggucgaucagcagcag

SEQ ID NO: 3375325 - RNA, 22 nt, Pseudomonas aeruginosa PA01
aggucgaucagcagcagcgcca

SEQ ID NO: 3375326 - RNA, 21 nt, Pseudomonas aeruginosa PA01
aggucgauccugaccccggcc

SEQ ID NO: 3375327 - RNA, 24 nt, Pseudomonas aeruginosa PA01
aggucgauccugaccccggccugg

SEQ ID NO: 3375328 - RNA, 13 nt, Pseudomonas aeruginosa PA01
aggucgcagcguu

SEQ ID NO: 3375329 - RNA, 16 nt, Pseudomonas aeruginosa PA01
aggucgcagcguucca

SEQ ID NO: 3375330 - RNA, 22 nt, Pseudomonas aeruginosa PA01
aggucgcagcguuccagcgcug

SEQ ID NO: 3375331 - RNA, 13 nt, Pseudomonas aeruginosa PA01
aggucgccagcgc

SEQ ID NO: 3375332 - RNA, 15 nt, Pseudomonas aeruginosa PA01
aggucgccagcgccu

SEQ ID NO: 3375333 - RNA, 12 nt, Pseudomonas aeruginosa PA01
aggucgcccugc

SEQ ID NO: 3375334 - RNA, 19 nt, Pseudomonas aeruginosa PA01
aggucgcccugcagcgcgc

SEQ ID NO: 3375335 - RNA, 24 nt, Pseudomonas aeruginosa PA01
aggucgcccugcagcgcgcgcugg

SEQ ID NO: 3375336 - RNA, 14 nt, Pseudomonas aeruginosa PA01
aggucgccgccagc

SEQ ID NO: 3375337 - RNA, 23 nt, Pseudomonas aeruginosa PA01
aggucgccgccagcuaccggcag

SEQ ID NO: 3375338 - RNA, 13 nt, Pseudomonas aeruginosa PA01
aggucgccgggcu

SEQ ID NO: 3375339 - RNA, 20 nt, Pseudomonas aeruginosa PA01
aggucgcgauguuggcgucg

SEQ ID NO: 3375340 - RNA, 21 nt, Pseudomonas aeruginosa PA01
aggucgcgauguuggcgucga

SEQ ID NO: 3375341 - RNA, 16 nt, Pseudomonas aeruginosa PA01
aggucgcgcagggcca

SEQ ID NO: 3375342 - RNA, 20 nt, Pseudomonas aeruginosa PA01
aggucgcgcagggccagggc

SEQ ID NO: 3375343 - RNA, 23 nt, Pseudomonas aeruginosa PA01
aggucgcgcagggccagggcggc

SEQ ID NO: 3375344 - RNA, 16 nt, Pseudomonas aeruginosa PA01
aggucgcgcaguucgu

SEQ ID NO: 3375345 - RNA, 18 nt, Pseudomonas aeruginosa PA01
aggucgcggaagugcggg

SEQ ID NO: 3375346 - RNA, 19 nt, Pseudomonas aeruginosa PA01
aggucgcggaucaggcugg

SEQ ID NO: 3375347 - RNA, 13 nt, Pseudomonas aeruginosa PA01
aggucgcggcccc

SEQ ID NO: 3375348 - RNA, 17 nt, Pseudomonas aeruginosa PA01
aggucgcggccccagca

SEQ ID NO: 3375349 - RNA, 19 nt, Pseudomonas aeruginosa PA01
aggucgcgggccaggcccu

SEQ ID NO: 3375350 - RNA, 12 nt, Pseudomonas aeruginosa PA01
aggucgcugccc

SEQ ID NO: 3375351 - RNA, 18 nt, Pseudomonas aeruginosa PA01
aggucgcuggcaccggcc

SEQ ID NO: 3375352 - RNA, 23 nt, Pseudomonas aeruginosa PA01
aggucgcugucgcguucccacuc

SEQ ID NO: 3375353 - RNA, 22 nt, Pseudomonas aeruginosa PA01
aggucggagugcucgaucaggu

SEQ ID NO: 3375354 - RNA, 15 nt, Pseudomonas aeruginosa PA01
aggucggcagcagcu

SEQ ID NO: 3375355 - RNA, 16 nt, Pseudomonas aeruginosa PA01
aggucggcagcagcuu

SEQ ID NO: 3375356 - RNA, 13 nt, Pseudomonas aeruginosa PA01
aggucggcagcgu

SEQ ID NO: 3375357 - RNA, 22 nt, Pseudomonas aeruginosa PA01
aggucggcagcgucgagcuggc

SEQ ID NO: 3375358 - RNA, 13 nt, Pseudomonas aeruginosa PA01
aggucggccgccu

SEQ ID NO: 3375359 - RNA, 15 nt, Pseudomonas aeruginosa PA01
aggucggccggcagc

SEQ ID NO: 3375360 - RNA, 18 nt, Pseudomonas aeruginosa PA01
aggucggccuggcugccg

SEQ ID NO: 3375361 - RNA, 20 nt, Pseudomonas aeruginosa PA01
aggucggcgccggugcuggc

SEQ ID NO: 3375362 - RNA, 22 nt, Pseudomonas aeruginosa PA01
aggucggcgccggugcuggcga

SEQ ID NO: 3375363 - RNA, 12 nt, Pseudomonas aeruginosa PA01
aggucggcgcgc

SEQ ID NO: 3375364 - RNA, 20 nt, Pseudomonas aeruginosa PA01
aggucggcgcgcccggcgca

SEQ ID NO: 3375365 - RNA, 21 nt, Pseudomonas aeruginosa PA01
aggucggcggcacgcuccaga

SEQ ID NO: 3375366 - RNA, 14 nt, Pseudomonas aeruginosa PA01
aggucggcggcagc

SEQ ID NO: 3375367 - RNA, 20 nt, Pseudomonas aeruginosa PA01
aggucggcggcagcugcggc

SEQ ID NO: 3375368 - RNA, 14 nt, Pseudomonas aeruginosa PA01
aggucggcggcggg

SEQ ID NO: 3375369 - RNA, 20 nt, Pseudomonas aeruginosa PA01
aggucgggcaacggcugggu

SEQ ID NO: 3375370 - RNA, 14 nt, Pseudomonas aeruginosa PA01
aggucggucggcgg

SEQ ID NO: 3375371 - RNA, 22 nt, Pseudomonas aeruginosa PA01
aggucggucuggcggcccuggu

SEQ ID NO: 3375372 - RNA, 13 nt, Pseudomonas aeruginosa PA01
aggucguccaccu

SEQ ID NO: 3375373 - RNA, 19 nt, Pseudomonas aeruginosa PA01
aggucguccaccuccaccu

SEQ ID NO: 3375374 - RNA, 14 nt, Pseudomonas aeruginosa PA01
aggucgucggcgaa

SEQ ID NO: 3375375 - RNA, 17 nt, Pseudomonas aeruginosa PA01
aggucgucgggcagagu

SEQ ID NO: 3375376 - RNA, 15 nt, Pseudomonas aeruginosa PA01
aggucguggaaggcu

SEQ ID NO: 3375377 - RNA, 22 nt, Pseudomonas aeruginosa PA01
aggucguugcgccggcccagca

SEQ ID NO: 3375378 - RNA, 18 nt, Pseudomonas aeruginosa PA01
aggucguuggcaaagccc

SEQ ID NO: 3375379 - RNA, 21 nt, Pseudomonas aeruginosa PA01
aggucguuggcaaagcccgcu

SEQ ID NO: 3375380 - RNA, 20 nt, Pseudomonas aeruginosa PA01
aggucguuggccaggcgcga

SEQ ID NO: 3375381 - RNA, 14 nt, Pseudomonas aeruginosa PA01
aggucucgccgccg

SEQ ID NO: 3375382 - RNA, 14 nt, Pseudomonas aeruginosa PA01
aggucugccccggc

SEQ ID NO: 3375383 - RNA, 16 nt, Pseudomonas aeruginosa PA01
aggucugccccggcuu

SEQ ID NO: 3375384 - RNA, 14 nt, Pseudomonas aeruginosa PA01
aggucugcccgacg

SEQ ID NO: 3375385 - RNA, 20 nt, Pseudomonas aeruginosa PA01
aggucugcccguggcgcgga

SEQ ID NO: 3375386 - RNA, 20 nt, Pseudomonas aeruginosa PA01
aggucugccucgccgaggcg

SEQ ID NO: 3375387 - RNA, 20 nt, Pseudomonas aeruginosa PA01
aggucugcgguauaggccuu

SEQ ID NO: 3375388 - RNA, 14 nt, Pseudomonas aeruginosa PA01
aggucugugccgug

SEQ ID NO: 3375389 - RNA, 21 nt, Pseudomonas aeruginosa PA01
aggucuugcccaacuccagcu

SEQ ID NO: 3375390 - RNA, 18 nt, Pseudomonas aeruginosa PA01
aggucuuggccagccgcg

SEQ ID NO: 3375391 - RNA, 20 nt, Pseudomonas aeruginosa PA01
aggugaaaagcgcugacgaa

SEQ ID NO: 3375392 - RNA, 14 nt, Pseudomonas aeruginosa PA01
aggugaagcugccg

SEQ ID NO: 3375393 - RNA, 14 nt, Pseudomonas aeruginosa PA01
aggugaccgcccag

SEQ ID NO: 3375394 - RNA, 19 nt, Pseudomonas aeruginosa PA01
aggugagcgacccgcugaa

SEQ ID NO: 3375395 - RNA, 22 nt, Pseudomonas aeruginosa PA01
aggugagcgacccgcugaagga

SEQ ID NO: 3375396 - RNA, 17 nt, Pseudomonas aeruginosa PA01
aggugaugcggcccuug

SEQ ID NO: 3375397 - RNA, 18 nt, Pseudomonas aeruginosa PA01
aggugcaccgcgcuggag

SEQ ID NO: 3375398 - RNA, 19 nt, Pseudomonas aeruginosa PA01
aggugcaccgcgcuggaga

SEQ ID NO: 3375399 - RNA, 17 nt, Pseudomonas aeruginosa PA01
aggugcacggccaggcc

SEQ ID NO: 3375400 - RNA, 20 nt, Pseudomonas aeruginosa PA01
aggugcaggaacagccagua

SEQ ID NO: 3375401 - RNA, 17 nt, Pseudomonas aeruginosa PA01
aggugcaggaagcgccg

SEQ ID NO: 3375402 - RNA, 19 nt, Pseudomonas aeruginosa PA01
aggugcaggaagcgccggg

SEQ ID NO: 3375403 - RNA, 20 nt, Pseudomonas aeruginosa PA01
aggugcaggaagcgccgggc

SEQ ID NO: 3375404 - RNA, 15 nt, Pseudomonas aeruginosa PA01
aggugcaggccgcgc

SEQ ID NO: 3375405 - RNA, 17 nt, Pseudomonas aeruginosa PA01
aggugcauguagcgcuc

SEQ ID NO: 3375406 - RNA, 13 nt, Pseudomonas aeruginosa PA01
aggugcccggcgg

SEQ ID NO: 3375407 - RNA, 12 nt, Pseudomonas aeruginosa PA01
aggugcccugga

SEQ ID NO: 3375408 - RNA, 20 nt, Pseudomonas aeruginosa PA01
aggugcccuggcagacgcug

SEQ ID NO: 3375409 - RNA, 24 nt, Pseudomonas aeruginosa PA01
aggugcccuggcagacgcugcucg

SEQ ID NO: 3375410 - RNA, 16 nt, Pseudomonas aeruginosa PA01
aggugccgcucgucca

SEQ ID NO: 3375411 - RNA, 20 nt, Pseudomonas aeruginosa PA01
aggugccgcucguccaguuc

SEQ ID NO: 3375412 - RNA, 20 nt, Pseudomonas aeruginosa PA01
aggugcgagucaccccgacc

SEQ ID NO: 3375413 - RNA, 14 nt, Pseudomonas aeruginosa PA01
aggugcgcaggcgc

SEQ ID NO: 3375414 - RNA, 15 nt, Pseudomonas aeruginosa PA01
aggugcgcaggcgcu

SEQ ID NO: 3375415 - RNA, 17 nt, Pseudomonas aeruginosa PA01
aggugcgccgagcgcuc

SEQ ID NO: 3375416 - RNA, 21 nt, Pseudomonas aeruginosa PA01
aggugcgccgagcgcucgccg

SEQ ID NO: 3375417 - RNA, 19 nt, Pseudomonas aeruginosa PA01
aggugcgcuggcgccagua

SEQ ID NO: 3375418 - RNA, 19 nt, Pseudomonas aeruginosa PA01
aggugcggcugggugucga

SEQ ID NO: 3375419 - RNA, 22 nt, Pseudomonas aeruginosa PA01
aggugcuggacucgcgccaguc

SEQ ID NO: 3375420 - RNA, 19 nt, Pseudomonas aeruginosa PA01
aggugcugguggcccuggg

SEQ ID NO: 3375421 - RNA, 17 nt, Pseudomonas aeruginosa PA01
aggugcuuggcaccgcg

SEQ ID NO: 3375422 - RNA, 19 nt, Pseudomonas aeruginosa PA01
aggugcuuggcaccgcgca

SEQ ID NO: 3375423 - RNA, 22 nt, Pseudomonas aeruginosa PA01
aggugcuugucacgcucggcau

SEQ ID NO: 3375424 - RNA, 15 nt, Pseudomonas aeruginosa PA01
agguggaggccgugg

SEQ ID NO: 3375425 - RNA, 23 nt, Pseudomonas aeruginosa PA01
agguggaugaacagcggaaugcu

SEQ ID NO: 3375426 - RNA, 15 nt, Pseudomonas aeruginosa PA01
agguggauugcagcg

SEQ ID NO: 3375427 - RNA, 18 nt, Pseudomonas aeruginosa PA01
agguggauugcagcgucg

SEQ ID NO: 3375428 - RNA, 23 nt, Pseudomonas aeruginosa PA01
agguggauugcagcgucgacgcc

SEQ ID NO: 3375429 - RNA, 14 nt, Pseudomonas aeruginosa PA01
agguggcaggccug

SEQ ID NO: 3375430 - RNA, 23 nt, Pseudomonas aeruginosa PA01
agguggcaggccuggaauacccc

SEQ ID NO: 3375431 - RNA, 16 nt, Pseudomonas aeruginosa PA01
agguggccggaaaaag

SEQ ID NO: 3375432 - RNA, 19 nt, Pseudomonas aeruginosa PA01
agguggcgcacugccagga

SEQ ID NO: 3375433 - RNA, 16 nt, Pseudomonas aeruginosa PA01
agguggcgccgccggc

SEQ ID NO: 3375434 - RNA, 18 nt, Pseudomonas aeruginosa PA01
agguggcgccgccggcga

SEQ ID NO: 3375435 - RNA, 23 nt, Pseudomonas aeruginosa PA01
agguggcgccgccggcgaacggc

SEQ ID NO: 3375436 - RNA, 20 nt, Pseudomonas aeruginosa PA01
agguggcgcucacgcucgac

SEQ ID NO: 3375437 - RNA, 17 nt, Pseudomonas aeruginosa PA01
agguggcgggucggcgg

SEQ ID NO: 3375438 - RNA, 23 nt, Pseudomonas aeruginosa PA01
agguggcguugcagggugcguac

SEQ ID NO: 3375439 - RNA, 13 nt, Pseudomonas aeruginosa PA01
agguggcugguca

SEQ ID NO: 3375440 - RNA, 17 nt, Pseudomonas aeruginosa PA01
agguggcuuuccagcau

SEQ ID NO: 3375441 - RNA, 15 nt, Pseudomonas aeruginosa PA01
aggugggcagcagcg

SEQ ID NO: 3375442 - RNA, 20 nt, Pseudomonas aeruginosa PA01
aggugggcagcagcgaacgc

SEQ ID NO: 3375443 - RNA, 23 nt, Pseudomonas aeruginosa PA01
aggugggcagcagcgaacgccgc

SEQ ID NO: 3375444 - RNA, 17 nt, Pseudomonas aeruginosa PA01
agguggugguagagcgg

SEQ ID NO: 3375445 - RNA, 14 nt, Pseudomonas aeruginosa PA01
agguguacaucggg

SEQ ID NO: 3375446 - RNA, 19 nt, Pseudomonas aeruginosa PA01
agguguucguccagaugcu

SEQ ID NO: 3375447 - RNA, 16 nt, Pseudomonas aeruginosa PA01
agguucaggccgggca

SEQ ID NO: 3375448 - RNA, 21 nt, Pseudomonas aeruginosa PA01
agguucaggguggcgaucacg

SEQ ID NO: 3375449 - RNA, 14 nt, Pseudomonas aeruginosa PA01
agguucaggucgau

SEQ ID NO: 3375450 - RNA, 16 nt, Pseudomonas aeruginosa PA01
agguucaucgccgcca

SEQ ID NO: 3375451 - RNA, 20 nt, Pseudomonas aeruginosa PA01
agguucaucgccgccaggca

SEQ ID NO: 3375452 - RNA, 17 nt, Pseudomonas aeruginosa PA01
agguucgaaugcugccc

SEQ ID NO: 3375453 - RNA, 22 nt, Pseudomonas aeruginosa PA01
agguucgcguggcccggcgcgg

SEQ ID NO: 3375454 - RNA, 18 nt, Pseudomonas aeruginosa PA01
agguugaccccgcggccg

SEQ ID NO: 3375455 - RNA, 22 nt, Pseudomonas aeruginosa PA01
agguugacgaugcggcccgccg

SEQ ID NO: 3375456 - RNA, 22 nt, Pseudomonas aeruginosa PA01
agguugaucgggugggacaugg

SEQ ID NO: 3375457 - RNA, 21 nt, Pseudomonas aeruginosa PA01
agguugccgaucaggcugaag

SEQ ID NO: 3375458 - RNA, 21 nt, Pseudomonas aeruginosa PA01
agguugccgccgaucagcgcg

SEQ ID NO: 3375459 - RNA, 12 nt, Pseudomonas aeruginosa PA01
agguugccggcg

SEQ ID NO: 3375460 - RNA, 16 nt, Pseudomonas aeruginosa PA01
agguugccggcgugca

SEQ ID NO: 3375461 - RNA, 12 nt, Pseudomonas aeruginosa PA01
agguugccggug

SEQ ID NO: 3375462 - RNA, 22 nt, Pseudomonas aeruginosa PA01
agguugccgugcagcuuggcga

SEQ ID NO: 3375463 - RNA, 20 nt, Pseudomonas aeruginosa PA01
agguugcgcaaccagcgcuc

SEQ ID NO: 3375464 - RNA, 18 nt, Pseudomonas aeruginosa PA01
agguugcgcuccauccag

SEQ ID NO: 3375465 - RNA, 13 nt, Pseudomonas aeruginosa PA01
agguugcgcuggc

SEQ ID NO: 3375466 - RNA, 14 nt, Pseudomonas aeruginosa PA01
agguugcgcuggcg

SEQ ID NO: 3375467 - RNA, 16 nt, Pseudomonas aeruginosa PA01
aguccuuguccagggc

SEQ ID NO: 3375468 - RNA, 16 nt, Pseudomonas aeruginosa PA01
agucgaacaggcccuu

SEQ ID NO: 3375469 - RNA, 22 nt, Pseudomonas aeruginosa PA01
agucgaagcagcccagcgcuuc

SEQ ID NO: 3375470 - RNA, 23 nt, Pseudomonas aeruginosa PA01
agucgacccaggcccagccggug

SEQ ID NO: 3375471 - RNA, 15 nt, Pseudomonas aeruginosa PA01
agucgaccgucgcca

SEQ ID NO: 3375472 - RNA, 17 nt, Pseudomonas aeruginosa PA01
agucgaccgucgccacg

SEQ ID NO: 3375473 - RNA, 15 nt, Pseudomonas aeruginosa PA01
agucgagacgccagc

SEQ ID NO: 3375474 - RNA, 23 nt, Pseudomonas aeruginosa PA01
agucgagagcggguagcgccggu

SEQ ID NO: 3375475 - RNA, 21 nt, Pseudomonas aeruginosa PA01
agucgagcaguucccccagca

SEQ ID NO: 3375476 - RNA, 22 nt, Pseudomonas aeruginosa PA01
agucgagcaguucccccagcac

SEQ ID NO: 3375477 - RNA, 13 nt, Pseudomonas aeruginosa PA01
agucgagcauguc

SEQ ID NO: 3375478 - RNA, 15 nt, Pseudomonas aeruginosa PA01
agucgaucaggucgc

SEQ ID NO: 3375479 - RNA, 20 nt, Pseudomonas aeruginosa PA01
agucgaugacgaggcccgcc

SEQ ID NO: 3375480 - RNA, 20 nt, Pseudomonas aeruginosa PA01
agucgcaccgggaggcgccg

SEQ ID NO: 3375481 - RNA, 15 nt, Pseudomonas aeruginosa PA01
agucgcagcucggug

SEQ ID NO: 3375482 - RNA, 22 nt, Pseudomonas aeruginosa PA01
agucgcccccaccgcccccgca

SEQ ID NO: 3375483 - RNA, 15 nt, Pseudomonas aeruginosa PA01
agucgccccgguugg

SEQ ID NO: 3375484 - RNA, 17 nt, Pseudomonas aeruginosa PA01
agucgcccgcuucgcca

SEQ ID NO: 3375485 - RNA, 18 nt, Pseudomonas aeruginosa PA01
agucgcccgcuucgccau

SEQ ID NO: 3375486 - RNA, 19 nt, Pseudomonas aeruginosa PA01
agucgcccggcucgcccau

SEQ ID NO: 3375487 - RNA, 17 nt, Pseudomonas aeruginosa PA01
agucgccgccaguucgg

SEQ ID NO: 3375488 - RNA, 14 nt, Pseudomonas aeruginosa PA01
agucgccggcaucg

SEQ ID NO: 3375489 - RNA, 15 nt, Pseudomonas aeruginosa PA01
agucgccggucagag

SEQ ID NO: 3375490 - RNA, 17 nt, Pseudomonas aeruginosa PA01
agucgccguucagguuc

SEQ ID NO: 3375491 - RNA, 17 nt, Pseudomonas aeruginosa PA01
agucgccuggcccugga

SEQ ID NO: 3375492 - RNA, 20 nt, Pseudomonas aeruginosa PA01
agucgcgcccagugcccggc

SEQ ID NO: 3375493 - RNA, 15 nt, Pseudomonas aeruginosa PA01
agucgcggcccuggu

SEQ ID NO: 3375494 - RNA, 18 nt, Pseudomonas aeruginosa PA01
agucgcggggcggauugc

SEQ ID NO: 3375495 - RNA, 21 nt, Pseudomonas aeruginosa PA01
agucgcgguugcugugcaccc

SEQ ID NO: 3375496 - RNA, 23 nt, Pseudomonas aeruginosa PA01
agucgcgguugcugugcacccag

SEQ ID NO: 3375497 - RNA, 18 nt, Pseudomonas aeruginosa PA01
agucgcucauggcgccgc

SEQ ID NO: 3375498 - RNA, 18 nt, Pseudomonas aeruginosa PA01
agucgcugcucggccuug

SEQ ID NO: 3375499 - RNA, 17 nt, Pseudomonas aeruginosa PA01
agucgcugcuggcgccg

SEQ ID NO: 3375500 - RNA, 18 nt, Pseudomonas aeruginosa PA01
agucgcugcuggcgccgc

SEQ ID NO: 3375501 - RNA, 21 nt, Pseudomonas aeruginosa PA01
agucggaacgaccgguagcca

SEQ ID NO: 3375502 - RNA, 13 nt, Pseudomonas aeruginosa PA01
agucggccaggcg

SEQ ID NO: 3375503 - RNA, 17 nt, Pseudomonas aeruginosa PA01
agucggccaggcgccag

SEQ ID NO: 3375504 - RNA, 13 nt, Pseudomonas aeruginosa PA01
agucggccgccca

SEQ ID NO: 3375505 - RNA, 16 nt, Pseudomonas aeruginosa PA01
agucggccugcaccag

SEQ ID NO: 3375506 - RNA, 22 nt, Pseudomonas aeruginosa PA01
agucggccuggcucaugucgug

SEQ ID NO: 3375507 - RNA, 21 nt, Pseudomonas aeruginosa PA01
agucggcgacgaugccgccgc

SEQ ID NO: 3375508 - RNA, 18 nt, Pseudomonas aeruginosa PA01
agucggcgagccggcgca

SEQ ID NO: 3375509 - RNA, 16 nt, Pseudomonas aeruginosa PA01
agucggcgaugcgcug

SEQ ID NO: 3375510 - RNA, 13 nt, Pseudomonas aeruginosa PA01
agucggcgcgcca

SEQ ID NO: 3375511 - RNA, 17 nt, Pseudomonas aeruginosa PA01
agucggcggguccgcgu

SEQ ID NO: 3375512 - RNA, 22 nt, Pseudomonas aeruginosa PA01
agucggcggucuugaucacguc

SEQ ID NO: 3375513 - RNA, 13 nt, Pseudomonas aeruginosa PA01
agucggggcaggc

SEQ ID NO: 3375514 - RNA, 16 nt, Pseudomonas aeruginosa PA01
agucggggcaggcgca

SEQ ID NO: 3375515 - RNA, 19 nt, Pseudomonas aeruginosa PA01
agucggggcaggcgcaggc

SEQ ID NO: 3375516 - RNA, 14 nt, Pseudomonas aeruginosa PA01
agucgguagagcaa

SEQ ID NO: 3375517 - RNA, 20 nt, Pseudomonas aeruginosa PA01
agucggugugaccuucaacg

SEQ ID NO: 3375518 - RNA, 22 nt, Pseudomonas aeruginosa PA01
agucgguuagaauaccggccug

SEQ ID NO: 3375519 - RNA, 17 nt, Pseudomonas aeruginosa PA01
agucguagcgcaugccg

SEQ ID NO: 3375520 - RNA, 19 nt, Pseudomonas aeruginosa PA01
agucgucgcgcagcuccuc

SEQ ID NO: 3375521 - RNA, 12 nt, Pseudomonas aeruginosa PA01
agucgugcaggu

SEQ ID NO: 3375522 - RNA, 18 nt, Pseudomonas aeruginosa PA01
agucguucccggccuggc

SEQ ID NO: 3375523 - RNA, 13 nt, Pseudomonas aeruginosa PA01
agucguugaagac

SEQ ID NO: 3375524 - RNA, 18 nt, Pseudomonas aeruginosa PA01
agucguugacggugcugu

SEQ ID NO: 3375525 - RNA, 11 nt, Pseudomonas aeruginosa PA01
agucuccagcg

SEQ ID NO: 3375526 - RNA, 17 nt, Pseudomonas aeruginosa PA01
agucuccagcgaauagc

SEQ ID NO: 3375527 - RNA, 19 nt, Pseudomonas aeruginosa PA01
agucugccuguccgcugcg

SEQ ID NO: 3375528 - RNA, 14 nt, Pseudomonas aeruginosa PA01
agucugugaucagg

SEQ ID NO: 3375529 - RNA, 11 nt, Pseudomonas aeruginosa PA01
agucuuccugc

SEQ ID NO: 3375530 - RNA, 19 nt, Pseudomonas aeruginosa PA01
agucuucucgguggugaca

SEQ ID NO: 3375531 - RNA, 19 nt, Pseudomonas aeruginosa PA01
agucuuucagcuucagggu

SEQ ID NO: 3375532 - RNA, 19 nt, Pseudomonas aeruginosa PA01
agugaagagcucccugccg

SEQ ID NO: 3375533 - RNA, 24 nt, Pseudomonas aeruginosa PA01
agugacauccucccugcccgcucg

SEQ ID NO: 3375534 - RNA, 16 nt, Pseudomonas aeruginosa PA01
agugagccccggcguc

SEQ ID NO: 3375535 - RNA, 17 nt, Pseudomonas aeruginosa PA01
agugaggccgagccgac

SEQ ID NO: 3375536 - RNA, 19 nt, Pseudomonas aeruginosa PA01
agugaggccgagccgacau

SEQ ID NO: 3375537 - RNA, 13 nt, Pseudomonas aeruginosa PA01
agugcaacaccug

SEQ ID NO: 3375538 - RNA, 17 nt, Pseudomonas aeruginosa PA01
agugcaacaccuggcgc

SEQ ID NO: 3375539 - RNA, 19 nt, Pseudomonas aeruginosa PA01
agugcaacaccuggcgcuc

SEQ ID NO: 3375540 - RNA, 21 nt, Pseudomonas aeruginosa PA01
agugcagggcguccaguagcg

SEQ ID NO: 3375541 - RNA, 18 nt, Pseudomonas aeruginosa PA01
agugcaucagccuggcca

SEQ ID NO: 3375542 - RNA, 18 nt, Pseudomonas aeruginosa PA01
agugcaucggccgccagg

SEQ ID NO: 3375543 - RNA, 17 nt, Pseudomonas aeruginosa PA01
agugccagcagacgcuc

SEQ ID NO: 3375544 - RNA, 20 nt, Pseudomonas aeruginosa PA01
agugcccaggcgcuggcgcc

SEQ ID NO: 3375545 - RNA, 23 nt, Pseudomonas aeruginosa PA01
agugcccaggcgcuggcgccgau

SEQ ID NO: 3375546 - RNA, 20 nt, Pseudomonas aeruginosa PA01
agugcccccggcaacacccu

SEQ ID NO: 3375547 - RNA, 13 nt, Pseudomonas aeruginosa PA01
agugccgaccaca

SEQ ID NO: 3375548 - RNA, 21 nt, Pseudomonas aeruginosa PA01
agugccgaccacaugggcgac

SEQ ID NO: 3375549 - RNA, 20 nt, Pseudomonas aeruginosa PA01
agugccggcgcgucgcugcg

SEQ ID NO: 3375550 - RNA, 12 nt, Pseudomonas aeruginosa PA01
agugccugcacc

SEQ ID NO: 3375551 - RNA, 18 nt, Pseudomonas aeruginosa PA01
agugccugcaccacgcag

SEQ ID NO: 3375552 - RNA, 16 nt, Pseudomonas aeruginosa PA01
agugcgagucggcgac

SEQ ID NO: 3375553 - RNA, 13 nt, Pseudomonas aeruginosa PA01
agugcgcagcagc

SEQ ID NO: 3375554 - RNA, 17 nt, Pseudomonas aeruginosa PA01
agugcgcagcagcgucg

SEQ ID NO: 3375555 - RNA, 20 nt, Pseudomonas aeruginosa PA01
agugcgccauauuucgaagg

SEQ ID NO: 3375556 - RNA, 21 nt, Pseudomonas aeruginosa PA01
agugcgccauauuucgaaggg

SEQ ID NO: 3375557 - RNA, 21 nt, Pseudomonas aeruginosa PA01
agugcgcccagcagcaggccg

SEQ ID NO: 3375558 - RNA, 20 nt, Pseudomonas aeruginosa PA01
agugcgccgcagcgcaaguc

SEQ ID NO: 3375559 - RNA, 17 nt, Pseudomonas aeruginosa PA01
agugcgccgggugccgg

SEQ ID NO: 3375560 - RNA, 11 nt, Pseudomonas aeruginosa PA01
agugcgcgguc

SEQ ID NO: 3375561 - RNA, 13 nt, Pseudomonas aeruginosa PA01
agugcggccaggc

SEQ ID NO: 3375562 - RNA, 18 nt, Pseudomonas aeruginosa PA01
agugcggcgggcgcccgc

SEQ ID NO: 3375563 - RNA, 20 nt, Pseudomonas aeruginosa PA01
agugcggcgggcgcccgcca

SEQ ID NO: 3375564 - RNA, 21 nt, Pseudomonas aeruginosa PA01
agugcugaguuucacgucgag

SEQ ID NO: 3375565 - RNA, 12 nt, Pseudomonas aeruginosa PA01
agugcuggcgca

SEQ ID NO: 3375566 - RNA, 22 nt, Pseudomonas aeruginosa PA01
agugcugggcgaccuucagcgg

SEQ ID NO: 3375567 - RNA, 16 nt, Pseudomonas aeruginosa PA01
agugcuggguggaggc

SEQ ID NO: 3375568 - RNA, 17 nt, Pseudomonas aeruginosa PA01
aguggaagccguggcgg

SEQ ID NO: 3375569 - RNA, 15 nt, Pseudomonas aeruginosa PA01
aguugcaggccggcg

SEQ ID NO: 3375570 - RNA, 16 nt, Pseudomonas aeruginosa PA01
aguugcaggccggcga

SEQ ID NO: 3375571 - RNA, 18 nt, Pseudomonas aeruginosa PA01
aguugccagacgaucagc

SEQ ID NO: 3375572 - RNA, 20 nt, Pseudomonas aeruginosa PA01
aguugccagacgaucagcgg

SEQ ID NO: 3375573 - RNA, 22 nt, Pseudomonas aeruginosa PA01
aguugccaggauuucuccugcg

SEQ ID NO: 3375574 - RNA, 20 nt, Pseudomonas aeruginosa PA01
aguugccgcagcagcggcga

SEQ ID NO: 3375575 - RNA, 20 nt, Pseudomonas aeruginosa PA01
aguugcgauagaccaggaag

SEQ ID NO: 3375576 - RNA, 14 nt, Pseudomonas aeruginosa PA01
aguugcgccgccug

SEQ ID NO: 3375577 - RNA, 19 nt, Pseudomonas aeruginosa PA01
aguugcgcgccggcgggga

SEQ ID NO: 3375578 - RNA, 20 nt, Pseudomonas aeruginosa PA01
aguugcgcuccgguggcgga

SEQ ID NO: 3375579 - RNA, 22 nt, Pseudomonas aeruginosa PA01
aguugcggagaauugcguugga

SEQ ID NO: 3375580 - RNA, 14 nt, Pseudomonas aeruginosa PA01
aguugcgggcgcag

SEQ ID NO: 3375581 - RNA, 21 nt, Pseudomonas aeruginosa PA01
aguugcucgcuccgagcaggc

SEQ ID NO: 3375582 - RNA, 18 nt, Pseudomonas aeruginosa PA01
aguugcuggaugucggcg

SEQ ID NO: 3375583 - RNA, 22 nt, Pseudomonas aeruginosa PA01
aguuggaaccaguugccgagcu

SEQ ID NO: 3375584 - RNA, 21 nt, Pseudomonas aeruginosa PA01
aguuggaaggaucgagccagc

SEQ ID NO: 3375585 - RNA, 20 nt, Pseudomonas aeruginosa PA01
aguuggaaguugccgccagc

SEQ ID NO: 3375586 - RNA, 16 nt, Pseudomonas aeruginosa PA01
aguuggacgcggccug

SEQ ID NO: 3375587 - RNA, 20 nt, Pseudomonas aeruginosa PA01
aguuggacugcgaggcggug

SEQ ID NO: 3375588 - RNA, 13 nt, Pseudomonas aeruginosa PA01
aguuggccgggca

SEQ ID NO: 3375589 - RNA, 13 nt, Pseudomonas aeruginosa PA01
aguugggccagga

SEQ ID NO: 3375590 - RNA, 16 nt, Pseudomonas aeruginosa PA01
aguugggcgaccugcu

SEQ ID NO: 3375591 - RNA, 17 nt, Pseudomonas aeruginosa PA01
aguuggugcacgcgccg

SEQ ID NO: 3375592 - RNA, 15 nt, Pseudomonas aeruginosa PA01
aguuguacagcgagg

SEQ ID NO: 3375593 - RNA, 21 nt, Pseudomonas aeruginosa PA01
aguuguacagcgaggcccgcg

SEQ ID NO: 3375594 - RNA, 13 nt, Pseudomonas aeruginosa PA01
aguuuagccgcca

SEQ ID NO: 3375595 - RNA, 20 nt, Pseudomonas aeruginosa PA01
aguuucacgucgagcacgcc

SEQ ID NO: 3375596 - RNA, 16 nt, Pseudomonas aeruginosa PA01
aguuucaucucggcgc

SEQ ID NO: 3375597 - RNA, 16 nt, Pseudomonas aeruginosa PA01
aguuucccggcgcggc

SEQ ID NO: 3375598 - RNA, 23 nt, Pseudomonas aeruginosa PA01
aguuuccgcgaggaucagccacg

SEQ ID NO: 3375599 - RNA, 19 nt, Pseudomonas aeruginosa PA01
aguuuccgggaaauuucgc

SEQ ID NO: 3375600 - RNA, 22 nt, Pseudomonas aeruginosa PA01
aguuucuucgcgugggccaggg

SEQ ID NO: 3375601 - RNA, 16 nt, Pseudomonas aeruginosa PA01
aguuugcccagcgccg

SEQ ID NO: 3375602 - RNA, 17 nt, Pseudomonas aeruginosa PA01
aguuugcccagcgccgc

SEQ ID NO: 3375603 - RNA, 13 nt, Pseudomonas aeruginosa PA01
auaaaaagccccg

SEQ ID NO: 3375604 - RNA, 19 nt, Pseudomonas aeruginosa PA01
auaaccccuuugccgagcg

SEQ ID NO: 3375605 - RNA, 20 nt, Pseudomonas aeruginosa PA01
auaaccgcaucgcgguuauc

SEQ ID NO: 3375606 - RNA, 20 nt, Pseudomonas aeruginosa PA01
auaaccgcgagcgguuauuc

SEQ ID NO: 3375607 - RNA, 21 nt, Pseudomonas aeruginosa PA01
auaaccgcguugcgguuauuc

SEQ ID NO: 3375608 - RNA, 16 nt, Pseudomonas aeruginosa PA01
auaaccgcucgcgguu

SEQ ID NO: 3375609 - RNA, 20 nt, Pseudomonas aeruginosa PA01
auaaccgcugcgcgguuauc

SEQ ID NO: 3375610 - RNA, 21 nt, Pseudomonas aeruginosa PA01
auaacgccacaggcguuaucc

SEQ ID NO: 3375611 - RNA, 21 nt, Pseudomonas aeruginosa PA01
auaacgccaccggcguuaucc

SEQ ID NO: 3375612 - RNA, 21 nt, Pseudomonas aeruginosa PA01
auaacgccgcaggcguuaucc

SEQ ID NO: 3375613 - RNA, 20 nt, Pseudomonas aeruginosa PA01
auaacgccuguggcguuauu

SEQ ID NO: 3375614 - RNA, 11 nt, Pseudomonas aeruginosa PA01
auaaggcgugc

SEQ ID NO: 3375615 - RNA, 17 nt, Pseudomonas aeruginosa PA01
auaaggcgugcaguacu

SEQ ID NO: 3375616 - RNA, 22 nt, Pseudomonas aeruginosa PA01
auaaugcgcaccacucccggcg

SEQ ID NO: 3375617 - RNA, 18 nt, Pseudomonas aeruginosa PA01
auacaaagcauuucuuca

SEQ ID NO: 3375618 - RNA, 20 nt, Pseudomonas aeruginosa PA01
auacaccaggccggcggccg

SEQ ID NO: 3375619 - RNA, 13 nt, Pseudomonas aeruginosa PA01
auacaccgcugcg

SEQ ID NO: 3375620 - RNA, 16 nt, Pseudomonas aeruginosa PA01
auacaccgcugcgccg

SEQ ID NO: 3375621 - RNA, 19 nt, Pseudomonas aeruginosa PA01
auacaccugcaacucggcg

SEQ ID NO: 3375622 - RNA, 11 nt, Pseudomonas aeruginosa PA01
auacagcagcc

SEQ ID NO: 3375623 - RNA, 14 nt, Pseudomonas aeruginosa PA01
auacagcagccaag

SEQ ID NO: 3375624 - RNA, 23 nt, Pseudomonas aeruginosa PA01
auacagcucgcugucgccgagca

SEQ ID NO: 3375625 - RNA, 17 nt, Pseudomonas aeruginosa PA01
auacaggcgcagcagca

SEQ ID NO: 3375626 - RNA, 14 nt, Pseudomonas aeruginosa PA01
auacaugcugcuca

SEQ ID NO: 3375627 - RNA, 16 nt, Pseudomonas aeruginosa PA01
auaccacguggccggc

SEQ ID NO: 3375628 - RNA, 12 nt, Pseudomonas aeruginosa PA01
auaccagcgccg

SEQ ID NO: 3375629 - RNA, 13 nt, Pseudomonas aeruginosa PA01
auaccagcgccgc

SEQ ID NO: 3375630 - RNA, 12 nt, Pseudomonas aeruginosa PA01
auaccagcggcu

SEQ ID NO: 3375631 - RNA, 17 nt, Pseudomonas aeruginosa PA01
auaccagugccgcggug

SEQ ID NO: 3375632 - RNA, 13 nt, Pseudomonas aeruginosa PA01
auacccagcgggc

SEQ ID NO: 3375633 - RNA, 19 nt, Pseudomonas aeruginosa PA01
auaccccguuguacccggc

SEQ ID NO: 3375634 - RNA, 17 nt, Pseudomonas aeruginosa PA01
auacccuggccggccuc

SEQ ID NO: 3375635 - RNA, 21 nt, Pseudomonas aeruginosa PA01
auacccugggagccgccggac

SEQ ID NO: 3375636 - RNA, 15 nt, Pseudomonas aeruginosa PA01
auacccuucaucccu

SEQ ID NO: 3375637 - RNA, 23 nt, Pseudomonas aeruginosa PA01
auaccgagggugcagagcagagu

SEQ ID NO: 3375638 - RNA, 12 nt, Pseudomonas aeruginosa PA01
auaccgccagcu

SEQ ID NO: 3375639 - RNA, 15 nt, Pseudomonas aeruginosa PA01
auaccgcgcgcgcaa

SEQ ID NO: 3375640 - RNA, 11 nt, Pseudomonas aeruginosa PA01
auaccgcugcg

SEQ ID NO: 3375641 - RNA, 14 nt, Pseudomonas aeruginosa PA01
auaccgcugcgcgg

SEQ ID NO: 3375642 - RNA, 16 nt, Pseudomonas aeruginosa PA01
auaccgcuggccaggu

SEQ ID NO: 3375643 - RNA, 23 nt, Pseudomonas aeruginosa PA01
auaccggccaucagcaccaggaa

SEQ ID NO: 3375644 - RNA, 21 nt, Pseudomonas aeruginosa PA01
auaccggcguugaacugcccg

SEQ ID NO: 3375645 - RNA, 15 nt, Pseudomonas aeruginosa PA01
auaccuccagccagc

SEQ ID NO: 3375646 - RNA, 23 nt, Pseudomonas aeruginosa PA01
auaccuccagccagcagcccggc

SEQ ID NO: 3375647 - RNA, 19 nt, Pseudomonas aeruginosa PA01
auaccucguuucccggcgc

SEQ ID NO: 3375648 - RNA, 17 nt, Pseudomonas aeruginosa PA01
auacgcaucugcucgag

SEQ ID NO: 3375649 - RNA, 15 nt, Pseudomonas aeruginosa PA01
auacgcucggcgucg

SEQ ID NO: 3375650 - RNA, 20 nt, Pseudomonas aeruginosa PA01
auacgcucgggcccucccaa

SEQ ID NO: 3375651 - RNA, 17 nt, Pseudomonas aeruginosa PA01
auacggcaggguagcca

SEQ ID NO: 3375652 - RNA, 22 nt, Pseudomonas aeruginosa PA01
auacggcaggguagccacgccg

SEQ ID NO: 3375653 - RNA, 23 nt, Pseudomonas aeruginosa PA01
auacgguuugaggcguugggguu

SEQ ID NO: 3375654 - RNA, 20 nt, Pseudomonas aeruginosa PA01
auacgucuucgauggcggcc

SEQ ID NO: 3375655 - RNA, 17 nt, Pseudomonas aeruginosa PA01
auacucaugcaggcguc

SEQ ID NO: 3375656 - RNA, 14 nt, Pseudomonas aeruginosa PA01
auacugcacgccca

SEQ ID NO: 3375657 - RNA, 16 nt, Pseudomonas aeruginosa PA01
auacugggcggcgacc

SEQ ID NO: 3375658 - RNA, 18 nt, Pseudomonas aeruginosa PA01
auagaaaccgucuuaaau

SEQ ID NO: 3375659 - RNA, 16 nt, Pseudomonas aeruginosa PA01
auagaaggucaccgcu

SEQ ID NO: 3375660 - RNA, 19 nt, Pseudomonas aeruginosa PA01
auagaaggucaccgcucgc

SEQ ID NO: 3375661 - RNA, 12 nt, Pseudomonas aeruginosa PA01
auagaccagcac

SEQ ID NO: 3375662 - RNA, 14 nt, Pseudomonas aeruginosa PA01
auagacgccgcuga

SEQ ID NO: 3375663 - RNA, 13 nt, Pseudomonas aeruginosa PA01
auagacgccggcg

SEQ ID NO: 3375664 - RNA, 17 nt, Pseudomonas aeruginosa PA01
auagcagcgccgcgccu

SEQ ID NO: 3375665 - RNA, 15 nt, Pseudomonas aeruginosa PA01
auagccaccgccgac

SEQ ID NO: 3375666 - RNA, 15 nt, Pseudomonas aeruginosa PA01
auagccgacgaaggc

SEQ ID NO: 3375667 - RNA, 22 nt, Pseudomonas aeruginosa PA01
auagccggcgaaccaggcggcc

SEQ ID NO: 3375668 - RNA, 19 nt, Pseudomonas aeruginosa PA01
auagccggcgaugccgccc

SEQ ID NO: 3375669 - RNA, 15 nt, Pseudomonas aeruginosa PA01
auagccggcgcgccc

SEQ ID NO: 3375670 - RNA, 22 nt, Pseudomonas aeruginosa PA01
auagccguugaggccgucgaag

SEQ ID NO: 3375671 - RNA, 13 nt, Pseudomonas aeruginosa PA01
aucagccagccca

SEQ ID NO: 3375672 - RNA, 14 nt, Pseudomonas aeruginosa PA01
aucagccagggcaa

SEQ ID NO: 3375673 - RNA, 22 nt, Pseudomonas aeruginosa PA01
aucagccagggcaacgccaggc

SEQ ID NO: 3375674 - RNA, 15 nt, Pseudomonas aeruginosa PA01
aucagcccgcugacc

SEQ ID NO: 3375675 - RNA, 18 nt, Pseudomonas aeruginosa PA01
aucagcccgucggccucg

SEQ ID NO: 3375676 - RNA, 22 nt, Pseudomonas aeruginosa PA01
aucagcccuucgcgcucgacga

SEQ ID NO: 3375677 - RNA, 16 nt, Pseudomonas aeruginosa PA01
aucagccgcgcgcugg

SEQ ID NO: 3375678 - RNA, 22 nt, Pseudomonas aeruginosa PA01
aucagccgcuccaggaucgccu

SEQ ID NO: 3375679 - RNA, 15 nt, Pseudomonas aeruginosa PA01
aucagccggcgcgcu

SEQ ID NO: 3375680 - RNA, 13 nt, Pseudomonas aeruginosa PA01
aucagcgaaaugg

SEQ ID NO: 3375681 - RNA, 13 nt, Pseudomonas aeruginosa PA01
aucagcgaacccg

SEQ ID NO: 3375682 - RNA, 18 nt, Pseudomonas aeruginosa PA01
aucagcgagcuucgccgc

SEQ ID NO: 3375683 - RNA, 20 nt, Pseudomonas aeruginosa PA01
aucagcgagcuucgccgcgc

SEQ ID NO: 3375684 - RNA, 21 nt, Pseudomonas aeruginosa PA01
aucagcgcauaggccugggcg

SEQ ID NO: 3375685 - RNA, 14 nt, Pseudomonas aeruginosa PA01
aucagcgccagggc

SEQ ID NO: 3375686 - RNA, 16 nt, Pseudomonas aeruginosa PA01
aucagcgccagggcau

SEQ ID NO: 3375687 - RNA, 14 nt, Pseudomonas aeruginosa PA01
aucagcgcccggca

SEQ ID NO: 3375688 - RNA, 13 nt, Pseudomonas aeruginosa PA01
aucagcgccgccu

SEQ ID NO: 3375689 - RNA, 13 nt, Pseudomonas aeruginosa PA01
aucagcgcgccuu

SEQ ID NO: 3375690 - RNA, 20 nt, Pseudomonas aeruginosa PA01
aucagcgcgcguuccagguc

SEQ ID NO: 3375691 - RNA, 18 nt, Pseudomonas aeruginosa PA01
aucagcgcggccacuucg

SEQ ID NO: 3375692 - RNA, 13 nt, Pseudomonas aeruginosa PA01
aucagcgcgguga

SEQ ID NO: 3375693 - RNA, 19 nt, Pseudomonas aeruginosa PA01
aucagcgcuuccagggugg

SEQ ID NO: 3375694 - RNA, 16 nt, Pseudomonas aeruginosa PA01
aucagcggcccgagca

SEQ ID NO: 3375695 - RNA, 21 nt, Pseudomonas aeruginosa PA01
aucagcggcggucccaucagc

SEQ ID NO: 3375696 - RNA, 21 nt, Pseudomonas aeruginosa PA01
aucagcgggccuuuucuuugg

SEQ ID NO: 3375697 - RNA, 23 nt, Pseudomonas aeruginosa PA01
aucagcggguaacccagggugcg

SEQ ID NO: 3375698 - RNA, 18 nt, Pseudomonas aeruginosa PA01
aucagcuccacgucggcc

SEQ ID NO: 3375699 - RNA, 20 nt, Pseudomonas aeruginosa PA01
aucagcuccacgucggcccg

SEQ ID NO: 3375700 - RNA, 14 nt, Pseudomonas aeruginosa PA01
aucagcucgcggua

SEQ ID NO: 3375701 - RNA, 16 nt, Pseudomonas aeruginosa PA01
aucagcucguugcccg

SEQ ID NO: 3375702 - RNA, 19 nt, Pseudomonas aeruginosa PA01
aucagcucguugcccggcu

SEQ ID NO: 3375703 - RNA, 13 nt, Pseudomonas aeruginosa PA01
aucagcuucagcu

SEQ ID NO: 3375704 - RNA, 18 nt, Pseudomonas aeruginosa PA01
aucagcuucuucagcagc

SEQ ID NO: 3375705 - RNA, 15 nt, Pseudomonas aeruginosa PA01
aucagcuuguggucg

SEQ ID NO: 3375706 - RNA, 15 nt, Pseudomonas aeruginosa PA01
aucaggaggaucgcc

SEQ ID NO: 3375707 - RNA, 19 nt, Pseudomonas aeruginosa PA01
aucaggaggaucgccagga

SEQ ID NO: 3375708 - RNA, 23 nt, Pseudomonas aeruginosa PA01
aucaggaggaucgccaggacgcu

SEQ ID NO: 3375709 - RNA, 14 nt, Pseudomonas aeruginosa PA01
aucaggcagcgcgc

SEQ ID NO: 3375710 - RNA, 23 nt, Pseudomonas aeruginosa PA01
aucaggcauccccggaccagggc

SEQ ID NO: 3375711 - RNA, 12 nt, Pseudomonas aeruginosa PA01
aucaggccgcgg

SEQ ID NO: 3375712 - RNA, 13 nt, Pseudomonas aeruginosa PA01
aucaggcgcaugc

SEQ ID NO: 3375713 - RNA, 17 nt, Pseudomonas aeruginosa PA01
aucaggcgcuccgggcu

SEQ ID NO: 3375714 - RNA, 22 nt, Pseudomonas aeruginosa PA01
aucaggcgcuuguccaucggcu

SEQ ID NO: 3375715 - RNA, 23 nt, Pseudomonas aeruginosa PA01
aucaggcguaggccgucgcugcc

SEQ ID NO: 3375716 - RNA, 18 nt, Pseudomonas aeruginosa PA01
aucaggcucaggccgggc

SEQ ID NO: 3375717 - RNA, 23 nt, Pseudomonas aeruginosa PA01
aucaggcugaagcggccgccgaa

SEQ ID NO: 3375718 - RNA, 13 nt, Pseudomonas aeruginosa PA01
aucaggcugccga

SEQ ID NO: 3375719 - RNA, 17 nt, Pseudomonas aeruginosa PA01
aucagggcaccgccgag

SEQ ID NO: 3375720 - RNA, 17 nt, Pseudomonas aeruginosa PA01
aucagggccucgccacg

SEQ ID NO: 3375721 - RNA, 14 nt, Pseudomonas aeruginosa PA01
aucagggcugggcg

SEQ ID NO: 3375722 - RNA, 23 nt, Pseudomonas aeruginosa PA01
aucagggcugggcgcccuucagc

SEQ ID NO: 3375723 - RNA, 21 nt, Pseudomonas aeruginosa PA01
aucagggucuucaggcguggg

SEQ ID NO: 3375724 - RNA, 16 nt, Pseudomonas aeruginosa PA01
aucagguaggccggcg

SEQ ID NO: 3375725 - RNA, 13 nt, Pseudomonas aeruginosa PA01
aucaggucgccag

SEQ ID NO: 3375726 - RNA, 15 nt, Pseudomonas aeruginosa PA01
aucaggucgccagcg

SEQ ID NO: 3375727 - RNA, 13 nt, Pseudomonas aeruginosa PA01
aucaggucgccgc

SEQ ID NO: 3375728 - RNA, 14 nt, Pseudomonas aeruginosa PA01
aucaggucgccgcc

SEQ ID NO: 3375729 - RNA, 21 nt, Pseudomonas aeruginosa PA01
aucaggucgccgcugaauacc

SEQ ID NO: 3375730 - RNA, 22 nt, Pseudomonas aeruginosa PA01
aucaggucgccgcugaauacca

SEQ ID NO: 3375731 - RNA, 11 nt, Pseudomonas aeruginosa PA01
aucaggucggc

SEQ ID NO: 3375732 - RNA, 14 nt, Pseudomonas aeruginosa PA01
aucaggucggccgc

SEQ ID NO: 3375733 - RNA, 16 nt, Pseudomonas aeruginosa PA01
aucagguugaagagca

SEQ ID NO: 3375734 - RNA, 15 nt, Pseudomonas aeruginosa PA01
aucaguaccggcagc

SEQ ID NO: 3375735 - RNA, 19 nt, Pseudomonas aeruginosa PA01
aucagucaggaucggcgcc

SEQ ID NO: 3375736 - RNA, 19 nt, Pseudomonas aeruginosa PA01
aucagucgcugcucggccu

SEQ ID NO: 3375737 - RNA, 20 nt, Pseudomonas aeruginosa PA01
aucagucgucguccagcggg

SEQ ID NO: 3375738 - RNA, 22 nt, Pseudomonas aeruginosa PA01
aucagugacauccucccugccc

SEQ ID NO: 3375739 - RNA, 18 nt, Pseudomonas aeruginosa PA01
aucagugcaucggccgcc

SEQ ID NO: 3375740 - RNA, 22 nt, Pseudomonas aeruginosa PA01
aucagugcaucggccgccaggc

SEQ ID NO: 3375741 - RNA, 17 nt, Pseudomonas aeruginosa PA01
aucaguggucgcagcuc

SEQ ID NO: 3375742 - RNA, 19 nt, Pseudomonas aeruginosa PA01
aucaguggucgcagcucca

SEQ ID NO: 3375743 - RNA, 13 nt, Pseudomonas aeruginosa PA01
aucaucagcaggg

SEQ ID NO: 3375744 - RNA, 16 nt, Pseudomonas aeruginosa PA01
aucaucaucagguaga

SEQ ID NO: 3375745 - RNA, 13 nt, Pseudomonas aeruginosa PA01
aucauccagcccc

SEQ ID NO: 3375746 - RNA, 15 nt, Pseudomonas aeruginosa PA01
aucaucggcccuggg

SEQ ID NO: 3375747 - RNA, 15 nt, Pseudomonas aeruginosa PA01
aucaucugggccauc

SEQ ID NO: 3375748 - RNA, 21 nt, Pseudomonas aeruginosa PA01
aucaucugggccaucgccggc

SEQ ID NO: 3375749 - RNA, 22 nt, Pseudomonas aeruginosa PA01
aucaucugggccaucgccggcc

SEQ ID NO: 3375750 - RNA, 13 nt, Pseudomonas aeruginosa PA01
aucaugccgagca

SEQ ID NO: 3375751 - RNA, 17 nt, Pseudomonas aeruginosa PA01
aucaugccgagcaucag

SEQ ID NO: 3375752 - RNA, 18 nt, Pseudomonas aeruginosa PA01
aucaugggggccagcagg

SEQ ID NO: 3375753 - RNA, 23 nt, Pseudomonas aeruginosa PA01
aucauguagacgaugccguucuc

SEQ ID NO: 3375754 - RNA, 13 nt, Pseudomonas aeruginosa PA01
auccacagcgugc

SEQ ID NO: 3375755 - RNA, 13 nt, Pseudomonas aeruginosa PA01
auccacaggcggc

SEQ ID NO: 3375756 - RNA, 14 nt, Pseudomonas aeruginosa PA01
auccaccgccaggg

SEQ ID NO: 3375757 - RNA, 15 nt, Pseudomonas aeruginosa PA01
auccaccgccagggc

SEQ ID NO: 3375758 - RNA, 19 nt, Pseudomonas aeruginosa PA01
auccaccggacccggcugc

SEQ ID NO: 3375759 - RNA, 17 nt, Pseudomonas aeruginosa PA01
auccaccuugccgcgcc

SEQ ID NO: 3375760 - RNA, 18 nt, Pseudomonas aeruginosa PA01
auccacgacgucggcggc

SEQ ID NO: 3375761 - RNA, 15 nt, Pseudomonas aeruginosa PA01
auccacgccgucgca

SEQ ID NO: 3375762 - RNA, 15 nt, Pseudomonas aeruginosa PA01
auccacgccuggccc

SEQ ID NO: 3375763 - RNA, 18 nt, Pseudomonas aeruginosa PA01
auccacuugccgccgccg

SEQ ID NO: 3375764 - RNA, 20 nt, Pseudomonas aeruginosa PA01
auccacuugccgccgccgga

SEQ ID NO: 3375765 - RNA, 15 nt, Pseudomonas aeruginosa PA01
auccacuugccgucc

SEQ ID NO: 3375766 - RNA, 16 nt, Pseudomonas aeruginosa PA01
auccagcagucgcggc

SEQ ID NO: 3375767 - RNA, 20 nt, Pseudomonas aeruginosa PA01
auccagcggacgcuuguccu

SEQ ID NO: 3375768 - RNA, 22 nt, Pseudomonas aeruginosa PA01
auccagcggacgcuuguccuuc

SEQ ID NO: 3375769 - RNA, 15 nt, Pseudomonas aeruginosa PA01
auccagcggcagccc

SEQ ID NO: 3375770 - RNA, 17 nt, Pseudomonas aeruginosa PA01
auccagcggcagccccu

SEQ ID NO: 3375771 - RNA, 16 nt, Pseudomonas aeruginosa PA01
auccagcggccgcgag

SEQ ID NO: 3375772 - RNA, 14 nt, Pseudomonas aeruginosa PA01
auccagcuggcgcg

SEQ ID NO: 3375773 - RNA, 22 nt, Pseudomonas aeruginosa PA01
auccaggcuuuccaccgccagc

SEQ ID NO: 3375774 - RNA, 16 nt, Pseudomonas aeruginosa PA01
auccgugccaggcgcu

SEQ ID NO: 3375775 - RNA, 14 nt, Pseudomonas aeruginosa PA01
auccgugcuggggg

SEQ ID NO: 3375776 - RNA, 16 nt, Pseudomonas aeruginosa PA01
auccguggcgagcgcg

SEQ ID NO: 3375777 - RNA, 17 nt, Pseudomonas aeruginosa PA01
auccuccaggccgccgg

SEQ ID NO: 3375778 - RNA, 23 nt, Pseudomonas aeruginosa PA01
auccucccugcccgcucggggca

SEQ ID NO: 3375779 - RNA, 17 nt, Pseudomonas aeruginosa PA01
auccuccgaggccacca

SEQ ID NO: 3375780 - RNA, 10 nt, Pseudomonas aeruginosa PA01
auccuccgcc

SEQ ID NO: 3375781 - RNA, 14 nt, Pseudomonas aeruginosa PA01
auccuccgccagcg

SEQ ID NO: 3375782 - RNA, 17 nt, Pseudomonas aeruginosa PA01
auccuccggacgccgaa

SEQ ID NO: 3375783 - RNA, 22 nt, Pseudomonas aeruginosa PA01
auccucgccccgccgggagcgg

SEQ ID NO: 3375784 - RNA, 21 nt, Pseudomonas aeruginosa PA01
auccucgccucgcgccagaga

SEQ ID NO: 3375785 - RNA, 18 nt, Pseudomonas aeruginosa PA01
auccucgcgcaccgccuc

SEQ ID NO: 3375786 - RNA, 20 nt, Pseudomonas aeruginosa PA01
auccucgcggaagucggcgg

SEQ ID NO: 3375787 - RNA, 21 nt, Pseudomonas aeruginosa PA01
auccucgcggaagucggcggg

SEQ ID NO: 3375788 - RNA, 16 nt, Pseudomonas aeruginosa PA01
auccucgucgauccgc

SEQ ID NO: 3375789 - RNA, 15 nt, Pseudomonas aeruginosa PA01
auccucguuccacgg

SEQ ID NO: 3375790 - RNA, 17 nt, Pseudomonas aeruginosa PA01
auccugaccccggccug

SEQ ID NO: 3375791 - RNA, 22 nt, Pseudomonas aeruginosa PA01
auccugaccccggccuggcugg

SEQ ID NO: 3375792 - RNA, 16 nt, Pseudomonas aeruginosa PA01
auccugaccguccugg

SEQ ID NO: 3375793 - RNA, 23 nt, Pseudomonas aeruginosa PA01
auccugcccguaccacguccaga

SEQ ID NO: 3375794 - RNA, 18 nt, Pseudomonas aeruginosa PA01
auccugcgcgccucuucc

SEQ ID NO: 3375795 - RNA, 20 nt, Pseudomonas aeruginosa PA01
auccugcgcgccucuuccug

SEQ ID NO: 3375796 - RNA, 21 nt, Pseudomonas aeruginosa PA01
auccugcgcgccucuuccugg

SEQ ID NO: 3375797 - RNA, 23 nt, Pseudomonas aeruginosa PA01
auccugcucagcggcccagcgcc

SEQ ID NO: 3375798 - RNA, 19 nt, Pseudomonas aeruginosa PA01
auccugcugguugaagccg

SEQ ID NO: 3375799 - RNA, 15 nt, Pseudomonas aeruginosa PA01
auccuggccggcggc

SEQ ID NO: 3375800 - RNA, 17 nt, Pseudomonas aeruginosa PA01
auccuggccggcggcgu

SEQ ID NO: 3375801 - RNA, 22 nt, Pseudomonas aeruginosa PA01
auccuggcgguucuggguggca

SEQ ID NO: 3375802 - RNA, 20 nt, Pseudomonas aeruginosa PA01
auccugggcgccagccgcca

SEQ ID NO: 3375803 - RNA, 23 nt, Pseudomonas aeruginosa PA01
auccuggguagauuuacaagccc

SEQ ID NO: 3375804 - RNA, 20 nt, Pseudomonas aeruginosa PA01
auccuguaguacaugacgaa

SEQ ID NO: 3375805 - RNA, 11 nt, Pseudomonas aeruginosa PA01
auccuguccgu

SEQ ID NO: 3375806 - RNA, 16 nt, Pseudomonas aeruginosa PA01
auccuucgcggcggcg

SEQ ID NO: 3375807 - RNA, 17 nt, Pseudomonas aeruginosa PA01
auccuucgcggcggcgc

SEQ ID NO: 3375808 - RNA, 15 nt, Pseudomonas aeruginosa PA01
auccuugagcacccg

SEQ ID NO: 3375809 - RNA, 17 nt, Pseudomonas aeruginosa PA01
auccuugagcacccggg

SEQ ID NO: 3375810 - RNA, 10 nt, Pseudomonas aeruginosa PA01
auccuugccg

SEQ ID NO: 3375811 - RNA, 14 nt, Pseudomonas aeruginosa PA01
auccuuggucaggg

SEQ ID NO: 3375812 - RNA, 17 nt, Pseudomonas aeruginosa PA01
auccuuggucagggugc

SEQ ID NO: 3375813 - RNA, 15 nt, Pseudomonas aeruginosa PA01
aucgaacccccgacc

SEQ ID NO: 3375814 - RNA, 16 nt, Pseudomonas aeruginosa PA01
aucgaacuggccagca

SEQ ID NO: 3375815 - RNA, 18 nt, Pseudomonas aeruginosa PA01
aucgaacuggccagcacc

SEQ ID NO: 3375816 - RNA, 19 nt, Pseudomonas aeruginosa PA01
aucgaagaaggcucaccgg

SEQ ID NO: 3375817 - RNA, 21 nt, Pseudomonas aeruginosa PA01
aucgaaggguuggccgcagca

SEQ ID NO: 3375818 - RNA, 15 nt, Pseudomonas aeruginosa PA01
aucgaagucgccauc

SEQ ID NO: 3375819 - RNA, 17 nt, Pseudomonas aeruginosa PA01
aucgacaauagcgccac

SEQ ID NO: 3375820 - RNA, 15 nt, Pseudomonas aeruginosa PA01
aucgacaccccgguc

SEQ ID NO: 3375821 - RNA, 23 nt, Pseudomonas aeruginosa PA01
aucgacaccccggucaggccgau

SEQ ID NO: 3375822 - RNA, 13 nt, Pseudomonas aeruginosa PA01
aucgacagcagcg

SEQ ID NO: 3375823 - RNA, 16 nt, Pseudomonas aeruginosa PA01
aucgacagcagcgcca

SEQ ID NO: 3375824 - RNA, 19 nt, Pseudomonas aeruginosa PA01
aucgacagcagcgccaggg

SEQ ID NO: 3375825 - RNA, 20 nt, Pseudomonas aeruginosa PA01
aucgacagcagcgccagggc

SEQ ID NO: 3375826 - RNA, 14 nt, Pseudomonas aeruginosa PA01
aucgacaggaugcg

SEQ ID NO: 3375827 - RNA, 19 nt, Pseudomonas aeruginosa PA01
aucgacaggccgccguaga

SEQ ID NO: 3375828 - RNA, 22 nt, Pseudomonas aeruginosa PA01
aucgacagggucgucuggguca

SEQ ID NO: 3375829 - RNA, 20 nt, Pseudomonas aeruginosa PA01
aucgaccagacgcagcagcu

SEQ ID NO: 3375830 - RNA, 14 nt, Pseudomonas aeruginosa PA01
aucgaccagcagcg

SEQ ID NO: 3375831 - RNA, 19 nt, Pseudomonas aeruginosa PA01
aucgaccagcagcggcuca

SEQ ID NO: 3375832 - RNA, 17 nt, Pseudomonas aeruginosa PA01
aucgaccaggucgccau

SEQ ID NO: 3375833 - RNA, 15 nt, Pseudomonas aeruginosa PA01
aucgacccagccgca

SEQ ID NO: 3375834 - RNA, 13 nt, Pseudomonas aeruginosa PA01
aucgaccccgccg

SEQ ID NO: 3375835 - RNA, 14 nt, Pseudomonas aeruginosa PA01
aucgaccucgcggg

SEQ ID NO: 3375836 - RNA, 15 nt, Pseudomonas aeruginosa PA01
aucgaccucgcgggc

SEQ ID NO: 3375837 - RNA, 21 nt, Pseudomonas aeruginosa PA01
aucgaccuugcccucggcgcc

SEQ ID NO: 3375838 - RNA, 13 nt, Pseudomonas aeruginosa PA01
aucgacgccagcg

SEQ ID NO: 3375839 - RNA, 17 nt, Pseudomonas aeruginosa PA01
aucgacgccagcggcga

SEQ ID NO: 3375840 - RNA, 13 nt, Pseudomonas aeruginosa PA01
aucgacgccagcu

SEQ ID NO: 3375841 - RNA, 19 nt, Pseudomonas aeruginosa PA01
aucgacgcccucggcgacg

SEQ ID NO: 3375842 - RNA, 12 nt, Pseudomonas aeruginosa PA01
aucgacgccgcu

SEQ ID NO: 3375843 - RNA, 17 nt, Pseudomonas aeruginosa PA01
aucgacgccgcuggcgg

SEQ ID NO: 3375844 - RNA, 17 nt, Pseudomonas aeruginosa PA01
aucgacgccucggcgcg

SEQ ID NO: 3375845 - RNA, 17 nt, Pseudomonas aeruginosa PA01
aucgacggauacgccag

SEQ ID NO: 3375846 - RNA, 17 nt, Pseudomonas aeruginosa PA01
aucgacgguuucaggcc

SEQ ID NO: 3375847 - RNA, 21 nt, Pseudomonas aeruginosa PA01
aucgacucgauggcgcggugg

SEQ ID NO: 3375848 - RNA, 15 nt, Pseudomonas aeruginosa PA01
aucgacugcaacaga

SEQ ID NO: 3375849 - RNA, 22 nt, Pseudomonas aeruginosa PA01
aucgacugcaugaugccgugca

SEQ ID NO: 3375850 - RNA, 17 nt, Pseudomonas aeruginosa PA01
aucgagcagcggcgcca

SEQ ID NO: 3375851 - RNA, 19 nt, Pseudomonas aeruginosa PA01
aucgagcagcggcgccaac

SEQ ID NO: 3375852 - RNA, 17 nt, Pseudomonas aeruginosa PA01
aucgagccagcgcucga

SEQ ID NO: 3375853 - RNA, 13 nt, Pseudomonas aeruginosa PA01
aucgagccgccgg

SEQ ID NO: 3375854 - RNA, 14 nt, Pseudomonas aeruginosa PA01
aucgagcgccagga

SEQ ID NO: 3375855 - RNA, 15 nt, Pseudomonas aeruginosa PA01
aucgagcggcccgcg

SEQ ID NO: 3375856 - RNA, 20 nt, Pseudomonas aeruginosa PA01
aucgagcggcccgcggucac

SEQ ID NO: 3375857 - RNA, 17 nt, Pseudomonas aeruginosa PA01
aucgagcggcggccguc

SEQ ID NO: 3375858 - RNA, 12 nt, Pseudomonas aeruginosa PA01
aucgagcugcuc

SEQ ID NO: 3375859 - RNA, 23 nt, Pseudomonas aeruginosa PA01
aucgagcuguccaucucgccgcg

SEQ ID NO: 3375860 - RNA, 13 nt, Pseudomonas aeruginosa PA01
aucgaggccaggc

SEQ ID NO: 3375861 - RNA, 12 nt, Pseudomonas aeruginosa PA01
aucgaggccgcc

SEQ ID NO: 3375862 - RNA, 13 nt, Pseudomonas aeruginosa PA01
aucgaggccgccc

SEQ ID NO: 3375863 - RNA, 17 nt, Pseudomonas aeruginosa PA01
aucgaggccgcccagcg

SEQ ID NO: 3375864 - RNA, 23 nt, Pseudomonas aeruginosa PA01
aucgaggccgcccagcgcagccu

SEQ ID NO: 3375865 - RNA, 14 nt, Pseudomonas aeruginosa PA01
aucgagggccacga

SEQ ID NO: 3375866 - RNA, 19 nt, Pseudomonas aeruginosa PA01
aucgaguaagugccgacca

SEQ ID NO: 3375867 - RNA, 13 nt, Pseudomonas aeruginosa PA01
aucgagucgccga

SEQ ID NO: 3375868 - RNA, 14 nt, Pseudomonas aeruginosa PA01
aucgagucgccggc

SEQ ID NO: 3375869 - RNA, 15 nt, Pseudomonas aeruginosa PA01
aucgagucgccggcg

SEQ ID NO: 3375870 - RNA, 18 nt, Pseudomonas aeruginosa PA01
aucgauauguccgguugg

SEQ ID NO: 3375871 - RNA, 19 nt, Pseudomonas aeruginosa PA01
aucgaucacugccuggcag

SEQ ID NO: 3375872 - RNA, 14 nt, Pseudomonas aeruginosa PA01
aucgaucagcagca

SEQ ID NO: 3375873 - RNA, 14 nt, Pseudomonas aeruginosa PA01
aucgauccgcaccc

SEQ ID NO: 3375874 - RNA, 16 nt, Pseudomonas aeruginosa PA01
aucgaucgagcgaucg

SEQ ID NO: 3375875 - RNA, 17 nt, Pseudomonas aeruginosa PA01
aucgaucucgucggcgg

SEQ ID NO: 3375876 - RNA, 12 nt, Pseudomonas aeruginosa PA01
aucgaugaccuu

SEQ ID NO: 3375877 - RNA, 17 nt, Pseudomonas aeruginosa PA01
aucgcggcguaggcgcg

SEQ ID NO: 3375878 - RNA, 18 nt, Pseudomonas aeruginosa PA01
aucgcggcguaggcgcgc

SEQ ID NO: 3375879 - RNA, 23 nt, Pseudomonas aeruginosa PA01
aucgcggcguaggcgcgccaagg

SEQ ID NO: 3375880 - RNA, 21 nt, Pseudomonas aeruginosa PA01
aucgcgggcgugcuccagcac

SEQ ID NO: 3375881 - RNA, 20 nt, Pseudomonas aeruginosa PA01
aucgcgguuauccgccggcu

SEQ ID NO: 3375882 - RNA, 14 nt, Pseudomonas aeruginosa PA01
aucgcguagcgccc

SEQ ID NO: 3375883 - RNA, 22 nt, Pseudomonas aeruginosa PA01
aucgcguaggacgcauaaccgc

SEQ ID NO: 3375884 - RNA, 20 nt, Pseudomonas aeruginosa PA01
aucgcguagguggcgccgcc

SEQ ID NO: 3375885 - RNA, 23 nt, Pseudomonas aeruginosa PA01
aucgcguagguggcgccgccggc

SEQ ID NO: 3375886 - RNA, 20 nt, Pseudomonas aeruginosa PA01
aucgcguccgguaugccgau

SEQ ID NO: 3375887 - RNA, 14 nt, Pseudomonas aeruginosa PA01
aucgcgucgcaggc

SEQ ID NO: 3375888 - RNA, 20 nt, Pseudomonas aeruginosa PA01
aucgcgucguauaggcgcug

SEQ ID NO: 3375889 - RNA, 22 nt, Pseudomonas aeruginosa PA01
aucgcgucguauaggcgcuggu

SEQ ID NO: 3375890 - RNA, 16 nt, Pseudomonas aeruginosa PA01
aucgcgugggccacca

SEQ ID NO: 3375891 - RNA, 20 nt, Pseudomonas aeruginosa PA01
aucgcgugggccaccaucag

SEQ ID NO: 3375892 - RNA, 16 nt, Pseudomonas aeruginosa PA01
aucgcuaccgacagga

SEQ ID NO: 3375893 - RNA, 23 nt, Pseudomonas aeruginosa PA01
aucgcuauccaccgucgcgguca

SEQ ID NO: 3375894 - RNA, 18 nt, Pseudomonas aeruginosa PA01
aucgcucaacggcgugcc

SEQ ID NO: 3375895 - RNA, 15 nt, Pseudomonas aeruginosa PA01
aucgcucccaggcuc

SEQ ID NO: 3375896 - RNA, 16 nt, Pseudomonas aeruginosa PA01
aucgcucccaggcuca

SEQ ID NO: 3375897 - RNA, 20 nt, Pseudomonas aeruginosa PA01
aucgcucgcaacgcuguccg

SEQ ID NO: 3375898 - RNA, 14 nt, Pseudomonas aeruginosa PA01
aucgcugaccugga

SEQ ID NO: 3375899 - RNA, 22 nt, Pseudomonas aeruginosa PA01
aucgcugaccuggaagcggguu

SEQ ID NO: 3375900 - RNA, 21 nt, Pseudomonas aeruginosa PA01
aucgcugccggucaggcuggu

SEQ ID NO: 3375901 - RNA, 23 nt, Pseudomonas aeruginosa PA01
aucgcugcggguucagucggcca

SEQ ID NO: 3375902 - RNA, 13 nt, Pseudomonas aeruginosa PA01
aucgcuggcgcag

SEQ ID NO: 3375903 - RNA, 14 nt, Pseudomonas aeruginosa PA01
aucgcugucgcccg

SEQ ID NO: 3375904 - RNA, 16 nt, Pseudomonas aeruginosa PA01
aucgcuuuccuggccg

SEQ ID NO: 3375905 - RNA, 17 nt, Pseudomonas aeruginosa PA01
aucgcuuuccuggccga

SEQ ID NO: 3375906 - RNA, 18 nt, Pseudomonas aeruginosa PA01
aucgcuuuccuggccgac

SEQ ID NO: 3375907 - RNA, 20 nt, Pseudomonas aeruginosa PA01
aucgcuuuccuggccgaccc

SEQ ID NO: 3375908 - RNA, 21 nt, Pseudomonas aeruginosa PA01
aucgcuuuccuggccgacccg

SEQ ID NO: 3375909 - RNA, 18 nt, Pseudomonas aeruginosa PA01
aucggaagaucgcccgcc

SEQ ID NO: 3375910 - RNA, 21 nt, Pseudomonas aeruginosa PA01
aucggagagacccgccagcgg

SEQ ID NO: 3375911 - RNA, 21 nt, Pseudomonas aeruginosa PA01
aucggauagccgugcagcagc

SEQ ID NO: 3375912 - RNA, 18 nt, Pseudomonas aeruginosa PA01
aucggcaacuggcuggcc

SEQ ID NO: 3375913 - RNA, 19 nt, Pseudomonas aeruginosa PA01
aucggcaacuggcuggccu

SEQ ID NO: 3375914 - RNA, 22 nt, Pseudomonas aeruginosa PA01
aucggcaagcugaagcgccgcg

SEQ ID NO: 3375915 - RNA, 14 nt, Pseudomonas aeruginosa PA01
aucggcaccaucac

SEQ ID NO: 3375916 - RNA, 15 nt, Pseudomonas aeruginosa PA01
aucggcaccaucacc

SEQ ID NO: 3375917 - RNA, 16 nt, Pseudomonas aeruginosa PA01
aucggcagcaucagcc

SEQ ID NO: 3375918 - RNA, 17 nt, Pseudomonas aeruginosa PA01
aucggcagcaucagccg

SEQ ID NO: 3375919 - RNA, 12 nt, Pseudomonas aeruginosa PA01
aucggcagggcg

SEQ ID NO: 3375920 - RNA, 19 nt, Pseudomonas aeruginosa PA01
aucggcaucaaucgcuggc

SEQ ID NO: 3375921 - RNA, 20 nt, Pseudomonas aeruginosa PA01
aucggcaucaaucgcuggcg

SEQ ID NO: 3375922 - RNA, 23 nt, Pseudomonas aeruginosa PA01
aucggcauggccgaccgccaggc

SEQ ID NO: 3375923 - RNA, 23 nt, Pseudomonas aeruginosa PA01
aucggccaccgaaucgaugcugu

SEQ ID NO: 3375924 - RNA, 16 nt, Pseudomonas aeruginosa PA01
aucggccacuccagcc

SEQ ID NO: 3375925 - RNA, 20 nt, Pseudomonas aeruginosa PA01
aucggccccaccgcacuggu

SEQ ID NO: 3375926 - RNA, 14 nt, Pseudomonas aeruginosa PA01
aucggccccaccug

SEQ ID NO: 3375927 - RNA, 17 nt, Pseudomonas aeruginosa PA01
aucggccccaccuggcg

SEQ ID NO: 3375928 - RNA, 14 nt, Pseudomonas aeruginosa PA01
aucggcccggcuuc

SEQ ID NO: 3375929 - RNA, 17 nt, Pseudomonas aeruginosa PA01
aucggcccgggcgccac

SEQ ID NO: 3375930 - RNA, 21 nt, Pseudomonas aeruginosa PA01
aucggcccgggcgccaccgcg

SEQ ID NO: 3375931 - RNA, 17 nt, Pseudomonas aeruginosa PA01
aucggcccggggcucug

SEQ ID NO: 3375932 - RNA, 21 nt, Pseudomonas aeruginosa PA01
aucggcccggggcucugccgg

SEQ ID NO: 3375933 - RNA, 21 nt, Pseudomonas aeruginosa PA01
aucggcccugggcguggcaaa

SEQ ID NO: 3375934 - RNA, 12 nt, Pseudomonas aeruginosa PA01
aucggcccuucg

SEQ ID NO: 3375935 - RNA, 14 nt, Pseudomonas aeruginosa PA01
aucggccgccaggc

SEQ ID NO: 3375936 - RNA, 13 nt, Pseudomonas aeruginosa PA01
aucggccgccagu

SEQ ID NO: 3375937 - RNA, 17 nt, Pseudomonas aeruginosa PA01
aucggccgccagugcau

SEQ ID NO: 3375938 - RNA, 20 nt, Pseudomonas aeruginosa PA01
aucggccgggauacagcagc

SEQ ID NO: 3375939 - RNA, 12 nt, Pseudomonas aeruginosa PA01
aucggccucgcg

SEQ ID NO: 3375940 - RNA, 14 nt, Pseudomonas aeruginosa PA01
aucggccucgcggc

SEQ ID NO: 3375941 - RNA, 22 nt, Pseudomonas aeruginosa PA01
aucggccugguuguaggcgccg

SEQ ID NO: 3375942 - RNA, 17 nt, Pseudomonas aeruginosa PA01
aucggccuuaaggugac

SEQ ID NO: 3375943 - RNA, 18 nt, Pseudomonas aeruginosa PA01
aucggcgagccgcagcgg

SEQ ID NO: 3375944 - RNA, 14 nt, Pseudomonas aeruginosa PA01
aucggcgcccagca

SEQ ID NO: 3375945 - RNA, 19 nt, Pseudomonas aeruginosa PA01
aucggcgcccagcaccaca

SEQ ID NO: 3375946 - RNA, 23 nt, Pseudomonas aeruginosa PA01
aucggcgccgcgcaccugggcgu

SEQ ID NO: 3375947 - RNA, 12 nt, Pseudomonas aeruginosa PA01
aucggcgccggc

SEQ ID NO: 3375948 - RNA, 21 nt, Pseudomonas aeruginosa PA01
aucggcgccucccagggucgc

SEQ ID NO: 3375949 - RNA, 22 nt, Pseudomonas aeruginosa PA01
aucggcgccucccagggucgcc

SEQ ID NO: 3375950 - RNA, 14 nt, Pseudomonas aeruginosa PA01
aucggcgcgcaggg

SEQ ID NO: 3375951 - RNA, 17 nt, Pseudomonas aeruginosa PA01
aucggcgcgcagggcca

SEQ ID NO: 3375952 - RNA, 12 nt, Pseudomonas aeruginosa PA01
aucggcgcgccg

SEQ ID NO: 3375953 - RNA, 13 nt, Pseudomonas aeruginosa PA01
aucggcgcgccga

SEQ ID NO: 3375954 - RNA, 14 nt, Pseudomonas aeruginosa PA01
aucggcgcgccggc

SEQ ID NO: 3375955 - RNA, 15 nt, Pseudomonas aeruginosa PA01
aucggcgcucaccgc

SEQ ID NO: 3375956 - RNA, 17 nt, Pseudomonas aeruginosa PA01
aucggcgcucaccgcau

SEQ ID NO: 3375957 - RNA, 15 nt, Pseudomonas aeruginosa PA01
aucggcggauaacgc

SEQ ID NO: 3375958 - RNA, 18 nt, Pseudomonas aeruginosa PA01
aucggcggauaacgccga

SEQ ID NO: 3375959 - RNA, 23 nt, Pseudomonas aeruginosa PA01
aucggcggauaacgccgcuggcg

SEQ ID NO: 3375960 - RNA, 18 nt, Pseudomonas aeruginosa PA01
aucggcggcaggccgaug

SEQ ID NO: 3375961 - RNA, 16 nt, Pseudomonas aeruginosa PA01
aucggcggcaggcgca

SEQ ID NO: 3375962 - RNA, 22 nt, Pseudomonas aeruginosa PA01
aucggcggugccauggaucacc

SEQ ID NO: 3375963 - RNA, 15 nt, Pseudomonas aeruginosa PA01
aucggcguccgcggc

SEQ ID NO: 3375964 - RNA, 20 nt, Pseudomonas aeruginosa PA01
aucggcguccgcggccugcu

SEQ ID NO: 3375965 - RNA, 22 nt, Pseudomonas aeruginosa PA01
aucggcgucggcuggucgaagc

SEQ ID NO: 3375966 - RNA, 23 nt, Pseudomonas aeruginosa PA01
aucggcguguucaggugcuggac

SEQ ID NO: 3375967 - RNA, 18 nt, Pseudomonas aeruginosa PA01
aucggcguuuagcgcccg

SEQ ID NO: 3375968 - RNA, 23 nt, Pseudomonas aeruginosa PA01
aucggcuccagcuugucgucggc

SEQ ID NO: 3375969 - RNA, 18 nt, Pseudomonas aeruginosa PA01
aucggcucggcaagcgaa

SEQ ID NO: 3375970 - RNA, 14 nt, Pseudomonas aeruginosa PA01
aucggcugcaacgc

SEQ ID NO: 3375971 - RNA, 17 nt, Pseudomonas aeruginosa PA01
aucggcugcaacgccgg

SEQ ID NO: 3375972 - RNA, 14 nt, Pseudomonas aeruginosa PA01
aucggcuggccgag

SEQ ID NO: 3375973 - RNA, 20 nt, Pseudomonas aeruginosa PA01
aucggcuugccggcggcgcu

SEQ ID NO: 3375974 - RNA, 21 nt, Pseudomonas aeruginosa PA01
aucgggcagggcagccgccgc

SEQ ID NO: 3375975 - RNA, 22 nt, Pseudomonas aeruginosa PA01
aucggggaagggacgucgccag

SEQ ID NO: 3375976 - RNA, 16 nt, Pseudomonas aeruginosa PA01
aucggggccaggucgg

SEQ ID NO: 3375977 - RNA, 17 nt, Pseudomonas aeruginosa PA01
aucggggccaggucggu

SEQ ID NO: 3375978 - RNA, 17 nt, Pseudomonas aeruginosa PA01
aucgggguauagcgcag

SEQ ID NO: 3375979 - RNA, 21 nt, Pseudomonas aeruginosa PA01
augaaaaaggccggucgcaac

SEQ ID NO: 3375980 - RNA, 22 nt, Pseudomonas aeruginosa PA01
augaaaaagggaugccgccggc

SEQ ID NO: 3375981 - RNA, 16 nt, Pseudomonas aeruginosa PA01
augaaaaauggccgcu

SEQ ID NO: 3375982 - RNA, 12 nt, Pseudomonas aeruginosa PA01
augaaagccagc

SEQ ID NO: 3375983 - RNA, 13 nt, Pseudomonas aeruginosa PA01
augaaagccagca

SEQ ID NO: 3375984 - RNA, 16 nt, Pseudomonas aeruginosa PA01
augaaauagcucugcc

SEQ ID NO: 3375985 - RNA, 20 nt, Pseudomonas aeruginosa PA01
augaacaccgcuucgagcac

SEQ ID NO: 3375986 - RNA, 18 nt, Pseudomonas aeruginosa PA01
augaacagcgagaacagc

SEQ ID NO: 3375987 - RNA, 23 nt, Pseudomonas aeruginosa PA01
augaacagcggaaugcuuccgua

SEQ ID NO: 3375988 - RNA, 16 nt, Pseudomonas aeruginosa PA01
augaacagugcgcccg

SEQ ID NO: 3375989 - RNA, 22 nt, Pseudomonas aeruginosa PA01
augaacgcccugacccgcaccg

SEQ ID NO: 3375990 - RNA, 13 nt, Pseudomonas aeruginosa PA01
augaacgccgcga

SEQ ID NO: 3375991 - RNA, 17 nt, Pseudomonas aeruginosa PA01
augaacgccucgccaac

SEQ ID NO: 3375992 - RNA, 20 nt, Pseudomonas aeruginosa PA01
augaacgcgcggaccuucga

SEQ ID NO: 3375993 - RNA, 18 nt, Pseudomonas aeruginosa PA01
augaagaucaucuggguc

SEQ ID NO: 3375994 - RNA, 20 nt, Pseudomonas aeruginosa PA01
augaagcacaccuccagcgg

SEQ ID NO: 3375995 - RNA, 12 nt, Pseudomonas aeruginosa PA01
augaagccgcga

SEQ ID NO: 3375996 - RNA, 18 nt, Pseudomonas aeruginosa PA01
augaagcgcugcugggcg

SEQ ID NO: 3375997 - RNA, 13 nt, Pseudomonas aeruginosa PA01
augaagcgguucu

SEQ ID NO: 3375998 - RNA, 19 nt, Pseudomonas aeruginosa PA01
augaagcuuuuccagcgca

SEQ ID NO: 3375999 - RNA, 12 nt, Pseudomonas aeruginosa PA01
augaaggcgcug

SEQ ID NO: 3376000 - RNA, 19 nt, Pseudomonas aeruginosa PA01
augaaggggaaaccgagca

SEQ ID NO: 3376001 - RNA, 21 nt, Pseudomonas aeruginosa PA01
augaagguucaggugaaaagc

SEQ ID NO: 3376002 - RNA, 13 nt, Pseudomonas aeruginosa PA01
augaaugccuuga

SEQ ID NO: 3376003 - RNA, 18 nt, Pseudomonas aeruginosa PA01
augaaugccuugaggccu

SEQ ID NO: 3376004 - RNA, 19 nt, Pseudomonas aeruginosa PA01
augaccagcgcaucggcgc

SEQ ID NO: 3376005 - RNA, 12 nt, Pseudomonas aeruginosa PA01
augaccaggcug

SEQ ID NO: 3376006 - RNA, 13 nt, Pseudomonas aeruginosa PA01
augaccaggcuga

SEQ ID NO: 3376007 - RNA, 18 nt, Pseudomonas aeruginosa PA01
augaccaggcugaucagc

SEQ ID NO: 3376008 - RNA, 19 nt, Pseudomonas aeruginosa PA01
augaccgauggcgccgcga

SEQ ID NO: 3376009 - RNA, 13 nt, Pseudomonas aeruginosa PA01
augaccgccccgg

SEQ ID NO: 3376010 - RNA, 18 nt, Pseudomonas aeruginosa PA01
augaccgccccggcagcc

SEQ ID NO: 3376011 - RNA, 18 nt, Pseudomonas aeruginosa PA01
augaccucggccagccag

SEQ ID NO: 3376012 - RNA, 21 nt, Pseudomonas aeruginosa PA01
augaccuucagcaccugcgcc

SEQ ID NO: 3376013 - RNA, 21 nt, Pseudomonas aeruginosa PA01
augacgcaaacgccauccgcc

SEQ ID NO: 3376014 - RNA, 16 nt, Pseudomonas aeruginosa PA01
augacggggaucacuc

SEQ ID NO: 3376015 - RNA, 19 nt, Pseudomonas aeruginosa PA01
augacuccggucaaggcag

SEQ ID NO: 3376016 - RNA, 14 nt, Pseudomonas aeruginosa PA01
augagaaggucggg

SEQ ID NO: 3376017 - RNA, 15 nt, Pseudomonas aeruginosa PA01
augagaggugggccg

SEQ ID NO: 3376018 - RNA, 13 nt, Pseudomonas aeruginosa PA01
augagauccgcca

SEQ ID NO: 3376019 - RNA, 14 nt, Pseudomonas aeruginosa PA01
augagccagccugc

SEQ ID NO: 3376020 - RNA, 14 nt, Pseudomonas aeruginosa PA01
augagcgacccaac

SEQ ID NO: 3376021 - RNA, 16 nt, Pseudomonas aeruginosa PA01
augagcgaucccaggu

SEQ ID NO: 3376022 - RNA, 14 nt, Pseudomonas aeruginosa PA01
augagcgcccggca

SEQ ID NO: 3376023 - RNA, 21 nt, Pseudomonas aeruginosa PA01
augagcugcucuaccgacuga

SEQ ID NO: 3376024 - RNA, 19 nt, Pseudomonas aeruginosa PA01
augagguuggccacguagg

SEQ ID NO: 3376025 - RNA, 15 nt, Pseudomonas aeruginosa PA01
augagugucgccauc

SEQ ID NO: 3376026 - RNA, 14 nt, Pseudomonas aeruginosa PA01
augaguugcagggc

SEQ ID NO: 3376027 - RNA, 15 nt, Pseudomonas aeruginosa PA01
augaguugcagggcu

SEQ ID NO: 3376028 - RNA, 20 nt, Pseudomonas aeruginosa PA01
augaucaccaggacccagau

SEQ ID NO: 3376029 - RNA, 17 nt, Pseudomonas aeruginosa PA01
augaucaggccgagcac

SEQ ID NO: 3376030 - RNA, 17 nt, Pseudomonas aeruginosa PA01
augaucaggucggccgc

SEQ ID NO: 3376031 - RNA, 21 nt, Pseudomonas aeruginosa PA01
augauccgcucgaucccggcg

SEQ ID NO: 3376032 - RNA, 18 nt, Pseudomonas aeruginosa PA01
augauccggugcaggccg

SEQ ID NO: 3376033 - RNA, 23 nt, Pseudomonas aeruginosa PA01
augaucgacugcaugaccuccag

SEQ ID NO: 3376034 - RNA, 21 nt, Pseudomonas aeruginosa PA01
augaucgccgaaaaauucagc

SEQ ID NO: 3376035 - RNA, 12 nt, Pseudomonas aeruginosa PA01
augaucgccggg

SEQ ID NO: 3376036 - RNA, 16 nt, Pseudomonas aeruginosa PA01
augaucgccucggcgc

SEQ ID NO: 3376037 - RNA, 21 nt, Pseudomonas aeruginosa PA01
augaucuccaggucgcccugc

SEQ ID NO: 3376038 - RNA, 23 nt, Pseudomonas aeruginosa PA01
augaucuccgcgccgggcuggcc

SEQ ID NO: 3376039 - RNA, 20 nt, Pseudomonas aeruginosa PA01
augaugcaggcagugugcac

SEQ ID NO: 3376040 - RNA, 18 nt, Pseudomonas aeruginosa PA01
augaugccgaggcggccg

SEQ ID NO: 3376041 - RNA, 15 nt, Pseudomonas aeruginosa PA01
augaugccgcggcga

SEQ ID NO: 3376042 - RNA, 17 nt, Pseudomonas aeruginosa PA01
augauggucaacaccag

SEQ ID NO: 3376043 - RNA, 19 nt, Pseudomonas aeruginosa PA01
augauggucaacaccagcg

SEQ ID NO: 3376044 - RNA, 21 nt, Pseudomonas aeruginosa PA01
augauggucaacaccagcgcc

SEQ ID NO: 3376045 - RNA, 13 nt, Pseudomonas aeruginosa PA01
augaugugcgcag

SEQ ID NO: 3376046 - RNA, 21 nt, Pseudomonas aeruginosa PA01
augaugugcgcaggcuggccg

SEQ ID NO: 3376047 - RNA, 22 nt, Pseudomonas aeruginosa PA01
augaugugcgcaggcuggccga

SEQ ID NO: 3376048 - RNA, 15 nt, Pseudomonas aeruginosa PA01
augauuucguuggcc

SEQ ID NO: 3376049 - RNA, 18 nt, Pseudomonas aeruginosa PA01
augauuucguuggcccag

SEQ ID NO: 3376050 - RNA, 23 nt, Pseudomonas aeruginosa PA01
augauuucguuggcccagaccuu

SEQ ID NO: 3376051 - RNA, 12 nt, Pseudomonas aeruginosa PA01
augcaacccgcc

SEQ ID NO: 3376052 - RNA, 17 nt, Pseudomonas aeruginosa PA01
augcaagaacgccgacc

SEQ ID NO: 3376053 - RNA, 17 nt, Pseudomonas aeruginosa PA01
augcacacgcucccaac

SEQ ID NO: 3376054 - RNA, 14 nt, Pseudomonas aeruginosa PA01
augcaccaggccgc

SEQ ID NO: 3376055 - RNA, 13 nt, Pseudomonas aeruginosa PA01
augcaccugcgcc

SEQ ID NO: 3376056 - RNA, 19 nt, Pseudomonas aeruginosa PA01
augcaccugcgccccgguc

SEQ ID NO: 3376057 - RNA, 16 nt, Pseudomonas aeruginosa PA01
augcacgugcagcucg

SEQ ID NO: 3376058 - RNA, 17 nt, Pseudomonas aeruginosa PA01
augcagauccagcggca

SEQ ID NO: 3376059 - RNA, 21 nt, Pseudomonas aeruginosa PA01
augcagcaacccggcccagcg

SEQ ID NO: 3376060 - RNA, 15 nt, Pseudomonas aeruginosa PA01
augcagcagguagug

SEQ ID NO: 3376061 - RNA, 14 nt, Pseudomonas aeruginosa PA01
augcagccgauggc

SEQ ID NO: 3376062 - RNA, 19 nt, Pseudomonas aeruginosa PA01
augcagcggcauggucagc

SEQ ID NO: 3376063 - RNA, 13 nt, Pseudomonas aeruginosa PA01
augcagcgucgcg

SEQ ID NO: 3376064 - RNA, 20 nt, Pseudomonas aeruginosa PA01
augcaggagaugcacgaugg

SEQ ID NO: 3376065 - RNA, 13 nt, Pseudomonas aeruginosa PA01
augcaggccaggg

SEQ ID NO: 3376066 - RNA, 17 nt, Pseudomonas aeruginosa PA01
augcaggccagggcggu

SEQ ID NO: 3376067 - RNA, 14 nt, Pseudomonas aeruginosa PA01
augcaggccggccu

SEQ ID NO: 3376068 - RNA, 15 nt, Pseudomonas aeruginosa PA01
augcaggccgguggu

SEQ ID NO: 3376069 - RNA, 23 nt, Pseudomonas aeruginosa PA01
augcaggcucucgcgcagcagga

SEQ ID NO: 3376070 - RNA, 22 nt, Pseudomonas aeruginosa PA01
augcaggucgugcagcccgguc

SEQ ID NO: 3376071 - RNA, 18 nt, Pseudomonas aeruginosa PA01
augcagucccgccaggcg

SEQ ID NO: 3376072 - RNA, 18 nt, Pseudomonas aeruginosa PA01
augccacgugcggggugc

SEQ ID NO: 3376073 - RNA, 14 nt, Pseudomonas aeruginosa PA01
augccacugacgcg

SEQ ID NO: 3376074 - RNA, 22 nt, Pseudomonas aeruginosa PA01
augccacugacgcgcagcgccg

SEQ ID NO: 3376075 - RNA, 18 nt, Pseudomonas aeruginosa PA01
augccagcgccacgccgc

SEQ ID NO: 3376076 - RNA, 19 nt, Pseudomonas aeruginosa PA01
augccagcgccacgccgcu

SEQ ID NO: 3376077 - RNA, 12 nt, Pseudomonas aeruginosa PA01
augccaggagaa

SEQ ID NO: 3376078 - RNA, 14 nt, Pseudomonas aeruginosa PA01
augccagggccuug

SEQ ID NO: 3376079 - RNA, 22 nt, Pseudomonas aeruginosa PA01
augcccaccugaacgcgcccgg

SEQ ID NO: 3376080 - RNA, 12 nt, Pseudomonas aeruginosa PA01
augcccagacgc

SEQ ID NO: 3376081 - RNA, 16 nt, Pseudomonas aeruginosa PA01
augcccagccagggcc

SEQ ID NO: 3376082 - RNA, 17 nt, Pseudomonas aeruginosa PA01
augccguucucggugac

SEQ ID NO: 3376083 - RNA, 23 nt, Pseudomonas aeruginosa PA01
augccguugcccucgcgcuggac

SEQ ID NO: 3376084 - RNA, 16 nt, Pseudomonas aeruginosa PA01
augccguuggccgagc

SEQ ID NO: 3376085 - RNA, 19 nt, Pseudomonas aeruginosa PA01
augccguuguagcugacca

SEQ ID NO: 3376086 - RNA, 12 nt, Pseudomonas aeruginosa PA01
augccucggcgg

SEQ ID NO: 3376087 - RNA, 18 nt, Pseudomonas aeruginosa PA01
augccucggcggcggccu

SEQ ID NO: 3376088 - RNA, 16 nt, Pseudomonas aeruginosa PA01
augccugcguuucgcc

SEQ ID NO: 3376089 - RNA, 14 nt, Pseudomonas aeruginosa PA01
augccugugcaccg

SEQ ID NO: 3376090 - RNA, 20 nt, Pseudomonas aeruginosa PA01
augccugugcaccgaaggga

SEQ ID NO: 3376091 - RNA, 14 nt, Pseudomonas aeruginosa PA01
augccuucggcggc

SEQ ID NO: 3376092 - RNA, 14 nt, Pseudomonas aeruginosa PA01
augccuugaggccu

SEQ ID NO: 3376093 - RNA, 14 nt, Pseudomonas aeruginosa PA01
augccuugcggccc

SEQ ID NO: 3376094 - RNA, 17 nt, Pseudomonas aeruginosa PA01
augcgaaaacggcgacc

SEQ ID NO: 3376095 - RNA, 23 nt, Pseudomonas aeruginosa PA01
augcgcaccacucccggcgacga

SEQ ID NO: 3376096 - RNA, 16 nt, Pseudomonas aeruginosa PA01
augcgcaccaggucgc

SEQ ID NO: 3376097 - RNA, 14 nt, Pseudomonas aeruginosa PA01
augcgcagcgcggg

SEQ ID NO: 3376098 - RNA, 18 nt, Pseudomonas aeruginosa PA01
augcgcagcuugcucgau

SEQ ID NO: 3376099 - RNA, 18 nt, Pseudomonas aeruginosa PA01
augcgccagcggcccggc

SEQ ID NO: 3376100 - RNA, 19 nt, Pseudomonas aeruginosa PA01
augcgccagcggcccggca

SEQ ID NO: 3376101 - RNA, 17 nt, Pseudomonas aeruginosa PA01
augcgccccagcgccug

SEQ ID NO: 3376102 - RNA, 23 nt, Pseudomonas aeruginosa PA01
augcgcccccacgacgcacucau

SEQ ID NO: 3376103 - RNA, 15 nt, Pseudomonas aeruginosa PA01
augcgcccgccgcga

SEQ ID NO: 3376104 - RNA, 20 nt, Pseudomonas aeruginosa PA01
augcgcccuaccugucccgg

SEQ ID NO: 3376105 - RNA, 20 nt, Pseudomonas aeruginosa PA01
augcgccgacgccaccagcc

SEQ ID NO: 3376106 - RNA, 16 nt, Pseudomonas aeruginosa PA01
augcgccggaucggcu

SEQ ID NO: 3376107 - RNA, 15 nt, Pseudomonas aeruginosa PA01
augcgccgggccucg

SEQ ID NO: 3376108 - RNA, 17 nt, Pseudomonas aeruginosa PA01
augcgccgggccucggc

SEQ ID NO: 3376109 - RNA, 18 nt, Pseudomonas aeruginosa PA01
augcgccgggccucggca

SEQ ID NO: 3376110 - RNA, 18 nt, Pseudomonas aeruginosa PA01
augcgccguuacgccggg

SEQ ID NO: 3376111 - RNA, 20 nt, Pseudomonas aeruginosa PA01
augcgccucagcggccuucg

SEQ ID NO: 3376112 - RNA, 20 nt, Pseudomonas aeruginosa PA01
augcgcgaauaccgcgcgcg

SEQ ID NO: 3376113 - RNA, 16 nt, Pseudomonas aeruginosa PA01
augcgcgaggucugug

SEQ ID NO: 3376114 - RNA, 14 nt, Pseudomonas aeruginosa PA01
augcgcggucacca

SEQ ID NO: 3376115 - RNA, 13 nt, Pseudomonas aeruginosa PA01
augcgcgucgccg

SEQ ID NO: 3376116 - RNA, 15 nt, Pseudomonas aeruginosa PA01
augcgcgucgccgaa

SEQ ID NO: 3376117 - RNA, 22 nt, Pseudomonas aeruginosa PA01
augcgcuacggcaucaccggcg

SEQ ID NO: 3376118 - RNA, 17 nt, Pseudomonas aeruginosa PA01
augcgcugguagcgcuc

SEQ ID NO: 3376119 - RNA, 13 nt, Pseudomonas aeruginosa PA01
augcgcuggucgu

SEQ ID NO: 3376120 - RNA, 20 nt, Pseudomonas aeruginosa PA01
augcggcaggccuuccacgc

SEQ ID NO: 3376121 - RNA, 22 nt, Pseudomonas aeruginosa PA01
augcggcaggccuuccacgccu

SEQ ID NO: 3376122 - RNA, 20 nt, Pseudomonas aeruginosa PA01
augcggccccggcgcucgcu

SEQ ID NO: 3376123 - RNA, 17 nt, Pseudomonas aeruginosa PA01
augcggcccgccggcga

SEQ ID NO: 3376124 - RNA, 20 nt, Pseudomonas aeruginosa PA01
augcggccugcaacgccgcc

SEQ ID NO: 3376125 - RNA, 15 nt, Pseudomonas aeruginosa PA01
augcggcgcugccac

SEQ ID NO: 3376126 - RNA, 22 nt, Pseudomonas aeruginosa PA01
augcggcggaacuugucgccgc

SEQ ID NO: 3376127 - RNA, 23 nt, Pseudomonas aeruginosa PA01
augcggcggaacuugucgccgcu

SEQ ID NO: 3376128 - RNA, 15 nt, Pseudomonas aeruginosa PA01
augcggcuacucgcc

SEQ ID NO: 3376129 - RNA, 20 nt, Pseudomonas aeruginosa PA01
augcggcuacucgcccgacc

SEQ ID NO: 3376130 - RNA, 13 nt, Pseudomonas aeruginosa PA01
augcgggcgggug

SEQ ID NO: 3376131 - RNA, 15 nt, Pseudomonas aeruginosa PA01
augcggggcgaccag

SEQ ID NO: 3376132 - RNA, 16 nt, Pseudomonas aeruginosa PA01
augcgguagucgcugc

SEQ ID NO: 3376133 - RNA, 18 nt, Pseudomonas aeruginosa PA01
augcggugcgccuccagg

SEQ ID NO: 3376134 - RNA, 15 nt, Pseudomonas aeruginosa PA01
augcggugcggccau

SEQ ID NO: 3376135 - RNA, 14 nt, Pseudomonas aeruginosa PA01
augcgguuccuggc

SEQ ID NO: 3376136 - RNA, 17 nt, Pseudomonas aeruginosa PA01
augcgguuccuggcugg

SEQ ID NO: 3376137 - RNA, 20 nt, Pseudomonas aeruginosa PA01
augcguggguccacgccggg

SEQ ID NO: 3376138 - RNA, 22 nt, Pseudomonas aeruginosa PA01
augcguggguccacgccgggca

SEQ ID NO: 3376139 - RNA, 17 nt, Pseudomonas aeruginosa PA01
augcguggucugcccgu

SEQ ID NO: 3376140 - RNA, 18 nt, Pseudomonas aeruginosa PA01
augcucacugcgagcacc

SEQ ID NO: 3376141 - RNA, 20 nt, Pseudomonas aeruginosa PA01
augcucacugcgagcaccau

SEQ ID NO: 3376142 - RNA, 16 nt, Pseudomonas aeruginosa PA01
augcucagcacggcga

SEQ ID NO: 3376143 - RNA, 19 nt, Pseudomonas aeruginosa PA01
augcucagcacggcgacgg

SEQ ID NO: 3376144 - RNA, 18 nt, Pseudomonas aeruginosa PA01
augcucagccgcgccggg

SEQ ID NO: 3376145 - RNA, 21 nt, Pseudomonas aeruginosa PA01
augcucagccgcgccggggca

SEQ ID NO: 3376146 - RNA, 13 nt, Pseudomonas aeruginosa PA01
augcucagcgccg

SEQ ID NO: 3376147 - RNA, 15 nt, Pseudomonas aeruginosa PA01
augcucagcgccggc

SEQ ID NO: 3376148 - RNA, 16 nt, Pseudomonas aeruginosa PA01
augcucagcgccggcc

SEQ ID NO: 3376149 - RNA, 14 nt, Pseudomonas aeruginosa PA01
augcucaggcgcug

SEQ ID NO: 3376150 - RNA, 18 nt, Pseudomonas aeruginosa PA01
augcucaggcgcugcugg

SEQ ID NO: 3376151 - RNA, 17 nt, Pseudomonas aeruginosa PA01
augcucauccugcccgu

SEQ ID NO: 3376152 - RNA, 14 nt, Pseudomonas aeruginosa PA01
augcucccgagcaa

SEQ ID NO: 3376153 - RNA, 14 nt, Pseudomonas aeruginosa PA01
augcuccgcgccuc

SEQ ID NO: 3376154 - RNA, 21 nt, Pseudomonas aeruginosa PA01
augcucgccaccuguagcagg

SEQ ID NO: 3376155 - RNA, 15 nt, Pseudomonas aeruginosa PA01
augcucgcgccagcc

SEQ ID NO: 3376156 - RNA, 21 nt, Pseudomonas aeruginosa PA01
augcucgcgccagccccaggc

SEQ ID NO: 3376157 - RNA, 13 nt, Pseudomonas aeruginosa PA01
augcucggccagc

SEQ ID NO: 3376158 - RNA, 17 nt, Pseudomonas aeruginosa PA01
augcucggccagcucgc

SEQ ID NO: 3376159 - RNA, 22 nt, Pseudomonas aeruginosa PA01
augcucggccagcucgccgaac

SEQ ID NO: 3376160 - RNA, 14 nt, Pseudomonas aeruginosa PA01
augcucggccaggu

SEQ ID NO: 3376161 - RNA, 17 nt, Pseudomonas aeruginosa PA01
augcucggccagguauu

SEQ ID NO: 3376162 - RNA, 20 nt, Pseudomonas aeruginosa PA01
augcucggccagguauucgc

SEQ ID NO: 3376163 - RNA, 21 nt, Pseudomonas aeruginosa PA01
augcucggugugaucaccagc

SEQ ID NO: 3376164 - RNA, 17 nt, Pseudomonas aeruginosa PA01
augcucgguugccaggc

SEQ ID NO: 3376165 - RNA, 18 nt, Pseudomonas aeruginosa PA01
augcucgguugccaggcc

SEQ ID NO: 3376166 - RNA, 22 nt, Pseudomonas aeruginosa PA01
augcucgguugccaggccggcg

SEQ ID NO: 3376167 - RNA, 21 nt, Pseudomonas aeruginosa PA01
augcugaucacccgcccgccg

SEQ ID NO: 3376168 - RNA, 13 nt, Pseudomonas aeruginosa PA01
augcugccacccg

SEQ ID NO: 3376169 - RNA, 19 nt, Pseudomonas aeruginosa PA01
augcugcccggagcggcug

SEQ ID NO: 3376170 - RNA, 13 nt, Pseudomonas aeruginosa PA01
augcugcgcggga

SEQ ID NO: 3376171 - RNA, 20 nt, Pseudomonas aeruginosa PA01
augcugcgggcgccgccgcu

SEQ ID NO: 3376172 - RNA, 20 nt, Pseudomonas aeruginosa PA01
augcuggagcuugccggcga

SEQ ID NO: 3376173 - RNA, 16 nt, Pseudomonas aeruginosa PA01
augcugucagcgcccg

SEQ ID NO: 3376174 - RNA, 14 nt, Pseudomonas aeruginosa PA01
augcugugcaggga

SEQ ID NO: 3376175 - RNA, 16 nt, Pseudomonas aeruginosa PA01
augcuguuccucgucg

SEQ ID NO: 3376176 - RNA, 17 nt, Pseudomonas aeruginosa PA01
augcuguuccucgucga

SEQ ID NO: 3376177 - RNA, 16 nt, Pseudomonas aeruginosa PA01
augcuuagcccgggau

SEQ ID NO: 3376178 - RNA, 21 nt, Pseudomonas aeruginosa PA01
augcuuccguagguggauugc

SEQ ID NO: 3376179 - RNA, 17 nt, Pseudomonas aeruginosa PA01
augcuugcacaccuggu

SEQ ID NO: 3376180 - RNA, 16 nt, Pseudomonas aeruginosa PA01
auggaacagcagccag

SEQ ID NO: 3376181 - RNA, 18 nt, Pseudomonas aeruginosa PA01
auggaacagcagccaggc

SEQ ID NO: 3376182 - RNA, 16 nt, Pseudomonas aeruginosa PA01
auggaacagucgcgcg

SEQ ID NO: 3376183 - RNA, 15 nt, Pseudomonas aeruginosa PA01
auggaacugcagggc

SEQ ID NO: 3376184 - RNA, 21 nt, Pseudomonas aeruginosa PA01
auggaagagcgccgcggcggc

SEQ ID NO: 3376185 - RNA, 18 nt, Pseudomonas aeruginosa PA01
augggcauccugccgccu

SEQ ID NO: 3376186 - RNA, 16 nt, Pseudomonas aeruginosa PA01
augggcgaagccggcg

SEQ ID NO: 3376187 - RNA, 17 nt, Pseudomonas aeruginosa PA01
augggcgaugcgccggu

SEQ ID NO: 3376188 - RNA, 22 nt, Pseudomonas aeruginosa PA01
augggcgcgcgccgggcucagc

SEQ ID NO: 3376189 - RNA, 18 nt, Pseudomonas aeruginosa PA01
augggcgcguucucccug

SEQ ID NO: 3376190 - RNA, 19 nt, Pseudomonas aeruginosa PA01
augggcggggugaucaguc

SEQ ID NO: 3376191 - RNA, 22 nt, Pseudomonas aeruginosa PA01
augggcguccgguaggagcgag

SEQ ID NO: 3376192 - RNA, 12 nt, Pseudomonas aeruginosa PA01
auggggcggccg

SEQ ID NO: 3376193 - RNA, 12 nt, Pseudomonas aeruginosa PA01
augggggccagc

SEQ ID NO: 3376194 - RNA, 23 nt, Pseudomonas aeruginosa PA01
augggggccagcagggccgccga

SEQ ID NO: 3376195 - RNA, 14 nt, Pseudomonas aeruginosa PA01
auggguggcccuuu

SEQ ID NO: 3376196 - RNA, 13 nt, Pseudomonas aeruginosa PA01
auggguucccagc

SEQ ID NO: 3376197 - RNA, 17 nt, Pseudomonas aeruginosa PA01
auggguucccagcagca

SEQ ID NO: 3376198 - RNA, 22 nt, Pseudomonas aeruginosa PA01
augguauggcggucggccaggc

SEQ ID NO: 3376199 - RNA, 23 nt, Pseudomonas aeruginosa PA01
augguauggcggucggccaggcg

SEQ ID NO: 3376200 - RNA, 13 nt, Pseudomonas aeruginosa PA01
auggucaccuuga

SEQ ID NO: 3376201 - RNA, 21 nt, Pseudomonas aeruginosa PA01
auggucacgccgaggcugcgg

SEQ ID NO: 3376202 - RNA, 17 nt, Pseudomonas aeruginosa PA01
auggucaggaucacauc

SEQ ID NO: 3376203 - RNA, 13 nt, Pseudomonas aeruginosa PA01
augguccgucgcg

SEQ ID NO: 3376204 - RNA, 17 nt, Pseudomonas aeruginosa PA01
augguccguucggcgcc

SEQ ID NO: 3376205 - RNA, 18 nt, Pseudomonas aeruginosa PA01
augguccguucggcgccc

SEQ ID NO: 3376206 - RNA, 12 nt, Pseudomonas aeruginosa PA01
auggucgccgcg

SEQ ID NO: 3376207 - RNA, 23 nt, Pseudomonas aeruginosa PA01
auggucgccgcgaccucguugca

SEQ ID NO: 3376208 - RNA, 13 nt, Pseudomonas aeruginosa PA01
auggucgccggag

SEQ ID NO: 3376209 - RNA, 22 nt, Pseudomonas aeruginosa PA01
auggucggugacccgcacggcg

SEQ ID NO: 3376210 - RNA, 18 nt, Pseudomonas aeruginosa PA01
auggugacguugcgccgc

SEQ ID NO: 3376211 - RNA, 18 nt, Pseudomonas aeruginosa PA01
auggugaucacgucggcg

SEQ ID NO: 3376212 - RNA, 19 nt, Pseudomonas aeruginosa PA01
auggugaucacgucggcgu

SEQ ID NO: 3376213 - RNA, 14 nt, Pseudomonas aeruginosa PA01
auggugcgcucgcg

SEQ ID NO: 3376214 - RNA, 19 nt, Pseudomonas aeruginosa PA01
auggugcgcuuaaagcaac

SEQ ID NO: 3376215 - RNA, 17 nt, Pseudomonas aeruginosa PA01
augguggaucgacugca

SEQ ID NO: 3376216 - RNA, 21 nt, Pseudomonas aeruginosa PA01
auggugggcucuaugcaaugg

SEQ ID NO: 3376217 - RNA, 16 nt, Pseudomonas aeruginosa PA01
augguguccggcggcg

SEQ ID NO: 3376218 - RNA, 16 nt, Pseudomonas aeruginosa PA01
auggugugcagcagca

SEQ ID NO: 3376219 - RNA, 22 nt, Pseudomonas aeruginosa PA01
augguugccguacuucagggug

SEQ ID NO: 3376220 - RNA, 16 nt, Pseudomonas aeruginosa PA01
augguuuaccaggacc

SEQ ID NO: 3376221 - RNA, 14 nt, Pseudomonas aeruginosa PA01
auguacggcaccac

SEQ ID NO: 3376222 - RNA, 17 nt, Pseudomonas aeruginosa PA01
auguacggcaccaccac

SEQ ID NO: 3376223 - RNA, 13 nt, Pseudomonas aeruginosa PA01
auguagacgaugc

SEQ ID NO: 3376224 - RNA, 14 nt, Pseudomonas aeruginosa PA01
auguagagcaggcu

SEQ ID NO: 3376225 - RNA, 19 nt, Pseudomonas aeruginosa PA01
auguagcggaaguucaccu

SEQ ID NO: 3376226 - RNA, 20 nt, Pseudomonas aeruginosa PA01
auguagcguugcaggcaguc

SEQ ID NO: 3376227 - RNA, 15 nt, Pseudomonas aeruginosa PA01
auguagcugccggcg

SEQ ID NO: 3376228 - RNA, 23 nt, Pseudomonas aeruginosa PA01
auguaggacaggccgacguccau

SEQ ID NO: 3376229 - RNA, 16 nt, Pseudomonas aeruginosa PA01
auguaguccagcgccg

SEQ ID NO: 3376230 - RNA, 17 nt, Pseudomonas aeruginosa PA01
auguaguccagcgccgc

SEQ ID NO: 3376231 - RNA, 18 nt, Pseudomonas aeruginosa PA01
auguaguccagcgccgcg

SEQ ID NO: 3376232 - RNA, 19 nt, Pseudomonas aeruginosa PA01
auguauucgaacagcuuga

SEQ ID NO: 3376233 - RNA, 18 nt, Pseudomonas aeruginosa PA01
augucagcguagcuguuc

SEQ ID NO: 3376234 - RNA, 20 nt, Pseudomonas aeruginosa PA01
auguccaccgccgccagcaa

SEQ ID NO: 3376235 - RNA, 13 nt, Pseudomonas aeruginosa PA01
auguccaggccga

SEQ ID NO: 3376236 - RNA, 17 nt, Pseudomonas aeruginosa PA01
auguccagugccucccg

SEQ ID NO: 3376237 - RNA, 21 nt, Pseudomonas aeruginosa PA01
auguccaucagccgcgcgcug

SEQ ID NO: 3376238 - RNA, 20 nt, Pseudomonas aeruginosa PA01
augucccggguguccuuugc

SEQ ID NO: 3376239 - RNA, 20 nt, Pseudomonas aeruginosa PA01
auguccgggugaugcccggu

SEQ ID NO: 3376240 - RNA, 13 nt, Pseudomonas aeruginosa PA01
auguccucggcgc

SEQ ID NO: 3376241 - RNA, 19 nt, Pseudomonas aeruginosa PA01
auguccuggaucggcagcu

SEQ ID NO: 3376242 - RNA, 22 nt, Pseudomonas aeruginosa PA01
auguccuggaucggcagcucgc

SEQ ID NO: 3376243 - RNA, 22 nt, Pseudomonas aeruginosa PA01
augucgaacaacccgccagcaa

SEQ ID NO: 3376244 - RNA, 13 nt, Pseudomonas aeruginosa PA01
augucgaccuggg

SEQ ID NO: 3376245 - RNA, 17 nt, Pseudomonas aeruginosa PA01
augucgagggccggguu

SEQ ID NO: 3376246 - RNA, 17 nt, Pseudomonas aeruginosa PA01
augucgcacuggucggc

SEQ ID NO: 3376247 - RNA, 19 nt, Pseudomonas aeruginosa PA01
augucgcacuggucggcca

SEQ ID NO: 3376248 - RNA, 14 nt, Pseudomonas aeruginosa PA01
augucgcggcaggc

SEQ ID NO: 3376249 - RNA, 20 nt, Pseudomonas aeruginosa PA01
augucgcggcaggcggcggc

SEQ ID NO: 3376250 - RNA, 18 nt, Pseudomonas aeruginosa PA01
augucgcgggcaugcugc

SEQ ID NO: 3376251 - RNA, 23 nt, Pseudomonas aeruginosa PA01
augucgcggguuacuucgccgau

SEQ ID NO: 3376252 - RNA, 15 nt, Pseudomonas aeruginosa PA01
augucgcuggccagc

SEQ ID NO: 3376253 - RNA, 16 nt, Pseudomonas aeruginosa PA01
augucgcuggccugca

SEQ ID NO: 3376254 - RNA, 22 nt, Pseudomonas aeruginosa PA01
augucgcuggccugcagguccg

SEQ ID NO: 3376255 - RNA, 19 nt, Pseudomonas aeruginosa PA01
augucguagccgcgcgcca

SEQ ID NO: 3376256 - RNA, 13 nt, Pseudomonas aeruginosa PA01
augucguggacau

SEQ ID NO: 3376257 - RNA, 16 nt, Pseudomonas aeruginosa PA01
augucguggucgccgu

SEQ ID NO: 3376258 - RNA, 23 nt, Pseudomonas aeruginosa PA01
augugcaguucgaccuccaggcc

SEQ ID NO: 3376259 - RNA, 15 nt, Pseudomonas aeruginosa PA01
augugccaggccugg

SEQ ID NO: 3376260 - RNA, 16 nt, Pseudomonas aeruginosa PA01
augugcguauggaucu

SEQ ID NO: 3376261 - RNA, 18 nt, Pseudomonas aeruginosa PA01
auguggccgucgcgccgc

SEQ ID NO: 3376262 - RNA, 20 nt, Pseudomonas aeruginosa PA01
auguggcgcagcaucaucuc

SEQ ID NO: 3376263 - RNA, 18 nt, Pseudomonas aeruginosa PA01
auguggguauccagcggc

SEQ ID NO: 3376264 - RNA, 22 nt, Pseudomonas aeruginosa PA01
auguucaccagcgcugccucgg

SEQ ID NO: 3376265 - RNA, 17 nt, Pseudomonas aeruginosa PA01
auguucgaaggccaguc

SEQ ID NO: 3376266 - RNA, 11 nt, Pseudomonas aeruginosa PA01
auguucgaagu

SEQ ID NO: 3376267 - RNA, 14 nt, Pseudomonas aeruginosa PA01
auguucgccgccgc

SEQ ID NO: 3376268 - RNA, 17 nt, Pseudomonas aeruginosa PA01
auguugacgauggccca

SEQ ID NO: 3376269 - RNA, 13 nt, Pseudomonas aeruginosa PA01
auguugccgccgc

SEQ ID NO: 3376270 - RNA, 16 nt, Pseudomonas aeruginosa PA01
auguugcgcagggugc

SEQ ID NO: 3376271 - RNA, 18 nt, Pseudomonas aeruginosa PA01
auguugcgcagggugccc

SEQ ID NO: 3376272 - RNA, 19 nt, Pseudomonas aeruginosa PA01
auguugcggcccagcggca

SEQ ID NO: 3376273 - RNA, 17 nt, Pseudomonas aeruginosa PA01
auguuggccuugagcag

SEQ ID NO: 3376274 - RNA, 15 nt, Pseudomonas aeruginosa PA01
auguuguugcccacc

SEQ ID NO: 3376275 - RNA, 17 nt, Pseudomonas aeruginosa PA01
auuaccccgcccacucu

SEQ ID NO: 3376276 - RNA, 18 nt, Pseudomonas aeruginosa PA01
auuaccccgcccacucuu

SEQ ID NO: 3376277 - RNA, 20 nt, Pseudomonas aeruginosa PA01
auucaaguguuagagguuga

SEQ ID NO: 3376278 - RNA, 13 nt, Pseudomonas aeruginosa PA01
auucacuuccccu

SEQ ID NO: 3376279 - RNA, 11 nt, Pseudomonas aeruginosa PA01
auucagaugcg

SEQ ID NO: 3376280 - RNA, 16 nt, Pseudomonas aeruginosa PA01
auucagcaggaauucg

SEQ ID NO: 3376281 - RNA, 13 nt, Pseudomonas aeruginosa PA01
auucagcgcgccc

SEQ ID NO: 3376282 - RNA, 18 nt, Pseudomonas aeruginosa PA01
auucagcgcgccccggcg

SEQ ID NO: 3376283 - RNA, 14 nt, Pseudomonas aeruginosa PA01
auucaggcuuccuc

SEQ ID NO: 3376284 - RNA, 21 nt, Pseudomonas aeruginosa PA01
auucagugggucgaugcccuc

SEQ ID NO: 3376285 - RNA, 14 nt, Pseudomonas aeruginosa PA01
auucaucggcggca

SEQ ID NO: 3376286 - RNA, 20 nt, Pseudomonas aeruginosa PA01
auucaucggcggcaggccga

SEQ ID NO: 3376287 - RNA, 20 nt, Pseudomonas aeruginosa PA01
auucaucucgccgucggcgg

SEQ ID NO: 3376288 - RNA, 23 nt, Pseudomonas aeruginosa PA01
auuggagaugcucaggcgcugcu

SEQ ID NO: 3376289 - RNA, 23 nt, Pseudomonas aeruginosa PA01
auuggcacccuggacccgggccu

SEQ ID NO: 3376290 - RNA, 13 nt, Pseudomonas aeruginosa PA01
auuggccaggcuc

SEQ ID NO: 3376291 - RNA, 23 nt, Pseudomonas aeruginosa PA01
auuggccaggcucgcgaugcugu

SEQ ID NO: 3376292 - RNA, 20 nt, Pseudomonas aeruginosa PA01
auuggccaucagcgccgccu

SEQ ID NO: 3376293 - RNA, 22 nt, Pseudomonas aeruginosa PA01
auuggccaucagcgccgccucg

SEQ ID NO: 3376294 - RNA, 15 nt, Pseudomonas aeruginosa PA01
auuggccgacgccgc

SEQ ID NO: 3376295 - RNA, 11 nt, Pseudomonas aeruginosa PA01
auuggccgccu

SEQ ID NO: 3376296 - RNA, 14 nt, Pseudomonas aeruginosa PA01
auuggccgccugcu

SEQ ID NO: 3376297 - RNA, 21 nt, Pseudomonas aeruginosa PA01
auuggccgccugcucggccug

SEQ ID NO: 3376298 - RNA, 24 nt, Pseudomonas aeruginosa PA01
auuggccgccugcucggccugcug

SEQ ID NO: 3376299 - RNA, 19 nt, Pseudomonas aeruginosa PA01
auuggcggaugagccgcug

SEQ ID NO: 3376300 - RNA, 14 nt, Pseudomonas aeruginosa PA01
auuggugcugccga

SEQ ID NO: 3376301 - RNA, 16 nt, Pseudomonas aeruginosa PA01
auuguccaccggcccg

SEQ ID NO: 3376302 - RNA, 16 nt, Pseudomonas aeruginosa PA01
auugucgccgccgagu

SEQ ID NO: 3376303 - RNA, 13 nt, Pseudomonas aeruginosa PA01
auugucggccucg

SEQ ID NO: 3376304 - RNA, 15 nt, Pseudomonas aeruginosa PA01
auugugcgcgcgcag

SEQ ID NO: 3376305 - RNA, 18 nt, Pseudomonas aeruginosa PA01
auuguggccccagcgcga

SEQ ID NO: 3376306 - RNA, 10 nt, Pseudomonas aeruginosa PA01
auuguugcgg

SEQ ID NO: 3376307 - RNA, 15 nt, Pseudomonas aeruginosa PA01
auuuaaguaacuuau

SEQ ID NO: 3376308 - RNA, 21 nt, Pseudomonas aeruginosa PA01
auuuaccugaguaguuucuga

SEQ ID NO: 3376309 - RNA, 16 nt, Pseudomonas aeruginosa PA01
auuuccccaacaucaa

SEQ ID NO: 3376310 - RNA, 19 nt, Pseudomonas aeruginosa PA01
auuuccccaaggcacgccc

SEQ ID NO: 3376311 - RNA, 18 nt, Pseudomonas aeruginosa PA01
auuuccgauccuccuggg

SEQ ID NO: 3376312 - RNA, 15 nt, Pseudomonas aeruginosa PA01
auuuccgcgcccggc

SEQ ID NO: 3376313 - RNA, 21 nt, Pseudomonas aeruginosa PA01
auuuccgcgcccggcuggcca

SEQ ID NO: 3376314 - RNA, 13 nt, Pseudomonas aeruginosa PA01
auuuccgcggccg

SEQ ID NO: 3376315 - RNA, 16 nt, Pseudomonas aeruginosa PA01
auuuccucgcgcaccg

SEQ ID NO: 3376316 - RNA, 14 nt, Pseudomonas aeruginosa PA01
auuuccugcggcac

SEQ ID NO: 3376317 - RNA, 17 nt, Pseudomonas aeruginosa PA01
auuucuacuucccugcc

SEQ ID NO: 3376318 - RNA, 20 nt, Pseudomonas aeruginosa PA01
auuucucgacuuccgccuug

SEQ ID NO: 3376319 - RNA, 22 nt, Pseudomonas aeruginosa PA01
auuucuucggguagccaugcac

SEQ ID NO: 3376320 - RNA, 16 nt, Pseudomonas aeruginosa PA01
auuugcccggcgaggu

SEQ ID NO: 3376321 - RNA, 12 nt, Pseudomonas aeruginosa PA01
auuugccgccga

SEQ ID NO: 3376322 - RNA, 11 nt, Pseudomonas aeruginosa PA01
auuugcgccuc

SEQ ID NO: 3376323 - RNA, 21 nt, Pseudomonas aeruginosa PA01
auuugcgccucgucgacgccc

SEQ ID NO: 3376324 - RNA, 14 nt, Pseudomonas aeruginosa PA01
auuuucauugccuc

SEQ ID NO: 3376325 - RNA, 22 nt, Pseudomonas aeruginosa PA01
auuuuccagcaggcaggcgcgg

SEQ ID NO: 3376326 - RNA, 17 nt, Pseudomonas aeruginosa PA01
auuuucgcgcucagcgc

SEQ ID NO: 3376327 - RNA, 15 nt, Pseudomonas aeruginosa PA01
auuuucuccggcgcc

SEQ ID NO: 3376328 - RNA, 17 nt, Pseudomonas aeruginosa PA01
auuuuucuaaaauggcu

SEQ ID NO: 3376329 - RNA, 15 nt, Pseudomonas aeruginosa PA01
caaaaaaaccgcccc

SEQ ID NO: 3376330 - RNA, 12 nt, Pseudomonas aeruginosa PA01
caaaaaaagggg

SEQ ID NO: 3376331 - RNA, 17 nt, Pseudomonas aeruginosa PA01
caaaaaccaugcgguuc

SEQ ID NO: 3376332 - RNA, 17 nt, Pseudomonas aeruginosa PA01
caaaaaugcccuuggcu

SEQ ID NO: 3376333 - RNA, 18 nt, Pseudomonas aeruginosa PA01
caaaaaugcccuuggcuu

SEQ ID NO: 3376334 - RNA, 22 nt, Pseudomonas aeruginosa PA01
caaaaccagccuugagccuugc

SEQ ID NO: 3376335 - RNA, 12 nt, Pseudomonas aeruginosa PA01
caaacgccgcca

SEQ ID NO: 3376336 - RNA, 23 nt, Pseudomonas aeruginosa PA01
caaacgggacagguugucgacca

SEQ ID NO: 3376337 - RNA, 21 nt, Pseudomonas aeruginosa PA01
caaacucaggguggucgauga

SEQ ID NO: 3376338 - RNA, 21 nt, Pseudomonas aeruginosa PA01
caaagcauuucuucaccaccc

SEQ ID NO: 3376339 - RNA, 18 nt, Pseudomonas aeruginosa PA01
caaagccuggagcagggc

SEQ ID NO: 3376340 - RNA, 19 nt, Pseudomonas aeruginosa PA01
caaagcgcgggcugccccu

SEQ ID NO: 3376341 - RNA, 19 nt, Pseudomonas aeruginosa PA01
caaaggaaucuucggcgcc

SEQ ID NO: 3376342 - RNA, 17 nt, Pseudomonas aeruginosa PA01
caaaggcccggcgcggu

SEQ ID NO: 3376343 - RNA, 15 nt, Pseudomonas aeruginosa PA01
caaaggcgcgcaggg

SEQ ID NO: 3376344 - RNA, 13 nt, Pseudomonas aeruginosa PA01
caaagggcagcgg

SEQ ID NO: 3376345 - RNA, 14 nt, Pseudomonas aeruginosa PA01
caacaccagcgccg

SEQ ID NO: 3376346 - RNA, 18 nt, Pseudomonas aeruginosa PA01
caacaccagcgccgccag

SEQ ID NO: 3376347 - RNA, 17 nt, Pseudomonas aeruginosa PA01
caacaccaucggcccca

SEQ ID NO: 3376348 - RNA, 22 nt, Pseudomonas aeruginosa PA01
caacaccaucggccccaccgca

SEQ ID NO: 3376349 - RNA, 14 nt, Pseudomonas aeruginosa PA01
caacacccaggccu

SEQ ID NO: 3376350 - RNA, 15 nt, Pseudomonas aeruginosa PA01
caacaccggaagcgu

SEQ ID NO: 3376351 - RNA, 19 nt, Pseudomonas aeruginosa PA01
caacaccuggcgcucgccg

SEQ ID NO: 3376352 - RNA, 19 nt, Pseudomonas aeruginosa PA01
caacacguagcgcaggucg

SEQ ID NO: 3376353 - RNA, 18 nt, Pseudomonas aeruginosa PA01
caacacuuccuucucccg

SEQ ID NO: 3376354 - RNA, 17 nt, Pseudomonas aeruginosa PA01
caacagcagguagacca

SEQ ID NO: 3376355 - RNA, 18 nt, Pseudomonas aeruginosa PA01
caacagcccgcgccgcga

SEQ ID NO: 3376356 - RNA, 17 nt, Pseudomonas aeruginosa PA01
caacagcgaagcuggcg

SEQ ID NO: 3376357 - RNA, 17 nt, Pseudomonas aeruginosa PA01
caacagcgccgcgcgcu

SEQ ID NO: 3376358 - RNA, 23 nt, Pseudomonas aeruginosa PA01
caacagcgcggcggugcagaacg

SEQ ID NO: 3376359 - RNA, 15 nt, Pseudomonas aeruginosa PA01
caacagcgucgccaa

SEQ ID NO: 3376360 - RNA, 13 nt, Pseudomonas aeruginosa PA01
caacaggacccag

SEQ ID NO: 3376361 - RNA, 19 nt, Pseudomonas aeruginosa PA01
caacaggacccagccauug

SEQ ID NO: 3376362 - RNA, 23 nt, Pseudomonas aeruginosa PA01
caacaggcaaagaccgaccagua

SEQ ID NO: 3376363 - RNA, 14 nt, Pseudomonas aeruginosa PA01
caacaggccgggcg

SEQ ID NO: 3376364 - RNA, 18 nt, Pseudomonas aeruginosa PA01
caacagggcauuggccau

SEQ ID NO: 3376365 - RNA, 14 nt, Pseudomonas aeruginosa PA01
caacagggcgucgu

SEQ ID NO: 3376366 - RNA, 17 nt, Pseudomonas aeruginosa PA01
caacaguucugccgcag

SEQ ID NO: 3376367 - RNA, 19 nt, Pseudomonas aeruginosa PA01
caacaguugccgcagcagc

SEQ ID NO: 3376368 - RNA, 21 nt, Pseudomonas aeruginosa PA01
caacauccugaaaagcgcugc

SEQ ID NO: 3376369 - RNA, 13 nt, Pseudomonas aeruginosa PA01
caacauggcgucg

SEQ ID NO: 3376370 - RNA, 21 nt, Pseudomonas aeruginosa PA01
caaccaccccgaaaccggcga

SEQ ID NO: 3376371 - RNA, 16 nt, Pseudomonas aeruginosa PA01
caaccacuccgccacc

SEQ ID NO: 3376372 - RNA, 16 nt, Pseudomonas aeruginosa PA01
caaccagaccagcagg

SEQ ID NO: 3376373 - RNA, 14 nt, Pseudomonas aeruginosa PA01
caaccagcaccgca

SEQ ID NO: 3376374 - RNA, 15 nt, Pseudomonas aeruginosa PA01
caaccagcccuggcg

SEQ ID NO: 3376375 - RNA, 17 nt, Pseudomonas aeruginosa PA01
caaccagccggagagau

SEQ ID NO: 3376376 - RNA, 23 nt, Pseudomonas aeruginosa PA01
caaccaggcgauaucccgccgcc

SEQ ID NO: 3376377 - RNA, 20 nt, Pseudomonas aeruginosa PA01
caaccccuggaucuccuggg

SEQ ID NO: 3376378 - RNA, 16 nt, Pseudomonas aeruginosa PA01
caaccccuucggucgc

SEQ ID NO: 3376379 - RNA, 20 nt, Pseudomonas aeruginosa PA01
caaccccuucggucgcgccc

SEQ ID NO: 3376380 - RNA, 20 nt, Pseudomonas aeruginosa PA01
caacccgcccuugcucgcgg

SEQ ID NO: 3376381 - RNA, 17 nt, Pseudomonas aeruginosa PA01
caacccgcuccgucgcu

SEQ ID NO: 3376382 - RNA, 16 nt, Pseudomonas aeruginosa PA01
caacccggccagcccg

SEQ ID NO: 3376383 - RNA, 19 nt, Pseudomonas aeruginosa PA01
caacccggccagcccggcc

SEQ ID NO: 3376384 - RNA, 15 nt, Pseudomonas aeruginosa PA01
caacccggcccagcg

SEQ ID NO: 3376385 - RNA, 18 nt, Pseudomonas aeruginosa PA01
caacccggcccagcguuc

SEQ ID NO: 3376386 - RNA, 17 nt, Pseudomonas aeruginosa PA01
caacccggcgcuggccg

SEQ ID NO: 3376387 - RNA, 18 nt, Pseudomonas aeruginosa PA01
caacccggcgcuggccgc

SEQ ID NO: 3376388 - RNA, 19 nt, Pseudomonas aeruginosa PA01
caacccggcgcuggccgcg

SEQ ID NO: 3376389 - RNA, 15 nt, Pseudomonas aeruginosa PA01
caacccuguccccuc

SEQ ID NO: 3376390 - RNA, 21 nt, Pseudomonas aeruginosa PA01
caacccuugcucccgccgcuc

SEQ ID NO: 3376391 - RNA, 22 nt, Pseudomonas aeruginosa PA01
caacugcuuaccuugccggugc

SEQ ID NO: 3376392 - RNA, 15 nt, Pseudomonas aeruginosa PA01
caacuggaaggccgc

SEQ ID NO: 3376393 - RNA, 23 nt, Pseudomonas aeruginosa PA01
caacuggaaggccgcgccgagau

SEQ ID NO: 3376394 - RNA, 21 nt, Pseudomonas aeruginosa PA01
caacuggauuuccuucggcac

SEQ ID NO: 3376395 - RNA, 17 nt, Pseudomonas aeruginosa PA01
caacuggcgcaacugca

SEQ ID NO: 3376396 - RNA, 19 nt, Pseudomonas aeruginosa PA01
caacuggcguagggcgaau

SEQ ID NO: 3376397 - RNA, 20 nt, Pseudomonas aeruginosa PA01
caacugggccuugaggaugu

SEQ ID NO: 3376398 - RNA, 23 nt, Pseudomonas aeruginosa PA01
caacugguccugaggcucccagg

SEQ ID NO: 3376399 - RNA, 15 nt, Pseudomonas aeruginosa PA01
caacuggucgccgca

SEQ ID NO: 3376400 - RNA, 19 nt, Pseudomonas aeruginosa PA01
caacuggucgccgcagguc

SEQ ID NO: 3376401 - RNA, 15 nt, Pseudomonas aeruginosa PA01
caacuggucgcggcu

SEQ ID NO: 3376402 - RNA, 15 nt, Pseudomonas aeruginosa PA01
caacuggucuugccg

SEQ ID NO: 3376403 - RNA, 15 nt, Pseudomonas aeruginosa PA01
caagaacgccgaccc

SEQ ID NO: 3376404 - RNA, 13 nt, Pseudomonas aeruginosa PA01
caagaagccccgc

SEQ ID NO: 3376405 - RNA, 15 nt, Pseudomonas aeruginosa PA01
caagaagccccgcua

SEQ ID NO: 3376406 - RNA, 13 nt, Pseudomonas aeruginosa PA01
caagacggucccc

SEQ ID NO: 3376407 - RNA, 15 nt, Pseudomonas aeruginosa PA01
caagagagcgccagc

SEQ ID NO: 3376408 - RNA, 22 nt, Pseudomonas aeruginosa PA01
caagaggucgacgguucgaucc

SEQ ID NO: 3376409 - RNA, 21 nt, Pseudomonas aeruginosa PA01
caagcauucagcgcgccccgg

SEQ ID NO: 3376410 - RNA, 22 nt, Pseudomonas aeruginosa PA01
caagcauucuggaugcagccgg

SEQ ID NO: 3376411 - RNA, 15 nt, Pseudomonas aeruginosa PA01
caagccaccagcgac

SEQ ID NO: 3376412 - RNA, 15 nt, Pseudomonas aeruginosa PA01
caagcccaagggcuc

SEQ ID NO: 3376413 - RNA, 24 nt, Pseudomonas aeruginosa PA01
caagcccggcgagagcguccggca

SEQ ID NO: 3376414 - RNA, 15 nt, Pseudomonas aeruginosa PA01
caagccgagcggcaa

SEQ ID NO: 3376415 - RNA, 19 nt, Pseudomonas aeruginosa PA01
caagccgagcggcaaggcc

SEQ ID NO: 3376416 - RNA, 21 nt, Pseudomonas aeruginosa PA01
caagccgagcggcaaggccaa

SEQ ID NO: 3376417 - RNA, 22 nt, Pseudomonas aeruginosa PA01
caagccgaugaaauagccggcg

SEQ ID NO: 3376418 - RNA, 15 nt, Pseudomonas aeruginosa PA01
caagccgcagcgccc

SEQ ID NO: 3376419 - RNA, 23 nt, Pseudomonas aeruginosa PA01
caagccggcgcgccccugcgccc

SEQ ID NO: 3376420 - RNA, 18 nt, Pseudomonas aeruginosa PA01
caagccguagaacgccag

SEQ ID NO: 3376421 - RNA, 19 nt, Pseudomonas aeruginosa PA01
caagccguagaacgccagg

SEQ ID NO: 3376422 - RNA, 20 nt, Pseudomonas aeruginosa PA01
caagccguuacgacaucgac

SEQ ID NO: 3376423 - RNA, 12 nt, Pseudomonas aeruginosa PA01
caagccuccagc

SEQ ID NO: 3376424 - RNA, 15 nt, Pseudomonas aeruginosa PA01
caagccuccagcgcc

SEQ ID NO: 3376425 - RNA, 16 nt, Pseudomonas aeruginosa PA01
caagccuuccagguag

SEQ ID NO: 3376426 - RNA, 12 nt, Pseudomonas aeruginosa PA01
caagcgcaugag

SEQ ID NO: 3376427 - RNA, 13 nt, Pseudomonas aeruginosa PA01
caagcgcccggcg

SEQ ID NO: 3376428 - RNA, 14 nt, Pseudomonas aeruginosa PA01
caagcgcccggcga

SEQ ID NO: 3376429 - RNA, 17 nt, Pseudomonas aeruginosa PA01
caagcggauaucccccc

SEQ ID NO: 3376430 - RNA, 22 nt, Pseudomonas aeruginosa PA01
caagcgguauugucgaugggca

SEQ ID NO: 3376431 - RNA, 23 nt, Pseudomonas aeruginosa PA01
caagcgguuauucgcccuaccgc

SEQ ID NO: 3376432 - RNA, 17 nt, Pseudomonas aeruginosa PA01
caagcuccccgccgcca

SEQ ID NO: 3376433 - RNA, 19 nt, Pseudomonas aeruginosa PA01
caagcuccccgccgccagg

SEQ ID NO: 3376434 - RNA, 21 nt, Pseudomonas aeruginosa PA01
caagcuccccgccgccaggcg

SEQ ID NO: 3376435 - RNA, 22 nt, Pseudomonas aeruginosa PA01
caagcuccccgccgccaggcgc

SEQ ID NO: 3376436 - RNA, 23 nt, Pseudomonas aeruginosa PA01
caagcuccccgccgccaggcgcu

SEQ ID NO: 3376437 - RNA, 15 nt, Pseudomonas aeruginosa PA01
caagcuccgcgaugu

SEQ ID NO: 3376438 - RNA, 18 nt, Pseudomonas aeruginosa PA01
caagcucgacgagccgcg

SEQ ID NO: 3376439 - RNA, 19 nt, Pseudomonas aeruginosa PA01
caagcucgucacccgcgcc

SEQ ID NO: 3376440 - RNA, 22 nt, Pseudomonas aeruginosa PA01
caagcucgucacccgcgccugc

SEQ ID NO: 3376441 - RNA, 14 nt, Pseudomonas aeruginosa PA01
caagcucuucgcga

SEQ ID NO: 3376442 - RNA, 16 nt, Pseudomonas aeruginosa PA01
caagcugaagcgccgc

SEQ ID NO: 3376443 - RNA, 20 nt, Pseudomonas aeruginosa PA01
caagcugcacggcgacccgc

SEQ ID NO: 3376444 - RNA, 15 nt, Pseudomonas aeruginosa PA01
caagcuggcgaucga

SEQ ID NO: 3376445 - RNA, 16 nt, Pseudomonas aeruginosa PA01
caagcuggcgaucgac

SEQ ID NO: 3376446 - RNA, 19 nt, Pseudomonas aeruginosa PA01
caagcuggcgaucgaccug

SEQ ID NO: 3376447 - RNA, 20 nt, Pseudomonas aeruginosa PA01
caagcuuguugcgcaggcga

SEQ ID NO: 3376448 - RNA, 17 nt, Pseudomonas aeruginosa PA01
caaggaacuggaagccu

SEQ ID NO: 3376449 - RNA, 15 nt, Pseudomonas aeruginosa PA01
caaggaccugcugcc

SEQ ID NO: 3376450 - RNA, 20 nt, Pseudomonas aeruginosa PA01
caaggaccugcugcccggca

SEQ ID NO: 3376451 - RNA, 19 nt, Pseudomonas aeruginosa PA01
caaggagcgcgagcggcag

SEQ ID NO: 3376452 - RNA, 20 nt, Pseudomonas aeruginosa PA01
caaggagcgcgagcggcaga

SEQ ID NO: 3376453 - RNA, 14 nt, Pseudomonas aeruginosa PA01
caaggaugcgccag

SEQ ID NO: 3376454 - RNA, 19 nt, Pseudomonas aeruginosa PA01
caaggaugcgccagcggcc

SEQ ID NO: 3376455 - RNA, 21 nt, Pseudomonas aeruginosa PA01
caaggaugcgccagcggcccg

SEQ ID NO: 3376456 - RNA, 13 nt, Pseudomonas aeruginosa PA01
caaggcacacgcc

SEQ ID NO: 3376457 - RNA, 15 nt, Pseudomonas aeruginosa PA01
caaggcacacgcccg

SEQ ID NO: 3376458 - RNA, 16 nt, Pseudomonas aeruginosa PA01
caaggcacacgcccgg

SEQ ID NO: 3376459 - RNA, 22 nt, Pseudomonas aeruginosa PA01
caaggcacacgcccggcacucg

SEQ ID NO: 3376460 - RNA, 13 nt, Pseudomonas aeruginosa PA01
caaggcacgcccc

SEQ ID NO: 3376461 - RNA, 19 nt, Pseudomonas aeruginosa PA01
caaggcauugcgcuugcga

SEQ ID NO: 3376462 - RNA, 19 nt, Pseudomonas aeruginosa PA01
caaggccaagucggccgcc

SEQ ID NO: 3376463 - RNA, 17 nt, Pseudomonas aeruginosa PA01
caaggccagcggcaucc

SEQ ID NO: 3376464 - RNA, 14 nt, Pseudomonas aeruginosa PA01
caaggccagggcgg

SEQ ID NO: 3376465 - RNA, 18 nt, Pseudomonas aeruginosa PA01
caaggccagggcggcgcc

SEQ ID NO: 3376466 - RNA, 23 nt, Pseudomonas aeruginosa PA01
caaggcccugcugcagggccucg

SEQ ID NO: 3376467 - RNA, 15 nt, Pseudomonas aeruginosa PA01
caaggccgccaggcc

SEQ ID NO: 3376468 - RNA, 20 nt, Pseudomonas aeruginosa PA01
caaggccucggcauccucgc

SEQ ID NO: 3376469 - RNA, 21 nt, Pseudomonas aeruginosa PA01
caaggcgcugaagcggccgag

SEQ ID NO: 3376470 - RNA, 12 nt, Pseudomonas aeruginosa PA01
caaggcggccuc

SEQ ID NO: 3376471 - RNA, 18 nt, Pseudomonas aeruginosa PA01
caaggcggggcuuuuucg

SEQ ID NO: 3376472 - RNA, 17 nt, Pseudomonas aeruginosa PA01
caaggcggugaccagcg

SEQ ID NO: 3376473 - RNA, 20 nt, Pseudomonas aeruginosa PA01
caaggcgucauagcagcgcc

SEQ ID NO: 3376474 - RNA, 18 nt, Pseudomonas aeruginosa PA01
caaggcugaggccgacga

SEQ ID NO: 3376475 - RNA, 22 nt, Pseudomonas aeruginosa PA01
caaggcuucggcggucaggcuc

SEQ ID NO: 3376476 - RNA, 18 nt, Pseudomonas aeruginosa PA01
caagggcacgugcagcgg

SEQ ID NO: 3376477 - RNA, 18 nt, Pseudomonas aeruginosa PA01
caagggcacuucguccag

SEQ ID NO: 3376478 - RNA, 21 nt, Pseudomonas aeruginosa PA01
caagggcacuucguccaggcc

SEQ ID NO: 3376479 - RNA, 17 nt, Pseudomonas aeruginosa PA01
caagggccagagcacga

SEQ ID NO: 3376480 - RNA, 23 nt, Pseudomonas aeruginosa PA01
caagggccaggaaaucgagcgcc

SEQ ID NO: 3376481 - RNA, 16 nt, Pseudomonas aeruginosa PA01
caagggccugcucagc

SEQ ID NO: 3376482 - RNA, 20 nt, Pseudomonas aeruginosa PA01
caagggccugggcgccgcca

SEQ ID NO: 3376483 - RNA, 13 nt, Pseudomonas aeruginosa PA01
caagggcgccgcc

SEQ ID NO: 3376484 - RNA, 22 nt, Pseudomonas aeruginosa PA01
caagggcgucugggacggcagc

SEQ ID NO: 3376485 - RNA, 15 nt, Pseudomonas aeruginosa PA01
caagggcuccgcaag

SEQ ID NO: 3376486 - RNA, 13 nt, Pseudomonas aeruginosa PA01
caaggggccgcgc

SEQ ID NO: 3376487 - RNA, 21 nt, Pseudomonas aeruginosa PA01
caaggggccgcgcuucaccag

SEQ ID NO: 3376488 - RNA, 23 nt, Pseudomonas aeruginosa PA01
caaggguuucgugaaacgccaga

SEQ ID NO: 3376489 - RNA, 18 nt, Pseudomonas aeruginosa PA01
caaggucgucucagaccu

SEQ ID NO: 3376490 - RNA, 20 nt, Pseudomonas aeruginosa PA01
caaggugccgaggucgucgc

SEQ ID NO: 3376491 - RNA, 17 nt, Pseudomonas aeruginosa PA01
caaggugggcagcagcg

SEQ ID NO: 3376492 - RNA, 20 nt, Pseudomonas aeruginosa PA01
caagguguggccgagccccg

SEQ ID NO: 3376493 - RNA, 20 nt, Pseudomonas aeruginosa PA01
cacaggcguuauccgccgcc

SEQ ID NO: 3376494 - RNA, 21 nt, Pseudomonas aeruginosa PA01
cacaggcguuauccgccgccg

SEQ ID NO: 3376495 - RNA, 14 nt, Pseudomonas aeruginosa PA01
cacaggcucuucuc

SEQ ID NO: 3376496 - RNA, 14 nt, Pseudomonas aeruginosa PA01
cacaggcuggccag

SEQ ID NO: 3376497 - RNA, 18 nt, Pseudomonas aeruginosa PA01
cacagggcgacuaccagg

SEQ ID NO: 3376498 - RNA, 13 nt, Pseudomonas aeruginosa PA01
cacaggguggcgg

SEQ ID NO: 3376499 - RNA, 21 nt, Pseudomonas aeruginosa PA01
cacaggguggcgggcggcccc

SEQ ID NO: 3376500 - RNA, 22 nt, Pseudomonas aeruginosa PA01
cacaggguggcgggcggccccu

SEQ ID NO: 3376501 - RNA, 22 nt, Pseudomonas aeruginosa PA01
cacagguugacgaugcggcccg

SEQ ID NO: 3376502 - RNA, 23 nt, Pseudomonas aeruginosa PA01
cacagguugacgaugcggcccgc

SEQ ID NO: 3376503 - RNA, 24 nt, Pseudomonas aeruginosa PA01
cacagguugacgaugcggcccgcc

SEQ ID NO: 3376504 - RNA, 15 nt, Pseudomonas aeruginosa PA01
cacaguacgccuugc

SEQ ID NO: 3376505 - RNA, 14 nt, Pseudomonas aeruginosa PA01
cacagugccaggcu

SEQ ID NO: 3376506 - RNA, 21 nt, Pseudomonas aeruginosa PA01
cacagugccaggcucgccgcc

SEQ ID NO: 3376507 - RNA, 19 nt, Pseudomonas aeruginosa PA01
cacaguuccuguaccaggg

SEQ ID NO: 3376508 - RNA, 13 nt, Pseudomonas aeruginosa PA01
cacauacaccuug

SEQ ID NO: 3376509 - RNA, 19 nt, Pseudomonas aeruginosa PA01
cacauagagggucagccgg

SEQ ID NO: 3376510 - RNA, 22 nt, Pseudomonas aeruginosa PA01
cacauagagggucagccggccg

SEQ ID NO: 3376511 - RNA, 17 nt, Pseudomonas aeruginosa PA01
cacaucaccuucgcccu

SEQ ID NO: 3376512 - RNA, 15 nt, Pseudomonas aeruginosa PA01
cacauccaguguggc

SEQ ID NO: 3376513 - RNA, 21 nt, Pseudomonas aeruginosa PA01
cacauccaguguggcggcgug

SEQ ID NO: 3376514 - RNA, 15 nt, Pseudomonas aeruginosa PA01
cacauccaguugcau

SEQ ID NO: 3376515 - RNA, 14 nt, Pseudomonas aeruginosa PA01
cacauccuugccgu

SEQ ID NO: 3376516 - RNA, 17 nt, Pseudomonas aeruginosa PA01
cacaucgaccaggucgc

SEQ ID NO: 3376517 - RNA, 19 nt, Pseudomonas aeruginosa PA01
cacaucgcccggcagcagg

SEQ ID NO: 3376518 - RNA, 14 nt, Pseudomonas aeruginosa PA01
cacaugcaccaggc

SEQ ID NO: 3376519 - RNA, 22 nt, Pseudomonas aeruginosa PA01
cacaugcaccaggcccugcucc

SEQ ID NO: 3376520 - RNA, 17 nt, Pseudomonas aeruginosa PA01
cacaugcaggcucgaca

SEQ ID NO: 3376521 - RNA, 20 nt, Pseudomonas aeruginosa PA01
cacaugcaggucgugcagcc

SEQ ID NO: 3376522 - RNA, 22 nt, Pseudomonas aeruginosa PA01
cacaugcaggucgugcagcccg

SEQ ID NO: 3376523 - RNA, 13 nt, Pseudomonas aeruginosa PA01
cacaugcgcucgu

SEQ ID NO: 3376524 - RNA, 23 nt, Pseudomonas aeruginosa PA01
cacauggaucggcaacuggcugg

SEQ ID NO: 3376525 - RNA, 12 nt, Pseudomonas aeruginosa PA01
cacauggcgguc

SEQ ID NO: 3376526 - RNA, 16 nt, Pseudomonas aeruginosa PA01
cacauggucggccagg

SEQ ID NO: 3376527 - RNA, 17 nt, Pseudomonas aeruginosa PA01
cacauggucggccaggu

SEQ ID NO: 3376528 - RNA, 20 nt, Pseudomonas aeruginosa PA01
caccaagcggauguucuuca

SEQ ID NO: 3376529 - RNA, 23 nt, Pseudomonas aeruginosa PA01
caccaagcggauguucuucaccu

SEQ ID NO: 3376530 - RNA, 16 nt, Pseudomonas aeruginosa PA01
caccacaaggugggca

SEQ ID NO: 3376531 - RNA, 22 nt, Pseudomonas aeruginosa PA01
caccacaaggugggcagcagcg

SEQ ID NO: 3376532 - RNA, 23 nt, Pseudomonas aeruginosa PA01
caccacaaggugggcagcagcga

SEQ ID NO: 3376533 - RNA, 15 nt, Pseudomonas aeruginosa PA01
caccacagcaccacg

SEQ ID NO: 3376534 - RNA, 15 nt, Pseudomonas aeruginosa PA01
caccaccaccgcgcc

SEQ ID NO: 3376535 - RNA, 14 nt, Pseudomonas aeruginosa PA01
caccaccagcauca

SEQ ID NO: 3376536 - RNA, 19 nt, Pseudomonas aeruginosa PA01
caccaccagcaucaccacc

SEQ ID NO: 3376537 - RNA, 23 nt, Pseudomonas aeruginosa PA01
caccaccagcaucaccaccggga

SEQ ID NO: 3376538 - RNA, 18 nt, Pseudomonas aeruginosa PA01
caccaccagcaucagcag

SEQ ID NO: 3376539 - RNA, 13 nt, Pseudomonas aeruginosa PA01
caccaccagcgcc

SEQ ID NO: 3376540 - RNA, 16 nt, Pseudomonas aeruginosa PA01
caccaccagcgccgcc

SEQ ID NO: 3376541 - RNA, 19 nt, Pseudomonas aeruginosa PA01
caccaccagcgcgcgcugg

SEQ ID NO: 3376542 - RNA, 17 nt, Pseudomonas aeruginosa PA01
caccaccagggucucca

SEQ ID NO: 3376543 - RNA, 19 nt, Pseudomonas aeruginosa PA01
caccaccagggucuccagg

SEQ ID NO: 3376544 - RNA, 20 nt, Pseudomonas aeruginosa PA01
caccaccagggucuccagga

SEQ ID NO: 3376545 - RNA, 22 nt, Pseudomonas aeruginosa PA01
caccaccagggucuccaggacc

SEQ ID NO: 3376546 - RNA, 15 nt, Pseudomonas aeruginosa PA01
caccaccaggucggc

SEQ ID NO: 3376547 - RNA, 19 nt, Pseudomonas aeruginosa PA01
caccaccaggucggcgcgc

SEQ ID NO: 3376548 - RNA, 11 nt, Pseudomonas aeruginosa PA01
caccaccaucg

SEQ ID NO: 3376549 - RNA, 16 nt, Pseudomonas aeruginosa PA01
caccaccaucgccgcg

SEQ ID NO: 3376550 - RNA, 16 nt, Pseudomonas aeruginosa PA01
caccacccagccgcgg

SEQ ID NO: 3376551 - RNA, 19 nt, Pseudomonas aeruginosa PA01
caccacccagccgcggccg

SEQ ID NO: 3376552 - RNA, 17 nt, Pseudomonas aeruginosa PA01
caccacccaucugccgg

SEQ ID NO: 3376553 - RNA, 21 nt, Pseudomonas aeruginosa PA01
caccacccgcugcaacuccgc

SEQ ID NO: 3376554 - RNA, 15 nt, Pseudomonas aeruginosa PA01
caccacccggccgcg

SEQ ID NO: 3376555 - RNA, 19 nt, Pseudomonas aeruginosa PA01
caccacccggcgcacgccg

SEQ ID NO: 3376556 - RNA, 16 nt, Pseudomonas aeruginosa PA01
caccaccgacaggccg

SEQ ID NO: 3376557 - RNA, 19 nt, Pseudomonas aeruginosa PA01
caccaccgacgggucgcca

SEQ ID NO: 3376558 - RNA, 18 nt, Pseudomonas aeruginosa PA01
caccaccgagagcggcgc

SEQ ID NO: 3376559 - RNA, 12 nt, Pseudomonas aeruginosa PA01
caccaccgccgc

SEQ ID NO: 3376560 - RNA, 16 nt, Pseudomonas aeruginosa PA01
caccaccgccgccagc

SEQ ID NO: 3376561 - RNA, 17 nt, Pseudomonas aeruginosa PA01
caccaccgccgccagca

SEQ ID NO: 3376562 - RNA, 13 nt, Pseudomonas aeruginosa PA01
caccaccggcugg

SEQ ID NO: 3376563 - RNA, 14 nt, Pseudomonas aeruginosa PA01
caccaccggcuggc

SEQ ID NO: 3376564 - RNA, 22 nt, Pseudomonas aeruginosa PA01
caccaccgggaugaacugcagc

SEQ ID NO: 3376565 - RNA, 18 nt, Pseudomonas aeruginosa PA01
caccaccgggggaagaac

SEQ ID NO: 3376566 - RNA, 21 nt, Pseudomonas aeruginosa PA01
caccaccgggggaagaaccca

SEQ ID NO: 3376567 - RNA, 11 nt, Pseudomonas aeruginosa PA01
caccaccguca

SEQ ID NO: 3376568 - RNA, 23 nt, Pseudomonas aeruginosa PA01
caccaccgucuggcgcauccgcc

SEQ ID NO: 3376569 - RNA, 19 nt, Pseudomonas aeruginosa PA01
caccaccgugaccagcaug

SEQ ID NO: 3376570 - RNA, 14 nt, Pseudomonas aeruginosa PA01
caccaccucgccaa

SEQ ID NO: 3376571 - RNA, 13 nt, Pseudomonas aeruginosa PA01
caccaccuggcag

SEQ ID NO: 3376572 - RNA, 13 nt, Pseudomonas aeruginosa PA01
caccacgaucagg

SEQ ID NO: 3376573 - RNA, 14 nt, Pseudomonas aeruginosa PA01
caccacgaucaggc

SEQ ID NO: 3376574 - RNA, 18 nt, Pseudomonas aeruginosa PA01
caccacgcauugucgggc

SEQ ID NO: 3376575 - RNA, 19 nt, Pseudomonas aeruginosa PA01
caccacgccgucgccgcug

SEQ ID NO: 3376576 - RNA, 22 nt, Pseudomonas aeruginosa PA01
caccacgcgauauccgccaggc

SEQ ID NO: 3376577 - RNA, 23 nt, Pseudomonas aeruginosa PA01
caccacgcgauauccgccaggcg

SEQ ID NO: 3376578 - RNA, 15 nt, Pseudomonas aeruginosa PA01
caccacgcggugcca

SEQ ID NO: 3376579 - RNA, 20 nt, Pseudomonas aeruginosa PA01
caccacggcgaagccgcgcc

SEQ ID NO: 3376580 - RNA, 22 nt, Pseudomonas aeruginosa PA01
caccacggcgaagccgcgcccg

SEQ ID NO: 3376581 - RNA, 20 nt, Pseudomonas aeruginosa PA01
caccacgguguugccguggu

SEQ ID NO: 3376582 - RNA, 17 nt, Pseudomonas aeruginosa PA01
caccacguucggcgcgg

SEQ ID NO: 3376583 - RNA, 13 nt, Pseudomonas aeruginosa PA01
caccacguugcgc

SEQ ID NO: 3376584 - RNA, 18 nt, Pseudomonas aeruginosa PA01
caccacguugcgccgcag

SEQ ID NO: 3376585 - RNA, 20 nt, Pseudomonas aeruginosa PA01
caccacguugcgccgcagca

SEQ ID NO: 3376586 - RNA, 17 nt, Pseudomonas aeruginosa PA01
caccacucgccagcgcg

SEQ ID NO: 3376587 - RNA, 16 nt, Pseudomonas aeruginosa PA01
caccacucgcgagcug

SEQ ID NO: 3376588 - RNA, 17 nt, Pseudomonas aeruginosa PA01
caccacucgcgagcugg

SEQ ID NO: 3376589 - RNA, 14 nt, Pseudomonas aeruginosa PA01
caccacugcaacac

SEQ ID NO: 3376590 - RNA, 18 nt, Pseudomonas aeruginosa PA01
caccacuggaaacgccca

SEQ ID NO: 3376591 - RNA, 13 nt, Pseudomonas aeruginosa PA01
caccacuucgcgg

SEQ ID NO: 3376592 - RNA, 20 nt, Pseudomonas aeruginosa PA01
caccacuucgcggaccacgu

SEQ ID NO: 3376593 - RNA, 19 nt, Pseudomonas aeruginosa PA01
caccagacgcagcaugucg

SEQ ID NO: 3376594 - RNA, 14 nt, Pseudomonas aeruginosa PA01
caccagagccagcc

SEQ ID NO: 3376595 - RNA, 16 nt, Pseudomonas aeruginosa PA01
caccagggucacgccg

SEQ ID NO: 3376596 - RNA, 18 nt, Pseudomonas aeruginosa PA01
caccagggucacgccgcg

SEQ ID NO: 3376597 - RNA, 14 nt, Pseudomonas aeruginosa PA01
caccagggucggca

SEQ ID NO: 3376598 - RNA, 15 nt, Pseudomonas aeruginosa PA01
caccagggucggcac

SEQ ID NO: 3376599 - RNA, 19 nt, Pseudomonas aeruginosa PA01
caccagggucgggccgcgc

SEQ ID NO: 3376600 - RNA, 20 nt, Pseudomonas aeruginosa PA01
caccagggucgguucgcggc

SEQ ID NO: 3376601 - RNA, 17 nt, Pseudomonas aeruginosa PA01
caccagggucuccagga

SEQ ID NO: 3376602 - RNA, 17 nt, Pseudomonas aeruginosa PA01
caccaggguggcgcgca

SEQ ID NO: 3376603 - RNA, 23 nt, Pseudomonas aeruginosa PA01
caccaggguggcgcgcaccaccu

SEQ ID NO: 3376604 - RNA, 23 nt, Pseudomonas aeruginosa PA01
caccaggucgauccugaccccgg

SEQ ID NO: 3376605 - RNA, 22 nt, Pseudomonas aeruginosa PA01
caccaggucgccgcacaccgcg

SEQ ID NO: 3376606 - RNA, 19 nt, Pseudomonas aeruginosa PA01
caccaggucgcggaucagg

SEQ ID NO: 3376607 - RNA, 19 nt, Pseudomonas aeruginosa PA01
caccaggucgcuguccucc

SEQ ID NO: 3376608 - RNA, 23 nt, Pseudomonas aeruginosa PA01
caccaggucgcuguccuccagcg

SEQ ID NO: 3376609 - RNA, 14 nt, Pseudomonas aeruginosa PA01
caccaggucggcgc

SEQ ID NO: 3376610 - RNA, 15 nt, Pseudomonas aeruginosa PA01
caccaggucggcgcg

SEQ ID NO: 3376611 - RNA, 16 nt, Pseudomonas aeruginosa PA01
caccaggucggcgcgc

SEQ ID NO: 3376612 - RNA, 18 nt, Pseudomonas aeruginosa PA01
caccaggucggcgcgcga

SEQ ID NO: 3376613 - RNA, 19 nt, Pseudomonas aeruginosa PA01
caccaggucgucgucacgc

SEQ ID NO: 3376614 - RNA, 16 nt, Pseudomonas aeruginosa PA01
caccagguugaagaac

SEQ ID NO: 3376615 - RNA, 22 nt, Pseudomonas aeruginosa PA01
caccagguugaagaacggcccg

SEQ ID NO: 3376616 - RNA, 23 nt, Pseudomonas aeruginosa PA01
caccagguugaagaacggcccgc

SEQ ID NO: 3376617 - RNA, 14 nt, Pseudomonas aeruginosa PA01
caccagguuggcca

SEQ ID NO: 3376618 - RNA, 16 nt, Pseudomonas aeruginosa PA01
caccagucccuggccg

SEQ ID NO: 3376619 - RNA, 21 nt, Pseudomonas aeruginosa PA01
caccagucccuggccggcgau

SEQ ID NO: 3376620 - RNA, 16 nt, Pseudomonas aeruginosa PA01
caccaguggcgccgcc

SEQ ID NO: 3376621 - RNA, 13 nt, Pseudomonas aeruginosa PA01
caccauaccgaca

SEQ ID NO: 3376622 - RNA, 21 nt, Pseudomonas aeruginosa PA01
caccauaccgacaugccccgc

SEQ ID NO: 3376623 - RNA, 21 nt, Pseudomonas aeruginosa PA01
caccaucaccgccaucagcac

SEQ ID NO: 3376624 - RNA, 20 nt, Pseudomonas aeruginosa PA01
caccaucacgucgcgcaccu

SEQ ID NO: 3376625 - RNA, 14 nt, Pseudomonas aeruginosa PA01
caccaucagccagc

SEQ ID NO: 3376626 - RNA, 16 nt, Pseudomonas aeruginosa PA01
caccauccgccgcagg

SEQ ID NO: 3376627 - RNA, 21 nt, Pseudomonas aeruginosa PA01
caccauccgccgcaggucggc

SEQ ID NO: 3376628 - RNA, 14 nt, Pseudomonas aeruginosa PA01
caccaucgcggcga

SEQ ID NO: 3376629 - RNA, 15 nt, Pseudomonas aeruginosa PA01
caccaucgcggcgau

SEQ ID NO: 3376630 - RNA, 21 nt, Pseudomonas aeruginosa PA01
caccaucgcggcgauggccgc

SEQ ID NO: 3376631 - RNA, 22 nt, Pseudomonas aeruginosa PA01
caccaucgcggcgauggccgcc

SEQ ID NO: 3376632 - RNA, 23 nt, Pseudomonas aeruginosa PA01
caccaucgcggcgauggccgcca

SEQ ID NO: 3376633 - RNA, 20 nt, Pseudomonas aeruginosa PA01
caccaugaucaucggcuggc

SEQ ID NO: 3376634 - RNA, 16 nt, Pseudomonas aeruginosa PA01
caccaugcccgcuggg

SEQ ID NO: 3376635 - RNA, 19 nt, Pseudomonas aeruginosa PA01
caccaugccgaugacaugg

SEQ ID NO: 3376636 - RNA, 15 nt, Pseudomonas aeruginosa PA01
caccauuuccagcaa

SEQ ID NO: 3376637 - RNA, 14 nt, Pseudomonas aeruginosa PA01
cacccacauggcgg

SEQ ID NO: 3376638 - RNA, 16 nt, Pseudomonas aeruginosa PA01
cacccagagcaccagg

SEQ ID NO: 3376639 - RNA, 16 nt, Pseudomonas aeruginosa PA01
cacccagccgcggccg

SEQ ID NO: 3376640 - RNA, 17 nt, Pseudomonas aeruginosa PA01
cacccagccgcggccgu

SEQ ID NO: 3376641 - RNA, 14 nt, Pseudomonas aeruginosa PA01
cacccaggccacgc

SEQ ID NO: 3376642 - RNA, 15 nt, Pseudomonas aeruginosa PA01
cacccaggccugggu

SEQ ID NO: 3376643 - RNA, 16 nt, Pseudomonas aeruginosa PA01
cacccaggcgccgauc

SEQ ID NO: 3376644 - RNA, 21 nt, Pseudomonas aeruginosa PA01
cacccagggcaguacguggcg

SEQ ID NO: 3376645 - RNA, 13 nt, Pseudomonas aeruginosa PA01
cacccaucugccg

SEQ ID NO: 3376646 - RNA, 15 nt, Pseudomonas aeruginosa PA01
cacccaucugccggc

SEQ ID NO: 3376647 - RNA, 17 nt, Pseudomonas aeruginosa PA01
cacccaucugccggcca

SEQ ID NO: 3376648 - RNA, 19 nt, Pseudomonas aeruginosa PA01
cacccauucgaugccgcgc

SEQ ID NO: 3376649 - RNA, 23 nt, Pseudomonas aeruginosa PA01
cacccauucgaugccgcgcgccu

SEQ ID NO: 3376650 - RNA, 21 nt, Pseudomonas aeruginosa PA01
caccccacaaaaaaaaucagu

SEQ ID NO: 3376651 - RNA, 14 nt, Pseudomonas aeruginosa PA01
caccccacgggcga

SEQ ID NO: 3376652 - RNA, 21 nt, Pseudomonas aeruginosa PA01
caccccacgggcgacccaggc

SEQ ID NO: 3376653 - RNA, 22 nt, Pseudomonas aeruginosa PA01
caccccacgggcgacccaggcc

SEQ ID NO: 3376654 - RNA, 19 nt, Pseudomonas aeruginosa PA01
caccccaggguuggcggca

SEQ ID NO: 3376655 - RNA, 15 nt, Pseudomonas aeruginosa PA01
caccccauccucgcc

SEQ ID NO: 3376656 - RNA, 12 nt, Pseudomonas aeruginosa PA01
cacccccagcag

SEQ ID NO: 3376657 - RNA, 13 nt, Pseudomonas aeruginosa PA01
cacccccaucgcc

SEQ ID NO: 3376658 - RNA, 18 nt, Pseudomonas aeruginosa PA01
cacccccgcaaccgcugc

SEQ ID NO: 3376659 - RNA, 16 nt, Pseudomonas aeruginosa PA01
cacccccggcccggcc

SEQ ID NO: 3376660 - RNA, 17 nt, Pseudomonas aeruginosa PA01
caccccgaaaccggcga

SEQ ID NO: 3376661 - RNA, 14 nt, Pseudomonas aeruginosa PA01
caccccgaccagcg

SEQ ID NO: 3376662 - RNA, 16 nt, Pseudomonas aeruginosa PA01
caccccgaccagcgcg

SEQ ID NO: 3376663 - RNA, 17 nt, Pseudomonas aeruginosa PA01
caccccgaccagcgcgc

SEQ ID NO: 3376664 - RNA, 18 nt, Pseudomonas aeruginosa PA01
caccccgaccagcgcgcu

SEQ ID NO: 3376665 - RNA, 15 nt, Pseudomonas aeruginosa PA01
caccccgagcccggc

SEQ ID NO: 3376666 - RNA, 18 nt, Pseudomonas aeruginosa PA01
caccccgagcggcgcgaa

SEQ ID NO: 3376667 - RNA, 22 nt, Pseudomonas aeruginosa PA01
caccccgcccuuggcggcgcca

SEQ ID NO: 3376668 - RNA, 17 nt, Pseudomonas aeruginosa PA01
caccccgccgcgcauca

SEQ ID NO: 3376669 - RNA, 16 nt, Pseudomonas aeruginosa PA01
caccccgccgcuggcg

SEQ ID NO: 3376670 - RNA, 23 nt, Pseudomonas aeruginosa PA01
caccccggucauggugccgagca

SEQ ID NO: 3376671 - RNA, 23 nt, Pseudomonas aeruginosa PA01
caccccgucaacccuugcucccg

SEQ ID NO: 3376672 - RNA, 18 nt, Pseudomonas aeruginosa PA01
caccccgucgacgcccug

SEQ ID NO: 3376673 - RNA, 16 nt, Pseudomonas aeruginosa PA01
caccccuucgagcaac

SEQ ID NO: 3376674 - RNA, 17 nt, Pseudomonas aeruginosa PA01
caccccuugcagccagc

SEQ ID NO: 3376675 - RNA, 18 nt, Pseudomonas aeruginosa PA01
cacccgaaagccgaagcg

SEQ ID NO: 3376676 - RNA, 18 nt, Pseudomonas aeruginosa PA01
cacccgaagguguccgcc

SEQ ID NO: 3376677 - RNA, 13 nt, Pseudomonas aeruginosa PA01
cacccgcaccagc

SEQ ID NO: 3376678 - RNA, 16 nt, Pseudomonas aeruginosa PA01
cacccgcaccagccgg

SEQ ID NO: 3376679 - RNA, 18 nt, Pseudomonas aeruginosa PA01
cacccgcaccagccggcg

SEQ ID NO: 3376680 - RNA, 19 nt, Pseudomonas aeruginosa PA01
cacccgcaccagccggcgc

SEQ ID NO: 3376681 - RNA, 22 nt, Pseudomonas aeruginosa PA01
cacccgcaccgguucgacacgc

SEQ ID NO: 3376682 - RNA, 22 nt, Pseudomonas aeruginosa PA01
cacccgcagccccgccggaaga

SEQ ID NO: 3376683 - RNA, 22 nt, Pseudomonas aeruginosa PA01
cacccgcagccgcgugcgcgcc

SEQ ID NO: 3376684 - RNA, 14 nt, Pseudomonas aeruginosa PA01
cacccgcagcggca

SEQ ID NO: 3376685 - RNA, 15 nt, Pseudomonas aeruginosa PA01
cacccgcagcggcag

SEQ ID NO: 3376686 - RNA, 17 nt, Pseudomonas aeruginosa PA01
cacccgcagcggcagcg

SEQ ID NO: 3376687 - RNA, 23 nt, Pseudomonas aeruginosa PA01
cacccgcagcggcagcggcucgu

SEQ ID NO: 3376688 - RNA, 18 nt, Pseudomonas aeruginosa PA01
cacccgcaucgaggccgc

SEQ ID NO: 3376689 - RNA, 13 nt, Pseudomonas aeruginosa PA01
cacccgccucguc

SEQ ID NO: 3376690 - RNA, 23 nt, Pseudomonas aeruginosa PA01
cacccgccucgucgccaugcggc

SEQ ID NO: 3376691 - RNA, 14 nt, Pseudomonas aeruginosa PA01
cacccgcgacucga

SEQ ID NO: 3376692 - RNA, 17 nt, Pseudomonas aeruginosa PA01
cacccgcgacucgagca

SEQ ID NO: 3376693 - RNA, 15 nt, Pseudomonas aeruginosa PA01
cacccgcgaggccgg

SEQ ID NO: 3376694 - RNA, 14 nt, Pseudomonas aeruginosa PA01
cacccgcgccgccg

SEQ ID NO: 3376695 - RNA, 15 nt, Pseudomonas aeruginosa PA01
cacccgcgccgccgc

SEQ ID NO: 3376696 - RNA, 18 nt, Pseudomonas aeruginosa PA01
cacccgcgccgccgcggc

SEQ ID NO: 3376697 - RNA, 13 nt, Pseudomonas aeruginosa PA01
caccgccaccccg

SEQ ID NO: 3376698 - RNA, 15 nt, Pseudomonas aeruginosa PA01
caccgccaccccgcc

SEQ ID NO: 3376699 - RNA, 18 nt, Pseudomonas aeruginosa PA01
caccgccaccugccccgg

SEQ ID NO: 3376700 - RNA, 19 nt, Pseudomonas aeruginosa PA01
caccgccaccugccccggg

SEQ ID NO: 3376701 - RNA, 14 nt, Pseudomonas aeruginosa PA01
caccgccagcaccc

SEQ ID NO: 3376702 - RNA, 20 nt, Pseudomonas aeruginosa PA01
caccgccagcgggacgaugc

SEQ ID NO: 3376703 - RNA, 18 nt, Pseudomonas aeruginosa PA01
caccgccagcgucgccgc

SEQ ID NO: 3376704 - RNA, 19 nt, Pseudomonas aeruginosa PA01
caccgccagcgucgccgcc

SEQ ID NO: 3376705 - RNA, 20 nt, Pseudomonas aeruginosa PA01
caccgccagcgucgccgccg

SEQ ID NO: 3376706 - RNA, 23 nt, Pseudomonas aeruginosa PA01
caccgccagcgucgccgccgcgg

SEQ ID NO: 3376707 - RNA, 16 nt, Pseudomonas aeruginosa PA01
caccgccaggcuggcc

SEQ ID NO: 3376708 - RNA, 15 nt, Pseudomonas aeruginosa PA01
caccgccaucagcac

SEQ ID NO: 3376709 - RNA, 14 nt, Pseudomonas aeruginosa PA01
caccgcccagccga

SEQ ID NO: 3376710 - RNA, 16 nt, Pseudomonas aeruginosa PA01
caccgcccccgcaucc

SEQ ID NO: 3376711 - RNA, 20 nt, Pseudomonas aeruginosa PA01
caccgcccccgcauccucca

SEQ ID NO: 3376712 - RNA, 13 nt, Pseudomonas aeruginosa PA01
caccgcccccggc

SEQ ID NO: 3376713 - RNA, 16 nt, Pseudomonas aeruginosa PA01
caccgcccccggcgcc

SEQ ID NO: 3376714 - RNA, 19 nt, Pseudomonas aeruginosa PA01
caccgcccccggcgccacc

SEQ ID NO: 3376715 - RNA, 13 nt, Pseudomonas aeruginosa PA01
caccgcccugcgc

SEQ ID NO: 3376716 - RNA, 14 nt, Pseudomonas aeruginosa PA01
caccgcccugcgcg

SEQ ID NO: 3376717 - RNA, 24 nt, Pseudomonas aeruginosa PA01
caccgccgacaucggagugcaugc

SEQ ID NO: 3376718 - RNA, 14 nt, Pseudomonas aeruginosa PA01
caccgccgaggaac

SEQ ID NO: 3376719 - RNA, 14 nt, Pseudomonas aeruginosa PA01
caccgccgccagca

SEQ ID NO: 3376720 - RNA, 16 nt, Pseudomonas aeruginosa PA01
caccgccgccagcaac

SEQ ID NO: 3376721 - RNA, 19 nt, Pseudomonas aeruginosa PA01
caccgccggguacagcgcc

SEQ ID NO: 3376722 - RNA, 20 nt, Pseudomonas aeruginosa PA01
caccgccucggagaacagca

SEQ ID NO: 3376723 - RNA, 23 nt, Pseudomonas aeruginosa PA01
caccgccucggagaacagcagcg

SEQ ID NO: 3376724 - RNA, 19 nt, Pseudomonas aeruginosa PA01
caccgccugcaacucgucg

SEQ ID NO: 3376725 - RNA, 15 nt, Pseudomonas aeruginosa PA01
caccgccugccccac

SEQ ID NO: 3376726 - RNA, 14 nt, Pseudomonas aeruginosa PA01
caccgccuggacca

SEQ ID NO: 3376727 - RNA, 19 nt, Pseudomonas aeruginosa PA01
caccgccuggaccaggucg

SEQ ID NO: 3376728 - RNA, 14 nt, Pseudomonas aeruginosa PA01
caccgccuggucga

SEQ ID NO: 3376729 - RNA, 14 nt, Pseudomonas aeruginosa PA01
caccgccuggucgc

SEQ ID NO: 3376730 - RNA, 18 nt, Pseudomonas aeruginosa PA01
caccgccuggucgccggg

SEQ ID NO: 3376731 - RNA, 19 nt, Pseudomonas aeruginosa PA01
caccgccuuggcaucgccg

SEQ ID NO: 3376732 - RNA, 22 nt, Pseudomonas aeruginosa PA01
caccgccuuggcaucgccgccc

SEQ ID NO: 3376733 - RNA, 20 nt, Pseudomonas aeruginosa PA01
caccgcgaauccgcggcccu

SEQ ID NO: 3376734 - RNA, 19 nt, Pseudomonas aeruginosa PA01
caccgcgacgcgcuggacc

SEQ ID NO: 3376735 - RNA, 20 nt, Pseudomonas aeruginosa PA01
caccgcgacgcgcuggacca

SEQ ID NO: 3376736 - RNA, 14 nt, Pseudomonas aeruginosa PA01
caccgcgcagacca

SEQ ID NO: 3376737 - RNA, 18 nt, Pseudomonas aeruginosa PA01
caccgcgcagaugaucgc

SEQ ID NO: 3376738 - RNA, 20 nt, Pseudomonas aeruginosa PA01
caccgcgcagaugaucgcca

SEQ ID NO: 3376739 - RNA, 11 nt, Pseudomonas aeruginosa PA01
caccgcgcagc

SEQ ID NO: 3376740 - RNA, 21 nt, Pseudomonas aeruginosa PA01
caccgcgcagcgucaccgcgu

SEQ ID NO: 3376741 - RNA, 16 nt, Pseudomonas aeruginosa PA01
caccgcgccgaagguc

SEQ ID NO: 3376742 - RNA, 22 nt, Pseudomonas aeruginosa PA01
caccgcgccgauguacggcacc

SEQ ID NO: 3376743 - RNA, 13 nt, Pseudomonas aeruginosa PA01
caccgcgccggcg

SEQ ID NO: 3376744 - RNA, 14 nt, Pseudomonas aeruginosa PA01
caccgcgccggcgg

SEQ ID NO: 3376745 - RNA, 18 nt, Pseudomonas aeruginosa PA01
caccgcgccuuccagccc

SEQ ID NO: 3376746 - RNA, 23 nt, Pseudomonas aeruginosa PA01
caccgcgccuuccagcccuucga

SEQ ID NO: 3376747 - RNA, 14 nt, Pseudomonas aeruginosa PA01
caccgcgcgcgccu

SEQ ID NO: 3376748 - RNA, 19 nt, Pseudomonas aeruginosa PA01
caccgcgcgcgccugcaac

SEQ ID NO: 3376749 - RNA, 22 nt, Pseudomonas aeruginosa PA01
caccgcgcgcuuuuccggcgcc

SEQ ID NO: 3376750 - RNA, 12 nt, Pseudomonas aeruginosa PA01
caccgcgcggca

SEQ ID NO: 3376751 - RNA, 23 nt, Pseudomonas aeruginosa PA01
caccgcgcggcacagcguggcca

SEQ ID NO: 3376752 - RNA, 18 nt, Pseudomonas aeruginosa PA01
caccgcggaauccgcuuc

SEQ ID NO: 3376753 - RNA, 11 nt, Pseudomonas aeruginosa PA01
caccgcggccu

SEQ ID NO: 3376754 - RNA, 18 nt, Pseudomonas aeruginosa PA01
caccgcggccucgcuggc

SEQ ID NO: 3376755 - RNA, 13 nt, Pseudomonas aeruginosa PA01
caccgcggcgcgg

SEQ ID NO: 3376756 - RNA, 14 nt, Pseudomonas aeruginosa PA01
caccgcggcgcuga

SEQ ID NO: 3376757 - RNA, 14 nt, Pseudomonas aeruginosa PA01
caccgcggcguccg

SEQ ID NO: 3376758 - RNA, 14 nt, Pseudomonas aeruginosa PA01
caccgcggugcgga

SEQ ID NO: 3376759 - RNA, 15 nt, Pseudomonas aeruginosa PA01
caccgcgguggaggc

SEQ ID NO: 3376760 - RNA, 21 nt, Pseudomonas aeruginosa PA01
caccgcgguggaggcggcggu

SEQ ID NO: 3376761 - RNA, 23 nt, Pseudomonas aeruginosa PA01
caccgcgguggaggcggcgguca

SEQ ID NO: 3376762 - RNA, 23 nt, Pseudomonas aeruginosa PA01
caccgcggugucggugcccucgc

SEQ ID NO: 3376763 - RNA, 20 nt, Pseudomonas aeruginosa PA01
caccgcggugugcuugucca

SEQ ID NO: 3376764 - RNA, 17 nt, Pseudomonas aeruginosa PA01
caccgcgguuggcgccu

SEQ ID NO: 3376765 - RNA, 23 nt, Pseudomonas aeruginosa PA01
caccgcguaauaggcgaagcggc

SEQ ID NO: 3376766 - RNA, 21 nt, Pseudomonas aeruginosa PA01
caccgcguccauccccgccuc

SEQ ID NO: 3376767 - RNA, 21 nt, Pseudomonas aeruginosa PA01
caccgcgucgggaaaggccgc

SEQ ID NO: 3376768 - RNA, 19 nt, Pseudomonas aeruginosa PA01
caccgcguuguaggaaaaa

SEQ ID NO: 3376769 - RNA, 16 nt, Pseudomonas aeruginosa PA01
caccgcucaagacggc

SEQ ID NO: 3376770 - RNA, 22 nt, Pseudomonas aeruginosa PA01
caccgcucaagacggcccgcag

SEQ ID NO: 3376771 - RNA, 16 nt, Pseudomonas aeruginosa PA01
caccgcuccggcgccg

SEQ ID NO: 3376772 - RNA, 19 nt, Pseudomonas aeruginosa PA01
caccgcucgaguucgcgcg

SEQ ID NO: 3376773 - RNA, 18 nt, Pseudomonas aeruginosa PA01
caccgcucugcagugcgu

SEQ ID NO: 3376774 - RNA, 15 nt, Pseudomonas aeruginosa PA01
caccgcugcgccgcc

SEQ ID NO: 3376775 - RNA, 17 nt, Pseudomonas aeruginosa PA01
caccgcugcgccgccgu

SEQ ID NO: 3376776 - RNA, 19 nt, Pseudomonas aeruginosa PA01
caccgcuucgagcaccccg

SEQ ID NO: 3376777 - RNA, 13 nt, Pseudomonas aeruginosa PA01
caccgcuucgcgg

SEQ ID NO: 3376778 - RNA, 22 nt, Pseudomonas aeruginosa PA01
caccgcuucgcggaucaacgcc

SEQ ID NO: 3376779 - RNA, 17 nt, Pseudomonas aeruginosa PA01
caccgcuuucagcgccg

SEQ ID NO: 3376780 - RNA, 20 nt, Pseudomonas aeruginosa PA01
caccgcuuucagcgccgcuc

SEQ ID NO: 3376781 - RNA, 16 nt, Pseudomonas aeruginosa PA01
caccgcuuucguaggg

SEQ ID NO: 3376782 - RNA, 17 nt, Pseudomonas aeruginosa PA01
caccgcuuucguagggc

SEQ ID NO: 3376783 - RNA, 22 nt, Pseudomonas aeruginosa PA01
caccggaaaggcgucguugccg

SEQ ID NO: 3376784 - RNA, 17 nt, Pseudomonas aeruginosa PA01
caccggaagcguccagg

SEQ ID NO: 3376785 - RNA, 18 nt, Pseudomonas aeruginosa PA01
caccggaagcguccaggg

SEQ ID NO: 3376786 - RNA, 14 nt, Pseudomonas aeruginosa PA01
caccggacccggcu

SEQ ID NO: 3376787 - RNA, 15 nt, Pseudomonas aeruginosa PA01
caccggaccgggcgc

SEQ ID NO: 3376788 - RNA, 17 nt, Pseudomonas aeruginosa PA01
caccggacggcugaggc

SEQ ID NO: 3376789 - RNA, 19 nt, Pseudomonas aeruginosa PA01
caccggacggcugaggcug

SEQ ID NO: 3376790 - RNA, 14 nt, Pseudomonas aeruginosa PA01
caccggaucgcccu

SEQ ID NO: 3376791 - RNA, 16 nt, Pseudomonas aeruginosa PA01
caccggaucgcccugg

SEQ ID NO: 3376792 - RNA, 20 nt, Pseudomonas aeruginosa PA01
caccggaucgcccuggcgcc

SEQ ID NO: 3376793 - RNA, 21 nt, Pseudomonas aeruginosa PA01
caccggaucgcccuggcgcca

SEQ ID NO: 3376794 - RNA, 22 nt, Pseudomonas aeruginosa PA01
caccggaucgcccuggcgccag

SEQ ID NO: 3376795 - RNA, 16 nt, Pseudomonas aeruginosa PA01
caccggcacgcccugu

SEQ ID NO: 3376796 - RNA, 15 nt, Pseudomonas aeruginosa PA01
caccggcagcagcgg

SEQ ID NO: 3376797 - RNA, 19 nt, Pseudomonas aeruginosa PA01
caccggcaggaucggcgcg

SEQ ID NO: 3376798 - RNA, 21 nt, Pseudomonas aeruginosa PA01
caccggcaggaucggcgcggu

SEQ ID NO: 3376799 - RNA, 15 nt, Pseudomonas aeruginosa PA01
caccucgacccuggc

SEQ ID NO: 3376800 - RNA, 21 nt, Pseudomonas aeruginosa PA01
caccucgacccuggcgccgac

SEQ ID NO: 3376801 - RNA, 23 nt, Pseudomonas aeruginosa PA01
caccucgacccuggcgccgaccu

SEQ ID NO: 3376802 - RNA, 16 nt, Pseudomonas aeruginosa PA01
caccucgaccgcgccg

SEQ ID NO: 3376803 - RNA, 15 nt, Pseudomonas aeruginosa PA01
caccucgaccuggua

SEQ ID NO: 3376804 - RNA, 13 nt, Pseudomonas aeruginosa PA01
caccucgacgccc

SEQ ID NO: 3376805 - RNA, 15 nt, Pseudomonas aeruginosa PA01
caccucgacgcccgc

SEQ ID NO: 3376806 - RNA, 16 nt, Pseudomonas aeruginosa PA01
caccucgacgcccgcu

SEQ ID NO: 3376807 - RNA, 13 nt, Pseudomonas aeruginosa PA01
caccucgacggcg

SEQ ID NO: 3376808 - RNA, 20 nt, Pseudomonas aeruginosa PA01
caccucgacggcgaucucag

SEQ ID NO: 3376809 - RNA, 22 nt, Pseudomonas aeruginosa PA01
caccucgacggcgaucucagcc

SEQ ID NO: 3376810 - RNA, 22 nt, Pseudomonas aeruginosa PA01
caccucgaugaacagugcgccc

SEQ ID NO: 3376811 - RNA, 23 nt, Pseudomonas aeruginosa PA01
caccucgaugaacagugcgcccg

SEQ ID NO: 3376812 - RNA, 18 nt, Pseudomonas aeruginosa PA01
caccucgccaagcuggcg

SEQ ID NO: 3376813 - RNA, 12 nt, Pseudomonas aeruginosa PA01
caccucgcccuc

SEQ ID NO: 3376814 - RNA, 20 nt, Pseudomonas aeruginosa PA01
caccucgcccuugcugccca

SEQ ID NO: 3376815 - RNA, 14 nt, Pseudomonas aeruginosa PA01
caccucggccaggc

SEQ ID NO: 3376816 - RNA, 12 nt, Pseudomonas aeruginosa PA01
caccucggcgcc

SEQ ID NO: 3376817 - RNA, 23 nt, Pseudomonas aeruginosa PA01
caccucggcgccauaggccagca

SEQ ID NO: 3376818 - RNA, 15 nt, Pseudomonas aeruginosa PA01
caccucguaggccga

SEQ ID NO: 3376819 - RNA, 14 nt, Pseudomonas aeruginosa PA01
caccugaacgcgcc

SEQ ID NO: 3376820 - RNA, 15 nt, Pseudomonas aeruginosa PA01
caccugaacgcgccc

SEQ ID NO: 3376821 - RNA, 17 nt, Pseudomonas aeruginosa PA01
caccugaacgcgcccgg

SEQ ID NO: 3376822 - RNA, 18 nt, Pseudomonas aeruginosa PA01
caccugaacgcgcccggc

SEQ ID NO: 3376823 - RNA, 19 nt, Pseudomonas aeruginosa PA01
caccugaacgcgcccggcc

SEQ ID NO: 3376824 - RNA, 22 nt, Pseudomonas aeruginosa PA01
caccugaacgcgcccggccagg

SEQ ID NO: 3376825 - RNA, 16 nt, Pseudomonas aeruginosa PA01
caccugcaacgcccgc

SEQ ID NO: 3376826 - RNA, 20 nt, Pseudomonas aeruginosa PA01
caccugcaacgcccgcgagc

SEQ ID NO: 3376827 - RNA, 16 nt, Pseudomonas aeruginosa PA01
caccugcagacgguuc

SEQ ID NO: 3376828 - RNA, 14 nt, Pseudomonas aeruginosa PA01
caccugcaucacca

SEQ ID NO: 3376829 - RNA, 16 nt, Pseudomonas aeruginosa PA01
caccugcaucaccagg

SEQ ID NO: 3376830 - RNA, 17 nt, Pseudomonas aeruginosa PA01
caccugcaucaccaggc

SEQ ID NO: 3376831 - RNA, 19 nt, Pseudomonas aeruginosa PA01
caccugcaucaccaggcug

SEQ ID NO: 3376832 - RNA, 18 nt, Pseudomonas aeruginosa PA01
caccugccccgggcgccg

SEQ ID NO: 3376833 - RNA, 14 nt, Pseudomonas aeruginosa PA01
caccugcgccccgg

SEQ ID NO: 3376834 - RNA, 12 nt, Pseudomonas aeruginosa PA01
caccugcgggug

SEQ ID NO: 3376835 - RNA, 21 nt, Pseudomonas aeruginosa PA01
caccugcguggcgaacgcccg

SEQ ID NO: 3376836 - RNA, 23 nt, Pseudomonas aeruginosa PA01
caccugcguggcgaacgcccggc

SEQ ID NO: 3376837 - RNA, 20 nt, Pseudomonas aeruginosa PA01
caccugcucgcugaaccgcg

SEQ ID NO: 3376838 - RNA, 14 nt, Pseudomonas aeruginosa PA01
caccugcucggggc

SEQ ID NO: 3376839 - RNA, 16 nt, Pseudomonas aeruginosa PA01
caccugcucggggccg

SEQ ID NO: 3376840 - RNA, 21 nt, Pseudomonas aeruginosa PA01
caccugcuugggcgccucgcc

SEQ ID NO: 3376841 - RNA, 17 nt, Pseudomonas aeruginosa PA01
caccuggaacuugcugu

SEQ ID NO: 3376842 - RNA, 16 nt, Pseudomonas aeruginosa PA01
caccuggaucgccagg

SEQ ID NO: 3376843 - RNA, 12 nt, Pseudomonas aeruginosa PA01
caccuggcaggu

SEQ ID NO: 3376844 - RNA, 19 nt, Pseudomonas aeruginosa PA01
caccuggcagugcgccggc

SEQ ID NO: 3376845 - RNA, 24 nt, Pseudomonas aeruginosa PA01
caccuggcagugcgccggcaucgc

SEQ ID NO: 3376846 - RNA, 16 nt, Pseudomonas aeruginosa PA01
caccuggccauucgcu

SEQ ID NO: 3376847 - RNA, 19 nt, Pseudomonas aeruginosa PA01
caccuggccauucgcuucg

SEQ ID NO: 3376848 - RNA, 16 nt, Pseudomonas aeruginosa PA01
caccuggccggugacg

SEQ ID NO: 3376849 - RNA, 17 nt, Pseudomonas aeruginosa PA01
caccuggccgugcucga

SEQ ID NO: 3376850 - RNA, 13 nt, Pseudomonas aeruginosa PA01
caccuggcgcagg

SEQ ID NO: 3376851 - RNA, 17 nt, Pseudomonas aeruginosa PA01
caccuggcgcagguaga

SEQ ID NO: 3376852 - RNA, 19 nt, Pseudomonas aeruginosa PA01
caccuggcggucgccgccg

SEQ ID NO: 3376853 - RNA, 20 nt, Pseudomonas aeruginosa PA01
caccuggcggucgccgccgg

SEQ ID NO: 3376854 - RNA, 21 nt, Pseudomonas aeruginosa PA01
caccuggcggucgccgccggc

SEQ ID NO: 3376855 - RNA, 17 nt, Pseudomonas aeruginosa PA01
caccugggacucccgca

SEQ ID NO: 3376856 - RNA, 19 nt, Pseudomonas aeruginosa PA01
caccugggacucccgcaga

SEQ ID NO: 3376857 - RNA, 17 nt, Pseudomonas aeruginosa PA01
caccugggcguuggcca

SEQ ID NO: 3376858 - RNA, 19 nt, Pseudomonas aeruginosa PA01
caccugggcguuggccagc

SEQ ID NO: 3376859 - RNA, 23 nt, Pseudomonas aeruginosa PA01
caccugggcguuggccagcgcca

SEQ ID NO: 3376860 - RNA, 18 nt, Pseudomonas aeruginosa PA01
caccugggugcuuuccug

SEQ ID NO: 3376861 - RNA, 23 nt, Pseudomonas aeruginosa PA01
caccugggugcuuuccugcucca

SEQ ID NO: 3376862 - RNA, 19 nt, Pseudomonas aeruginosa PA01
caccugguggacacccugc

SEQ ID NO: 3376863 - RNA, 21 nt, Pseudomonas aeruginosa PA01
caccugguucaucgagcggcg

SEQ ID NO: 3376864 - RNA, 14 nt, Pseudomonas aeruginosa PA01
caccuguuccagca

SEQ ID NO: 3376865 - RNA, 16 nt, Pseudomonas aeruginosa PA01
caccuguucggcgcug

SEQ ID NO: 3376866 - RNA, 11 nt, Pseudomonas aeruginosa PA01
caccuuccucg

SEQ ID NO: 3376867 - RNA, 13 nt, Pseudomonas aeruginosa PA01
caccuuccucgcg

SEQ ID NO: 3376868 - RNA, 15 nt, Pseudomonas aeruginosa PA01
caccuucgccagcag

SEQ ID NO: 3376869 - RNA, 22 nt, Pseudomonas aeruginosa PA01
caccuucgcccgcugcgcugcc

SEQ ID NO: 3376870 - RNA, 24 nt, Pseudomonas aeruginosa PA01
caccuucgcccucagcagcgccgc

SEQ ID NO: 3376871 - RNA, 21 nt, Pseudomonas aeruginosa PA01
caccuugaccuugucggccga

SEQ ID NO: 3376872 - RNA, 23 nt, Pseudomonas aeruginosa PA01
caccuugaggcggguucggcguc

SEQ ID NO: 3376873 - RNA, 12 nt, Pseudomonas aeruginosa PA01
caccuugauccg

SEQ ID NO: 3376874 - RNA, 13 nt, Pseudomonas aeruginosa PA01
caccuugcccugc

SEQ ID NO: 3376875 - RNA, 15 nt, Pseudomonas aeruginosa PA01
caccuugccgcgccc

SEQ ID NO: 3376876 - RNA, 22 nt, Pseudomonas aeruginosa PA01
caccuugccgcgcccggccuuc

SEQ ID NO: 3376877 - RNA, 17 nt, Pseudomonas aeruginosa PA01
caccuugcgaaaagccc

SEQ ID NO: 3376878 - RNA, 13 nt, Pseudomonas aeruginosa PA01
caccuugcgcacc

SEQ ID NO: 3376879 - RNA, 15 nt, Pseudomonas aeruginosa PA01
caccuugcgcaccgc

SEQ ID NO: 3376880 - RNA, 18 nt, Pseudomonas aeruginosa PA01
caccuugcgcaccgccug

SEQ ID NO: 3376881 - RNA, 20 nt, Pseudomonas aeruginosa PA01
caccuugcgcaccgccugca

SEQ ID NO: 3376882 - RNA, 23 nt, Pseudomonas aeruginosa PA01
caccuugcgcaccgccugcagca

SEQ ID NO: 3376883 - RNA, 19 nt, Pseudomonas aeruginosa PA01
caccuugcggaacccgcgc

SEQ ID NO: 3376884 - RNA, 16 nt, Pseudomonas aeruginosa PA01
caccuugcgggugguc

SEQ ID NO: 3376885 - RNA, 21 nt, Pseudomonas aeruginosa PA01
caccuugcgguagcgcucgcc

SEQ ID NO: 3376886 - RNA, 16 nt, Pseudomonas aeruginosa PA01
caccuuggccaugggc

SEQ ID NO: 3376887 - RNA, 22 nt, Pseudomonas aeruginosa PA01
caccuuggcuugcagguagcug

SEQ ID NO: 3376888 - RNA, 22 nt, Pseudomonas aeruginosa PA01
caccuugggguguccgauucuu

SEQ ID NO: 3376889 - RNA, 22 nt, Pseudomonas aeruginosa PA01
caccuugucgcugaccggccgc

SEQ ID NO: 3376890 - RNA, 18 nt, Pseudomonas aeruginosa PA01
caccuugugcugccugcg

SEQ ID NO: 3376891 - RNA, 19 nt, Pseudomonas aeruginosa PA01
cacgaaaaagccggcgcau

SEQ ID NO: 3376892 - RNA, 18 nt, Pseudomonas aeruginosa PA01
cacgaaagccaugcccag

SEQ ID NO: 3376893 - RNA, 17 nt, Pseudomonas aeruginosa PA01
cacgaacagcuugccgu

SEQ ID NO: 3376894 - RNA, 20 nt, Pseudomonas aeruginosa PA01
cacgaacaggcugugcgcca

SEQ ID NO: 3376895 - RNA, 22 nt, Pseudomonas aeruginosa PA01
cacgaacaggcugugcgccagg

SEQ ID NO: 3376896 - RNA, 23 nt, Pseudomonas aeruginosa PA01
cacgaacagggucuucaggccga

SEQ ID NO: 3376897 - RNA, 15 nt, Pseudomonas aeruginosa PA01
cacgaacaggugcug

SEQ ID NO: 3376898 - RNA, 21 nt, Pseudomonas aeruginosa PA01
cacgaaccauugcggcccgcc

SEQ ID NO: 3376899 - RNA, 22 nt, Pseudomonas aeruginosa PA01
cacgaaccauugcggcccgcca

SEQ ID NO: 3376900 - RNA, 16 nt, Pseudomonas aeruginosa PA01
cacgaagaacgccagc

SEQ ID NO: 3376901 - RNA, 13 nt, Pseudomonas aeruginosa PA01
cacgccgauggcg

SEQ ID NO: 3376902 - RNA, 22 nt, Pseudomonas aeruginosa PA01
cacgccgcgaccgaagccgcgc

SEQ ID NO: 3376903 - RNA, 17 nt, Pseudomonas aeruginosa PA01
cacgccgcggaaggccc

SEQ ID NO: 3376904 - RNA, 19 nt, Pseudomonas aeruginosa PA01
cacgccgcggaaggcccgc

SEQ ID NO: 3376905 - RNA, 22 nt, Pseudomonas aeruginosa PA01
cacgccgcggcugaugccgcgg

SEQ ID NO: 3376906 - RNA, 23 nt, Pseudomonas aeruginosa PA01
cacgccgcggcugaugccgcggu

SEQ ID NO: 3376907 - RNA, 17 nt, Pseudomonas aeruginosa PA01
cacgccgcucugcccga

SEQ ID NO: 3376908 - RNA, 19 nt, Pseudomonas aeruginosa PA01
cacgccgcucugcccgacc

SEQ ID NO: 3376909 - RNA, 22 nt, Pseudomonas aeruginosa PA01
cacgccgcucugcccgaccggg

SEQ ID NO: 3376910 - RNA, 19 nt, Pseudomonas aeruginosa PA01
cacgccgcugucguccagc

SEQ ID NO: 3376911 - RNA, 20 nt, Pseudomonas aeruginosa PA01
cacgccgcugucguccagcg

SEQ ID NO: 3376912 - RNA, 14 nt, Pseudomonas aeruginosa PA01
cacgccggccggcu

SEQ ID NO: 3376913 - RNA, 17 nt, Pseudomonas aeruginosa PA01
cacgccggccucgcgca

SEQ ID NO: 3376914 - RNA, 22 nt, Pseudomonas aeruginosa PA01
cacgccggccucgcgcaacugc

SEQ ID NO: 3376915 - RNA, 14 nt, Pseudomonas aeruginosa PA01
cacgccggcgcucc

SEQ ID NO: 3376916 - RNA, 18 nt, Pseudomonas aeruginosa PA01
cacgccggcgcuccuccu

SEQ ID NO: 3376917 - RNA, 15 nt, Pseudomonas aeruginosa PA01
cacgccggugaugua

SEQ ID NO: 3376918 - RNA, 22 nt, Pseudomonas aeruginosa PA01
cacgccggugauguaggacgcc

SEQ ID NO: 3376919 - RNA, 14 nt, Pseudomonas aeruginosa PA01
cacgccgguggcca

SEQ ID NO: 3376920 - RNA, 13 nt, Pseudomonas aeruginosa PA01
cacgccgucgccg

SEQ ID NO: 3376921 - RNA, 23 nt, Pseudomonas aeruginosa PA01
cacgccgucgccgcugaugcgcu

SEQ ID NO: 3376922 - RNA, 19 nt, Pseudomonas aeruginosa PA01
cacgccgucgcgcucuucc

SEQ ID NO: 3376923 - RNA, 20 nt, Pseudomonas aeruginosa PA01
cacgccgugcaucaccggca

SEQ ID NO: 3376924 - RNA, 23 nt, Pseudomonas aeruginosa PA01
cacgccgugcaucaccggcagca

SEQ ID NO: 3376925 - RNA, 17 nt, Pseudomonas aeruginosa PA01
cacgccguggaccagga

SEQ ID NO: 3376926 - RNA, 17 nt, Pseudomonas aeruginosa PA01
cacgccucaaggcaucg

SEQ ID NO: 3376927 - RNA, 18 nt, Pseudomonas aeruginosa PA01
cacgccuuccagaucguc

SEQ ID NO: 3376928 - RNA, 18 nt, Pseudomonas aeruginosa PA01
cacgccuucgcggccgag

SEQ ID NO: 3376929 - RNA, 17 nt, Pseudomonas aeruginosa PA01
cacgccuugcagcaccg

SEQ ID NO: 3376930 - RNA, 18 nt, Pseudomonas aeruginosa PA01
cacgccuugcagcaccgc

SEQ ID NO: 3376931 - RNA, 13 nt, Pseudomonas aeruginosa PA01
cacgccuugcugc

SEQ ID NO: 3376932 - RNA, 16 nt, Pseudomonas aeruginosa PA01
cacgcgaccagcgcca

SEQ ID NO: 3376933 - RNA, 19 nt, Pseudomonas aeruginosa PA01
cacgcgaccagcgccaggc

SEQ ID NO: 3376934 - RNA, 21 nt, Pseudomonas aeruginosa PA01
cacgcgaccagcgccaggcgc

SEQ ID NO: 3376935 - RNA, 18 nt, Pseudomonas aeruginosa PA01
cacgcgagaagccgccca

SEQ ID NO: 3376936 - RNA, 18 nt, Pseudomonas aeruginosa PA01
cacgcgauauccgccagg

SEQ ID NO: 3376937 - RNA, 19 nt, Pseudomonas aeruginosa PA01
cacgcgauauccgccaggc

SEQ ID NO: 3376938 - RNA, 23 nt, Pseudomonas aeruginosa PA01
cacgcgauauccgccaggcggag

SEQ ID NO: 3376939 - RNA, 21 nt, Pseudomonas aeruginosa PA01
cacgcgcaguacgaucagcca

SEQ ID NO: 3376940 - RNA, 11 nt, Pseudomonas aeruginosa PA01
cacgcgccggg

SEQ ID NO: 3376941 - RNA, 16 nt, Pseudomonas aeruginosa PA01
cacgcgccgggucgga

SEQ ID NO: 3376942 - RNA, 19 nt, Pseudomonas aeruginosa PA01
cacgcgccgggucggaugc

SEQ ID NO: 3376943 - RNA, 14 nt, Pseudomonas aeruginosa PA01
cacgcgccuggccg

SEQ ID NO: 3376944 - RNA, 23 nt, Pseudomonas aeruginosa PA01
cacgcggacccaguugggccagg

SEQ ID NO: 3376945 - RNA, 14 nt, Pseudomonas aeruginosa PA01
cacgcggagggcgg

SEQ ID NO: 3376946 - RNA, 15 nt, Pseudomonas aeruginosa PA01
cacgcggagggcggc

SEQ ID NO: 3376947 - RNA, 20 nt, Pseudomonas aeruginosa PA01
cacgcggauaucgcuggcgc

SEQ ID NO: 3376948 - RNA, 22 nt, Pseudomonas aeruginosa PA01
cacgcggauaucgcuggcgccc

SEQ ID NO: 3376949 - RNA, 16 nt, Pseudomonas aeruginosa PA01
cacgcggaucuggccc

SEQ ID NO: 3376950 - RNA, 17 nt, Pseudomonas aeruginosa PA01
cacgcggaucuggcccu

SEQ ID NO: 3376951 - RNA, 14 nt, Pseudomonas aeruginosa PA01
cacgcguccgacca

SEQ ID NO: 3376952 - RNA, 20 nt, Pseudomonas aeruginosa PA01
cacgcguccgaccauuuccc

SEQ ID NO: 3376953 - RNA, 14 nt, Pseudomonas aeruginosa PA01
cacgcguucggcga

SEQ ID NO: 3376954 - RNA, 13 nt, Pseudomonas aeruginosa PA01
cacgcucaggcag

SEQ ID NO: 3376955 - RNA, 14 nt, Pseudomonas aeruginosa PA01
cacgcucaggcagc

SEQ ID NO: 3376956 - RNA, 15 nt, Pseudomonas aeruginosa PA01
cacgcucaggcagcg

SEQ ID NO: 3376957 - RNA, 22 nt, Pseudomonas aeruginosa PA01
cacgcucaggucggucgaacug

SEQ ID NO: 3376958 - RNA, 18 nt, Pseudomonas aeruginosa PA01
cacgcucagugcgccggg

SEQ ID NO: 3376959 - RNA, 14 nt, Pseudomonas aeruginosa PA01
cacgcucaugcgcg

SEQ ID NO: 3376960 - RNA, 16 nt, Pseudomonas aeruginosa PA01
cacgcucuccaaccga

SEQ ID NO: 3376961 - RNA, 14 nt, Pseudomonas aeruginosa PA01
cacgcucucgaaca

SEQ ID NO: 3376962 - RNA, 17 nt, Pseudomonas aeruginosa PA01
cacgcucucgaacagca

SEQ ID NO: 3376963 - RNA, 14 nt, Pseudomonas aeruginosa PA01
cacgcucuucuuac

SEQ ID NO: 3376964 - RNA, 20 nt, Pseudomonas aeruginosa PA01
cacgcugaagaucgccacga

SEQ ID NO: 3376965 - RNA, 23 nt, Pseudomonas aeruginosa PA01
cacgcugaagaucgccacgauca

SEQ ID NO: 3376966 - RNA, 16 nt, Pseudomonas aeruginosa PA01
cacgcugacgccggca

SEQ ID NO: 3376967 - RNA, 18 nt, Pseudomonas aeruginosa PA01
cacgcugacgccggcacc

SEQ ID NO: 3376968 - RNA, 13 nt, Pseudomonas aeruginosa PA01
cacgcugccagca

SEQ ID NO: 3376969 - RNA, 17 nt, Pseudomonas aeruginosa PA01
cacgcugccagcaggcc

SEQ ID NO: 3376970 - RNA, 17 nt, Pseudomonas aeruginosa PA01
cacgcugcgccggcgcu

SEQ ID NO: 3376971 - RNA, 14 nt, Pseudomonas aeruginosa PA01
cacgcugcugccgg

SEQ ID NO: 3376972 - RNA, 13 nt, Pseudomonas aeruginosa PA01
cacgcuggcgaga

SEQ ID NO: 3376973 - RNA, 13 nt, Pseudomonas aeruginosa PA01
cacgcugggcagg

SEQ ID NO: 3376974 - RNA, 22 nt, Pseudomonas aeruginosa PA01
cacgcuggugaugucgcggcag

SEQ ID NO: 3376975 - RNA, 17 nt, Pseudomonas aeruginosa PA01
cacgcuggugccgacgc

SEQ ID NO: 3376976 - RNA, 23 nt, Pseudomonas aeruginosa PA01
cacgcuggugccgacgcugauca

SEQ ID NO: 3376977 - RNA, 20 nt, Pseudomonas aeruginosa PA01
cacgcugugcggcagcaggc

SEQ ID NO: 3376978 - RNA, 19 nt, Pseudomonas aeruginosa PA01
cacgcuucuccucggccga

SEQ ID NO: 3376979 - RNA, 15 nt, Pseudomonas aeruginosa PA01
cacgcuucugcuggc

SEQ ID NO: 3376980 - RNA, 18 nt, Pseudomonas aeruginosa PA01
cacgcuucugcuggccgc

SEQ ID NO: 3376981 - RNA, 21 nt, Pseudomonas aeruginosa PA01
cacgcuucugcuggccgcgca

SEQ ID NO: 3376982 - RNA, 15 nt, Pseudomonas aeruginosa PA01
cacgcuuuccggcuu

SEQ ID NO: 3376983 - RNA, 18 nt, Pseudomonas aeruginosa PA01
cacggaaacgccgagaac

SEQ ID NO: 3376984 - RNA, 16 nt, Pseudomonas aeruginosa PA01
cacggaacggguccuu

SEQ ID NO: 3376985 - RNA, 17 nt, Pseudomonas aeruginosa PA01
cacggaaggccacgccg

SEQ ID NO: 3376986 - RNA, 18 nt, Pseudomonas aeruginosa PA01
cacggaaggccacgccgc

SEQ ID NO: 3376987 - RNA, 19 nt, Pseudomonas aeruginosa PA01
cacggaaggccacgccgcc

SEQ ID NO: 3376988 - RNA, 15 nt, Pseudomonas aeruginosa PA01
cacggacccgcucgg

SEQ ID NO: 3376989 - RNA, 17 nt, Pseudomonas aeruginosa PA01
cacggacccgcucggcc

SEQ ID NO: 3376990 - RNA, 15 nt, Pseudomonas aeruginosa PA01
cacggacgcgcaggg

SEQ ID NO: 3376991 - RNA, 17 nt, Pseudomonas aeruginosa PA01
cacggacgcgcaggguc

SEQ ID NO: 3376992 - RNA, 14 nt, Pseudomonas aeruginosa PA01
cacggagaagcguc

SEQ ID NO: 3376993 - RNA, 21 nt, Pseudomonas aeruginosa PA01
cacggagaagcguccgaggug

SEQ ID NO: 3376994 - RNA, 19 nt, Pseudomonas aeruginosa PA01
cacggaggccuucgccgac

SEQ ID NO: 3376995 - RNA, 20 nt, Pseudomonas aeruginosa PA01
cacggaggccuucgccgacc

SEQ ID NO: 3376996 - RNA, 16 nt, Pseudomonas aeruginosa PA01
cacggaggcgcucagg

SEQ ID NO: 3376997 - RNA, 16 nt, Pseudomonas aeruginosa PA01
cacggauaccacccgc

SEQ ID NO: 3376998 - RNA, 21 nt, Pseudomonas aeruginosa PA01
cacggauaccacccgcagccc

SEQ ID NO: 3376999 - RNA, 16 nt, Pseudomonas aeruginosa PA01
cacggauagcaccgau

SEQ ID NO: 3377000 - RNA, 18 nt, Pseudomonas aeruginosa PA01
cacggauaggcggcggau

SEQ ID NO: 3377001 - RNA, 16 nt, Pseudomonas aeruginosa PA01
cacggauaugcgccgc

SEQ ID NO: 3377002 - RNA, 18 nt, Pseudomonas aeruginosa PA01
cacggauaugcgccgcca

SEQ ID NO: 3377003 - RNA, 15 nt, Pseudomonas aeruginosa PA01
cacguagcccccgcc

SEQ ID NO: 3377004 - RNA, 16 nt, Pseudomonas aeruginosa PA01
cacguagcccccgccg

SEQ ID NO: 3377005 - RNA, 13 nt, Pseudomonas aeruginosa PA01
cacguagccgccc

SEQ ID NO: 3377006 - RNA, 12 nt, Pseudomonas aeruginosa PA01
cacguagccggc

SEQ ID NO: 3377007 - RNA, 13 nt, Pseudomonas aeruginosa PA01
cacguagcgcagg

SEQ ID NO: 3377008 - RNA, 14 nt, Pseudomonas aeruginosa PA01
cacguagcgcaggu

SEQ ID NO: 3377009 - RNA, 15 nt, Pseudomonas aeruginosa PA01
cacguaggagccggc

SEQ ID NO: 3377010 - RNA, 19 nt, Pseudomonas aeruginosa PA01
cacguaggagccggccagg

SEQ ID NO: 3377011 - RNA, 16 nt, Pseudomonas aeruginosa PA01
cacguaguaggcgcgg

SEQ ID NO: 3377012 - RNA, 20 nt, Pseudomonas aeruginosa PA01
cacguaguugacccgccccu

SEQ ID NO: 3377013 - RNA, 15 nt, Pseudomonas aeruginosa PA01
cacguccagaugaaa

SEQ ID NO: 3377014 - RNA, 23 nt, Pseudomonas aeruginosa PA01
cacguccauguagcguugcaggc

SEQ ID NO: 3377015 - RNA, 22 nt, Pseudomonas aeruginosa PA01
cacguccggcgagaaaggcugc

SEQ ID NO: 3377016 - RNA, 20 nt, Pseudomonas aeruginosa PA01
cacguccuccaggcucaggg

SEQ ID NO: 3377017 - RNA, 21 nt, Pseudomonas aeruginosa PA01
cacgucgagcacgccguccga

SEQ ID NO: 3377018 - RNA, 17 nt, Pseudomonas aeruginosa PA01
cacgucgaucaccuugc

SEQ ID NO: 3377019 - RNA, 15 nt, Pseudomonas aeruginosa PA01
cacgucgaucugcuc

SEQ ID NO: 3377020 - RNA, 22 nt, Pseudomonas aeruginosa PA01
cacgucgaugccuucggcggcc

SEQ ID NO: 3377021 - RNA, 13 nt, Pseudomonas aeruginosa PA01
cacgucgccgacc

SEQ ID NO: 3377022 - RNA, 14 nt, Pseudomonas aeruginosa PA01
cacgucgccgacca

SEQ ID NO: 3377023 - RNA, 16 nt, Pseudomonas aeruginosa PA01
cacgucgccgaccagg

SEQ ID NO: 3377024 - RNA, 18 nt, Pseudomonas aeruginosa PA01
cacgucgccgaccaggcg

SEQ ID NO: 3377025 - RNA, 20 nt, Pseudomonas aeruginosa PA01
cacgucgccgaccaggcggc

SEQ ID NO: 3377026 - RNA, 15 nt, Pseudomonas aeruginosa PA01
cacgucgcgaccggu

SEQ ID NO: 3377027 - RNA, 13 nt, Pseudomonas aeruginosa PA01
cacgucgcgcacc

SEQ ID NO: 3377028 - RNA, 14 nt, Pseudomonas aeruginosa PA01
cacgucggcgcgca

SEQ ID NO: 3377029 - RNA, 18 nt, Pseudomonas aeruginosa PA01
cacgucgguucagcgcgg

SEQ ID NO: 3377030 - RNA, 21 nt, Pseudomonas aeruginosa PA01
cacgucgguucagcgcggagc

SEQ ID NO: 3377031 - RNA, 18 nt, Pseudomonas aeruginosa PA01
cacgucguaggccgagcc

SEQ ID NO: 3377032 - RNA, 16 nt, Pseudomonas aeruginosa PA01
cacgucguccagcgcc

SEQ ID NO: 3377033 - RNA, 17 nt, Pseudomonas aeruginosa PA01
cacgucguccggcgcca

SEQ ID NO: 3377034 - RNA, 18 nt, Pseudomonas aeruginosa PA01
cacgucguugggccccac

SEQ ID NO: 3377035 - RNA, 19 nt, Pseudomonas aeruginosa PA01
cacgucugugccgaggccg

SEQ ID NO: 3377036 - RNA, 21 nt, Pseudomonas aeruginosa PA01
cacgucugugccgaggccgcc

SEQ ID NO: 3377037 - RNA, 23 nt, Pseudomonas aeruginosa PA01
cacgucugugccgaggccgccgc

SEQ ID NO: 3377038 - RNA, 17 nt, Pseudomonas aeruginosa PA01
cacgucuugcaggcuca

SEQ ID NO: 3377039 - RNA, 22 nt, Pseudomonas aeruginosa PA01
cacgucuugcaggcucacgcgu

SEQ ID NO: 3377040 - RNA, 14 nt, Pseudomonas aeruginosa PA01
cacgugaccgucca

SEQ ID NO: 3377041 - RNA, 19 nt, Pseudomonas aeruginosa PA01
cacgugaccguccagcgcg

SEQ ID NO: 3377042 - RNA, 20 nt, Pseudomonas aeruginosa PA01
cacgugaccguccagcgcgc

SEQ ID NO: 3377043 - RNA, 16 nt, Pseudomonas aeruginosa PA01
cacgugcacgccgugc

SEQ ID NO: 3377044 - RNA, 13 nt, Pseudomonas aeruginosa PA01
cacgugcagcggc

SEQ ID NO: 3377045 - RNA, 14 nt, Pseudomonas aeruginosa PA01
cacgugcagcggca

SEQ ID NO: 3377046 - RNA, 16 nt, Pseudomonas aeruginosa PA01
cacgugcagcggcagc

SEQ ID NO: 3377047 - RNA, 16 nt, Pseudomonas aeruginosa PA01
cacgugcagcucggca

SEQ ID NO: 3377048 - RNA, 20 nt, Pseudomonas aeruginosa PA01
cacgugcagcucggcacgca

SEQ ID NO: 3377049 - RNA, 19 nt, Pseudomonas aeruginosa PA01
cacgugcggggugcgcugg

SEQ ID NO: 3377050 - RNA, 21 nt, Pseudomonas aeruginosa PA01
cacgugugucgacaccuggca

SEQ ID NO: 3377051 - RNA, 13 nt, Pseudomonas aeruginosa PA01
cacguuccagcuc

SEQ ID NO: 3377052 - RNA, 15 nt, Pseudomonas aeruginosa PA01
cacguucggcgcggg

SEQ ID NO: 3377053 - RNA, 16 nt, Pseudomonas aeruginosa PA01
cacguucugcaggacg

SEQ ID NO: 3377054 - RNA, 23 nt, Pseudomonas aeruginosa PA01
cacguugaacacaucgaccaggu

SEQ ID NO: 3377055 - RNA, 17 nt, Pseudomonas aeruginosa PA01
cacguugccauccagcg

SEQ ID NO: 3377056 - RNA, 19 nt, Pseudomonas aeruginosa PA01
cacguugccauccagcgcc

SEQ ID NO: 3377057 - RNA, 15 nt, Pseudomonas aeruginosa PA01
cacguugcgccgcag

SEQ ID NO: 3377058 - RNA, 17 nt, Pseudomonas aeruginosa PA01
cacguugcgccgcagca

SEQ ID NO: 3377059 - RNA, 22 nt, Pseudomonas aeruginosa PA01
cacguugcugugcugcaccagc

SEQ ID NO: 3377060 - RNA, 23 nt, Pseudomonas aeruginosa PA01
cacguugcugugcugcaccagca

SEQ ID NO: 3377061 - RNA, 21 nt, Pseudomonas aeruginosa PA01
cacguugggauagcuuuccag

SEQ ID NO: 3377062 - RNA, 13 nt, Pseudomonas aeruginosa PA01
cacguugggaucg

SEQ ID NO: 3377063 - RNA, 18 nt, Pseudomonas aeruginosa PA01
cacuacaggaccuucaga

SEQ ID NO: 3377064 - RNA, 20 nt, Pseudomonas aeruginosa PA01
cacuaucuucgauugcuaca

SEQ ID NO: 3377065 - RNA, 23 nt, Pseudomonas aeruginosa PA01
cacucagccagcggcgcuugcgg

SEQ ID NO: 3377066 - RNA, 21 nt, Pseudomonas aeruginosa PA01
cacucaggcaugcgggcgcga

SEQ ID NO: 3377067 - RNA, 13 nt, Pseudomonas aeruginosa PA01
cacucauagcuca

SEQ ID NO: 3377068 - RNA, 13 nt, Pseudomonas aeruginosa PA01
cacuccagcgcgg

SEQ ID NO: 3377069 - RNA, 19 nt, Pseudomonas aeruginosa PA01
cacucccaggcuggcggca

SEQ ID NO: 3377070 - RNA, 13 nt, Pseudomonas aeruginosa PA01
cacucccggcccu

SEQ ID NO: 3377071 - RNA, 17 nt, Pseudomonas aeruginosa PA01
cacucccguccagcgcu

SEQ ID NO: 3377072 - RNA, 15 nt, Pseudomonas aeruginosa PA01
cacuccggcagcacc

SEQ ID NO: 3377073 - RNA, 15 nt, Pseudomonas aeruginosa PA01
cacuccggcaggcgc

SEQ ID NO: 3377074 - RNA, 17 nt, Pseudomonas aeruginosa PA01
cacuccggcaggcgcuc

SEQ ID NO: 3377075 - RNA, 17 nt, Pseudomonas aeruginosa PA01
cacuccgggcuggucgu

SEQ ID NO: 3377076 - RNA, 13 nt, Pseudomonas aeruginosa PA01
cacuccgucucca

SEQ ID NO: 3377077 - RNA, 16 nt, Pseudomonas aeruginosa PA01
cacuccuccgccugca

SEQ ID NO: 3377078 - RNA, 19 nt, Pseudomonas aeruginosa PA01
cacucgacaggccauucuu

SEQ ID NO: 3377079 - RNA, 13 nt, Pseudomonas aeruginosa PA01
cacucgcagccgc

SEQ ID NO: 3377080 - RNA, 14 nt, Pseudomonas aeruginosa PA01
cacucgccagcgcg

SEQ ID NO: 3377081 - RNA, 16 nt, Pseudomonas aeruginosa PA01
cacucgcccuugacca

SEQ ID NO: 3377082 - RNA, 13 nt, Pseudomonas aeruginosa PA01
cacucgccgccgu

SEQ ID NO: 3377083 - RNA, 14 nt, Pseudomonas aeruginosa PA01
cacucgccgggcgu

SEQ ID NO: 3377084 - RNA, 18 nt, Pseudomonas aeruginosa PA01
cacucgcgagcuggcgcc

SEQ ID NO: 3377085 - RNA, 19 nt, Pseudomonas aeruginosa PA01
cacucgcgagcuggcgccg

SEQ ID NO: 3377086 - RNA, 20 nt, Pseudomonas aeruginosa PA01
cacucgcgagcuggcgccgu

SEQ ID NO: 3377087 - RNA, 22 nt, Pseudomonas aeruginosa PA01
cacucggccagcaaugcccgcg

SEQ ID NO: 3377088 - RNA, 15 nt, Pseudomonas aeruginosa PA01
cacucggccaggcgc

SEQ ID NO: 3377089 - RNA, 19 nt, Pseudomonas aeruginosa PA01
cacucggccaggcgccagg

SEQ ID NO: 3377090 - RNA, 20 nt, Pseudomonas aeruginosa PA01
cacucggccaggcgccaggg

SEQ ID NO: 3377091 - RNA, 22 nt, Pseudomonas aeruginosa PA01
cacucugagggacacggcgacc

SEQ ID NO: 3377092 - RNA, 18 nt, Pseudomonas aeruginosa PA01
cacucugguagcugcggc

SEQ ID NO: 3377093 - RNA, 21 nt, Pseudomonas aeruginosa PA01
cacucugguagcugcggccga

SEQ ID NO: 3377094 - RNA, 11 nt, Pseudomonas aeruginosa PA01
cacucuucagu

SEQ ID NO: 3377095 - RNA, 14 nt, Pseudomonas aeruginosa PA01
cacucuucaguccc

SEQ ID NO: 3377096 - RNA, 17 nt, Pseudomonas aeruginosa PA01
cacugcaacacuuccuu

SEQ ID NO: 3377097 - RNA, 17 nt, Pseudomonas aeruginosa PA01
cacugccgccucagcga

SEQ ID NO: 3377098 - RNA, 16 nt, Pseudomonas aeruginosa PA01
cacugcgagcaccaug

SEQ ID NO: 3377099 - RNA, 12 nt, Pseudomonas aeruginosa PA01
cacugcgcgcca

SEQ ID NO: 3377100 - RNA, 12 nt, Pseudomonas aeruginosa PA01
cacugcggcggu

SEQ ID NO: 3377101 - RNA, 14 nt, Pseudomonas aeruginosa PA01
cacugcggcggucc

SEQ ID NO: 3377102 - RNA, 24 nt, Pseudomonas aeruginosa PA01
cacugcggcggucccuucgugggc

SEQ ID NO: 3377103 - RNA, 23 nt, Pseudomonas aeruginosa PA01
cacugcguggguagccauggcgg

SEQ ID NO: 3377104 - RNA, 13 nt, Pseudomonas aeruginosa PA01
cacugcuuggcca

SEQ ID NO: 3377105 - RNA, 14 nt, Pseudomonas aeruginosa PA01
cacugcuuggccag

SEQ ID NO: 3377106 - RNA, 20 nt, Pseudomonas aeruginosa PA01
cagaccacgcccugcgccag

SEQ ID NO: 3377107 - RNA, 13 nt, Pseudomonas aeruginosa PA01
cagaccagcagcg

SEQ ID NO: 3377108 - RNA, 18 nt, Pseudomonas aeruginosa PA01
cagaccagcagcgcacca

SEQ ID NO: 3377109 - RNA, 21 nt, Pseudomonas aeruginosa PA01
cagaccagcagcgcaccaucc

SEQ ID NO: 3377110 - RNA, 15 nt, Pseudomonas aeruginosa PA01
cagaccagcagcggc

SEQ ID NO: 3377111 - RNA, 18 nt, Pseudomonas aeruginosa PA01
cagaccagcagcggcagc

SEQ ID NO: 3377112 - RNA, 12 nt, Pseudomonas aeruginosa PA01
cagaccagcagg

SEQ ID NO: 3377113 - RNA, 15 nt, Pseudomonas aeruginosa PA01
cagaccagcaggaaa

SEQ ID NO: 3377114 - RNA, 17 nt, Pseudomonas aeruginosa PA01
cagaccagcccuggcgc

SEQ ID NO: 3377115 - RNA, 14 nt, Pseudomonas aeruginosa PA01
cagaccagcgaacc

SEQ ID NO: 3377116 - RNA, 20 nt, Pseudomonas aeruginosa PA01
cagaccagcgcaagcggcgg

SEQ ID NO: 3377117 - RNA, 22 nt, Pseudomonas aeruginosa PA01
cagaccagcgcaagcggcggcu

SEQ ID NO: 3377118 - RNA, 13 nt, Pseudomonas aeruginosa PA01
cagaccaggccga

SEQ ID NO: 3377119 - RNA, 19 nt, Pseudomonas aeruginosa PA01
cagaccaggccgagcagga

SEQ ID NO: 3377120 - RNA, 13 nt, Pseudomonas aeruginosa PA01
cagacccaggugc

SEQ ID NO: 3377121 - RNA, 18 nt, Pseudomonas aeruginosa PA01
cagacccaggugcgcagg

SEQ ID NO: 3377122 - RNA, 21 nt, Pseudomonas aeruginosa PA01
cagacccaggugcgcaggcgc

SEQ ID NO: 3377123 - RNA, 15 nt, Pseudomonas aeruginosa PA01
cagaccccggcgauc

SEQ ID NO: 3377124 - RNA, 13 nt, Pseudomonas aeruginosa PA01
cagaccgacccuc

SEQ ID NO: 3377125 - RNA, 15 nt, Pseudomonas aeruginosa PA01
cagaccgcagccggc

SEQ ID NO: 3377126 - RNA, 14 nt, Pseudomonas aeruginosa PA01
cagaccggcagcgc

SEQ ID NO: 3377127 - RNA, 16 nt, Pseudomonas aeruginosa PA01
cagaccggcagcgccg

SEQ ID NO: 3377128 - RNA, 22 nt, Pseudomonas aeruginosa PA01
cagaccggcagcgccgccagca

SEQ ID NO: 3377129 - RNA, 21 nt, Pseudomonas aeruginosa PA01
cagaccgucgaucucgagcau

SEQ ID NO: 3377130 - RNA, 22 nt, Pseudomonas aeruginosa PA01
cagaccguggcgcuacgcucgc

SEQ ID NO: 3377131 - RNA, 15 nt, Pseudomonas aeruginosa PA01
cagaccucgagcagg

SEQ ID NO: 3377132 - RNA, 16 nt, Pseudomonas aeruginosa PA01
cagaccucgagcaggc

SEQ ID NO: 3377133 - RNA, 11 nt, Pseudomonas aeruginosa PA01
cagaccugcaa

SEQ ID NO: 3377134 - RNA, 23 nt, Pseudomonas aeruginosa PA01
cagaccugcaauuccaccggcug

SEQ ID NO: 3377135 - RNA, 15 nt, Pseudomonas aeruginosa PA01
cagaccugcagcagg

SEQ ID NO: 3377136 - RNA, 12 nt, Pseudomonas aeruginosa PA01
cagaccugccgc

SEQ ID NO: 3377137 - RNA, 15 nt, Pseudomonas aeruginosa PA01
cagaccugccgcccg

SEQ ID NO: 3377138 - RNA, 17 nt, Pseudomonas aeruginosa PA01
cagaccugccgcccggc

SEQ ID NO: 3377139 - RNA, 15 nt, Pseudomonas aeruginosa PA01
cagaccuggccgcug

SEQ ID NO: 3377140 - RNA, 22 nt, Pseudomonas aeruginosa PA01
cagaccuggccgcuguggaagu

SEQ ID NO: 3377141 - RNA, 16 nt, Pseudomonas aeruginosa PA01
cagaccuuccagccgc

SEQ ID NO: 3377142 - RNA, 17 nt, Pseudomonas aeruginosa PA01
cagaccuuccagccgcg

SEQ ID NO: 3377143 - RNA, 19 nt, Pseudomonas aeruginosa PA01
cagaccuuccagccgcgcg

SEQ ID NO: 3377144 - RNA, 20 nt, Pseudomonas aeruginosa PA01
cagaccuuccagccgcgcgc

SEQ ID NO: 3377145 - RNA, 11 nt, Pseudomonas aeruginosa PA01
cagaccuuccu

SEQ ID NO: 3377146 - RNA, 18 nt, Pseudomonas aeruginosa PA01
cagaccuucgaagacccc

SEQ ID NO: 3377147 - RNA, 14 nt, Pseudomonas aeruginosa PA01
cagacgaucagcgg

SEQ ID NO: 3377148 - RNA, 17 nt, Pseudomonas aeruginosa PA01
cagacgaucuccugcug

SEQ ID NO: 3377149 - RNA, 14 nt, Pseudomonas aeruginosa PA01
cagacgaucuggca

SEQ ID NO: 3377150 - RNA, 15 nt, Pseudomonas aeruginosa PA01
cagacgaucuggcag

SEQ ID NO: 3377151 - RNA, 20 nt, Pseudomonas aeruginosa PA01
cagacgauugaccucccgcg

SEQ ID NO: 3377152 - RNA, 21 nt, Pseudomonas aeruginosa PA01
cagacgauugaccucccgcgc

SEQ ID NO: 3377153 - RNA, 15 nt, Pseudomonas aeruginosa PA01
cagacgcagcagcuc

SEQ ID NO: 3377154 - RNA, 16 nt, Pseudomonas aeruginosa PA01
cagacgcagccguugg

SEQ ID NO: 3377155 - RNA, 12 nt, Pseudomonas aeruginosa PA01
cagacgcccuga

SEQ ID NO: 3377156 - RNA, 13 nt, Pseudomonas aeruginosa PA01
cagacgccgcucu

SEQ ID NO: 3377157 - RNA, 21 nt, Pseudomonas aeruginosa PA01
cagacgcggguaauccaucgc

SEQ ID NO: 3377158 - RNA, 16 nt, Pseudomonas aeruginosa PA01
cagacgcuccuuguag

SEQ ID NO: 3377159 - RNA, 16 nt, Pseudomonas aeruginosa PA01
cagacgcucggccagc

SEQ ID NO: 3377160 - RNA, 20 nt, Pseudomonas aeruginosa PA01
cagacgcucggccagcgucc

SEQ ID NO: 3377161 - RNA, 13 nt, Pseudomonas aeruginosa PA01
cagacgcugccga

SEQ ID NO: 3377162 - RNA, 18 nt, Pseudomonas aeruginosa PA01
cagacgcugccgaggaac

SEQ ID NO: 3377163 - RNA, 15 nt, Pseudomonas aeruginosa PA01
cagacgggugcugaa

SEQ ID NO: 3377164 - RNA, 16 nt, Pseudomonas aeruginosa PA01
cagacgggugcugaag

SEQ ID NO: 3377165 - RNA, 18 nt, Pseudomonas aeruginosa PA01
cagacgggugcugaagau

SEQ ID NO: 3377166 - RNA, 21 nt, Pseudomonas aeruginosa PA01
cagacgguucagcagcggcac

SEQ ID NO: 3377167 - RNA, 15 nt, Pseudomonas aeruginosa PA01
cagacguccagcgcc

SEQ ID NO: 3377168 - RNA, 16 nt, Pseudomonas aeruginosa PA01
cagacguccagcgcca

SEQ ID NO: 3377169 - RNA, 18 nt, Pseudomonas aeruginosa PA01
cagacguccagcgccacu

SEQ ID NO: 3377170 - RNA, 19 nt, Pseudomonas aeruginosa PA01
cagacguggcauucgucgc

SEQ ID NO: 3377171 - RNA, 21 nt, Pseudomonas aeruginosa PA01
cagacguggcauucgucgccg

SEQ ID NO: 3377172 - RNA, 22 nt, Pseudomonas aeruginosa PA01
cagacguggcauucgucgccgc

SEQ ID NO: 3377173 - RNA, 21 nt, Pseudomonas aeruginosa PA01
cagacguugcgcaucugcgcg

SEQ ID NO: 3377174 - RNA, 18 nt, Pseudomonas aeruginosa PA01
cagacuccggcgcagccc

SEQ ID NO: 3377175 - RNA, 20 nt, Pseudomonas aeruginosa PA01
cagacuccggcgcagcccag

SEQ ID NO: 3377176 - RNA, 22 nt, Pseudomonas aeruginosa PA01
cagacucuccaggucggucggc

SEQ ID NO: 3377177 - RNA, 15 nt, Pseudomonas aeruginosa PA01
cagagaaaaggccgc

SEQ ID NO: 3377178 - RNA, 14 nt, Pseudomonas aeruginosa PA01
cagagacgcagcgc

SEQ ID NO: 3377179 - RNA, 21 nt, Pseudomonas aeruginosa PA01
cagagacgcagcgcuagcgca

SEQ ID NO: 3377180 - RNA, 19 nt, Pseudomonas aeruginosa PA01
cagagaucgcccagcggcu

SEQ ID NO: 3377181 - RNA, 22 nt, Pseudomonas aeruginosa PA01
cagagaucgcccagcggcuggc

SEQ ID NO: 3377182 - RNA, 15 nt, Pseudomonas aeruginosa PA01
cagagaucggcggcg

SEQ ID NO: 3377183 - RNA, 12 nt, Pseudomonas aeruginosa PA01
cagagcagaguc

SEQ ID NO: 3377184 - RNA, 13 nt, Pseudomonas aeruginosa PA01
cagagcagagucg

SEQ ID NO: 3377185 - RNA, 17 nt, Pseudomonas aeruginosa PA01
cagagcagagucgccgg

SEQ ID NO: 3377186 - RNA, 17 nt, Pseudomonas aeruginosa PA01
cagagcagcaccagcac

SEQ ID NO: 3377187 - RNA, 20 nt, Pseudomonas aeruginosa PA01
cagagcaggcggaucgccgc

SEQ ID NO: 3377188 - RNA, 21 nt, Pseudomonas aeruginosa PA01
cagagcaggcggaucgccgcc

SEQ ID NO: 3377189 - RNA, 22 nt, Pseudomonas aeruginosa PA01
cagagcaggcggaucgccgccu

SEQ ID NO: 3377190 - RNA, 18 nt, Pseudomonas aeruginosa PA01
cagagcagggugaagcug

SEQ ID NO: 3377191 - RNA, 16 nt, Pseudomonas aeruginosa PA01
cagagcaucacccgcg

SEQ ID NO: 3377192 - RNA, 13 nt, Pseudomonas aeruginosa PA01
cagagccagccgc

SEQ ID NO: 3377193 - RNA, 17 nt, Pseudomonas aeruginosa PA01
cagagccagccgcagcc

SEQ ID NO: 3377194 - RNA, 18 nt, Pseudomonas aeruginosa PA01
cagagccagccgcagccc

SEQ ID NO: 3377195 - RNA, 14 nt, Pseudomonas aeruginosa PA01
cagagccagccgcg

SEQ ID NO: 3377196 - RNA, 16 nt, Pseudomonas aeruginosa PA01
cagagccagccgcgag

SEQ ID NO: 3377197 - RNA, 18 nt, Pseudomonas aeruginosa PA01
cagagccaugggccggcc

SEQ ID NO: 3377198 - RNA, 19 nt, Pseudomonas aeruginosa PA01
cagagcccgccgaacagca

SEQ ID NO: 3377199 - RNA, 15 nt, Pseudomonas aeruginosa PA01
cagagcccgucgaag

SEQ ID NO: 3377200 - RNA, 14 nt, Pseudomonas aeruginosa PA01
cagagcgccagcca

SEQ ID NO: 3377201 - RNA, 15 nt, Pseudomonas aeruginosa PA01
cagagcgccagccag

SEQ ID NO: 3377202 - RNA, 16 nt, Pseudomonas aeruginosa PA01
cagagcgccagccagc

SEQ ID NO: 3377203 - RNA, 19 nt, Pseudomonas aeruginosa PA01
cagagcgccagccagcgcg

SEQ ID NO: 3377204 - RNA, 22 nt, Pseudomonas aeruginosa PA01
cagagcgccaugacccgcggca

SEQ ID NO: 3377205 - RNA, 12 nt, Pseudomonas aeruginosa PA01
cagagcgcgccc

SEQ ID NO: 3377206 - RNA, 23 nt, Pseudomonas aeruginosa PA01
cagagcgcgcccugcaggccgaa

SEQ ID NO: 3377207 - RNA, 13 nt, Pseudomonas aeruginosa PA01
cagagcgcgcuac

SEQ ID NO: 3377208 - RNA, 12 nt, Pseudomonas aeruginosa PA01
cagagcgcugcc

SEQ ID NO: 3377209 - RNA, 22 nt, Pseudomonas aeruginosa PA01
cagcaaggcgucauagcagcgc

SEQ ID NO: 3377210 - RNA, 23 nt, Pseudomonas aeruginosa PA01
cagcaaggcgucauagcagcgcc

SEQ ID NO: 3377211 - RNA, 15 nt, Pseudomonas aeruginosa PA01
cagcaaucaggaacg

SEQ ID NO: 3377212 - RNA, 16 nt, Pseudomonas aeruginosa PA01
cagcaaugccagcgcc

SEQ ID NO: 3377213 - RNA, 13 nt, Pseudomonas aeruginosa PA01
cagcaaugcccag

SEQ ID NO: 3377214 - RNA, 14 nt, Pseudomonas aeruginosa PA01
cagcaaugcccagc

SEQ ID NO: 3377215 - RNA, 19 nt, Pseudomonas aeruginosa PA01
cagcaaugcccgcgccugg

SEQ ID NO: 3377216 - RNA, 21 nt, Pseudomonas aeruginosa PA01
cagcaaugcccgcgccugggc

SEQ ID NO: 3377217 - RNA, 21 nt, Pseudomonas aeruginosa PA01
cagcaauuccacgcgacagcg

SEQ ID NO: 3377218 - RNA, 17 nt, Pseudomonas aeruginosa PA01
cagcaauuccgcagccu

SEQ ID NO: 3377219 - RNA, 16 nt, Pseudomonas aeruginosa PA01
cagcaauugccggcgu

SEQ ID NO: 3377220 - RNA, 22 nt, Pseudomonas aeruginosa PA01
cagcacauagagggucagccgg

SEQ ID NO: 3377221 - RNA, 23 nt, Pseudomonas aeruginosa PA01
cagcacauagagggucagccggc

SEQ ID NO: 3377222 - RNA, 17 nt, Pseudomonas aeruginosa PA01
cagcacauagcugccga

SEQ ID NO: 3377223 - RNA, 14 nt, Pseudomonas aeruginosa PA01
cagcacaugccacg

SEQ ID NO: 3377224 - RNA, 14 nt, Pseudomonas aeruginosa PA01
cagcaccacccggc

SEQ ID NO: 3377225 - RNA, 18 nt, Pseudomonas aeruginosa PA01
cagcaccacccggccgcg

SEQ ID NO: 3377226 - RNA, 17 nt, Pseudomonas aeruginosa PA01
cagcaccacccggcgca

SEQ ID NO: 3377227 - RNA, 16 nt, Pseudomonas aeruginosa PA01
cagcaccaccucgcca

SEQ ID NO: 3377228 - RNA, 22 nt, Pseudomonas aeruginosa PA01
cagcaccaccucgccaagcugg

SEQ ID NO: 3377229 - RNA, 19 nt, Pseudomonas aeruginosa PA01
cagcaccacgaugcugauc

SEQ ID NO: 3377230 - RNA, 13 nt, Pseudomonas aeruginosa PA01
cagcaccagcaau

SEQ ID NO: 3377231 - RNA, 16 nt, Pseudomonas aeruginosa PA01
cagcaccagcaccagc

SEQ ID NO: 3377232 - RNA, 15 nt, Pseudomonas aeruginosa PA01
cagcaccagcaggag

SEQ ID NO: 3377233 - RNA, 15 nt, Pseudomonas aeruginosa PA01
cagcaccaggaagcc

SEQ ID NO: 3377234 - RNA, 19 nt, Pseudomonas aeruginosa PA01
cagcaccaggaagccccag

SEQ ID NO: 3377235 - RNA, 14 nt, Pseudomonas aeruginosa PA01
cagcaccaggcugg

SEQ ID NO: 3377236 - RNA, 17 nt, Pseudomonas aeruginosa PA01
cagcaccaggcuggcca

SEQ ID NO: 3377237 - RNA, 17 nt, Pseudomonas aeruginosa PA01
cagcaccagucccuggc

SEQ ID NO: 3377238 - RNA, 12 nt, Pseudomonas aeruginosa PA01
cagcaccaucag

SEQ ID NO: 3377239 - RNA, 17 nt, Pseudomonas aeruginosa PA01
cagcaccaucagccagc

SEQ ID NO: 3377240 - RNA, 21 nt, Pseudomonas aeruginosa PA01
cagcaccaucagccagcccag

SEQ ID NO: 3377241 - RNA, 17 nt, Pseudomonas aeruginosa PA01
cagcaccaugcgcggca

SEQ ID NO: 3377242 - RNA, 20 nt, Pseudomonas aeruginosa PA01
cagcaccaugcgcggcagga

SEQ ID NO: 3377243 - RNA, 11 nt, Pseudomonas aeruginosa PA01
cagcacccagg

SEQ ID NO: 3377244 - RNA, 14 nt, Pseudomonas aeruginosa PA01
cagcacccaggcga

SEQ ID NO: 3377245 - RNA, 15 nt, Pseudomonas aeruginosa PA01
cagcacccagguaga

SEQ ID NO: 3377246 - RNA, 16 nt, Pseudomonas aeruginosa PA01
cagcacccccagcagg

SEQ ID NO: 3377247 - RNA, 19 nt, Pseudomonas aeruginosa PA01
cagcacccccagcaggcca

SEQ ID NO: 3377248 - RNA, 17 nt, Pseudomonas aeruginosa PA01
cagcacccgcaccagcc

SEQ ID NO: 3377249 - RNA, 20 nt, Pseudomonas aeruginosa PA01
cagcacccgcaccagccggc

SEQ ID NO: 3377250 - RNA, 20 nt, Pseudomonas aeruginosa PA01
cagcacccggaccuugucca

SEQ ID NO: 3377251 - RNA, 13 nt, Pseudomonas aeruginosa PA01
cagcacccggucg

SEQ ID NO: 3377252 - RNA, 17 nt, Pseudomonas aeruginosa PA01
cagcacccggucggccu

SEQ ID NO: 3377253 - RNA, 14 nt, Pseudomonas aeruginosa PA01
cagcacccuggcca

SEQ ID NO: 3377254 - RNA, 21 nt, Pseudomonas aeruginosa PA01
cagcaccgagacgcccuggau

SEQ ID NO: 3377255 - RNA, 18 nt, Pseudomonas aeruginosa PA01
cagcaccgagcaggcacc

SEQ ID NO: 3377256 - RNA, 14 nt, Pseudomonas aeruginosa PA01
cagcaccgagcuga

SEQ ID NO: 3377257 - RNA, 20 nt, Pseudomonas aeruginosa PA01
cagcaccgagcugaucgcgc

SEQ ID NO: 3377258 - RNA, 13 nt, Pseudomonas aeruginosa PA01
cagcaccgccacc

SEQ ID NO: 3377259 - RNA, 14 nt, Pseudomonas aeruginosa PA01
cagcaccgccacca

SEQ ID NO: 3377260 - RNA, 16 nt, Pseudomonas aeruginosa PA01
cagcaccgccaccagc

SEQ ID NO: 3377261 - RNA, 17 nt, Pseudomonas aeruginosa PA01
cagcaccgccaccagcg

SEQ ID NO: 3377262 - RNA, 20 nt, Pseudomonas aeruginosa PA01
cagcaccgccaccagcgagu

SEQ ID NO: 3377263 - RNA, 16 nt, Pseudomonas aeruginosa PA01
cagcaccgccugcaac

SEQ ID NO: 3377264 - RNA, 18 nt, Pseudomonas aeruginosa PA01
cagcaccgccugcaacuc

SEQ ID NO: 3377265 - RNA, 14 nt, Pseudomonas aeruginosa PA01
cagcaccgccuggc

SEQ ID NO: 3377266 - RNA, 15 nt, Pseudomonas aeruginosa PA01
cagcaccgccuggcg

SEQ ID NO: 3377267 - RNA, 17 nt, Pseudomonas aeruginosa PA01
cagcaccgccuggcgca

SEQ ID NO: 3377268 - RNA, 21 nt, Pseudomonas aeruginosa PA01
cagcaccgccuggcgcaaggu

SEQ ID NO: 3377269 - RNA, 16 nt, Pseudomonas aeruginosa PA01
cagcaccgccuggucg

SEQ ID NO: 3377270 - RNA, 18 nt, Pseudomonas aeruginosa PA01
cagcaccgcgagcaugcu

SEQ ID NO: 3377271 - RNA, 14 nt, Pseudomonas aeruginosa PA01
cagcaccgcgcgcu

SEQ ID NO: 3377272 - RNA, 17 nt, Pseudomonas aeruginosa PA01
cagcaccgcuuucacca

SEQ ID NO: 3377273 - RNA, 19 nt, Pseudomonas aeruginosa PA01
cagcaccgcuuucaccagg

SEQ ID NO: 3377274 - RNA, 14 nt, Pseudomonas aeruginosa PA01
cagcaccggcggcg

SEQ ID NO: 3377275 - RNA, 15 nt, Pseudomonas aeruginosa PA01
cagcaccggcggcgc

SEQ ID NO: 3377276 - RNA, 23 nt, Pseudomonas aeruginosa PA01
cagcaccggcggcgccaggccgg

SEQ ID NO: 3377277 - RNA, 21 nt, Pseudomonas aeruginosa PA01
cagcaccgggauggucgaggg

SEQ ID NO: 3377278 - RNA, 16 nt, Pseudomonas aeruginosa PA01
cagcaccguggcgcca

SEQ ID NO: 3377279 - RNA, 17 nt, Pseudomonas aeruginosa PA01
cagcaccguggcgccau

SEQ ID NO: 3377280 - RNA, 18 nt, Pseudomonas aeruginosa PA01
cagcaccguggucagcac

SEQ ID NO: 3377281 - RNA, 20 nt, Pseudomonas aeruginosa PA01
cagcaccguggucagcacca

SEQ ID NO: 3377282 - RNA, 20 nt, Pseudomonas aeruginosa PA01
cagcaccucccccagcgggc

SEQ ID NO: 3377283 - RNA, 13 nt, Pseudomonas aeruginosa PA01
cagcaccucgccg

SEQ ID NO: 3377284 - RNA, 16 nt, Pseudomonas aeruginosa PA01
cagcaccucgccgucg

SEQ ID NO: 3377285 - RNA, 17 nt, Pseudomonas aeruginosa PA01
cagcaccucgcgggaac

SEQ ID NO: 3377286 - RNA, 17 nt, Pseudomonas aeruginosa PA01
cagcaccugcgccgaag

SEQ ID NO: 3377287 - RNA, 21 nt, Pseudomonas aeruginosa PA01
cagcaccugcgggcugcgugc

SEQ ID NO: 3377288 - RNA, 22 nt, Pseudomonas aeruginosa PA01
cagcaccugcgggcugcgugcc

SEQ ID NO: 3377289 - RNA, 23 nt, Pseudomonas aeruginosa PA01
cagcaccuggcagugcgccggca

SEQ ID NO: 3377290 - RNA, 16 nt, Pseudomonas aeruginosa PA01
cagcaccuucaccgug

SEQ ID NO: 3377291 - RNA, 22 nt, Pseudomonas aeruginosa PA01
cagcaccuucaucaccaggucg

SEQ ID NO: 3377292 - RNA, 23 nt, Pseudomonas aeruginosa PA01
cagcaccuucaucaccaggucgc

SEQ ID NO: 3377293 - RNA, 17 nt, Pseudomonas aeruginosa PA01
cagcacgagcuuggcca

SEQ ID NO: 3377294 - RNA, 24 nt, Pseudomonas aeruginosa PA01
cagcacgagcuuggccacuccggg

SEQ ID NO: 3377295 - RNA, 18 nt, Pseudomonas aeruginosa PA01
cagcacgaugaggcgugg

SEQ ID NO: 3377296 - RNA, 14 nt, Pseudomonas aeruginosa PA01
cagcacgaugcaca

SEQ ID NO: 3377297 - RNA, 19 nt, Pseudomonas aeruginosa PA01
cagcacgaugcacaggcgu

SEQ ID NO: 3377298 - RNA, 15 nt, Pseudomonas aeruginosa PA01
cagcacgauggcgag

SEQ ID NO: 3377299 - RNA, 18 nt, Pseudomonas aeruginosa PA01
cagcacgauggcgaggau

SEQ ID NO: 3377300 - RNA, 21 nt, Pseudomonas aeruginosa PA01
cagcacgcccaguugcgccgc

SEQ ID NO: 3377301 - RNA, 16 nt, Pseudomonas aeruginosa PA01
cagcacgcccugggac

SEQ ID NO: 3377302 - RNA, 13 nt, Pseudomonas aeruginosa PA01
cagcacgccgagc

SEQ ID NO: 3377303 - RNA, 20 nt, Pseudomonas aeruginosa PA01
cagcacgccgagcaacggca

SEQ ID NO: 3377304 - RNA, 13 nt, Pseudomonas aeruginosa PA01
cagcacgccuucc

SEQ ID NO: 3377305 - RNA, 14 nt, Pseudomonas aeruginosa PA01
cagcacgccuucca

SEQ ID NO: 3377306 - RNA, 19 nt, Pseudomonas aeruginosa PA01
cagcacgcucaggcagcga

SEQ ID NO: 3377307 - RNA, 18 nt, Pseudomonas aeruginosa PA01
cagcacgcugacgccggc

SEQ ID NO: 3377308 - RNA, 17 nt, Pseudomonas aeruginosa PA01
cagcacgcuggcgucgg

SEQ ID NO: 3377309 - RNA, 15 nt, Pseudomonas aeruginosa PA01
cagcacggccucgcg

SEQ ID NO: 3377310 - RNA, 20 nt, Pseudomonas aeruginosa PA01
cagcacggcgaauucgucgc

SEQ ID NO: 3377311 - RNA, 16 nt, Pseudomonas aeruginosa PA01
cagcacggcgacgaag

SEQ ID NO: 3377312 - RNA, 15 nt, Pseudomonas aeruginosa PA01
cagcagcucgccgcu

SEQ ID NO: 3377313 - RNA, 21 nt, Pseudomonas aeruginosa PA01
cagcagcuucggcgcgacgcu

SEQ ID NO: 3377314 - RNA, 15 nt, Pseudomonas aeruginosa PA01
cagcagcuugccggc

SEQ ID NO: 3377315 - RNA, 18 nt, Pseudomonas aeruginosa PA01
cagcaggaaaacgcucag

SEQ ID NO: 3377316 - RNA, 18 nt, Pseudomonas aeruginosa PA01
cagcaggaagccgaccac

SEQ ID NO: 3377317 - RNA, 22 nt, Pseudomonas aeruginosa PA01
cagcaggaagcugacgaacauc

SEQ ID NO: 3377318 - RNA, 16 nt, Pseudomonas aeruginosa PA01
cagcaggaccuggccg

SEQ ID NO: 3377319 - RNA, 22 nt, Pseudomonas aeruginosa PA01
cagcaggacgucgaggucgacg

SEQ ID NO: 3377320 - RNA, 19 nt, Pseudomonas aeruginosa PA01
cagcaggagaagcgccucg

SEQ ID NO: 3377321 - RNA, 20 nt, Pseudomonas aeruginosa PA01
cagcaggagaagcgccucgc

SEQ ID NO: 3377322 - RNA, 11 nt, Pseudomonas aeruginosa PA01
cagcaggagca

SEQ ID NO: 3377323 - RNA, 14 nt, Pseudomonas aeruginosa PA01
cagcaggagcagcu

SEQ ID NO: 3377324 - RNA, 12 nt, Pseudomonas aeruginosa PA01
cagcaggagcgc

SEQ ID NO: 3377325 - RNA, 14 nt, Pseudomonas aeruginosa PA01
cagcaggagcgcca

SEQ ID NO: 3377326 - RNA, 15 nt, Pseudomonas aeruginosa PA01
cagcaggaucagcgc

SEQ ID NO: 3377327 - RNA, 16 nt, Pseudomonas aeruginosa PA01
cagcaggaucagcgca

SEQ ID NO: 3377328 - RNA, 23 nt, Pseudomonas aeruginosa PA01
cagcaggauccaggugcgcggca

SEQ ID NO: 3377329 - RNA, 21 nt, Pseudomonas aeruginosa PA01
cagcaggaucgacagcagcgc

SEQ ID NO: 3377330 - RNA, 23 nt, Pseudomonas aeruginosa PA01
cagcaggaucgagcccuggucga

SEQ ID NO: 3377331 - RNA, 23 nt, Pseudomonas aeruginosa PA01
cagcaggaucggagagacccgcc

SEQ ID NO: 3377332 - RNA, 14 nt, Pseudomonas aeruginosa PA01
cagcaggaugcagu

SEQ ID NO: 3377333 - RNA, 13 nt, Pseudomonas aeruginosa PA01
cagcaggaugcug

SEQ ID NO: 3377334 - RNA, 17 nt, Pseudomonas aeruginosa PA01
cagcaggcacagggcga

SEQ ID NO: 3377335 - RNA, 21 nt, Pseudomonas aeruginosa PA01
cagcaggcacagggcgacuac

SEQ ID NO: 3377336 - RNA, 16 nt, Pseudomonas aeruginosa PA01
cagcaggcaggcgcgg

SEQ ID NO: 3377337 - RNA, 18 nt, Pseudomonas aeruginosa PA01
cagcaggcaggcgcgggu

SEQ ID NO: 3377338 - RNA, 19 nt, Pseudomonas aeruginosa PA01
cagcaggcaggcgcggguc

SEQ ID NO: 3377339 - RNA, 15 nt, Pseudomonas aeruginosa PA01
cagcaggccagccaa

SEQ ID NO: 3377340 - RNA, 15 nt, Pseudomonas aeruginosa PA01
cagcaggccgaaggc

SEQ ID NO: 3377341 - RNA, 17 nt, Pseudomonas aeruginosa PA01
cagcaggccgaaggcca

SEQ ID NO: 3377342 - RNA, 20 nt, Pseudomonas aeruginosa PA01
cagcaggccgaaggccagga

SEQ ID NO: 3377343 - RNA, 13 nt, Pseudomonas aeruginosa PA01
cagcaggccgagc

SEQ ID NO: 3377344 - RNA, 21 nt, Pseudomonas aeruginosa PA01
cagcaggccgaggucggcggc

SEQ ID NO: 3377345 - RNA, 22 nt, Pseudomonas aeruginosa PA01
cagcaggccgaggucggcggcg

SEQ ID NO: 3377346 - RNA, 23 nt, Pseudomonas aeruginosa PA01
cagcaggccgaucaccagcgcca

SEQ ID NO: 3377347 - RNA, 18 nt, Pseudomonas aeruginosa PA01
cagcaggccgaucagcgg

SEQ ID NO: 3377348 - RNA, 19 nt, Pseudomonas aeruginosa PA01
cagcaggccgaucagcggc

SEQ ID NO: 3377349 - RNA, 21 nt, Pseudomonas aeruginosa PA01
cagcaggccgaucagcggcgg

SEQ ID NO: 3377350 - RNA, 14 nt, Pseudomonas aeruginosa PA01
cagcaggccgccgc

SEQ ID NO: 3377351 - RNA, 21 nt, Pseudomonas aeruginosa PA01
cagcaggccgccgcgugccgc

SEQ ID NO: 3377352 - RNA, 12 nt, Pseudomonas aeruginosa PA01
cagcaggccgcu

SEQ ID NO: 3377353 - RNA, 14 nt, Pseudomonas aeruginosa PA01
cagcaggccgcugg

SEQ ID NO: 3377354 - RNA, 14 nt, Pseudomonas aeruginosa PA01
cagcaggccggcca

SEQ ID NO: 3377355 - RNA, 16 nt, Pseudomonas aeruginosa PA01
cagcaggccggccagc

SEQ ID NO: 3377356 - RNA, 21 nt, Pseudomonas aeruginosa PA01
cagcaggcgcaaccagaccag

SEQ ID NO: 3377357 - RNA, 14 nt, Pseudomonas aeruginosa PA01
cagcaggcgcagca

SEQ ID NO: 3377358 - RNA, 20 nt, Pseudomonas aeruginosa PA01
cagcaggcgcagcagcgacu

SEQ ID NO: 3377359 - RNA, 14 nt, Pseudomonas aeruginosa PA01
cagcaggcgcaggu

SEQ ID NO: 3377360 - RNA, 16 nt, Pseudomonas aeruginosa PA01
cagcaggcgcaggucg

SEQ ID NO: 3377361 - RNA, 16 nt, Pseudomonas aeruginosa PA01
cagcaggcgccggcgg

SEQ ID NO: 3377362 - RNA, 13 nt, Pseudomonas aeruginosa PA01
cagcaggcgcucg

SEQ ID NO: 3377363 - RNA, 14 nt, Pseudomonas aeruginosa PA01
cagcaggcgcucgc

SEQ ID NO: 3377364 - RNA, 15 nt, Pseudomonas aeruginosa PA01
cagcaggcgcucgcu

SEQ ID NO: 3377365 - RNA, 18 nt, Pseudomonas aeruginosa PA01
cagcaggcgcucggcgac

SEQ ID NO: 3377366 - RNA, 19 nt, Pseudomonas aeruginosa PA01
cagcaggcgcucggcgacg

SEQ ID NO: 3377367 - RNA, 13 nt, Pseudomonas aeruginosa PA01
cagcaggcggccc

SEQ ID NO: 3377368 - RNA, 14 nt, Pseudomonas aeruginosa PA01
cagcaggcgggcga

SEQ ID NO: 3377369 - RNA, 17 nt, Pseudomonas aeruginosa PA01
cagcaggcguucggcga

SEQ ID NO: 3377370 - RNA, 17 nt, Pseudomonas aeruginosa PA01
cagcaggcucaucgccc

SEQ ID NO: 3377371 - RNA, 19 nt, Pseudomonas aeruginosa PA01
cagcaggcucaugcccagc

SEQ ID NO: 3377372 - RNA, 17 nt, Pseudomonas aeruginosa PA01
cagcaggcucuuggucg

SEQ ID NO: 3377373 - RNA, 13 nt, Pseudomonas aeruginosa PA01
cagcaggcugccg

SEQ ID NO: 3377374 - RNA, 14 nt, Pseudomonas aeruginosa PA01
cagcaggcugccgu

SEQ ID NO: 3377375 - RNA, 22 nt, Pseudomonas aeruginosa PA01
cagcaggcugccguugcggccc

SEQ ID NO: 3377376 - RNA, 23 nt, Pseudomonas aeruginosa PA01
cagcaggcuguacagcaggagcg

SEQ ID NO: 3377377 - RNA, 13 nt, Pseudomonas aeruginosa PA01
cagcagggaggcg

SEQ ID NO: 3377378 - RNA, 17 nt, Pseudomonas aeruginosa PA01
cagcagggaggcgcaca

SEQ ID NO: 3377379 - RNA, 17 nt, Pseudomonas aeruginosa PA01
cagcagggccagcagcg

SEQ ID NO: 3377380 - RNA, 18 nt, Pseudomonas aeruginosa PA01
cagcagggccagcagcgc

SEQ ID NO: 3377381 - RNA, 20 nt, Pseudomonas aeruginosa PA01
cagcagggccagcagcgcug

SEQ ID NO: 3377382 - RNA, 14 nt, Pseudomonas aeruginosa PA01
cagcagggccagcc

SEQ ID NO: 3377383 - RNA, 17 nt, Pseudomonas aeruginosa PA01
cagcagggccagcgccu

SEQ ID NO: 3377384 - RNA, 13 nt, Pseudomonas aeruginosa PA01
cagcagggccagg

SEQ ID NO: 3377385 - RNA, 19 nt, Pseudomonas aeruginosa PA01
cagcagggccaggccgagc

SEQ ID NO: 3377386 - RNA, 16 nt, Pseudomonas aeruginosa PA01
cagcagggccgccgag

SEQ ID NO: 3377387 - RNA, 17 nt, Pseudomonas aeruginosa PA01
cagcagggccgccgagg

SEQ ID NO: 3377388 - RNA, 18 nt, Pseudomonas aeruginosa PA01
cagcagggccgccgaggu

SEQ ID NO: 3377389 - RNA, 22 nt, Pseudomonas aeruginosa PA01
cagcagggcguaggcgucgcga

SEQ ID NO: 3377390 - RNA, 14 nt, Pseudomonas aeruginosa PA01
cagcagggcgucgg

SEQ ID NO: 3377391 - RNA, 18 nt, Pseudomonas aeruginosa PA01
cagcagggcgucggcgug

SEQ ID NO: 3377392 - RNA, 20 nt, Pseudomonas aeruginosa PA01
cagcagggcgucggcgugcu

SEQ ID NO: 3377393 - RNA, 16 nt, Pseudomonas aeruginosa PA01
cagcaggguaccgcug

SEQ ID NO: 3377394 - RNA, 17 nt, Pseudomonas aeruginosa PA01
cagcaggguaccgcugg

SEQ ID NO: 3377395 - RNA, 16 nt, Pseudomonas aeruginosa PA01
cagcagggucagcagc

SEQ ID NO: 3377396 - RNA, 19 nt, Pseudomonas aeruginosa PA01
cagcagggucagcagcgcc

SEQ ID NO: 3377397 - RNA, 20 nt, Pseudomonas aeruginosa PA01
cagcagggucagcagcgcca

SEQ ID NO: 3377398 - RNA, 16 nt, Pseudomonas aeruginosa PA01
cagcagggucagggug

SEQ ID NO: 3377399 - RNA, 15 nt, Pseudomonas aeruginosa PA01
cagcagggucgcgcc

SEQ ID NO: 3377400 - RNA, 17 nt, Pseudomonas aeruginosa PA01
cagcagggucgcgccgu

SEQ ID NO: 3377401 - RNA, 18 nt, Pseudomonas aeruginosa PA01
cagcagggucgcgccguc

SEQ ID NO: 3377402 - RNA, 20 nt, Pseudomonas aeruginosa PA01
cagcagggucuucaggcgcc

SEQ ID NO: 3377403 - RNA, 22 nt, Pseudomonas aeruginosa PA01
cagcagggugcggauggcgauc

SEQ ID NO: 3377404 - RNA, 14 nt, Pseudomonas aeruginosa PA01
cagcaggguggcca

SEQ ID NO: 3377405 - RNA, 20 nt, Pseudomonas aeruginosa PA01
cagcaggguggccagggucc

SEQ ID NO: 3377406 - RNA, 15 nt, Pseudomonas aeruginosa PA01
cagcagguagaagaa

SEQ ID NO: 3377407 - RNA, 17 nt, Pseudomonas aeruginosa PA01
cagcagguagaccacgc

SEQ ID NO: 3377408 - RNA, 18 nt, Pseudomonas aeruginosa PA01
cagcagguagacgcaggu

SEQ ID NO: 3377409 - RNA, 21 nt, Pseudomonas aeruginosa PA01
cagcagguagccugcggccag

SEQ ID NO: 3377410 - RNA, 18 nt, Pseudomonas aeruginosa PA01
cagcagguagugcggcgg

SEQ ID NO: 3377411 - RNA, 20 nt, Pseudomonas aeruginosa PA01
cagcagguagugcggcgggc

SEQ ID NO: 3377412 - RNA, 15 nt, Pseudomonas aeruginosa PA01
cagcaggucgagcag

SEQ ID NO: 3377413 - RNA, 16 nt, Pseudomonas aeruginosa PA01
cagcaggucgagcagu

SEQ ID NO: 3377414 - RNA, 14 nt, Pseudomonas aeruginosa PA01
cagcaggucgaggu

SEQ ID NO: 3377415 - RNA, 15 nt, Pseudomonas aeruginosa PA01
cagccagagcuccag

SEQ ID NO: 3377416 - RNA, 19 nt, Pseudomonas aeruginosa PA01
cagccagagcuccagggcu

SEQ ID NO: 3377417 - RNA, 15 nt, Pseudomonas aeruginosa PA01
cagccagaggucgag

SEQ ID NO: 3377418 - RNA, 15 nt, Pseudomonas aeruginosa PA01
cagccagcagcccgg

SEQ ID NO: 3377419 - RNA, 18 nt, Pseudomonas aeruginosa PA01
cagccagcagcccggccu

SEQ ID NO: 3377420 - RNA, 20 nt, Pseudomonas aeruginosa PA01
cagccagcagcccggccugg

SEQ ID NO: 3377421 - RNA, 14 nt, Pseudomonas aeruginosa PA01
cagccagcccggcg

SEQ ID NO: 3377422 - RNA, 16 nt, Pseudomonas aeruginosa PA01
cagccagccgccgaag

SEQ ID NO: 3377423 - RNA, 13 nt, Pseudomonas aeruginosa PA01
cagccagccgccu

SEQ ID NO: 3377424 - RNA, 14 nt, Pseudomonas aeruginosa PA01
cagccagccggcga

SEQ ID NO: 3377425 - RNA, 20 nt, Pseudomonas aeruginosa PA01
cagccagccggcgaagggca

SEQ ID NO: 3377426 - RNA, 14 nt, Pseudomonas aeruginosa PA01
cagccagcgcggcu

SEQ ID NO: 3377427 - RNA, 14 nt, Pseudomonas aeruginosa PA01
cagccagcggcgcu

SEQ ID NO: 3377428 - RNA, 14 nt, Pseudomonas aeruginosa PA01
cagccaggaagagc

SEQ ID NO: 3377429 - RNA, 20 nt, Pseudomonas aeruginosa PA01
cagccaggaagagcccgcca

SEQ ID NO: 3377430 - RNA, 22 nt, Pseudomonas aeruginosa PA01
cagccaggcccgguugagaucc

SEQ ID NO: 3377431 - RNA, 19 nt, Pseudomonas aeruginosa PA01
cagccaggcgaagcggcug

SEQ ID NO: 3377432 - RNA, 16 nt, Pseudomonas aeruginosa PA01
cagccaggcgaaggcg

SEQ ID NO: 3377433 - RNA, 19 nt, Pseudomonas aeruginosa PA01
cagccaggcgaaggcgauc

SEQ ID NO: 3377434 - RNA, 20 nt, Pseudomonas aeruginosa PA01
cagccaggcgaaggcgaucc

SEQ ID NO: 3377435 - RNA, 16 nt, Pseudomonas aeruginosa PA01
cagccaggcgauggug

SEQ ID NO: 3377436 - RNA, 14 nt, Pseudomonas aeruginosa PA01
cagccaggcgcucu

SEQ ID NO: 3377437 - RNA, 14 nt, Pseudomonas aeruginosa PA01
cagccaggcggcca

SEQ ID NO: 3377438 - RNA, 21 nt, Pseudomonas aeruginosa PA01
cagccaggcggccaccaccgu

SEQ ID NO: 3377439 - RNA, 13 nt, Pseudomonas aeruginosa PA01
cagccaggcuggc

SEQ ID NO: 3377440 - RNA, 14 nt, Pseudomonas aeruginosa PA01
cagccaggcuggcu

SEQ ID NO: 3377441 - RNA, 14 nt, Pseudomonas aeruginosa PA01
cagccagggcaacg

SEQ ID NO: 3377442 - RNA, 20 nt, Pseudomonas aeruginosa PA01
cagccagggcaacgccaggc

SEQ ID NO: 3377443 - RNA, 21 nt, Pseudomonas aeruginosa PA01
cagccagggcaacgccaggcu

SEQ ID NO: 3377444 - RNA, 19 nt, Pseudomonas aeruginosa PA01
cagccagggccgcgagagg

SEQ ID NO: 3377445 - RNA, 20 nt, Pseudomonas aeruginosa PA01
cagccagggccgcgagaggu

SEQ ID NO: 3377446 - RNA, 15 nt, Pseudomonas aeruginosa PA01
cagccaggggcacgc

SEQ ID NO: 3377447 - RNA, 17 nt, Pseudomonas aeruginosa PA01
cagccaggggcacgcug

SEQ ID NO: 3377448 - RNA, 20 nt, Pseudomonas aeruginosa PA01
cagccaggggcacgcuggcg

SEQ ID NO: 3377449 - RNA, 21 nt, Pseudomonas aeruginosa PA01
cagccaggggcacgcuggcga

SEQ ID NO: 3377450 - RNA, 23 nt, Pseudomonas aeruginosa PA01
cagccaggguacuucgugccaca

SEQ ID NO: 3377451 - RNA, 21 nt, Pseudomonas aeruginosa PA01
cagccagguguucggccccgg

SEQ ID NO: 3377452 - RNA, 17 nt, Pseudomonas aeruginosa PA01
cagccaguaguccuccg

SEQ ID NO: 3377453 - RNA, 18 nt, Pseudomonas aeruginosa PA01
cagccaguaguccuccgc

SEQ ID NO: 3377454 - RNA, 19 nt, Pseudomonas aeruginosa PA01
cagccaguaguccuccgcg

SEQ ID NO: 3377455 - RNA, 22 nt, Pseudomonas aeruginosa PA01
cagccaguaguccuccgcgccc

SEQ ID NO: 3377456 - RNA, 23 nt, Pseudomonas aeruginosa PA01
cagccaguaguccuccgcgccca

SEQ ID NO: 3377457 - RNA, 16 nt, Pseudomonas aeruginosa PA01
cagccaguccggcagc

SEQ ID NO: 3377458 - RNA, 22 nt, Pseudomonas aeruginosa PA01
cagccaguccggcagcacggcg

SEQ ID NO: 3377459 - RNA, 24 nt, Pseudomonas aeruginosa PA01
cagccagucgagacgccagccgcc

SEQ ID NO: 3377460 - RNA, 14 nt, Pseudomonas aeruginosa PA01
cagccagucggcgg

SEQ ID NO: 3377461 - RNA, 16 nt, Pseudomonas aeruginosa PA01
cagccagucggcgguc

SEQ ID NO: 3377462 - RNA, 13 nt, Pseudomonas aeruginosa PA01
cagccagugcaug

SEQ ID NO: 3377463 - RNA, 16 nt, Pseudomonas aeruginosa PA01
cagccauagcaauaca

SEQ ID NO: 3377464 - RNA, 14 nt, Pseudomonas aeruginosa PA01
cagccauagcgccg

SEQ ID NO: 3377465 - RNA, 15 nt, Pseudomonas aeruginosa PA01
cagccauagcgccgg

SEQ ID NO: 3377466 - RNA, 16 nt, Pseudomonas aeruginosa PA01
cagccauagcgccggc

SEQ ID NO: 3377467 - RNA, 19 nt, Pseudomonas aeruginosa PA01
cagccaucgcauagccggc

SEQ ID NO: 3377468 - RNA, 13 nt, Pseudomonas aeruginosa PA01
cagccauggcugg

SEQ ID NO: 3377469 - RNA, 18 nt, Pseudomonas aeruginosa PA01
cagccaugugcuccuuga

SEQ ID NO: 3377470 - RNA, 14 nt, Pseudomonas aeruginosa PA01
cagccauucgccgc

SEQ ID NO: 3377471 - RNA, 15 nt, Pseudomonas aeruginosa PA01
cagccauucgccgcg

SEQ ID NO: 3377472 - RNA, 17 nt, Pseudomonas aeruginosa PA01
cagccauucgccgcgac

SEQ ID NO: 3377473 - RNA, 16 nt, Pseudomonas aeruginosa PA01
cagccauugagcgcgc

SEQ ID NO: 3377474 - RNA, 18 nt, Pseudomonas aeruginosa PA01
cagccauugagcgcgccc

SEQ ID NO: 3377475 - RNA, 22 nt, Pseudomonas aeruginosa PA01
cagccauugagcgcgcccaggc

SEQ ID NO: 3377476 - RNA, 17 nt, Pseudomonas aeruginosa PA01
cagccauugcgccagga

SEQ ID NO: 3377477 - RNA, 22 nt, Pseudomonas aeruginosa PA01
cagccauuggccgacgccgcug

SEQ ID NO: 3377478 - RNA, 17 nt, Pseudomonas aeruginosa PA01
cagccauuucugcugug

SEQ ID NO: 3377479 - RNA, 22 nt, Pseudomonas aeruginosa PA01
cagcccacccccagcccggcca

SEQ ID NO: 3377480 - RNA, 15 nt, Pseudomonas aeruginosa PA01
cagcccacccccggc

SEQ ID NO: 3377481 - RNA, 19 nt, Pseudomonas aeruginosa PA01
cagcccacccccggcccgg

SEQ ID NO: 3377482 - RNA, 22 nt, Pseudomonas aeruginosa PA01
cagcccacccccggcccggcca

SEQ ID NO: 3377483 - RNA, 15 nt, Pseudomonas aeruginosa PA01
cagcccagaacagca

SEQ ID NO: 3377484 - RNA, 12 nt, Pseudomonas aeruginosa PA01
cagcccagccgc

SEQ ID NO: 3377485 - RNA, 13 nt, Pseudomonas aeruginosa PA01
cagcccagccgcu

SEQ ID NO: 3377486 - RNA, 15 nt, Pseudomonas aeruginosa PA01
cagcccagcgcuucc

SEQ ID NO: 3377487 - RNA, 14 nt, Pseudomonas aeruginosa PA01
cagcccagcggcgc

SEQ ID NO: 3377488 - RNA, 16 nt, Pseudomonas aeruginosa PA01
cagcccagcggcgcgg

SEQ ID NO: 3377489 - RNA, 19 nt, Pseudomonas aeruginosa PA01
cagcccagcggcgcggcgu

SEQ ID NO: 3377490 - RNA, 12 nt, Pseudomonas aeruginosa PA01
cagcccaggcgc

SEQ ID NO: 3377491 - RNA, 13 nt, Pseudomonas aeruginosa PA01
cagcccaggcgcc

SEQ ID NO: 3377492 - RNA, 17 nt, Pseudomonas aeruginosa PA01
cagcccaguucgcgcag

SEQ ID NO: 3377493 - RNA, 21 nt, Pseudomonas aeruginosa PA01
cagcccaguucgcgcaggacc

SEQ ID NO: 3377494 - RNA, 17 nt, Pseudomonas aeruginosa PA01
cagcccauacaccaggc

SEQ ID NO: 3377495 - RNA, 20 nt, Pseudomonas aeruginosa PA01
cagccccagcacgccgagca

SEQ ID NO: 3377496 - RNA, 12 nt, Pseudomonas aeruginosa PA01
cagccccaggcc

SEQ ID NO: 3377497 - RNA, 14 nt, Pseudomonas aeruginosa PA01
cagccccaggccgc

SEQ ID NO: 3377498 - RNA, 13 nt, Pseudomonas aeruginosa PA01
cagccccaggcgc

SEQ ID NO: 3377499 - RNA, 15 nt, Pseudomonas aeruginosa PA01
cagccccaggcgcgg

SEQ ID NO: 3377500 - RNA, 17 nt, Pseudomonas aeruginosa PA01
cagccccaggcgcggcg

SEQ ID NO: 3377501 - RNA, 13 nt, Pseudomonas aeruginosa PA01
cagccccaguccc

SEQ ID NO: 3377502 - RNA, 16 nt, Pseudomonas aeruginosa PA01
cagccccagucccuuc

SEQ ID NO: 3377503 - RNA, 14 nt, Pseudomonas aeruginosa PA01
cagcccccaggcac

SEQ ID NO: 3377504 - RNA, 15 nt, Pseudomonas aeruginosa PA01
cagcccccaggcacc

SEQ ID NO: 3377505 - RNA, 15 nt, Pseudomonas aeruginosa PA01
cagcccccgccggcc

SEQ ID NO: 3377506 - RNA, 14 nt, Pseudomonas aeruginosa PA01
cagcccccucgccc

SEQ ID NO: 3377507 - RNA, 18 nt, Pseudomonas aeruginosa PA01
cagcccccucgcccucga

SEQ ID NO: 3377508 - RNA, 16 nt, Pseudomonas aeruginosa PA01
cagccccgaggccagc

SEQ ID NO: 3377509 - RNA, 19 nt, Pseudomonas aeruginosa PA01
cagccccgaucgccucggc

SEQ ID NO: 3377510 - RNA, 21 nt, Pseudomonas aeruginosa PA01
cagccccgaucgccucggcca

SEQ ID NO: 3377511 - RNA, 12 nt, Pseudomonas aeruginosa PA01
cagccccgccgg

SEQ ID NO: 3377512 - RNA, 14 nt, Pseudomonas aeruginosa PA01
cagccccgccggaa

SEQ ID NO: 3377513 - RNA, 15 nt, Pseudomonas aeruginosa PA01
cagccccgccggaag

SEQ ID NO: 3377514 - RNA, 22 nt, Pseudomonas aeruginosa PA01
cagccccgcgauugcagcuccu

SEQ ID NO: 3377515 - RNA, 22 nt, Pseudomonas aeruginosa PA01
cagccccgcucgucauggcgca

SEQ ID NO: 3377516 - RNA, 14 nt, Pseudomonas aeruginosa PA01
cagccccggcccgg

SEQ ID NO: 3377517 - RNA, 14 nt, Pseudomonas aeruginosa PA01
cagccccucgccau

SEQ ID NO: 3377518 - RNA, 20 nt, Pseudomonas aeruginosa PA01
cagccgcgaguccuucggcg

SEQ ID NO: 3377519 - RNA, 22 nt, Pseudomonas aeruginosa PA01
cagccgcgaguccuucggcgca

SEQ ID NO: 3377520 - RNA, 13 nt, Pseudomonas aeruginosa PA01
cagccgcgccggg

SEQ ID NO: 3377521 - RNA, 15 nt, Pseudomonas aeruginosa PA01
cagccgcgccggggc

SEQ ID NO: 3377522 - RNA, 19 nt, Pseudomonas aeruginosa PA01
cagccgcgcgccgcaucgc

SEQ ID NO: 3377523 - RNA, 16 nt, Pseudomonas aeruginosa PA01
cagccgcgcgcgucga

SEQ ID NO: 3377524 - RNA, 14 nt, Pseudomonas aeruginosa PA01
cagccgcggccggg

SEQ ID NO: 3377525 - RNA, 13 nt, Pseudomonas aeruginosa PA01
cagccgcggcgcc

SEQ ID NO: 3377526 - RNA, 17 nt, Pseudomonas aeruginosa PA01
cagccgcggcgccacgc

SEQ ID NO: 3377527 - RNA, 12 nt, Pseudomonas aeruginosa PA01
cagccgcggggc

SEQ ID NO: 3377528 - RNA, 19 nt, Pseudomonas aeruginosa PA01
cagccgcgugcgcgccgcc

SEQ ID NO: 3377529 - RNA, 20 nt, Pseudomonas aeruginosa PA01
cagccgcgugcgcgccgccg

SEQ ID NO: 3377530 - RNA, 21 nt, Pseudomonas aeruginosa PA01
cagccgcgugcgcgccgccgg

SEQ ID NO: 3377531 - RNA, 22 nt, Pseudomonas aeruginosa PA01
cagccgcgugcgcgccgccggg

SEQ ID NO: 3377532 - RNA, 17 nt, Pseudomonas aeruginosa PA01
cagccgcguugucccug

SEQ ID NO: 3377533 - RNA, 18 nt, Pseudomonas aeruginosa PA01
cagccgcuagcgguagcc

SEQ ID NO: 3377534 - RNA, 14 nt, Pseudomonas aeruginosa PA01
cagccgcuccagga

SEQ ID NO: 3377535 - RNA, 18 nt, Pseudomonas aeruginosa PA01
cagccgcucgcguccgca

SEQ ID NO: 3377536 - RNA, 14 nt, Pseudomonas aeruginosa PA01
cagccgcucggccg

SEQ ID NO: 3377537 - RNA, 15 nt, Pseudomonas aeruginosa PA01
cagccgcucggccgc

SEQ ID NO: 3377538 - RNA, 16 nt, Pseudomonas aeruginosa PA01
cagccgcucggccgcc

SEQ ID NO: 3377539 - RNA, 19 nt, Pseudomonas aeruginosa PA01
cagccgcucggccgccagc

SEQ ID NO: 3377540 - RNA, 17 nt, Pseudomonas aeruginosa PA01
cagccgcugcagggcgg

SEQ ID NO: 3377541 - RNA, 21 nt, Pseudomonas aeruginosa PA01
cagccgcuggcgucgaaugcg

SEQ ID NO: 3377542 - RNA, 16 nt, Pseudomonas aeruginosa PA01
cagccgcugggccacg

SEQ ID NO: 3377543 - RNA, 14 nt, Pseudomonas aeruginosa PA01
cagccgcuuccggc

SEQ ID NO: 3377544 - RNA, 17 nt, Pseudomonas aeruginosa PA01
cagccggaccagccguc

SEQ ID NO: 3377545 - RNA, 20 nt, Pseudomonas aeruginosa PA01
cagccggcaagcgugccccg

SEQ ID NO: 3377546 - RNA, 21 nt, Pseudomonas aeruginosa PA01
cagccggcaagcgugccccga

SEQ ID NO: 3377547 - RNA, 13 nt, Pseudomonas aeruginosa PA01
cagccggcaucca

SEQ ID NO: 3377548 - RNA, 15 nt, Pseudomonas aeruginosa PA01
cagccggcauccagc

SEQ ID NO: 3377549 - RNA, 18 nt, Pseudomonas aeruginosa PA01
cagccggcauccagcauc

SEQ ID NO: 3377550 - RNA, 23 nt, Pseudomonas aeruginosa PA01
cagccggccauccagccaggcgc

SEQ ID NO: 3377551 - RNA, 13 nt, Pseudomonas aeruginosa PA01
cagccggccgcgu

SEQ ID NO: 3377552 - RNA, 20 nt, Pseudomonas aeruginosa PA01
cagccggcgaacagguagcc

SEQ ID NO: 3377553 - RNA, 14 nt, Pseudomonas aeruginosa PA01
cagccggcgccgca

SEQ ID NO: 3377554 - RNA, 20 nt, Pseudomonas aeruginosa PA01
cagccggcgccgcagggugc

SEQ ID NO: 3377555 - RNA, 13 nt, Pseudomonas aeruginosa PA01
cagccggcgcgcu

SEQ ID NO: 3377556 - RNA, 16 nt, Pseudomonas aeruginosa PA01
cagccggcgcgcuucc

SEQ ID NO: 3377557 - RNA, 20 nt, Pseudomonas aeruginosa PA01
cagccggcgcgcuuccucca

SEQ ID NO: 3377558 - RNA, 19 nt, Pseudomonas aeruginosa PA01
cagccggcgcucggccagg

SEQ ID NO: 3377559 - RNA, 22 nt, Pseudomonas aeruginosa PA01
cagccggcgcuucugcgagccg

SEQ ID NO: 3377560 - RNA, 18 nt, Pseudomonas aeruginosa PA01
cagccgggccgcagcgca

SEQ ID NO: 3377561 - RNA, 23 nt, Pseudomonas aeruginosa PA01
cagccgggcgugucgaggaaggc

SEQ ID NO: 3377562 - RNA, 18 nt, Pseudomonas aeruginosa PA01
cagccgggcuccgccgcg

SEQ ID NO: 3377563 - RNA, 21 nt, Pseudomonas aeruginosa PA01
cagccgggcuccgccgcgagc

SEQ ID NO: 3377564 - RNA, 13 nt, Pseudomonas aeruginosa PA01
cagccggggcuca

SEQ ID NO: 3377565 - RNA, 22 nt, Pseudomonas aeruginosa PA01
cagccgggguugaguugcaggc

SEQ ID NO: 3377566 - RNA, 20 nt, Pseudomonas aeruginosa PA01
cagccggguucccaguugcu

SEQ ID NO: 3377567 - RNA, 23 nt, Pseudomonas aeruginosa PA01
cagccggguucccaguugcuggg

SEQ ID NO: 3377568 - RNA, 15 nt, Pseudomonas aeruginosa PA01
cagccgguacugcgc

SEQ ID NO: 3377569 - RNA, 18 nt, Pseudomonas aeruginosa PA01
cagccgguaggggccgac

SEQ ID NO: 3377570 - RNA, 22 nt, Pseudomonas aeruginosa PA01
cagccgguaggggccgacgaag

SEQ ID NO: 3377571 - RNA, 20 nt, Pseudomonas aeruginosa PA01
cagccggugaaacggaucac

SEQ ID NO: 3377572 - RNA, 18 nt, Pseudomonas aeruginosa PA01
cagccgguggucuucagc

SEQ ID NO: 3377573 - RNA, 19 nt, Pseudomonas aeruginosa PA01
cagccgguggucuucagca

SEQ ID NO: 3377574 - RNA, 23 nt, Pseudomonas aeruginosa PA01
cagccgguugcguuuccggucac

SEQ ID NO: 3377575 - RNA, 18 nt, Pseudomonas aeruginosa PA01
cagccguccagcuugagg

SEQ ID NO: 3377576 - RNA, 15 nt, Pseudomonas aeruginosa PA01
cagccguccaucugu

SEQ ID NO: 3377577 - RNA, 14 nt, Pseudomonas aeruginosa PA01
cagccguccgccca

SEQ ID NO: 3377578 - RNA, 17 nt, Pseudomonas aeruginosa PA01
cagccguccgcgggcga

SEQ ID NO: 3377579 - RNA, 15 nt, Pseudomonas aeruginosa PA01
cagccgucggugauc

SEQ ID NO: 3377580 - RNA, 19 nt, Pseudomonas aeruginosa PA01
cagccgucggugaucgaga

SEQ ID NO: 3377581 - RNA, 17 nt, Pseudomonas aeruginosa PA01
cagccguggcacccagg

SEQ ID NO: 3377582 - RNA, 18 nt, Pseudomonas aeruginosa PA01
cagccguggcacccaggc

SEQ ID NO: 3377583 - RNA, 14 nt, Pseudomonas aeruginosa PA01
cagccguggcaggc

SEQ ID NO: 3377584 - RNA, 18 nt, Pseudomonas aeruginosa PA01
cagccguggcaggcgccc

SEQ ID NO: 3377585 - RNA, 15 nt, Pseudomonas aeruginosa PA01
cagccgugggcguag

SEQ ID NO: 3377586 - RNA, 15 nt, Pseudomonas aeruginosa PA01
cagccguucccgguc

SEQ ID NO: 3377587 - RNA, 14 nt, Pseudomonas aeruginosa PA01
cagccguucgcugg

SEQ ID NO: 3377588 - RNA, 14 nt, Pseudomonas aeruginosa PA01
cagccuacugggcg

SEQ ID NO: 3377589 - RNA, 23 nt, Pseudomonas aeruginosa PA01
cagccuacugggcguggcggccg

SEQ ID NO: 3377590 - RNA, 13 nt, Pseudomonas aeruginosa PA01
cagccucacccug

SEQ ID NO: 3377591 - RNA, 14 nt, Pseudomonas aeruginosa PA01
cagccucacccugc

SEQ ID NO: 3377592 - RNA, 19 nt, Pseudomonas aeruginosa PA01
cagccucacccugcugggc

SEQ ID NO: 3377593 - RNA, 23 nt, Pseudomonas aeruginosa PA01
cagccucacccugcugggcggga

SEQ ID NO: 3377594 - RNA, 14 nt, Pseudomonas aeruginosa PA01
cagccucagcgaca

SEQ ID NO: 3377595 - RNA, 14 nt, Pseudomonas aeruginosa PA01
cagccucgcgcucg

SEQ ID NO: 3377596 - RNA, 18 nt, Pseudomonas aeruginosa PA01
cagccucgcgcucggcgg

SEQ ID NO: 3377597 - RNA, 19 nt, Pseudomonas aeruginosa PA01
cagccucgcgcucggcggc

SEQ ID NO: 3377598 - RNA, 23 nt, Pseudomonas aeruginosa PA01
cagccucgcgcucggcggccucg

SEQ ID NO: 3377599 - RNA, 11 nt, Pseudomonas aeruginosa PA01
cagccucggca

SEQ ID NO: 3377600 - RNA, 18 nt, Pseudomonas aeruginosa PA01
cagccucggcagggcgcc

SEQ ID NO: 3377601 - RNA, 12 nt, Pseudomonas aeruginosa PA01
cagccucggcga

SEQ ID NO: 3377602 - RNA, 14 nt, Pseudomonas aeruginosa PA01
cagccucggcgaag

SEQ ID NO: 3377603 - RNA, 22 nt, Pseudomonas aeruginosa PA01
cagccugacguugccgcgcggg

SEQ ID NO: 3377604 - RNA, 24 nt, Pseudomonas aeruginosa PA01
cagccugacguugccgcgcgggcc

SEQ ID NO: 3377605 - RNA, 13 nt, Pseudomonas aeruginosa PA01
cagccugcuggcc

SEQ ID NO: 3377606 - RNA, 17 nt, Pseudomonas aeruginosa PA01
cagccuggccagcgucg

SEQ ID NO: 3377607 - RNA, 22 nt, Pseudomonas aeruginosa PA01
cagccugggggucuacgugauc

SEQ ID NO: 3377608 - RNA, 11 nt, Pseudomonas aeruginosa PA01
cagccuggggu

SEQ ID NO: 3377609 - RNA, 19 nt, Pseudomonas aeruginosa PA01
cagccuggggugcagcagg

SEQ ID NO: 3377610 - RNA, 23 nt, Pseudomonas aeruginosa PA01
cagccuggggugcagcagguucc

SEQ ID NO: 3377611 - RNA, 17 nt, Pseudomonas aeruginosa PA01
cagccugucacucaggc

SEQ ID NO: 3377612 - RNA, 14 nt, Pseudomonas aeruginosa PA01
cagccuucccggcg

SEQ ID NO: 3377613 - RNA, 20 nt, Pseudomonas aeruginosa PA01
cagccuucccggcgcuucgc

SEQ ID NO: 3377614 - RNA, 12 nt, Pseudomonas aeruginosa PA01
cagccuuccggc

SEQ ID NO: 3377615 - RNA, 16 nt, Pseudomonas aeruginosa PA01
cagccuucgagccacu

SEQ ID NO: 3377616 - RNA, 23 nt, Pseudomonas aeruginosa PA01
cagccuucgagccacucgugcaa

SEQ ID NO: 3377617 - RNA, 17 nt, Pseudomonas aeruginosa PA01
cagccuugagccuugcc

SEQ ID NO: 3377618 - RNA, 22 nt, Pseudomonas aeruginosa PA01
cagccuugcuggacuucccggc

SEQ ID NO: 3377619 - RNA, 14 nt, Pseudomonas aeruginosa PA01
cagccuuggccacg

SEQ ID NO: 3377620 - RNA, 15 nt, Pseudomonas aeruginosa PA01
cagcgccaccagcag

SEQ ID NO: 3377621 - RNA, 17 nt, Pseudomonas aeruginosa PA01
cagcgccaccagcaggg

SEQ ID NO: 3377622 - RNA, 18 nt, Pseudomonas aeruginosa PA01
cagcgccaccagcagggc

SEQ ID NO: 3377623 - RNA, 22 nt, Pseudomonas aeruginosa PA01
cagcgccaccagcagggccagg

SEQ ID NO: 3377624 - RNA, 15 nt, Pseudomonas aeruginosa PA01
cagcgccaccagcau

SEQ ID NO: 3377625 - RNA, 16 nt, Pseudomonas aeruginosa PA01
cagcgccaccagcaug

SEQ ID NO: 3377626 - RNA, 19 nt, Pseudomonas aeruginosa PA01
cagcgccaccagcaugccc

SEQ ID NO: 3377627 - RNA, 13 nt, Pseudomonas aeruginosa PA01
cagcgccaccagg

SEQ ID NO: 3377628 - RNA, 14 nt, Pseudomonas aeruginosa PA01
cagcgccaccagga

SEQ ID NO: 3377629 - RNA, 15 nt, Pseudomonas aeruginosa PA01
cagcgccacgccgcu

SEQ ID NO: 3377630 - RNA, 16 nt, Pseudomonas aeruginosa PA01
cagcgccacgccgcug

SEQ ID NO: 3377631 - RNA, 15 nt, Pseudomonas aeruginosa PA01
cagcgccacgcugau

SEQ ID NO: 3377632 - RNA, 13 nt, Pseudomonas aeruginosa PA01
cagcgccacggcc

SEQ ID NO: 3377633 - RNA, 17 nt, Pseudomonas aeruginosa PA01
cagcgccacggccagca

SEQ ID NO: 3377634 - RNA, 19 nt, Pseudomonas aeruginosa PA01
cagcgccacggccagcagg

SEQ ID NO: 3377635 - RNA, 16 nt, Pseudomonas aeruginosa PA01
cagcgccacggcgauc

SEQ ID NO: 3377636 - RNA, 20 nt, Pseudomonas aeruginosa PA01
cagcgccacggcgcggaaca

SEQ ID NO: 3377637 - RNA, 23 nt, Pseudomonas aeruginosa PA01
cagcgccacggcgcggaacaucg

SEQ ID NO: 3377638 - RNA, 13 nt, Pseudomonas aeruginosa PA01
cagcgccacuucc

SEQ ID NO: 3377639 - RNA, 14 nt, Pseudomonas aeruginosa PA01
cagcgccacuucca

SEQ ID NO: 3377640 - RNA, 15 nt, Pseudomonas aeruginosa PA01
cagcgccacuuccag

SEQ ID NO: 3377641 - RNA, 17 nt, Pseudomonas aeruginosa PA01
cagcgccacuuccagcu

SEQ ID NO: 3377642 - RNA, 13 nt, Pseudomonas aeruginosa PA01
cagcgccagcaac

SEQ ID NO: 3377643 - RNA, 15 nt, Pseudomonas aeruginosa PA01
cagcgccagcaaccc

SEQ ID NO: 3377644 - RNA, 18 nt, Pseudomonas aeruginosa PA01
cagcgccagcaacccgcc

SEQ ID NO: 3377645 - RNA, 13 nt, Pseudomonas aeruginosa PA01
cagcgccagcagg

SEQ ID NO: 3377646 - RNA, 16 nt, Pseudomonas aeruginosa PA01
cagcgccagcaggcga

SEQ ID NO: 3377647 - RNA, 20 nt, Pseudomonas aeruginosa PA01
cagcgccagcagguacagca

SEQ ID NO: 3377648 - RNA, 21 nt, Pseudomonas aeruginosa PA01
cagcgccagcaggucgcgcug

SEQ ID NO: 3377649 - RNA, 13 nt, Pseudomonas aeruginosa PA01
cagcgccagcagu

SEQ ID NO: 3377650 - RNA, 13 nt, Pseudomonas aeruginosa PA01
cagcgccagccag

SEQ ID NO: 3377651 - RNA, 16 nt, Pseudomonas aeruginosa PA01
cagcgccagccagggu

SEQ ID NO: 3377652 - RNA, 21 nt, Pseudomonas aeruginosa PA01
cagcgccagccaggguacuuc

SEQ ID NO: 3377653 - RNA, 13 nt, Pseudomonas aeruginosa PA01
cagcgccagcggc

SEQ ID NO: 3377654 - RNA, 15 nt, Pseudomonas aeruginosa PA01
cagcgccagcggcag

SEQ ID NO: 3377655 - RNA, 17 nt, Pseudomonas aeruginosa PA01
cagcgccagcggcagcg

SEQ ID NO: 3377656 - RNA, 18 nt, Pseudomonas aeruginosa PA01
cagcgccagcggcagcgg

SEQ ID NO: 3377657 - RNA, 15 nt, Pseudomonas aeruginosa PA01
cagcgccaggaagcc

SEQ ID NO: 3377658 - RNA, 12 nt, Pseudomonas aeruginosa PA01
cagcgccaggag

SEQ ID NO: 3377659 - RNA, 13 nt, Pseudomonas aeruginosa PA01
cagcgccaggagc

SEQ ID NO: 3377660 - RNA, 17 nt, Pseudomonas aeruginosa PA01
cagcgccaggagcaggg

SEQ ID NO: 3377661 - RNA, 14 nt, Pseudomonas aeruginosa PA01
cagcgccaggccga

SEQ ID NO: 3377662 - RNA, 23 nt, Pseudomonas aeruginosa PA01
cagcgccaggccgaucagcgccu

SEQ ID NO: 3377663 - RNA, 16 nt, Pseudomonas aeruginosa PA01
cagcgccaggccgccg

SEQ ID NO: 3377664 - RNA, 19 nt, Pseudomonas aeruginosa PA01
cagcgccaggccgccgaag

SEQ ID NO: 3377665 - RNA, 14 nt, Pseudomonas aeruginosa PA01
cagcgccaggcgcg

SEQ ID NO: 3377666 - RNA, 20 nt, Pseudomonas aeruginosa PA01
cagcgccagggguaggagga

SEQ ID NO: 3377667 - RNA, 22 nt, Pseudomonas aeruginosa PA01
cagcgccagguuggccuggccc

SEQ ID NO: 3377668 - RNA, 18 nt, Pseudomonas aeruginosa PA01
cagcgccaguuggacgcg

SEQ ID NO: 3377669 - RNA, 23 nt, Pseudomonas aeruginosa PA01
cagcgccaguuggacgcggccug

SEQ ID NO: 3377670 - RNA, 16 nt, Pseudomonas aeruginosa PA01
cagcgccaucaggccc

SEQ ID NO: 3377671 - RNA, 18 nt, Pseudomonas aeruginosa PA01
cagcgccaucaggcccuu

SEQ ID NO: 3377672 - RNA, 19 nt, Pseudomonas aeruginosa PA01
cagcgccaucaggcccuug

SEQ ID NO: 3377673 - RNA, 19 nt, Pseudomonas aeruginosa PA01
cagcgccaugcucuucagg

SEQ ID NO: 3377674 - RNA, 20 nt, Pseudomonas aeruginosa PA01
cagcgccaugcucuucaggc

SEQ ID NO: 3377675 - RNA, 21 nt, Pseudomonas aeruginosa PA01
cagcgccauggggaucaccgg

SEQ ID NO: 3377676 - RNA, 20 nt, Pseudomonas aeruginosa PA01
cagcgcccagacacgccuca

SEQ ID NO: 3377677 - RNA, 13 nt, Pseudomonas aeruginosa PA01
cagcgcccaggcc

SEQ ID NO: 3377678 - RNA, 14 nt, Pseudomonas aeruginosa PA01
cagcgcccaggccg

SEQ ID NO: 3377679 - RNA, 15 nt, Pseudomonas aeruginosa PA01
cagcgcccaggccgg

SEQ ID NO: 3377680 - RNA, 17 nt, Pseudomonas aeruginosa PA01
cagcgcccaggccgggu

SEQ ID NO: 3377681 - RNA, 19 nt, Pseudomonas aeruginosa PA01
cagcgcccaggccgggucg

SEQ ID NO: 3377682 - RNA, 21 nt, Pseudomonas aeruginosa PA01
cagcgcccaggccgggucgca

SEQ ID NO: 3377683 - RNA, 15 nt, Pseudomonas aeruginosa PA01
cagcgccccaccagg

SEQ ID NO: 3377684 - RNA, 18 nt, Pseudomonas aeruginosa PA01
cagcgccccaccaggcuc

SEQ ID NO: 3377685 - RNA, 19 nt, Pseudomonas aeruginosa PA01
cagcgccccaccaggcucg

SEQ ID NO: 3377686 - RNA, 15 nt, Pseudomonas aeruginosa PA01
cagcgccccagcacc

SEQ ID NO: 3377687 - RNA, 18 nt, Pseudomonas aeruginosa PA01
cagcgccccagcaccucg

SEQ ID NO: 3377688 - RNA, 22 nt, Pseudomonas aeruginosa PA01
cagcgccccagcaccucgccgu

SEQ ID NO: 3377689 - RNA, 12 nt, Pseudomonas aeruginosa PA01
cagcgccccgcc

SEQ ID NO: 3377690 - RNA, 14 nt, Pseudomonas aeruginosa PA01
cagcgccccuccca

SEQ ID NO: 3377691 - RNA, 19 nt, Pseudomonas aeruginosa PA01
cagcgcccgauaggcgccg

SEQ ID NO: 3377692 - RNA, 22 nt, Pseudomonas aeruginosa PA01
cagcgcccgcaccacccgcugc

SEQ ID NO: 3377693 - RNA, 22 nt, Pseudomonas aeruginosa PA01
cagcgcccggcacgcuccaggg

SEQ ID NO: 3377694 - RNA, 12 nt, Pseudomonas aeruginosa PA01
cagcgcccggcu

SEQ ID NO: 3377695 - RNA, 17 nt, Pseudomonas aeruginosa PA01
cagcgcccggcugugcu

SEQ ID NO: 3377696 - RNA, 19 nt, Pseudomonas aeruginosa PA01
cagcgccgcauuggccagg

SEQ ID NO: 3377697 - RNA, 20 nt, Pseudomonas aeruginosa PA01
cagcgccgcauuggccaggc

SEQ ID NO: 3377698 - RNA, 23 nt, Pseudomonas aeruginosa PA01
cagcgccgccaaccacuccgcca

SEQ ID NO: 3377699 - RNA, 17 nt, Pseudomonas aeruginosa PA01
cagcgccgccaccgcca

SEQ ID NO: 3377700 - RNA, 18 nt, Pseudomonas aeruginosa PA01
cagcgccgccaccgccac

SEQ ID NO: 3377701 - RNA, 14 nt, Pseudomonas aeruginosa PA01
cagcgccgccagca

SEQ ID NO: 3377702 - RNA, 16 nt, Pseudomonas aeruginosa PA01
cagcgccgccagcagg

SEQ ID NO: 3377703 - RNA, 17 nt, Pseudomonas aeruginosa PA01
cagcgccgccagcaggu

SEQ ID NO: 3377704 - RNA, 20 nt, Pseudomonas aeruginosa PA01
cagcgccgccagcaggucgg

SEQ ID NO: 3377705 - RNA, 13 nt, Pseudomonas aeruginosa PA01
cagcgccgccagg

SEQ ID NO: 3377706 - RNA, 14 nt, Pseudomonas aeruginosa PA01
cagcgccgccaggc

SEQ ID NO: 3377707 - RNA, 15 nt, Pseudomonas aeruginosa PA01
cagcgccgccaggca

SEQ ID NO: 3377708 - RNA, 17 nt, Pseudomonas aeruginosa PA01
cagcgccgccaggcccu

SEQ ID NO: 3377709 - RNA, 15 nt, Pseudomonas aeruginosa PA01
cagcgccgccaggcg

SEQ ID NO: 3377710 - RNA, 16 nt, Pseudomonas aeruginosa PA01
cagcgccgccaggcgc

SEQ ID NO: 3377711 - RNA, 17 nt, Pseudomonas aeruginosa PA01
cagcgccgccaggcgcg

SEQ ID NO: 3377712 - RNA, 15 nt, Pseudomonas aeruginosa PA01
cagcgccgccgcguc

SEQ ID NO: 3377713 - RNA, 15 nt, Pseudomonas aeruginosa PA01
cagcgccgccgcugc

SEQ ID NO: 3377714 - RNA, 13 nt, Pseudomonas aeruginosa PA01
cagcgccgccggg

SEQ ID NO: 3377715 - RNA, 14 nt, Pseudomonas aeruginosa PA01
cagcgccgccgggc

SEQ ID NO: 3377716 - RNA, 12 nt, Pseudomonas aeruginosa PA01
cagcgccgccuc

SEQ ID NO: 3377717 - RNA, 23 nt, Pseudomonas aeruginosa PA01
cagcgccgccucgaaggccggca

SEQ ID NO: 3377718 - RNA, 14 nt, Pseudomonas aeruginosa PA01
cagcgccgccucgc

SEQ ID NO: 3377719 - RNA, 17 nt, Pseudomonas aeruginosa PA01
cagcgccgccucgcugg

SEQ ID NO: 3377720 - RNA, 15 nt, Pseudomonas aeruginosa PA01
cagcgccgccugcug

SEQ ID NO: 3377721 - RNA, 17 nt, Pseudomonas aeruginosa PA01
cagcgccgccugcuggc

SEQ ID NO: 3377722 - RNA, 13 nt, Pseudomonas aeruginosa PA01
cagcgccgcgaac

SEQ ID NO: 3377723 - RNA, 22 nt, Pseudomonas aeruginosa PA01
cagcgcgcguagcgugccgcca

SEQ ID NO: 3377724 - RNA, 17 nt, Pseudomonas aeruginosa PA01
cagcgcgcgucggcgaa

SEQ ID NO: 3377725 - RNA, 19 nt, Pseudomonas aeruginosa PA01
cagcgcgcgucggcgaacc

SEQ ID NO: 3377726 - RNA, 15 nt, Pseudomonas aeruginosa PA01
cagcgcgcgucgguc

SEQ ID NO: 3377727 - RNA, 18 nt, Pseudomonas aeruginosa PA01
cagcgcgcucgcugucgc

SEQ ID NO: 3377728 - RNA, 21 nt, Pseudomonas aeruginosa PA01
cagcgcgcucgcugucgcuca

SEQ ID NO: 3377729 - RNA, 19 nt, Pseudomonas aeruginosa PA01
cagcgcgcucggccuggug

SEQ ID NO: 3377730 - RNA, 20 nt, Pseudomonas aeruginosa PA01
cagcgcgcucggccuggugc

SEQ ID NO: 3377731 - RNA, 22 nt, Pseudomonas aeruginosa PA01
cagcgcggagcguccaccagcg

SEQ ID NO: 3377732 - RNA, 17 nt, Pseudomonas aeruginosa PA01
cagcgcggaucagucag

SEQ ID NO: 3377733 - RNA, 18 nt, Pseudomonas aeruginosa PA01
cagcgcggaucagucagg

SEQ ID NO: 3377734 - RNA, 13 nt, Pseudomonas aeruginosa PA01
cagcgcggccgcc

SEQ ID NO: 3377735 - RNA, 17 nt, Pseudomonas aeruginosa PA01
cagcgcggccgccgccg

SEQ ID NO: 3377736 - RNA, 14 nt, Pseudomonas aeruginosa PA01
cagcgcggcgcccc

SEQ ID NO: 3377737 - RNA, 18 nt, Pseudomonas aeruginosa PA01
cagcgcggcgccccaggc

SEQ ID NO: 3377738 - RNA, 20 nt, Pseudomonas aeruginosa PA01
cagcgcggcgccccaggcgc

SEQ ID NO: 3377739 - RNA, 23 nt, Pseudomonas aeruginosa PA01
cagcgcggcgccccaggcgccca

SEQ ID NO: 3377740 - RNA, 14 nt, Pseudomonas aeruginosa PA01
cagcgcggcgcgcu

SEQ ID NO: 3377741 - RNA, 16 nt, Pseudomonas aeruginosa PA01
cagcgcggcgcggaca

SEQ ID NO: 3377742 - RNA, 12 nt, Pseudomonas aeruginosa PA01
cagcgcggcgcu

SEQ ID NO: 3377743 - RNA, 15 nt, Pseudomonas aeruginosa PA01
cagcgcggcgcuggg

SEQ ID NO: 3377744 - RNA, 21 nt, Pseudomonas aeruginosa PA01
cagcgcggcgcuuggcgaaau

SEQ ID NO: 3377745 - RNA, 19 nt, Pseudomonas aeruginosa PA01
cagcgcggcggacaggcag

SEQ ID NO: 3377746 - RNA, 15 nt, Pseudomonas aeruginosa PA01
cagcgcggcggcggc

SEQ ID NO: 3377747 - RNA, 17 nt, Pseudomonas aeruginosa PA01
cagcgcggcggcggcca

SEQ ID NO: 3377748 - RNA, 20 nt, Pseudomonas aeruginosa PA01
cagcgcggcggcggccagca

SEQ ID NO: 3377749 - RNA, 16 nt, Pseudomonas aeruginosa PA01
cagcgcggcucgggcg

SEQ ID NO: 3377750 - RNA, 15 nt, Pseudomonas aeruginosa PA01
cagcgcgggcaccga

SEQ ID NO: 3377751 - RNA, 16 nt, Pseudomonas aeruginosa PA01
cagcgcgggcaccgag

SEQ ID NO: 3377752 - RNA, 13 nt, Pseudomonas aeruginosa PA01
cagcgcgggggcu

SEQ ID NO: 3377753 - RNA, 19 nt, Pseudomonas aeruginosa PA01
cagcgcggucucuucgucg

SEQ ID NO: 3377754 - RNA, 14 nt, Pseudomonas aeruginosa PA01
cagcgcggugagca

SEQ ID NO: 3377755 - RNA, 16 nt, Pseudomonas aeruginosa PA01
cagcgcggugagcagg

SEQ ID NO: 3377756 - RNA, 17 nt, Pseudomonas aeruginosa PA01
cagcgcggugcgcgcca

SEQ ID NO: 3377757 - RNA, 21 nt, Pseudomonas aeruginosa PA01
cagcgcguagcuuuccgcggc

SEQ ID NO: 3377758 - RNA, 22 nt, Pseudomonas aeruginosa PA01
cagcgcguagcuuuccgcggcg

SEQ ID NO: 3377759 - RNA, 15 nt, Pseudomonas aeruginosa PA01
cagcgcgucgaccac

SEQ ID NO: 3377760 - RNA, 20 nt, Pseudomonas aeruginosa PA01
cagcgcgucgaccaccgcgu

SEQ ID NO: 3377761 - RNA, 13 nt, Pseudomonas aeruginosa PA01
cagcgcgucgcgg

SEQ ID NO: 3377762 - RNA, 20 nt, Pseudomonas aeruginosa PA01
cagcgcguucaccccgcccu

SEQ ID NO: 3377763 - RNA, 21 nt, Pseudomonas aeruginosa PA01
cagcgcguucaccccgcccuu

SEQ ID NO: 3377764 - RNA, 17 nt, Pseudomonas aeruginosa PA01
cagcgcuacgcaggccc

SEQ ID NO: 3377765 - RNA, 18 nt, Pseudomonas aeruginosa PA01
cagcgcuagcgcauggcg

SEQ ID NO: 3377766 - RNA, 18 nt, Pseudomonas aeruginosa PA01
cagcgcucacgcaccucg

SEQ ID NO: 3377767 - RNA, 22 nt, Pseudomonas aeruginosa PA01
cagcgcuccuugcgccaggccc

SEQ ID NO: 3377768 - RNA, 22 nt, Pseudomonas aeruginosa PA01
cagcgcucguagccggcgcggc

SEQ ID NO: 3377769 - RNA, 20 nt, Pseudomonas aeruginosa PA01
cagcgcugaucacgaucggc

SEQ ID NO: 3377770 - RNA, 12 nt, Pseudomonas aeruginosa PA01
cagcgcugccuc

SEQ ID NO: 3377771 - RNA, 22 nt, Pseudomonas aeruginosa PA01
cagcgcuggcagguugcacggc

SEQ ID NO: 3377772 - RNA, 15 nt, Pseudomonas aeruginosa PA01
cagcgcuggcgauca

SEQ ID NO: 3377773 - RNA, 18 nt, Pseudomonas aeruginosa PA01
cagcgcuggcgaucacca

SEQ ID NO: 3377774 - RNA, 17 nt, Pseudomonas aeruginosa PA01
cagcgcuuccaccgccu

SEQ ID NO: 3377775 - RNA, 21 nt, Pseudomonas aeruginosa PA01
cagcgcuuccaccgccugccc

SEQ ID NO: 3377776 - RNA, 22 nt, Pseudomonas aeruginosa PA01
cagcgcuuccaccgccugcccc

SEQ ID NO: 3377777 - RNA, 23 nt, Pseudomonas aeruginosa PA01
cagcgcuuccaccgccugcccca

SEQ ID NO: 3377778 - RNA, 15 nt, Pseudomonas aeruginosa PA01
cagcgcuuccucggg

SEQ ID NO: 3377779 - RNA, 22 nt, Pseudomonas aeruginosa PA01
cagcgcuuccuugcccugggcg

SEQ ID NO: 3377780 - RNA, 19 nt, Pseudomonas aeruginosa PA01
cagcgcuucggcuccagca

SEQ ID NO: 3377781 - RNA, 21 nt, Pseudomonas aeruginosa PA01
cagcgcuucggcuccagcacc

SEQ ID NO: 3377782 - RNA, 23 nt, Pseudomonas aeruginosa PA01
cagcgcuucguugcuccugcggc

SEQ ID NO: 3377783 - RNA, 15 nt, Pseudomonas aeruginosa PA01
cagcgcuucucggca

SEQ ID NO: 3377784 - RNA, 20 nt, Pseudomonas aeruginosa PA01
cagcgcuugaacgcgcgccu

SEQ ID NO: 3377785 - RNA, 13 nt, Pseudomonas aeruginosa PA01
cagcgcuugcugg

SEQ ID NO: 3377786 - RNA, 14 nt, Pseudomonas aeruginosa PA01
cagcgcuugcuggc

SEQ ID NO: 3377787 - RNA, 16 nt, Pseudomonas aeruginosa PA01
cagcgcuugcuggcgc

SEQ ID NO: 3377788 - RNA, 17 nt, Pseudomonas aeruginosa PA01
cagcgcuugcuggcgcg

SEQ ID NO: 3377789 - RNA, 19 nt, Pseudomonas aeruginosa PA01
cagcgcuuguagcagccgc

SEQ ID NO: 3377790 - RNA, 20 nt, Pseudomonas aeruginosa PA01
cagcgcuuguagcagccgca

SEQ ID NO: 3377791 - RNA, 22 nt, Pseudomonas aeruginosa PA01
cagcgcuuguagcagccgcagg

SEQ ID NO: 3377792 - RNA, 18 nt, Pseudomonas aeruginosa PA01
cagcgcuuuucaggaugu

SEQ ID NO: 3377793 - RNA, 17 nt, Pseudomonas aeruginosa PA01
cagcggaaaugcucgcc

SEQ ID NO: 3377794 - RNA, 18 nt, Pseudomonas aeruginosa PA01
cagcggaaaugcucgccg

SEQ ID NO: 3377795 - RNA, 21 nt, Pseudomonas aeruginosa PA01
cagcggaacuugcgccgaccg

SEQ ID NO: 3377796 - RNA, 14 nt, Pseudomonas aeruginosa PA01
cagcggaagcccug

SEQ ID NO: 3377797 - RNA, 17 nt, Pseudomonas aeruginosa PA01
cagcggaagcccugcug

SEQ ID NO: 3377798 - RNA, 18 nt, Pseudomonas aeruginosa PA01
cagcggaagcccugcugg

SEQ ID NO: 3377799 - RNA, 16 nt, Pseudomonas aeruginosa PA01
cagcggaaucgcgccc

SEQ ID NO: 3377800 - RNA, 19 nt, Pseudomonas aeruginosa PA01
cagcggacaaccgccguag

SEQ ID NO: 3377801 - RNA, 14 nt, Pseudomonas aeruginosa PA01
cagcggaccgucgg

SEQ ID NO: 3377802 - RNA, 16 nt, Pseudomonas aeruginosa PA01
cagcggacgcagcggg

SEQ ID NO: 3377803 - RNA, 17 nt, Pseudomonas aeruginosa PA01
cagcggaggauucagca

SEQ ID NO: 3377804 - RNA, 18 nt, Pseudomonas aeruginosa PA01
cagcggauaguucuucgg

SEQ ID NO: 3377805 - RNA, 21 nt, Pseudomonas aeruginosa PA01
cagcggauauucgacgcgcgg

SEQ ID NO: 3377806 - RNA, 23 nt, Pseudomonas aeruginosa PA01
cagcggauauucgacgcgcggcu

SEQ ID NO: 3377807 - RNA, 20 nt, Pseudomonas aeruginosa PA01
cagcggcaaaggcccggcgc

SEQ ID NO: 3377808 - RNA, 15 nt, Pseudomonas aeruginosa PA01
cagcggcaccagcac

SEQ ID NO: 3377809 - RNA, 16 nt, Pseudomonas aeruginosa PA01
cagcggcacccggcug

SEQ ID NO: 3377810 - RNA, 20 nt, Pseudomonas aeruginosa PA01
cagcggcaccgagagcugca

SEQ ID NO: 3377811 - RNA, 11 nt, Pseudomonas aeruginosa PA01
cagcggcacgc

SEQ ID NO: 3377812 - RNA, 22 nt, Pseudomonas aeruginosa PA01
cagcggcacgcucuggccguuc

SEQ ID NO: 3377813 - RNA, 20 nt, Pseudomonas aeruginosa PA01
cagcggcacggucauggcca

SEQ ID NO: 3377814 - RNA, 18 nt, Pseudomonas aeruginosa PA01
cagcggcacuucccgccc

SEQ ID NO: 3377815 - RNA, 21 nt, Pseudomonas aeruginosa PA01
cagcggcagaucggugcgggc

SEQ ID NO: 3377816 - RNA, 22 nt, Pseudomonas aeruginosa PA01
cagcggcagccacucggccagg

SEQ ID NO: 3377817 - RNA, 23 nt, Pseudomonas aeruginosa PA01
cagcggcagccccuugcgcucug

SEQ ID NO: 3377818 - RNA, 13 nt, Pseudomonas aeruginosa PA01
cagcggcagcguc

SEQ ID NO: 3377819 - RNA, 14 nt, Pseudomonas aeruginosa PA01
cagcggcagcgucu

SEQ ID NO: 3377820 - RNA, 15 nt, Pseudomonas aeruginosa PA01
cagcggcaggcacgc

SEQ ID NO: 3377821 - RNA, 13 nt, Pseudomonas aeruginosa PA01
cagcggcagggcg

SEQ ID NO: 3377822 - RNA, 14 nt, Pseudomonas aeruginosa PA01
cagcggcagggcgg

SEQ ID NO: 3377823 - RNA, 16 nt, Pseudomonas aeruginosa PA01
cagcggcagggcggcg

SEQ ID NO: 3377824 - RNA, 17 nt, Pseudomonas aeruginosa PA01
cagcggcagggcggcga

SEQ ID NO: 3377825 - RNA, 20 nt, Pseudomonas aeruginosa PA01
cagcgguaugccgcaggcag

SEQ ID NO: 3377826 - RNA, 13 nt, Pseudomonas aeruginosa PA01
cagcgguccgcuc

SEQ ID NO: 3377827 - RNA, 13 nt, Pseudomonas aeruginosa PA01
cagcggucgccgg

SEQ ID NO: 3377828 - RNA, 16 nt, Pseudomonas aeruginosa PA01
cagcggucgccggucg

SEQ ID NO: 3377829 - RNA, 22 nt, Pseudomonas aeruginosa PA01
cagcggugaagguccgcgccau

SEQ ID NO: 3377830 - RNA, 14 nt, Pseudomonas aeruginosa PA01
cagcggugggaaga

SEQ ID NO: 3377831 - RNA, 16 nt, Pseudomonas aeruginosa PA01
cagcggugggaagagc

SEQ ID NO: 3377832 - RNA, 22 nt, Pseudomonas aeruginosa PA01
cagcggugugcucaggcgaacc

SEQ ID NO: 3377833 - RNA, 16 nt, Pseudomonas aeruginosa PA01
cagcgguucgcccgcg

SEQ ID NO: 3377834 - RNA, 16 nt, Pseudomonas aeruginosa PA01
cagcgguucggcacgg

SEQ ID NO: 3377835 - RNA, 16 nt, Pseudomonas aeruginosa PA01
cagcgguugagcaggg

SEQ ID NO: 3377836 - RNA, 13 nt, Pseudomonas aeruginosa PA01
cagcgucaccgcg

SEQ ID NO: 3377837 - RNA, 18 nt, Pseudomonas aeruginosa PA01
cagcgucaccgcgucggg

SEQ ID NO: 3377838 - RNA, 17 nt, Pseudomonas aeruginosa PA01
cagcguccgaacgcgcu

SEQ ID NO: 3377839 - RNA, 14 nt, Pseudomonas aeruginosa PA01
cagcguccucagcc

SEQ ID NO: 3377840 - RNA, 23 nt, Pseudomonas aeruginosa PA01
cagcguccucagccucacccugc

SEQ ID NO: 3377841 - RNA, 14 nt, Pseudomonas aeruginosa PA01
cagcguccugcccu

SEQ ID NO: 3377842 - RNA, 14 nt, Pseudomonas aeruginosa PA01
cagcguccuucggc

SEQ ID NO: 3377843 - RNA, 17 nt, Pseudomonas aeruginosa PA01
cagcguccuucggcgcu

SEQ ID NO: 3377844 - RNA, 17 nt, Pseudomonas aeruginosa PA01
cagcgucgagcuggcgc

SEQ ID NO: 3377845 - RNA, 20 nt, Pseudomonas aeruginosa PA01
cagcgucgccaacgcgccgu

SEQ ID NO: 3377846 - RNA, 13 nt, Pseudomonas aeruginosa PA01
cagcgucgccagg

SEQ ID NO: 3377847 - RNA, 20 nt, Pseudomonas aeruginosa PA01
cagcgucgccgccgcgggcg

SEQ ID NO: 3377848 - RNA, 12 nt, Pseudomonas aeruginosa PA01
cagcgucgccgg

SEQ ID NO: 3377849 - RNA, 13 nt, Pseudomonas aeruginosa PA01
cagcgucgccggg

SEQ ID NO: 3377850 - RNA, 14 nt, Pseudomonas aeruginosa PA01
cagcgucgccgggc

SEQ ID NO: 3377851 - RNA, 16 nt, Pseudomonas aeruginosa PA01
cagcgucgccgggcgu

SEQ ID NO: 3377852 - RNA, 17 nt, Pseudomonas aeruginosa PA01
cagcgucgccugccagg

SEQ ID NO: 3377853 - RNA, 18 nt, Pseudomonas aeruginosa PA01
cagcgucgccugccaggc

SEQ ID NO: 3377854 - RNA, 19 nt, Pseudomonas aeruginosa PA01
cagcgucgccugccaggcg

SEQ ID NO: 3377855 - RNA, 13 nt, Pseudomonas aeruginosa PA01
cagcgucgcgcgu

SEQ ID NO: 3377856 - RNA, 16 nt, Pseudomonas aeruginosa PA01
cagcgucgcgcgucca

SEQ ID NO: 3377857 - RNA, 19 nt, Pseudomonas aeruginosa PA01
cagcgucgcgcguccagcc

SEQ ID NO: 3377858 - RNA, 21 nt, Pseudomonas aeruginosa PA01
cagcgucgcgcguccagccgg

SEQ ID NO: 3377859 - RNA, 17 nt, Pseudomonas aeruginosa PA01
cagcgucgcgucggccu

SEQ ID NO: 3377860 - RNA, 20 nt, Pseudomonas aeruginosa PA01
cagcgucgcgucggccuggc

SEQ ID NO: 3377861 - RNA, 21 nt, Pseudomonas aeruginosa PA01
cagcgucgcgucggccuggcg

SEQ ID NO: 3377862 - RNA, 22 nt, Pseudomonas aeruginosa PA01
cagcgucgcgucggccuggcgc

SEQ ID NO: 3377863 - RNA, 22 nt, Pseudomonas aeruginosa PA01
cagcgucggaaaacccuguucc

SEQ ID NO: 3377864 - RNA, 21 nt, Pseudomonas aeruginosa PA01
cagcgucguaguggcgcaaca

SEQ ID NO: 3377865 - RNA, 20 nt, Pseudomonas aeruginosa PA01
cagcgucucagcccucggcc

SEQ ID NO: 3377866 - RNA, 20 nt, Pseudomonas aeruginosa PA01
cagcgucucggcugccgcca

SEQ ID NO: 3377867 - RNA, 21 nt, Pseudomonas aeruginosa PA01
cagcgucucggcugccgccag

SEQ ID NO: 3377868 - RNA, 22 nt, Pseudomonas aeruginosa PA01
cagcgucucggcugccgccagc

SEQ ID NO: 3377869 - RNA, 16 nt, Pseudomonas aeruginosa PA01
cagcgucugcagcuug

SEQ ID NO: 3377870 - RNA, 16 nt, Pseudomonas aeruginosa PA01
cagcgucugccgcugg

SEQ ID NO: 3377871 - RNA, 19 nt, Pseudomonas aeruginosa PA01
cagcgucugggugaccagc

SEQ ID NO: 3377872 - RNA, 22 nt, Pseudomonas aeruginosa PA01
cagcgucugggugaccagcagg

SEQ ID NO: 3377873 - RNA, 15 nt, Pseudomonas aeruginosa PA01
cagcgugcaccagca

SEQ ID NO: 3377874 - RNA, 16 nt, Pseudomonas aeruginosa PA01
cagcgugcagaccagg

SEQ ID NO: 3377875 - RNA, 23 nt, Pseudomonas aeruginosa PA01
cagcgugcccgcugcaugugcca

SEQ ID NO: 3377876 - RNA, 14 nt, Pseudomonas aeruginosa PA01
cagcguggccagcg

SEQ ID NO: 3377877 - RNA, 16 nt, Pseudomonas aeruginosa PA01
cagcguggccagcgcc

SEQ ID NO: 3377878 - RNA, 19 nt, Pseudomonas aeruginosa PA01
cagcguggccagcgcccag

SEQ ID NO: 3377879 - RNA, 21 nt, Pseudomonas aeruginosa PA01
cagcguggccagcgcccaggc

SEQ ID NO: 3377880 - RNA, 23 nt, Pseudomonas aeruginosa PA01
cagcguggcggacaacccggcgc

SEQ ID NO: 3377881 - RNA, 21 nt, Pseudomonas aeruginosa PA01
cagcgugggcaacaggccgau

SEQ ID NO: 3377882 - RNA, 16 nt, Pseudomonas aeruginosa PA01
cagcguucacgcgacc

SEQ ID NO: 3377883 - RNA, 15 nt, Pseudomonas aeruginosa PA01
cagcguuccagcgcu

SEQ ID NO: 3377884 - RNA, 16 nt, Pseudomonas aeruginosa PA01
cagcguuccagcgcug

SEQ ID NO: 3377885 - RNA, 19 nt, Pseudomonas aeruginosa PA01
cagcguucggcgcuggcgc

SEQ ID NO: 3377886 - RNA, 21 nt, Pseudomonas aeruginosa PA01
cagcguucggcgcuggcgcgg

SEQ ID NO: 3377887 - RNA, 20 nt, Pseudomonas aeruginosa PA01
cagcguuguccucggcggcu

SEQ ID NO: 3377888 - RNA, 23 nt, Pseudomonas aeruginosa PA01
cagcguuucgaagccgccgccga

SEQ ID NO: 3377889 - RNA, 13 nt, Pseudomonas aeruginosa PA01
cagcuaccggcag

SEQ ID NO: 3377890 - RNA, 15 nt, Pseudomonas aeruginosa PA01
cagcucaccccagga

SEQ ID NO: 3377891 - RNA, 13 nt, Pseudomonas aeruginosa PA01
cagcucagcaggu

SEQ ID NO: 3377892 - RNA, 16 nt, Pseudomonas aeruginosa PA01
cagcucagcaggucgc

SEQ ID NO: 3377893 - RNA, 16 nt, Pseudomonas aeruginosa PA01
cagcucagcuccaggc

SEQ ID NO: 3377894 - RNA, 20 nt, Pseudomonas aeruginosa PA01
cagcucauaggucagguaca

SEQ ID NO: 3377895 - RNA, 20 nt, Pseudomonas aeruginosa PA01
cagcucauucguaaugagaa

SEQ ID NO: 3377896 - RNA, 13 nt, Pseudomonas aeruginosa PA01
cagcuccaccagg

SEQ ID NO: 3377897 - RNA, 15 nt, Pseudomonas aeruginosa PA01
cagcuccaccaggcc

SEQ ID NO: 3377898 - RNA, 15 nt, Pseudomonas aeruginosa PA01
cagcuccaccgaugg

SEQ ID NO: 3377899 - RNA, 16 nt, Pseudomonas aeruginosa PA01
cagcuccagcaccggc

SEQ ID NO: 3377900 - RNA, 23 nt, Pseudomonas aeruginosa PA01
cagcuccagcaccggcggcgcca

SEQ ID NO: 3377901 - RNA, 13 nt, Pseudomonas aeruginosa PA01
cagcuccagcagu

SEQ ID NO: 3377902 - RNA, 21 nt, Pseudomonas aeruginosa PA01
cagcuccagcagucgcacagc

SEQ ID NO: 3377903 - RNA, 22 nt, Pseudomonas aeruginosa PA01
cagcuccagcagucgcacagcc

SEQ ID NO: 3377904 - RNA, 13 nt, Pseudomonas aeruginosa PA01
cagcuccagcgcc

SEQ ID NO: 3377905 - RNA, 16 nt, Pseudomonas aeruginosa PA01
cagcuccagcggaauc

SEQ ID NO: 3377906 - RNA, 14 nt, Pseudomonas aeruginosa PA01
cagcuccaggccgc

SEQ ID NO: 3377907 - RNA, 20 nt, Pseudomonas aeruginosa PA01
cagcuccaggccgcgggucu

SEQ ID NO: 3377908 - RNA, 13 nt, Pseudomonas aeruginosa PA01
cagcucccaggcg

SEQ ID NO: 3377909 - RNA, 17 nt, Pseudomonas aeruginosa PA01
cagcucccaggcgucgc

SEQ ID NO: 3377910 - RNA, 16 nt, Pseudomonas aeruginosa PA01
cagcuccgaagggaac

SEQ ID NO: 3377911 - RNA, 13 nt, Pseudomonas aeruginosa PA01
cagcuccgagcca

SEQ ID NO: 3377912 - RNA, 16 nt, Pseudomonas aeruginosa PA01
cagcuccgccugaccg

SEQ ID NO: 3377913 - RNA, 14 nt, Pseudomonas aeruginosa PA01
cagcuccggcagca

SEQ ID NO: 3377914 - RNA, 19 nt, Pseudomonas aeruginosa PA01
cagcuccgggcuggccacc

SEQ ID NO: 3377915 - RNA, 23 nt, Pseudomonas aeruginosa PA01
cagcuccgggcuggccaccagca

SEQ ID NO: 3377916 - RNA, 16 nt, Pseudomonas aeruginosa PA01
cagcuccuccagccgc

SEQ ID NO: 3377917 - RNA, 23 nt, Pseudomonas aeruginosa PA01
cagcuccucggcguggcuacgga

SEQ ID NO: 3377918 - RNA, 19 nt, Pseudomonas aeruginosa PA01
cagcuccuggucgcggggc

SEQ ID NO: 3377919 - RNA, 20 nt, Pseudomonas aeruginosa PA01
cagcuccuugcgcuccuugg

SEQ ID NO: 3377920 - RNA, 16 nt, Pseudomonas aeruginosa PA01
cagcuccuugcucucg

SEQ ID NO: 3377921 - RNA, 16 nt, Pseudomonas aeruginosa PA01
cagcucgaaauccggu

SEQ ID NO: 3377922 - RNA, 17 nt, Pseudomonas aeruginosa PA01
cagcucgaacagcaccg

SEQ ID NO: 3377923 - RNA, 20 nt, Pseudomonas aeruginosa PA01
cagcucgaacagcaccgagc

SEQ ID NO: 3377924 - RNA, 16 nt, Pseudomonas aeruginosa PA01
cagcucgaagccgccg

SEQ ID NO: 3377925 - RNA, 17 nt, Pseudomonas aeruginosa PA01
cagcucgaagccgccgu

SEQ ID NO: 3377926 - RNA, 16 nt, Pseudomonas aeruginosa PA01
cagcucgacagcgucg

SEQ ID NO: 3377927 - RNA, 17 nt, Pseudomonas aeruginosa PA01
cagcuucgccgcccugg

SEQ ID NO: 3377928 - RNA, 13 nt, Pseudomonas aeruginosa PA01
cagcuucggcgcg

SEQ ID NO: 3377929 - RNA, 15 nt, Pseudomonas aeruginosa PA01
cagcuucggcgcgac

SEQ ID NO: 3377930 - RNA, 18 nt, Pseudomonas aeruginosa PA01
cagcuucggcgcgacgcu

SEQ ID NO: 3377931 - RNA, 20 nt, Pseudomonas aeruginosa PA01
cagcuucucuuucaccuggu

SEQ ID NO: 3377932 - RNA, 14 nt, Pseudomonas aeruginosa PA01
cagcuucugcaggg

SEQ ID NO: 3377933 - RNA, 22 nt, Pseudomonas aeruginosa PA01
cagcuucugcagggcggcuucc

SEQ ID NO: 3377934 - RNA, 20 nt, Pseudomonas aeruginosa PA01
cagcuucuucagcagcgggc

SEQ ID NO: 3377935 - RNA, 16 nt, Pseudomonas aeruginosa PA01
cagcuucuucugcagc

SEQ ID NO: 3377936 - RNA, 13 nt, Pseudomonas aeruginosa PA01
cagcuucuugccu

SEQ ID NO: 3377937 - RNA, 18 nt, Pseudomonas aeruginosa PA01
cagcuucuugccuuccac

SEQ ID NO: 3377938 - RNA, 22 nt, Pseudomonas aeruginosa PA01
cagcuugacccguugcgccucg

SEQ ID NO: 3377939 - RNA, 14 nt, Pseudomonas aeruginosa PA01
cagcuugacgaucu

SEQ ID NO: 3377940 - RNA, 23 nt, Pseudomonas aeruginosa PA01
cagcuugacgaucuucugcaccc

SEQ ID NO: 3377941 - RNA, 20 nt, Pseudomonas aeruginosa PA01
cagcuugauguaggacaggc

SEQ ID NO: 3377942 - RNA, 18 nt, Pseudomonas aeruginosa PA01
cagcuugccggcauagcc

SEQ ID NO: 3377943 - RNA, 20 nt, Pseudomonas aeruginosa PA01
cagcuugccguuggcgucgc

SEQ ID NO: 3377944 - RNA, 14 nt, Pseudomonas aeruginosa PA01
cagcuugccuucca

SEQ ID NO: 3377945 - RNA, 17 nt, Pseudomonas aeruginosa PA01
cagcuugccuuccaggc

SEQ ID NO: 3377946 - RNA, 21 nt, Pseudomonas aeruginosa PA01
cagcuugccuuccaggcugua

SEQ ID NO: 3377947 - RNA, 16 nt, Pseudomonas aeruginosa PA01
cagcuugcgccagagc

SEQ ID NO: 3377948 - RNA, 16 nt, Pseudomonas aeruginosa PA01
cagcuugcgcgccagg

SEQ ID NO: 3377949 - RNA, 17 nt, Pseudomonas aeruginosa PA01
cagcuugcuggcguaga

SEQ ID NO: 3377950 - RNA, 15 nt, Pseudomonas aeruginosa PA01
cagcuuggcacggcc

SEQ ID NO: 3377951 - RNA, 16 nt, Pseudomonas aeruginosa PA01
cagcuuggccagcagg

SEQ ID NO: 3377952 - RNA, 22 nt, Pseudomonas aeruginosa PA01
cagcuuggcgacguccugcggg

SEQ ID NO: 3377953 - RNA, 18 nt, Pseudomonas aeruginosa PA01
cagcuuggcggucagcga

SEQ ID NO: 3377954 - RNA, 19 nt, Pseudomonas aeruginosa PA01
cagcuuggcggucagcgac

SEQ ID NO: 3377955 - RNA, 22 nt, Pseudomonas aeruginosa PA01
cagcuugggauggccagccagg

SEQ ID NO: 3377956 - RNA, 23 nt, Pseudomonas aeruginosa PA01
cagcuugggauggccagccagga

SEQ ID NO: 3377957 - RNA, 18 nt, Pseudomonas aeruginosa PA01
cagcuugguauccaccuc

SEQ ID NO: 3377958 - RNA, 14 nt, Pseudomonas aeruginosa PA01
cagcuuggucggga

SEQ ID NO: 3377959 - RNA, 22 nt, Pseudomonas aeruginosa PA01
cagcuuguaguagcgcccgacg

SEQ ID NO: 3377960 - RNA, 13 nt, Pseudomonas aeruginosa PA01
cagcuuguccacg

SEQ ID NO: 3377961 - RNA, 23 nt, Pseudomonas aeruginosa PA01
cagcuugucgccuuccucggcga

SEQ ID NO: 3377962 - RNA, 21 nt, Pseudomonas aeruginosa PA01
cagcuugugggcaugcucggc

SEQ ID NO: 3377963 - RNA, 17 nt, Pseudomonas aeruginosa PA01
caggaaaaaacgccggu

SEQ ID NO: 3377964 - RNA, 16 nt, Pseudomonas aeruginosa PA01
caggaaaacgcucagg

SEQ ID NO: 3377965 - RNA, 17 nt, Pseudomonas aeruginosa PA01
caggaaaccccucggcu

SEQ ID NO: 3377966 - RNA, 18 nt, Pseudomonas aeruginosa PA01
caggaaauccgccgcgca

SEQ ID NO: 3377967 - RNA, 17 nt, Pseudomonas aeruginosa PA01
caggaaaucgagcgcca

SEQ ID NO: 3377968 - RNA, 13 nt, Pseudomonas aeruginosa PA01
caggaaaucgccg

SEQ ID NO: 3377969 - RNA, 22 nt, Pseudomonas aeruginosa PA01
caggaaaucgccguugccuucg

SEQ ID NO: 3377970 - RNA, 14 nt, Pseudomonas aeruginosa PA01
caggaacacccggu

SEQ ID NO: 3377971 - RNA, 12 nt, Pseudomonas aeruginosa PA01
caggaaccagac

SEQ ID NO: 3377972 - RNA, 17 nt, Pseudomonas aeruginosa PA01
caggaaccaggggucga

SEQ ID NO: 3377973 - RNA, 22 nt, Pseudomonas aeruginosa PA01
caggaaccaggggucgacgcag

SEQ ID NO: 3377974 - RNA, 13 nt, Pseudomonas aeruginosa PA01
caggaacgcccgc

SEQ ID NO: 3377975 - RNA, 15 nt, Pseudomonas aeruginosa PA01
caggaacgcccuugu

SEQ ID NO: 3377976 - RNA, 21 nt, Pseudomonas aeruginosa PA01
caggaacgcccuuguagaucg

SEQ ID NO: 3377977 - RNA, 12 nt, Pseudomonas aeruginosa PA01
caggaacgcgcc

SEQ ID NO: 3377978 - RNA, 16 nt, Pseudomonas aeruginosa PA01
caggaacucgaucagc

SEQ ID NO: 3377979 - RNA, 16 nt, Pseudomonas aeruginosa PA01
caggaagaagccucgc

SEQ ID NO: 3377980 - RNA, 19 nt, Pseudomonas aeruginosa PA01
caggaagaaggcguccagg

SEQ ID NO: 3377981 - RNA, 14 nt, Pseudomonas aeruginosa PA01
caggaagccgacca

SEQ ID NO: 3377982 - RNA, 22 nt, Pseudomonas aeruginosa PA01
caggaagccgaccacucgcgag

SEQ ID NO: 3377983 - RNA, 16 nt, Pseudomonas aeruginosa PA01
caggaagccgcgcccc

SEQ ID NO: 3377984 - RNA, 17 nt, Pseudomonas aeruginosa PA01
caggaagccgcgcccca

SEQ ID NO: 3377985 - RNA, 23 nt, Pseudomonas aeruginosa PA01
caggaagccgcgccccagcggca

SEQ ID NO: 3377986 - RNA, 13 nt, Pseudomonas aeruginosa PA01
caggaagcgccgg

SEQ ID NO: 3377987 - RNA, 16 nt, Pseudomonas aeruginosa PA01
caggaagcgccgggcc

SEQ ID NO: 3377988 - RNA, 14 nt, Pseudomonas aeruginosa PA01
caggaagcgcggga

SEQ ID NO: 3377989 - RNA, 23 nt, Pseudomonas aeruginosa PA01
caggaagcgcgggaauucuuccg

SEQ ID NO: 3377990 - RNA, 20 nt, Pseudomonas aeruginosa PA01
caggaagcgucgugcgccgg

SEQ ID NO: 3377991 - RNA, 22 nt, Pseudomonas aeruginosa PA01
caggaagcgucgugcgccggcc

SEQ ID NO: 3377992 - RNA, 23 nt, Pseudomonas aeruginosa PA01
caggaagcgucgugcgccggccu

SEQ ID NO: 3377993 - RNA, 18 nt, Pseudomonas aeruginosa PA01
caggaagcugacgaacau

SEQ ID NO: 3377994 - RNA, 21 nt, Pseudomonas aeruginosa PA01
caggaagcugacgaacaucgc

SEQ ID NO: 3377995 - RNA, 17 nt, Pseudomonas aeruginosa PA01
caggaagcugcgcucgg

SEQ ID NO: 3377996 - RNA, 23 nt, Pseudomonas aeruginosa PA01
caggaaggccgcuucgccgcccu

SEQ ID NO: 3377997 - RNA, 15 nt, Pseudomonas aeruginosa PA01
caggaaggccgggcc

SEQ ID NO: 3377998 - RNA, 17 nt, Pseudomonas aeruginosa PA01
caggaaggccuggaaca

SEQ ID NO: 3377999 - RNA, 18 nt, Pseudomonas aeruginosa PA01
caggaaggccuggaacac

SEQ ID NO: 3378000 - RNA, 20 nt, Pseudomonas aeruginosa PA01
caggaaggcgaagccguugu

SEQ ID NO: 3378001 - RNA, 16 nt, Pseudomonas aeruginosa PA01
caggaaggcgucgccg

SEQ ID NO: 3378002 - RNA, 20 nt, Pseudomonas aeruginosa PA01
caggaaggucucgccgccgg

SEQ ID NO: 3378003 - RNA, 14 nt, Pseudomonas aeruginosa PA01
caggaaguggcgga

SEQ ID NO: 3378004 - RNA, 17 nt, Pseudomonas aeruginosa PA01
caggaaguggcggaugc

SEQ ID NO: 3378005 - RNA, 22 nt, Pseudomonas aeruginosa PA01
caggaaguugauggucaggcug

SEQ ID NO: 3378006 - RNA, 15 nt, Pseudomonas aeruginosa PA01
caggaauccuccgcc

SEQ ID NO: 3378007 - RNA, 19 nt, Pseudomonas aeruginosa PA01
caggaaucgacccagccgc

SEQ ID NO: 3378008 - RNA, 14 nt, Pseudomonas aeruginosa PA01
caggaauuccuggc

SEQ ID NO: 3378009 - RNA, 16 nt, Pseudomonas aeruginosa PA01
caggacaacgacagcc

SEQ ID NO: 3378010 - RNA, 19 nt, Pseudomonas aeruginosa PA01
caggacaacgacagccccg

SEQ ID NO: 3378011 - RNA, 23 nt, Pseudomonas aeruginosa PA01
caggacaacgacagccccggccc

SEQ ID NO: 3378012 - RNA, 13 nt, Pseudomonas aeruginosa PA01
caggacagcacgc

SEQ ID NO: 3378013 - RNA, 17 nt, Pseudomonas aeruginosa PA01
caggacagcacgcucag

SEQ ID NO: 3378014 - RNA, 13 nt, Pseudomonas aeruginosa PA01
caggaccagcgcc

SEQ ID NO: 3378015 - RNA, 15 nt, Pseudomonas aeruginosa PA01
caggaccagcgccug

SEQ ID NO: 3378016 - RNA, 22 nt, Pseudomonas aeruginosa PA01
caggaccaggaucgaccccgcc

SEQ ID NO: 3378017 - RNA, 14 nt, Pseudomonas aeruginosa PA01
caggaccaucggca

SEQ ID NO: 3378018 - RNA, 15 nt, Pseudomonas aeruginosa PA01
caggaccaucggcac

SEQ ID NO: 3378019 - RNA, 16 nt, Pseudomonas aeruginosa PA01
caggaccaucggcacc

SEQ ID NO: 3378020 - RNA, 18 nt, Pseudomonas aeruginosa PA01
caggaccaugucgcacug

SEQ ID NO: 3378021 - RNA, 17 nt, Pseudomonas aeruginosa PA01
caggacccuuccagcgu

SEQ ID NO: 3378022 - RNA, 21 nt, Pseudomonas aeruginosa PA01
caggacccuuccagcgugugg

SEQ ID NO: 3378023 - RNA, 14 nt, Pseudomonas aeruginosa PA01
caggaccgccaugg

SEQ ID NO: 3378024 - RNA, 19 nt, Pseudomonas aeruginosa PA01
caggaccgccauggcgcug

SEQ ID NO: 3378025 - RNA, 20 nt, Pseudomonas aeruginosa PA01
caggaccgccauggcgcuga

SEQ ID NO: 3378026 - RNA, 13 nt, Pseudomonas aeruginosa PA01
caggaccgcgaug

SEQ ID NO: 3378027 - RNA, 14 nt, Pseudomonas aeruginosa PA01
caggaccggcaggu

SEQ ID NO: 3378028 - RNA, 16 nt, Pseudomonas aeruginosa PA01
caggaccggcaggucg

SEQ ID NO: 3378029 - RNA, 23 nt, Pseudomonas aeruginosa PA01
caggauguugacgauggcccaga

SEQ ID NO: 3378030 - RNA, 21 nt, Pseudomonas aeruginosa PA01
caggauuucuccugcggucgg

SEQ ID NO: 3378031 - RNA, 20 nt, Pseudomonas aeruginosa PA01
caggcaaaaagaaaccccgc

SEQ ID NO: 3378032 - RNA, 16 nt, Pseudomonas aeruginosa PA01
caggcaaagaccgacc

SEQ ID NO: 3378033 - RNA, 20 nt, Pseudomonas aeruginosa PA01
caggcaaagaccgaccagua

SEQ ID NO: 3378034 - RNA, 17 nt, Pseudomonas aeruginosa PA01
caggcaaucucccccuc

SEQ ID NO: 3378035 - RNA, 19 nt, Pseudomonas aeruginosa PA01
caggcaaucucccccucuu

SEQ ID NO: 3378036 - RNA, 15 nt, Pseudomonas aeruginosa PA01
caggcaauggccggc

SEQ ID NO: 3378037 - RNA, 16 nt, Pseudomonas aeruginosa PA01
caggcaauggccggcg

SEQ ID NO: 3378038 - RNA, 17 nt, Pseudomonas aeruginosa PA01
caggcaauggccggcgg

SEQ ID NO: 3378039 - RNA, 22 nt, Pseudomonas aeruginosa PA01
caggcacagggcgacuaccagg

SEQ ID NO: 3378040 - RNA, 13 nt, Pseudomonas aeruginosa PA01
caggcaccaccuc

SEQ ID NO: 3378041 - RNA, 15 nt, Pseudomonas aeruginosa PA01
caggcaccaccucgc

SEQ ID NO: 3378042 - RNA, 22 nt, Pseudomonas aeruginosa PA01
caggcaccgaagcugaggccgg

SEQ ID NO: 3378043 - RNA, 19 nt, Pseudomonas aeruginosa PA01
caggcacgaauuuccuggc

SEQ ID NO: 3378044 - RNA, 20 nt, Pseudomonas aeruginosa PA01
caggcacgcugccagcaggc

SEQ ID NO: 3378045 - RNA, 21 nt, Pseudomonas aeruginosa PA01
caggcacgcugccagcaggcc

SEQ ID NO: 3378046 - RNA, 15 nt, Pseudomonas aeruginosa PA01
caggcacggaagcgc

SEQ ID NO: 3378047 - RNA, 22 nt, Pseudomonas aeruginosa PA01
caggcacggaagcgcugcucga

SEQ ID NO: 3378048 - RNA, 17 nt, Pseudomonas aeruginosa PA01
caggcacggcuucagcg

SEQ ID NO: 3378049 - RNA, 22 nt, Pseudomonas aeruginosa PA01
caggcacggcuucagcgccagg

SEQ ID NO: 3378050 - RNA, 23 nt, Pseudomonas aeruginosa PA01
caggcacggcuucagcgccaggc

SEQ ID NO: 3378051 - RNA, 16 nt, Pseudomonas aeruginosa PA01
caggcagaccagcgca

SEQ ID NO: 3378052 - RNA, 18 nt, Pseudomonas aeruginosa PA01
caggcagaccaggccgag

SEQ ID NO: 3378053 - RNA, 15 nt, Pseudomonas aeruginosa PA01
caggcagaccugcag

SEQ ID NO: 3378054 - RNA, 16 nt, Pseudomonas aeruginosa PA01
caggcagcagagcgcc

SEQ ID NO: 3378055 - RNA, 13 nt, Pseudomonas aeruginosa PA01
caggcagcgaucg

SEQ ID NO: 3378056 - RNA, 11 nt, Pseudomonas aeruginosa PA01
caggcagcgcc

SEQ ID NO: 3378057 - RNA, 12 nt, Pseudomonas aeruginosa PA01
caggcagcgccg

SEQ ID NO: 3378058 - RNA, 14 nt, Pseudomonas aeruginosa PA01
caggcagcgccgcc

SEQ ID NO: 3378059 - RNA, 15 nt, Pseudomonas aeruginosa PA01
caggcagcgccgccc

SEQ ID NO: 3378060 - RNA, 16 nt, Pseudomonas aeruginosa PA01
caggcagcgccgccca

SEQ ID NO: 3378061 - RNA, 17 nt, Pseudomonas aeruginosa PA01
caggcagcgccgcccac

SEQ ID NO: 3378062 - RNA, 12 nt, Pseudomonas aeruginosa PA01
caggcagcgcgc

SEQ ID NO: 3378063 - RNA, 16 nt, Pseudomonas aeruginosa PA01
caggcagcgcgcgucg

SEQ ID NO: 3378064 - RNA, 14 nt, Pseudomonas aeruginosa PA01
caggcaggccuggg

SEQ ID NO: 3378065 - RNA, 16 nt, Pseudomonas aeruginosa PA01
caggcaggccugggca

SEQ ID NO: 3378066 - RNA, 17 nt, Pseudomonas aeruginosa PA01
caggcaggcgaugaccg

SEQ ID NO: 3378067 - RNA, 18 nt, Pseudomonas aeruginosa PA01
caggcaggcgaugaccgc

SEQ ID NO: 3378068 - RNA, 15 nt, Pseudomonas aeruginosa PA01
caggcaggcgcgggu

SEQ ID NO: 3378069 - RNA, 14 nt, Pseudomonas aeruginosa PA01
caggcaggcgguca

SEQ ID NO: 3378070 - RNA, 18 nt, Pseudomonas aeruginosa PA01
caggcaggcggucagcgc

SEQ ID NO: 3378071 - RNA, 13 nt, Pseudomonas aeruginosa PA01
caggcagucccag

SEQ ID NO: 3378072 - RNA, 22 nt, Pseudomonas aeruginosa PA01
caggcagucccagaaggccagg

SEQ ID NO: 3378073 - RNA, 23 nt, Pseudomonas aeruginosa PA01
caggcagucccagaaggccaggg

SEQ ID NO: 3378074 - RNA, 22 nt, Pseudomonas aeruginosa PA01
caggcaguccuugagcgccagc

SEQ ID NO: 3378075 - RNA, 23 nt, Pseudomonas aeruginosa PA01
caggcaguccuugagcgccagca

SEQ ID NO: 3378076 - RNA, 13 nt, Pseudomonas aeruginosa PA01
caggcagugccgg

SEQ ID NO: 3378077 - RNA, 14 nt, Pseudomonas aeruginosa PA01
caggcagugccggg

SEQ ID NO: 3378078 - RNA, 16 nt, Pseudomonas aeruginosa PA01
caggcagugccgggcg

SEQ ID NO: 3378079 - RNA, 17 nt, Pseudomonas aeruginosa PA01
caggcagugccgggcgu

SEQ ID NO: 3378080 - RNA, 15 nt, Pseudomonas aeruginosa PA01
caggcaguggcgcca

SEQ ID NO: 3378081 - RNA, 18 nt, Pseudomonas aeruginosa PA01
caggcaguggcgccagcc

SEQ ID NO: 3378082 - RNA, 18 nt, Pseudomonas aeruginosa PA01
caggcauccagcaccgcu

SEQ ID NO: 3378083 - RNA, 22 nt, Pseudomonas aeruginosa PA01
caggcaugaacgaaaacgccgc

SEQ ID NO: 3378084 - RNA, 16 nt, Pseudomonas aeruginosa PA01
caggcaugcggccccg

SEQ ID NO: 3378085 - RNA, 17 nt, Pseudomonas aeruginosa PA01
caggcaugcggccccgg

SEQ ID NO: 3378086 - RNA, 18 nt, Pseudomonas aeruginosa PA01
caggcaugcggccccggc

SEQ ID NO: 3378087 - RNA, 18 nt, Pseudomonas aeruginosa PA01
caggcauuccgggcacgg

SEQ ID NO: 3378088 - RNA, 16 nt, Pseudomonas aeruginosa PA01
caggcauuccuccagg

SEQ ID NO: 3378089 - RNA, 18 nt, Pseudomonas aeruginosa PA01
caggcauugccguccguc

SEQ ID NO: 3378090 - RNA, 22 nt, Pseudomonas aeruginosa PA01
caggcauugccguccgucggca

SEQ ID NO: 3378091 - RNA, 15 nt, Pseudomonas aeruginosa PA01
caggccaaccacccc

SEQ ID NO: 3378092 - RNA, 15 nt, Pseudomonas aeruginosa PA01
caggccaagcaugaa

SEQ ID NO: 3378093 - RNA, 21 nt, Pseudomonas aeruginosa PA01
caggccaagcaugaagugcca

SEQ ID NO: 3378094 - RNA, 24 nt, Pseudomonas aeruginosa PA01
caggccaagcuguugcuccaacca

SEQ ID NO: 3378095 - RNA, 15 nt, Pseudomonas aeruginosa PA01
caggccaagcuuguu

SEQ ID NO: 3378096 - RNA, 15 nt, Pseudomonas aeruginosa PA01
caggccacccgccuc

SEQ ID NO: 3378097 - RNA, 19 nt, Pseudomonas aeruginosa PA01
caggccaccgcgcagcugg

SEQ ID NO: 3378098 - RNA, 18 nt, Pseudomonas aeruginosa PA01
caggccaccgguggacug

SEQ ID NO: 3378099 - RNA, 17 nt, Pseudomonas aeruginosa PA01
caggccacgcaccagcu

SEQ ID NO: 3378100 - RNA, 22 nt, Pseudomonas aeruginosa PA01
caggccacgcccaugccuugca

SEQ ID NO: 3378101 - RNA, 13 nt, Pseudomonas aeruginosa PA01
caggccacggccg

SEQ ID NO: 3378102 - RNA, 14 nt, Pseudomonas aeruginosa PA01
caggccacggccgc

SEQ ID NO: 3378103 - RNA, 15 nt, Pseudomonas aeruginosa PA01
caggccacggccgcu

SEQ ID NO: 3378104 - RNA, 15 nt, Pseudomonas aeruginosa PA01
caggccacggccggc

SEQ ID NO: 3378105 - RNA, 16 nt, Pseudomonas aeruginosa PA01
caggccacggccggcg

SEQ ID NO: 3378106 - RNA, 17 nt, Pseudomonas aeruginosa PA01
caggccacggccggcga

SEQ ID NO: 3378107 - RNA, 20 nt, Pseudomonas aeruginosa PA01
caggccacggccggcgaggc

SEQ ID NO: 3378108 - RNA, 22 nt, Pseudomonas aeruginosa PA01
caggccacggccggcgaggcgu

SEQ ID NO: 3378109 - RNA, 15 nt, Pseudomonas aeruginosa PA01
caggccacggcggaa

SEQ ID NO: 3378110 - RNA, 23 nt, Pseudomonas aeruginosa PA01
caggccagcagguagccugcggc

SEQ ID NO: 3378111 - RNA, 14 nt, Pseudomonas aeruginosa PA01
caggccagcgccag

SEQ ID NO: 3378112 - RNA, 16 nt, Pseudomonas aeruginosa PA01
caggccagcgccaggg

SEQ ID NO: 3378113 - RNA, 17 nt, Pseudomonas aeruginosa PA01
caggccagcgccagggg

SEQ ID NO: 3378114 - RNA, 16 nt, Pseudomonas aeruginosa PA01
caggccagcgccaggu

SEQ ID NO: 3378115 - RNA, 13 nt, Pseudomonas aeruginosa PA01
caggccagcgggc

SEQ ID NO: 3378116 - RNA, 17 nt, Pseudomonas aeruginosa PA01
caggccagcucgcccgc

SEQ ID NO: 3378117 - RNA, 19 nt, Pseudomonas aeruginosa PA01
caggccagcucgcccgccu

SEQ ID NO: 3378118 - RNA, 21 nt, Pseudomonas aeruginosa PA01
caggccagcuuccaggcgcgc

SEQ ID NO: 3378119 - RNA, 17 nt, Pseudomonas aeruginosa PA01
caggccaggccccaggg

SEQ ID NO: 3378120 - RNA, 23 nt, Pseudomonas aeruginosa PA01
caggccagggcggugagguugcc

SEQ ID NO: 3378121 - RNA, 14 nt, Pseudomonas aeruginosa PA01
caggccaggugguc

SEQ ID NO: 3378122 - RNA, 17 nt, Pseudomonas aeruginosa PA01
caggccauagcgcgccg

SEQ ID NO: 3378123 - RNA, 20 nt, Pseudomonas aeruginosa PA01
caggccauagcgcgccgggu

SEQ ID NO: 3378124 - RNA, 14 nt, Pseudomonas aeruginosa PA01
caggccaugggugu

SEQ ID NO: 3378125 - RNA, 23 nt, Pseudomonas aeruginosa PA01
caggccaugggugucggcgauca

SEQ ID NO: 3378126 - RNA, 19 nt, Pseudomonas aeruginosa PA01
caggccauucuucuccaga

SEQ ID NO: 3378127 - RNA, 18 nt, Pseudomonas aeruginosa PA01
caggccauugaaggccga

SEQ ID NO: 3378128 - RNA, 13 nt, Pseudomonas aeruginosa PA01
caggcccacgccc

SEQ ID NO: 3378129 - RNA, 13 nt, Pseudomonas aeruginosa PA01
caggcccagccgg

SEQ ID NO: 3378130 - RNA, 16 nt, Pseudomonas aeruginosa PA01
caggcccagccgguga

SEQ ID NO: 3378131 - RNA, 14 nt, Pseudomonas aeruginosa PA01
caggcccagcgcgg

SEQ ID NO: 3378132 - RNA, 17 nt, Pseudomonas aeruginosa PA01
caggccgaucaggaaau

SEQ ID NO: 3378133 - RNA, 17 nt, Pseudomonas aeruginosa PA01
caggccgaucaucauca

SEQ ID NO: 3378134 - RNA, 23 nt, Pseudomonas aeruginosa PA01
caggccgaucgccucguucagca

SEQ ID NO: 3378135 - RNA, 14 nt, Pseudomonas aeruginosa PA01
caggccgaucucgu

SEQ ID NO: 3378136 - RNA, 20 nt, Pseudomonas aeruginosa PA01
caggccgaucucguggaccc

SEQ ID NO: 3378137 - RNA, 23 nt, Pseudomonas aeruginosa PA01
caggccgaucucgugggccagca

SEQ ID NO: 3378138 - RNA, 19 nt, Pseudomonas aeruginosa PA01
caggccgaugaacgccgcg

SEQ ID NO: 3378139 - RNA, 21 nt, Pseudomonas aeruginosa PA01
caggccgaugaacgccgcgaa

SEQ ID NO: 3378140 - RNA, 17 nt, Pseudomonas aeruginosa PA01
caggccgaugcgcaacg

SEQ ID NO: 3378141 - RNA, 23 nt, Pseudomonas aeruginosa PA01
caggccgaugcgcaacgggcggc

SEQ ID NO: 3378142 - RNA, 13 nt, Pseudomonas aeruginosa PA01
caggccgauggcc

SEQ ID NO: 3378143 - RNA, 14 nt, Pseudomonas aeruginosa PA01
caggccgauggccc

SEQ ID NO: 3378144 - RNA, 15 nt, Pseudomonas aeruginosa PA01
caggccgauggcccc

SEQ ID NO: 3378145 - RNA, 16 nt, Pseudomonas aeruginosa PA01
caggccgauggccccg

SEQ ID NO: 3378146 - RNA, 18 nt, Pseudomonas aeruginosa PA01
caggccgauggccccggc

SEQ ID NO: 3378147 - RNA, 17 nt, Pseudomonas aeruginosa PA01
caggccgauguccucga

SEQ ID NO: 3378148 - RNA, 19 nt, Pseudomonas aeruginosa PA01
caggccgauuuucugccgc

SEQ ID NO: 3378149 - RNA, 20 nt, Pseudomonas aeruginosa PA01
caggccgccaugcucggcca

SEQ ID NO: 3378150 - RNA, 21 nt, Pseudomonas aeruginosa PA01
caggccgccaugcucggccag

SEQ ID NO: 3378151 - RNA, 20 nt, Pseudomonas aeruginosa PA01
caggccgcccaggacaacga

SEQ ID NO: 3378152 - RNA, 20 nt, Pseudomonas aeruginosa PA01
caggccgccgauccaggaac

SEQ ID NO: 3378153 - RNA, 16 nt, Pseudomonas aeruginosa PA01
caggccgccgcgucga

SEQ ID NO: 3378154 - RNA, 22 nt, Pseudomonas aeruginosa PA01
caggccgccgcgugccgccgga

SEQ ID NO: 3378155 - RNA, 14 nt, Pseudomonas aeruginosa PA01
caggccgccggcga

SEQ ID NO: 3378156 - RNA, 19 nt, Pseudomonas aeruginosa PA01
caggccgccggcgaccgcg

SEQ ID NO: 3378157 - RNA, 18 nt, Pseudomonas aeruginosa PA01
caggccgccggcggccag

SEQ ID NO: 3378158 - RNA, 19 nt, Pseudomonas aeruginosa PA01
caggccgccuauggcggau

SEQ ID NO: 3378159 - RNA, 13 nt, Pseudomonas aeruginosa PA01
caggccgcgcagc

SEQ ID NO: 3378160 - RNA, 16 nt, Pseudomonas aeruginosa PA01
caggccgcgcagcaac

SEQ ID NO: 3378161 - RNA, 17 nt, Pseudomonas aeruginosa PA01
caggccgcgcagcaacg

SEQ ID NO: 3378162 - RNA, 21 nt, Pseudomonas aeruginosa PA01
caggccgcgcagcaacggcgc

SEQ ID NO: 3378163 - RNA, 22 nt, Pseudomonas aeruginosa PA01
caggccgcgcagcaacggcgca

SEQ ID NO: 3378164 - RNA, 18 nt, Pseudomonas aeruginosa PA01
caggccgcgcagucccgc

SEQ ID NO: 3378165 - RNA, 21 nt, Pseudomonas aeruginosa PA01
caggccgcgcgauggccggcg

SEQ ID NO: 3378166 - RNA, 13 nt, Pseudomonas aeruginosa PA01
caggccgcggccc

SEQ ID NO: 3378167 - RNA, 21 nt, Pseudomonas aeruginosa PA01
caggccgcggggaggaagcuc

SEQ ID NO: 3378168 - RNA, 23 nt, Pseudomonas aeruginosa PA01
caggccgcggggaggaagcuccc

SEQ ID NO: 3378169 - RNA, 21 nt, Pseudomonas aeruginosa PA01
caggccgcgucguaguugccu

SEQ ID NO: 3378170 - RNA, 18 nt, Pseudomonas aeruginosa PA01
caggccgcugccgccgcg

SEQ ID NO: 3378171 - RNA, 23 nt, Pseudomonas aeruginosa PA01
caggccgcugccgccgcgcaggc

SEQ ID NO: 3378172 - RNA, 13 nt, Pseudomonas aeruginosa PA01
caggccgcugccu

SEQ ID NO: 3378173 - RNA, 19 nt, Pseudomonas aeruginosa PA01
caggccgcugccugucgca

SEQ ID NO: 3378174 - RNA, 14 nt, Pseudomonas aeruginosa PA01
caggccgcuggcga

SEQ ID NO: 3378175 - RNA, 14 nt, Pseudomonas aeruginosa PA01
caggccgcuggcgg

SEQ ID NO: 3378176 - RNA, 16 nt, Pseudomonas aeruginosa PA01
caggccgcuggcggcg

SEQ ID NO: 3378177 - RNA, 23 nt, Pseudomonas aeruginosa PA01
caggccgcuuuccacccgaaagc

SEQ ID NO: 3378178 - RNA, 12 nt, Pseudomonas aeruginosa PA01
caggccggagcc

SEQ ID NO: 3378179 - RNA, 14 nt, Pseudomonas aeruginosa PA01
caggccggagccgc

SEQ ID NO: 3378180 - RNA, 16 nt, Pseudomonas aeruginosa PA01
caggccggagccgcgu

SEQ ID NO: 3378181 - RNA, 23 nt, Pseudomonas aeruginosa PA01
caggccggaguccacggugaucc

SEQ ID NO: 3378182 - RNA, 16 nt, Pseudomonas aeruginosa PA01
caggccggccagccuu

SEQ ID NO: 3378183 - RNA, 13 nt, Pseudomonas aeruginosa PA01
caggccggccucc

SEQ ID NO: 3378184 - RNA, 20 nt, Pseudomonas aeruginosa PA01
caggccggccuccagcgccu

SEQ ID NO: 3378185 - RNA, 23 nt, Pseudomonas aeruginosa PA01
caggccggccuccagcgccucgc

SEQ ID NO: 3378186 - RNA, 16 nt, Pseudomonas aeruginosa PA01
caggccggcgaccagc

SEQ ID NO: 3378187 - RNA, 19 nt, Pseudomonas aeruginosa PA01
caggccggcgaccagcguc

SEQ ID NO: 3378188 - RNA, 17 nt, Pseudomonas aeruginosa PA01
caggccggcgagccagg

SEQ ID NO: 3378189 - RNA, 13 nt, Pseudomonas aeruginosa PA01
caggccggcgagg

SEQ ID NO: 3378190 - RNA, 20 nt, Pseudomonas aeruginosa PA01
caggccggcgagggcggcga

SEQ ID NO: 3378191 - RNA, 13 nt, Pseudomonas aeruginosa PA01
caggccggcgccg

SEQ ID NO: 3378192 - RNA, 16 nt, Pseudomonas aeruginosa PA01
caggccggcgccgaug

SEQ ID NO: 3378193 - RNA, 19 nt, Pseudomonas aeruginosa PA01
caggccggcgcgauccugg

SEQ ID NO: 3378194 - RNA, 22 nt, Pseudomonas aeruginosa PA01
caggccggcgcgauccuggcgg

SEQ ID NO: 3378195 - RNA, 23 nt, Pseudomonas aeruginosa PA01
caggccggcgcgauccuggcggc

SEQ ID NO: 3378196 - RNA, 24 nt, Pseudomonas aeruginosa PA01
caggccggcgcgauccuggcggca

SEQ ID NO: 3378197 - RNA, 13 nt, Pseudomonas aeruginosa PA01
caggccggcggcc

SEQ ID NO: 3378198 - RNA, 15 nt, Pseudomonas aeruginosa PA01
caggccggcggccga

SEQ ID NO: 3378199 - RNA, 16 nt, Pseudomonas aeruginosa PA01
caggccggcggccgag

SEQ ID NO: 3378200 - RNA, 14 nt, Pseudomonas aeruginosa PA01
caggccggcgucga

SEQ ID NO: 3378201 - RNA, 16 nt, Pseudomonas aeruginosa PA01
caggccggcguuggaa

SEQ ID NO: 3378202 - RNA, 14 nt, Pseudomonas aeruginosa PA01
caggccgggcaggc

SEQ ID NO: 3378203 - RNA, 12 nt, Pseudomonas aeruginosa PA01
caggccgggcgg

SEQ ID NO: 3378204 - RNA, 13 nt, Pseudomonas aeruginosa PA01
caggccgggcgga

SEQ ID NO: 3378205 - RNA, 19 nt, Pseudomonas aeruginosa PA01
caggccgggcggacgcugg

SEQ ID NO: 3378206 - RNA, 19 nt, Pseudomonas aeruginosa PA01
caggccgggcggcggcgcu

SEQ ID NO: 3378207 - RNA, 13 nt, Pseudomonas aeruginosa PA01
caggccgggcugg

SEQ ID NO: 3378208 - RNA, 16 nt, Pseudomonas aeruginosa PA01
caggccgggcuggcca

SEQ ID NO: 3378209 - RNA, 14 nt, Pseudomonas aeruginosa PA01
caggccggugaucu

SEQ ID NO: 3378210 - RNA, 19 nt, Pseudomonas aeruginosa PA01
caggccggugaucucgcgg

SEQ ID NO: 3378211 - RNA, 16 nt, Pseudomonas aeruginosa PA01
caggccggugccgccg

SEQ ID NO: 3378212 - RNA, 18 nt, Pseudomonas aeruginosa PA01
caggccggugccgccggc

SEQ ID NO: 3378213 - RNA, 19 nt, Pseudomonas aeruginosa PA01
caggccggugccgccggcc

SEQ ID NO: 3378214 - RNA, 20 nt, Pseudomonas aeruginosa PA01
caggccggugccgccggcca

SEQ ID NO: 3378215 - RNA, 20 nt, Pseudomonas aeruginosa PA01
caggccguagaagaucggau

SEQ ID NO: 3378216 - RNA, 18 nt, Pseudomonas aeruginosa PA01
caggccguagaccaccag

SEQ ID NO: 3378217 - RNA, 19 nt, Pseudomonas aeruginosa PA01
caggccguagaccaccagc

SEQ ID NO: 3378218 - RNA, 17 nt, Pseudomonas aeruginosa PA01
caggccguagcgcucga

SEQ ID NO: 3378219 - RNA, 19 nt, Pseudomonas aeruginosa PA01
caggccguaggcgauggcc

SEQ ID NO: 3378220 - RNA, 15 nt, Pseudomonas aeruginosa PA01
caggccgucgagggc

SEQ ID NO: 3378221 - RNA, 22 nt, Pseudomonas aeruginosa PA01
caggccgugggccggcgcgccg

SEQ ID NO: 3378222 - RNA, 12 nt, Pseudomonas aeruginosa PA01
caggccuccagc

SEQ ID NO: 3378223 - RNA, 13 nt, Pseudomonas aeruginosa PA01
caggccuccagca

SEQ ID NO: 3378224 - RNA, 14 nt, Pseudomonas aeruginosa PA01
caggccucccagcc

SEQ ID NO: 3378225 - RNA, 15 nt, Pseudomonas aeruginosa PA01
caggccucccagccg

SEQ ID NO: 3378226 - RNA, 19 nt, Pseudomonas aeruginosa PA01
caggccucccagccguggg

SEQ ID NO: 3378227 - RNA, 23 nt, Pseudomonas aeruginosa PA01
caggccucccagccgugggcgua

SEQ ID NO: 3378228 - RNA, 12 nt, Pseudomonas aeruginosa PA01
caggccucggcg

SEQ ID NO: 3378229 - RNA, 15 nt, Pseudomonas aeruginosa PA01
caggccucggcgcgg

SEQ ID NO: 3378230 - RNA, 14 nt, Pseudomonas aeruginosa PA01
caggccuggagcgc

SEQ ID NO: 3378231 - RNA, 19 nt, Pseudomonas aeruginosa PA01
caggccuggcccuggcgca

SEQ ID NO: 3378232 - RNA, 22 nt, Pseudomonas aeruginosa PA01
caggccugggcaagcugcacgg

SEQ ID NO: 3378233 - RNA, 16 nt, Pseudomonas aeruginosa PA01
caggccugggucacca

SEQ ID NO: 3378234 - RNA, 23 nt, Pseudomonas aeruginosa PA01
caggcgccgcucgaugcccgcca

SEQ ID NO: 3378235 - RNA, 15 nt, Pseudomonas aeruginosa PA01
caggcgccgcugucu

SEQ ID NO: 3378236 - RNA, 14 nt, Pseudomonas aeruginosa PA01
caggcgccggacca

SEQ ID NO: 3378237 - RNA, 11 nt, Pseudomonas aeruginosa PA01
caggcgccggc

SEQ ID NO: 3378238 - RNA, 12 nt, Pseudomonas aeruginosa PA01
caggcgccggcc

SEQ ID NO: 3378239 - RNA, 14 nt, Pseudomonas aeruginosa PA01
caggcgccggccuc

SEQ ID NO: 3378240 - RNA, 20 nt, Pseudomonas aeruginosa PA01
caggcgcgaacgcucccagc

SEQ ID NO: 3378241 - RNA, 14 nt, Pseudomonas aeruginosa PA01
caggcgcgccgugc

SEQ ID NO: 3378242 - RNA, 15 nt, Pseudomonas aeruginosa PA01
caggcgcgccgugcg

SEQ ID NO: 3378243 - RNA, 18 nt, Pseudomonas aeruginosa PA01
caggcgcgccgugcggcg

SEQ ID NO: 3378244 - RNA, 13 nt, Pseudomonas aeruginosa PA01
caggcgcgccugg

SEQ ID NO: 3378245 - RNA, 14 nt, Pseudomonas aeruginosa PA01
caggcgcgccuggc

SEQ ID NO: 3378246 - RNA, 17 nt, Pseudomonas aeruginosa PA01
caggcgcgccuggcccu

SEQ ID NO: 3378247 - RNA, 14 nt, Pseudomonas aeruginosa PA01
caggcgcgcggcca

SEQ ID NO: 3378248 - RNA, 16 nt, Pseudomonas aeruginosa PA01
caggcgcgcggccagc

SEQ ID NO: 3378249 - RNA, 19 nt, Pseudomonas aeruginosa PA01
caggcgcgcggccagcgcg

SEQ ID NO: 3378250 - RNA, 17 nt, Pseudomonas aeruginosa PA01
caggcgcgcggucuuca

SEQ ID NO: 3378251 - RNA, 21 nt, Pseudomonas aeruginosa PA01
caggcgcgcggucuucaucac

SEQ ID NO: 3378252 - RNA, 15 nt, Pseudomonas aeruginosa PA01
caggcgcgcucggga

SEQ ID NO: 3378253 - RNA, 21 nt, Pseudomonas aeruginosa PA01
caggcgcgcucgggaucgccu

SEQ ID NO: 3378254 - RNA, 19 nt, Pseudomonas aeruginosa PA01
caggcgcgcuggaugcccu

SEQ ID NO: 3378255 - RNA, 12 nt, Pseudomonas aeruginosa PA01
caggcgcggcau

SEQ ID NO: 3378256 - RNA, 15 nt, Pseudomonas aeruginosa PA01
caggcgcggcgccuu

SEQ ID NO: 3378257 - RNA, 16 nt, Pseudomonas aeruginosa PA01
caggcgcggcgccuuc

SEQ ID NO: 3378258 - RNA, 15 nt, Pseudomonas aeruginosa PA01
caggcgcggcgucgg

SEQ ID NO: 3378259 - RNA, 17 nt, Pseudomonas aeruginosa PA01
caggcgcggcgucgggc

SEQ ID NO: 3378260 - RNA, 18 nt, Pseudomonas aeruginosa PA01
caggcgcggcgucgggcg

SEQ ID NO: 3378261 - RNA, 20 nt, Pseudomonas aeruginosa PA01
caggcgcgggucaucggccc

SEQ ID NO: 3378262 - RNA, 21 nt, Pseudomonas aeruginosa PA01
caggcgcgggucaucggcccg

SEQ ID NO: 3378263 - RNA, 16 nt, Pseudomonas aeruginosa PA01
caggcgcgggucuuca

SEQ ID NO: 3378264 - RNA, 22 nt, Pseudomonas aeruginosa PA01
caggcgcgggucuucaggccgc

SEQ ID NO: 3378265 - RNA, 20 nt, Pseudomonas aeruginosa PA01
caggcgcgguugccgcugcg

SEQ ID NO: 3378266 - RNA, 18 nt, Pseudomonas aeruginosa PA01
caggcgcgucgcggccuc

SEQ ID NO: 3378267 - RNA, 16 nt, Pseudomonas aeruginosa PA01
caggcgcgucuccagc

SEQ ID NO: 3378268 - RNA, 23 nt, Pseudomonas aeruginosa PA01
caggcgcgucuccagcucggcga

SEQ ID NO: 3378269 - RNA, 19 nt, Pseudomonas aeruginosa PA01
caggcgcguugcuuccagg

SEQ ID NO: 3378270 - RNA, 22 nt, Pseudomonas aeruginosa PA01
caggcgcguugcuuccaggcac

SEQ ID NO: 3378271 - RNA, 16 nt, Pseudomonas aeruginosa PA01
caggcgcucagggaaa

SEQ ID NO: 3378272 - RNA, 20 nt, Pseudomonas aeruginosa PA01
caggcgcuccagacucucca

SEQ ID NO: 3378273 - RNA, 16 nt, Pseudomonas aeruginosa PA01
caggcgcuccuccagc

SEQ ID NO: 3378274 - RNA, 17 nt, Pseudomonas aeruginosa PA01
caggcgcuccuccagcg

SEQ ID NO: 3378275 - RNA, 16 nt, Pseudomonas aeruginosa PA01
caggcgcuccuggagg

SEQ ID NO: 3378276 - RNA, 22 nt, Pseudomonas aeruginosa PA01
caggcgcuccuggugcggcacc

SEQ ID NO: 3378277 - RNA, 19 nt, Pseudomonas aeruginosa PA01
caggcgcuccuugagcagc

SEQ ID NO: 3378278 - RNA, 17 nt, Pseudomonas aeruginosa PA01
caggcgcucgcgggccg

SEQ ID NO: 3378279 - RNA, 18 nt, Pseudomonas aeruginosa PA01
caggcgcucgcgggccgc

SEQ ID NO: 3378280 - RNA, 19 nt, Pseudomonas aeruginosa PA01
caggcgcucgcgggccgcc

SEQ ID NO: 3378281 - RNA, 21 nt, Pseudomonas aeruginosa PA01
caggcgcucgcgggccgccug

SEQ ID NO: 3378282 - RNA, 14 nt, Pseudomonas aeruginosa PA01
caggcgcucggcga

SEQ ID NO: 3378283 - RNA, 16 nt, Pseudomonas aeruginosa PA01
caggcgcucggcgacg

SEQ ID NO: 3378284 - RNA, 16 nt, Pseudomonas aeruginosa PA01
caggcgcucucgccgc

SEQ ID NO: 3378285 - RNA, 17 nt, Pseudomonas aeruginosa PA01
caggcgcucucgccgcc

SEQ ID NO: 3378286 - RNA, 19 nt, Pseudomonas aeruginosa PA01
caggcgcucucgccgccuu

SEQ ID NO: 3378287 - RNA, 22 nt, Pseudomonas aeruginosa PA01
caggcgcucucgccgccuucgg

SEQ ID NO: 3378288 - RNA, 14 nt, Pseudomonas aeruginosa PA01
caggcgcugcagcc

SEQ ID NO: 3378289 - RNA, 15 nt, Pseudomonas aeruginosa PA01
caggcgcugcgcggc

SEQ ID NO: 3378290 - RNA, 16 nt, Pseudomonas aeruginosa PA01
caggcgcugcgcggcc

SEQ ID NO: 3378291 - RNA, 18 nt, Pseudomonas aeruginosa PA01
caggcgcugcgcggccug

SEQ ID NO: 3378292 - RNA, 20 nt, Pseudomonas aeruginosa PA01
caggcgcugcgcggccugcg

SEQ ID NO: 3378293 - RNA, 18 nt, Pseudomonas aeruginosa PA01
caggcgcugcguuccugu

SEQ ID NO: 3378294 - RNA, 22 nt, Pseudomonas aeruginosa PA01
caggcgcugcguuccuguucgc

SEQ ID NO: 3378295 - RNA, 17 nt, Pseudomonas aeruginosa PA01
caggcgcugcuggugga

SEQ ID NO: 3378296 - RNA, 13 nt, Pseudomonas aeruginosa PA01
caggcgcuggcga

SEQ ID NO: 3378297 - RNA, 13 nt, Pseudomonas aeruginosa PA01
caggcgcuggcgg

SEQ ID NO: 3378298 - RNA, 17 nt, Pseudomonas aeruginosa PA01
caggcgcuggcgggcgc

SEQ ID NO: 3378299 - RNA, 17 nt, Pseudomonas aeruginosa PA01
caggcgcugguccagca

SEQ ID NO: 3378300 - RNA, 20 nt, Pseudomonas aeruginosa PA01
caggcgcugguccagcacgc

SEQ ID NO: 3378301 - RNA, 21 nt, Pseudomonas aeruginosa PA01
caggcgcugguccagcacgcu

SEQ ID NO: 3378302 - RNA, 22 nt, Pseudomonas aeruginosa PA01
caggcgcugguccagcacgcug

SEQ ID NO: 3378303 - RNA, 14 nt, Pseudomonas aeruginosa PA01
caggcgcuggugau

SEQ ID NO: 3378304 - RNA, 18 nt, Pseudomonas aeruginosa PA01
caggcgcuguccuguggc

SEQ ID NO: 3378305 - RNA, 23 nt, Pseudomonas aeruginosa PA01
caggcgcuguccuguggcgcuuc

SEQ ID NO: 3378306 - RNA, 20 nt, Pseudomonas aeruginosa PA01
caggcgcuugcucuccacua

SEQ ID NO: 3378307 - RNA, 18 nt, Pseudomonas aeruginosa PA01
caggcggaaaaagcgcgg

SEQ ID NO: 3378308 - RNA, 14 nt, Pseudomonas aeruginosa PA01
caggcggaaggccu

SEQ ID NO: 3378309 - RNA, 15 nt, Pseudomonas aeruginosa PA01
caggcggaaggccuc

SEQ ID NO: 3378310 - RNA, 18 nt, Pseudomonas aeruginosa PA01
caggcggacacgcaggcg

SEQ ID NO: 3378311 - RNA, 19 nt, Pseudomonas aeruginosa PA01
caggcggacacgcaggcgc

SEQ ID NO: 3378312 - RNA, 19 nt, Pseudomonas aeruginosa PA01
caggcggagauugcggcga

SEQ ID NO: 3378313 - RNA, 18 nt, Pseudomonas aeruginosa PA01
caggcggaguagccggcg

SEQ ID NO: 3378314 - RNA, 21 nt, Pseudomonas aeruginosa PA01
caggcggaguagccggcggcg

SEQ ID NO: 3378315 - RNA, 22 nt, Pseudomonas aeruginosa PA01
caggcggaguagccggcggcga

SEQ ID NO: 3378316 - RNA, 13 nt, Pseudomonas aeruginosa PA01
caggcggaucacc

SEQ ID NO: 3378317 - RNA, 13 nt, Pseudomonas aeruginosa PA01
caggcggaucgcc

SEQ ID NO: 3378318 - RNA, 18 nt, Pseudomonas aeruginosa PA01
caggcggaucgcccggcg

SEQ ID NO: 3378319 - RNA, 14 nt, Pseudomonas aeruginosa PA01
caggcggaucgccg

SEQ ID NO: 3378320 - RNA, 15 nt, Pseudomonas aeruginosa PA01
caggcggaucgccgc

SEQ ID NO: 3378321 - RNA, 17 nt, Pseudomonas aeruginosa PA01
caggcggaucgccgccu

SEQ ID NO: 3378322 - RNA, 20 nt, Pseudomonas aeruginosa PA01
caggcggcacucggcgacca

SEQ ID NO: 3378323 - RNA, 13 nt, Pseudomonas aeruginosa PA01
caggcggcagccg

SEQ ID NO: 3378324 - RNA, 13 nt, Pseudomonas aeruginosa PA01
caggcggccacca

SEQ ID NO: 3378325 - RNA, 14 nt, Pseudomonas aeruginosa PA01
caggcggcccaugc

SEQ ID NO: 3378326 - RNA, 22 nt, Pseudomonas aeruginosa PA01
caggcggcccaugcggaucgcc

SEQ ID NO: 3378327 - RNA, 12 nt, Pseudomonas aeruginosa PA01
caggcggccgaa

SEQ ID NO: 3378328 - RNA, 16 nt, Pseudomonas aeruginosa PA01
caggcggccgaacugg

SEQ ID NO: 3378329 - RNA, 13 nt, Pseudomonas aeruginosa PA01
caggcggccgaau

SEQ ID NO: 3378330 - RNA, 22 nt, Pseudomonas aeruginosa PA01
caggcggccgaauccuccagcc

SEQ ID NO: 3378331 - RNA, 12 nt, Pseudomonas aeruginosa PA01
caggcggccgcu

SEQ ID NO: 3378332 - RNA, 14 nt, Pseudomonas aeruginosa PA01
caggcggccgcugg

SEQ ID NO: 3378333 - RNA, 15 nt, Pseudomonas aeruginosa PA01
caggcggccgucggc

SEQ ID NO: 3378334 - RNA, 19 nt, Pseudomonas aeruginosa PA01
caggcggccgucggccugg

SEQ ID NO: 3378335 - RNA, 21 nt, Pseudomonas aeruginosa PA01
caggcggccgucggccuggcg

SEQ ID NO: 3378336 - RNA, 20 nt, Pseudomonas aeruginosa PA01
caggcggcgcuguuugcggc

SEQ ID NO: 3378337 - RNA, 20 nt, Pseudomonas aeruginosa PA01
caggcugaucuugccgcugg

SEQ ID NO: 3378338 - RNA, 18 nt, Pseudomonas aeruginosa PA01
caggcugcaucggcucgg

SEQ ID NO: 3378339 - RNA, 21 nt, Pseudomonas aeruginosa PA01
caggcugcccagguagccggc

SEQ ID NO: 3378340 - RNA, 13 nt, Pseudomonas aeruginosa PA01
caggcugccgaag

SEQ ID NO: 3378341 - RNA, 14 nt, Pseudomonas aeruginosa PA01
caggcugccgagaa

SEQ ID NO: 3378342 - RNA, 13 nt, Pseudomonas aeruginosa PA01
caggcugccgagc

SEQ ID NO: 3378343 - RNA, 14 nt, Pseudomonas aeruginosa PA01
caggcugccgagca

SEQ ID NO: 3378344 - RNA, 17 nt, Pseudomonas aeruginosa PA01
caggcugccgagcaggg

SEQ ID NO: 3378345 - RNA, 12 nt, Pseudomonas aeruginosa PA01
caggcugccgca

SEQ ID NO: 3378346 - RNA, 15 nt, Pseudomonas aeruginosa PA01
caggcugccgccgcc

SEQ ID NO: 3378347 - RNA, 18 nt, Pseudomonas aeruginosa PA01
caggcugccgccgccguc

SEQ ID NO: 3378348 - RNA, 21 nt, Pseudomonas aeruginosa PA01
caggcugccgccuucgcgggc

SEQ ID NO: 3378349 - RNA, 14 nt, Pseudomonas aeruginosa PA01
caggcugccggcca

SEQ ID NO: 3378350 - RNA, 15 nt, Pseudomonas aeruginosa PA01
caggcugccggccag

SEQ ID NO: 3378351 - RNA, 16 nt, Pseudomonas aeruginosa PA01
caggcugccggccagg

SEQ ID NO: 3378352 - RNA, 17 nt, Pseudomonas aeruginosa PA01
caggcugccggccaggu

SEQ ID NO: 3378353 - RNA, 15 nt, Pseudomonas aeruginosa PA01
caggcugccuucgac

SEQ ID NO: 3378354 - RNA, 11 nt, Pseudomonas aeruginosa PA01
caggcugcgca

SEQ ID NO: 3378355 - RNA, 23 nt, Pseudomonas aeruginosa PA01
caggcugcgcaccucggccaggc

SEQ ID NO: 3378356 - RNA, 17 nt, Pseudomonas aeruginosa PA01
caggcugcgccgcugcg

SEQ ID NO: 3378357 - RNA, 18 nt, Pseudomonas aeruginosa PA01
caggcugcgccgcugcgg

SEQ ID NO: 3378358 - RNA, 22 nt, Pseudomonas aeruginosa PA01
caggcugcgccgcugcggcugc

SEQ ID NO: 3378359 - RNA, 16 nt, Pseudomonas aeruginosa PA01
caggcugcgcgcaucg

SEQ ID NO: 3378360 - RNA, 14 nt, Pseudomonas aeruginosa PA01
caggcugcggcgga

SEQ ID NO: 3378361 - RNA, 16 nt, Pseudomonas aeruginosa PA01
caggcugcggcggaag

SEQ ID NO: 3378362 - RNA, 21 nt, Pseudomonas aeruginosa PA01
caggcugcggcggaaggcggc

SEQ ID NO: 3378363 - RNA, 12 nt, Pseudomonas aeruginosa PA01
caggcugcugcu

SEQ ID NO: 3378364 - RNA, 18 nt, Pseudomonas aeruginosa PA01
caggcugcugcugcggcg

SEQ ID NO: 3378365 - RNA, 19 nt, Pseudomonas aeruginosa PA01
caggcugcugcugcggcgg

SEQ ID NO: 3378366 - RNA, 16 nt, Pseudomonas aeruginosa PA01
caggcuggaggcuggg

SEQ ID NO: 3378367 - RNA, 15 nt, Pseudomonas aeruginosa PA01
caggcuggccacgaa

SEQ ID NO: 3378368 - RNA, 20 nt, Pseudomonas aeruginosa PA01
caggcuggccacgaacaggc

SEQ ID NO: 3378369 - RNA, 12 nt, Pseudomonas aeruginosa PA01
caggcuggccag

SEQ ID NO: 3378370 - RNA, 21 nt, Pseudomonas aeruginosa PA01
caggcuggccagaauuccagc

SEQ ID NO: 3378371 - RNA, 22 nt, Pseudomonas aeruginosa PA01
caggcuggccaguugcgcuccg

SEQ ID NO: 3378372 - RNA, 11 nt, Pseudomonas aeruginosa PA01
caggcuggccg

SEQ ID NO: 3378373 - RNA, 18 nt, Pseudomonas aeruginosa PA01
caggcuggccgagcgccg

SEQ ID NO: 3378374 - RNA, 19 nt, Pseudomonas aeruginosa PA01
caggcuggccuuggccaug

SEQ ID NO: 3378375 - RNA, 12 nt, Pseudomonas aeruginosa PA01
caggcuggcggc

SEQ ID NO: 3378376 - RNA, 13 nt, Pseudomonas aeruginosa PA01
caggcuggcggca

SEQ ID NO: 3378377 - RNA, 14 nt, Pseudomonas aeruginosa PA01
caggcuggcggcau

SEQ ID NO: 3378378 - RNA, 22 nt, Pseudomonas aeruginosa PA01
caggcuggcggcaucggcgccg

SEQ ID NO: 3378379 - RNA, 23 nt, Pseudomonas aeruginosa PA01
caggcuggcgucgacgccgaagc

SEQ ID NO: 3378380 - RNA, 14 nt, Pseudomonas aeruginosa PA01
caggcuggcucccc

SEQ ID NO: 3378381 - RNA, 15 nt, Pseudomonas aeruginosa PA01
caggcugggccgaac

SEQ ID NO: 3378382 - RNA, 21 nt, Pseudomonas aeruginosa PA01
caggcugggccgaaccggggc

SEQ ID NO: 3378383 - RNA, 22 nt, Pseudomonas aeruginosa PA01
caggcugggccgaaccggggcg

SEQ ID NO: 3378384 - RNA, 20 nt, Pseudomonas aeruginosa PA01
caggcugggguugcggcgcc

SEQ ID NO: 3378385 - RNA, 18 nt, Pseudomonas aeruginosa PA01
caggcuggguuggcgcga

SEQ ID NO: 3378386 - RNA, 17 nt, Pseudomonas aeruginosa PA01
caggcugguaugcagca

SEQ ID NO: 3378387 - RNA, 15 nt, Pseudomonas aeruginosa PA01
caggcuggugccgcu

SEQ ID NO: 3378388 - RNA, 22 nt, Pseudomonas aeruginosa PA01
caggcugguggucaccgccagc

SEQ ID NO: 3378389 - RNA, 17 nt, Pseudomonas aeruginosa PA01
caggcuguacagcagga

SEQ ID NO: 3378390 - RNA, 15 nt, Pseudomonas aeruginosa PA01
caggcuguagccggc

SEQ ID NO: 3378391 - RNA, 16 nt, Pseudomonas aeruginosa PA01
caggcuguagccggcg

SEQ ID NO: 3378392 - RNA, 17 nt, Pseudomonas aeruginosa PA01
caggcuguagccggcga

SEQ ID NO: 3378393 - RNA, 22 nt, Pseudomonas aeruginosa PA01
caggcuguagccucccgccgcg

SEQ ID NO: 3378394 - RNA, 24 nt, Pseudomonas aeruginosa PA01
caggcuguagccucccgccgcggc

SEQ ID NO: 3378395 - RNA, 16 nt, Pseudomonas aeruginosa PA01
caggcuguaguggcuu

SEQ ID NO: 3378396 - RNA, 14 nt, Pseudomonas aeruginosa PA01
caggcugucggcca

SEQ ID NO: 3378397 - RNA, 20 nt, Pseudomonas aeruginosa PA01
caggcugucggccaucgccg

SEQ ID NO: 3378398 - RNA, 12 nt, Pseudomonas aeruginosa PA01
caggcugugcag

SEQ ID NO: 3378399 - RNA, 23 nt, Pseudomonas aeruginosa PA01
caggcugugcaggaaggcgacga

SEQ ID NO: 3378400 - RNA, 23 nt, Pseudomonas aeruginosa PA01
caggcugugcaucugcgacaugc

SEQ ID NO: 3378401 - RNA, 16 nt, Pseudomonas aeruginosa PA01
caggcugugcgccagg

SEQ ID NO: 3378402 - RNA, 17 nt, Pseudomonas aeruginosa PA01
caggcugugcgccaggc

SEQ ID NO: 3378403 - RNA, 18 nt, Pseudomonas aeruginosa PA01
caggcugugcgccaggcc

SEQ ID NO: 3378404 - RNA, 19 nt, Pseudomonas aeruginosa PA01
caggcugugcgccaggccg

SEQ ID NO: 3378405 - RNA, 20 nt, Pseudomonas aeruginosa PA01
caggcugugcgccaggccgg

SEQ ID NO: 3378406 - RNA, 15 nt, Pseudomonas aeruginosa PA01
caggcuguggcgcgg

SEQ ID NO: 3378407 - RNA, 19 nt, Pseudomonas aeruginosa PA01
caggcuguggcgcggcugg

SEQ ID NO: 3378408 - RNA, 16 nt, Pseudomonas aeruginosa PA01
caggcuguugcccugg

SEQ ID NO: 3378409 - RNA, 18 nt, Pseudomonas aeruginosa PA01
caggcuguugcccugggc

SEQ ID NO: 3378410 - RNA, 19 nt, Pseudomonas aeruginosa PA01
caggcuguugcccugggcc

SEQ ID NO: 3378411 - RNA, 15 nt, Pseudomonas aeruginosa PA01
caggcuuacccgcga

SEQ ID NO: 3378412 - RNA, 22 nt, Pseudomonas aeruginosa PA01
caggcuuacccgcgaccacagg

SEQ ID NO: 3378413 - RNA, 19 nt, Pseudomonas aeruginosa PA01
caggcuucgagcacuuccc

SEQ ID NO: 3378414 - RNA, 14 nt, Pseudomonas aeruginosa PA01
caggcuucggcgcg

SEQ ID NO: 3378415 - RNA, 16 nt, Pseudomonas aeruginosa PA01
caggcuucggcgcgcu

SEQ ID NO: 3378416 - RNA, 17 nt, Pseudomonas aeruginosa PA01
caggcuucggcgcgcug

SEQ ID NO: 3378417 - RNA, 18 nt, Pseudomonas aeruginosa PA01
caggcuucggcgcgcugg

SEQ ID NO: 3378418 - RNA, 14 nt, Pseudomonas aeruginosa PA01
caggcuuuccaccg

SEQ ID NO: 3378419 - RNA, 15 nt, Pseudomonas aeruginosa PA01
caggcuuuccaccgc

SEQ ID NO: 3378420 - RNA, 15 nt, Pseudomonas aeruginosa PA01
caggcuuucguaggc

SEQ ID NO: 3378421 - RNA, 19 nt, Pseudomonas aeruginosa PA01
caggcuuucguaggcaggc

SEQ ID NO: 3378422 - RNA, 21 nt, Pseudomonas aeruginosa PA01
caggcuuucguaggcaggcgc

SEQ ID NO: 3378423 - RNA, 22 nt, Pseudomonas aeruginosa PA01
caggcuuucguaggcaggcgcg

SEQ ID NO: 3378424 - RNA, 21 nt, Pseudomonas aeruginosa PA01
caggcuuugcggcaaggcgau

SEQ ID NO: 3378425 - RNA, 15 nt, Pseudomonas aeruginosa PA01
cagggaaaccaccug

SEQ ID NO: 3378426 - RNA, 12 nt, Pseudomonas aeruginosa PA01
cagggaaaucag

SEQ ID NO: 3378427 - RNA, 20 nt, Pseudomonas aeruginosa PA01
cagggaaaucgguugcgaca

SEQ ID NO: 3378428 - RNA, 16 nt, Pseudomonas aeruginosa PA01
cagggaagcgcgcgcc

SEQ ID NO: 3378429 - RNA, 17 nt, Pseudomonas aeruginosa PA01
cagggaagcgcgcgcca

SEQ ID NO: 3378430 - RNA, 13 nt, Pseudomonas aeruginosa PA01
cagggaaucguca

SEQ ID NO: 3378431 - RNA, 18 nt, Pseudomonas aeruginosa PA01
cagggaauggaugcgcgg

SEQ ID NO: 3378432 - RNA, 21 nt, Pseudomonas aeruginosa PA01
cagggaauggaugcgcggcag

SEQ ID NO: 3378433 - RNA, 17 nt, Pseudomonas aeruginosa PA01
cagggacaccccgucuc

SEQ ID NO: 3378434 - RNA, 17 nt, Pseudomonas aeruginosa PA01
cagggacaugucgaggg

SEQ ID NO: 3378435 - RNA, 18 nt, Pseudomonas aeruginosa PA01
cagggacgcccggagcgc

SEQ ID NO: 3378436 - RNA, 17 nt, Pseudomonas aeruginosa PA01
cagggacgcgcagcggc

SEQ ID NO: 3378437 - RNA, 14 nt, Pseudomonas aeruginosa PA01
cagggacgcgccgg

SEQ ID NO: 3378438 - RNA, 16 nt, Pseudomonas aeruginosa PA01
cagggacgcgccggcg

SEQ ID NO: 3378439 - RNA, 17 nt, Pseudomonas aeruginosa PA01
cagggacgcgccggcgg

SEQ ID NO: 3378440 - RNA, 17 nt, Pseudomonas aeruginosa PA01
cagggcgacgccgaugc

SEQ ID NO: 3378441 - RNA, 22 nt, Pseudomonas aeruginosa PA01
cagggcgacgccgaugcucggu

SEQ ID NO: 3378442 - RNA, 12 nt, Pseudomonas aeruginosa PA01
cagggcgagcag

SEQ ID NO: 3378443 - RNA, 14 nt, Pseudomonas aeruginosa PA01
cagggcgagcaggg

SEQ ID NO: 3378444 - RNA, 18 nt, Pseudomonas aeruginosa PA01
cagggcgagcagggcgcu

SEQ ID NO: 3378445 - RNA, 20 nt, Pseudomonas aeruginosa PA01
cagggcgagcagggcgcuga

SEQ ID NO: 3378446 - RNA, 21 nt, Pseudomonas aeruginosa PA01
cagggcgaggaucacgcagca

SEQ ID NO: 3378447 - RNA, 23 nt, Pseudomonas aeruginosa PA01
cagggcgaggaucacgcagcagg

SEQ ID NO: 3378448 - RNA, 18 nt, Pseudomonas aeruginosa PA01
cagggcgaucgucgagau

SEQ ID NO: 3378449 - RNA, 15 nt, Pseudomonas aeruginosa PA01
cagggcgaugccgau

SEQ ID NO: 3378450 - RNA, 19 nt, Pseudomonas aeruginosa PA01
cagggcgaugccgauggcg

SEQ ID NO: 3378451 - RNA, 16 nt, Pseudomonas aeruginosa PA01
cagggcgauggccagc

SEQ ID NO: 3378452 - RNA, 19 nt, Pseudomonas aeruginosa PA01
cagggcgauggccagcgcg

SEQ ID NO: 3378453 - RNA, 16 nt, Pseudomonas aeruginosa PA01
cagggcgcccgcccgg

SEQ ID NO: 3378454 - RNA, 20 nt, Pseudomonas aeruginosa PA01
cagggcgccgaucaggcgua

SEQ ID NO: 3378455 - RNA, 18 nt, Pseudomonas aeruginosa PA01
cagggcgccgggcugccg

SEQ ID NO: 3378456 - RNA, 19 nt, Pseudomonas aeruginosa PA01
cagggcgccgggcugccga

SEQ ID NO: 3378457 - RNA, 23 nt, Pseudomonas aeruginosa PA01
cagggcgcgaaguagcgggagau

SEQ ID NO: 3378458 - RNA, 16 nt, Pseudomonas aeruginosa PA01
cagggcgcgguaggga

SEQ ID NO: 3378459 - RNA, 14 nt, Pseudomonas aeruginosa PA01
cagggcgcucaccg

SEQ ID NO: 3378460 - RNA, 18 nt, Pseudomonas aeruginosa PA01
cagggcgcucaccgaggc

SEQ ID NO: 3378461 - RNA, 11 nt, Pseudomonas aeruginosa PA01
cagggcgcuga

SEQ ID NO: 3378462 - RNA, 23 nt, Pseudomonas aeruginosa PA01
cagggcgcugaccaggucgugga

SEQ ID NO: 3378463 - RNA, 13 nt, Pseudomonas aeruginosa PA01
cagggcgcugagc

SEQ ID NO: 3378464 - RNA, 17 nt, Pseudomonas aeruginosa PA01
cagggcgcugagcgcgg

SEQ ID NO: 3378465 - RNA, 19 nt, Pseudomonas aeruginosa PA01
cagggcgcugccgaucagc

SEQ ID NO: 3378466 - RNA, 20 nt, Pseudomonas aeruginosa PA01
cagggcggauaaucgcagcg

SEQ ID NO: 3378467 - RNA, 13 nt, Pseudomonas aeruginosa PA01
cagggcggcgagc

SEQ ID NO: 3378468 - RNA, 21 nt, Pseudomonas aeruginosa PA01
cagggcggcgccgaacagggc

SEQ ID NO: 3378469 - RNA, 23 nt, Pseudomonas aeruginosa PA01
cagggcggcgccgaacagggcga

SEQ ID NO: 3378470 - RNA, 22 nt, Pseudomonas aeruginosa PA01
cagggcggcgccuggagcagaa

SEQ ID NO: 3378471 - RNA, 13 nt, Pseudomonas aeruginosa PA01
cagggcggcgcgg

SEQ ID NO: 3378472 - RNA, 16 nt, Pseudomonas aeruginosa PA01
cagggcggcgcggagc

SEQ ID NO: 3378473 - RNA, 18 nt, Pseudomonas aeruginosa PA01
cagggcggcuuccaggua

SEQ ID NO: 3378474 - RNA, 16 nt, Pseudomonas aeruginosa PA01
cagggcgggccgcucg

SEQ ID NO: 3378475 - RNA, 18 nt, Pseudomonas aeruginosa PA01
cagggcgggccgcucgcg

SEQ ID NO: 3378476 - RNA, 16 nt, Pseudomonas aeruginosa PA01
cagggcgguacgccgc

SEQ ID NO: 3378477 - RNA, 18 nt, Pseudomonas aeruginosa PA01
cagggcgguacgccgcgc

SEQ ID NO: 3378478 - RNA, 15 nt, Pseudomonas aeruginosa PA01
cagggcggucggcca

SEQ ID NO: 3378479 - RNA, 17 nt, Pseudomonas aeruginosa PA01
cagggcggucggccagg

SEQ ID NO: 3378480 - RNA, 23 nt, Pseudomonas aeruginosa PA01
cagggcggugagguugccgccga

SEQ ID NO: 3378481 - RNA, 21 nt, Pseudomonas aeruginosa PA01
cagggcguccaguagcgccug

SEQ ID NO: 3378482 - RNA, 21 nt, Pseudomonas aeruginosa PA01
cagggcgucccguuccggcgc

SEQ ID NO: 3378483 - RNA, 17 nt, Pseudomonas aeruginosa PA01
cagggcgucgaaggcgg

SEQ ID NO: 3378484 - RNA, 18 nt, Pseudomonas aeruginosa PA01
cagggcgucgaaggcggc

SEQ ID NO: 3378485 - RNA, 20 nt, Pseudomonas aeruginosa PA01
cagggcgucgaaggcggcgc

SEQ ID NO: 3378486 - RNA, 22 nt, Pseudomonas aeruginosa PA01
cagggcgucgaaggcggcgcgg

SEQ ID NO: 3378487 - RNA, 20 nt, Pseudomonas aeruginosa PA01
cagggcgucgcccucggcgc

SEQ ID NO: 3378488 - RNA, 23 nt, Pseudomonas aeruginosa PA01
cagggcgucgcccucggcgcugg

SEQ ID NO: 3378489 - RNA, 18 nt, Pseudomonas aeruginosa PA01
cagggcgucggcgugcug

SEQ ID NO: 3378490 - RNA, 22 nt, Pseudomonas aeruginosa PA01
cagggcgucgucgaggcugucg

SEQ ID NO: 3378491 - RNA, 19 nt, Pseudomonas aeruginosa PA01
cagggcguggucggcggcc

SEQ ID NO: 3378492 - RNA, 17 nt, Pseudomonas aeruginosa PA01
cagggcguucuucaccc

SEQ ID NO: 3378493 - RNA, 23 nt, Pseudomonas aeruginosa PA01
cagggcguucuucacccgcagcg

SEQ ID NO: 3378494 - RNA, 23 nt, Pseudomonas aeruginosa PA01
cagggcuccgaugaagcaggcgg

SEQ ID NO: 3378495 - RNA, 17 nt, Pseudomonas aeruginosa PA01
cagggcucgugccauca

SEQ ID NO: 3378496 - RNA, 19 nt, Pseudomonas aeruginosa PA01
cagggcucgugccaucagg

SEQ ID NO: 3378497 - RNA, 16 nt, Pseudomonas aeruginosa PA01
cagggcugccaccgag

SEQ ID NO: 3378498 - RNA, 20 nt, Pseudomonas aeruginosa PA01
cagggcugcuguugccaggg

SEQ ID NO: 3378499 - RNA, 18 nt, Pseudomonas aeruginosa PA01
cagggcugggcgcccuuc

SEQ ID NO: 3378500 - RNA, 21 nt, Pseudomonas aeruginosa PA01
cagggcugggcgcccuucagc

SEQ ID NO: 3378501 - RNA, 16 nt, Pseudomonas aeruginosa PA01
cagggcuucccaggcc

SEQ ID NO: 3378502 - RNA, 17 nt, Pseudomonas aeruginosa PA01
cagggcuucccaggcca

SEQ ID NO: 3378503 - RNA, 18 nt, Pseudomonas aeruginosa PA01
cagggcuucccaggccag

SEQ ID NO: 3378504 - RNA, 16 nt, Pseudomonas aeruginosa PA01
cagggcuucgcgcaga

SEQ ID NO: 3378505 - RNA, 13 nt, Pseudomonas aeruginosa PA01
cagggcuucgcgg

SEQ ID NO: 3378506 - RNA, 20 nt, Pseudomonas aeruginosa PA01
cagggcuugcgcgccaccag

SEQ ID NO: 3378507 - RNA, 22 nt, Pseudomonas aeruginosa PA01
cagggcuugcgcgccaccagcg

SEQ ID NO: 3378508 - RNA, 21 nt, Pseudomonas aeruginosa PA01
cagggcuugugcagagaggcu

SEQ ID NO: 3378509 - RNA, 14 nt, Pseudomonas aeruginosa PA01
caggggagcgccgg

SEQ ID NO: 3378510 - RNA, 15 nt, Pseudomonas aeruginosa PA01
caggggagcgccggc

SEQ ID NO: 3378511 - RNA, 18 nt, Pseudomonas aeruginosa PA01
caggggcauguccaccgc

SEQ ID NO: 3378512 - RNA, 21 nt, Pseudomonas aeruginosa PA01
caggggcauguccaccgccgc

SEQ ID NO: 3378513 - RNA, 17 nt, Pseudomonas aeruginosa PA01
caggggcgagagacuga

SEQ ID NO: 3378514 - RNA, 16 nt, Pseudomonas aeruginosa PA01
caggggcgcggcgcgg

SEQ ID NO: 3378515 - RNA, 17 nt, Pseudomonas aeruginosa PA01
caggggcgcggcgcgga

SEQ ID NO: 3378516 - RNA, 18 nt, Pseudomonas aeruginosa PA01
caggggcugaacagcgcc

SEQ ID NO: 3378517 - RNA, 20 nt, Pseudomonas aeruginosa PA01
cagggggacgaaaaccgcag

SEQ ID NO: 3378518 - RNA, 23 nt, Pseudomonas aeruginosa PA01
cagggggaucgcgaagaacacgc

SEQ ID NO: 3378519 - RNA, 14 nt, Pseudomonas aeruginosa PA01
caggggucaggccg

SEQ ID NO: 3378520 - RNA, 15 nt, Pseudomonas aeruginosa PA01
caggggucaggccga

SEQ ID NO: 3378521 - RNA, 16 nt, Pseudomonas aeruginosa PA01
caggggucaggccgau

SEQ ID NO: 3378522 - RNA, 14 nt, Pseudomonas aeruginosa PA01
caggggucggcauc

SEQ ID NO: 3378523 - RNA, 17 nt, Pseudomonas aeruginosa PA01
caggggucggcaucgcg

SEQ ID NO: 3378524 - RNA, 18 nt, Pseudomonas aeruginosa PA01
caggguaccgaaacaggg

SEQ ID NO: 3378525 - RNA, 14 nt, Pseudomonas aeruginosa PA01
caggguaccgcugg

SEQ ID NO: 3378526 - RNA, 20 nt, Pseudomonas aeruginosa PA01
caggguaccgcuggcgcugg

SEQ ID NO: 3378527 - RNA, 22 nt, Pseudomonas aeruginosa PA01
caggguaccguugcgcaggcgu

SEQ ID NO: 3378528 - RNA, 19 nt, Pseudomonas aeruginosa PA01
caggguacuucgugccaca

SEQ ID NO: 3378529 - RNA, 22 nt, Pseudomonas aeruginosa PA01
caggguacuucgugccacaggc

SEQ ID NO: 3378530 - RNA, 15 nt, Pseudomonas aeruginosa PA01
caggguagcgccgcg

SEQ ID NO: 3378531 - RNA, 18 nt, Pseudomonas aeruginosa PA01
caggguagcgccgcgggc

SEQ ID NO: 3378532 - RNA, 20 nt, Pseudomonas aeruginosa PA01
caggguagcgccgcgggcca

SEQ ID NO: 3378533 - RNA, 15 nt, Pseudomonas aeruginosa PA01
cagggucacgccaga

SEQ ID NO: 3378534 - RNA, 14 nt, Pseudomonas aeruginosa PA01
cagggucacgccga

SEQ ID NO: 3378535 - RNA, 15 nt, Pseudomonas aeruginosa PA01
cagggucacgccgau

SEQ ID NO: 3378536 - RNA, 15 nt, Pseudomonas aeruginosa PA01
cagggucacgccggu

SEQ ID NO: 3378537 - RNA, 16 nt, Pseudomonas aeruginosa PA01
cagggucacgcugggc

SEQ ID NO: 3378538 - RNA, 17 nt, Pseudomonas aeruginosa PA01
cagggucacgcugggca

SEQ ID NO: 3378539 - RNA, 13 nt, Pseudomonas aeruginosa PA01
cagggucagcagc

SEQ ID NO: 3378540 - RNA, 14 nt, Pseudomonas aeruginosa PA01
cagggucagcagcg

SEQ ID NO: 3378541 - RNA, 18 nt, Pseudomonas aeruginosa PA01
cagggucagcagcgccag

SEQ ID NO: 3378542 - RNA, 17 nt, Pseudomonas aeruginosa PA01
cagguagcuggaaagcu

SEQ ID NO: 3378543 - RNA, 22 nt, Pseudomonas aeruginosa PA01
cagguaggagagggucagcagg

SEQ ID NO: 3378544 - RNA, 19 nt, Pseudomonas aeruginosa PA01
cagguaggagaugcagcgu

SEQ ID NO: 3378545 - RNA, 16 nt, Pseudomonas aeruginosa PA01
cagguaggcgacgaag

SEQ ID NO: 3378546 - RNA, 14 nt, Pseudomonas aeruginosa PA01
cagguaggcgaugc

SEQ ID NO: 3378547 - RNA, 13 nt, Pseudomonas aeruginosa PA01
cagguaggcgccg

SEQ ID NO: 3378548 - RNA, 17 nt, Pseudomonas aeruginosa PA01
cagguaggcgcgggcgu

SEQ ID NO: 3378549 - RNA, 17 nt, Pseudomonas aeruginosa PA01
cagguaggcgguggcga

SEQ ID NO: 3378550 - RNA, 19 nt, Pseudomonas aeruginosa PA01
cagguaggggaaaccgugg

SEQ ID NO: 3378551 - RNA, 16 nt, Pseudomonas aeruginosa PA01
cagguaguccagccag

SEQ ID NO: 3378552 - RNA, 17 nt, Pseudomonas aeruginosa PA01
cagguaguccagccagu

SEQ ID NO: 3378553 - RNA, 14 nt, Pseudomonas aeruginosa PA01
cagguaguccagcu

SEQ ID NO: 3378554 - RNA, 16 nt, Pseudomonas aeruginosa PA01
cagguagucgcccagc

SEQ ID NO: 3378555 - RNA, 19 nt, Pseudomonas aeruginosa PA01
cagguagucgcccagcgcc

SEQ ID NO: 3378556 - RNA, 14 nt, Pseudomonas aeruginosa PA01
cagguagucgcccg

SEQ ID NO: 3378557 - RNA, 20 nt, Pseudomonas aeruginosa PA01
cagguagucgcccggcucgc

SEQ ID NO: 3378558 - RNA, 17 nt, Pseudomonas aeruginosa PA01
cagguagucggcgaugc

SEQ ID NO: 3378559 - RNA, 22 nt, Pseudomonas aeruginosa PA01
cagguagucggcgaugcgcugg

SEQ ID NO: 3378560 - RNA, 17 nt, Pseudomonas aeruginosa PA01
cagguagugcaacaccu

SEQ ID NO: 3378561 - RNA, 16 nt, Pseudomonas aeruginosa PA01
cagguagugccgcccu

SEQ ID NO: 3378562 - RNA, 22 nt, Pseudomonas aeruginosa PA01
cagguagugcggcgggcgcccg

SEQ ID NO: 3378563 - RNA, 16 nt, Pseudomonas aeruginosa PA01
cagguagugcucggcc

SEQ ID NO: 3378564 - RNA, 17 nt, Pseudomonas aeruginosa PA01
cagguagugcucggcca

SEQ ID NO: 3378565 - RNA, 17 nt, Pseudomonas aeruginosa PA01
cagguaguggcccucga

SEQ ID NO: 3378566 - RNA, 16 nt, Pseudomonas aeruginosa PA01
cagguaguugaggucg

SEQ ID NO: 3378567 - RNA, 23 nt, Pseudomonas aeruginosa PA01
cagguaguugaggucggcaaagc

SEQ ID NO: 3378568 - RNA, 21 nt, Pseudomonas aeruginosa PA01
cagguauccgcuuacuggcga

SEQ ID NO: 3378569 - RNA, 20 nt, Pseudomonas aeruginosa PA01
cagguauucgccggccaggu

SEQ ID NO: 3378570 - RNA, 21 nt, Pseudomonas aeruginosa PA01
cagguauucgccggccaggua

SEQ ID NO: 3378571 - RNA, 20 nt, Pseudomonas aeruginosa PA01
cagguauucgcgcucggcga

SEQ ID NO: 3378572 - RNA, 19 nt, Pseudomonas aeruginosa PA01
caggucagccaccugcucg

SEQ ID NO: 3378573 - RNA, 17 nt, Pseudomonas aeruginosa PA01
caggucaucaggaucag

SEQ ID NO: 3378574 - RNA, 16 nt, Pseudomonas aeruginosa PA01
caggucaugcccuggc

SEQ ID NO: 3378575 - RNA, 21 nt, Pseudomonas aeruginosa PA01
caggucaugcccuggccgacg

SEQ ID NO: 3378576 - RNA, 22 nt, Pseudomonas aeruginosa PA01
caggucaugcccuggccgacgc

SEQ ID NO: 3378577 - RNA, 11 nt, Pseudomonas aeruginosa PA01
cagguccaggc

SEQ ID NO: 3378578 - RNA, 19 nt, Pseudomonas aeruginosa PA01
cagguccgccacuucaagc

SEQ ID NO: 3378579 - RNA, 14 nt, Pseudomonas aeruginosa PA01
cagguccgccuggu

SEQ ID NO: 3378580 - RNA, 16 nt, Pseudomonas aeruginosa PA01
cagguccgcgccucgc

SEQ ID NO: 3378581 - RNA, 18 nt, Pseudomonas aeruginosa PA01
cagguccgcgccucgcgc

SEQ ID NO: 3378582 - RNA, 19 nt, Pseudomonas aeruginosa PA01
cagguccgcgccucgcgca

SEQ ID NO: 3378583 - RNA, 17 nt, Pseudomonas aeruginosa PA01
cagguccggcagcgccu

SEQ ID NO: 3378584 - RNA, 19 nt, Pseudomonas aeruginosa PA01
cagguccguuccguucaaa

SEQ ID NO: 3378585 - RNA, 12 nt, Pseudomonas aeruginosa PA01
cagguccuggcc

SEQ ID NO: 3378586 - RNA, 17 nt, Pseudomonas aeruginosa PA01
cagguccugucccagcg

SEQ ID NO: 3378587 - RNA, 13 nt, Pseudomonas aeruginosa PA01
caggucgaacagc

SEQ ID NO: 3378588 - RNA, 15 nt, Pseudomonas aeruginosa PA01
caggucgaacagcgg

SEQ ID NO: 3378589 - RNA, 19 nt, Pseudomonas aeruginosa PA01
caggucgaacagcggcugg

SEQ ID NO: 3378590 - RNA, 20 nt, Pseudomonas aeruginosa PA01
caggucgaacugcacccgcc

SEQ ID NO: 3378591 - RNA, 19 nt, Pseudomonas aeruginosa PA01
caggucgacaugcaccagg

SEQ ID NO: 3378592 - RNA, 21 nt, Pseudomonas aeruginosa PA01
caggucgacgaccuugcccac

SEQ ID NO: 3378593 - RNA, 18 nt, Pseudomonas aeruginosa PA01
caggucgacgccgccgag

SEQ ID NO: 3378594 - RNA, 22 nt, Pseudomonas aeruginosa PA01
caggucgagacgcgggcccagc

SEQ ID NO: 3378595 - RNA, 17 nt, Pseudomonas aeruginosa PA01
caggucgagcaguuccg

SEQ ID NO: 3378596 - RNA, 19 nt, Pseudomonas aeruginosa PA01
caggucgagcaguuccggc

SEQ ID NO: 3378597 - RNA, 15 nt, Pseudomonas aeruginosa PA01
caggucgaggccgcg

SEQ ID NO: 3378598 - RNA, 19 nt, Pseudomonas aeruginosa PA01
caggucgaggccgcggagc

SEQ ID NO: 3378599 - RNA, 20 nt, Pseudomonas aeruginosa PA01
caggucgaggcgcuccaccg

SEQ ID NO: 3378600 - RNA, 23 nt, Pseudomonas aeruginosa PA01
caggucgagggugguuuccaggc

SEQ ID NO: 3378601 - RNA, 20 nt, Pseudomonas aeruginosa PA01
caggucgaucagcagcagcg

SEQ ID NO: 3378602 - RNA, 21 nt, Pseudomonas aeruginosa PA01
caggucgaucagcagcagcgc

SEQ ID NO: 3378603 - RNA, 24 nt, Pseudomonas aeruginosa PA01
caggucgaucagcagcagcgccau

SEQ ID NO: 3378604 - RNA, 18 nt, Pseudomonas aeruginosa PA01
caggucgauccccaaccc

SEQ ID NO: 3378605 - RNA, 23 nt, Pseudomonas aeruginosa PA01
caggucgauccccaacccggcca

SEQ ID NO: 3378606 - RNA, 23 nt, Pseudomonas aeruginosa PA01
caggucgauccugaccccggccu

SEQ ID NO: 3378607 - RNA, 18 nt, Pseudomonas aeruginosa PA01
caggucgaucucgaagac

SEQ ID NO: 3378608 - RNA, 16 nt, Pseudomonas aeruginosa PA01
caggucgaugcccagc

SEQ ID NO: 3378609 - RNA, 21 nt, Pseudomonas aeruginosa PA01
caggucgaugcccagccaggg

SEQ ID NO: 3378610 - RNA, 17 nt, Pseudomonas aeruginosa PA01
caggucgauguggcugg

SEQ ID NO: 3378611 - RNA, 15 nt, Pseudomonas aeruginosa PA01
caggucgccagcgcc

SEQ ID NO: 3378612 - RNA, 16 nt, Pseudomonas aeruginosa PA01
caggucgccagcgccu

SEQ ID NO: 3378613 - RNA, 20 nt, Pseudomonas aeruginosa PA01
caggucgccaugcccgucga

SEQ ID NO: 3378614 - RNA, 20 nt, Pseudomonas aeruginosa PA01
caggucgcccugcagcgcgc

SEQ ID NO: 3378615 - RNA, 21 nt, Pseudomonas aeruginosa PA01
caggucgcccugcagcgcgcg

SEQ ID NO: 3378616 - RNA, 23 nt, Pseudomonas aeruginosa PA01
caggucgcccugcagcgcgcgcu

SEQ ID NO: 3378617 - RNA, 19 nt, Pseudomonas aeruginosa PA01
caggucgccgcacaccgcg

SEQ ID NO: 3378618 - RNA, 21 nt, Pseudomonas aeruginosa PA01
caggucgccgcacaccgcgcg

SEQ ID NO: 3378619 - RNA, 16 nt, Pseudomonas aeruginosa PA01
caggucgccgccgccg

SEQ ID NO: 3378620 - RNA, 19 nt, Pseudomonas aeruginosa PA01
caggucgccgccgccggga

SEQ ID NO: 3378621 - RNA, 16 nt, Pseudomonas aeruginosa PA01
caggucgccgcugaau

SEQ ID NO: 3378622 - RNA, 23 nt, Pseudomonas aeruginosa PA01
caggucgccguagaacagcacgu

SEQ ID NO: 3378623 - RNA, 21 nt, Pseudomonas aeruginosa PA01
caggucgcgacugaccacgca

SEQ ID NO: 3378624 - RNA, 14 nt, Pseudomonas aeruginosa PA01
caggucgcgcaggg

SEQ ID NO: 3378625 - RNA, 16 nt, Pseudomonas aeruginosa PA01
caggucgcgcagggcc

SEQ ID NO: 3378626 - RNA, 14 nt, Pseudomonas aeruginosa PA01
caggucgcgcggcg

SEQ ID NO: 3378627 - RNA, 15 nt, Pseudomonas aeruginosa PA01
caggucgcgcggcgc

SEQ ID NO: 3378628 - RNA, 18 nt, Pseudomonas aeruginosa PA01
caggucgcgcggcgccug

SEQ ID NO: 3378629 - RNA, 20 nt, Pseudomonas aeruginosa PA01
caggucgcgcggcgccugcu

SEQ ID NO: 3378630 - RNA, 13 nt, Pseudomonas aeruginosa PA01
caggucgcgcugg

SEQ ID NO: 3378631 - RNA, 14 nt, Pseudomonas aeruginosa PA01
caggucgcgcuggg

SEQ ID NO: 3378632 - RNA, 17 nt, Pseudomonas aeruginosa PA01
caggucgcgcugggcga

SEQ ID NO: 3378633 - RNA, 20 nt, Pseudomonas aeruginosa PA01
caggucgcggaacucgauga

SEQ ID NO: 3378634 - RNA, 16 nt, Pseudomonas aeruginosa PA01
caggucgcggagccaa

SEQ ID NO: 3378635 - RNA, 17 nt, Pseudomonas aeruginosa PA01
caggucgcggagccaac

SEQ ID NO: 3378636 - RNA, 16 nt, Pseudomonas aeruginosa PA01
caggucgcggaucagg

SEQ ID NO: 3378637 - RNA, 17 nt, Pseudomonas aeruginosa PA01
caggucgcggccccagc

SEQ ID NO: 3378638 - RNA, 20 nt, Pseudomonas aeruginosa PA01
caggucgcugcccucgacca

SEQ ID NO: 3378639 - RNA, 16 nt, Pseudomonas aeruginosa PA01
caggucgcuggcaccg

SEQ ID NO: 3378640 - RNA, 18 nt, Pseudomonas aeruginosa PA01
caggucgcuggcaccggc

SEQ ID NO: 3378641 - RNA, 11 nt, Pseudomonas aeruginosa PA01
caggucgcugu

SEQ ID NO: 3378642 - RNA, 16 nt, Pseudomonas aeruginosa PA01
caggucgcuguccucc

SEQ ID NO: 3378643 - RNA, 19 nt, Pseudomonas aeruginosa PA01
caggucgcuguccuccagc

SEQ ID NO: 3378644 - RNA, 14 nt, Pseudomonas aeruginosa PA01
cagguucggcagcg

SEQ ID NO: 3378645 - RNA, 17 nt, Pseudomonas aeruginosa PA01
cagguucugccagagcg

SEQ ID NO: 3378646 - RNA, 17 nt, Pseudomonas aeruginosa PA01
cagguucuggucgccga

SEQ ID NO: 3378647 - RNA, 17 nt, Pseudomonas aeruginosa PA01
cagguugaagaacggcc

SEQ ID NO: 3378648 - RNA, 18 nt, Pseudomonas aeruginosa PA01
cagguugaagagcagcac

SEQ ID NO: 3378649 - RNA, 20 nt, Pseudomonas aeruginosa PA01
cagguugaagagcagcacca

SEQ ID NO: 3378650 - RNA, 20 nt, Pseudomonas aeruginosa PA01
cagguugaccccgcggccga

SEQ ID NO: 3378651 - RNA, 12 nt, Pseudomonas aeruginosa PA01
cagguugaccuu

SEQ ID NO: 3378652 - RNA, 19 nt, Pseudomonas aeruginosa PA01
cagguugacgaugcggccc

SEQ ID NO: 3378653 - RNA, 21 nt, Pseudomonas aeruginosa PA01
cagguugacgaugcggcccgc

SEQ ID NO: 3378654 - RNA, 23 nt, Pseudomonas aeruginosa PA01
cagguugacgaugcggcccgccg

SEQ ID NO: 3378655 - RNA, 20 nt, Pseudomonas aeruginosa PA01
cagguugauccugggcgcca

SEQ ID NO: 3378656 - RNA, 14 nt, Pseudomonas aeruginosa PA01
cagguugcacggcc

SEQ ID NO: 3378657 - RNA, 17 nt, Pseudomonas aeruginosa PA01
cagguugcacggccggu

SEQ ID NO: 3378658 - RNA, 13 nt, Pseudomonas aeruginosa PA01
cagguugcccggc

SEQ ID NO: 3378659 - RNA, 17 nt, Pseudomonas aeruginosa PA01
cagguugcgcuggcgca

SEQ ID NO: 3378660 - RNA, 19 nt, Pseudomonas aeruginosa PA01
cagguugcgcuggcgcagc

SEQ ID NO: 3378661 - RNA, 22 nt, Pseudomonas aeruginosa PA01
cagguugcgcuggcgcagcagc

SEQ ID NO: 3378662 - RNA, 14 nt, Pseudomonas aeruginosa PA01
cagguugcucgccu

SEQ ID NO: 3378663 - RNA, 20 nt, Pseudomonas aeruginosa PA01
cagguugcuggcgaggaaca

SEQ ID NO: 3378664 - RNA, 14 nt, Pseudomonas aeruginosa PA01
cagguuggacaggu

SEQ ID NO: 3378665 - RNA, 13 nt, Pseudomonas aeruginosa PA01
cagguuggccagu

SEQ ID NO: 3378666 - RNA, 15 nt, Pseudomonas aeruginosa PA01
cagguuggccccgcc

SEQ ID NO: 3378667 - RNA, 13 nt, Pseudomonas aeruginosa PA01
cagguuggccugg

SEQ ID NO: 3378668 - RNA, 16 nt, Pseudomonas aeruginosa PA01
cagguuggccuggccc

SEQ ID NO: 3378669 - RNA, 17 nt, Pseudomonas aeruginosa PA01
cagguuggccuggcccg

SEQ ID NO: 3378670 - RNA, 23 nt, Pseudomonas aeruginosa PA01
cagguuggcgaacaggcagcggg

SEQ ID NO: 3378671 - RNA, 19 nt, Pseudomonas aeruginosa PA01
cagguuggcgccgggcgcg

SEQ ID NO: 3378672 - RNA, 20 nt, Pseudomonas aeruginosa PA01
cagguuggcgccgggcgcga

SEQ ID NO: 3378673 - RNA, 14 nt, Pseudomonas aeruginosa PA01
cagguuguccaggg

SEQ ID NO: 3378674 - RNA, 13 nt, Pseudomonas aeruginosa PA01
cagguugugcggg

SEQ ID NO: 3378675 - RNA, 18 nt, Pseudomonas aeruginosa PA01
cagguugugcucgaucac

SEQ ID NO: 3378676 - RNA, 23 nt, Pseudomonas aeruginosa PA01
cagguugugguugggcaggcgca

SEQ ID NO: 3378677 - RNA, 21 nt, Pseudomonas aeruginosa PA01
cagguuguucgccgcagcggu

SEQ ID NO: 3378678 - RNA, 15 nt, Pseudomonas aeruginosa PA01
cagguuguucggcga

SEQ ID NO: 3378679 - RNA, 15 nt, Pseudomonas aeruginosa PA01
cagguuucgcaaggg

SEQ ID NO: 3378680 - RNA, 12 nt, Pseudomonas aeruginosa PA01
caguaacgccug

SEQ ID NO: 3378681 - RNA, 15 nt, Pseudomonas aeruginosa PA01
caguacagcucggcg

SEQ ID NO: 3378682 - RNA, 20 nt, Pseudomonas aeruginosa PA01
caguacagcugcaccgcgcg

SEQ ID NO: 3378683 - RNA, 12 nt, Pseudomonas aeruginosa PA01
caguaccagcaa

SEQ ID NO: 3378684 - RNA, 15 nt, Pseudomonas aeruginosa PA01
caguaccagcaaugc

SEQ ID NO: 3378685 - RNA, 21 nt, Pseudomonas aeruginosa PA01
caguaccagcaaugcccagcg

SEQ ID NO: 3378686 - RNA, 18 nt, Pseudomonas aeruginosa PA01
caguacccgcugguaauc

SEQ ID NO: 3378687 - RNA, 15 nt, Pseudomonas aeruginosa PA01
caguacccggccgcc

SEQ ID NO: 3378688 - RNA, 16 nt, Pseudomonas aeruginosa PA01
caguacccggccgccu

SEQ ID NO: 3378689 - RNA, 21 nt, Pseudomonas aeruginosa PA01
caguaccgccacguacagcgc

SEQ ID NO: 3378690 - RNA, 16 nt, Pseudomonas aeruginosa PA01
caguaccggcagcgcc

SEQ ID NO: 3378691 - RNA, 19 nt, Pseudomonas aeruginosa PA01
caguaccggcagcgccgag

SEQ ID NO: 3378692 - RNA, 16 nt, Pseudomonas aeruginosa PA01
caguacgucgagaccg

SEQ ID NO: 3378693 - RNA, 21 nt, Pseudomonas aeruginosa PA01
caguacguggcgcuugagcag

SEQ ID NO: 3378694 - RNA, 20 nt, Pseudomonas aeruginosa PA01
caguacucuggccauagaaa

SEQ ID NO: 3378695 - RNA, 12 nt, Pseudomonas aeruginosa PA01
caguagaagcag

SEQ ID NO: 3378696 - RNA, 20 nt, Pseudomonas aeruginosa PA01
caguagcgcuucgcgcagcu

SEQ ID NO: 3378697 - RNA, 15 nt, Pseudomonas aeruginosa PA01
caguagcggaagcac

SEQ ID NO: 3378698 - RNA, 19 nt, Pseudomonas aeruginosa PA01
caguagcggaagcacggcu

SEQ ID NO: 3378699 - RNA, 13 nt, Pseudomonas aeruginosa PA01
caguagcggcagg

SEQ ID NO: 3378700 - RNA, 16 nt, Pseudomonas aeruginosa PA01
caguagcucgccgagg

SEQ ID NO: 3378701 - RNA, 17 nt, Pseudomonas aeruginosa PA01
caguagcucgccgaggu

SEQ ID NO: 3378702 - RNA, 23 nt, Pseudomonas aeruginosa PA01
caguagcucgccgagguugcugc

SEQ ID NO: 3378703 - RNA, 15 nt, Pseudomonas aeruginosa PA01
caguaggccagcggc

SEQ ID NO: 3378704 - RNA, 18 nt, Pseudomonas aeruginosa PA01
caguagggggugaagcgc

SEQ ID NO: 3378705 - RNA, 22 nt, Pseudomonas aeruginosa PA01
caguagggggugaagcgcaggc

SEQ ID NO: 3378706 - RNA, 21 nt, Pseudomonas aeruginosa PA01
caguagguagagaugcagcag

SEQ ID NO: 3378707 - RNA, 19 nt, Pseudomonas aeruginosa PA01
caguaguccuccgcgccca

SEQ ID NO: 3378708 - RNA, 21 nt, Pseudomonas aeruginosa PA01
caguaguccuccgcgcccagg

SEQ ID NO: 3378709 - RNA, 22 nt, Pseudomonas aeruginosa PA01
caguaguccuccgcgcccaggc

SEQ ID NO: 3378710 - RNA, 15 nt, Pseudomonas aeruginosa PA01
caguagucuuccugg

SEQ ID NO: 3378711 - RNA, 12 nt, Pseudomonas aeruginosa PA01
caguauuucucg

SEQ ID NO: 3378712 - RNA, 20 nt, Pseudomonas aeruginosa PA01
caguauuucucgacuuccgc

SEQ ID NO: 3378713 - RNA, 15 nt, Pseudomonas aeruginosa PA01
cagucaccaggucgc

SEQ ID NO: 3378714 - RNA, 18 nt, Pseudomonas aeruginosa PA01
cagucaccaggucgcgga

SEQ ID NO: 3378715 - RNA, 17 nt, Pseudomonas aeruginosa PA01
cagucaggaucggcgcc

SEQ ID NO: 3378716 - RNA, 13 nt, Pseudomonas aeruginosa PA01
caguccaggccgu

SEQ ID NO: 3378717 - RNA, 18 nt, Pseudomonas aeruginosa PA01
cagucccagaaggccagg

SEQ ID NO: 3378718 - RNA, 19 nt, Pseudomonas aeruginosa PA01
cagucccagaaggccaggg

SEQ ID NO: 3378719 - RNA, 12 nt, Pseudomonas aeruginosa PA01
cagucccaggcc

SEQ ID NO: 3378720 - RNA, 17 nt, Pseudomonas aeruginosa PA01
cagucccaggccaacca

SEQ ID NO: 3378721 - RNA, 12 nt, Pseudomonas aeruginosa PA01
cagucccgcaaa

SEQ ID NO: 3378722 - RNA, 20 nt, Pseudomonas aeruginosa PA01
cagucccgcaaagcccgcuc

SEQ ID NO: 3378723 - RNA, 12 nt, Pseudomonas aeruginosa PA01
cagucccgccag

SEQ ID NO: 3378724 - RNA, 17 nt, Pseudomonas aeruginosa PA01
cagucccgccaggcgcc

SEQ ID NO: 3378725 - RNA, 15 nt, Pseudomonas aeruginosa PA01
cagucccgcgcggcc

SEQ ID NO: 3378726 - RNA, 20 nt, Pseudomonas aeruginosa PA01
cagucccgcgcggcccuucg

SEQ ID NO: 3378727 - RNA, 21 nt, Pseudomonas aeruginosa PA01
cagucccggcuugccggcagc

SEQ ID NO: 3378728 - RNA, 14 nt, Pseudomonas aeruginosa PA01
cagucccugccagg

SEQ ID NO: 3378729 - RNA, 17 nt, Pseudomonas aeruginosa PA01
cagucccuggccggcga

SEQ ID NO: 3378730 - RNA, 16 nt, Pseudomonas aeruginosa PA01
cagucccuucagcgca

SEQ ID NO: 3378731 - RNA, 19 nt, Pseudomonas aeruginosa PA01
cagucccuucagcgcaccg

SEQ ID NO: 3378732 - RNA, 19 nt, Pseudomonas aeruginosa PA01
cagucccuugaucagcgcg

SEQ ID NO: 3378733 - RNA, 16 nt, Pseudomonas aeruginosa PA01
caguccggcaccgcuc

SEQ ID NO: 3378734 - RNA, 16 nt, Pseudomonas aeruginosa PA01
caguccgguagcgcgc

SEQ ID NO: 3378735 - RNA, 16 nt, Pseudomonas aeruginosa PA01
caguccuggacccguu

SEQ ID NO: 3378736 - RNA, 21 nt, Pseudomonas aeruginosa PA01
caguccuggcgguagcccggc

SEQ ID NO: 3378737 - RNA, 15 nt, Pseudomonas aeruginosa PA01
caguccuugagcgcc

SEQ ID NO: 3378738 - RNA, 22 nt, Pseudomonas aeruginosa PA01
caguccuugagcgccagcaggu

SEQ ID NO: 3378739 - RNA, 21 nt, Pseudomonas aeruginosa PA01
cagucgaccgucgccacgcuc

SEQ ID NO: 3378740 - RNA, 16 nt, Pseudomonas aeruginosa PA01
cagucgagacgccagc

SEQ ID NO: 3378741 - RNA, 19 nt, Pseudomonas aeruginosa PA01
cagucgagacgccagccgc

SEQ ID NO: 3378742 - RNA, 20 nt, Pseudomonas aeruginosa PA01
cagucgagcaguucccccag

SEQ ID NO: 3378743 - RNA, 22 nt, Pseudomonas aeruginosa PA01
cagucgagguagaucauuuucc

SEQ ID NO: 3378744 - RNA, 13 nt, Pseudomonas aeruginosa PA01
cagucgaugacga

SEQ ID NO: 3378745 - RNA, 22 nt, Pseudomonas aeruginosa PA01
cagucgaugacgaggcccgccc

SEQ ID NO: 3378746 - RNA, 17 nt, Pseudomonas aeruginosa PA01
cagucgcagcucgguga

SEQ ID NO: 3378747 - RNA, 19 nt, Pseudomonas aeruginosa PA01
caguucgccccgccgccag

SEQ ID NO: 3378748 - RNA, 23 nt, Pseudomonas aeruginosa PA01
caguucgccccgccgccaggcgg

SEQ ID NO: 3378749 - RNA, 13 nt, Pseudomonas aeruginosa PA01
caguucgcccggc

SEQ ID NO: 3378750 - RNA, 14 nt, Pseudomonas aeruginosa PA01
caguucgcccggcu

SEQ ID NO: 3378751 - RNA, 13 nt, Pseudomonas aeruginosa PA01
caguucgccgccc

SEQ ID NO: 3378752 - RNA, 18 nt, Pseudomonas aeruginosa PA01
caguucgccgcccgaggc

SEQ ID NO: 3378753 - RNA, 20 nt, Pseudomonas aeruginosa PA01
caguucgccgcccgaggcga

SEQ ID NO: 3378754 - RNA, 17 nt, Pseudomonas aeruginosa PA01
caguucgccgccgagcg

SEQ ID NO: 3378755 - RNA, 23 nt, Pseudomonas aeruginosa PA01
caguucgccgccgagcgccuggc

SEQ ID NO: 3378756 - RNA, 13 nt, Pseudomonas aeruginosa PA01
caguucgccggcc

SEQ ID NO: 3378757 - RNA, 17 nt, Pseudomonas aeruginosa PA01
caguucgccggccagca

SEQ ID NO: 3378758 - RNA, 15 nt, Pseudomonas aeruginosa PA01
caguucgcgcggagu

SEQ ID NO: 3378759 - RNA, 14 nt, Pseudomonas aeruginosa PA01
caguucgcggcgca

SEQ ID NO: 3378760 - RNA, 23 nt, Pseudomonas aeruginosa PA01
caguucgcugacccagcgcacgc

SEQ ID NO: 3378761 - RNA, 17 nt, Pseudomonas aeruginosa PA01
caguucgcugccgccgc

SEQ ID NO: 3378762 - RNA, 20 nt, Pseudomonas aeruginosa PA01
caguucgcugccgccgcgcu

SEQ ID NO: 3378763 - RNA, 22 nt, Pseudomonas aeruginosa PA01
caguucgcugccgccgcgcugc

SEQ ID NO: 3378764 - RNA, 23 nt, Pseudomonas aeruginosa PA01
caguucgcugccgccgcgcugca

SEQ ID NO: 3378765 - RNA, 17 nt, Pseudomonas aeruginosa PA01
caguucggcccagcagc

SEQ ID NO: 3378766 - RNA, 13 nt, Pseudomonas aeruginosa PA01
caguucggccgcg

SEQ ID NO: 3378767 - RNA, 15 nt, Pseudomonas aeruginosa PA01
caguucggccgcggc

SEQ ID NO: 3378768 - RNA, 20 nt, Pseudomonas aeruginosa PA01
caguucggccgcggcuggca

SEQ ID NO: 3378769 - RNA, 14 nt, Pseudomonas aeruginosa PA01
caguucggcggugg

SEQ ID NO: 3378770 - RNA, 19 nt, Pseudomonas aeruginosa PA01
caguucggggucggccugc

SEQ ID NO: 3378771 - RNA, 21 nt, Pseudomonas aeruginosa PA01
caguucggugccgccggcgcc

SEQ ID NO: 3378772 - RNA, 20 nt, Pseudomonas aeruginosa PA01
caguucguccaucgccaggc

SEQ ID NO: 3378773 - RNA, 22 nt, Pseudomonas aeruginosa PA01
caguucguccaucgccaggcca

SEQ ID NO: 3378774 - RNA, 20 nt, Pseudomonas aeruginosa PA01
caguucgucgccacgcccgc

SEQ ID NO: 3378775 - RNA, 17 nt, Pseudomonas aeruginosa PA01
caguucgugccaggcga

SEQ ID NO: 3378776 - RNA, 14 nt, Pseudomonas aeruginosa PA01
caguucguugacca

SEQ ID NO: 3378777 - RNA, 20 nt, Pseudomonas aeruginosa PA01
caguucguugagggccuuga

SEQ ID NO: 3378778 - RNA, 16 nt, Pseudomonas aeruginosa PA01
caguucguugggccgg

SEQ ID NO: 3378779 - RNA, 13 nt, Pseudomonas aeruginosa PA01
caguucugggcgg

SEQ ID NO: 3378780 - RNA, 17 nt, Pseudomonas aeruginosa PA01
caguucuucgccgcccg

SEQ ID NO: 3378781 - RNA, 22 nt, Pseudomonas aeruginosa PA01
caguugaggcagguggcgcagc

SEQ ID NO: 3378782 - RNA, 19 nt, Pseudomonas aeruginosa PA01
caguugagucgcgcgcgcu

SEQ ID NO: 3378783 - RNA, 17 nt, Pseudomonas aeruginosa PA01
caguugcaacagcgcgg

SEQ ID NO: 3378784 - RNA, 20 nt, Pseudomonas aeruginosa PA01
caguugcaacagcgcggcgg

SEQ ID NO: 3378785 - RNA, 22 nt, Pseudomonas aeruginosa PA01
caguugcagcacccccagcagg

SEQ ID NO: 3378786 - RNA, 18 nt, Pseudomonas aeruginosa PA01
caguugcaggguggcgac

SEQ ID NO: 3378787 - RNA, 15 nt, Pseudomonas aeruginosa PA01
caguugccaggagga

SEQ ID NO: 3378788 - RNA, 23 nt, Pseudomonas aeruginosa PA01
caguugcccgagugccggcgcgu

SEQ ID NO: 3378789 - RNA, 15 nt, Pseudomonas aeruginosa PA01
caguugcccggccug

SEQ ID NO: 3378790 - RNA, 13 nt, Pseudomonas aeruginosa PA01
caguugccgagcu

SEQ ID NO: 3378791 - RNA, 16 nt, Pseudomonas aeruginosa PA01
caguugccgcagcagc

SEQ ID NO: 3378792 - RNA, 17 nt, Pseudomonas aeruginosa PA01
caguugccgcagcagcg

SEQ ID NO: 3378793 - RNA, 12 nt, Pseudomonas aeruginosa PA01
caguugccucug

SEQ ID NO: 3378794 - RNA, 18 nt, Pseudomonas aeruginosa PA01
caguugccucugugcggu

SEQ ID NO: 3378795 - RNA, 14 nt, Pseudomonas aeruginosa PA01
caguugcgccgccu

SEQ ID NO: 3378796 - RNA, 15 nt, Pseudomonas aeruginosa PA01
caguugcgcgccggc

SEQ ID NO: 3378797 - RNA, 18 nt, Pseudomonas aeruginosa PA01
caguugcgcgccggcggg

SEQ ID NO: 3378798 - RNA, 15 nt, Pseudomonas aeruginosa PA01
caguugcgcggcgag

SEQ ID NO: 3378799 - RNA, 12 nt, Pseudomonas aeruginosa PA01
caguugcucgcu

SEQ ID NO: 3378800 - RNA, 22 nt, Pseudomonas aeruginosa PA01
caguugcucgcuccgagcaggc

SEQ ID NO: 3378801 - RNA, 21 nt, Pseudomonas aeruginosa PA01
caguuucuucgcgugggccag

SEQ ID NO: 3378802 - RNA, 22 nt, Pseudomonas aeruginosa PA01
cauaaccccuuugccgagcgga

SEQ ID NO: 3378803 - RNA, 19 nt, Pseudomonas aeruginosa PA01
cauaacgccccucuuccac

SEQ ID NO: 3378804 - RNA, 17 nt, Pseudomonas aeruginosa PA01
cauacacaugcaggcuc

SEQ ID NO: 3378805 - RNA, 14 nt, Pseudomonas aeruginosa PA01
cauacaccaggccg

SEQ ID NO: 3378806 - RNA, 15 nt, Pseudomonas aeruginosa PA01
cauacaccaggccgg

SEQ ID NO: 3378807 - RNA, 12 nt, Pseudomonas aeruginosa PA01
cauacagcgccc

SEQ ID NO: 3378808 - RNA, 13 nt, Pseudomonas aeruginosa PA01
cauacaggcgcgc

SEQ ID NO: 3378809 - RNA, 18 nt, Pseudomonas aeruginosa PA01
cauacaggcgcgccuggc

SEQ ID NO: 3378810 - RNA, 20 nt, Pseudomonas aeruginosa PA01
cauacaggcgcgccuggccc

SEQ ID NO: 3378811 - RNA, 21 nt, Pseudomonas aeruginosa PA01
cauaccgacaugccccgccga

SEQ ID NO: 3378812 - RNA, 19 nt, Pseudomonas aeruginosa PA01
cauaccggcaaggcggccu

SEQ ID NO: 3378813 - RNA, 15 nt, Pseudomonas aeruginosa PA01
cauacuccgccgcuu

SEQ ID NO: 3378814 - RNA, 20 nt, Pseudomonas aeruginosa PA01
cauacucggacggcucgcgc

SEQ ID NO: 3378815 - RNA, 14 nt, Pseudomonas aeruginosa PA01
cauagaaacgcagg

SEQ ID NO: 3378816 - RNA, 14 nt, Pseudomonas aeruginosa PA01
cauagaccagcagc

SEQ ID NO: 3378817 - RNA, 15 nt, Pseudomonas aeruginosa PA01
cauagaccagcagcg

SEQ ID NO: 3378818 - RNA, 16 nt, Pseudomonas aeruginosa PA01
cauagaugccgcccug

SEQ ID NO: 3378819 - RNA, 17 nt, Pseudomonas aeruginosa PA01
cauagaugccgcccugc

SEQ ID NO: 3378820 - RNA, 23 nt, Pseudomonas aeruginosa PA01
cauagaugccgcccugcggcagg

SEQ ID NO: 3378821 - RNA, 17 nt, Pseudomonas aeruginosa PA01
cauagcagcgccgcgcc

SEQ ID NO: 3378822 - RNA, 23 nt, Pseudomonas aeruginosa PA01
cauagcagcgccgcgccugcugc

SEQ ID NO: 3378823 - RNA, 17 nt, Pseudomonas aeruginosa PA01
cauagccaccgccgaca

SEQ ID NO: 3378824 - RNA, 22 nt, Pseudomonas aeruginosa PA01
cauagccgaacuccgccagcac

SEQ ID NO: 3378825 - RNA, 15 nt, Pseudomonas aeruginosa PA01
cauagccggcgcgcc

SEQ ID NO: 3378826 - RNA, 16 nt, Pseudomonas aeruginosa PA01
cauagccggcgcgccc

SEQ ID NO: 3378827 - RNA, 19 nt, Pseudomonas aeruginosa PA01
cauagcgagccgcgcugcu

SEQ ID NO: 3378828 - RNA, 14 nt, Pseudomonas aeruginosa PA01
cauagcgcagcacc

SEQ ID NO: 3378829 - RNA, 12 nt, Pseudomonas aeruginosa PA01
cauagcgcagcc

SEQ ID NO: 3378830 - RNA, 15 nt, Pseudomonas aeruginosa PA01
cauagcgccggcacc

SEQ ID NO: 3378831 - RNA, 23 nt, Pseudomonas aeruginosa PA01
cauagcgcgcuguagccggcgcc

SEQ ID NO: 3378832 - RNA, 14 nt, Pseudomonas aeruginosa PA01
cauagcggccauug

SEQ ID NO: 3378833 - RNA, 13 nt, Pseudomonas aeruginosa PA01
cauagcggcugcu

SEQ ID NO: 3378834 - RNA, 16 nt, Pseudomonas aeruginosa PA01
cauagcggcugcuguc

SEQ ID NO: 3378835 - RNA, 16 nt, Pseudomonas aeruginosa PA01
cauagcucagcuggau

SEQ ID NO: 3378836 - RNA, 17 nt, Pseudomonas aeruginosa PA01
cauagcucagcuggaua

SEQ ID NO: 3378837 - RNA, 18 nt, Pseudomonas aeruginosa PA01
cauaggacugccaacugg

SEQ ID NO: 3378838 - RNA, 22 nt, Pseudomonas aeruginosa PA01
cauaggacugccaacuggcguc

SEQ ID NO: 3378839 - RNA, 18 nt, Pseudomonas aeruginosa PA01
cauaggaggcgcuuuccc

SEQ ID NO: 3378840 - RNA, 14 nt, Pseudomonas aeruginosa PA01
cauaggccagcacc

SEQ ID NO: 3378841 - RNA, 20 nt, Pseudomonas aeruginosa PA01
cauaggccagcaccucgacg

SEQ ID NO: 3378842 - RNA, 16 nt, Pseudomonas aeruginosa PA01
cauaggcccggcgugc

SEQ ID NO: 3378843 - RNA, 18 nt, Pseudomonas aeruginosa PA01
cauaggcccggcgugccg

SEQ ID NO: 3378844 - RNA, 16 nt, Pseudomonas aeruginosa PA01
cauaggcuugcgccga

SEQ ID NO: 3378845 - RNA, 12 nt, Pseudomonas aeruginosa PA01
cauaggucaggu

SEQ ID NO: 3378846 - RNA, 15 nt, Pseudomonas aeruginosa PA01
cauaggucagguaca

SEQ ID NO: 3378847 - RNA, 16 nt, Pseudomonas aeruginosa PA01
cauaggucaugcccag

SEQ ID NO: 3378848 - RNA, 15 nt, Pseudomonas aeruginosa PA01
cauaguagagaugca

SEQ ID NO: 3378849 - RNA, 16 nt, Pseudomonas aeruginosa PA01
cauaguagagaugcac

SEQ ID NO: 3378850 - RNA, 13 nt, Pseudomonas aeruginosa PA01
cauccgccgcugg

SEQ ID NO: 3378851 - RNA, 14 nt, Pseudomonas aeruginosa PA01
cauccgccgcuggg

SEQ ID NO: 3378852 - RNA, 20 nt, Pseudomonas aeruginosa PA01
cauccgccgcuggggaccgc

SEQ ID NO: 3378853 - RNA, 15 nt, Pseudomonas aeruginosa PA01
cauccgccggcgcgu

SEQ ID NO: 3378854 - RNA, 17 nt, Pseudomonas aeruginosa PA01
cauccgcgccgaccagc

SEQ ID NO: 3378855 - RNA, 12 nt, Pseudomonas aeruginosa PA01
cauccgcggccc

SEQ ID NO: 3378856 - RNA, 16 nt, Pseudomonas aeruginosa PA01
cauccgcggccccggc

SEQ ID NO: 3378857 - RNA, 16 nt, Pseudomonas aeruginosa PA01
cauccgcucggcgagu

SEQ ID NO: 3378858 - RNA, 23 nt, Pseudomonas aeruginosa PA01
cauccgcugguagcccaggccga

SEQ ID NO: 3378859 - RNA, 21 nt, Pseudomonas aeruginosa PA01
cauccggaguucgcccgcccc

SEQ ID NO: 3378860 - RNA, 21 nt, Pseudomonas aeruginosa PA01
cauccggccaugucccgggug

SEQ ID NO: 3378861 - RNA, 14 nt, Pseudomonas aeruginosa PA01
cauccggcucgacg

SEQ ID NO: 3378862 - RNA, 21 nt, Pseudomonas aeruginosa PA01
cauccguaaaauggcgcgccu

SEQ ID NO: 3378863 - RNA, 14 nt, Pseudomonas aeruginosa PA01
cauccgugcugggg

SEQ ID NO: 3378864 - RNA, 13 nt, Pseudomonas aeruginosa PA01
cauccuccagcac

SEQ ID NO: 3378865 - RNA, 15 nt, Pseudomonas aeruginosa PA01
cauccuccagcacua

SEQ ID NO: 3378866 - RNA, 14 nt, Pseudomonas aeruginosa PA01
cauccuccagcgcc

SEQ ID NO: 3378867 - RNA, 16 nt, Pseudomonas aeruginosa PA01
cauccuccagcgccgc

SEQ ID NO: 3378868 - RNA, 17 nt, Pseudomonas aeruginosa PA01
cauccuccagcgccgca

SEQ ID NO: 3378869 - RNA, 13 nt, Pseudomonas aeruginosa PA01
cauccucccugcc

SEQ ID NO: 3378870 - RNA, 16 nt, Pseudomonas aeruginosa PA01
cauccucccugcccgc

SEQ ID NO: 3378871 - RNA, 18 nt, Pseudomonas aeruginosa PA01
cauccucccugcccgcuc

SEQ ID NO: 3378872 - RNA, 23 nt, Pseudomonas aeruginosa PA01
cauccucccugcccgcucggggc

SEQ ID NO: 3378873 - RNA, 19 nt, Pseudomonas aeruginosa PA01
cauccuccgaggccaccac

SEQ ID NO: 3378874 - RNA, 17 nt, Pseudomonas aeruginosa PA01
cauccucgccccgccgg

SEQ ID NO: 3378875 - RNA, 16 nt, Pseudomonas aeruginosa PA01
cauccucgccgcuggc

SEQ ID NO: 3378876 - RNA, 17 nt, Pseudomonas aeruginosa PA01
cauccucgccgcuggcg

SEQ ID NO: 3378877 - RNA, 20 nt, Pseudomonas aeruginosa PA01
cauccucgccgcuggcgcug

SEQ ID NO: 3378878 - RNA, 12 nt, Pseudomonas aeruginosa PA01
cauccucgccgg

SEQ ID NO: 3378879 - RNA, 22 nt, Pseudomonas aeruginosa PA01
cauccucguuccacgggucgca

SEQ ID NO: 3378880 - RNA, 20 nt, Pseudomonas aeruginosa PA01
cauccugaaaagcgcugcgg

SEQ ID NO: 3378881 - RNA, 17 nt, Pseudomonas aeruginosa PA01
cauccugccgccuguuc

SEQ ID NO: 3378882 - RNA, 18 nt, Pseudomonas aeruginosa PA01
cauccugcgcgccucuuc

SEQ ID NO: 3378883 - RNA, 23 nt, Pseudomonas aeruginosa PA01
cauccugcgcgccucuuccugga

SEQ ID NO: 3378884 - RNA, 14 nt, Pseudomonas aeruginosa PA01
cauccugucgaggc

SEQ ID NO: 3378885 - RNA, 15 nt, Pseudomonas aeruginosa PA01
cauccugucgaggcc

SEQ ID NO: 3378886 - RNA, 19 nt, Pseudomonas aeruginosa PA01
cauccuuggucagggugcc

SEQ ID NO: 3378887 - RNA, 15 nt, Pseudomonas aeruginosa PA01
caucgaaaucgccca

SEQ ID NO: 3378888 - RNA, 20 nt, Pseudomonas aeruginosa PA01
caucgaaaugccgcacccca

SEQ ID NO: 3378889 - RNA, 13 nt, Pseudomonas aeruginosa PA01
caucgaaggcgcc

SEQ ID NO: 3378890 - RNA, 16 nt, Pseudomonas aeruginosa PA01
caucgaaggcgccggc

SEQ ID NO: 3378891 - RNA, 17 nt, Pseudomonas aeruginosa PA01
caucgaaggcgccggca

SEQ ID NO: 3378892 - RNA, 18 nt, Pseudomonas aeruginosa PA01
caucgaaggcgccggcau

SEQ ID NO: 3378893 - RNA, 19 nt, Pseudomonas aeruginosa PA01
caucgaaggcgccggcaug

SEQ ID NO: 3378894 - RNA, 13 nt, Pseudomonas aeruginosa PA01
caucgacaccccg

SEQ ID NO: 3378895 - RNA, 23 nt, Pseudomonas aeruginosa PA01
caucgacaccccggucaggccga

SEQ ID NO: 3378896 - RNA, 18 nt, Pseudomonas aeruginosa PA01
caucgacagggucgucug

SEQ ID NO: 3378897 - RNA, 12 nt, Pseudomonas aeruginosa PA01
caucgaccagca

SEQ ID NO: 3378898 - RNA, 23 nt, Pseudomonas aeruginosa PA01
caucgaccaggaauuccuggccg

SEQ ID NO: 3378899 - RNA, 15 nt, Pseudomonas aeruginosa PA01
caucgaccagggccg

SEQ ID NO: 3378900 - RNA, 20 nt, Pseudomonas aeruginosa PA01
caucgaccagggccgggucg

SEQ ID NO: 3378901 - RNA, 17 nt, Pseudomonas aeruginosa PA01
caucgaccaugccguag

SEQ ID NO: 3378902 - RNA, 18 nt, Pseudomonas aeruginosa PA01
caucgaccuugcccucgg

SEQ ID NO: 3378903 - RNA, 21 nt, Pseudomonas aeruginosa PA01
caucgacgauguacugcucgg

SEQ ID NO: 3378904 - RNA, 12 nt, Pseudomonas aeruginosa PA01
caucgacgccag

SEQ ID NO: 3378905 - RNA, 15 nt, Pseudomonas aeruginosa PA01
caucgacgcccucgg

SEQ ID NO: 3378906 - RNA, 17 nt, Pseudomonas aeruginosa PA01
caucgacgcccucggcg

SEQ ID NO: 3378907 - RNA, 18 nt, Pseudomonas aeruginosa PA01
caucgagaacaggugggu

SEQ ID NO: 3378908 - RNA, 13 nt, Pseudomonas aeruginosa PA01
caucgagcaggua

SEQ ID NO: 3378909 - RNA, 15 nt, Pseudomonas aeruginosa PA01
caucgagcaguucca

SEQ ID NO: 3378910 - RNA, 18 nt, Pseudomonas aeruginosa PA01
caucgagcaguuccaggc

SEQ ID NO: 3378911 - RNA, 20 nt, Pseudomonas aeruginosa PA01
caucgagcaguuccaggcgu

SEQ ID NO: 3378912 - RNA, 14 nt, Pseudomonas aeruginosa PA01
caucgagcgcucca

SEQ ID NO: 3378913 - RNA, 20 nt, Pseudomonas aeruginosa PA01
caucgagcgcuccaccgcgc

SEQ ID NO: 3378914 - RNA, 15 nt, Pseudomonas aeruginosa PA01
caucgagcggcggcc

SEQ ID NO: 3378915 - RNA, 19 nt, Pseudomonas aeruginosa PA01
caucgagcggcggccgucg

SEQ ID NO: 3378916 - RNA, 21 nt, Pseudomonas aeruginosa PA01
caucgagcggcggccgucgcu

SEQ ID NO: 3378917 - RNA, 22 nt, Pseudomonas aeruginosa PA01
caucgagcggcggccgucgcug

SEQ ID NO: 3378918 - RNA, 16 nt, Pseudomonas aeruginosa PA01
caucgaggccaggccg

SEQ ID NO: 3378919 - RNA, 21 nt, Pseudomonas aeruginosa PA01
caucgaggccaggccgagcgc

SEQ ID NO: 3378920 - RNA, 21 nt, Pseudomonas aeruginosa PA01
caucgaggccauccccgaggc

SEQ ID NO: 3378921 - RNA, 15 nt, Pseudomonas aeruginosa PA01
caucgaggccgccca

SEQ ID NO: 3378922 - RNA, 16 nt, Pseudomonas aeruginosa PA01
caucgaggccgcccag

SEQ ID NO: 3378923 - RNA, 17 nt, Pseudomonas aeruginosa PA01
caucgaggccgcccagc

SEQ ID NO: 3378924 - RNA, 15 nt, Pseudomonas aeruginosa PA01
caucgaggccggcau

SEQ ID NO: 3378925 - RNA, 17 nt, Pseudomonas aeruginosa PA01
caucgaggccggcaugc

SEQ ID NO: 3378926 - RNA, 22 nt, Pseudomonas aeruginosa PA01
caucgauaacaccaggagcgcc

SEQ ID NO: 3378927 - RNA, 14 nt, Pseudomonas aeruginosa PA01
caucgaucagcagc

SEQ ID NO: 3378928 - RNA, 22 nt, Pseudomonas aeruginosa PA01
caucgauccgcacccgggcaac

SEQ ID NO: 3378929 - RNA, 14 nt, Pseudomonas aeruginosa PA01
caucgaugccuugc

SEQ ID NO: 3378930 - RNA, 14 nt, Pseudomonas aeruginosa PA01
caucgauggucagg

SEQ ID NO: 3378931 - RNA, 22 nt, Pseudomonas aeruginosa PA01
caucgauggucaggcuggcccc

SEQ ID NO: 3378932 - RNA, 16 nt, Pseudomonas aeruginosa PA01
caucgcauagccggcg

SEQ ID NO: 3378933 - RNA, 16 nt, Pseudomonas aeruginosa PA01
caucgcaucggcgacc

SEQ ID NO: 3378934 - RNA, 12 nt, Pseudomonas aeruginosa PA01
caucgcaucggu

SEQ ID NO: 3378935 - RNA, 19 nt, Pseudomonas aeruginosa PA01
caucgccaccagcaggaag

SEQ ID NO: 3378936 - RNA, 23 nt, Pseudomonas aeruginosa PA01
caucgccaccgguacgcucacca

SEQ ID NO: 3378937 - RNA, 13 nt, Pseudomonas aeruginosa PA01
caucgccagcgcc

SEQ ID NO: 3378938 - RNA, 15 nt, Pseudomonas aeruginosa PA01
caucgccagcgccac

SEQ ID NO: 3378939 - RNA, 20 nt, Pseudomonas aeruginosa PA01
caucgccagcgccacgguga

SEQ ID NO: 3378940 - RNA, 17 nt, Pseudomonas aeruginosa PA01
caucgccaggccauuga

SEQ ID NO: 3378941 - RNA, 14 nt, Pseudomonas aeruginosa PA01
caucgccagggucu

SEQ ID NO: 3378942 - RNA, 16 nt, Pseudomonas aeruginosa PA01
caucgccagggucuug

SEQ ID NO: 3378943 - RNA, 19 nt, Pseudomonas aeruginosa PA01
caucgcccauugccgggcu

SEQ ID NO: 3378944 - RNA, 13 nt, Pseudomonas aeruginosa PA01
caucgcccgcagc

SEQ ID NO: 3378945 - RNA, 24 nt, Pseudomonas aeruginosa PA01
caucgcccgcagccacaggcgcca

SEQ ID NO: 3378946 - RNA, 19 nt, Pseudomonas aeruginosa PA01
caucgcccgcccucgucgc

SEQ ID NO: 3378947 - RNA, 21 nt, Pseudomonas aeruginosa PA01
caucgcccggcagcaggccgc

SEQ ID NO: 3378948 - RNA, 20 nt, Pseudomonas aeruginosa PA01
caucgccgaagacgccuguc

SEQ ID NO: 3378949 - RNA, 14 nt, Pseudomonas aeruginosa PA01
caucgccgcggaaa

SEQ ID NO: 3378950 - RNA, 23 nt, Pseudomonas aeruginosa PA01
caucgccgcggaaaacgccgcga

SEQ ID NO: 3378951 - RNA, 14 nt, Pseudomonas aeruginosa PA01
caucgccgcggcga

SEQ ID NO: 3378952 - RNA, 15 nt, Pseudomonas aeruginosa PA01
caucgccgcggcgaa

SEQ ID NO: 3378953 - RNA, 20 nt, Pseudomonas aeruginosa PA01
caugccgaacuucuccgcca

SEQ ID NO: 3378954 - RNA, 13 nt, Pseudomonas aeruginosa PA01
caugccgaagagc

SEQ ID NO: 3378955 - RNA, 17 nt, Pseudomonas aeruginosa PA01
caugccgagcaucagcg

SEQ ID NO: 3378956 - RNA, 13 nt, Pseudomonas aeruginosa PA01
caugccgaggaac

SEQ ID NO: 3378957 - RNA, 20 nt, Pseudomonas aeruginosa PA01
caugccgaggaacgccgaca

SEQ ID NO: 3378958 - RNA, 20 nt, Pseudomonas aeruginosa PA01
caugccgcaagcuccccgcc

SEQ ID NO: 3378959 - RNA, 22 nt, Pseudomonas aeruginosa PA01
caugccgcaagcuccccgccgc

SEQ ID NO: 3378960 - RNA, 18 nt, Pseudomonas aeruginosa PA01
caugccgccaucgaccag

SEQ ID NO: 3378961 - RNA, 20 nt, Pseudomonas aeruginosa PA01
caugccgccaucgaccagga

SEQ ID NO: 3378962 - RNA, 22 nt, Pseudomonas aeruginosa PA01
caugccgccaucgaccaggaau

SEQ ID NO: 3378963 - RNA, 17 nt, Pseudomonas aeruginosa PA01
caugccgcccggccgcu

SEQ ID NO: 3378964 - RNA, 14 nt, Pseudomonas aeruginosa PA01
caugccgccgacgc

SEQ ID NO: 3378965 - RNA, 20 nt, Pseudomonas aeruginosa PA01
caugccgccgucgcggccau

SEQ ID NO: 3378966 - RNA, 19 nt, Pseudomonas aeruginosa PA01
caugccgcucugccagaag

SEQ ID NO: 3378967 - RNA, 20 nt, Pseudomonas aeruginosa PA01
caugccgcucugccagaagg

SEQ ID NO: 3378968 - RNA, 17 nt, Pseudomonas aeruginosa PA01
caugccggccaggaagg

SEQ ID NO: 3378969 - RNA, 22 nt, Pseudomonas aeruginosa PA01
caugccggccaggaaggccgcu

SEQ ID NO: 3378970 - RNA, 16 nt, Pseudomonas aeruginosa PA01
caugccggccgucgcg

SEQ ID NO: 3378971 - RNA, 13 nt, Pseudomonas aeruginosa PA01
caugccggggucc

SEQ ID NO: 3378972 - RNA, 19 nt, Pseudomonas aeruginosa PA01
caugccgguucccgcagcg

SEQ ID NO: 3378973 - RNA, 17 nt, Pseudomonas aeruginosa PA01
caugccguagaucagga

SEQ ID NO: 3378974 - RNA, 19 nt, Pseudomonas aeruginosa PA01
caugccguagaucaggacg

SEQ ID NO: 3378975 - RNA, 18 nt, Pseudomonas aeruginosa PA01
caugccgugggcgccgcc

SEQ ID NO: 3378976 - RNA, 16 nt, Pseudomonas aeruginosa PA01
caugccguucagcguc

SEQ ID NO: 3378977 - RNA, 21 nt, Pseudomonas aeruginosa PA01
caugccguucaggccggcgcc

SEQ ID NO: 3378978 - RNA, 15 nt, Pseudomonas aeruginosa PA01
caugccguugggcca

SEQ ID NO: 3378979 - RNA, 18 nt, Pseudomonas aeruginosa PA01
caugccguugggccaggg

SEQ ID NO: 3378980 - RNA, 15 nt, Pseudomonas aeruginosa PA01
caugccuagcacccg

SEQ ID NO: 3378981 - RNA, 12 nt, Pseudomonas aeruginosa PA01
caugccuccgac

SEQ ID NO: 3378982 - RNA, 17 nt, Pseudomonas aeruginosa PA01
caugccuuccaccggcg

SEQ ID NO: 3378983 - RNA, 14 nt, Pseudomonas aeruginosa PA01
caugccuugcagcg

SEQ ID NO: 3378984 - RNA, 17 nt, Pseudomonas aeruginosa PA01
caugccuugcagcgcca

SEQ ID NO: 3378985 - RNA, 17 nt, Pseudomonas aeruginosa PA01
caugcgaaaacggcgac

SEQ ID NO: 3378986 - RNA, 22 nt, Pseudomonas aeruginosa PA01
caugcgaaaacggcgacccugg

SEQ ID NO: 3378987 - RNA, 23 nt, Pseudomonas aeruginosa PA01
caugcgaaaacggcgacccuggg

SEQ ID NO: 3378988 - RNA, 14 nt, Pseudomonas aeruginosa PA01
caugcgcagcgcgu

SEQ ID NO: 3378989 - RNA, 16 nt, Pseudomonas aeruginosa PA01
caugcgcggcaggaaa

SEQ ID NO: 3378990 - RNA, 23 nt, Pseudomonas aeruginosa PA01
caugcgcggcaggaaauccgccg

SEQ ID NO: 3378991 - RNA, 11 nt, Pseudomonas aeruginosa PA01
caugcgcggcg

SEQ ID NO: 3378992 - RNA, 12 nt, Pseudomonas aeruginosa PA01
caugcgcggcga

SEQ ID NO: 3378993 - RNA, 21 nt, Pseudomonas aeruginosa PA01
caugcgcggcguaccuucgag

SEQ ID NO: 3378994 - RNA, 23 nt, Pseudomonas aeruginosa PA01
caugcgcguguugcgccgcacca

SEQ ID NO: 3378995 - RNA, 18 nt, Pseudomonas aeruginosa PA01
caugcgcugguagcgcuc

SEQ ID NO: 3378996 - RNA, 21 nt, Pseudomonas aeruginosa PA01
caugcgcugguagcgcuccag

SEQ ID NO: 3378997 - RNA, 13 nt, Pseudomonas aeruginosa PA01
caugcggaacacc

SEQ ID NO: 3378998 - RNA, 18 nt, Pseudomonas aeruginosa PA01
caugcggaacaccgccug

SEQ ID NO: 3378999 - RNA, 20 nt, Pseudomonas aeruginosa PA01
caugcggaacaccgccugga

SEQ ID NO: 3379000 - RNA, 17 nt, Pseudomonas aeruginosa PA01
caugcggaagcagccau

SEQ ID NO: 3379001 - RNA, 17 nt, Pseudomonas aeruginosa PA01
caugcggcaggccuucc

SEQ ID NO: 3379002 - RNA, 20 nt, Pseudomonas aeruginosa PA01
caugcggcaggccuuccacg

SEQ ID NO: 3379003 - RNA, 23 nt, Pseudomonas aeruginosa PA01
caugcggcaggccuuccacgccu

SEQ ID NO: 3379004 - RNA, 13 nt, Pseudomonas aeruginosa PA01
caugcggccccgg

SEQ ID NO: 3379005 - RNA, 16 nt, Pseudomonas aeruginosa PA01
caugcggccccggcgc

SEQ ID NO: 3379006 - RNA, 17 nt, Pseudomonas aeruginosa PA01
caugcggccccggcgcu

SEQ ID NO: 3379007 - RNA, 18 nt, Pseudomonas aeruginosa PA01
caugcggcuacucgcccg

SEQ ID NO: 3379008 - RNA, 19 nt, Pseudomonas aeruginosa PA01
caugcggcuacucgcccga

SEQ ID NO: 3379009 - RNA, 15 nt, Pseudomonas aeruginosa PA01
caugcgggagagcgc

SEQ ID NO: 3379010 - RNA, 18 nt, Pseudomonas aeruginosa PA01
caugcgggagagcgccgu

SEQ ID NO: 3379011 - RNA, 16 nt, Pseudomonas aeruginosa PA01
caugcgugcgauucag

SEQ ID NO: 3379012 - RNA, 21 nt, Pseudomonas aeruginosa PA01
caugcgugcgauucagaugcg

SEQ ID NO: 3379013 - RNA, 23 nt, Pseudomonas aeruginosa PA01
caugcgugcgggaacgaugccgc

SEQ ID NO: 3379014 - RNA, 15 nt, Pseudomonas aeruginosa PA01
caugcucacugcgag

SEQ ID NO: 3379015 - RNA, 15 nt, Pseudomonas aeruginosa PA01
caugcucagccgcgc

SEQ ID NO: 3379016 - RNA, 15 nt, Pseudomonas aeruginosa PA01
caugcuccgccuggc

SEQ ID NO: 3379017 - RNA, 18 nt, Pseudomonas aeruginosa PA01
caugcuccgccuggcgga

SEQ ID NO: 3379018 - RNA, 22 nt, Pseudomonas aeruginosa PA01
caugcucggccagcucgccgaa

SEQ ID NO: 3379019 - RNA, 19 nt, Pseudomonas aeruginosa PA01
caugcucgggguuuccucg

SEQ ID NO: 3379020 - RNA, 20 nt, Pseudomonas aeruginosa PA01
caugcucgggguuuccucga

SEQ ID NO: 3379021 - RNA, 17 nt, Pseudomonas aeruginosa PA01
caugcugcgcgggacgc

SEQ ID NO: 3379022 - RNA, 14 nt, Pseudomonas aeruginosa PA01
caugcugcucggca

SEQ ID NO: 3379023 - RNA, 12 nt, Pseudomonas aeruginosa PA01
caugcuggcgcu

SEQ ID NO: 3379024 - RNA, 20 nt, Pseudomonas aeruginosa PA01
caugcugggucuccgcucgg

SEQ ID NO: 3379025 - RNA, 19 nt, Pseudomonas aeruginosa PA01
caugcuguugcacuugccg

SEQ ID NO: 3379026 - RNA, 17 nt, Pseudomonas aeruginosa PA01
caugcuguugccguggc

SEQ ID NO: 3379027 - RNA, 22 nt, Pseudomonas aeruginosa PA01
caugcuugccgguuuguugcag

SEQ ID NO: 3379028 - RNA, 20 nt, Pseudomonas aeruginosa PA01
caugcuuuugaacaccagcg

SEQ ID NO: 3379029 - RNA, 17 nt, Pseudomonas aeruginosa PA01
cauggaaaccccggccu

SEQ ID NO: 3379030 - RNA, 19 nt, Pseudomonas aeruginosa PA01
cauggaaaccccggccugg

SEQ ID NO: 3379031 - RNA, 15 nt, Pseudomonas aeruginosa PA01
cauggaacagcagcc

SEQ ID NO: 3379032 - RNA, 21 nt, Pseudomonas aeruginosa PA01
cauggaacagcagccaggcga

SEQ ID NO: 3379033 - RNA, 18 nt, Pseudomonas aeruginosa PA01
cauggacaggucgacggc

SEQ ID NO: 3379034 - RNA, 19 nt, Pseudomonas aeruginosa PA01
cauggacaggucgacggcc

SEQ ID NO: 3379035 - RNA, 19 nt, Pseudomonas aeruginosa PA01
cauggaccgagaccgacgc

SEQ ID NO: 3379036 - RNA, 23 nt, Pseudomonas aeruginosa PA01
cauggaccgagaccgacgcucgc

SEQ ID NO: 3379037 - RNA, 17 nt, Pseudomonas aeruginosa PA01
cauggagacggcccgcc

SEQ ID NO: 3379038 - RNA, 18 nt, Pseudomonas aeruginosa PA01
cauggagacggcccgccc

SEQ ID NO: 3379039 - RNA, 14 nt, Pseudomonas aeruginosa PA01
cauggagcaacagc

SEQ ID NO: 3379040 - RNA, 17 nt, Pseudomonas aeruginosa PA01
cauggagcaacagcguc

SEQ ID NO: 3379041 - RNA, 21 nt, Pseudomonas aeruginosa PA01
cauggagcaacagcgucgcca

SEQ ID NO: 3379042 - RNA, 22 nt, Pseudomonas aeruginosa PA01
cauggagcaacagcgucgccaa

SEQ ID NO: 3379043 - RNA, 12 nt, Pseudomonas aeruginosa PA01
cauggaucggca

SEQ ID NO: 3379044 - RNA, 18 nt, Pseudomonas aeruginosa PA01
cauggcaccgucaagggc

SEQ ID NO: 3379045 - RNA, 14 nt, Pseudomonas aeruginosa PA01
cauggcacgcaggg

SEQ ID NO: 3379046 - RNA, 22 nt, Pseudomonas aeruginosa PA01
cauggccaccgaaucggacagg

SEQ ID NO: 3379047 - RNA, 15 nt, Pseudomonas aeruginosa PA01
cauggccagcucgac

SEQ ID NO: 3379048 - RNA, 22 nt, Pseudomonas aeruginosa PA01
cauggccagcucgaccuugccc

SEQ ID NO: 3379049 - RNA, 22 nt, Pseudomonas aeruginosa PA01
cauggccgagcccagcggcagg

SEQ ID NO: 3379050 - RNA, 16 nt, Pseudomonas aeruginosa PA01
cauggccgcagcggcu

SEQ ID NO: 3379051 - RNA, 11 nt, Pseudomonas aeruginosa PA01
cauggccggcu

SEQ ID NO: 3379052 - RNA, 13 nt, Pseudomonas aeruginosa PA01
cauggccuggcgc

SEQ ID NO: 3379053 - RNA, 14 nt, Pseudomonas aeruginosa PA01
cauggccuggcgcu

SEQ ID NO: 3379054 - RNA, 15 nt, Pseudomonas aeruginosa PA01
cauggccuggcgcuc

SEQ ID NO: 3379055 - RNA, 22 nt, Pseudomonas aeruginosa PA01
cauucguccagccgccgcugca

SEQ ID NO: 3379056 - RNA, 13 nt, Pseudomonas aeruginosa PA01
cauucgucgccgc

SEQ ID NO: 3379057 - RNA, 18 nt, Pseudomonas aeruginosa PA01
cauucuccagccgcaccc

SEQ ID NO: 3379058 - RNA, 17 nt, Pseudomonas aeruginosa PA01
cauucucccucgccgac

SEQ ID NO: 3379059 - RNA, 20 nt, Pseudomonas aeruginosa PA01
cauucucccucgccgaccgc

SEQ ID NO: 3379060 - RNA, 22 nt, Pseudomonas aeruginosa PA01
cauucucucuucagcaggggga

SEQ ID NO: 3379061 - RNA, 21 nt, Pseudomonas aeruginosa PA01
cauucuggaugcagccggggc

SEQ ID NO: 3379062 - RNA, 15 nt, Pseudomonas aeruginosa PA01
cauucuucuccagaa

SEQ ID NO: 3379063 - RNA, 17 nt, Pseudomonas aeruginosa PA01
cauugaaaacggcgccc

SEQ ID NO: 3379064 - RNA, 17 nt, Pseudomonas aeruginosa PA01
cauugaaaucaucggcc

SEQ ID NO: 3379065 - RNA, 19 nt, Pseudomonas aeruginosa PA01
cauugaaggccgacaccuc

SEQ ID NO: 3379066 - RNA, 22 nt, Pseudomonas aeruginosa PA01
cauugcacuuccacuccaggcg

SEQ ID NO: 3379067 - RNA, 23 nt, Pseudomonas aeruginosa PA01
cauugccaccaccaugccuucca

SEQ ID NO: 3379068 - RNA, 21 nt, Pseudomonas aeruginosa PA01
cauugcccgguggccuccugc

SEQ ID NO: 3379069 - RNA, 18 nt, Pseudomonas aeruginosa PA01
cauugccgaugugcacgc

SEQ ID NO: 3379070 - RNA, 14 nt, Pseudomonas aeruginosa PA01
cauugccgccaggu

SEQ ID NO: 3379071 - RNA, 21 nt, Pseudomonas aeruginosa PA01
cauugccgggcuuccuggccg

SEQ ID NO: 3379072 - RNA, 23 nt, Pseudomonas aeruginosa PA01
cauugccgggcuuccuggccggg

SEQ ID NO: 3379073 - RNA, 23 nt, Pseudomonas aeruginosa PA01
cauugcgccgccggcuccuugcg

SEQ ID NO: 3379074 - RNA, 21 nt, Pseudomonas aeruginosa PA01
cauugcgcuccgacuccugca

SEQ ID NO: 3379075 - RNA, 23 nt, Pseudomonas aeruginosa PA01
cauugcgcuccgacuccugcaac

SEQ ID NO: 3379076 - RNA, 16 nt, Pseudomonas aeruginosa PA01
cauugcugccgaggcc

SEQ ID NO: 3379077 - RNA, 17 nt, Pseudomonas aeruginosa PA01
cauugcugccgaggccg

SEQ ID NO: 3379078 - RNA, 15 nt, Pseudomonas aeruginosa PA01
cauuggcacccugga

SEQ ID NO: 3379079 - RNA, 15 nt, Pseudomonas aeruginosa PA01
cauuggccaucagcg

SEQ ID NO: 3379080 - RNA, 16 nt, Pseudomonas aeruginosa PA01
cauuggccgacgccgc

SEQ ID NO: 3379081 - RNA, 22 nt, Pseudomonas aeruginosa PA01
cauuggcgaaguugccgccgcu

SEQ ID NO: 3379082 - RNA, 16 nt, Pseudomonas aeruginosa PA01
cauuggcgcgucggug

SEQ ID NO: 3379083 - RNA, 13 nt, Pseudomonas aeruginosa PA01
cauugggcagcca

SEQ ID NO: 3379084 - RNA, 15 nt, Pseudomonas aeruginosa PA01
cauugggcagccacg

SEQ ID NO: 3379085 - RNA, 16 nt, Pseudomonas aeruginosa PA01
cauugggcagccacga

SEQ ID NO: 3379086 - RNA, 19 nt, Pseudomonas aeruginosa PA01
cauuggugcugcgcgcggc

SEQ ID NO: 3379087 - RNA, 20 nt, Pseudomonas aeruginosa PA01
cauuggugcugcgcgcggcc

SEQ ID NO: 3379088 - RNA, 14 nt, Pseudomonas aeruginosa PA01
cauugucccugcgg

SEQ ID NO: 3379089 - RNA, 16 nt, Pseudomonas aeruginosa PA01
cauuguugcggucgcg

SEQ ID NO: 3379090 - RNA, 21 nt, Pseudomonas aeruginosa PA01
cauuguugcggucgcgcccgc

SEQ ID NO: 3379091 - RNA, 13 nt, Pseudomonas aeruginosa PA01
cauuuccuccgag

SEQ ID NO: 3379092 - RNA, 20 nt, Pseudomonas aeruginosa PA01
cauuuccugggugccgcgaa

SEQ ID NO: 3379093 - RNA, 15 nt, Pseudomonas aeruginosa PA01
cauuucgaagcuguc

SEQ ID NO: 3379094 - RNA, 13 nt, Pseudomonas aeruginosa PA01
cauuucguugcgc

SEQ ID NO: 3379095 - RNA, 21 nt, Pseudomonas aeruginosa PA01
cauuuucagcggaguucguca

SEQ ID NO: 3379096 - RNA, 20 nt, Pseudomonas aeruginosa PA01
cauuuucgcgcucagcgcga

SEQ ID NO: 3379097 - RNA, 13 nt, Pseudomonas aeruginosa PA01
ccaaaaaaagccc

SEQ ID NO: 3379098 - RNA, 16 nt, Pseudomonas aeruginosa PA01
ccaaagaaaaggcccg

SEQ ID NO: 3379099 - RNA, 17 nt, Pseudomonas aeruginosa PA01
ccaaagccuggagcagg

SEQ ID NO: 3379100 - RNA, 15 nt, Pseudomonas aeruginosa PA01
ccaaaguucaguagc

SEQ ID NO: 3379101 - RNA, 22 nt, Pseudomonas aeruginosa PA01
ccaacagcagguagaccacgca

SEQ ID NO: 3379102 - RNA, 12 nt, Pseudomonas aeruginosa PA01
ccaacagccggc

SEQ ID NO: 3379103 - RNA, 14 nt, Pseudomonas aeruginosa PA01
ccaacagccggcgg

SEQ ID NO: 3379104 - RNA, 20 nt, Pseudomonas aeruginosa PA01
ccaacaggcauugccguccg

SEQ ID NO: 3379105 - RNA, 21 nt, Pseudomonas aeruginosa PA01
ccaacaggcauugccguccgu

SEQ ID NO: 3379106 - RNA, 20 nt, Pseudomonas aeruginosa PA01
ccaacagucgucgcgcagcu

SEQ ID NO: 3379107 - RNA, 19 nt, Pseudomonas aeruginosa PA01
ccaaccacuccgccacccg

SEQ ID NO: 3379108 - RNA, 19 nt, Pseudomonas aeruginosa PA01
ccaaccaugguuuccgccg

SEQ ID NO: 3379109 - RNA, 19 nt, Pseudomonas aeruginosa PA01
ccaacccggccagcccggc

SEQ ID NO: 3379110 - RNA, 23 nt, Pseudomonas aeruginosa PA01
ccaacccggccagcccggccucg

SEQ ID NO: 3379111 - RNA, 24 nt, Pseudomonas aeruginosa PA01
ccaacccucggaugccgcacaggc

SEQ ID NO: 3379112 - RNA, 16 nt, Pseudomonas aeruginosa PA01
ccaaccgggcaucgcc

SEQ ID NO: 3379113 - RNA, 19 nt, Pseudomonas aeruginosa PA01
ccaaccgggcaucgccgac

SEQ ID NO: 3379114 - RNA, 21 nt, Pseudomonas aeruginosa PA01
ccaaccgggcaucgccgacca

SEQ ID NO: 3379115 - RNA, 19 nt, Pseudomonas aeruginosa PA01
ccaaccguucugccgcagc

SEQ ID NO: 3379116 - RNA, 14 nt, Pseudomonas aeruginosa PA01
ccaaccucucccca

SEQ ID NO: 3379117 - RNA, 14 nt, Pseudomonas aeruginosa PA01
ccaacgcaggcgca

SEQ ID NO: 3379118 - RNA, 16 nt, Pseudomonas aeruginosa PA01
ccaacgccaccgcgcg

SEQ ID NO: 3379119 - RNA, 17 nt, Pseudomonas aeruginosa PA01
ccaacgccaccgcgcgc

SEQ ID NO: 3379120 - RNA, 14 nt, Pseudomonas aeruginosa PA01
ccaacgcccgggcc

SEQ ID NO: 3379121 - RNA, 16 nt, Pseudomonas aeruginosa PA01
ccaacgcgcgaagcac

SEQ ID NO: 3379122 - RNA, 20 nt, Pseudomonas aeruginosa PA01
ccaacggcguguccaggguc

SEQ ID NO: 3379123 - RNA, 20 nt, Pseudomonas aeruginosa PA01
ccaacggcguuauccgccgc

SEQ ID NO: 3379124 - RNA, 15 nt, Pseudomonas aeruginosa PA01
ccaacgggcucgugc

SEQ ID NO: 3379125 - RNA, 16 nt, Pseudomonas aeruginosa PA01
ccaacgguagcggauc

SEQ ID NO: 3379126 - RNA, 19 nt, Pseudomonas aeruginosa PA01
ccaacgguagcggaucagc

SEQ ID NO: 3379127 - RNA, 19 nt, Pseudomonas aeruginosa PA01
ccaacguccucgaugcccg

SEQ ID NO: 3379128 - RNA, 23 nt, Pseudomonas aeruginosa PA01
ccaacguccucgaugcccgccuc

SEQ ID NO: 3379129 - RNA, 17 nt, Pseudomonas aeruginosa PA01
ccaacgucuucaggcgc

SEQ ID NO: 3379130 - RNA, 21 nt, Pseudomonas aeruginosa PA01
ccaacgucuucaggcgcuccu

SEQ ID NO: 3379131 - RNA, 12 nt, Pseudomonas aeruginosa PA01
ccaacuccagcu

SEQ ID NO: 3379132 - RNA, 16 nt, Pseudomonas aeruginosa PA01
ccaacuccagcucgac

SEQ ID NO: 3379133 - RNA, 14 nt, Pseudomonas aeruginosa PA01
ccaacucggccugg

SEQ ID NO: 3379134 - RNA, 18 nt, Pseudomonas aeruginosa PA01
ccaacucggccuggaacc

SEQ ID NO: 3379135 - RNA, 16 nt, Pseudomonas aeruginosa PA01
ccaacugcgcccccag

SEQ ID NO: 3379136 - RNA, 18 nt, Pseudomonas aeruginosa PA01
ccaacugcgcccccagcg

SEQ ID NO: 3379137 - RNA, 17 nt, Pseudomonas aeruginosa PA01
ccaacugcuucaggcgc

SEQ ID NO: 3379138 - RNA, 19 nt, Pseudomonas aeruginosa PA01
ccaacugcuucaggcgcgc

SEQ ID NO: 3379139 - RNA, 15 nt, Pseudomonas aeruginosa PA01
ccaacuggcggcugg

SEQ ID NO: 3379140 - RNA, 22 nt, Pseudomonas aeruginosa PA01
ccaacuggcggcugggcugcgg

SEQ ID NO: 3379141 - RNA, 23 nt, Pseudomonas aeruginosa PA01
ccaacuggcguccccaugcccgg

SEQ ID NO: 3379142 - RNA, 17 nt, Pseudomonas aeruginosa PA01
ccaacuggcugucgagc

SEQ ID NO: 3379143 - RNA, 20 nt, Pseudomonas aeruginosa PA01
ccaacuuguuggcauccggc

SEQ ID NO: 3379144 - RNA, 14 nt, Pseudomonas aeruginosa PA01
ccaacuuucccucu

SEQ ID NO: 3379145 - RNA, 20 nt, Pseudomonas aeruginosa PA01
ccaagagagcgccagcgaga

SEQ ID NO: 3379146 - RNA, 14 nt, Pseudomonas aeruginosa PA01
ccaagcccggcgag

SEQ ID NO: 3379147 - RNA, 15 nt, Pseudomonas aeruginosa PA01
ccaagccgagcggca

SEQ ID NO: 3379148 - RNA, 19 nt, Pseudomonas aeruginosa PA01
ccaagccgagcggcaaggc

SEQ ID NO: 3379149 - RNA, 22 nt, Pseudomonas aeruginosa PA01
ccaagcgagacgccgccccagc

SEQ ID NO: 3379150 - RNA, 20 nt, Pseudomonas aeruginosa PA01
ccaagcggauguucuucacc

SEQ ID NO: 3379151 - RNA, 19 nt, Pseudomonas aeruginosa PA01
ccaaggaugcgccagcggc

SEQ ID NO: 3379152 - RNA, 23 nt, Pseudomonas aeruginosa PA01
ccaaggaugcgccagcggcccgg

SEQ ID NO: 3379153 - RNA, 14 nt, Pseudomonas aeruginosa PA01
ccaaggcacgcccc

SEQ ID NO: 3379154 - RNA, 16 nt, Pseudomonas aeruginosa PA01
ccaaggccgccaggcc

SEQ ID NO: 3379155 - RNA, 21 nt, Pseudomonas aeruginosa PA01
ccaaggccucggcauccucgc

SEQ ID NO: 3379156 - RNA, 14 nt, Pseudomonas aeruginosa PA01
ccaagggccugggc

SEQ ID NO: 3379157 - RNA, 18 nt, Pseudomonas aeruginosa PA01
ccaagggccugggcgccg

SEQ ID NO: 3379158 - RNA, 22 nt, Pseudomonas aeruginosa PA01
ccaagggccugggcgccgccag

SEQ ID NO: 3379159 - RNA, 23 nt, Pseudomonas aeruginosa PA01
ccaagggccugggcgccgccagc

SEQ ID NO: 3379160 - RNA, 20 nt, Pseudomonas aeruginosa PA01
ccaagggcguaaagcaagcc

SEQ ID NO: 3379161 - RNA, 22 nt, Pseudomonas aeruginosa PA01
ccaaggguauugguauccaggu

SEQ ID NO: 3379162 - RNA, 17 nt, Pseudomonas aeruginosa PA01
ccaagguuccagccccg

SEQ ID NO: 3379163 - RNA, 16 nt, Pseudomonas aeruginosa PA01
ccaagucggccgccca

SEQ ID NO: 3379164 - RNA, 21 nt, Pseudomonas aeruginosa PA01
ccaauacggcggggucgggca

SEQ ID NO: 3379165 - RNA, 23 nt, Pseudomonas aeruginosa PA01
ccaauccaugaucccuagggguu

SEQ ID NO: 3379166 - RNA, 17 nt, Pseudomonas aeruginosa PA01
ccaauccgauuccgcgc

SEQ ID NO: 3379167 - RNA, 16 nt, Pseudomonas aeruginosa PA01
ccaauccgcgccggug

SEQ ID NO: 3379168 - RNA, 17 nt, Pseudomonas aeruginosa PA01
ccaauccgcgccggugg

SEQ ID NO: 3379169 - RNA, 16 nt, Pseudomonas aeruginosa PA01
ccaaugcaccugcgcc

SEQ ID NO: 3379170 - RNA, 14 nt, Pseudomonas aeruginosa PA01
ccaaugcaucggcc

SEQ ID NO: 3379171 - RNA, 16 nt, Pseudomonas aeruginosa PA01
ccaaugcaucggccgg

SEQ ID NO: 3379172 - RNA, 20 nt, Pseudomonas aeruginosa PA01
ccaaugccagugccucgcgc

SEQ ID NO: 3379173 - RNA, 17 nt, Pseudomonas aeruginosa PA01
ccaaugcccggaccugg

SEQ ID NO: 3379174 - RNA, 11 nt, Pseudomonas aeruginosa PA01
ccaaugcgugg

SEQ ID NO: 3379175 - RNA, 19 nt, Pseudomonas aeruginosa PA01
ccaauugcccguagggcga

SEQ ID NO: 3379176 - RNA, 17 nt, Pseudomonas aeruginosa PA01
ccacaaacacuguggag

SEQ ID NO: 3379177 - RNA, 23 nt, Pseudomonas aeruginosa PA01
ccacaaaccccugggaugccgcc

SEQ ID NO: 3379178 - RNA, 17 nt, Pseudomonas aeruginosa PA01
ccacaaccagccaugca

SEQ ID NO: 3379179 - RNA, 22 nt, Pseudomonas aeruginosa PA01
ccacaaccugccgaucgccgcg

SEQ ID NO: 3379180 - RNA, 16 nt, Pseudomonas aeruginosa PA01
ccacacauccagugug

SEQ ID NO: 3379181 - RNA, 18 nt, Pseudomonas aeruginosa PA01
ccacacccggucgcgcug

SEQ ID NO: 3379182 - RNA, 12 nt, Pseudomonas aeruginosa PA01
ccacagaggucg

SEQ ID NO: 3379183 - RNA, 19 nt, Pseudomonas aeruginosa PA01
ccacagcgugcagaccagg

SEQ ID NO: 3379184 - RNA, 17 nt, Pseudomonas aeruginosa PA01
ccacaggagcacggccg

SEQ ID NO: 3379185 - RNA, 22 nt, Pseudomonas aeruginosa PA01
ccacaggccggcuaaccgcgaa

SEQ ID NO: 3379186 - RNA, 23 nt, Pseudomonas aeruginosa PA01
ccacaggccggcuaaccgcgaag

SEQ ID NO: 3379187 - RNA, 21 nt, Pseudomonas aeruginosa PA01
ccacaggcgccagucauugcg

SEQ ID NO: 3379188 - RNA, 21 nt, Pseudomonas aeruginosa PA01
ccacaggcggcggaagaagcc

SEQ ID NO: 3379189 - RNA, 22 nt, Pseudomonas aeruginosa PA01
ccacaggcggcggaagaagccc

SEQ ID NO: 3379190 - RNA, 19 nt, Pseudomonas aeruginosa PA01
ccacaggcguuauccgccg

SEQ ID NO: 3379191 - RNA, 20 nt, Pseudomonas aeruginosa PA01
ccacaggcguuauccgccga

SEQ ID NO: 3379192 - RNA, 20 nt, Pseudomonas aeruginosa PA01
ccacaggcguuauccgccgc

SEQ ID NO: 3379193 - RNA, 22 nt, Pseudomonas aeruginosa PA01
ccacaggcguuauccgccgccg

SEQ ID NO: 3379194 - RNA, 19 nt, Pseudomonas aeruginosa PA01
ccacagguggaucgcggcg

SEQ ID NO: 3379195 - RNA, 20 nt, Pseudomonas aeruginosa PA01
ccacagugccaggcucgccg

SEQ ID NO: 3379196 - RNA, 22 nt, Pseudomonas aeruginosa PA01
ccacagugccaggcucgccgcc

SEQ ID NO: 3379197 - RNA, 16 nt, Pseudomonas aeruginosa PA01
ccacauuuaaaguuuc

SEQ ID NO: 3379198 - RNA, 21 nt, Pseudomonas aeruginosa PA01
ccaccaacggcguguccaggg

SEQ ID NO: 3379199 - RNA, 15 nt, Pseudomonas aeruginosa PA01
ccaccaccacgaucu

SEQ ID NO: 3379200 - RNA, 17 nt, Pseudomonas aeruginosa PA01
ccaccaccaugccuucc

SEQ ID NO: 3379201 - RNA, 22 nt, Pseudomonas aeruginosa PA01
ccaccaccaugccuuccaccgg

SEQ ID NO: 3379202 - RNA, 13 nt, Pseudomonas aeruginosa PA01
ccaccaccgacgc

SEQ ID NO: 3379203 - RNA, 12 nt, Pseudomonas aeruginosa PA01
ccaccaccgcgc

SEQ ID NO: 3379204 - RNA, 15 nt, Pseudomonas aeruginosa PA01
ccaccaccgcgccga

SEQ ID NO: 3379205 - RNA, 21 nt, Pseudomonas aeruginosa PA01
ccaccaccggaccgggcgccu

SEQ ID NO: 3379206 - RNA, 21 nt, Pseudomonas aeruginosa PA01
ccaccaccgucuggcgcaucc

SEQ ID NO: 3379207 - RNA, 18 nt, Pseudomonas aeruginosa PA01
ccaccacgccgucgccgc

SEQ ID NO: 3379208 - RNA, 22 nt, Pseudomonas aeruginosa PA01
ccaccacggcgaagccgcgccc

SEQ ID NO: 3379209 - RNA, 15 nt, Pseudomonas aeruginosa PA01
ccaccacucgcgagc

SEQ ID NO: 3379210 - RNA, 17 nt, Pseudomonas aeruginosa PA01
ccaccagaaggcgggca

SEQ ID NO: 3379211 - RNA, 19 nt, Pseudomonas aeruginosa PA01
ccaccagaaggcgggcagc

SEQ ID NO: 3379212 - RNA, 16 nt, Pseudomonas aeruginosa PA01
ccaccagagccagccg

SEQ ID NO: 3379213 - RNA, 19 nt, Pseudomonas aeruginosa PA01
ccaccagagccagccgcga

SEQ ID NO: 3379214 - RNA, 11 nt, Pseudomonas aeruginosa PA01
ccaccagcacc

SEQ ID NO: 3379215 - RNA, 13 nt, Pseudomonas aeruginosa PA01
ccaccagcaccug

SEQ ID NO: 3379216 - RNA, 12 nt, Pseudomonas aeruginosa PA01
ccaccagcagca

SEQ ID NO: 3379217 - RNA, 13 nt, Pseudomonas aeruginosa PA01
ccaccagcagcag

SEQ ID NO: 3379218 - RNA, 15 nt, Pseudomonas aeruginosa PA01
ccaccagcagggcca

SEQ ID NO: 3379219 - RNA, 17 nt, Pseudomonas aeruginosa PA01
ccaccagcagggccagg

SEQ ID NO: 3379220 - RNA, 21 nt, Pseudomonas aeruginosa PA01
ccaccagcaucaccaccggga

SEQ ID NO: 3379221 - RNA, 18 nt, Pseudomonas aeruginosa PA01
ccaccagccagcucggcg

SEQ ID NO: 3379222 - RNA, 11 nt, Pseudomonas aeruginosa PA01
ccaccagcccg

SEQ ID NO: 3379223 - RNA, 13 nt, Pseudomonas aeruginosa PA01
ccaccagcccgca

SEQ ID NO: 3379224 - RNA, 19 nt, Pseudomonas aeruginosa PA01
ccaccagcgcccguagcac

SEQ ID NO: 3379225 - RNA, 12 nt, Pseudomonas aeruginosa PA01
ccaccagcgccg

SEQ ID NO: 3379226 - RNA, 13 nt, Pseudomonas aeruginosa PA01
ccaccagcgccgc

SEQ ID NO: 3379227 - RNA, 14 nt, Pseudomonas aeruginosa PA01
ccaccagcgccgcc

SEQ ID NO: 3379228 - RNA, 19 nt, Pseudomonas aeruginosa PA01
ccaccagcgccgccaccgc

SEQ ID NO: 3379229 - RNA, 15 nt, Pseudomonas aeruginosa PA01
ccaccagcgccggcg

SEQ ID NO: 3379230 - RNA, 21 nt, Pseudomonas aeruginosa PA01
ccaccaggaagcgucgugcgc

SEQ ID NO: 3379231 - RNA, 22 nt, Pseudomonas aeruginosa PA01
ccaccaggccauagcgcgccgg

SEQ ID NO: 3379232 - RNA, 13 nt, Pseudomonas aeruginosa PA01
ccaccaggccgcu

SEQ ID NO: 3379233 - RNA, 14 nt, Pseudomonas aeruginosa PA01
ccaccaggcgccgg

SEQ ID NO: 3379234 - RNA, 15 nt, Pseudomonas aeruginosa PA01
ccaccaggcgccggg

SEQ ID NO: 3379235 - RNA, 16 nt, Pseudomonas aeruginosa PA01
ccaccaggcgccgggu

SEQ ID NO: 3379236 - RNA, 24 nt, Pseudomonas aeruginosa PA01
ccaccaggcgucgcaccugggacu

SEQ ID NO: 3379237 - RNA, 18 nt, Pseudomonas aeruginosa PA01
ccaccagggccucggggc

SEQ ID NO: 3379238 - RNA, 23 nt, Pseudomonas aeruginosa PA01
ccaccagggccucggggccgucc

SEQ ID NO: 3379239 - RNA, 19 nt, Pseudomonas aeruginosa PA01
ccaccagggccuugccgcg

SEQ ID NO: 3379240 - RNA, 20 nt, Pseudomonas aeruginosa PA01
ccaccagggccuugccgcga

SEQ ID NO: 3379241 - RNA, 22 nt, Pseudomonas aeruginosa PA01
ccaccagggucgguucgcggcg

SEQ ID NO: 3379242 - RNA, 21 nt, Pseudomonas aeruginosa PA01
ccaccagggugcgauggaugc

SEQ ID NO: 3379243 - RNA, 13 nt, Pseudomonas aeruginosa PA01
ccaccaggucgcc

SEQ ID NO: 3379244 - RNA, 17 nt, Pseudomonas aeruginosa PA01
ccaccaggucgccguag

SEQ ID NO: 3379245 - RNA, 12 nt, Pseudomonas aeruginosa PA01
ccaccaggucgg

SEQ ID NO: 3379246 - RNA, 15 nt, Pseudomonas aeruginosa PA01
ccaccaggucggcgc

SEQ ID NO: 3379247 - RNA, 18 nt, Pseudomonas aeruginosa PA01
ccaccaggucggcgcgcg

SEQ ID NO: 3379248 - RNA, 18 nt, Pseudomonas aeruginosa PA01
ccaccauaaagcccacac

SEQ ID NO: 3379249 - RNA, 21 nt, Pseudomonas aeruginosa PA01
ccaccaucacgucgcgcaccu

SEQ ID NO: 3379250 - RNA, 14 nt, Pseudomonas aeruginosa PA01
ccaccaucgcggcg

SEQ ID NO: 3379251 - RNA, 16 nt, Pseudomonas aeruginosa PA01
ccaccaugugcuggcg

SEQ ID NO: 3379252 - RNA, 16 nt, Pseudomonas aeruginosa PA01
ccacccaucugccggc

SEQ ID NO: 3379253 - RNA, 22 nt, Pseudomonas aeruginosa PA01
ccaccccaggguuggcggcauc

SEQ ID NO: 3379254 - RNA, 14 nt, Pseudomonas aeruginosa PA01
ccacccccagcccg

SEQ ID NO: 3379255 - RNA, 18 nt, Pseudomonas aeruginosa PA01
ccacccccagcccggcca

SEQ ID NO: 3379256 - RNA, 17 nt, Pseudomonas aeruginosa PA01
ccacccccaucgcccgc

SEQ ID NO: 3379257 - RNA, 22 nt, Pseudomonas aeruginosa PA01
ccacccccgcaaccgcugccgc

SEQ ID NO: 3379258 - RNA, 14 nt, Pseudomonas aeruginosa PA01
ccacccccggcccg

SEQ ID NO: 3379259 - RNA, 18 nt, Pseudomonas aeruginosa PA01
ccaccgucuggcgcaucc

SEQ ID NO: 3379260 - RNA, 21 nt, Pseudomonas aeruginosa PA01
ccaccgugaccagcauggcgg

SEQ ID NO: 3379261 - RNA, 18 nt, Pseudomonas aeruginosa PA01
ccaccgugcccgccggcg

SEQ ID NO: 3379262 - RNA, 15 nt, Pseudomonas aeruginosa PA01
ccaccgugcgcaccu

SEQ ID NO: 3379263 - RNA, 18 nt, Pseudomonas aeruginosa PA01
ccaccguggcgacgaugc

SEQ ID NO: 3379264 - RNA, 16 nt, Pseudomonas aeruginosa PA01
ccaccguggcgccggc

SEQ ID NO: 3379265 - RNA, 17 nt, Pseudomonas aeruginosa PA01
ccaccguggcgccggcg

SEQ ID NO: 3379266 - RNA, 18 nt, Pseudomonas aeruginosa PA01
ccaccguggcgccggcgc

SEQ ID NO: 3379267 - RNA, 16 nt, Pseudomonas aeruginosa PA01
ccaccucgacccuggc

SEQ ID NO: 3379268 - RNA, 18 nt, Pseudomonas aeruginosa PA01
ccaccucgacggcgaucu

SEQ ID NO: 3379269 - RNA, 14 nt, Pseudomonas aeruginosa PA01
ccaccucgccaagc

SEQ ID NO: 3379270 - RNA, 20 nt, Pseudomonas aeruginosa PA01
ccaccucgccaagcuggcga

SEQ ID NO: 3379271 - RNA, 19 nt, Pseudomonas aeruginosa PA01
ccaccucgcccucgcucca

SEQ ID NO: 3379272 - RNA, 14 nt, Pseudomonas aeruginosa PA01
ccaccucggcgucg

SEQ ID NO: 3379273 - RNA, 22 nt, Pseudomonas aeruginosa PA01
ccaccucguauuccacgucgcc

SEQ ID NO: 3379274 - RNA, 16 nt, Pseudomonas aeruginosa PA01
ccaccugaacgcgccc

SEQ ID NO: 3379275 - RNA, 20 nt, Pseudomonas aeruginosa PA01
ccaccugaacgcgcccggcc

SEQ ID NO: 3379276 - RNA, 23 nt, Pseudomonas aeruginosa PA01
ccaccugcaucacguacggcgcc

SEQ ID NO: 3379277 - RNA, 18 nt, Pseudomonas aeruginosa PA01
ccaccugcggguggccuu

SEQ ID NO: 3379278 - RNA, 22 nt, Pseudomonas aeruginosa PA01
ccaccugcucgcugaaccgcgu

SEQ ID NO: 3379279 - RNA, 17 nt, Pseudomonas aeruginosa PA01
ccaccugcuugggcgcc

SEQ ID NO: 3379280 - RNA, 23 nt, Pseudomonas aeruginosa PA01
ccaccuggaacuugcuguugccg

SEQ ID NO: 3379281 - RNA, 12 nt, Pseudomonas aeruginosa PA01
ccaccuggcgca

SEQ ID NO: 3379282 - RNA, 14 nt, Pseudomonas aeruginosa PA01
ccaccuggcgcagg

SEQ ID NO: 3379283 - RNA, 16 nt, Pseudomonas aeruginosa PA01
ccaccuggcgcaggua

SEQ ID NO: 3379284 - RNA, 17 nt, Pseudomonas aeruginosa PA01
ccaccuggcgcagguag

SEQ ID NO: 3379285 - RNA, 18 nt, Pseudomonas aeruginosa PA01
ccaccugguucaucgagc

SEQ ID NO: 3379286 - RNA, 13 nt, Pseudomonas aeruginosa PA01
ccaccuguagcag

SEQ ID NO: 3379287 - RNA, 15 nt, Pseudomonas aeruginosa PA01
ccaccuguuccacga

SEQ ID NO: 3379288 - RNA, 14 nt, Pseudomonas aeruginosa PA01
ccaccuguuccgcg

SEQ ID NO: 3379289 - RNA, 23 nt, Pseudomonas aeruginosa PA01
ccaccuucgcccgcugcgcugcc

SEQ ID NO: 3379290 - RNA, 17 nt, Pseudomonas aeruginosa PA01
ccaccuugauccgcgac

SEQ ID NO: 3379291 - RNA, 16 nt, Pseudomonas aeruginosa PA01
ccaccuugccgcgccc

SEQ ID NO: 3379292 - RNA, 19 nt, Pseudomonas aeruginosa PA01
ccaccuugcgguagcgcuc

SEQ ID NO: 3379293 - RNA, 20 nt, Pseudomonas aeruginosa PA01
ccaccuugcgguagcgcucg

SEQ ID NO: 3379294 - RNA, 20 nt, Pseudomonas aeruginosa PA01
ccaccuugcgucccugggcc

SEQ ID NO: 3379295 - RNA, 19 nt, Pseudomonas aeruginosa PA01
ccacgaaaaagcccggcau

SEQ ID NO: 3379296 - RNA, 19 nt, Pseudomonas aeruginosa PA01
ccacgaacaggcugugcgc

SEQ ID NO: 3379297 - RNA, 21 nt, Pseudomonas aeruginosa PA01
ccacgaacaggcugugcgcca

SEQ ID NO: 3379298 - RNA, 22 nt, Pseudomonas aeruginosa PA01
ccacgaacaggcugugcgccag

SEQ ID NO: 3379299 - RNA, 23 nt, Pseudomonas aeruginosa PA01
ccacgaacaggcugugcgccagg

SEQ ID NO: 3379300 - RNA, 17 nt, Pseudomonas aeruginosa PA01
ccacgaacugcauggcc

SEQ ID NO: 3379301 - RNA, 20 nt, Pseudomonas aeruginosa PA01
ccacgaagcgaccgaucaug

SEQ ID NO: 3379302 - RNA, 22 nt, Pseudomonas aeruginosa PA01
ccacgaagcgaccgaucaugcc

SEQ ID NO: 3379303 - RNA, 12 nt, Pseudomonas aeruginosa PA01
ccacgacccgcu

SEQ ID NO: 3379304 - RNA, 16 nt, Pseudomonas aeruginosa PA01
ccacgacccgcucuuc

SEQ ID NO: 3379305 - RNA, 13 nt, Pseudomonas aeruginosa PA01
ccacgacccgggu

SEQ ID NO: 3379306 - RNA, 18 nt, Pseudomonas aeruginosa PA01
ccacgacccugcuggccg

SEQ ID NO: 3379307 - RNA, 21 nt, Pseudomonas aeruginosa PA01
ccacgacccugcuggccggug

SEQ ID NO: 3379308 - RNA, 15 nt, Pseudomonas aeruginosa PA01
ccacgaccgcgucca

SEQ ID NO: 3379309 - RNA, 19 nt, Pseudomonas aeruginosa PA01
ccacgacgaagcgccggcg

SEQ ID NO: 3379310 - RNA, 13 nt, Pseudomonas aeruginosa PA01
ccacgacgcacuc

SEQ ID NO: 3379311 - RNA, 20 nt, Pseudomonas aeruginosa PA01
ccacgacgcacucauagcuc

SEQ ID NO: 3379312 - RNA, 14 nt, Pseudomonas aeruginosa PA01
ccacgaggaugucg

SEQ ID NO: 3379313 - RNA, 16 nt, Pseudomonas aeruginosa PA01
ccacgaggaugucggc

SEQ ID NO: 3379314 - RNA, 17 nt, Pseudomonas aeruginosa PA01
ccacgaggaugucggcg

SEQ ID NO: 3379315 - RNA, 21 nt, Pseudomonas aeruginosa PA01
ccacgaucagcucguugcccg

SEQ ID NO: 3379316 - RNA, 21 nt, Pseudomonas aeruginosa PA01
ccacgaucaggcccuuuucca

SEQ ID NO: 3379317 - RNA, 23 nt, Pseudomonas aeruginosa PA01
ccacgaucauggugaagcccacc

SEQ ID NO: 3379318 - RNA, 23 nt, Pseudomonas aeruginosa PA01
ccacgaucugcuugcgcgccgcc

SEQ ID NO: 3379319 - RNA, 15 nt, Pseudomonas aeruginosa PA01
ccacgcaauccucgg

SEQ ID NO: 3379320 - RNA, 16 nt, Pseudomonas aeruginosa PA01
ccacgcaauccucggu

SEQ ID NO: 3379321 - RNA, 20 nt, Pseudomonas aeruginosa PA01
ccacgcaauccucggugcgc

SEQ ID NO: 3379322 - RNA, 19 nt, Pseudomonas aeruginosa PA01
ccacgcaccaccaggucga

SEQ ID NO: 3379323 - RNA, 16 nt, Pseudomonas aeruginosa PA01
ccacgcaccagcuccc

SEQ ID NO: 3379324 - RNA, 19 nt, Pseudomonas aeruginosa PA01
ccacgcaccagcucccggc

SEQ ID NO: 3379325 - RNA, 19 nt, Pseudomonas aeruginosa PA01
ccacgcagaaggcgcuuuc

SEQ ID NO: 3379326 - RNA, 21 nt, Pseudomonas aeruginosa PA01
ccacgcagccacccgcgggca

SEQ ID NO: 3379327 - RNA, 23 nt, Pseudomonas aeruginosa PA01
ccacgcaggaacagcuccuccag

SEQ ID NO: 3379328 - RNA, 15 nt, Pseudomonas aeruginosa PA01
ccacgcaggccagcg

SEQ ID NO: 3379329 - RNA, 18 nt, Pseudomonas aeruginosa PA01
ccacgcaggccagcgcca

SEQ ID NO: 3379330 - RNA, 20 nt, Pseudomonas aeruginosa PA01
ccacgcaggccagcgccagg

SEQ ID NO: 3379331 - RNA, 18 nt, Pseudomonas aeruginosa PA01
ccacgcaguucgcgggcc

SEQ ID NO: 3379332 - RNA, 16 nt, Pseudomonas aeruginosa PA01
ccacgcauuggcuucg

SEQ ID NO: 3379333 - RNA, 16 nt, Pseudomonas aeruginosa PA01
ccacgcauugucgggc

SEQ ID NO: 3379334 - RNA, 18 nt, Pseudomonas aeruginosa PA01
ccacgccauaggcggcgc

SEQ ID NO: 3379335 - RNA, 19 nt, Pseudomonas aeruginosa PA01
ccacgccauaggcggcgca

SEQ ID NO: 3379336 - RNA, 22 nt, Pseudomonas aeruginosa PA01
ccacgccauaggcggcgcagac

SEQ ID NO: 3379337 - RNA, 18 nt, Pseudomonas aeruginosa PA01
ccacgccauucgaauggc

SEQ ID NO: 3379338 - RNA, 22 nt, Pseudomonas aeruginosa PA01
ccacgccauucgaauggcgccg

SEQ ID NO: 3379339 - RNA, 18 nt, Pseudomonas aeruginosa PA01
ccacgcccaucggcgucg

SEQ ID NO: 3379340 - RNA, 13 nt, Pseudomonas aeruginosa PA01
ccacgcccgccgu

SEQ ID NO: 3379341 - RNA, 14 nt, Pseudomonas aeruginosa PA01
ccacgcccgccgug

SEQ ID NO: 3379342 - RNA, 17 nt, Pseudomonas aeruginosa PA01
ccacgcccugcgccagc

SEQ ID NO: 3379343 - RNA, 13 nt, Pseudomonas aeruginosa PA01
ccacgccgaaggc

SEQ ID NO: 3379344 - RNA, 17 nt, Pseudomonas aeruginosa PA01
ccacgccgauaccggcc

SEQ ID NO: 3379345 - RNA, 18 nt, Pseudomonas aeruginosa PA01
ccacgccgauaccggccu

SEQ ID NO: 3379346 - RNA, 23 nt, Pseudomonas aeruginosa PA01
ccacgccgauaccggccucgaug

SEQ ID NO: 3379347 - RNA, 15 nt, Pseudomonas aeruginosa PA01
ccacgccgcuggcgu

SEQ ID NO: 3379348 - RNA, 17 nt, Pseudomonas aeruginosa PA01
ccacgccgcuggcguug

SEQ ID NO: 3379349 - RNA, 21 nt, Pseudomonas aeruginosa PA01
ccacgccgcuggcguuguugc

SEQ ID NO: 3379350 - RNA, 13 nt, Pseudomonas aeruginosa PA01
ccacgccggccgg

SEQ ID NO: 3379351 - RNA, 13 nt, Pseudomonas aeruginosa PA01
ccacgccggcgcu

SEQ ID NO: 3379352 - RNA, 18 nt, Pseudomonas aeruginosa PA01
ccacgccggcgcuccucc

SEQ ID NO: 3379353 - RNA, 13 nt, Pseudomonas aeruginosa PA01
ccacgccgucgcc

SEQ ID NO: 3379354 - RNA, 12 nt, Pseudomonas aeruginosa PA01
ccacgccuggcc

SEQ ID NO: 3379355 - RNA, 15 nt, Pseudomonas aeruginosa PA01
ccacgccuggcccug

SEQ ID NO: 3379356 - RNA, 15 nt, Pseudomonas aeruginosa PA01
ccacgccuucgcggc

SEQ ID NO: 3379357 - RNA, 17 nt, Pseudomonas aeruginosa PA01
ccacgccuucgcggccg

SEQ ID NO: 3379358 - RNA, 22 nt, Pseudomonas aeruginosa PA01
ccacgccuugcagcaccgccug

SEQ ID NO: 3379359 - RNA, 14 nt, Pseudomonas aeruginosa PA01
ccacgcgaccagcg

SEQ ID NO: 3379360 - RNA, 15 nt, Pseudomonas aeruginosa PA01
ccacgcgaccagcgc

SEQ ID NO: 3379361 - RNA, 23 nt, Pseudomonas aeruginosa PA01
ccacucgccagcgcgcgccgaca

SEQ ID NO: 3379362 - RNA, 20 nt, Pseudomonas aeruginosa PA01
ccacucgcgacugccgucgg

SEQ ID NO: 3379363 - RNA, 21 nt, Pseudomonas aeruginosa PA01
ccacucgcgagcuggcgccgu

SEQ ID NO: 3379364 - RNA, 20 nt, Pseudomonas aeruginosa PA01
ccacucgcguagcugggcga

SEQ ID NO: 3379365 - RNA, 14 nt, Pseudomonas aeruginosa PA01
ccacucggccagca

SEQ ID NO: 3379366 - RNA, 17 nt, Pseudomonas aeruginosa PA01
ccacucggccaggcgcc

SEQ ID NO: 3379367 - RNA, 16 nt, Pseudomonas aeruginosa PA01
ccacucggcgcuuucg

SEQ ID NO: 3379368 - RNA, 17 nt, Pseudomonas aeruginosa PA01
ccacucggcgugccggg

SEQ ID NO: 3379369 - RNA, 18 nt, Pseudomonas aeruginosa PA01
ccacugaacuggaucggc

SEQ ID NO: 3379370 - RNA, 14 nt, Pseudomonas aeruginosa PA01
ccacugacgcgcag

SEQ ID NO: 3379371 - RNA, 15 nt, Pseudomonas aeruginosa PA01
ccacugacgcgcagc

SEQ ID NO: 3379372 - RNA, 19 nt, Pseudomonas aeruginosa PA01
ccacugacgcgcagcgccg

SEQ ID NO: 3379373 - RNA, 21 nt, Pseudomonas aeruginosa PA01
ccacugacgcgcagcgccgcc

SEQ ID NO: 3379374 - RNA, 23 nt, Pseudomonas aeruginosa PA01
ccacugacgcgcagcgccgccgc

SEQ ID NO: 3379375 - RNA, 16 nt, Pseudomonas aeruginosa PA01
ccacugauaccgcugg

SEQ ID NO: 3379376 - RNA, 19 nt, Pseudomonas aeruginosa PA01
ccacugauaccgcuggcca

SEQ ID NO: 3379377 - RNA, 21 nt, Pseudomonas aeruginosa PA01
ccacugauaccgcuggccagg

SEQ ID NO: 3379378 - RNA, 22 nt, Pseudomonas aeruginosa PA01
ccacugccgccucagcgaaacu

SEQ ID NO: 3379379 - RNA, 18 nt, Pseudomonas aeruginosa PA01
ccacugcgcgccagucca

SEQ ID NO: 3379380 - RNA, 18 nt, Pseudomonas aeruginosa PA01
ccacugcguccuggucgc

SEQ ID NO: 3379381 - RNA, 15 nt, Pseudomonas aeruginosa PA01
ccacugcuuggccag

SEQ ID NO: 3379382 - RNA, 17 nt, Pseudomonas aeruginosa PA01
ccacugcuuggccaggc

SEQ ID NO: 3379383 - RNA, 19 nt, Pseudomonas aeruginosa PA01
ccacugcuuggccaggcgc

SEQ ID NO: 3379384 - RNA, 17 nt, Pseudomonas aeruginosa PA01
ccacugcuuggcgaacu

SEQ ID NO: 3379385 - RNA, 22 nt, Pseudomonas aeruginosa PA01
ccacuggauggucacgccgagg

SEQ ID NO: 3379386 - RNA, 19 nt, Pseudomonas aeruginosa PA01
ccacuggcccacggcgccu

SEQ ID NO: 3379387 - RNA, 15 nt, Pseudomonas aeruginosa PA01
ccacugucucgccga

SEQ ID NO: 3379388 - RNA, 19 nt, Pseudomonas aeruginosa PA01
ccacugucucgccgaugcc

SEQ ID NO: 3379389 - RNA, 23 nt, Pseudomonas aeruginosa PA01
ccacuuaggcggauaacgccagg

SEQ ID NO: 3379390 - RNA, 15 nt, Pseudomonas aeruginosa PA01
ccacuuccagcacgc

SEQ ID NO: 3379391 - RNA, 15 nt, Pseudomonas aeruginosa PA01
ccacuuccagcuugc

SEQ ID NO: 3379392 - RNA, 17 nt, Pseudomonas aeruginosa PA01
ccacuuccggcccggcc

SEQ ID NO: 3379393 - RNA, 18 nt, Pseudomonas aeruginosa PA01
ccacuuccggcccggcca

SEQ ID NO: 3379394 - RNA, 20 nt, Pseudomonas aeruginosa PA01
ccacuuccggcccggccagg

SEQ ID NO: 3379395 - RNA, 22 nt, Pseudomonas aeruginosa PA01
ccacuucggcgguggggccgcc

SEQ ID NO: 3379396 - RNA, 23 nt, Pseudomonas aeruginosa PA01
ccacuucggcgguggggccgccg

SEQ ID NO: 3379397 - RNA, 21 nt, Pseudomonas aeruginosa PA01
ccacuucguccggccgcccga

SEQ ID NO: 3379398 - RNA, 21 nt, Pseudomonas aeruginosa PA01
ccacuugccgccgccggaggg

SEQ ID NO: 3379399 - RNA, 12 nt, Pseudomonas aeruginosa PA01
ccacuugcgccg

SEQ ID NO: 3379400 - RNA, 14 nt, Pseudomonas aeruginosa PA01
ccagaaaccgauca

SEQ ID NO: 3379401 - RNA, 15 nt, Pseudomonas aeruginosa PA01
ccagaaacggcugcc

SEQ ID NO: 3379402 - RNA, 16 nt, Pseudomonas aeruginosa PA01
ccagaaacggcugccg

SEQ ID NO: 3379403 - RNA, 19 nt, Pseudomonas aeruginosa PA01
ccagaaagccucaggcgcu

SEQ ID NO: 3379404 - RNA, 15 nt, Pseudomonas aeruginosa PA01
ccagaacaccugcgu

SEQ ID NO: 3379405 - RNA, 17 nt, Pseudomonas aeruginosa PA01
ccagaacaccugcgugg

SEQ ID NO: 3379406 - RNA, 21 nt, Pseudomonas aeruginosa PA01
ccagaacaccugcguggcgaa

SEQ ID NO: 3379407 - RNA, 22 nt, Pseudomonas aeruginosa PA01
ccagaacgaaaaaggcgcgccg

SEQ ID NO: 3379408 - RNA, 23 nt, Pseudomonas aeruginosa PA01
ccagaacgaaaaaggcgcgccgg

SEQ ID NO: 3379409 - RNA, 13 nt, Pseudomonas aeruginosa PA01
ccagaacgccgcg

SEQ ID NO: 3379410 - RNA, 15 nt, Pseudomonas aeruginosa PA01
ccagaacgccgcgca

SEQ ID NO: 3379411 - RNA, 16 nt, Pseudomonas aeruginosa PA01
ccagaacgccgcgcac

SEQ ID NO: 3379412 - RNA, 21 nt, Pseudomonas aeruginosa PA01
ccagaagaucgccugcuggcc

SEQ ID NO: 3379413 - RNA, 22 nt, Pseudomonas aeruginosa PA01
ccagaagaucgccugcuggccg

SEQ ID NO: 3379414 - RNA, 23 nt, Pseudomonas aeruginosa PA01
ccagaagccccagagcccgccga

SEQ ID NO: 3379415 - RNA, 18 nt, Pseudomonas aeruginosa PA01
ccagaagcgacuguccaa

SEQ ID NO: 3379416 - RNA, 17 nt, Pseudomonas aeruginosa PA01
ccagaagcgcucguaga

SEQ ID NO: 3379417 - RNA, 22 nt, Pseudomonas aeruginosa PA01
ccagaagcggccgaccaggccg

SEQ ID NO: 3379418 - RNA, 14 nt, Pseudomonas aeruginosa PA01
ccagaaggccaggg

SEQ ID NO: 3379419 - RNA, 19 nt, Pseudomonas aeruginosa PA01
ccagaaggcuucuuccugg

SEQ ID NO: 3379420 - RNA, 16 nt, Pseudomonas aeruginosa PA01
ccagaagucgcuggcc

SEQ ID NO: 3379421 - RNA, 17 nt, Pseudomonas aeruginosa PA01
ccagaagucgcuggccu

SEQ ID NO: 3379422 - RNA, 17 nt, Pseudomonas aeruginosa PA01
ccagaauuccagcaggu

SEQ ID NO: 3379423 - RNA, 15 nt, Pseudomonas aeruginosa PA01
ccagacagcccucca

SEQ ID NO: 3379424 - RNA, 15 nt, Pseudomonas aeruginosa PA01
ccagacauccggguc

SEQ ID NO: 3379425 - RNA, 21 nt, Pseudomonas aeruginosa PA01
ccagacauccggguccagcgg

SEQ ID NO: 3379426 - RNA, 11 nt, Pseudomonas aeruginosa PA01
ccagaccagca

SEQ ID NO: 3379427 - RNA, 14 nt, Pseudomonas aeruginosa PA01
ccagaccagcagga

SEQ ID NO: 3379428 - RNA, 17 nt, Pseudomonas aeruginosa PA01
ccagaccagcaggaaaa

SEQ ID NO: 3379429 - RNA, 12 nt, Pseudomonas aeruginosa PA01
ccagaccagccc

SEQ ID NO: 3379430 - RNA, 15 nt, Pseudomonas aeruginosa PA01
ccagaccccggcgau

SEQ ID NO: 3379431 - RNA, 16 nt, Pseudomonas aeruginosa PA01
ccagacccucucccug

SEQ ID NO: 3379432 - RNA, 20 nt, Pseudomonas aeruginosa PA01
ccagaccgagauuggccgcc

SEQ ID NO: 3379433 - RNA, 13 nt, Pseudomonas aeruginosa PA01
ccagaccggcagc

SEQ ID NO: 3379434 - RNA, 14 nt, Pseudomonas aeruginosa PA01
ccagaccggcagcg

SEQ ID NO: 3379435 - RNA, 16 nt, Pseudomonas aeruginosa PA01
ccagaccggcagcgcc

SEQ ID NO: 3379436 - RNA, 19 nt, Pseudomonas aeruginosa PA01
ccagaccggcagcgccgcc

SEQ ID NO: 3379437 - RNA, 21 nt, Pseudomonas aeruginosa PA01
ccagaccggcagcgccgccag

SEQ ID NO: 3379438 - RNA, 21 nt, Pseudomonas aeruginosa PA01
ccagaccguggauuucagcag

SEQ ID NO: 3379439 - RNA, 16 nt, Pseudomonas aeruginosa PA01
ccagaccucgagcagg

SEQ ID NO: 3379440 - RNA, 18 nt, Pseudomonas aeruginosa PA01
ccagaccucgagcaggcc

SEQ ID NO: 3379441 - RNA, 13 nt, Pseudomonas aeruginosa PA01
ccagaccugccgc

SEQ ID NO: 3379442 - RNA, 20 nt, Pseudomonas aeruginosa PA01
ccagaccugccgcccggcca

SEQ ID NO: 3379443 - RNA, 22 nt, Pseudomonas aeruginosa PA01
ccagaccugccgcccggccagg

SEQ ID NO: 3379444 - RNA, 23 nt, Pseudomonas aeruginosa PA01
ccagaccugccgcccggccaggc

SEQ ID NO: 3379445 - RNA, 14 nt, Pseudomonas aeruginosa PA01
ccagaccuggccgc

SEQ ID NO: 3379446 - RNA, 17 nt, Pseudomonas aeruginosa PA01
ccagacgaucagcggcc

SEQ ID NO: 3379447 - RNA, 19 nt, Pseudomonas aeruginosa PA01
ccagacgaucagcggcccg

SEQ ID NO: 3379448 - RNA, 23 nt, Pseudomonas aeruginosa PA01
ccagacgaucagcggcccgagca

SEQ ID NO: 3379449 - RNA, 11 nt, Pseudomonas aeruginosa PA01
ccagacgccgc

SEQ ID NO: 3379450 - RNA, 15 nt, Pseudomonas aeruginosa PA01
ccagacgcucggcca

SEQ ID NO: 3379451 - RNA, 18 nt, Pseudomonas aeruginosa PA01
ccagacgcucggccagcg

SEQ ID NO: 3379452 - RNA, 14 nt, Pseudomonas aeruginosa PA01
ccagacgcucggcu

SEQ ID NO: 3379453 - RNA, 15 nt, Pseudomonas aeruginosa PA01
ccagacguccagcgc

SEQ ID NO: 3379454 - RNA, 16 nt, Pseudomonas aeruginosa PA01
ccagacguccagcgcc

SEQ ID NO: 3379455 - RNA, 16 nt, Pseudomonas aeruginosa PA01
ccagacguccggcagg

SEQ ID NO: 3379456 - RNA, 13 nt, Pseudomonas aeruginosa PA01
ccagacguugcgc

SEQ ID NO: 3379457 - RNA, 14 nt, Pseudomonas aeruginosa PA01
ccagacuuccgggc

SEQ ID NO: 3379458 - RNA, 17 nt, Pseudomonas aeruginosa PA01
ccagacuuccgggcugc

SEQ ID NO: 3379459 - RNA, 18 nt, Pseudomonas aeruginosa PA01
ccagagaucgcccagcgg

SEQ ID NO: 3379460 - RNA, 17 nt, Pseudomonas aeruginosa PA01
ccagagcagcaccagca

SEQ ID NO: 3379461 - RNA, 19 nt, Pseudomonas aeruginosa PA01
ccagagcagcaccagcacc

SEQ ID NO: 3379462 - RNA, 15 nt, Pseudomonas aeruginosa PA01
ccagagccagccgcg

SEQ ID NO: 3379463 - RNA, 17 nt, Pseudomonas aeruginosa PA01
ccagcacgcggagggcg

SEQ ID NO: 3379464 - RNA, 15 nt, Pseudomonas aeruginosa PA01
ccagcacgcuggcga

SEQ ID NO: 3379465 - RNA, 18 nt, Pseudomonas aeruginosa PA01
ccagcacgcuggcgagga

SEQ ID NO: 3379466 - RNA, 22 nt, Pseudomonas aeruginosa PA01
ccagcacgcuggcgaggacgcc

SEQ ID NO: 3379467 - RNA, 22 nt, Pseudomonas aeruginosa PA01
ccagcacggcgaauucgucgcc

SEQ ID NO: 3379468 - RNA, 17 nt, Pseudomonas aeruginosa PA01
ccagcacggcgcagggc

SEQ ID NO: 3379469 - RNA, 17 nt, Pseudomonas aeruginosa PA01
ccagcacggugaaccag

SEQ ID NO: 3379470 - RNA, 19 nt, Pseudomonas aeruginosa PA01
ccagcacggugaaccaggc

SEQ ID NO: 3379471 - RNA, 20 nt, Pseudomonas aeruginosa PA01
ccagcacggugaaccaggcg

SEQ ID NO: 3379472 - RNA, 22 nt, Pseudomonas aeruginosa PA01
ccagcacggugaaccaggcgcc

SEQ ID NO: 3379473 - RNA, 22 nt, Pseudomonas aeruginosa PA01
ccagcacucgcuccuccgggcg

SEQ ID NO: 3379474 - RNA, 21 nt, Pseudomonas aeruginosa PA01
ccagcagacggcuguugucga

SEQ ID NO: 3379475 - RNA, 18 nt, Pseudomonas aeruginosa PA01
ccagcagcaacagcgccg

SEQ ID NO: 3379476 - RNA, 23 nt, Pseudomonas aeruginosa PA01
ccagcagcaacagcgccgcgcgc

SEQ ID NO: 3379477 - RNA, 21 nt, Pseudomonas aeruginosa PA01
ccagcagcaacuccagagcca

SEQ ID NO: 3379478 - RNA, 13 nt, Pseudomonas aeruginosa PA01
ccagcagcaccau

SEQ ID NO: 3379479 - RNA, 14 nt, Pseudomonas aeruginosa PA01
ccagcagcacccgg

SEQ ID NO: 3379480 - RNA, 11 nt, Pseudomonas aeruginosa PA01
ccagcagcacg

SEQ ID NO: 3379481 - RNA, 13 nt, Pseudomonas aeruginosa PA01
ccagcagcacgcc

SEQ ID NO: 3379482 - RNA, 16 nt, Pseudomonas aeruginosa PA01
ccagcagcacggcgac

SEQ ID NO: 3379483 - RNA, 14 nt, Pseudomonas aeruginosa PA01
ccagcagcaggccg

SEQ ID NO: 3379484 - RNA, 14 nt, Pseudomonas aeruginosa PA01
ccagcagcaggucg

SEQ ID NO: 3379485 - RNA, 21 nt, Pseudomonas aeruginosa PA01
ccagcagcaggucgucggcga

SEQ ID NO: 3379486 - RNA, 18 nt, Pseudomonas aeruginosa PA01
ccagcagcaucggaccgg

SEQ ID NO: 3379487 - RNA, 19 nt, Pseudomonas aeruginosa PA01
ccagcagcaugggauggcg

SEQ ID NO: 3379488 - RNA, 13 nt, Pseudomonas aeruginosa PA01
ccagcagccccga

SEQ ID NO: 3379489 - RNA, 23 nt, Pseudomonas aeruginosa PA01
ccagcagccccgaggccagcagg

SEQ ID NO: 3379490 - RNA, 14 nt, Pseudomonas aeruginosa PA01
ccagcagcccggcc

SEQ ID NO: 3379491 - RNA, 16 nt, Pseudomonas aeruginosa PA01
ccagcagcccggccug

SEQ ID NO: 3379492 - RNA, 17 nt, Pseudomonas aeruginosa PA01
ccagcagcccggccugg

SEQ ID NO: 3379493 - RNA, 15 nt, Pseudomonas aeruginosa PA01
ccagcagcgagcagg

SEQ ID NO: 3379494 - RNA, 16 nt, Pseudomonas aeruginosa PA01
ccagcagcgcaccauc

SEQ ID NO: 3379495 - RNA, 17 nt, Pseudomonas aeruginosa PA01
ccagcagcgcaccaucc

SEQ ID NO: 3379496 - RNA, 17 nt, Pseudomonas aeruginosa PA01
ccagcagcgcacgcuuc

SEQ ID NO: 3379497 - RNA, 13 nt, Pseudomonas aeruginosa PA01
ccagcagcgccga

SEQ ID NO: 3379498 - RNA, 12 nt, Pseudomonas aeruginosa PA01
ccagcagcgccu

SEQ ID NO: 3379499 - RNA, 21 nt, Pseudomonas aeruginosa PA01
ccagcagcgccuccucuacca

SEQ ID NO: 3379500 - RNA, 20 nt, Pseudomonas aeruginosa PA01
ccagcagcgcucacgcaccu

SEQ ID NO: 3379501 - RNA, 14 nt, Pseudomonas aeruginosa PA01
ccagcagcggcagc

SEQ ID NO: 3379502 - RNA, 22 nt, Pseudomonas aeruginosa PA01
ccagcagcggcggcgccggcag

SEQ ID NO: 3379503 - RNA, 23 nt, Pseudomonas aeruginosa PA01
ccagcagcggcggcgccggcagg

SEQ ID NO: 3379504 - RNA, 12 nt, Pseudomonas aeruginosa PA01
ccagcagcuccg

SEQ ID NO: 3379505 - RNA, 22 nt, Pseudomonas aeruginosa PA01
ccagcaggaaaacgcucaggcc

SEQ ID NO: 3379506 - RNA, 14 nt, Pseudomonas aeruginosa PA01
ccagcaggaagccg

SEQ ID NO: 3379507 - RNA, 16 nt, Pseudomonas aeruginosa PA01
ccagcaggaagccgac

SEQ ID NO: 3379508 - RNA, 20 nt, Pseudomonas aeruginosa PA01
ccagcaggaagccgaccacu

SEQ ID NO: 3379509 - RNA, 17 nt, Pseudomonas aeruginosa PA01
ccagcaggaccuggccg

SEQ ID NO: 3379510 - RNA, 18 nt, Pseudomonas aeruginosa PA01
ccagcaggaccuggccgu

SEQ ID NO: 3379511 - RNA, 18 nt, Pseudomonas aeruginosa PA01
ccagcaggacgucgaggu

SEQ ID NO: 3379512 - RNA, 12 nt, Pseudomonas aeruginosa PA01
ccagcaggaucg

SEQ ID NO: 3379513 - RNA, 15 nt, Pseudomonas aeruginosa PA01
ccagcaggaucgaca

SEQ ID NO: 3379514 - RNA, 20 nt, Pseudomonas aeruginosa PA01
ccagcaggaucgacagcagc

SEQ ID NO: 3379515 - RNA, 14 nt, Pseudomonas aeruginosa PA01
ccagcaggaucgag

SEQ ID NO: 3379516 - RNA, 14 nt, Pseudomonas aeruginosa PA01
ccagcaggaucgga

SEQ ID NO: 3379517 - RNA, 21 nt, Pseudomonas aeruginosa PA01
ccagcaggaugcugcacagcc

SEQ ID NO: 3379518 - RNA, 22 nt, Pseudomonas aeruginosa PA01
ccagcaggaugcugcacagcca

SEQ ID NO: 3379519 - RNA, 12 nt, Pseudomonas aeruginosa PA01
ccagcaggcagg

SEQ ID NO: 3379520 - RNA, 16 nt, Pseudomonas aeruginosa PA01
ccagcaggcaggcgcg

SEQ ID NO: 3379521 - RNA, 14 nt, Pseudomonas aeruginosa PA01
ccagcaggccagcc

SEQ ID NO: 3379522 - RNA, 20 nt, Pseudomonas aeruginosa PA01
ccagcaggccagccaacugc

SEQ ID NO: 3379523 - RNA, 12 nt, Pseudomonas aeruginosa PA01
ccagcaggccca

SEQ ID NO: 3379524 - RNA, 15 nt, Pseudomonas aeruginosa PA01
ccagcaggcccagcc

SEQ ID NO: 3379525 - RNA, 18 nt, Pseudomonas aeruginosa PA01
ccagcaggccgaaggcca

SEQ ID NO: 3379526 - RNA, 15 nt, Pseudomonas aeruginosa PA01
ccagcaggccgagcc

SEQ ID NO: 3379527 - RNA, 17 nt, Pseudomonas aeruginosa PA01
ccagcaggccgagcccg

SEQ ID NO: 3379528 - RNA, 13 nt, Pseudomonas aeruginosa PA01
ccagcaggccgau

SEQ ID NO: 3379529 - RNA, 16 nt, Pseudomonas aeruginosa PA01
ccagcaggccgaucag

SEQ ID NO: 3379530 - RNA, 20 nt, Pseudomonas aeruginosa PA01
ccagcaggccgaucagcggc

SEQ ID NO: 3379531 - RNA, 16 nt, Pseudomonas aeruginosa PA01
ccagcaggccggccag

SEQ ID NO: 3379532 - RNA, 19 nt, Pseudomonas aeruginosa PA01
ccagcaggccgugggccgg

SEQ ID NO: 3379533 - RNA, 19 nt, Pseudomonas aeruginosa PA01
ccagcaggcgauacaccgc

SEQ ID NO: 3379534 - RNA, 17 nt, Pseudomonas aeruginosa PA01
ccagcaggcgcagcagc

SEQ ID NO: 3379535 - RNA, 18 nt, Pseudomonas aeruginosa PA01
ccagcaggcgcaggucgg

SEQ ID NO: 3379536 - RNA, 22 nt, Pseudomonas aeruginosa PA01
ccagcaggcgcaggucggccuc

SEQ ID NO: 3379537 - RNA, 23 nt, Pseudomonas aeruginosa PA01
ccagcaggcgcaggucggccucg

SEQ ID NO: 3379538 - RNA, 12 nt, Pseudomonas aeruginosa PA01
ccagcaggcgcc

SEQ ID NO: 3379539 - RNA, 19 nt, Pseudomonas aeruginosa PA01
ccagcaggcgccgcgcauc

SEQ ID NO: 3379540 - RNA, 16 nt, Pseudomonas aeruginosa PA01
ccagcaggcgccggcg

SEQ ID NO: 3379541 - RNA, 23 nt, Pseudomonas aeruginosa PA01
ccagcaggcgccggcggaucagc

SEQ ID NO: 3379542 - RNA, 13 nt, Pseudomonas aeruginosa PA01
ccagcaggcgcgg

SEQ ID NO: 3379543 - RNA, 17 nt, Pseudomonas aeruginosa PA01
ccagcaggcgcgggcug

SEQ ID NO: 3379544 - RNA, 21 nt, Pseudomonas aeruginosa PA01
ccagcaggcgcgggcuggcca

SEQ ID NO: 3379545 - RNA, 12 nt, Pseudomonas aeruginosa PA01
ccagcaggcgcu

SEQ ID NO: 3379546 - RNA, 19 nt, Pseudomonas aeruginosa PA01
ccagcaggcgcucgcugcg

SEQ ID NO: 3379547 - RNA, 23 nt, Pseudomonas aeruginosa PA01
ccagcaggcguugcagugcgccg

SEQ ID NO: 3379548 - RNA, 19 nt, Pseudomonas aeruginosa PA01
ccagcaggcucaucgcccg

SEQ ID NO: 3379549 - RNA, 20 nt, Pseudomonas aeruginosa PA01
ccagcaggcucaucgcccgc

SEQ ID NO: 3379550 - RNA, 23 nt, Pseudomonas aeruginosa PA01
ccagcaggcucaugcccagcuuc

SEQ ID NO: 3379551 - RNA, 21 nt, Pseudomonas aeruginosa PA01
ccagcaggcucuuggucgcgg

SEQ ID NO: 3379552 - RNA, 16 nt, Pseudomonas aeruginosa PA01
ccagcaggcuggcggc

SEQ ID NO: 3379553 - RNA, 16 nt, Pseudomonas aeruginosa PA01
ccagcagggccagcag

SEQ ID NO: 3379554 - RNA, 17 nt, Pseudomonas aeruginosa PA01
ccagcagggccagcagc

SEQ ID NO: 3379555 - RNA, 18 nt, Pseudomonas aeruginosa PA01
ccagcagggccagccaga

SEQ ID NO: 3379556 - RNA, 22 nt, Pseudomonas aeruginosa PA01
ccagcagggccagccagagcca

SEQ ID NO: 3379557 - RNA, 15 nt, Pseudomonas aeruginosa PA01
ccagcagggccagcg

SEQ ID NO: 3379558 - RNA, 16 nt, Pseudomonas aeruginosa PA01
ccagcagggccagcgc

SEQ ID NO: 3379559 - RNA, 14 nt, Pseudomonas aeruginosa PA01
ccagcagggccagg

SEQ ID NO: 3379560 - RNA, 16 nt, Pseudomonas aeruginosa PA01
ccagcagggccaggcc

SEQ ID NO: 3379561 - RNA, 20 nt, Pseudomonas aeruginosa PA01
ccagcagggccaggccgagc

SEQ ID NO: 3379562 - RNA, 22 nt, Pseudomonas aeruginosa PA01
ccagcagggccaggccgagcgc

SEQ ID NO: 3379563 - RNA, 12 nt, Pseudomonas aeruginosa PA01
ccagcagggugg

SEQ ID NO: 3379564 - RNA, 14 nt, Pseudomonas aeruginosa PA01
ccagcagguacagc

SEQ ID NO: 3379565 - RNA, 17 nt, Pseudomonas aeruginosa PA01
ccagcagguacagcagc

SEQ ID NO: 3379566 - RNA, 15 nt, Pseudomonas aeruginosa PA01
ccagcccggcguggg

SEQ ID NO: 3379567 - RNA, 14 nt, Pseudomonas aeruginosa PA01
ccagcccggcucgg

SEQ ID NO: 3379568 - RNA, 23 nt, Pseudomonas aeruginosa PA01
ccagcccgguucagcgggacagc

SEQ ID NO: 3379569 - RNA, 22 nt, Pseudomonas aeruginosa PA01
ccagcccguagucguucagcgc

SEQ ID NO: 3379570 - RNA, 22 nt, Pseudomonas aeruginosa PA01
ccagcccuggaaaggccucggc

SEQ ID NO: 3379571 - RNA, 13 nt, Pseudomonas aeruginosa PA01
ccagcccuggcgc

SEQ ID NO: 3379572 - RNA, 14 nt, Pseudomonas aeruginosa PA01
ccagcccuggcgca

SEQ ID NO: 3379573 - RNA, 16 nt, Pseudomonas aeruginosa PA01
ccagcccuggcgcaga

SEQ ID NO: 3379574 - RNA, 14 nt, Pseudomonas aeruginosa PA01
ccagcccuggcgcg

SEQ ID NO: 3379575 - RNA, 18 nt, Pseudomonas aeruginosa PA01
ccagcccuggcgcggcaa

SEQ ID NO: 3379576 - RNA, 18 nt, Pseudomonas aeruginosa PA01
ccagccgaacaguucggc

SEQ ID NO: 3379577 - RNA, 20 nt, Pseudomonas aeruginosa PA01
ccagccgacguagggcaucg

SEQ ID NO: 3379578 - RNA, 16 nt, Pseudomonas aeruginosa PA01
ccagccgacuggcggu

SEQ ID NO: 3379579 - RNA, 14 nt, Pseudomonas aeruginosa PA01
ccagccgagcaacu

SEQ ID NO: 3379580 - RNA, 22 nt, Pseudomonas aeruginosa PA01
ccagccgagcaacucggcggcg

SEQ ID NO: 3379581 - RNA, 14 nt, Pseudomonas aeruginosa PA01
ccagccgaggcagc

SEQ ID NO: 3379582 - RNA, 17 nt, Pseudomonas aeruginosa PA01
ccagccgaggcagccgu

SEQ ID NO: 3379583 - RNA, 13 nt, Pseudomonas aeruginosa PA01
ccagccgcacgcc

SEQ ID NO: 3379584 - RNA, 14 nt, Pseudomonas aeruginosa PA01
ccagccgcacgccc

SEQ ID NO: 3379585 - RNA, 12 nt, Pseudomonas aeruginosa PA01
ccagccgcagcc

SEQ ID NO: 3379586 - RNA, 13 nt, Pseudomonas aeruginosa PA01
ccagccgcagccc

SEQ ID NO: 3379587 - RNA, 17 nt, Pseudomonas aeruginosa PA01
ccagccgcagcccgguc

SEQ ID NO: 3379588 - RNA, 17 nt, Pseudomonas aeruginosa PA01
ccagccgcaggcugccg

SEQ ID NO: 3379589 - RNA, 23 nt, Pseudomonas aeruginosa PA01
ccagccgcaggcugccguccagg

SEQ ID NO: 3379590 - RNA, 20 nt, Pseudomonas aeruginosa PA01
ccagccgccaggacggcagg

SEQ ID NO: 3379591 - RNA, 14 nt, Pseudomonas aeruginosa PA01
ccagccgccaucac

SEQ ID NO: 3379592 - RNA, 22 nt, Pseudomonas aeruginosa PA01
ccagccgcccuugucgaugagc

SEQ ID NO: 3379593 - RNA, 22 nt, Pseudomonas aeruginosa PA01
ccagccgccgaagggccgcagg

SEQ ID NO: 3379594 - RNA, 15 nt, Pseudomonas aeruginosa PA01
ccagccgccgcugca

SEQ ID NO: 3379595 - RNA, 15 nt, Pseudomonas aeruginosa PA01
ccagccgcgccagug

SEQ ID NO: 3379596 - RNA, 15 nt, Pseudomonas aeruginosa PA01
ccagccgcgcgccgc

SEQ ID NO: 3379597 - RNA, 13 nt, Pseudomonas aeruginosa PA01
ccagccgcgcggc

SEQ ID NO: 3379598 - RNA, 14 nt, Pseudomonas aeruginosa PA01
ccagccgcgcggca

SEQ ID NO: 3379599 - RNA, 17 nt, Pseudomonas aeruginosa PA01
ccagccgcggaucaccu

SEQ ID NO: 3379600 - RNA, 13 nt, Pseudomonas aeruginosa PA01
ccagccgcggccg

SEQ ID NO: 3379601 - RNA, 14 nt, Pseudomonas aeruginosa PA01
ccagccgcggccgu

SEQ ID NO: 3379602 - RNA, 13 nt, Pseudomonas aeruginosa PA01
ccagccgcggcgc

SEQ ID NO: 3379603 - RNA, 12 nt, Pseudomonas aeruginosa PA01
ccagccgcucgc

SEQ ID NO: 3379604 - RNA, 13 nt, Pseudomonas aeruginosa PA01
ccagccgcucgcg

SEQ ID NO: 3379605 - RNA, 17 nt, Pseudomonas aeruginosa PA01
ccagccgcucgcguccg

SEQ ID NO: 3379606 - RNA, 18 nt, Pseudomonas aeruginosa PA01
ccagccgcucgcguccgc

SEQ ID NO: 3379607 - RNA, 15 nt, Pseudomonas aeruginosa PA01
ccagccgcugcaggg

SEQ ID NO: 3379608 - RNA, 17 nt, Pseudomonas aeruginosa PA01
ccagccgcuuccggcgc

SEQ ID NO: 3379609 - RNA, 13 nt, Pseudomonas aeruginosa PA01
ccagccggagaga

SEQ ID NO: 3379610 - RNA, 15 nt, Pseudomonas aeruginosa PA01
ccagccggcaagcgu

SEQ ID NO: 3379611 - RNA, 21 nt, Pseudomonas aeruginosa PA01
ccagccggcaagcgugccccg

SEQ ID NO: 3379612 - RNA, 19 nt, Pseudomonas aeruginosa PA01
ccagccggcauccagcauc

SEQ ID NO: 3379613 - RNA, 14 nt, Pseudomonas aeruginosa PA01
ccagccggccaucc

SEQ ID NO: 3379614 - RNA, 19 nt, Pseudomonas aeruginosa PA01
ccagccggccauccagcca

SEQ ID NO: 3379615 - RNA, 21 nt, Pseudomonas aeruginosa PA01
ccagccggccauccagccagg

SEQ ID NO: 3379616 - RNA, 12 nt, Pseudomonas aeruginosa PA01
ccagccggccgc

SEQ ID NO: 3379617 - RNA, 13 nt, Pseudomonas aeruginosa PA01
ccagccggccgcg

SEQ ID NO: 3379618 - RNA, 14 nt, Pseudomonas aeruginosa PA01
ccagccggccgcgu

SEQ ID NO: 3379619 - RNA, 13 nt, Pseudomonas aeruginosa PA01
ccagccggcgacg

SEQ ID NO: 3379620 - RNA, 15 nt, Pseudomonas aeruginosa PA01
ccagccggcgacgca

SEQ ID NO: 3379621 - RNA, 14 nt, Pseudomonas aeruginosa PA01
ccagccggcgccgc

SEQ ID NO: 3379622 - RNA, 20 nt, Pseudomonas aeruginosa PA01
ccagccggcgcucggccagg

SEQ ID NO: 3379623 - RNA, 14 nt, Pseudomonas aeruginosa PA01
ccagccggcgcuuc

SEQ ID NO: 3379624 - RNA, 13 nt, Pseudomonas aeruginosa PA01
ccagccggcugug

SEQ ID NO: 3379625 - RNA, 18 nt, Pseudomonas aeruginosa PA01
ccagccgggcuccgccgc

SEQ ID NO: 3379626 - RNA, 20 nt, Pseudomonas aeruginosa PA01
ccagccgggcuccgccgcga

SEQ ID NO: 3379627 - RNA, 21 nt, Pseudomonas aeruginosa PA01
ccagccgggcuccgccgcgag

SEQ ID NO: 3379628 - RNA, 23 nt, Pseudomonas aeruginosa PA01
ccagccgucgucguccaccgagu

SEQ ID NO: 3379629 - RNA, 15 nt, Pseudomonas aeruginosa PA01
ccagccguggcaggc

SEQ ID NO: 3379630 - RNA, 18 nt, Pseudomonas aeruginosa PA01
ccagccguggcaggcgcc

SEQ ID NO: 3379631 - RNA, 23 nt, Pseudomonas aeruginosa PA01
ccagccguggcaggcgcccgguc

SEQ ID NO: 3379632 - RNA, 23 nt, Pseudomonas aeruginosa PA01
ccagccgugggcguagagccugg

SEQ ID NO: 3379633 - RNA, 17 nt, Pseudomonas aeruginosa PA01
ccagccucauucgcucu

SEQ ID NO: 3379634 - RNA, 14 nt, Pseudomonas aeruginosa PA01
ccagccucggcagg

SEQ ID NO: 3379635 - RNA, 20 nt, Pseudomonas aeruginosa PA01
ccagccucggcagggcgccc

SEQ ID NO: 3379636 - RNA, 12 nt, Pseudomonas aeruginosa PA01
ccagccugcagc

SEQ ID NO: 3379637 - RNA, 13 nt, Pseudomonas aeruginosa PA01
ccagccugcagcc

SEQ ID NO: 3379638 - RNA, 14 nt, Pseudomonas aeruginosa PA01
ccagccuggccagc

SEQ ID NO: 3379639 - RNA, 15 nt, Pseudomonas aeruginosa PA01
ccagccuuccucggg

SEQ ID NO: 3379640 - RNA, 16 nt, Pseudomonas aeruginosa PA01
ccagccuugagccuug

SEQ ID NO: 3379641 - RNA, 21 nt, Pseudomonas aeruginosa PA01
ccagccuugcuggacuucccg

SEQ ID NO: 3379642 - RNA, 15 nt, Pseudomonas aeruginosa PA01
ccagcgaacccaggc

SEQ ID NO: 3379643 - RNA, 16 nt, Pseudomonas aeruginosa PA01
ccagcgaacccaggcc

SEQ ID NO: 3379644 - RNA, 13 nt, Pseudomonas aeruginosa PA01
ccagcgaaccgcc

SEQ ID NO: 3379645 - RNA, 16 nt, Pseudomonas aeruginosa PA01
ccagcgaaccgccggc

SEQ ID NO: 3379646 - RNA, 17 nt, Pseudomonas aeruginosa PA01
ccagcgaaccgccggcc

SEQ ID NO: 3379647 - RNA, 22 nt, Pseudomonas aeruginosa PA01
ccagcgaaccgccggccucgcu

SEQ ID NO: 3379648 - RNA, 22 nt, Pseudomonas aeruginosa PA01
ccagcgaagcuucuucggcagc

SEQ ID NO: 3379649 - RNA, 15 nt, Pseudomonas aeruginosa PA01
ccagcgaagugcgcu

SEQ ID NO: 3379650 - RNA, 16 nt, Pseudomonas aeruginosa PA01
ccagcgaauggacagg

SEQ ID NO: 3379651 - RNA, 23 nt, Pseudomonas aeruginosa PA01
ccagcgaauggacaggcgccccu

SEQ ID NO: 3379652 - RNA, 16 nt, Pseudomonas aeruginosa PA01
ccagcgacuccgccag

SEQ ID NO: 3379653 - RNA, 21 nt, Pseudomonas aeruginosa PA01
ccagcgacuccgccaguuccg

SEQ ID NO: 3379654 - RNA, 18 nt, Pseudomonas aeruginosa PA01
ccagcgagacgggcgagg

SEQ ID NO: 3379655 - RNA, 19 nt, Pseudomonas aeruginosa PA01
ccagcgagacgggcgaggc

SEQ ID NO: 3379656 - RNA, 13 nt, Pseudomonas aeruginosa PA01
ccagcgagccgag

SEQ ID NO: 3379657 - RNA, 17 nt, Pseudomonas aeruginosa PA01
ccagcgagccgaucacc

SEQ ID NO: 3379658 - RNA, 18 nt, Pseudomonas aeruginosa PA01
ccagcgagccgaucacca

SEQ ID NO: 3379659 - RNA, 14 nt, Pseudomonas aeruginosa PA01
ccagcgaggagccu

SEQ ID NO: 3379660 - RNA, 15 nt, Pseudomonas aeruginosa PA01
ccagcgaguaggcga

SEQ ID NO: 3379661 - RNA, 15 nt, Pseudomonas aeruginosa PA01
ccagcgaguagucgc

SEQ ID NO: 3379662 - RNA, 22 nt, Pseudomonas aeruginosa PA01
ccagcgaguagucgcggggcgg

SEQ ID NO: 3379663 - RNA, 17 nt, Pseudomonas aeruginosa PA01
ccagcgagucgacccag

SEQ ID NO: 3379664 - RNA, 22 nt, Pseudomonas aeruginosa PA01
ccagcgagucgacccaggccca

SEQ ID NO: 3379665 - RNA, 13 nt, Pseudomonas aeruginosa PA01
ccagcgcaaccgg

SEQ ID NO: 3379666 - RNA, 14 nt, Pseudomonas aeruginosa PA01
ccagcgcaagcggc

SEQ ID NO: 3379667 - RNA, 17 nt, Pseudomonas aeruginosa PA01
ccagcgcaagcggcggc

SEQ ID NO: 3379668 - RNA, 16 nt, Pseudomonas aeruginosa PA01
ccagcgcaccaggguc

SEQ ID NO: 3379669 - RNA, 15 nt, Pseudomonas aeruginosa PA01
ccagcgcaccgccaa

SEQ ID NO: 3379670 - RNA, 20 nt, Pseudomonas aeruginosa PA01
ccagcgcuucggcggcuucg

SEQ ID NO: 3379671 - RNA, 19 nt, Pseudomonas aeruginosa PA01
ccagcgcuugaacgcgcgc

SEQ ID NO: 3379672 - RNA, 20 nt, Pseudomonas aeruginosa PA01
ccagcgcuugaacgcgcgcc

SEQ ID NO: 3379673 - RNA, 15 nt, Pseudomonas aeruginosa PA01
ccagcggaaucgcgc

SEQ ID NO: 3379674 - RNA, 16 nt, Pseudomonas aeruginosa PA01
ccagcggaaucgcgcc

SEQ ID NO: 3379675 - RNA, 17 nt, Pseudomonas aeruginosa PA01
ccagcggaaucgcgccc

SEQ ID NO: 3379676 - RNA, 15 nt, Pseudomonas aeruginosa PA01
ccagcggaccgucgg

SEQ ID NO: 3379677 - RNA, 18 nt, Pseudomonas aeruginosa PA01
ccagcggaugcuggcgga

SEQ ID NO: 3379678 - RNA, 12 nt, Pseudomonas aeruginosa PA01
ccagcggcagcg

SEQ ID NO: 3379679 - RNA, 22 nt, Pseudomonas aeruginosa PA01
ccagcggcagcgguucgcccgc

SEQ ID NO: 3379680 - RNA, 15 nt, Pseudomonas aeruginosa PA01
ccagcggcagcucgg

SEQ ID NO: 3379681 - RNA, 13 nt, Pseudomonas aeruginosa PA01
ccagcggcaggca

SEQ ID NO: 3379682 - RNA, 14 nt, Pseudomonas aeruginosa PA01
ccagcggcaggcac

SEQ ID NO: 3379683 - RNA, 15 nt, Pseudomonas aeruginosa PA01
ccagcggcaggcacg

SEQ ID NO: 3379684 - RNA, 17 nt, Pseudomonas aeruginosa PA01
ccagcggcagggcggcg

SEQ ID NO: 3379685 - RNA, 19 nt, Pseudomonas aeruginosa PA01
ccagcggcaggugguaagc

SEQ ID NO: 3379686 - RNA, 17 nt, Pseudomonas aeruginosa PA01
ccagcggcauccgccgc

SEQ ID NO: 3379687 - RNA, 20 nt, Pseudomonas aeruginosa PA01
ccagcggcauccgccgcugg

SEQ ID NO: 3379688 - RNA, 15 nt, Pseudomonas aeruginosa PA01
ccagcggcaugccgu

SEQ ID NO: 3379689 - RNA, 12 nt, Pseudomonas aeruginosa PA01
ccagcggcccgg

SEQ ID NO: 3379690 - RNA, 15 nt, Pseudomonas aeruginosa PA01
ccagcggcccggcag

SEQ ID NO: 3379691 - RNA, 20 nt, Pseudomonas aeruginosa PA01
ccagcggcccggcaggcgca

SEQ ID NO: 3379692 - RNA, 14 nt, Pseudomonas aeruginosa PA01
ccagcggcccggcg

SEQ ID NO: 3379693 - RNA, 12 nt, Pseudomonas aeruginosa PA01
ccagcggccgcg

SEQ ID NO: 3379694 - RNA, 18 nt, Pseudomonas aeruginosa PA01
ccagcggccgcgagcgcg

SEQ ID NO: 3379695 - RNA, 15 nt, Pseudomonas aeruginosa PA01
ccagcggccgcgagg

SEQ ID NO: 3379696 - RNA, 15 nt, Pseudomonas aeruginosa PA01
ccagcggcgaucgcc

SEQ ID NO: 3379697 - RNA, 22 nt, Pseudomonas aeruginosa PA01
ccagcggcgguagcuccaggcc

SEQ ID NO: 3379698 - RNA, 19 nt, Pseudomonas aeruginosa PA01
ccagcggcuccucggccug

SEQ ID NO: 3379699 - RNA, 23 nt, Pseudomonas aeruginosa PA01
ccagcggcuccucggccugggcg

SEQ ID NO: 3379700 - RNA, 15 nt, Pseudomonas aeruginosa PA01
ccagcggcuccugga

SEQ ID NO: 3379701 - RNA, 13 nt, Pseudomonas aeruginosa PA01
ccagcggcucgcu

SEQ ID NO: 3379702 - RNA, 13 nt, Pseudomonas aeruginosa PA01
ccagcggcuggcg

SEQ ID NO: 3379703 - RNA, 17 nt, Pseudomonas aeruginosa PA01
ccagcggcuggcgggcg

SEQ ID NO: 3379704 - RNA, 15 nt, Pseudomonas aeruginosa PA01
ccagcggcuggcuga

SEQ ID NO: 3379705 - RNA, 16 nt, Pseudomonas aeruginosa PA01
ccagcgggaaggucgg

SEQ ID NO: 3379706 - RNA, 18 nt, Pseudomonas aeruginosa PA01
ccagcgggaaggucggca

SEQ ID NO: 3379707 - RNA, 20 nt, Pseudomonas aeruginosa PA01
ccagcgggaaggucggcagc

SEQ ID NO: 3379708 - RNA, 18 nt, Pseudomonas aeruginosa PA01
ccagcgggacgaugccga

SEQ ID NO: 3379709 - RNA, 15 nt, Pseudomonas aeruginosa PA01
ccagcgggcggauca

SEQ ID NO: 3379710 - RNA, 17 nt, Pseudomonas aeruginosa PA01
ccagcgggcggaucagc

SEQ ID NO: 3379711 - RNA, 19 nt, Pseudomonas aeruginosa PA01
ccagcgggcggaucagcuc

SEQ ID NO: 3379712 - RNA, 14 nt, Pseudomonas aeruginosa PA01
ccagcgggcggucg

SEQ ID NO: 3379713 - RNA, 23 nt, Pseudomonas aeruginosa PA01
ccagcgggcggucgcggaccucc

SEQ ID NO: 3379714 - RNA, 12 nt, Pseudomonas aeruginosa PA01
ccagcggguaga

SEQ ID NO: 3379715 - RNA, 15 nt, Pseudomonas aeruginosa PA01
ccagcgggucgucga

SEQ ID NO: 3379716 - RNA, 23 nt, Pseudomonas aeruginosa PA01
ccagcgggucgucgaagcgcagc

SEQ ID NO: 3379717 - RNA, 20 nt, Pseudomonas aeruginosa PA01
ccagcgguaccagcagcgcc

SEQ ID NO: 3379718 - RNA, 21 nt, Pseudomonas aeruginosa PA01
ccagcgguaccagcagcgccg

SEQ ID NO: 3379719 - RNA, 19 nt, Pseudomonas aeruginosa PA01
ccagcgguacccgccggcc

SEQ ID NO: 3379720 - RNA, 20 nt, Pseudomonas aeruginosa PA01
ccagcgguacccgccggcca

SEQ ID NO: 3379721 - RNA, 22 nt, Pseudomonas aeruginosa PA01
ccagcgguacccgccggccaug

SEQ ID NO: 3379722 - RNA, 19 nt, Pseudomonas aeruginosa PA01
ccagcgguacguagcgcgg

SEQ ID NO: 3379723 - RNA, 18 nt, Pseudomonas aeruginosa PA01
ccagcgguacuaucccgg

SEQ ID NO: 3379724 - RNA, 22 nt, Pseudomonas aeruginosa PA01
ccagcgguucaggucgaggccg

SEQ ID NO: 3379725 - RNA, 16 nt, Pseudomonas aeruginosa PA01
ccagcgguugagcagg

SEQ ID NO: 3379726 - RNA, 22 nt, Pseudomonas aeruginosa PA01
ccagcgguugagcagggcgucg

SEQ ID NO: 3379727 - RNA, 17 nt, Pseudomonas aeruginosa PA01
ccagcguccuucggcgc

SEQ ID NO: 3379728 - RNA, 12 nt, Pseudomonas aeruginosa PA01
ccagcgucgcca

SEQ ID NO: 3379729 - RNA, 14 nt, Pseudomonas aeruginosa PA01
ccagcgucgccgcc

SEQ ID NO: 3379730 - RNA, 16 nt, Pseudomonas aeruginosa PA01
ccagcgucgccgccgc

SEQ ID NO: 3379731 - RNA, 13 nt, Pseudomonas aeruginosa PA01
ccagcgucgcgcg

SEQ ID NO: 3379732 - RNA, 21 nt, Pseudomonas aeruginosa PA01
ccagcgucgcgcgugccccgu

SEQ ID NO: 3379733 - RNA, 17 nt, Pseudomonas aeruginosa PA01
ccagcgucugccgcugg

SEQ ID NO: 3379734 - RNA, 18 nt, Pseudomonas aeruginosa PA01
ccagcgugaagaccuggu

SEQ ID NO: 3379735 - RNA, 20 nt, Pseudomonas aeruginosa PA01
ccagcguggccagcgaaccc

SEQ ID NO: 3379736 - RNA, 21 nt, Pseudomonas aeruginosa PA01
ccagcguggcggacaacccgg

SEQ ID NO: 3379737 - RNA, 21 nt, Pseudomonas aeruginosa PA01
ccagcgugggcaacaggccga

SEQ ID NO: 3379738 - RNA, 14 nt, Pseudomonas aeruginosa PA01
ccagcguguggcga

SEQ ID NO: 3379739 - RNA, 14 nt, Pseudomonas aeruginosa PA01
ccagcguucggcgc

SEQ ID NO: 3379740 - RNA, 19 nt, Pseudomonas aeruginosa PA01
ccagcguucggcgcuggcg

SEQ ID NO: 3379741 - RNA, 14 nt, Pseudomonas aeruginosa PA01
ccagcguuguccuc

SEQ ID NO: 3379742 - RNA, 17 nt, Pseudomonas aeruginosa PA01
ccagcguuguccucggc

SEQ ID NO: 3379743 - RNA, 18 nt, Pseudomonas aeruginosa PA01
ccagcguuguccucggcg

SEQ ID NO: 3379744 - RNA, 20 nt, Pseudomonas aeruginosa PA01
ccagcguuguccucggcggc

SEQ ID NO: 3379745 - RNA, 21 nt, Pseudomonas aeruginosa PA01
ccagcguuguccucggcggcu

SEQ ID NO: 3379746 - RNA, 20 nt, Pseudomonas aeruginosa PA01
ccagcguuucgaagccgccg

SEQ ID NO: 3379747 - RNA, 21 nt, Pseudomonas aeruginosa PA01
ccagcguuucgaagccgccgc

SEQ ID NO: 3379748 - RNA, 14 nt, Pseudomonas aeruginosa PA01
ccagcuaccggcag

SEQ ID NO: 3379749 - RNA, 14 nt, Pseudomonas aeruginosa PA01
ccagcucagcucca

SEQ ID NO: 3379750 - RNA, 17 nt, Pseudomonas aeruginosa PA01
ccagcucagcuccaggc

SEQ ID NO: 3379751 - RNA, 18 nt, Pseudomonas aeruginosa PA01
ccagcucagcuccaggcc

SEQ ID NO: 3379752 - RNA, 18 nt, Pseudomonas aeruginosa PA01
ccagcucauggagcaaca

SEQ ID NO: 3379753 - RNA, 23 nt, Pseudomonas aeruginosa PA01
ccagcucauggagcaacagcguc

SEQ ID NO: 3379754 - RNA, 16 nt, Pseudomonas aeruginosa PA01
ccagcuccaccaggcc

SEQ ID NO: 3379755 - RNA, 17 nt, Pseudomonas aeruginosa PA01
ccagcuccaccaggcca

SEQ ID NO: 3379756 - RNA, 13 nt, Pseudomonas aeruginosa PA01
ccagcuccagcac

SEQ ID NO: 3379757 - RNA, 21 nt, Pseudomonas aeruginosa PA01
ccagcuccagcaccggcggcg

SEQ ID NO: 3379758 - RNA, 17 nt, Pseudomonas aeruginosa PA01
ccagcuccccgucccuc

SEQ ID NO: 3379759 - RNA, 14 nt, Pseudomonas aeruginosa PA01
ccagcuccgccuga

SEQ ID NO: 3379760 - RNA, 21 nt, Pseudomonas aeruginosa PA01
ccagcuccgucuguucggcca

SEQ ID NO: 3379761 - RNA, 22 nt, Pseudomonas aeruginosa PA01
ccagcuccgucuguucggccag

SEQ ID NO: 3379762 - RNA, 14 nt, Pseudomonas aeruginosa PA01
ccagcuccuccagc

SEQ ID NO: 3379763 - RNA, 14 nt, Pseudomonas aeruginosa PA01
ccagcucgaacagc

SEQ ID NO: 3379764 - RNA, 18 nt, Pseudomonas aeruginosa PA01
ccagcucgaagccgccgu

SEQ ID NO: 3379765 - RNA, 20 nt, Pseudomonas aeruginosa PA01
ccagcucgacccgcccgccg

SEQ ID NO: 3379766 - RNA, 16 nt, Pseudomonas aeruginosa PA01
ccagcucgaccuugcc

SEQ ID NO: 3379767 - RNA, 12 nt, Pseudomonas aeruginosa PA01
ccagcucgcccg

SEQ ID NO: 3379768 - RNA, 13 nt, Pseudomonas aeruginosa PA01
ccagcucgcccgc

SEQ ID NO: 3379769 - RNA, 14 nt, Pseudomonas aeruginosa PA01
ccagcucgcccgcc

SEQ ID NO: 3379770 - RNA, 17 nt, Pseudomonas aeruginosa PA01
ccagcucgcccgccucg

SEQ ID NO: 3379771 - RNA, 12 nt, Pseudomonas aeruginosa PA01
ccagcucgccga

SEQ ID NO: 3379772 - RNA, 13 nt, Pseudomonas aeruginosa PA01
ccagcucgccgaa

SEQ ID NO: 3379773 - RNA, 22 nt, Pseudomonas aeruginosa PA01
ccaggaucgccuccaccagcgc

SEQ ID NO: 3379774 - RNA, 17 nt, Pseudomonas aeruginosa PA01
ccaggaucggcauggcc

SEQ ID NO: 3379775 - RNA, 17 nt, Pseudomonas aeruginosa PA01
ccaggaucgucggcccg

SEQ ID NO: 3379776 - RNA, 17 nt, Pseudomonas aeruginosa PA01
ccaggaugcaaccgccc

SEQ ID NO: 3379777 - RNA, 19 nt, Pseudomonas aeruginosa PA01
ccaggaugcaaccgcccug

SEQ ID NO: 3379778 - RNA, 20 nt, Pseudomonas aeruginosa PA01
ccaggaugcaaccgcccugg

SEQ ID NO: 3379779 - RNA, 21 nt, Pseudomonas aeruginosa PA01
ccaggaugcccugcucuucca

SEQ ID NO: 3379780 - RNA, 22 nt, Pseudomonas aeruginosa PA01
ccaggaugcccugcucuuccag

SEQ ID NO: 3379781 - RNA, 23 nt, Pseudomonas aeruginosa PA01
ccaggaugcccugcucuuccagc

SEQ ID NO: 3379782 - RNA, 18 nt, Pseudomonas aeruginosa PA01
ccaggaugcgguugccgg

SEQ ID NO: 3379783 - RNA, 17 nt, Pseudomonas aeruginosa PA01
ccaggauguucgccgag

SEQ ID NO: 3379784 - RNA, 20 nt, Pseudomonas aeruginosa PA01
ccaggauuucuccugcgguc

SEQ ID NO: 3379785 - RNA, 21 nt, Pseudomonas aeruginosa PA01
ccaggcaagcgcaugaggcug

SEQ ID NO: 3379786 - RNA, 19 nt, Pseudomonas aeruginosa PA01
ccaggcaauggccggcggg

SEQ ID NO: 3379787 - RNA, 16 nt, Pseudomonas aeruginosa PA01
ccaggcaccguaggcc

SEQ ID NO: 3379788 - RNA, 20 nt, Pseudomonas aeruginosa PA01
ccaggcaccguaggccaggc

SEQ ID NO: 3379789 - RNA, 22 nt, Pseudomonas aeruginosa PA01
ccaggcaccguaggccaggcag

SEQ ID NO: 3379790 - RNA, 22 nt, Pseudomonas aeruginosa PA01
ccaggcacgaauuuccuggcgc

SEQ ID NO: 3379791 - RNA, 23 nt, Pseudomonas aeruginosa PA01
ccaggcacggcuucagcgccagg

SEQ ID NO: 3379792 - RNA, 18 nt, Pseudomonas aeruginosa PA01
ccaggcagaccagcgcaa

SEQ ID NO: 3379793 - RNA, 15 nt, Pseudomonas aeruginosa PA01
ccaggcagaccaggc

SEQ ID NO: 3379794 - RNA, 16 nt, Pseudomonas aeruginosa PA01
ccaggcagaccaggcc

SEQ ID NO: 3379795 - RNA, 18 nt, Pseudomonas aeruginosa PA01
ccaggcagaucgcgccga

SEQ ID NO: 3379796 - RNA, 23 nt, Pseudomonas aeruginosa PA01
ccaggcagaucgcgccgagcugg

SEQ ID NO: 3379797 - RNA, 13 nt, Pseudomonas aeruginosa PA01
ccaggcagcagag

SEQ ID NO: 3379798 - RNA, 19 nt, Pseudomonas aeruginosa PA01
ccaggcagcagagcgccac

SEQ ID NO: 3379799 - RNA, 12 nt, Pseudomonas aeruginosa PA01
ccaggcaggccg

SEQ ID NO: 3379800 - RNA, 16 nt, Pseudomonas aeruginosa PA01
ccaggcagucguaggu

SEQ ID NO: 3379801 - RNA, 12 nt, Pseudomonas aeruginosa PA01
ccaggcauccag

SEQ ID NO: 3379802 - RNA, 15 nt, Pseudomonas aeruginosa PA01
ccaggcauccagcac

SEQ ID NO: 3379803 - RNA, 23 nt, Pseudomonas aeruginosa PA01
ccaggcauuccuccagggucgcc

SEQ ID NO: 3379804 - RNA, 18 nt, Pseudomonas aeruginosa PA01
ccaggccaaccaccccga

SEQ ID NO: 3379805 - RNA, 15 nt, Pseudomonas aeruginosa PA01
ccaggccacgcccau

SEQ ID NO: 3379806 - RNA, 15 nt, Pseudomonas aeruginosa PA01
ccaggccagcgggcu

SEQ ID NO: 3379807 - RNA, 13 nt, Pseudomonas aeruginosa PA01
ccaggccaggcug

SEQ ID NO: 3379808 - RNA, 16 nt, Pseudomonas aeruginosa PA01
ccaggccaggcugcgc

SEQ ID NO: 3379809 - RNA, 17 nt, Pseudomonas aeruginosa PA01
ccaggccaggcugcgcu

SEQ ID NO: 3379810 - RNA, 16 nt, Pseudomonas aeruginosa PA01
ccaggccauagcgcgc

SEQ ID NO: 3379811 - RNA, 18 nt, Pseudomonas aeruginosa PA01
ccaggccauagcgcgccg

SEQ ID NO: 3379812 - RNA, 19 nt, Pseudomonas aeruginosa PA01
ccaggccauagcgcgccgg

SEQ ID NO: 3379813 - RNA, 16 nt, Pseudomonas aeruginosa PA01
ccaggccaucgaaauc

SEQ ID NO: 3379814 - RNA, 18 nt, Pseudomonas aeruginosa PA01
ccaggccauugaaggccg

SEQ ID NO: 3379815 - RNA, 15 nt, Pseudomonas aeruginosa PA01
ccaggcccacgccca

SEQ ID NO: 3379816 - RNA, 15 nt, Pseudomonas aeruginosa PA01
ccaggcccagcgcgg

SEQ ID NO: 3379817 - RNA, 16 nt, Pseudomonas aeruginosa PA01
ccaggcccagcgcggc

SEQ ID NO: 3379818 - RNA, 15 nt, Pseudomonas aeruginosa PA01
ccaggccccaggccg

SEQ ID NO: 3379819 - RNA, 18 nt, Pseudomonas aeruginosa PA01
ccaggccccaggccgccg

SEQ ID NO: 3379820 - RNA, 12 nt, Pseudomonas aeruginosa PA01
ccaggcccgccg

SEQ ID NO: 3379821 - RNA, 17 nt, Pseudomonas aeruginosa PA01
ccaggcccgccggucaa

SEQ ID NO: 3379822 - RNA, 14 nt, Pseudomonas aeruginosa PA01
ccaggcccggcgcu

SEQ ID NO: 3379823 - RNA, 16 nt, Pseudomonas aeruginosa PA01
ccaggcccggcgcugc

SEQ ID NO: 3379824 - RNA, 17 nt, Pseudomonas aeruginosa PA01
ccaggcccggcgcugcu

SEQ ID NO: 3379825 - RNA, 22 nt, Pseudomonas aeruginosa PA01
ccaggcccucagcggcggugcg

SEQ ID NO: 3379826 - RNA, 14 nt, Pseudomonas aeruginosa PA01
ccaggcccucggcg

SEQ ID NO: 3379827 - RNA, 15 nt, Pseudomonas aeruginosa PA01
ccaggcccucggcga

SEQ ID NO: 3379828 - RNA, 23 nt, Pseudomonas aeruginosa PA01
ccaggcccugcuccuccaggcuc

SEQ ID NO: 3379829 - RNA, 17 nt, Pseudomonas aeruginosa PA01
ccaggcccugggcggcg

SEQ ID NO: 3379830 - RNA, 17 nt, Pseudomonas aeruginosa PA01
ccaggcccuuggucagg

SEQ ID NO: 3379831 - RNA, 17 nt, Pseudomonas aeruginosa PA01
ccaggccgaagccgccg

SEQ ID NO: 3379832 - RNA, 16 nt, Pseudomonas aeruginosa PA01
ccaggccgaaggccug

SEQ ID NO: 3379833 - RNA, 14 nt, Pseudomonas aeruginosa PA01
ccaggccgacagcg

SEQ ID NO: 3379834 - RNA, 17 nt, Pseudomonas aeruginosa PA01
ccaggccgacagcggcu

SEQ ID NO: 3379835 - RNA, 23 nt, Pseudomonas aeruginosa PA01
ccaggccgacagcggcuggcgcu

SEQ ID NO: 3379836 - RNA, 21 nt, Pseudomonas aeruginosa PA01
ccaggccgagcaauccggcgc

SEQ ID NO: 3379837 - RNA, 18 nt, Pseudomonas aeruginosa PA01
ccaggccgagcaggaaga

SEQ ID NO: 3379838 - RNA, 22 nt, Pseudomonas aeruginosa PA01
ccaggccgagcaggaagaagcc

SEQ ID NO: 3379839 - RNA, 16 nt, Pseudomonas aeruginosa PA01
ccaggccgagcgccag

SEQ ID NO: 3379840 - RNA, 14 nt, Pseudomonas aeruginosa PA01
ccaggccgagcgcg

SEQ ID NO: 3379841 - RNA, 15 nt, Pseudomonas aeruginosa PA01
ccaggccgagcgcgc

SEQ ID NO: 3379842 - RNA, 18 nt, Pseudomonas aeruginosa PA01
ccaggccgagcgcgccgc

SEQ ID NO: 3379843 - RNA, 22 nt, Pseudomonas aeruginosa PA01
ccaggccgagcgugcgcaugcc

SEQ ID NO: 3379844 - RNA, 15 nt, Pseudomonas aeruginosa PA01
ccaggccgaucgccu

SEQ ID NO: 3379845 - RNA, 16 nt, Pseudomonas aeruginosa PA01
ccaggccgaucgccuc

SEQ ID NO: 3379846 - RNA, 21 nt, Pseudomonas aeruginosa PA01
ccaggccgaugaacgccgcga

SEQ ID NO: 3379847 - RNA, 22 nt, Pseudomonas aeruginosa PA01
ccaggccgauguucaggccgga

SEQ ID NO: 3379848 - RNA, 12 nt, Pseudomonas aeruginosa PA01
ccaggccgcaag

SEQ ID NO: 3379849 - RNA, 16 nt, Pseudomonas aeruginosa PA01
ccaggccgcaagcggu

SEQ ID NO: 3379850 - RNA, 20 nt, Pseudomonas aeruginosa PA01
ccaggccgccaugcucggcc

SEQ ID NO: 3379851 - RNA, 13 nt, Pseudomonas aeruginosa PA01
ccaggccgcccag

SEQ ID NO: 3379852 - RNA, 14 nt, Pseudomonas aeruginosa PA01
ccaggccgccgaag

SEQ ID NO: 3379853 - RNA, 14 nt, Pseudomonas aeruginosa PA01
ccaggccgccgauc

SEQ ID NO: 3379854 - RNA, 21 nt, Pseudomonas aeruginosa PA01
ccaggccgccgauccaggaac

SEQ ID NO: 3379855 - RNA, 12 nt, Pseudomonas aeruginosa PA01
ccaggccgccgg

SEQ ID NO: 3379856 - RNA, 13 nt, Pseudomonas aeruginosa PA01
ccaggccgccggc

SEQ ID NO: 3379857 - RNA, 14 nt, Pseudomonas aeruginosa PA01
ccaggccgccggcg

SEQ ID NO: 3379858 - RNA, 15 nt, Pseudomonas aeruginosa PA01
ccaggccgccggcga

SEQ ID NO: 3379859 - RNA, 18 nt, Pseudomonas aeruginosa PA01
ccaggccgccggcgaccg

SEQ ID NO: 3379860 - RNA, 12 nt, Pseudomonas aeruginosa PA01
ccaggccgcgca

SEQ ID NO: 3379861 - RNA, 14 nt, Pseudomonas aeruginosa PA01
ccaggccgcgcagu

SEQ ID NO: 3379862 - RNA, 15 nt, Pseudomonas aeruginosa PA01
ccaggccgcgcaguc

SEQ ID NO: 3379863 - RNA, 20 nt, Pseudomonas aeruginosa PA01
ccaggccgcgcagucccgcg

SEQ ID NO: 3379864 - RNA, 14 nt, Pseudomonas aeruginosa PA01
ccaggccgcugccg

SEQ ID NO: 3379865 - RNA, 15 nt, Pseudomonas aeruginosa PA01
ccaggccgcugccgc

SEQ ID NO: 3379866 - RNA, 17 nt, Pseudomonas aeruginosa PA01
ccaggccgcugccgccg

SEQ ID NO: 3379867 - RNA, 22 nt, Pseudomonas aeruginosa PA01
ccaggccgcuggcggcgacgaa

SEQ ID NO: 3379868 - RNA, 19 nt, Pseudomonas aeruginosa PA01
ccaggccgcuuuccacccg

SEQ ID NO: 3379869 - RNA, 20 nt, Pseudomonas aeruginosa PA01
ccaggccgcuuuccacccga

SEQ ID NO: 3379870 - RNA, 15 nt, Pseudomonas aeruginosa PA01
ccaggccggagccgc

SEQ ID NO: 3379871 - RNA, 17 nt, Pseudomonas aeruginosa PA01
ccaggccggagccgcgu

SEQ ID NO: 3379872 - RNA, 12 nt, Pseudomonas aeruginosa PA01
ccaggccggcgc

SEQ ID NO: 3379873 - RNA, 13 nt, Pseudomonas aeruginosa PA01
ccaggccggcgca

SEQ ID NO: 3379874 - RNA, 16 nt, Pseudomonas aeruginosa PA01
ccaggccggcgcaucg

SEQ ID NO: 3379875 - RNA, 13 nt, Pseudomonas aeruginosa PA01
ccaggccggcggc

SEQ ID NO: 3379876 - RNA, 20 nt, Pseudomonas aeruginosa PA01
ccaggcgucgcaccugggac

SEQ ID NO: 3379877 - RNA, 13 nt, Pseudomonas aeruginosa PA01
ccaggcgucgccg

SEQ ID NO: 3379878 - RNA, 16 nt, Pseudomonas aeruginosa PA01
ccaggcgucgcgccag

SEQ ID NO: 3379879 - RNA, 17 nt, Pseudomonas aeruginosa PA01
ccaggcgucgcgccagc

SEQ ID NO: 3379880 - RNA, 18 nt, Pseudomonas aeruginosa PA01
ccaggcgucgcgccagca

SEQ ID NO: 3379881 - RNA, 19 nt, Pseudomonas aeruginosa PA01
ccaggcgucgcgccagcac

SEQ ID NO: 3379882 - RNA, 21 nt, Pseudomonas aeruginosa PA01
ccaggcgucgcgccagcaccg

SEQ ID NO: 3379883 - RNA, 22 nt, Pseudomonas aeruginosa PA01
ccaggcgucgcgccagcaccgu

SEQ ID NO: 3379884 - RNA, 15 nt, Pseudomonas aeruginosa PA01
ccaggcgucggcgcc

SEQ ID NO: 3379885 - RNA, 11 nt, Pseudomonas aeruginosa PA01
ccaggcgucgu

SEQ ID NO: 3379886 - RNA, 13 nt, Pseudomonas aeruginosa PA01
ccaggcgugccug

SEQ ID NO: 3379887 - RNA, 15 nt, Pseudomonas aeruginosa PA01
ccaggcgugcugcac

SEQ ID NO: 3379888 - RNA, 18 nt, Pseudomonas aeruginosa PA01
ccaggcguggggcgaaua

SEQ ID NO: 3379889 - RNA, 17 nt, Pseudomonas aeruginosa PA01
ccaggcguuccaccagg

SEQ ID NO: 3379890 - RNA, 23 nt, Pseudomonas aeruginosa PA01
ccaggcguuccagcucggcgagg

SEQ ID NO: 3379891 - RNA, 13 nt, Pseudomonas aeruginosa PA01
ccaggcucaccuc

SEQ ID NO: 3379892 - RNA, 15 nt, Pseudomonas aeruginosa PA01
ccaggcucaccucga

SEQ ID NO: 3379893 - RNA, 16 nt, Pseudomonas aeruginosa PA01
ccaggcucaccucgaa

SEQ ID NO: 3379894 - RNA, 16 nt, Pseudomonas aeruginosa PA01
ccaggcucagcucucc

SEQ ID NO: 3379895 - RNA, 13 nt, Pseudomonas aeruginosa PA01
ccaggcucgcccc

SEQ ID NO: 3379896 - RNA, 22 nt, Pseudomonas aeruginosa PA01
ccaggcucgccccggcggcgau

SEQ ID NO: 3379897 - RNA, 15 nt, Pseudomonas aeruginosa PA01
ccaggcucgccgcca

SEQ ID NO: 3379898 - RNA, 16 nt, Pseudomonas aeruginosa PA01
ccaggcucgccgccag

SEQ ID NO: 3379899 - RNA, 14 nt, Pseudomonas aeruginosa PA01
ccaggcucgcgaug

SEQ ID NO: 3379900 - RNA, 20 nt, Pseudomonas aeruginosa PA01
ccaggcucgcgaugcugugc

SEQ ID NO: 3379901 - RNA, 21 nt, Pseudomonas aeruginosa PA01
ccaggcucuucuucgaaccgc

SEQ ID NO: 3379902 - RNA, 14 nt, Pseudomonas aeruginosa PA01
ccaggcugacccgg

SEQ ID NO: 3379903 - RNA, 20 nt, Pseudomonas aeruginosa PA01
ccaggcugacccggucgcug

SEQ ID NO: 3379904 - RNA, 14 nt, Pseudomonas aeruginosa PA01
ccaggcugaccgcg

SEQ ID NO: 3379905 - RNA, 15 nt, Pseudomonas aeruginosa PA01
ccaggcugaggucgc

SEQ ID NO: 3379906 - RNA, 19 nt, Pseudomonas aeruginosa PA01
ccaggcugaguucgucgag

SEQ ID NO: 3379907 - RNA, 16 nt, Pseudomonas aeruginosa PA01
ccaggcugaucagccc

SEQ ID NO: 3379908 - RNA, 19 nt, Pseudomonas aeruginosa PA01
ccaggcugaucagcccgcu

SEQ ID NO: 3379909 - RNA, 15 nt, Pseudomonas aeruginosa PA01
ccaggcugccgccgc

SEQ ID NO: 3379910 - RNA, 15 nt, Pseudomonas aeruginosa PA01
ccaggcugccgccgu

SEQ ID NO: 3379911 - RNA, 14 nt, Pseudomonas aeruginosa PA01
ccaggcugccgccu

SEQ ID NO: 3379912 - RNA, 15 nt, Pseudomonas aeruginosa PA01
ccaggcugccggcca

SEQ ID NO: 3379913 - RNA, 18 nt, Pseudomonas aeruginosa PA01
ccaggcugccggccaggu

SEQ ID NO: 3379914 - RNA, 20 nt, Pseudomonas aeruginosa PA01
ccaggcugccggccagguag

SEQ ID NO: 3379915 - RNA, 20 nt, Pseudomonas aeruginosa PA01
ccaggcuggccacgaacagg

SEQ ID NO: 3379916 - RNA, 14 nt, Pseudomonas aeruginosa PA01
ccaggcuggccagu

SEQ ID NO: 3379917 - RNA, 21 nt, Pseudomonas aeruginosa PA01
ccaggcuggccuuggccaugc

SEQ ID NO: 3379918 - RNA, 22 nt, Pseudomonas aeruginosa PA01
ccaggcuggccuuggccaugcc

SEQ ID NO: 3379919 - RNA, 17 nt, Pseudomonas aeruginosa PA01
ccaggcuggcggccagg

SEQ ID NO: 3379920 - RNA, 20 nt, Pseudomonas aeruginosa PA01
ccaggcuggcggccagggca

SEQ ID NO: 3379921 - RNA, 15 nt, Pseudomonas aeruginosa PA01
ccaggcuguagccgg

SEQ ID NO: 3379922 - RNA, 17 nt, Pseudomonas aeruginosa PA01
ccaggcuguagccggcg

SEQ ID NO: 3379923 - RNA, 16 nt, Pseudomonas aeruginosa PA01
ccaggcugucagggcg

SEQ ID NO: 3379924 - RNA, 18 nt, Pseudomonas aeruginosa PA01
ccaggcugucagggcgca

SEQ ID NO: 3379925 - RNA, 23 nt, Pseudomonas aeruginosa PA01
ccaggcuuacccgcgaccacagg

SEQ ID NO: 3379926 - RNA, 15 nt, Pseudomonas aeruginosa PA01
ccaggcuucggcgcg

SEQ ID NO: 3379927 - RNA, 19 nt, Pseudomonas aeruginosa PA01
ccaggcuuuccaccgccag

SEQ ID NO: 3379928 - RNA, 18 nt, Pseudomonas aeruginosa PA01
ccaggcuuuccgccgagc

SEQ ID NO: 3379929 - RNA, 12 nt, Pseudomonas aeruginosa PA01
ccagggaaaagc

SEQ ID NO: 3379930 - RNA, 19 nt, Pseudomonas aeruginosa PA01
ccagggaaaagcccaggug

SEQ ID NO: 3379931 - RNA, 21 nt, Pseudomonas aeruginosa PA01
ccagggaaaagcccagguggc

SEQ ID NO: 3379932 - RNA, 15 nt, Pseudomonas aeruginosa PA01
ccagggaagcgcgcg

SEQ ID NO: 3379933 - RNA, 14 nt, Pseudomonas aeruginosa PA01
ccagggacgcccgg

SEQ ID NO: 3379934 - RNA, 15 nt, Pseudomonas aeruginosa PA01
ccagggacgcccgga

SEQ ID NO: 3379935 - RNA, 13 nt, Pseudomonas aeruginosa PA01
ccagggacgcgcc

SEQ ID NO: 3379936 - RNA, 16 nt, Pseudomonas aeruginosa PA01
ccagggacgcgccggc

SEQ ID NO: 3379937 - RNA, 22 nt, Pseudomonas aeruginosa PA01
ccagggacgcgccggcggauca

SEQ ID NO: 3379938 - RNA, 14 nt, Pseudomonas aeruginosa PA01
ccagggagaacagc

SEQ ID NO: 3379939 - RNA, 15 nt, Pseudomonas aeruginosa PA01
ccagggagaacagca

SEQ ID NO: 3379940 - RNA, 17 nt, Pseudomonas aeruginosa PA01
ccagggagaacagcagg

SEQ ID NO: 3379941 - RNA, 18 nt, Pseudomonas aeruginosa PA01
ccagggagaacagcaggg

SEQ ID NO: 3379942 - RNA, 19 nt, Pseudomonas aeruginosa PA01
ccagggagaacagcagggu

SEQ ID NO: 3379943 - RNA, 23 nt, Pseudomonas aeruginosa PA01
ccagggagaacagcagggucagg

SEQ ID NO: 3379944 - RNA, 20 nt, Pseudomonas aeruginosa PA01
ccagggagcgcucgcgcagc

SEQ ID NO: 3379945 - RNA, 22 nt, Pseudomonas aeruginosa PA01
ccagggagcgcucgcgcagcca

SEQ ID NO: 3379946 - RNA, 18 nt, Pseudomonas aeruginosa PA01
ccagggaggcgcuggcca

SEQ ID NO: 3379947 - RNA, 19 nt, Pseudomonas aeruginosa PA01
ccagggaggcgcuggccag

SEQ ID NO: 3379948 - RNA, 22 nt, Pseudomonas aeruginosa PA01
ccagggaggcgcuggccagcgc

SEQ ID NO: 3379949 - RNA, 23 nt, Pseudomonas aeruginosa PA01
ccagggaggcgcuggccagcgcu

SEQ ID NO: 3379950 - RNA, 15 nt, Pseudomonas aeruginosa PA01
ccagggagucgcugg

SEQ ID NO: 3379951 - RNA, 18 nt, Pseudomonas aeruginosa PA01
ccagggagucgcuggcca

SEQ ID NO: 3379952 - RNA, 15 nt, Pseudomonas aeruginosa PA01
ccagggcaaacagcu

SEQ ID NO: 3379953 - RNA, 15 nt, Pseudomonas aeruginosa PA01
ccagggcaacgccag

SEQ ID NO: 3379954 - RNA, 16 nt, Pseudomonas aeruginosa PA01
ccagggcaacgccagg

SEQ ID NO: 3379955 - RNA, 22 nt, Pseudomonas aeruginosa PA01
ccagggcagggaguccgccagc

SEQ ID NO: 3379956 - RNA, 21 nt, Pseudomonas aeruginosa PA01
ccagggcaugggucagcgcca

SEQ ID NO: 3379957 - RNA, 23 nt, Pseudomonas aeruginosa PA01
ccagggcaugucgaucuucgagu

SEQ ID NO: 3379958 - RNA, 21 nt, Pseudomonas aeruginosa PA01
ccagggcauguuccuccagag

SEQ ID NO: 3379959 - RNA, 13 nt, Pseudomonas aeruginosa PA01
ccagggccagcag

SEQ ID NO: 3379960 - RNA, 14 nt, Pseudomonas aeruginosa PA01
ccagggccagcagc

SEQ ID NO: 3379961 - RNA, 18 nt, Pseudomonas aeruginosa PA01
ccagggccagcagcggcg

SEQ ID NO: 3379962 - RNA, 22 nt, Pseudomonas aeruginosa PA01
ccagggccagcagcggcggcgc

SEQ ID NO: 3379963 - RNA, 15 nt, Pseudomonas aeruginosa PA01
ccagggccaggagca

SEQ ID NO: 3379964 - RNA, 18 nt, Pseudomonas aeruginosa PA01
ccagggccaggagcaucg

SEQ ID NO: 3379965 - RNA, 12 nt, Pseudomonas aeruginosa PA01
ccagggccaggg

SEQ ID NO: 3379966 - RNA, 14 nt, Pseudomonas aeruginosa PA01
ccagggccagggcg

SEQ ID NO: 3379967 - RNA, 21 nt, Pseudomonas aeruginosa PA01
ccagggcccacagugccaggc

SEQ ID NO: 3379968 - RNA, 22 nt, Pseudomonas aeruginosa PA01
ccagggcccacagugccaggcu

SEQ ID NO: 3379969 - RNA, 12 nt, Pseudomonas aeruginosa PA01
ccagggccgagc

SEQ ID NO: 3379970 - RNA, 20 nt, Pseudomonas aeruginosa PA01
ccagggccgagcacagggug

SEQ ID NO: 3379971 - RNA, 19 nt, Pseudomonas aeruginosa PA01
ccagggccgcgagagguuc

SEQ ID NO: 3379972 - RNA, 12 nt, Pseudomonas aeruginosa PA01
ccagggccggcg

SEQ ID NO: 3379973 - RNA, 13 nt, Pseudomonas aeruginosa PA01
ccagggccucggg

SEQ ID NO: 3379974 - RNA, 16 nt, Pseudomonas aeruginosa PA01
ccagggccucggggcc

SEQ ID NO: 3379975 - RNA, 20 nt, Pseudomonas aeruginosa PA01
ccagggccucggggccgucc

SEQ ID NO: 3379976 - RNA, 21 nt, Pseudomonas aeruginosa PA01
ccagggccucggggccguccg

SEQ ID NO: 3379977 - RNA, 19 nt, Pseudomonas aeruginosa PA01
ccagggccugcuccagcgg

SEQ ID NO: 3379978 - RNA, 21 nt, Pseudomonas aeruginosa PA01
ccagggccugcuccagcggag

SEQ ID NO: 3379979 - RNA, 18 nt, Pseudomonas aeruginosa PA01
ccagguaggcgacgaagc

SEQ ID NO: 3379980 - RNA, 15 nt, Pseudomonas aeruginosa PA01
ccagguaggcgaugc

SEQ ID NO: 3379981 - RNA, 15 nt, Pseudomonas aeruginosa PA01
ccagguaggcgcccu

SEQ ID NO: 3379982 - RNA, 18 nt, Pseudomonas aeruginosa PA01
ccagguaguccagcuccu

SEQ ID NO: 3379983 - RNA, 19 nt, Pseudomonas aeruginosa PA01
ccagguagucgcccagcgc

SEQ ID NO: 3379984 - RNA, 16 nt, Pseudomonas aeruginosa PA01
ccagguagugccgccc

SEQ ID NO: 3379985 - RNA, 16 nt, Pseudomonas aeruginosa PA01
ccagguauucgcgcuc

SEQ ID NO: 3379986 - RNA, 15 nt, Pseudomonas aeruginosa PA01
ccagguccaggcuca

SEQ ID NO: 3379987 - RNA, 14 nt, Pseudomonas aeruginosa PA01
ccagguccgcaccg

SEQ ID NO: 3379988 - RNA, 23 nt, Pseudomonas aeruginosa PA01
ccagguccgccacuucaagcugg

SEQ ID NO: 3379989 - RNA, 16 nt, Pseudomonas aeruginosa PA01
ccaggucgagggcaug

SEQ ID NO: 3379990 - RNA, 18 nt, Pseudomonas aeruginosa PA01
ccaggucgaucagcagca

SEQ ID NO: 3379991 - RNA, 21 nt, Pseudomonas aeruginosa PA01
ccaggucgaucagcagcagcg

SEQ ID NO: 3379992 - RNA, 13 nt, Pseudomonas aeruginosa PA01
ccaggucgauccc

SEQ ID NO: 3379993 - RNA, 20 nt, Pseudomonas aeruginosa PA01
ccaggucgauccugaccccg

SEQ ID NO: 3379994 - RNA, 22 nt, Pseudomonas aeruginosa PA01
ccaggucgauccugaccccggc

SEQ ID NO: 3379995 - RNA, 23 nt, Pseudomonas aeruginosa PA01
ccaggucgauccugaccccggcc

SEQ ID NO: 3379996 - RNA, 17 nt, Pseudomonas aeruginosa PA01
ccaggucgccaugcccg

SEQ ID NO: 3379997 - RNA, 16 nt, Pseudomonas aeruginosa PA01
ccaggucgcccaccuu

SEQ ID NO: 3379998 - RNA, 18 nt, Pseudomonas aeruginosa PA01
ccaggucgcccaccuugc

SEQ ID NO: 3379999 - RNA, 18 nt, Pseudomonas aeruginosa PA01
ccaggucgcccugcagcg

SEQ ID NO: 3380000 - RNA, 20 nt, Pseudomonas aeruginosa PA01
ccaggucgcccugcagcgcg

SEQ ID NO: 3380001 - RNA, 24 nt, Pseudomonas aeruginosa PA01
ccaggucgcccugcagcgcgcgcu

SEQ ID NO: 3380002 - RNA, 18 nt, Pseudomonas aeruginosa PA01
ccaggucgccgcacaccg

SEQ ID NO: 3380003 - RNA, 22 nt, Pseudomonas aeruginosa PA01
ccaggucgcgcagggccagggc

SEQ ID NO: 3380004 - RNA, 17 nt, Pseudomonas aeruginosa PA01
ccaggucgcggagccaa

SEQ ID NO: 3380005 - RNA, 15 nt, Pseudomonas aeruginosa PA01
ccaggucgcugcuga

SEQ ID NO: 3380006 - RNA, 14 nt, Pseudomonas aeruginosa PA01
ccaggucgcuggca

SEQ ID NO: 3380007 - RNA, 23 nt, Pseudomonas aeruginosa PA01
ccaggucgcuggcaccggccagg

SEQ ID NO: 3380008 - RNA, 12 nt, Pseudomonas aeruginosa PA01
ccaggucgcugu

SEQ ID NO: 3380009 - RNA, 19 nt, Pseudomonas aeruginosa PA01
ccaggucgcuguccuccag

SEQ ID NO: 3380010 - RNA, 20 nt, Pseudomonas aeruginosa PA01
ccaggucgcuguccuccagc

SEQ ID NO: 3380011 - RNA, 22 nt, Pseudomonas aeruginosa PA01
ccaggucgcuguccuccagcgg

SEQ ID NO: 3380012 - RNA, 14 nt, Pseudomonas aeruginosa PA01
ccaggucggcgcgc

SEQ ID NO: 3380013 - RNA, 12 nt, Pseudomonas aeruginosa PA01
ccaggucggcgg

SEQ ID NO: 3380014 - RNA, 17 nt, Pseudomonas aeruginosa PA01
ccaggucgguccgccga

SEQ ID NO: 3380015 - RNA, 16 nt, Pseudomonas aeruginosa PA01
ccaggucggucggcgg

SEQ ID NO: 3380016 - RNA, 20 nt, Pseudomonas aeruginosa PA01
ccaggucggucggcggcggu

SEQ ID NO: 3380017 - RNA, 21 nt, Pseudomonas aeruginosa PA01
ccaggucguugcgccggccca

SEQ ID NO: 3380018 - RNA, 19 nt, Pseudomonas aeruginosa PA01
ccaggucuguggaggcgca

SEQ ID NO: 3380019 - RNA, 17 nt, Pseudomonas aeruginosa PA01
ccaggucuucuggaaau

SEQ ID NO: 3380020 - RNA, 14 nt, Pseudomonas aeruginosa PA01
ccaggugauccaug

SEQ ID NO: 3380021 - RNA, 13 nt, Pseudomonas aeruginosa PA01
ccaggugcacggc

SEQ ID NO: 3380022 - RNA, 14 nt, Pseudomonas aeruginosa PA01
ccaggugcacggcc

SEQ ID NO: 3380023 - RNA, 15 nt, Pseudomonas aeruginosa PA01
ccaggugcacggcca

SEQ ID NO: 3380024 - RNA, 17 nt, Pseudomonas aeruginosa PA01
ccaggugcacggccagg

SEQ ID NO: 3380025 - RNA, 13 nt, Pseudomonas aeruginosa PA01
ccaggugcagcga

SEQ ID NO: 3380026 - RNA, 15 nt, Pseudomonas aeruginosa PA01
ccaggugcagcgagg

SEQ ID NO: 3380027 - RNA, 22 nt, Pseudomonas aeruginosa PA01
ccaggugcaggaagcgccgggc

SEQ ID NO: 3380028 - RNA, 24 nt, Pseudomonas aeruginosa PA01
ccaggugcaggaagcgccgggccg

SEQ ID NO: 3380029 - RNA, 19 nt, Pseudomonas aeruginosa PA01
ccaggugccaauccgggcg

SEQ ID NO: 3380030 - RNA, 20 nt, Pseudomonas aeruginosa PA01
ccaggugccaauccgggcgu

SEQ ID NO: 3380031 - RNA, 15 nt, Pseudomonas aeruginosa PA01
ccaggugcgcaggcg

SEQ ID NO: 3380032 - RNA, 18 nt, Pseudomonas aeruginosa PA01
ccaggugcgcaggcgcuc

SEQ ID NO: 3380033 - RNA, 17 nt, Pseudomonas aeruginosa PA01
ccaggugcgccgagcgc

SEQ ID NO: 3380034 - RNA, 14 nt, Pseudomonas aeruginosa PA01
ccaggugcggcugg

SEQ ID NO: 3380035 - RNA, 21 nt, Pseudomonas aeruginosa PA01
ccaggugcggcugggugucga

SEQ ID NO: 3380036 - RNA, 17 nt, Pseudomonas aeruginosa PA01
ccagguggaagcgcgcg

SEQ ID NO: 3380037 - RNA, 14 nt, Pseudomonas aeruginosa PA01
ccagguggcaggcc

SEQ ID NO: 3380038 - RNA, 15 nt, Pseudomonas aeruginosa PA01
ccagguggcaggccu

SEQ ID NO: 3380039 - RNA, 17 nt, Pseudomonas aeruginosa PA01
ccagguggcaggccugg

SEQ ID NO: 3380040 - RNA, 18 nt, Pseudomonas aeruginosa PA01
ccagguggucguagcagg

SEQ ID NO: 3380041 - RNA, 22 nt, Pseudomonas aeruginosa PA01
ccagguggucguagcagguccg

SEQ ID NO: 3380042 - RNA, 17 nt, Pseudomonas aeruginosa PA01
ccagguguucggccccg

SEQ ID NO: 3380043 - RNA, 19 nt, Pseudomonas aeruginosa PA01
ccagguguucggccccggc

SEQ ID NO: 3380044 - RNA, 20 nt, Pseudomonas aeruginosa PA01
ccagguguucggccccggcc

SEQ ID NO: 3380045 - RNA, 21 nt, Pseudomonas aeruginosa PA01
ccagguguucggccccggcca

SEQ ID NO: 3380046 - RNA, 22 nt, Pseudomonas aeruginosa PA01
ccagguguucggccccggccag

SEQ ID NO: 3380047 - RNA, 20 nt, Pseudomonas aeruginosa PA01
ccagguucgcguggcccggc

SEQ ID NO: 3380048 - RNA, 16 nt, Pseudomonas aeruginosa PA01
ccagguugaagaacgg

SEQ ID NO: 3380049 - RNA, 17 nt, Pseudomonas aeruginosa PA01
ccagguugaagaacggc

SEQ ID NO: 3380050 - RNA, 22 nt, Pseudomonas aeruginosa PA01
ccagguugaagaacggcccgcu

SEQ ID NO: 3380051 - RNA, 13 nt, Pseudomonas aeruginosa PA01
ccagguugaccag

SEQ ID NO: 3380052 - RNA, 15 nt, Pseudomonas aeruginosa PA01
ccagguugaccaguu

SEQ ID NO: 3380053 - RNA, 14 nt, Pseudomonas aeruginosa PA01
ccagguugcccggc

SEQ ID NO: 3380054 - RNA, 16 nt, Pseudomonas aeruginosa PA01
ccagguugcccggcuu

SEQ ID NO: 3380055 - RNA, 21 nt, Pseudomonas aeruginosa PA01
ccagguugcgcaaccagcgcu

SEQ ID NO: 3380056 - RNA, 13 nt, Pseudomonas aeruginosa PA01
ccagguuggccag

SEQ ID NO: 3380057 - RNA, 14 nt, Pseudomonas aeruginosa PA01
ccagguuggccagu

SEQ ID NO: 3380058 - RNA, 15 nt, Pseudomonas aeruginosa PA01
ccagguuggccaguu

SEQ ID NO: 3380059 - RNA, 13 nt, Pseudomonas aeruginosa PA01
ccagguuggccug

SEQ ID NO: 3380060 - RNA, 17 nt, Pseudomonas aeruginosa PA01
ccagguuggccuggccc

SEQ ID NO: 3380061 - RNA, 19 nt, Pseudomonas aeruginosa PA01
ccagguuggccuggcccgg

SEQ ID NO: 3380062 - RNA, 21 nt, Pseudomonas aeruginosa PA01
ccagguuggccuggcccggcg

SEQ ID NO: 3380063 - RNA, 19 nt, Pseudomonas aeruginosa PA01
ccagguuggcgaacaggca

SEQ ID NO: 3380064 - RNA, 22 nt, Pseudomonas aeruginosa PA01
ccagguuggcgaacaggcagcg

SEQ ID NO: 3380065 - RNA, 17 nt, Pseudomonas aeruginosa PA01
ccagguugugaucgacc

SEQ ID NO: 3380066 - RNA, 23 nt, Pseudomonas aeruginosa PA01
ccagguugugaucgaccucgcgg

SEQ ID NO: 3380067 - RNA, 20 nt, Pseudomonas aeruginosa PA01
ccagguugugcucgaucacc

SEQ ID NO: 3380068 - RNA, 19 nt, Pseudomonas aeruginosa PA01
ccagguuuccggcagcacg

SEQ ID NO: 3380069 - RNA, 13 nt, Pseudomonas aeruginosa PA01
ccaguacacccag

SEQ ID NO: 3380070 - RNA, 14 nt, Pseudomonas aeruginosa PA01
ccaguacacccagg

SEQ ID NO: 3380071 - RNA, 15 nt, Pseudomonas aeruginosa PA01
ccaguacacccaggg

SEQ ID NO: 3380072 - RNA, 17 nt, Pseudomonas aeruginosa PA01
ccaguacacccagggca

SEQ ID NO: 3380073 - RNA, 23 nt, Pseudomonas aeruginosa PA01
ccaguaccacgcagccacccgcg

SEQ ID NO: 3380074 - RNA, 24 nt, Pseudomonas aeruginosa PA01
ccaguaccagcaaugcccagcgca

SEQ ID NO: 3380075 - RNA, 14 nt, Pseudomonas aeruginosa PA01
ccaguaccgccacg

SEQ ID NO: 3380076 - RNA, 19 nt, Pseudomonas aeruginosa PA01
ccaguacgucacgaacggc

SEQ ID NO: 3380077 - RNA, 13 nt, Pseudomonas aeruginosa PA01
ccaguacgucgag

SEQ ID NO: 3380078 - RNA, 21 nt, Pseudomonas aeruginosa PA01
ccaguacuccgagggccgcgc

SEQ ID NO: 3380079 - RNA, 13 nt, Pseudomonas aeruginosa PA01
ccaguagcauccc

SEQ ID NO: 3380080 - RNA, 13 nt, Pseudomonas aeruginosa PA01
ccaguagcgccug

SEQ ID NO: 3380081 - RNA, 17 nt, Pseudomonas aeruginosa PA01
ccaucagcgccgccucg

SEQ ID NO: 3380082 - RNA, 19 nt, Pseudomonas aeruginosa PA01
ccaucagcgccgccucgcu

SEQ ID NO: 3380083 - RNA, 20 nt, Pseudomonas aeruginosa PA01
ccaucagcuccacgucggcc

SEQ ID NO: 3380084 - RNA, 19 nt, Pseudomonas aeruginosa PA01
ccaucagcuggaucuggug

SEQ ID NO: 3380085 - RNA, 11 nt, Pseudomonas aeruginosa PA01
ccaucaggccc

SEQ ID NO: 3380086 - RNA, 23 nt, Pseudomonas aeruginosa PA01
ccaucaggccgcggcccugcgcc

SEQ ID NO: 3380087 - RNA, 15 nt, Pseudomonas aeruginosa PA01
ccaucaggcucaggc

SEQ ID NO: 3380088 - RNA, 22 nt, Pseudomonas aeruginosa PA01
ccaucagggcgaaagccuucau

SEQ ID NO: 3380089 - RNA, 15 nt, Pseudomonas aeruginosa PA01
ccaucagggucggcc

SEQ ID NO: 3380090 - RNA, 16 nt, Pseudomonas aeruginosa PA01
ccaucagggucggccc

SEQ ID NO: 3380091 - RNA, 18 nt, Pseudomonas aeruginosa PA01
ccaucagugacauccucc

SEQ ID NO: 3380092 - RNA, 14 nt, Pseudomonas aeruginosa PA01
ccaucaguugcgcg

SEQ ID NO: 3380093 - RNA, 15 nt, Pseudomonas aeruginosa PA01
ccaucaguugcgcgc

SEQ ID NO: 3380094 - RNA, 15 nt, Pseudomonas aeruginosa PA01
ccauccagccaggcg

SEQ ID NO: 3380095 - RNA, 12 nt, Pseudomonas aeruginosa PA01
ccauccagcgcc

SEQ ID NO: 3380096 - RNA, 23 nt, Pseudomonas aeruginosa PA01
ccauccaggcuuuccaccgccag

SEQ ID NO: 3380097 - RNA, 19 nt, Pseudomonas aeruginosa PA01
ccauccagucuucgccggc

SEQ ID NO: 3380098 - RNA, 21 nt, Pseudomonas aeruginosa PA01
ccauccagucuucgccggccu

SEQ ID NO: 3380099 - RNA, 23 nt, Pseudomonas aeruginosa PA01
ccauccagucuucgccggccugc

SEQ ID NO: 3380100 - RNA, 14 nt, Pseudomonas aeruginosa PA01
ccauccccgccucg

SEQ ID NO: 3380101 - RNA, 18 nt, Pseudomonas aeruginosa PA01
ccaucccugcuucgacca

SEQ ID NO: 3380102 - RNA, 19 nt, Pseudomonas aeruginosa PA01
ccaucccuucgugcuggcg

SEQ ID NO: 3380103 - RNA, 13 nt, Pseudomonas aeruginosa PA01
ccauccgcgccga

SEQ ID NO: 3380104 - RNA, 17 nt, Pseudomonas aeruginosa PA01
ccauccgcgccgaccag

SEQ ID NO: 3380105 - RNA, 19 nt, Pseudomonas aeruginosa PA01
ccauccgcgccgaccagcc

SEQ ID NO: 3380106 - RNA, 22 nt, Pseudomonas aeruginosa PA01
ccauccgcgccgaccagccgca

SEQ ID NO: 3380107 - RNA, 18 nt, Pseudomonas aeruginosa PA01
ccauccggaguucgcccg

SEQ ID NO: 3380108 - RNA, 19 nt, Pseudomonas aeruginosa PA01
ccauccggggugggcauag

SEQ ID NO: 3380109 - RNA, 14 nt, Pseudomonas aeruginosa PA01
ccauccuccagcac

SEQ ID NO: 3380110 - RNA, 21 nt, Pseudomonas aeruginosa PA01
ccauccuccgaggccaccacu

SEQ ID NO: 3380111 - RNA, 17 nt, Pseudomonas aeruginosa PA01
ccauccuggcgaucagg

SEQ ID NO: 3380112 - RNA, 21 nt, Pseudomonas aeruginosa PA01
ccaucgacucggugcguagcg

SEQ ID NO: 3380113 - RNA, 16 nt, Pseudomonas aeruginosa PA01
ccaucgacugcaacag

SEQ ID NO: 3380114 - RNA, 19 nt, Pseudomonas aeruginosa PA01
ccaucgaggccaggccgag

SEQ ID NO: 3380115 - RNA, 19 nt, Pseudomonas aeruginosa PA01
ccaucgaucagcagcgcca

SEQ ID NO: 3380116 - RNA, 15 nt, Pseudomonas aeruginosa PA01
ccaucgaugcucauc

SEQ ID NO: 3380117 - RNA, 16 nt, Pseudomonas aeruginosa PA01
ccaucgauggucacug

SEQ ID NO: 3380118 - RNA, 23 nt, Pseudomonas aeruginosa PA01
ccaucgauggucacuggcgaggc

SEQ ID NO: 3380119 - RNA, 18 nt, Pseudomonas aeruginosa PA01
ccaucgcauagccggcgc

SEQ ID NO: 3380120 - RNA, 15 nt, Pseudomonas aeruginosa PA01
ccaucgccaccagca

SEQ ID NO: 3380121 - RNA, 13 nt, Pseudomonas aeruginosa PA01
ccaucgccaggcc

SEQ ID NO: 3380122 - RNA, 14 nt, Pseudomonas aeruginosa PA01
ccaucgccaggguc

SEQ ID NO: 3380123 - RNA, 21 nt, Pseudomonas aeruginosa PA01
ccaucgccagggucuugccga

SEQ ID NO: 3380124 - RNA, 15 nt, Pseudomonas aeruginosa PA01
ccaucgcccgcagcc

SEQ ID NO: 3380125 - RNA, 16 nt, Pseudomonas aeruginosa PA01
ccaucgcccgcagcca

SEQ ID NO: 3380126 - RNA, 13 nt, Pseudomonas aeruginosa PA01
ccaucgcccugca

SEQ ID NO: 3380127 - RNA, 12 nt, Pseudomonas aeruginosa PA01
ccaucgccgcgg

SEQ ID NO: 3380128 - RNA, 14 nt, Pseudomonas aeruginosa PA01
ccaucgccgcggaa

SEQ ID NO: 3380129 - RNA, 18 nt, Pseudomonas aeruginosa PA01
ccaucgccggcccgcgcg

SEQ ID NO: 3380130 - RNA, 22 nt, Pseudomonas aeruginosa PA01
ccaucgccggcccgcgcggcaa

SEQ ID NO: 3380131 - RNA, 19 nt, Pseudomonas aeruginosa PA01
ccaucgccucgccggccag

SEQ ID NO: 3380132 - RNA, 15 nt, Pseudomonas aeruginosa PA01
ccaucgccucgcgga

SEQ ID NO: 3380133 - RNA, 22 nt, Pseudomonas aeruginosa PA01
ccaucgccucgcggaccucggg

SEQ ID NO: 3380134 - RNA, 20 nt, Pseudomonas aeruginosa PA01
ccaucgcggcgauggccgcc

SEQ ID NO: 3380135 - RNA, 21 nt, Pseudomonas aeruginosa PA01
ccaucgcggcgauggccgcca

SEQ ID NO: 3380136 - RNA, 22 nt, Pseudomonas aeruginosa PA01
ccaucgcggcgauggccgccag

SEQ ID NO: 3380137 - RNA, 14 nt, Pseudomonas aeruginosa PA01
ccaucgcucaccgg

SEQ ID NO: 3380138 - RNA, 14 nt, Pseudomonas aeruginosa PA01
ccaucgcuccagcg

SEQ ID NO: 3380139 - RNA, 17 nt, Pseudomonas aeruginosa PA01
ccaucgcuuucaggcgc

SEQ ID NO: 3380140 - RNA, 21 nt, Pseudomonas aeruginosa PA01
ccaucgcuuuccuggccgacc

SEQ ID NO: 3380141 - RNA, 12 nt, Pseudomonas aeruginosa PA01
ccaucggcccca

SEQ ID NO: 3380142 - RNA, 16 nt, Pseudomonas aeruginosa PA01
ccaucggccccaccgc

SEQ ID NO: 3380143 - RNA, 14 nt, Pseudomonas aeruginosa PA01
ccaucggcggcggc

SEQ ID NO: 3380144 - RNA, 17 nt, Pseudomonas aeruginosa PA01
ccaucggcgucggcugg

SEQ ID NO: 3380145 - RNA, 17 nt, Pseudomonas aeruginosa PA01
ccaucggguugaucgac

SEQ ID NO: 3380146 - RNA, 18 nt, Pseudomonas aeruginosa PA01
ccaucggguugaucgacg

SEQ ID NO: 3380147 - RNA, 22 nt, Pseudomonas aeruginosa PA01
ccaucggguugaucgacgccag

SEQ ID NO: 3380148 - RNA, 14 nt, Pseudomonas aeruginosa PA01
ccaucggucgcgcc

SEQ ID NO: 3380149 - RNA, 15 nt, Pseudomonas aeruginosa PA01
ccaucggucgcgccc

SEQ ID NO: 3380150 - RNA, 19 nt, Pseudomonas aeruginosa PA01
ccaucgucgcuuccggcgc

SEQ ID NO: 3380151 - RNA, 17 nt, Pseudomonas aeruginosa PA01
ccaucguucaguugccu

SEQ ID NO: 3380152 - RNA, 20 nt, Pseudomonas aeruginosa PA01
ccaucguucaguugccucug

SEQ ID NO: 3380153 - RNA, 17 nt, Pseudomonas aeruginosa PA01
ccaucugcaacgcggcg

SEQ ID NO: 3380154 - RNA, 18 nt, Pseudomonas aeruginosa PA01
ccaucugcacgucguagc

SEQ ID NO: 3380155 - RNA, 13 nt, Pseudomonas aeruginosa PA01
ccaucugccggcc

SEQ ID NO: 3380156 - RNA, 14 nt, Pseudomonas aeruginosa PA01
ccaucugccggcca

SEQ ID NO: 3380157 - RNA, 22 nt, Pseudomonas aeruginosa PA01
ccaucugccggccaccaucacg

SEQ ID NO: 3380158 - RNA, 15 nt, Pseudomonas aeruginosa PA01
ccaucuggaucagga

SEQ ID NO: 3380159 - RNA, 15 nt, Pseudomonas aeruginosa PA01
ccaucuucaggccgu

SEQ ID NO: 3380160 - RNA, 19 nt, Pseudomonas aeruginosa PA01
ccaucuucucgaagcgcgc

SEQ ID NO: 3380161 - RNA, 14 nt, Pseudomonas aeruginosa PA01
ccaucuuuuccugc

SEQ ID NO: 3380162 - RNA, 15 nt, Pseudomonas aeruginosa PA01
ccaucuuuuccugcu

SEQ ID NO: 3380163 - RNA, 20 nt, Pseudomonas aeruginosa PA01
ccaucuuuuccugcuggcga

SEQ ID NO: 3380164 - RNA, 20 nt, Pseudomonas aeruginosa PA01
ccaugaaaaagccccgccga

SEQ ID NO: 3380165 - RNA, 21 nt, Pseudomonas aeruginosa PA01
ccaugaaaaagcccggccugg

SEQ ID NO: 3380166 - RNA, 17 nt, Pseudomonas aeruginosa PA01
ccaugaaaaaggcgccc

SEQ ID NO: 3380167 - RNA, 20 nt, Pseudomonas aeruginosa PA01
ccaugaaaaauggccgcuuc

SEQ ID NO: 3380168 - RNA, 15 nt, Pseudomonas aeruginosa PA01
ccaugacacaccacg

SEQ ID NO: 3380169 - RNA, 20 nt, Pseudomonas aeruginosa PA01
ccaugaccgucagccaggcu

SEQ ID NO: 3380170 - RNA, 20 nt, Pseudomonas aeruginosa PA01
ccaugaucaucggcuggccg

SEQ ID NO: 3380171 - RNA, 12 nt, Pseudomonas aeruginosa PA01
ccaugauccggu

SEQ ID NO: 3380172 - RNA, 21 nt, Pseudomonas aeruginosa PA01
ccaugcaagaacgccgacccu

SEQ ID NO: 3380173 - RNA, 13 nt, Pseudomonas aeruginosa PA01
ccaugcagcggca

SEQ ID NO: 3380174 - RNA, 15 nt, Pseudomonas aeruginosa PA01
ccaugcaggccaggg

SEQ ID NO: 3380175 - RNA, 18 nt, Pseudomonas aeruginosa PA01
ccaugcaggccagggcgg

SEQ ID NO: 3380176 - RNA, 19 nt, Pseudomonas aeruginosa PA01
ccaugcaggcugccggacg

SEQ ID NO: 3380177 - RNA, 20 nt, Pseudomonas aeruginosa PA01
ccaugcaggcugccggacgc

SEQ ID NO: 3380178 - RNA, 21 nt, Pseudomonas aeruginosa PA01
ccaugcaugauuucguuggcc

SEQ ID NO: 3380179 - RNA, 13 nt, Pseudomonas aeruginosa PA01
ccaugcccagacg

SEQ ID NO: 3380180 - RNA, 17 nt, Pseudomonas aeruginosa PA01
ccaugcccagacgccgc

SEQ ID NO: 3380181 - RNA, 15 nt, Pseudomonas aeruginosa PA01
ccaugcccgccccgc

SEQ ID NO: 3380182 - RNA, 24 nt, Pseudomonas aeruginosa PA01
ccaugcccgccccgcaccagccag

SEQ ID NO: 3380183 - RNA, 15 nt, Pseudomonas aeruginosa PA01
cccaaggcacgcccc

SEQ ID NO: 3380184 - RNA, 23 nt, Pseudomonas aeruginosa PA01
cccaaggccaggcgauacgcggc

SEQ ID NO: 3380185 - RNA, 13 nt, Pseudomonas aeruginosa PA01
cccaaggccaggu

SEQ ID NO: 3380186 - RNA, 22 nt, Pseudomonas aeruginosa PA01
cccaagggccugggcgccgcca

SEQ ID NO: 3380187 - RNA, 16 nt, Pseudomonas aeruginosa PA01
cccaauccgcgccggu

SEQ ID NO: 3380188 - RNA, 18 nt, Pseudomonas aeruginosa PA01
cccaauugcccguagggc

SEQ ID NO: 3380189 - RNA, 14 nt, Pseudomonas aeruginosa PA01
cccacaaagucacu

SEQ ID NO: 3380190 - RNA, 13 nt, Pseudomonas aeruginosa PA01
cccacaggccggc

SEQ ID NO: 3380191 - RNA, 19 nt, Pseudomonas aeruginosa PA01
cccacauggcgguccaggu

SEQ ID NO: 3380192 - RNA, 13 nt, Pseudomonas aeruginosa PA01
cccaccaccaccg

SEQ ID NO: 3380193 - RNA, 13 nt, Pseudomonas aeruginosa PA01
cccaccaccagga

SEQ ID NO: 3380194 - RNA, 14 nt, Pseudomonas aeruginosa PA01
cccaccaccaggac

SEQ ID NO: 3380195 - RNA, 13 nt, Pseudomonas aeruginosa PA01
cccaccaccaucg

SEQ ID NO: 3380196 - RNA, 15 nt, Pseudomonas aeruginosa PA01
cccaccaccaucgcc

SEQ ID NO: 3380197 - RNA, 18 nt, Pseudomonas aeruginosa PA01
cccaccaccaucgccgcg

SEQ ID NO: 3380198 - RNA, 22 nt, Pseudomonas aeruginosa PA01
cccaccaccaucgccgcggaaa

SEQ ID NO: 3380199 - RNA, 13 nt, Pseudomonas aeruginosa PA01
cccaccagcgucg

SEQ ID NO: 3380200 - RNA, 18 nt, Pseudomonas aeruginosa PA01
cccaccagcgucgccagg

SEQ ID NO: 3380201 - RNA, 14 nt, Pseudomonas aeruginosa PA01
cccacccccagccc

SEQ ID NO: 3380202 - RNA, 14 nt, Pseudomonas aeruginosa PA01
cccacccccggccc

SEQ ID NO: 3380203 - RNA, 17 nt, Pseudomonas aeruginosa PA01
cccacccccggcccggc

SEQ ID NO: 3380204 - RNA, 14 nt, Pseudomonas aeruginosa PA01
cccacccgucccgc

SEQ ID NO: 3380205 - RNA, 18 nt, Pseudomonas aeruginosa PA01
cccacccgucccgcgcgc

SEQ ID NO: 3380206 - RNA, 15 nt, Pseudomonas aeruginosa PA01
cccacccugcgcgag

SEQ ID NO: 3380207 - RNA, 22 nt, Pseudomonas aeruginosa PA01
cccacccugcgcgaggagccgu
